United States Patent
Wen et al.

(10) Patent No.: US 11,578,365 B2
(45) Date of Patent: Feb. 14, 2023

(54) CHICKEN WHOLE-GENOME SNP CHIP AND USE THEREOF

(71) Applicant: INSTITUTE OF ANIMAL SCIENCE, CHINESE ACADEMY OF AGRICULTURAL SCIENCES, Beijing (CN)

(72) Inventors: Jie Wen, Beijing (CN); Ranran Liu, Beijing (CN); Guiping Zhao, Beijing (CN); Maiqing Zheng, Beijing (CN); Qinghe Li, Beijing (CN); Huanxian Cui, Beijing (CN); Siyuan Xing, Beijing (CN)

(73) Assignee: INST. OF ANIMAL SCI., CHINESE ACAD. OF AG. SCIENCE, Beijing (CN)

( * ) Notice: Subject to any disclaimer, the term of this patent is extended or adjusted under 35 U.S.C. 154(b) by 0 days.

(21) Appl. No.: 16/309,763

(22) PCT Filed: Oct. 10, 2017

(86) PCT No.: PCT/CN2017/105438
§ 371 (c)(1),
(2) Date: Dec. 13, 2018

(87) PCT Pub. No.: WO2019/071407
PCT Pub. Date: Apr. 18, 2019

(65) Prior Publication Data
US 2021/0139962 A1    May 13, 2021

(51) Int. Cl.
*C12Q 1/6876* (2018.01)
*A01K 67/00* (2006.01)
*A01K 67/027* (2006.01)

(52) U.S. Cl.
CPC ............ *C12Q 1/6876* (2013.01); *A01K 67/00* (2013.01); *A01K 67/0275* (2013.01); *C12Q 2600/124* (2013.01); *C12Q 2600/156* (2013.01)

(58) Field of Classification Search
None
See application file for complete search history.

(56) References Cited

FOREIGN PATENT DOCUMENTS

| | | |
|---|---|---|
| CN | 1438325 A | 8/2003 |
| CN | 102747138 A | 10/2012 |
| CN | 105238859 A | 1/2016 |
| CN | 111225986 B | 2/2021 |

OTHER PUBLICATIONS

Kranis et al; BMC Genomics; 14:59, pp. 1-13, 2013.*
Granted Claims for Chinese Application No. 201780023241.X.
Notification of the First Office Action for Chinese Application No. 201780023241.X dated Oct. 30, 2020.
Notification to Grant Patent Right for Invention for Chinese Application No. 201780023241.X dated Jan. 12, 2021.
Search Report for Chinese Application No. 201780023241.X dated Oct. 23, 2020.
Ailuan, et al., "Status and Prospect of Whole-genome Association Analysis of Chicken Important Traits", Chinese Poultry, vol. 39, Issue 18, 2017, pp. 1-6.

* cited by examiner

*Primary Examiner* — Jehanne S Sitton
(74) *Attorney, Agent, or Firm* — Dorsey & Whitney LLP

(57) ABSTRACT

Provided in the present invention is a chicken whole-genome SNP chip and application thereof. There are a total of 50,000 SNP loci on the chip: including 19,600 SNP loci for white-feather broilers, yellow-feather and partridge chickens having a MAF value greater than 0.05 and uniformly distributed across the genome which were derived from the data of the whole-genome resequencing of main indigenous chicken breeds in China and introduced chicken breeds; 14,000 SNP loci associated with economic traits, and 16,400 SNP loci for making up for the genomic regions that are not covered by the first two types of probes. The 50,000 SNP loci on the chicken whole-genome SNP chip of the present invention have DNA sequences represented by SEQ ID NOs. 1 to 50,000. The SNP loci on the chip are uniformly distributed across the whole genome, and associated with traits such as feed efficiency, meat production rate, lipid metabolism, meat quality, general resistance to diseases, reproduction and the like, and the chip has moderate through-put and low cost, and could be used universally for chicken breeds at indigenous and abroad.

1 Claim, 2 Drawing Sheets

Specification includes a Sequence Listing.

CHICKEN WHOLE-GENOME SNP CHIP AND USE THEREOF

SEQUENCE LISTING

A sequence listing submitted in computer readable format is hereby incorporated by reference. The computer readable file, created 25 Mar. 2022 is named KHP183110201_7_the_amended_Sequence_Listing.txt and is 13,778,625 bytes in size.

CROSS-REFERENCE TO RELATED APPLICATIONS

The present application is the U.S. National Phase filing under 35 U.S.C. § 371 of International Application No. PCT/CN2017/105438, filed Oct. 10, 2017, the content of which is herein incorporated by reference in its entirety.

TECHNICAL FIELD

The present invention relates to the fields of molecular biology, functional genomics, bioinformatics and genome breeding, and more particularly relates to a chicken whole-genome SNP chip and application thereof.

BACKGROUND ART

Single nucleotide polymorphism (SNP) refers to the variation of a single nucleotide in a genome, which is a form of variation formed by substitution, transversion, insertion or deletion of a single nucleotide pair. As a third-generation genetic marker, the single nucleotide polymorphisms are numerous, densely distributed, and easy to detect, and are relatively ideal genotyping targets.

A whole-genome SNP chip is a SNP microarray, also known as SNP array, with millions of DNA marker sequences aligned and immobilized to form an array of SNP probes on a slide or a special silicon wafer. It works by means of base-pairing reaction of the DNA marker sequences immobilized on the chip with the target genome so as to accurately identify the genetic information. The gene chip uses advanced microbiochemical reaction technology, micro-labeling technology, micro-scale scanning resolution imaging technology and biological information computer processing technology to accurately identify specific mRNA or DNA sequences in biological subjects. Currently, there are two US biotech companies, ThermoFisher and Illumina, each having a commercial genome SNP chip manufacturing technical platform. ThermoFisher (formerly Affymetrix) uses the Axiom platform technology to manufacture a SNP chip (www.thermofisher.com), i.e., in-situ photolithographic technology is used to in-situ synthesize gene probe sequences on a substrate by photolithography. The chip has been widely used in the study of animal and plant genome variations.

The livestock and poultry whole-genome SNP chip can be applied to the fields of molecular genetic research and molecule-assisted breeding and the like because of its advantages, such as high marker density, uniform coverage of the whole genome, high measurement accuracy, easy realization of standardization and automated detection, etc. It can provide support for upstream and downstream processes of breeding, including genetic diversity analysis of genetic resources, genetic relationship analysis, genome-wide association analysis (GWAS), QTL (quantitative trait locus) mapping analysis, selective evolution studies and the like, wherein a very important use is the use in genomic selection breeding. Genomic selection is currently the main breeding technique in livestock and poultry breeding, using whole-genome markers to estimate all possible genetic effects, and interpret all genetic variations, so as to predict Genomic Estimated Breeding Values (GEBVs) through statistically labeled genetic effects. Genomic selection has the advantages of high accuracy of estimated breeding values and rapid genetic progress. It has been applied to the breeding practice of commercialized lines of dairy cows, pigs, abroad high-yielding layers and fast growing white-feather broilers.

However, the loci information of the current chicken 600K commercial SNP chip (Axiom® Whole-genome Chicken Genotyping Array) mostly derived from abroad commercial layers and broilers, lacking the genome variation information of Chinese indigenous chicken breeds (meat-type breeds or high-quality layer chicken breeds), and there are great limitations in the application in Chinese indigenous chicken breeding and related basic scientific research. Moreover, compared with other animals, chickens have the characteristics of numerous breeds and large population, but low individual price and the like, therefore, a relatively low-cost whole-genome SNP chip is needed for large population sample testing. Thus, broiler and laying hen breeding industry and scientific research fields urgently need to develop a whole-genome SNP chip with moderate flux, including specific information on the genetic variation of Chinese indigenous chicken breeds, and taking into account the genomic information of chicken breeds introduced from abroad.

SUMMARY OF THE INVENTION

One purpose of the present invention is to provide a chicken whole-genome SNP chip and application thereof.

The present invention first provides a combination of chicken whole-genome SNP molecular markers consisting of 50,000 SNP/INDEL molecular markers, the nucleotide sequences of which are represented by SEQ ID NOs. 1 to 50,000, respectively.

The present invention provides a chicken whole-genome breeding chip comprising 50,000 SNP/INDEL molecular markers having the nucleotide sequences represented by SEQ ID NOs. 1 to 50,000.

In the above combination of chicken whole-genome SNP molecular markers and the above chicken whole-genome breeding chip of the present invention, the SNP/INDEL loci of the molecular marker is located at the $36^{th}$ position of the nucleotide sequences represented by SEQ ID NOs. 1 to 50,000.

The molecular markers are associated with chicken functional traits, The traits are as follows: growth traits including feed efficiency and body weight of different day-ages; carcass traits including breast muscle weight percentage (BMP), leg muscle weight percentage (LMP), total weight percentage after slaughtering (TWP), and abdominal fat percentage (AbFP); immune traits including IgY levels in serum, IgY levels in response to sheep red blood cell (SRBC), the heterophil and lymphocyte ratio (H/L), and the average red blood cell backlog (ABRBC); meat quality traits including the ultimate pH, breast muscle intramuscular fat ratio (IMFbr), meat lightness, yellow value and red value; and reproductive traits.

The present invention provides the above chicken whole-genome breeding chip which is suitable for chicken breeds at indigenous and abroad, named as IASCHICK chicken SNP chip, and has stronger correlation with economic traits and moderate through-put. The SNP loci on this chip include three types: the first type is derived from the information of the whole-genome resequencing of five indigenous breeds and three introduced chicken breeds, which are frequently used in domestic meat-type chicken breeding. The indigenous breeds resequenced include yellow-feather broilers and partridge chickens and the like. After filtering, there are 19,600 SNPs (referred to as the first type of probes in the present chip) having a minor allele frequency (MAF) value greater than 0.05 and uniformly distributed across the genome were screened out from white-feather broilers, yellow-feather chickens and partridge chickens. The second type of SNPs includes 14,000 SNPs (referred to as the second type of probes in the present chip) associated with economic traits, which were screened out by a variety of correlation analysis such as genome-wide association analysis. The third type includes 16,400 probes (referred to as the third type of probes in the present chip) from SNPs of existing databases used to make up for the genomic regions that cannot be covered by the above two types of probes.

Specifically, the first type of probes includes 12,600 white-feather chicken SNPs, 4,000 yellow-feather broiler SNPs, and 3,000 partridge broiler SNPs. The second type of probes includes 6,000 significant loci obtained from genome-wide association analysis of total 15 traits (including growth, meat quality, disease resistance and reproduction) by using F2 hybrid populations of indigenous breeds and introduced breeds and the like as materials and using illumina 60K SNP Bead Chip. By comparison among multiple control lines, 3,000 SNPs in the corresponding regions of 100 candidate genes (related to traits such as fat deposition and the like) were obtained. A total of 5,000 SNPs of economic trait-related genes were obtained by searching previous research results.

Among the 50,000 loci in the entire chip, 17,000 are newly discovered by resequencing of multiple breeds, and are SNPs not listed in the Ensembl chicken variation database. The IASCHICK chip was fabricated by designing probes for the total 50,000 loci and performing in-situ photolithography synthesis process with ThermoFisher's Axiom platform technology. Each chip can be used to simultaneously detect 96 or 384 samples.

The 50,000 SNPs obtained by the present invention have the DNA sequences and characteristics represented by SEQ ID No. 1 to SEQ ID No. 50,000. The IASCHICK chicken whole-genome SNP chip according to the present invention refers to a chip fabricated by in-situ photolithography synthesis process based on the 50,000 sequences using ThermoFisher's Axiom platform technology. The SNP/INDEL loci on the IASCHICK chicken whole-genome SNP chip of the present invention refers to the nucleotide at the $36^{th}$ position in the sequence represented by SEQ ID No. 1 to SEQ ID No. 50,000.

The present invention also provides the use of the above chicken whole-genome SNP chip—IASCHICK chicken SNP chip in detecting chicken DNA samples. The chip can be used in applications such as evaluation of germplasm resources for indigenous and abroad chicken breed resources, whole-genome selection breeding of indigenous broilers and layers, identification of QTLs, association loci and candidate genes for target trait, genetic relationship analysis and the like.

Specifically, the present invention provides the use of the above combination of chicken whole-genome SNP molecular markers and/or the above chicken whole-genome breeding chip in improving chicken germplasm resources.

The present invention provides the use of the above combination of chicken whole-genome SNP molecular markers and/or the above chicken whole-genome breeding chip in identifying chicken breeds.

The present invention provides the use of the above combination of chicken whole-genome SNP molecular markers and/or the above chicken whole-genome breeding chip in chicken breeding.

The present invention provides the use of the above combination of chicken whole-genome SNP molecular markers and/or the above chicken whole-genome breeding chip in identifying chicken genetic relationships.

The present invention provides the use of the above combination of chicken whole-genome SNP molecular markers and/or the above chicken whole-genome breeding chip in analyzing chicken genetic diversity.

The present invention provides the use of the above combination of chicken whole-genome SNP molecular markers and/or the above chicken whole-genome breeding chip in chicken genome-wide association analysis.

The present invention has the following advantages: (1) the present invention has three characteristics: first, it may be used universally for indigenous and abroad chicken breeds: the characteristic loci of the representative Chinese indigenous chicken breeds and highly-selected commercial chicken breeds at indigenous and abroad were comparatively screened to ensure the universality and effectiveness of the loci information. Second, it has functional correlation with economic traits. The loci having significant genetic association with traits such as feed efficiency, meat production rate, lipid metabolism, meat quality, general disease resistance, and reproduction were screened out, so as to increase the accuracy of the basic researches performed using the chip. Third, the loci are uniformly distributed and the throughput is moderate. The 50,000 loci are uniformly distributed across the whole genome (except that the density on chromosome 16 is relatively high), with an average interval of 24 kb (kilobase), thereby ensuring the accuracy of the breeding value estimation and related researches. Compared with the existing 600K commercial chip, the throughput is moderate, the price is greatly reduced, and the cost performance is high. (2) Compared with the genotyping system based on the second-generation resequencing, the data analysis is simple and it is easy to implement standardized and automatic detection and analysis, and it is relatively easy to achieve comparability among different batches and different laboratory data, since the variant loci to be detected are fixed.

SPECIFIC MODES FOR CARRYING OUT THE EMBODIMENTS

Figure 1:
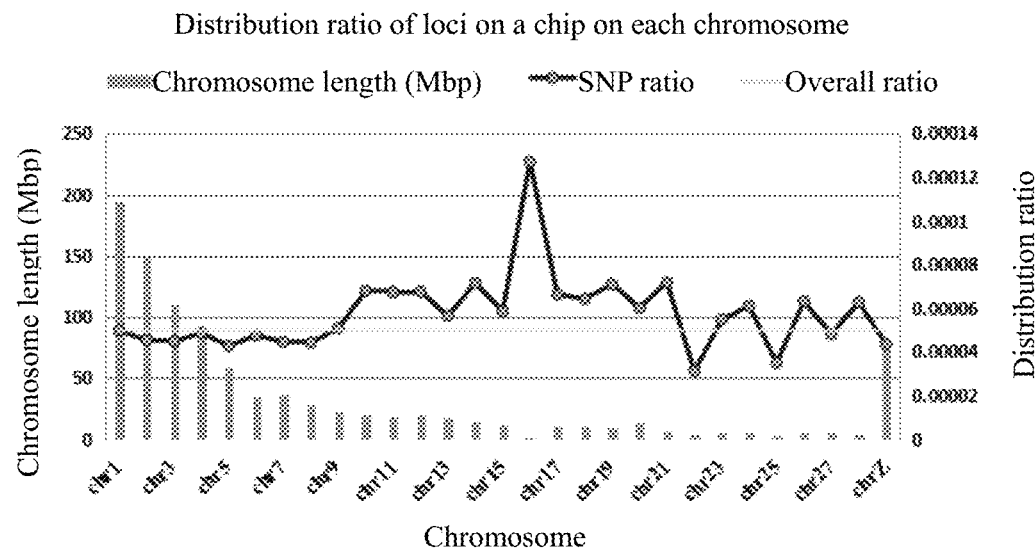
FIG. 1 shows that the 50K loci are uniformly distributed across the whole chromosome (except for chromosome 16) and have similar LD levels.

The following Examples are intended to further illustrate the present invention, but are not intended to limit the scope of the present invention. Modifications or substitutions of the methods, steps or conditions of the present invention made without deviating from the spirit and substance of the present invention fall within the scope of the invention.

The technical means used in the Examples are conventional means well known to a person skilled in the art unless otherwise specified.

Example 1: Method for Preparing an IASCHICK Chicken Whole-Genome SNP Chip

1. Acquisition of the first type of probes: The first type of probes was mainly characterized by obtaining 50,000 specific SNP loci for Chinese indigenous chicken breeds for breeding purpose and abroad fast-growing white-feather broilers.

First, eight indigenous and abroad chicken breeds (see Table 1) were subjected to whole-genome resequencing using the Hiseq 2500 platform (Illumina Inc.) sequencing technology and a 20-fold genomic coverage was obtained for each sample. The specific procedure comprised constructing a sequencing library for each breed, and the specific construction method comprised setting up three mixing pools for each breed, and constructing a DNA library using the standard procedure for Nextera DNA library preparation kit (Illumina Inc., San Diego, Calif., USA). All DNA libraries were sequenced on the Hiseq 2500 platform. Low-quality (fragment length <10) reads and adapter-polluted reads were eliminated so as to obtain clean data. All clean data were mapped to GalGAL 4.0 (Li and Durbin, 2010) by BWA tools software, and PCR duplication was removed using the rmdup parameter in SAM tools (Li et al., 2009). SNP mutation typing was performed using the mpileup function of SAM Tools software (Koboldt et al., 2009). A total of 15,312,402 high-quality mutation loci were obtained (see Table 1). The loci with a minor allele frequency value greater than 0.05 were used as data sources for the first type of probes. In addition, the procedure further comprised target region sequence capture and resequencing of chromosomes 11, 16 and 19 of high and low IgY group samples of Leghorns and Beijing-You chicken, and as a result, 1,700 related high-quality mutation loci were obtained.

TABLE 1

Indigenous and abroad chicken breeds for resequencing and the number of identified SNPs

| Breeds | | SNP/Ten thousand |
|---|---|---|
| Yellow feather | Beijing-You chicken | 850.5214 |
| | Yellow dwarf chicken | 834.9627 |
| | Sanhuang chicken | 940.5319 |

TABLE 1-continued

Indigenous and abroad chicken breeds for resequencing and the number of identified SNPs

| Breeds | | SNP/Ten thousand |
|---|---|---|
| Cyan-shank partridge | Cyan-shank partridge chicken (fast-growing) | 895.4795 |
| | Cyan-shank partridge chicken (medium-growing) | 888.4232 |
| Introduced white feather | Cobb maternal line | 709.3225 |
| | Cobb paternal line | 837.2769 |
| | Recessive white chicken | 755.6464 |
| | Total | 15312402 |

2. Acquisition of the second type of probes: SNP loci associated with 15 target traits were obtained based on genome-wide association analysis (GWAS) and screening methods for SNPs in related candidate genes.

First, the F2 chicken resource population (the Chinese Academy of Agricultural Sciences) produced by the hybridization between Beijing-You chicken and Cobb chickens were used. A total of 400 chickens including F0-F2 generations were used. Phenotypic assays were well known methods, including (1) breast muscle weight percentage, leg muscle weight percentage, total weight percentage after slaughtering and abdominal fat percentage, body weight at the age of 28 days, body weight at the age of 42 days; (2) IgY levels in response to sheep red blood cell (SRBC), IgY levels in serum, H/L value, and the average red blood cell backlog (ABRBC); and (3) the ultimate pH, breast muscle intramuscular fat ratio (IMFbr), meat lightness, yellow value and red value. Venous blood samples were collected from wings of test chickens for genomic DNA extraction. The Illumina chicken 60K whole-genome SNP chip was used for assay, and after quality control, there were 42,585 remaining SNP loci. The GLM model in the plink software was used for genome-wide association analysis, and after the p-value was corrected by the Bonferroni method, 6,147 loci with the top one percent significance for the 15 main traits such as body weight at the age of 42 days, IMFbr and IgY levels in serum and the like were obtained and used as candidate loci.

Screening method for candidate genes: economic trait-related candidate genes were obtained based on the applicant's previous research and PUBMED database on the NCBI website (see Table 2), and in combination with the resequencing results in Example 1, the SNP loci located within the target gene and downstream and upstream of the target gene were obtained. Each gene has more than 100 SNPs as candidate. 15,173 candidate SNP loci were obtained by removing the repeated loci and screening based on the locus's minor allele frequency (MAF<0.05) and the annotation on the location of the loci in the gene structure (preferentially intragenic and regulatory regions).

TABLE 2

Data Sources for the second type of probes

| Traits | Gene number | SNP | SNP/Per gene | References |
|---|---|---|---|---|
| Various economic traits | 48 | 7,224 | 151 | Obtained by searching in PUBMED with chicken and gene and/or polymorphism as keywords |
| Genes in QTL regions of various economic traits | 880 | 94,000 | 106 | Obtained by searching in PUBMED with chicken and QTL as keywords |
| Muscle development | 310 | 42,470 | 137 | Cui et al., BMC Genomics. 2012, 13: 213; Wang Hongyang. "Proteomics study of muscle development and intramuscular fat deposition in chickens from embryonic period to early growth period" |

TABLE 2-continued

Data Sources for the second type of probes

| Traits | Gene number | SNP | SNP/Per gene | References |
|---|---|---|---|---|
| Lipid Metabolism | 333 | 51,282 | 154 | Huang et al., Scientific Reports. 2015, 5: 16132 Sun et al., BMC Genomics, 2013. 14: 458. etc. |
| Salmonella, influenza resistance, and resistance to general disease | 297 | 33,876 | 111 | Peng Li, et al., Veterinary Microbiology 2010, 143: 346-351; Qinghe Li, et al., Journal of Proteomics, 2016, 148: 20-25 |
| Total | 1868 | 228,852 | >100 | |

The final procedures for determining loci for the chip were as follows:

(1) After the first and second types of probes were sent to the Thermo company for scoring, the loci for which probes are not recommended to design were removed;

(2) Chromosomes were divided with a window/interval of 24 kb, the SNP in the second type of probes was preferentially selected for each interval and in case of lacking the second type of probes, the SNP in the first type of probes was selected. The probes for regions that were still not covered after the first and second types of probes were selected were obtained from the SNPdb database on the NCBI website (www.ncbi.nlm.nih.gov/projects/SNP/index.html).

Finally, 50,000 SNPs with uniform distribution across the whole genome (except that the density on chromosome 16 was relatively high, as shown in FIG. 1, Table 3) was achieved. The chip had (1) versatility: the characteristic SNPs of indigenous chicken breeds and commercially introduced breeds were contained; (2) effectiveness: the MAF of 20K loci in 8 indigenous and abroad chicken breeds (such as white-feather, yellow-feather, partridge chicken, etc.) was all higher than 0.05; (3) functional correlation: 14K loci were identified by GWAS and other studies as being associated with economic traits, such as growth, carcass composition, meat quality, general immunity, reproduction, appearance, etc.; and (5) moderate throughput: 50,000 SNP loci were uniformly distributed across the whole genome at an average interval of 24 kb, and the application performance/price ratio is high in the practice of whole-genome selection breeding.

TABLE 3

The number of loci on the chip distributed in each chromosome

| Chromosome | SNP number |
|---|---|
| chr1 | 9,752 |
| chr2 | 6,752 |
| chr3 | 4,961 |
| chr4 | 4,392 |
| chr5 | 2,552 |
| chr6 | 1,664 |
| chr7 | 1,618 |
| chr8 | 1,275 |
| chr9 | 1,194 |
| chr10 | 1,354 |
| chr11 | 1,307 |
| chr12 | 1,344 |
| chr13 | 1,005 |
| chr14 | 1,085 |
| chr15 | 743 |
| chr16 | 68 |
| chr17 | 699 |
| chr18 | 722 |
| chr19 | 709 |

TABLE 3-continued

The number of loci on the chip distributed in each chromosome

| Chromosome | SNP number |
|---|---|
| chr20 | 849 |
| chr21 | 493 |
| chr22 | 148 |
| chr23 | 317 |
| chr24 | 384 |
| chr25 | 102 |
| chr26 | 336 |
| chr27 | 272 |
| chr28 | 312 |
| chrZ | 3,591 |
| Total | 50,000 |

Example 2: Method of Applying IASCHICK Chicken SNP Chip in Detection of Chicken DNA Samples Chicken blood samples were collected, the genomic DNA of the blood was extracted by a phenol-chloroform method or a special kit and dissolved in ddH$_2$O, and the purity was checked by 1% agarose gel electrophoresis. DNA sample quality detection: agarose gel electrophoresis with a mass fraction of 1% to 1.5% (w/w) was used for detection, the gel imaging system (GelDocXR System, Bio-Rad company, USA) was used to determine the electrophoresis results to ensure good integrity of genomic DNA and a length of the genomic DNA fragment greater than 10 kb; the concentration of genomic DNA was measured by a micro-ultraviolet spectrophotometer (Q5000, Quayu company, USA) or a similar nucleic acid protein analyzer, and the DNA concentration was adjusted to a working concentration of 10 to 50 ng/µl.

Gene chip detection: operation was performed according to the standard process for Affymetrix GeneTitan™ gene chip assay (Axiom 2.0 Target Prep 384 Samples Protocol www.thermofisher.com). The chip scanning was performed using a GeneChip HT Array Plate Scanner chip scanner (GeneChip HT Array Plate Scanner, Thermos Fisher Scientific company, USA).

Data Analysis: Genotypes were analyzed using Axiom Analysis Suite (software download www.thermofisher.com/cn/zh/home/life-science/microarray-analysis/microarray-analysis-instruments-software-services/microarray-analysis-software/axiom-analysis-suite.html, source of the software: www.thermofisher.com), and the R language (www.rproject.org) was used for programming so as to obtain genotype comparison results.

Example 3: Mining of Important Economic Trait-Related Genes was Performed Based on Test Results with IASCHICK Chicken SNP Chip The 1062 random selected individuals of the fast-growing white-feather broiler K line were subjected to IASCHICK chip detection (performed according to the method of Example 2), with the quality control conditions for genotype: individual call rate (CR)>95%, MAF>0.05, Hardy-Weinberg equilibrium test >0.001. After quality control, 948 qualified individuals and 46,386 high-quality SNP loci were obtained for GWAS analysis. The GWAS analysis based on the mixed linear model was performed according to the calculation results (between −46.77 and 22.80) of the corresponding residual feed intake (RFI) of individuals (28 to 42 days old). With $p<1\times10^{-5}$ as the genome-related level, loci exhibiting significant association were obtained, as shown in Table 4. There were four loci significantly associated with RFI in the region of 51526729-66784053 bp of No. 1 chromosome, 15.3 Mb in total, suggesting that this region is a key QTL region affecting RFI. Moreover, this region contains the IGF-1 gene (Chr1: 55335204-55383631 bp), which gene has been proved to be a known gene affecting growth and feed efficiency. Loci showing significant association on chromosomes 2, 4, 7 and 10 may be previously undiscovered variants. Therefore, the IASCHICK chip prepared in Example 1 was used to identify the genotype to obtain data, and a relatively accurate association analysis result can be obtained, as shown in Table 4.

feather broilers including Hubbard broiler and synthetic white-feather broiler K line. The indigenous chicken breed samples were collected from the National Poultry Genetic Resources of the Institute of Poultry Research of the Chinese Academy of Agricultural Sciences, respectively 20 birds for each breed. Among the tested 10 chicken breeds, the detection rate of all SNP loci was 97% or more, and the loci having a MAF greater than 0.05 were more than 40,000, accounting for more than 80%. The mean MAF within breeds was between 0.22 and 0.27. It is proved that the IASCHICK chicken SNP chip loci are widely applicable to indigenous and abroad chicken breeds, and there was a high polymorphism in both indigenous breeds and introduced breeds.

Figure 2:
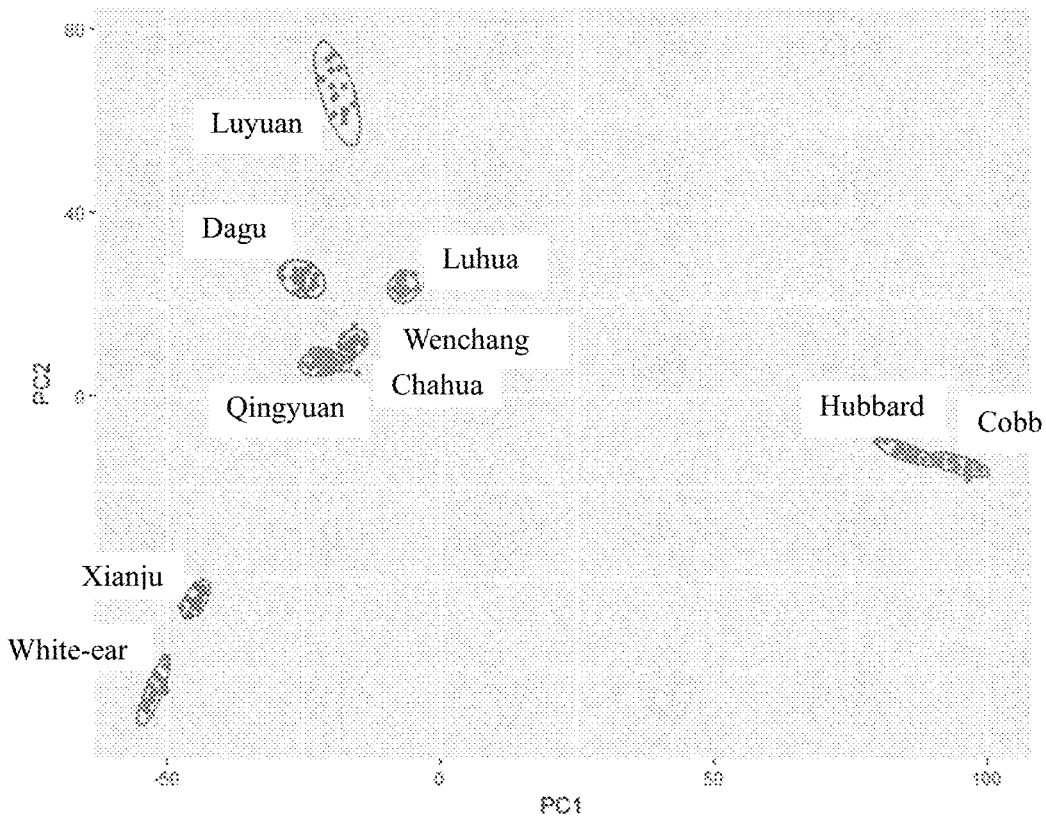
FIG. 2 is a graph showing the results of PCA for clustering for indigenous and abroad chicken breeds.

Quality control was performed on the genotype results (for conditions, see the method of Example 3). Cluster analysis was performed respectively using the PCA population structure and the MEGA software's neighbor-joining method (NJ), and the results were consistent. The PCA results were shown in FIG. 2 (the MEGA results were not given). For small-sized indigenous meat-type chicken breeds, the Chahua chickens and Qingyuan chickens have the closest distance, the next being the small-sized meat-type Wenchang chicken; and for large-sized meat-type chicken breeds, Luhua chickens, Luyuan chickens, and Dagu chickens were respectively clustered into one category. Moreover, as a whole, the meat-type chicken breeds have a closer distance than the egg-type chicken breeds and the introduced fast-growing and large-sized white-feather

TABLE 4

Information table of loci showing significant association obtained by GWAS analysis for RFI trait

| SNP name | Chromosome | Chromosome position (bp) | Upstream and downstream adjacent gene | Distance (kb) | P_value |
| --- | --- | --- | --- | --- | --- |
| AX_172568278 | 1 | 51425729 | CYTH4 | within | 9.64E−07 |
| AX_172566576 | 1 | 51425733 | CYTH4 | within | 9.65E−07 |
| AX_75478420 | 1 | 56132680 | CHPT1; ATP6V0A4 | 488; 251 | 2.81E−06 |
| AX_172675091 | 1 | 59382649 | DNM1L; MIR6700 | 376; 30 | 1.02E−06 |
| AX_75501099 | 1 | 66784053 | C3AR1; ST8SIA1 | 63; 27 | 9.64E−07 |
| AX_75531923 | 1 | 82792277 | QTRTD1 | 212 | 9.64E−07 |
| AX_75322007 | 1 | 164057964 | — | — | 9.72E−07 |
| AX_172592895 | 2 | 129826402 | AZIN1; NCALD | 14; 283 | 3.42E−07 |
| AX_80976861 | 4 | 37059652 | HPGDS | 390 | 9.39E−07 |
| AX_76675177 | 4 | 48727906 | MIR1730 | 193 | 6.48E−06 |
| AX_172565228 | 7 | 27104939 | ADCY5 | within | 4.73E−06 |
| AX_172565235 | 7 | 27466345 | MYLK | within | 4.45E−06 |
| AX_172579026 | 7 | 27720431 | UMPS | 292 | 2.66E−06 |
| AX_75614475 | 10 | 5811559 | MCEE; TARSL2 | 68; 341 | 9.64E−07 |

Example 4: Wide Applicability of Detection with IASCHICK Chips for Indigenous and Abroad Chicken Breeds and Results of Genetic Diversity Analysis of Indigenous Chicken Breeds The present invention uses the IASCHICK chicken chip prepared in Example 1 to carry out genetic diversity analysis on 8 indigenous chicken breeds and 2 fast-growing white feather chicken breeds (performed according to the method of Example 2). Indigenous chicken breeds include meat-type chickens comprising Qingyuan chicken, Wenchang chicken, Chahua chicken, Luhua chicken, Luyuan chicken, and Dagu chicken; egg-type chickens including white-ear chicken and Xianju chicken; and commercialized fast-growing white-broilers. For the egg-type indigenous chicken breeds, the white-ear chicken and Xianju chicken have the closest distance, and were distinguished from various meat-type indigenous chicken breeds; and the introduced abroad fast-growing and large-sized white-feather Hubbard broiler and the synthetic fast-growing and large-sized white-feather broiler K line (which has a genetic connection with the introduced fast-growing and large-sized chicken) had the closest clustering distance and were clearly distinguished from various indigenous chicken breeds. The results show that the IASCHICK chicken SNP chip prepared in Example 1 can be well applied to the diversity and evolution analysis of indigenous chicken germplasm resources, and the identification results were accurate and reliable.

Figure 3:
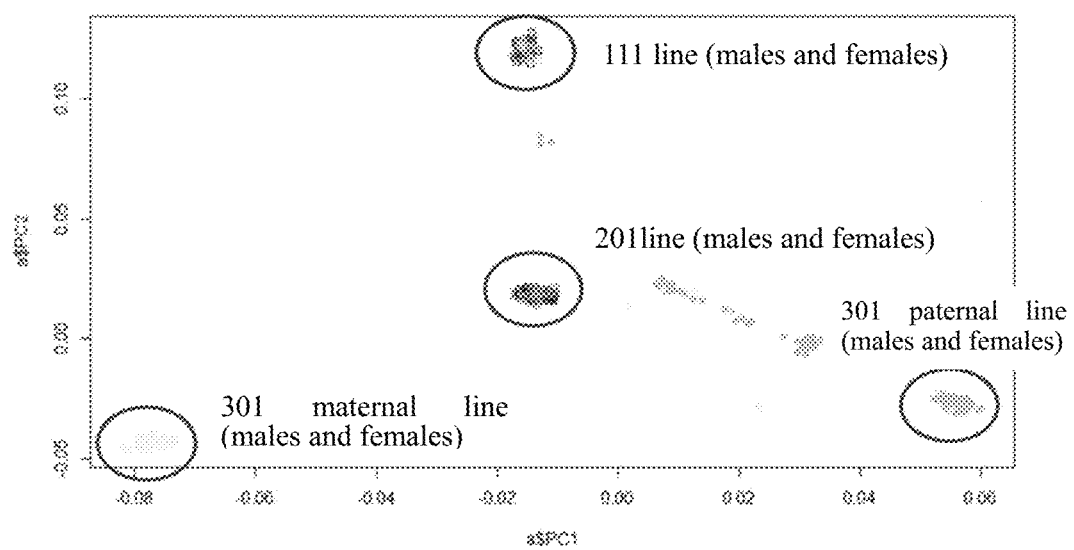
FIG. 3 is a graph showing the results of PCA for clustering for different chicken populations in the same farm.

Example 5: Identification of Genetic Relationship Based on Test Results with IASCHICK Chicken SNP Chip Genetic breeding of chickens is usually carried out for the breeding of large populations under a high selection pressure. In the practice, due to a variety of subjective or objective factors, some chickens may be mixed and the sources cannot be distinguished. Therefore, it is necessary to carry out the identification of genetic relationship of chicken populations. In the present Example, for the populations of three chicken lines doped with non-pure chicken lines in a farm that are to be tested, the IASCHICK chicken SNP chip prepared in Example 1 was used to perform genetic relationship detection on the DNA samples of totally 412 chickens of 111 line, 201 line and 301 lines, and the results according to PCA and MEGA clustering analyses were consistent. The PCA results were shown in FIG. 3 (the MEGA results were not given). There were 67 non-pure chickens (individuals outside the 4 black circles in the figure) were identified, which need to be eliminated or adjusted in the breeding. Other individuals in the black circles belong to 3 known line populations in production. After identification by the IASCHICK chip, the results can assist in the accurate identification of genetic relationship in breeding and accelerate the breeding process.

INDUSTRIAL APPLICABILITY

There are a total of 50,000 SNP loci on the chicken whole-genome SNP chip provided by the present invention: respectively derived from the whole-genome resequencing information of the main Chinese indigenous chicken breeds and introduced chicken breeds, 19,600 SNP loci having MAF greater than 0.05 and uniformly distributed across the genome; 14,000 SNP loci associated with economic traits; and 16,400 SNP loci for making up for the genomic regions that are not covered by the first two types of probes were screened out from white-feather broilers, yellow-feather and partridge chickens. The SNP loci on the chip respectively have the DNA sequences represented by SEQ ID NOs. 1 to 50,000. The SNP loci on the chip are uniformly distributed in the whole genome, and associated with traits such as feed efficiency, meat production rate, lipid metabolism, meat quality, general disease resistance, reproduction and the like, and the chip has moderate throughput and low cost, and may be used universally for indigenous and abroad chicken breeds.

SEQUENCE LISTING (50000 sequences)

SEQ ID NO: 1 - DNA, 71 bp, chicken (Gallus Gallus)
  misc_feature (36): n=c or t
aggtgaatgcaccgctgtcttttccacgacggaaancgtcctccactcctacagccaaattaactgcagtc

SEQ ID NO: 2 - DNA, 71 bp, chicken (Gallus Gallus)
  misc_feature (36): n=c or t
agcctggaattcctcgtaagtgtttgtacctgcgcngtgatggcactgtgctttcccttcctgagtcatcc

SEQ ID NO: 3 - DNA, 71 bp, chicken (Gallus Gallus)
  misc_feature (36): n=c or g
cggcagttgccaacacaagagaggactacaatgctnaagaagttctatctcttcccaggcctctgatctgc

SEQ ID NO: 4 - DNA, 71 bp, chicken (Gallus Gallus)
  misc_feature (36): n=c or t
aagactgcctgaattgcccagcatcataaaggatcnagtcaattcagcactaaatccagagctcctgagca

SEQ ID NO: 5 - DNA, 71 bp, chicken (Gallus Gallus)
  misc_feature (36): n=c or t
caatttattacaacagcagacttgcctgtatctatngcaggaggatctggaacccagctgggaggagctat

SEQ ID NO: 6 - DNA, 71 bp, chicken (Gallus Gallus)
  misc_feature (36): n=a or g
attttgccaggctgctcctccttcttcttctccccnctagctgcaattgttgcaaagtactggatgacacg

SEQ ID NO: 7 - DNA, 71 bp, chicken (Gallus Gallus)
  misc_feature (36): n=c or t
ttttagatgtttgaaagaatgccgtaagctgtgctngtgttacttgtggcaacctgctgagacagttagag

SEQ ID NO: 8 - DNA, 71 bp, chicken (Gallus Gallus)
  misc_feature (36): n=c or t
tgcccggtccccagcagcggtccctgcgctcacatnggtgcgtcaccacctgaattaatcatcagcctcac

SEQ ID NO: 9 - DNA, 71 bp, chicken (Gallus Gallus)
  misc_feature (36): n=a or g
aagcatgcatgaagacaggcaccgtgcatgtccacngggacactgacacagtaactgctactagaaatggg

SEQ ID NO: 10 - DNA, 71 bp, chicken (Gallus Gallus)
  misc_feature (36): n=a or g
aaaattatgggagaacaaagttatgtgtcattttcnccctgttctgaggtggtttcattaccccaggatcc

SEQ ID NO: 11 - DNA, 71 bp, chicken (Gallus Gallus)
  misc_feature (36): n=a or g
aacatcacacctcatttatttaaatatcagctcgcnttttgtgagatggggtcctgggaagtgcagccaag

SEQ ID NO: 12 - DNA, 71 bp, chicken (Gallus Gallus)
  misc_feature (36): n=a or g
aactacaatgatgctgcttcttgttacaggcagaangaacaaatgcagaagagcaatggtggaaagacaga

SEQ ID NO: 13 - DNA, 71 bp, chicken (Gallus Gallus)
  misc_feature (36): n=a or g
aagatgactttcgagtcttgcagaaagttatggccngtcagaatcatctttttccctccagtaacaggaaa

SEQ ID NO: 14 - DNA, 71 bp, chicken (Gallus Gallus)
  misc_feature (36): n=c or t
acactatagtatttctgacagaaagggaaagggcangagggcattcagcgctctgcaaagggcagaggcct

SEQ ID NO: 15 - DNA, 71 bp, chicken (Gallus Gallus)
  misc_feature (36): n=a or g
acgtaatttgagtcattccttatatctcttgccagnccaaagtcacagatttttgttattcgaccatgagt

SEQ ID NO: 16 - DNA, 71 bp, chicken (Gallus Gallus)
  misc_feature (36): n=a or g
agcacagcatccctgtggatgacattggagagcctnttgtggcaaccagagacagcagaggtaaagccttt

SEQ ID NO: 17 - DNA, 71 bp, chicken (Gallus Gallus)
  misc_feature (36): n=a or g
agggtcttgagtgcaattcggaatcctccaggaacnggagggctcagcctgagggtttccttgataacaca

SEQ ID NO: 18 - DNA, 71 bp, chicken (Gallus Gallus)
  misc_feature (36): n=a or t
ataaaatggttaataaagttgggtggaattgaagcnatgttatatacatattcttttttacttaagttgag

SEQ ID NO: 19 - DNA, 71 bp, chicken (Gallus Gallus)
  misc_feature (36): n=a or g
ataactgttttgtcctttacatggtacagaaaagancatccaggagatagacaaactagacaacaatagtc

SEQ ID NO: 20 - DNA, 71 bp, chicken (Gallus Gallus)
  misc_feature (36): n=a or c
ataccaatgacttccctcaaggcaaaatatttttcngtcagatcccctgcttcgcttaatggagcatcata

SEQ ID NO: 21 - DNA, 71 bp, chicken (Gallus Gallus)
  misc_feature (36): n=a or g
atcgcactgaatttcctccacataggttgtacgccntgcagaaacttccttctcttctggctagaacactg

SEQ ID NO: 22 - DNA, 71 bp, chicken (Gallus Gallus)
  misc_feature (36): n=c or t
cagcagaactgttcttgcaaatcacaggtcacaggnaccaaaaaaggggatttgaagttggcattatactt

SEQ ID NO: 23 - DNA, 71 bp, chicken (Gallus Gallus)
  misc_feature (36): n=g or t
cagccaagctcatgaacctgcaccattcgtccaaangtaatgaggcctactaacgcagttggtggtaggag

SEQ ID NO: 24 - DNA, 71 bp, chicken (Gallus Gallus)
  misc_feature (36): n=c or t
ccacgtccgttttcccggcttcagttacaatctgangatgatgaccctttaattgaatagcatgtgctgag

SEQ ID NO: 25 - DNA, 71 bp, chicken (Gallus Gallus)
  misc_feature (36): n=a or g
ccagaccctttgctgggacagtctaactgaggattnatttttgtgttaagttctatcacatctctgacaaa

SEQ ID NO: 26 - DNA, 71 bp, chicken (Gallus Gallus)
  misc_feature (36): n=c or t
cccatccatgcaaaacgatggtatggctttcttgangtccaacaagcttttcagtctgtaggagccaagtg

SEQ ID NO: 27 - DNA, 71 bp, chicken (Gallus Gallus)
  misc_feature (36): n=c or t
cccggtggcagaggtacatcatcagggatctcaaangaagactggcggagatgctgagaagacggagctcc

SEQ ID NO: 28 - DNA, 71 bp, chicken (Gallus Gallus)
  misc_feature (36): n=c or t
ccttccttctatgatgtgatcagtcccgatacaatnactctcactgatgatttttcctatgggatgcatcg

SEQ ID NO: 29 - DNA, 71 bp, chicken (Gallus Gallus)
  misc_feature (36): n=a or g
cgactgggagaagtcttcagttaagatatagccatncaacagcacctttcacatgtccgtaagagtgactg

SEQ ID NO: 30 - DNA, 71 bp, chicken (Gallus Gallus)
  misc_feature (36): n=a or g
cgggggaagcggtttcacgtgtgttttctgacctcngggtctgtgttgccttagtgctgctcgtgggcctg

SEQ ID NO: 31 - DNA, 71 bp, chicken (Gallus Gallus)
  misc_feature (36): n=a or g
ctgtgatgcaatgttatccctcagatgcactgttcnggcctggcctggcaccccgatgttgctacccagat

SEQ ID NO: 32 - DNA, 71 bp, chicken (Gallus Gallus)
  misc_feature (36): n=c or t
gacttgtagtttatttgttgcattaacttctgctanacatcccagctgcatggctgacagggattttgaac

SEQ ID NO: 33 - DNA, 71 bp, chicken (Gallus Gallus)
  misc_feature (36): n=c or t
gatcatcagccatgtatcattttcatggatgagatngatgctatcggtaaggctcgtggcctggacaatgg

SEQ ID NO: 34 - DNA, 71 bp, chicken (Gallus Gallus)
  misc_feature (36): n=a or g
gcaaaaagagagtgccttgctccaaatggttttagnaagtattatgggcaattctttagggaaacgatgaa

SEQ ID NO: 35 - DNA, 71 bp, chicken (Gallus Gallus)
  misc_feature (36): n=g or t
gctacagagagtttcccaggcagagttcagcatttnggagaacactgtgccgtggctgcagcatctgaagg

SEQ ID NO: 36 - DNA, 71 bp, chicken (Gallus Gallus)
  misc_feature (36): n=c or t
gctctgtattgtgaggtctgctatgagaagttcttngcacctgagtgttccaagtgccagcggaagatcct

SEQ ID NO: 37 - DNA, 71 bp, chicken (Gallus Gallus)
  misc_feature (36): n=a or g
ggtcagagccttgagatttctcccagcaacctaacngaaggctacatcataactcttctgagcttttacct

SEQ ID NO: 38 - DNA, 71 bp, chicken (Gallus Gallus)
  misc_feature (36): n=g or t
gtagatgccacaattaggaagaacatcagcacagtncttcttgggatgctgggacacgatgaggtattgct

SEQ ID NO: 39 - DNA, 71 bp, chicken (Gallus Gallus)
  misc_feature (36): n=c or t
gtcttgtatgttatggagaatgaagttgatgccttntggtgctttgtctcatatatggatcaaatggtaaa

SEQ ID NO: 40 - DNA, 71 bp, chicken (Gallus Gallus)
  misc_feature (36): n=c or t
gtttggaaagtgggcttaaacacatgcaaggaaaangtacccgttttgtcccacgtgagtatatggtaatg

SEQ ID NO: 41 - DNA, 71 bp, chicken (Gallus Gallus)
  misc_feature (36): n=c or t
tactctgggctgaagaagcgtctggagaacagtgangatgcttggatggtccagttcctggagctgtgtgg

SEQ ID NO: 42 - DNA, 71 bp, chicken (Gallus Gallus)
  misc_feature (36): n=a or g
tatgagtagagtccatcaatcaaattttagccatcnaccaaagaacctaaaaacaagagaactgtcttcct

SEQ ID NO: 43 - DNA, 71 bp, chicken (Gallus Gallus)
  misc_feature (36): n=c or t
tatgtaagcatttcattttatttaccaggtaatatncgacccatttctccatggcgctggcttttttcagt

SEQ ID NO: 44 - DNA, 71 bp, chicken (Gallus Gallus)
  misc_feature (36): n=a or g
tcaaatctcttctgaatatcaaacacattgactgantaacccttgtccagtagcttctctaccatatgctg

SEQ ID NO: 45 - DNA, 71 bp, chicken (Gallus Gallus)
  misc_feature (36): n=c or t
tcgttgttactttaacctcactcacagggaacttgntgtcttttttgtgtttagcagaagcctttttggac

SEQ ID NO: 46 - DNA, 71 bp, chicken (Gallus Gallus)
  misc_feature (36): n=a or t
tctgaaacctataaagtggaaacagatttcatagtngctgacttcagtaaggggcgtgaggcttaccaagc

SEQ ID NO: 47 - DNA, 71 bp, chicken (Gallus Gallus)
  misc_feature (36): n=a or g
tctgacaggatgcagaagagacctcctccaaaatcncggagcagagcccctccaatgaagcgaagagaatc

SEQ ID NO: 48 - DNA, 71 bp, chicken (Gallus Gallus)
  misc_feature (36): n=a or t
tctttagcacagccttttgggttagcatatgtactncttttttctttgcttaaacaaaaggctctagaaat

SEQ ID NO: 49 - DNA, 71 bp, chicken (Gallus Gallus)
  misc_feature (36): n=a or g
tgaatgcagaagacaggcaccatgaagatgatgacnatgacccacacggcaacgcttgcagcaatggcatg

SEQ ID NO: 50 - DNA, 71 bp, chicken (Gallus Gallus)
  misc_feature (36): n=c or g
tgctcagccatcttctgctttgaacaaactgcatcngacttatcagtcccagggactatttctgccaatcc

SEQ ID NO: 51 - DNA, 71 bp, chicken (Gallus Gallus)
  misc_feature (36): n=c or t
tgctttaaaaatatataaaggttggcataagtaggngtggggaattgccagcatccatgggcctagctcgc

SEQ ID NO: 52 - DNA, 71 bp, chicken (Gallus Gallus)
  misc_feature (36): n=a or c
tgtgtgtgtgcagaagaaggaaacaacaaacagcanatccagactgccactgccagctcagtctgaaggat

SEQ ID NO: 53 - DNA, 71 bp, chicken (Gallus Gallus)
  misc_feature (36): n=a or g
ttaaatgactcaccggcatctttgatccattcatcntagagcagcacagcctttgaggtcaaattgctaag

SEQ ID NO: 54 - DNA, 71 bp, chicken (Gallus Gallus)
  misc_feature (36): n=c or t
ttaatacaattaattaccttgttctttttcccatcnacttcaaaaactgaaatggagcctttgcggtagat

SEQ ID NO: 55 - DNA, 71 bp, chicken (Gallus Gallus)
  misc_feature (36): n=c or t
ttagtcaggaaaaaatttttgctcagatgaatattngtctggccagagaacttacggaaagcaagaaaaca

SEQ ID NO: 56 - DNA, 71 bp, chicken (Gallus Gallus)
  misc_feature (36): n=c or t
ttattttccgcagtgacttttagtgccatgggagangtgccgccagttcttgtatttctgtaaaccaaaac

SEQ ID NO: 57 - DNA, 71 bp, chicken (Gallus Gallus)
  misc_feature (36): n=a or g
ttcttgcagacatctgtcattggggttttcacaacnctcctgctgttctccagacaccggtatctctggaa

SEQ ID NO: 58 - DNA, 71 bp, chicken (Gallus Gallus)
  misc_feature (36): n=a or c
ttggctctctcggaagtgatcatgtcgtgagctttncgctcggcttctgacactgccttctgcaactctgc

SEQ ID NO: 59 - DNA, 71 bp, chicken (Gallus Gallus)
  misc_feature (36): n=c or t
ttgttttcagtgtccctaatcctccactgctgcttngtgtgatggggggacagcctggtacaggacagagc

SEQ ID NO: 60 - DNA, 71 bp, chicken (Gallus Gallus)
  misc_feature (36): n=a or g
ttttcctttcgctcttttgctagggtttactctgangatcccaaagaagcagtcagacagtgcgaacttct

SEQ ID NO: 61 - DNA, 71 bp, chicken (Gallus Gallus)
  misc_feature (36): n=c or t
aaaaaaaaagtgttttattgtatttcatttggtttngttcttttgcagtatgactcatttttatataatct

SEQ ID NO: 62 - DNA, 71 bp, chicken (Gallus Gallus)
  misc_feature (36): n=c or t
aaaatcgatcgagcgtacgcacagggcagagagaangtgtattcttcctcatgttccaagaggcttaggag

SEQ ID NO: 63 - DNA, 71 bp, chicken (Gallus Gallus)
  misc_feature (36): n=c or t
aaagaggctcatctgtgcacttctcttattcattangtttttaaacctcaaagactggttgagcaggactt

SEQ ID NO: 64 - DNA, 71 bp, chicken (Gallus Gallus)
  misc_feature (36): n=a or t
aaatgttactacttgaagccgagtaaaactgatggntgcatccgaagtctagcaacattcatcatagctct

SEQ ID NO: 65 - DNA, 71 bp, chicken (Gallus Gallus)
  misc_feature (36): n=c or g
acaaacagtgtttaccttaacagaggaggcgggttnataatttgactgtagtgttgcagatcttgcctata

SEQ ID NO: 66 - DNA, 71 bp, chicken (Gallus Gallus)
  misc_feature (36): n=a or g
acagggtaactcactgtgtctgtgcagagtgagtcnatagtcaggaatatgtattgtttttttccctctgt

SEQ ID NO: 67 - DNA, 71 bp, chicken (Gallus Gallus)
  misc_feature (36): n=a or g
acattgagcattttcccacgaaggggaaatactccntatttgtctctaccaaccactcctaaaccagagac

SEQ ID NO: 68 - DNA, 71 bp, chicken (Gallus Gallus)
  misc_feature (36): n=c or t
acctatgtctgtttctgaagggacttggctagcaangagattgaatcacttcctgcatatgtgtttaagga

SEQ ID NO: 69 - DNA, 71 bp, chicken (Gallus Gallus)
  misc_feature (36): n=c or t
agcttcactttccagatctccccaaatgagttcccnatcacattaatgagctatgctgtcaagaagcaggc

SEQ ID NO: 70 - DNA, 71 bp, chicken (Gallus Gallus)
  misc_feature (36): n=c or t
agtttgaaaacgagctgtacaaggatggctggctgntgggtaagtcagttcttcgtcttgctttctgttgg

SEQ ID NO: 71 - DNA, 71 bp, chicken (Gallus Gallus)
  misc_feature (36): n=c or t
atcttggatctgtcacatccaggtgtctcagaaganaaccaaggtaaggatgcttacattaaatctctgtg

SEQ ID NO: 72 - DNA, 71 bp, chicken (Gallus Gallus)
  misc_feature (36): n=c or t
cactagttcattgccatctttcctgaaagcttcctngtaggcatgcacttaaatgtttttaataactaagt

SEQ ID NO: 73 - DNA, 71 bp, chicken (Gallus Gallus)
  misc_feature (36): n=a or g
cagcactggagccaagcagaggcagacaagcgaganctgcaactcaagagagaggagacaaagaggaagat

SEQ ID NO: 74 - DNA, 71 bp, chicken (Gallus Gallus)
  misc_feature (36): n=a or g
caggatgagatccggcggctgaaggacgagctctcncagaaagacattcggatccgccagctacagctgga

SEQ ID NO: 75 - DNA, 71 bp, chicken (Gallus Gallus)
  misc_feature (36): n=a or g
ccaaagtctgctcccagccaaacactgctgggagangtcacccaagatgttcagggtgctgcttaaataca

SEQ ID NO: 76 - DNA, 71 bp, chicken (Gallus Gallus)
  misc_feature (36): n=c or t
ccacctcaggatcttctcttgctctgcccacacccngacgtttgggtcactgtttagctttctcaggtgag

SEQ ID NO: 77 - DNA, 71 bp, chicken (Gallus Gallus)
  misc_feature (36): n=a or g
ccatctttggggacgtagagtgtgccatacaggtcntccacattcatcagcgggtacagctccttggtctg

SEQ ID NO: 78 - DNA, 71 bp, chicken (Gallus Gallus)
  misc_feature (36): n=a or g
cccgtctgcctgcatgcacacatctggcttgtgaanggttgcagacgtagcccacagagcagaaaggagag

SEQ ID NO: 79 - DNA, 71 bp, chicken (Gallus Gallus)
  misc_feature (36): n=c or t
cctcctcaaccctctgctcccctctcccaaccctcngctcctccatcccttcaggtttgatggttttgctg

SEQ ID NO: 80 - DNA, 71 bp, chicken (Gallus Gallus)
  misc_feature (36): n=g or t
ctagccaaaaatctgcgctattttccaaatgtgacnttctgttgccaaaagtcaaactgcatcagctgtcc

SEQ ID NO: 81 - DNA, 71 bp, chicken (Gallus Gallus)
  misc_feature (36): n=g or t
ctgctttcaccatgtctgcagtgactttaacgtctnttgcacctttgctgtggagcaaaactaggttagca

SEQ ID NO: 82 - DNA, 71 bp, chicken (Gallus Gallus)
  misc_feature (36): n=a or g
ctgcttttcaggataactcttctgatgtctggaggngctagtatactttatatacgctggaggattatggg

SEQ ID NO: 83 - DNA, 71 bp, chicken (Gallus Gallus)
  misc_feature (36): n=c or t
cttctttttccagataaagccctgaaggaggttgtngaacgtattcttcaaactagttactttgatagcac

SEQ ID NO: 84 - DNA, 71 bp, chicken (Gallus Gallus)
  misc_feature (36): n=c or g
gacagactaaaatcagcgttattggccctgggactnaaatgtggagggtaagatgcactctcttcctaatt

SEQ ID NO: 85 - DNA, 71 bp, chicken (Gallus Gallus)
  misc_feature (36): n=a or g
gacataaacaggccccgaaccacattttaacctcangacaactggtggtgtgatctcaaatccacctagtg

SEQ ID NO: 86 - DNA, 71 bp, chicken (Gallus Gallus)
  misc_feature (36): n=a or g
gagatgccccctgttcagttcaagctgctgggaacnttacgaatgttaatagatgcacaaggtaaaaataa

SEQ ID NO: 87 - DNA, 71 bp, chicken (Gallus Gallus)
  misc_feature (36): n=c or t
gatgataacgcaggaagacctctcagagatgtctgnttccatctgttaaagctctacagcgacaggtgagt

SEQ ID NO: 88 - DNA, 71 bp, chicken (Gallus Gallus)
  misc_feature (36): n=a or g
gcaactgggaaggatgtggtggagcaccgagtgaancagatactggttcaaacaaaggaagaggagacacc

SEQ ID NO: 89 - DNA, 71 bp, chicken (Gallus Gallus)
  misc_feature (36): n=c or t
gcaatccaagcaagcttccttgcgttcacagcatcnaccaccactgtacagaagggcaggaacaatgaggg

SEQ ID NO: 90 - DNA, 71 bp, chicken (Gallus Gallus)
  misc_feature (36): n=a or g
gcacaagactgcattctgctcaacttccaggttcanctatcagcacattctgttaaaaagaaaataagctt

SEQ ID NO: 91 - DNA, 71 bp, chicken (Gallus Gallus)
  misc_feature (36): n=c or t
gcattttctcctcaaccacccaagtttttcaaaccnttaatgccagtgaaagaggaacataaaaggaagac

SEQ ID NO: 92 - DNA, 71 bp, chicken (Gallus Gallus)
  misc_feature (36): n=a or g
gctaccaacagcttctggccaactgcagcaggaacntggcagaggatacctaaggagacaactgggagtga

SEQ ID NO: 93 - DNA, 71 bp, chicken (Gallus Gallus)
  misc_feature (36): n=a or g
ggccccaaaaccatcgaccagatccacaaagaggcngagatggaggagcatcgggaacacatcaaagtgca

SEQ ID NO: 94 - DNA, 71 bp, chicken (Gallus Gallus)
  misc_feature (36): n=a or g
ggctgaaaatatcatctttttcctccctagtactcnttatgtaacgagcccctgatagagctgtcgaaccc

SEQ ID NO: 95 - DNA, 71 bp, chicken (Gallus Gallus)
  misc_feature (36): n=a or t
gggcccaatggagattttgggattaaattcaatacngccaatggaggtaaagttgcttagttgattcttgt

SEQ ID NO: 96 - DNA, 71 bp, chicken (Gallus Gallus)
  misc_feature (36): n=a or g
gggttggcatgaatggtgatatctttgatgtgaacntcattcagaggtcggtaggttttctcattcacagg

SEQ ID NO: 97 - DNA, 71 bp, chicken (Gallus Gallus)
  misc_feature (36): n=c or t
ggttttggtgtgtccagtttctcacactcatgatcngactgatgccgatgtctataaataacagagataaa

SEQ ID NO: 98 - DNA, 71 bp, chicken (Gallus Gallus)
  misc_feature (36): n=g or t
gtctcttcttcattagcaacatcctctgaagactcncctactttgaactttgctttctgaagtgatgacac

SEQ ID NO: 99 - DNA, 71 bp, chicken (Gallus Gallus)
  misc_feature (36): n=c or t
gtgtcttccttaccttcagttgccttgattgtatanccattctcttcatttggtggtacttccagaagttg

SEQ ID NO: 100 - DNA, 71 bp, chicken (Gallus Gallus)
  misc_feature (36): n=a or g
taaatccaaacgcgcgttactgtgctaaaagcaagngcaggtattctgagtgtaaataaactcttaaatta

SEQ ID NO: 101 - DNA, 71 bp, chicken (Gallus Gallus)
  misc_feature (36): n=a or t
taacacttaggagcagtaggccacttcaacatccangtgctttgcaaatgtcacgatatattcacagctta

SEQ ID NO: 102 - DNA, 71 bp, chicken (Gallus Gallus)
  misc_feature (36): n=a or t
tatatcctcttctaccagtcaagagactaagacaanggatgtgtgcataactaaaagggatcaagatatgt

SEQ ID NO: 103 - DNA, 71 bp, chicken (Gallus Gallus)
  misc_feature (36): n=c or t
tatcaagttcctaaagtgtcttatggggtggatagnttgtacagcttttaccacaacaggaggcagaactg

SEQ ID NO: 104 - DNA, 71 bp, chicken (Gallus Gallus)
  misc_feature (36): n=a or c
tcaaaccatttcttcactaactttttcaacagcccnctgtgctcaataacagcattcttcattacatctta

SEQ ID NO: 105 - DNA, 71 bp, chicken (Gallus Gallus)
  misc_feature (36): n=a or g
tcagggtctgaaggaggccgtaggtggaactcggantcacagaaatttccatcaccatccacgttgtgcaa

SEQ ID NO: 106 - DNA, 71 bp, chicken (Gallus Gallus)
  misc_feature (36): n=a or g
tccttagaggaggaggaggtaaacactaaacatcancttgttcttacagggaagattcaaaccctaagtat

SEQ ID NO: 107 - DNA, 71 bp, chicken (Gallus Gallus)
  misc_feature (36): n=a or t
tgaataggaataaggactttgtaaacctcattaacngcttcatacatgccagcctaaaaaacaagggccac

SEQ ID NO: 108 - DNA, 71 bp, chicken (Gallus Gallus)
  misc_feature (36): n=c or t
tgagctcttcagatgcaaccaaactgttccgttcantgaagactgccctattgccaagtgttcgttcttca

SEQ ID NO: 109 - DNA, 71 bp, chicken (Gallus Gallus)
  misc_feature (36): n=c or t
tgcagtggagtgagagttgtcctctttatgtgtttnatctcttctttggtagttgctcatgaatagagcag

SEQ ID NO: 110 - DNA, 71 bp, chicken (Gallus Gallus)
  misc_feature (36): n=c or t
tgcctttttttttttccagtggaaattgtggactcngtagaagcttatgcaaatatgctgaggaacatctt

SEQ ID NO: 111 - DNA, 71 bp, chicken (Gallus Gallus)
  misc_feature (36): n=c or g
tgcgctcaccctatgatgcatgtcccactttactcntctccatgaatggttcagcctggatgtgaaaatca

SEQ ID NO: 112 - DNA, 71 bp, chicken (Gallus Gallus)
  misc_feature (36): n=a or g
tgctgtgcacaggtcccgcatgacacgtgctggccnctggaaggagactctctctgcacaaagctgctgac

SEQ ID NO: 113 - DNA, 71 bp, chicken (Gallus Gallus)
  misc_feature (36): n=a or g
tggttggtgctgtcagtaggcattgctgcatagacntactctattctcaggcttgcctgtgagaaataaag

SEQ ID NO: 114 - DNA, 71 bp, chicken (Gallus Gallus)
  misc_feature (36): n=a or g
tgttctgattaaatatttagattaaaataataattnttattaaatactgtgataattaccagggcctgatc

SEQ ID NO: 115 - DNA, 71 bp, chicken (Gallus Gallus)
  misc_feature (36): n=c or t
ttaaaataagaagttaatagatacctttcaatgacngttccattttgaatcatccaaatatcacaatatgt

SEQ ID NO: 116 - DNA, 71 bp, chicken (Gallus Gallus)
  misc_feature (36): n=c or t
ttatggggtacctatgaactgctgttaccatacgtngtataaccaggactatttcaccaaaactctttgaa

SEQ ID NO: 117 - DNA, 71 bp, chicken (Gallus Gallus)
  misc_feature (36): n=g or t
ttctgctacatgtgaatgtaatacagaagatagtgnttggctggcaaagtcttagggttttgttcctgtgg

SEQ ID NO: 118 - DNA, 71 bp, chicken (Gallus Gallus)
  misc_feature (36): n=c or t
ttcttggacaggaacacacctgtgttcagagatgangtctgcttttttataagtcagtcaggtgagctgtt

SEQ ID NO: 119 - DNA, 71 bp, chicken (Gallus Gallus)
  misc_feature (36): n=c or t
ttgaacaccgccggcagggtgacattcttgccggangcttcccccttttcagagtagacagatatcaacgg

SEQ ID NO: 120 - DNA, 71 bp, chicken (Gallus Gallus)
  misc_feature (36): n=a or g
tttgtgtctgagctttgctcagagaggctctgaccncaagttccatccctgaataagggtctgacccaaca

SEQ ID NO: 121 - DNA, 71 bp, chicken (Gallus Gallus)
  misc_feature (36): n=c or g
ttttcctctgctcccaggatgttcattttgagttcncaaggaattgttagaactttggcgacatctaatgg

SEQ ID NO: 122 - DNA, 71 bp, chicken (Gallus Gallus)
  misc_feature (36): n=a or t
ttttcttcttttctctgttttggactatgaagcatnagtgaccagaaggatccaaaagaaagaatggttca

SEQ ID NO: 123 - DNA, 71 bp, chicken (Gallus Gallus)
  misc_feature (36): n=c or t
caaatcagtataggttggattattgaaggttgtttnccagcgcacctgagattgttgtgactgtgctctta

SEQ ID NO: 124 - DNA, 71 bp, chicken (Gallus Gallus)
  misc_feature (36): n=a or g
ggctcctacttgcagacacaaatagctaagggcacnctacacttataggagggaaaaaagactaagaaacc

SEQ ID NO: 125 - DNA, 71 bp, chicken (Gallus Gallus)
  misc_feature (36): n=c or t
aaaaaaaacaaggaagctaaaaaagaaagacttcangagccacattttcaaataagccttcaccttaatct

SEQ ID NO: 126 - DNA, 71 bp, chicken (Gallus Gallus)
  misc_feature (36): n=a or g
aaaaaagctacttgtaaatattttccttcaaaaacntggtgatagagactgtattatattgccacttttga

SEQ ID NO: 127 - DNA, 71 bp, chicken (Gallus Gallus)
  misc_feature (36): n=a or g
aaaaactagatgctagctaagggacaaaactgtacntggaaatcgagcttaaaaaagccaaagaatttcag

SEQ ID NO: 128 - DNA, 71 bp, chicken (Gallus Gallus)
  misc_feature (36): n=a or g
aaaaagcaaacagaaggaaacctttcaagaacacgngcgtttccaggctcccctcacacagtgcaaagagg

SEQ ID NO: 129 - DNA, 71 bp, chicken (Gallus Gallus)
  misc_feature (36): n=a or g
aaaaaggtaatcctagggtactttgaagttaaaaantagcatcattttataagggcaaaattaatttaaga

SEQ ID NO: 130 - DNA, 71 bp, chicken (Gallus Gallus)
  misc_feature (36): n=c or t
aaaaatgagagttaaaatgcatgtttaaatactacngttatgataacatagtaacaaatagacatatttca

SEQ ID NO: 131 - DNA, 71 bp, chicken (Gallus Gallus)
  misc_feature (36): n=c or t
aaaacccagatgttataaagagctagtaattaatgnagaatgctcttccttgatagtttctactgaaccag

SEQ ID NO: 132 - DNA, 71 bp, chicken (Gallus Gallus)
  misc_feature (36): n=a or g
aaaagaaatagaagatttcagttcctcttgtgctgncatattggcatgtactggaagtgggcacagtcagg

SEQ ID NO: 133 - DNA, 71 bp, chicken (Gallus Gallus)
  misc_feature (36): n=a or g
aaaagaaattaaaaggcacctgaatagcctacacancgtggttaaggctcctgtcaagctgagcaagactg

SEQ ID NO: 134 - DNA, 71 bp, chicken (Gallus Gallus)
  misc_feature (36): n=a or g
aaaagagatccaacgtcttataaaaatatggccaangcatagaagtggcaaaatacacattacattataat

SEQ ID NO: 135 - DNA, 71 bp, chicken (Gallus Gallus)
  misc_feature (36): n=a or g
aaaagagatggctcccaaaacacatgtatattttcngttaactcaaaatgccccggactcccacggctatg

SEQ ID NO: 136 - DNA, 71 bp, chicken (Gallus Gallus)
  misc_feature (36): n=a or c
aaaagttactgctcatttacaagtgtagctcagaanacactttgccctgaagtgctttcctccttgaccat

SEQ ID NO: 137 - DNA, 71 bp, chicken (Gallus Gallus)
  misc_feature (36): n=c or t
aaaataaagatctataaggtcaacggcacgtgtttntgccagctgctcttattccatgccaacctcgggag

SEQ ID NO: 138 - DNA, 71 bp, chicken (Gallus Gallus)
  misc_feature (36): n=a or g
aaaataggcagttttccaaattcaccaaagtaaaanccatcaaaatatatctaaggaacttaccaagacaa

SEQ ID NO: 139 - DNA, 71 bp, chicken (Gallus Gallus)
  misc_feature (36): n=c or t
aaaatatcggaaatagtacttctagctccaaaatancccaggcactaagaagcatctaacagcaattatca

SEQ ID NO: 140 - DNA, 71 bp, chicken (Gallus Gallus)
  misc_feature (36): n=a or g
aaacaaaacaaaaacacccaaagccatgtgggccancagagctgggttcgttagcacgacacggccctttt

SEQ ID NO: 141 - DNA, 71 bp, chicken (Gallus Gallus)
  misc_feature (36): n=c or t
aaacaagtgggtgtttctttaaaccgaatatttacngtcaaccccaaaggagaacttatacaagaacatgc

SEQ ID NO: 142 - DNA, 71 bp, chicken (Gallus Gallus)
  misc_feature (36): n=a or g
aaacagaaactgatattcctgtcaatgagggaaatntggggaaaggtgtgttttgctgtgtatagctgcat

SEQ ID NO: 143 - DNA, 71 bp, chicken (Gallus Gallus)
  misc_feature (36): n=g or t
aaacagagtttgaaaataggtttcacactccctccntggttttttttttccccctcctgagagggggagtg

SEQ ID NO: 144 - DNA, 71 bp, chicken (Gallus Gallus)
  misc_feature (36): n=c or t
aaacctccacggggaaaccaccgtctttcacagctntaaccaacacacagcagcctttattccccacatct

SEQ ID NO: 145 - DNA, 71 bp, chicken (Gallus Gallus)
  misc_feature (36): n=a or g
aaacgcagcttgagattttcttccttgtttgcatcnctctcctcacagcctggggaatctgaccattcttt

SEQ ID NO: 146 - DNA, 71 bp, chicken (Gallus Gallus)
  misc_feature (36): n=a or g
aaactacttcaaatggcacaagatttaactatcagntacttgatttgcaaggtcatgagggtggacaacct

SEQ ID NO: 147 - DNA, 71 bp, chicken (Gallus Gallus)
  misc_feature (36): n=a or g
aaactagttttctaagtctttgctttggataaaccngaaaatgaactgtgggtaaatgaacattgcataga

SEQ ID NO: 148 - DNA, 71 bp, chicken (Gallus Gallus)
  misc_feature (36): n=a or g
aaactgagaagaatgaagagctgaagtgtatctagnctgaactgcaagtgcagagatgggctaagggtctg

SEQ ID NO: 149 - DNA, 71 bp, chicken (Gallus Gallus)
  misc_feature (36): n=c or t
aaactgattgcattcaattgtagactgaaatttcangtttactcagaacatagcttttaaagctcaattgc

SEQ ID NO: 150 - DNA, 71 bp, chicken (Gallus Gallus)
  misc_feature (36): n=c or t
aaactgcatcaggcccaatcctaaaaatccagtgantctttgggagccatggcagctcttccctactgaaa

SEQ ID NO: 151 - DNA, 71 bp, chicken (Gallus Gallus)
  misc_feature (36): n=a or g
aaagaaatgacatttgtatatgtgcaaatttgcctnaagctgtttcagtatctccctttgggcctgatgcc

SEQ ID NO: 152 - DNA, 71 bp, chicken (Gallus Gallus)
  misc_feature (36): n=a or g
aaagaagggctgaaacatccaggcttgatgttaaantattccacctataaaaacctagcacaactggcagt

SEQ ID NO: 153 - DNA, 71 bp, chicken (Gallus Gallus)
  misc_feature (36): n=a or g
aaagacttgctttactcttacaaacctttaacaagnaacaaaaactttgaagcctctctgcagatgttctc

SEQ ID NO: 154 - DNA, 71 bp, chicken (Gallus Gallus)
  misc_feature (36): n=a or g
aaagaggtgtgtgaatacaaatgattaggcttttcntgtctccaaaaggtaaattttctaagtagtattct

SEQ ID NO: 155 - DNA, 71 bp, chicken (Gallus Gallus)
  misc_feature (36): n=a or g
aaagagtaagaaggaagtctttgaagctcttaaacntacagtgaaatttgctcacttgcagaggtgtgata

SEQ ID NO: 156 - DNA, 71 bp, chicken (Gallus Gallus)
  misc_feature (36): n=g or t
aaagagtttccatacataggaacagagagctttttnggggaaggtgctaatctgtcagtgccaaccactga

SEQ ID NO: 157 - DNA, 71 bp, chicken (Gallus Gallus)
  misc_feature (36): n=c or t
aaggcaagcagttctgactctgagagctcaagcagngaggaagaaaagaaaccagctgtgaaaccagccag

SEQ ID NO: 158 - DNA, 71 bp, chicken (Gallus Gallus)
  misc_feature (36): n=g or t
aaagcagaggcaagagagagctctctccaaaaactngcttcaacgttgagtttccaggggacaaattactg

SEQ ID NO: 159 - DNA, 71 bp, chicken (Gallus Gallus)
  misc_feature (36): n=c or t
aaagcattgcgatagtcactgtatcacagaacatcncaaccctgctgccacattgcagcactctgagtggg

SEQ ID NO: 160 - DNA, 71 bp, chicken (Gallus Gallus)
  misc_feature (36): n=c or t
aaagctgatcagaattctgatttttctccaggaaanccaccagaaaaggaaatcctaaaaccctgagcatg

SEQ ID NO: 161 - DNA, 71 bp, chicken (Gallus Gallus)
  misc_feature (36): n=a or g
aaagctttcattctgcgctacttctctaccatctcnacaagctttgagtccaaactcaagatgagagactg

SEQ ID NO: 162 - DNA, 71 bp, chicken (Gallus Gallus)
  misc_feature (36): n=g or t
aaaggggaagagagcatgtgaaagcactagaaaatnttatgtacaggtaggctgagagcaaaaagggatat

SEQ ID NO: 163 - DNA, 71 bp, chicken (Gallus Gallus)
  misc_feature (36): n=a or g
aaagtaatagaatgtgtacagagactttcttgcacntggttgtcagggtcgttagctgaagctcttctttc

SEQ ID NO: 164 - DNA, 71 bp, chicken (Gallus Gallus)
  misc_feature (36): n=c or t
aaagttgaatgcctttaggttaggtaggatgaatcnggactgtttagtagtccatttggaaggtcacaggg

SEQ ID NO: 165 - DNA, 71 bp, chicken (Gallus Gallus)
  misc_feature (36): n=a or g
aaagttgtataaagaatgcttgatagatctgttcantgcttctcacttgggtcagtgctacaaggttgtgt

SEQ ID NO: 166 - DNA, 71 bp, chicken (Gallus Gallus)
  misc_feature (36): n=g or t
aaataacaactggcacaccaccatttaaagtgtctngcatgtattagaactagaaaaaattggcaaattca

SEQ ID NO: 167 - DNA, 71 bp, chicken (Gallus Gallus)
  misc_feature (36): n=g or t
aaatacatgtaaacagttgttgtaagatgctgatanaaggttttttgttttttcttattttcttagagcat

SEQ ID NO: 168 - DNA, 71 bp, chicken (Gallus Gallus)
  misc_feature (36): n=c or t
aaatagatgactttgttctaaaagctgcacaacaanctctatccatcatctacagtaaagagcaagatcaa

SEQ ID NO: 169 - DNA, 71 bp, chicken (Gallus Gallus)
  misc_feature (36): n=c or t
aaatatacaactatgtgtctcagtttattacctctnccccttagctaatgctggtccacttgaccaatcat

SEQ ID NO: 170 - DNA, 71 bp, chicken (Gallus Gallus)
  misc_feature (36): n=g or t
aaatcagaaaagtatttatcacaaattcagaggctnactgagtcacggatgggcagttctgtaggacagtc

SEQ ID NO: 171 - DNA, 71 bp, chicken (Gallus Gallus)
  misc_feature (36): n=a or g
aaatgagatactgggtgtttggtaataaaaagacanatcccgctgaattttccaataacaaggaagtcaca

SEQ ID NO: 172 - DNA, 71 bp, chicken (Gallus Gallus)
  misc_feature (36): n=a or c
aaatgattgtacttcctggagatgagaagctaagcnttagattcaggaaaaatctaggagacagaaatctc

SEQ ID NO: 173 - DNA, 71 bp, chicken (Gallus Gallus)
  misc_feature (36): n=a or g
aaatgcaagctgaattcatcacagatgtctgtgctnaggaacttccagccatgtttgagagggaggaatca

SEQ ID NO: 174 - DNA, 71 bp, chicken (Gallus Gallus)
  misc_feature (36): n=a or g
aaatgcgatatcccaaggatgatagggaagtgactntcacagtccatctattttatgttgtgatatgttat

SEQ ID NO: 175 - DNA, 71 bp, chicken (Gallus Gallus)
  misc_feature (36): n=a or g
aaatgcttctaatggaactgctagtccatggaaaangagtttaagtgttactgagaatacagaagccagtc

SEQ ID NO: 176 - DNA, 71 bp, chicken (Gallus Gallus)
  misc_feature (36): n=a or g
aaatggtgcaactgtcatggaagactggcttacacngaaaaccaagcagaatgcccaaatgttccattagc

SEQ ID NO: 177 - DNA, 71 bp, chicken (Gallus Gallus)
  misc_feature (36): n=a or g
aaatgttattctttaggctttccaggaagggggatnggggagaagtacccaataaatcaaccaccagcagg

SEQ ID NO: 178 - DNA, 71 bp, chicken (Gallus Gallus)
  misc_feature (36): n=c or t
aaattatgtaatacaccctcgtaaaaatgagcattngtttgagagatgaggttggcatgagctgaagctat

SEQ ID NO: 179 - DNA, 71 bp, chicken (Gallus Gallus)
  misc_feature (36): n=c or t
aaattccacaatattttgaagaattattacagcatnccaagttgagattggaaagggcctttgaagctcgt

SEQ ID NO: 180 - DNA, 71 bp, chicken (Gallus Gallus)
  misc_feature (36): n=c or t
aaattccagctggtttcaacatcatttcacctctantgaagtgcaggattctgcttgcttcaaagccctac

SEQ ID NO: 181 - DNA, 71 bp, chicken (Gallus Gallus)
  misc_feature (36): n=a or g
aacaattatggtgaataacctgaagagctacaattnaacatttgcatggaatgtgaggagccaaaaatgca

SEQ ID NO: 182 - DNA, 71 bp, chicken (Gallus Gallus)
  misc_feature (36): n=c or t
aacacaagaagctttcctgtgcttttgaaacacagnggccaggggtatttttgtggaactgcacaacgtgt

SEQ ID NO: 183 - DNA, 71 bp, chicken (Gallus Gallus)
  misc_feature (36): n=c or t
aacacagccaactttatggtaagattccattacagngttaaacacagatagctcctgtatggcaggaatga

SEQ ID NO: 184 - DNA, 71 bp, chicken (Gallus Gallus)
  misc_feature (36): n=a or g
aacacttctgctgtaagcaaacaatacttagctttnaacatgctgcataacctctgcatttactgacattg

SEQ ID NO: 185 - DNA, 71 bp, chicken (Gallus Gallus)
  misc_feature (36): n=c or t
aacagcgtcggttattttccctcgctctttaagganaacgagagcaggcgggctgcggcgctccctgtgga

SEQ ID NO: 186 - DNA, 71 bp, chicken (Gallus Gallus)
  misc_feature (36): n=c or t
aacagtgttttgaagctggccaatgagcaagcaaanggttcctgcttgactctgcagctttaaacctgaaa

SEQ ID NO: 187 - DNA, 71 bp, chicken (Gallus Gallus)
  misc_feature (36): n=a or g
aacagttttctagtaggtctgaatgccagttttgtnggatgatgcctgtggggttgtcctggcagcgatga

SEQ ID NO: 188 - DNA, 71 bp, chicken (Gallus Gallus)
  misc_feature (36): n=c or t
aacatagttccaagctaacgctagctctacagatcntgtaaggtaccaggactgccggcaatgctatctaa

SEQ ID NO: 189 - DNA, 71 bp, chicken (Gallus Gallus)
  misc_feature (36): n=a or g
aaccaaagcctgtgaaatacctggcatagaacaganggatattgaatagcctggcctcctaacctggtgtc

SEQ ID NO: 190 - DNA, 71 bp, chicken (Gallus Gallus)
  misc_feature (36): n=c or t
aaccaatacaactttgcaaagttgtactgtttacangaaaagctcatggttttcctatgagctattccgaa

SEQ ID NO: 191 - DNA, 71 bp, chicken (Gallus Gallus)
  misc_feature (36): n=c or t
aacccccacaagctcctacgtgggatcagtaagctnatgtaagtcgtgctgccagcagaaaggtctgaaga

SEQ ID NO: 192 - DNA, 71 bp, chicken (Gallus Gallus)
  misc_feature (36): n=g or t
aaccctccaatcatgtagcttatgtacagccagcancagagagagacccagctaaatagctcctgtagaac

SEQ ID NO: 193 - DNA, 71 bp, chicken (Gallus Gallus)
  misc_feature (36): n=c or t
aactaaaaatcagaatatagcaataattgtcaagtngctgttaactgcgacctatgaattaaaaacatcaa

SEQ ID NO: 194 - DNA, 71 bp, chicken (Gallus Gallus)
  misc_feature (36): n=a or c
aactgatccaaagctcactttggtttttccatttantgaagtgggattcggatcagatccggataaattgg

SEQ ID NO: 195 - DNA, 71 bp, chicken (Gallus Gallus)
  misc_feature (36): n=a or g
aactttacatcattgtacccacttgtgtttcagagnaagggaacactcccatagtatctcagttctgagca

SEQ ID NO: 196 - DNA, 71 bp, chicken (Gallus Gallus)
  misc_feature (36): n=a or c
aacttttaattcattccagtatatttgagtatacanttacagtccgaattctagactactagttacaggca

SEQ ID NO: 197 - DNA, 71 bp, chicken (Gallus Gallus)
  misc_feature (36): n=c or t
aagaaaaacacacacacaaatgtatacagctggtangcagcctggaatttggctgggcaaaggctttaggg

SEQ ID NO: 198 - DNA, 71 bp, chicken (Gallus Gallus)
  misc_feature (36): n=c or t
aagaaaaagacacttccttgtagaaacaaacgtcanggcagcttaagaaagaacgaacctcaaattcctgt

SEQ ID NO: 199 - DNA, 71 bp, chicken (Gallus Gallus)
  misc_feature (36): n=a or g
aagaaacagtcttcttaaaattatttgtgcaagcanaactagaatgtccaaagttaaagtctgcatcccaa

SEQ ID NO: 200 - DNA, 71 bp, chicken (Gallus Gallus)
  misc_feature (36): n=c or t
aagaactctgctttgtttgcatgtacaatgagacantgggaaacacctgcccatcgctcagcagacgctca

SEQ ID NO: 201 - DNA, 71 bp, chicken (Gallus Gallus)
  misc_feature (36): n=a or g
aagactgtgccaaagtgagcctggacagcatcttcntacagtggcagttgcagccaaagcagtggagcttt

SEQ ID NO: 202 - DNA, 71 bp, chicken (Gallus Gallus)
  misc_feature (36): n=a or g
aagagggaacagcatgccaattagactgtagggctnttctcatgggtgaaaatgcagcttgaatctagcaa

SEQ ID NO: 203 - DNA, 71 bp, chicken (Gallus Gallus)
  misc_feature (36): n=g or t
aagagtatgtgcccacaaatggtaatagaagacctntgtcataattcctccccacactgaaggttgcagct

SEQ ID NO: 204 - DNA, 71 bp, chicken (Gallus Gallus)
  misc_feature (36): n=g or t
aagatctgacaatacttgtggagagatatatcacgnacctgacctaacaattcctttagcacaggtgaaat

SEQ ID NO: 205 - DNA, 71 bp, chicken (Gallus Gallus)
  misc_feature (36): n=a or g
aagcaaaaacgtgttttcatcctgattatctagccnttgtcttttcatctccaaagcatcagtgctctcac

SEQ ID NO: 206 - DNA, 71 bp, chicken (Gallus Gallus)
  misc_feature (36): n=a or g
aagcatatttaatcacctctggaaactatagagtgnaactgcaggcactgaagtttttctttttttttttt

SEQ ID NO: 207 - DNA, 71 bp, chicken (Gallus Gallus)
  misc_feature (36): n=c or t
aagcattcaagtaaggtggctctaggcaatagcctngtgaaatttcagctcgttcttaagagtggtgagta

SEQ ID NO: 208 - DNA, 71 bp, chicken (Gallus Gallus)
  misc_feature (36): n=a or g
aagctaatgttccaactacagcaatattctgctggncacagaagaaaaacttccagcagagttggaggaga

SEQ ID NO: 209 - DNA, 71 bp, chicken (Gallus Gallus)
  misc_feature (36): n=c or t
aagctcattgtcttagacatgctttcctctaaggcnactgtttcccacctggttttgtctcactacacagg

SEQ ID NO: 210 - DNA, 71 bp, chicken (Gallus Gallus)
  misc_feature (36): n=c or t
aagctttaattaactctaatgataattgcggagcangcgttaccattttgggcaacaatttcccagcttat

SEQ ID NO: 211 - DNA, 71 bp, chicken (Gallus Gallus)
  misc_feature (36): n=a or g
aagctttaggacttttaaagacttgtatttctaatnaaggacaataacgtgtcttgttatgggcttttctt

SEQ ID NO: 212 - DNA, 71 bp, chicken (Gallus Gallus)
  misc_feature (36): n=a or g
aaggattgctgtaaacgcaaaggatcattgttgtcnagcaatcacttctgttcccagcaagctatcaagca

SEQ ID NO: 213 - DNA, 71 bp, chicken (Gallus Gallus)
  misc_feature (36): n=c or t
aaggatttagaaaactgagttccagatttaggattnagctctctgcctaaccttgagaaggcctggaatgt

SEQ ID NO: 214 - DNA, 71 bp, chicken (Gallus Gallus)
  misc_feature (36): n=c or t
aaggctgaatgaatagagtgcttctaaaacaaactntgtaccaaatgtgttcatccacaggaatgtattaa

SEQ ID NO: 215 - DNA, 71 bp, chicken (Gallus Gallus)
  misc_feature (36): n=a or g
aaggggaactagagggtccctgctgaaagagtttgnagcacagtatggggtatggagtggacactgcacac

SEQ ID NO: 216 - DNA, 71 bp, chicken (Gallus Gallus)
  misc_feature (36): n=c or t
aagtatagaaaggtggtttactgtttaataagcttntctgctaatctcaagcacgtccccttgctgtgtaa

SEQ ID NO: 217 - DNA, 71 bp, chicken (Gallus Gallus)
  misc_feature (36): n=g or t
aagtatatctaatacatctacacagttgttgagganggagagatgaattagcgaccaagggtgagacaacc

SEQ ID NO: 218 - DNA, 71 bp, chicken (Gallus Gallus)
  misc_feature (36): n=a or g
aagtcctaatgtctgtgacacagcccagaaaatcangtctccttttacaatatggaaacctgacctgctac

SEQ ID NO: 219 - DNA, 71 bp, chicken (Gallus Gallus)
  misc_feature (36): n=a or g
aagtctcttttcttcaacgaaattctacccaaagtnaaaaagaattggcacaggtaaaactaacccacata

SEQ ID NO: 220 - DNA, 71 bp, chicken (Gallus Gallus)
  misc_feature (36): n=a or g
aagtgtgtctgttaactttacctgctctgaactgangaaagggtttgggccctttgtgtgtatgacatttg

SEQ ID NO: 221 - DNA, 71 bp, chicken (Gallus Gallus)
  misc_feature (36): n=g or t
aagtgttgtaccaagaaagtgtaatggaatctgtgnttgcttagcaatgggaaaagaagactatgggggag

SEQ ID NO: 222 - DNA, 71 bp, chicken (Gallus Gallus)
  misc_feature (36): n=a or g
aataaaaaatatgtcctctcccaggtctttgaaggntcttcatttcagtatttcaggaagtgggtgcactt

SEQ ID NO: 223 - DNA, 71 bp, chicken (Gallus Gallus)
  misc_feature (36): n=a or g
aatacaggagtcacagagttactagatgacaaaatnatatcctagcttcccagcagccttaggtgatcatc

SEQ ID NO: 224 - DNA, 71 bp, chicken (Gallus Gallus)
  misc_feature (36): n=g or t
aatactccttcacatttttgcagaaccaggtttctncctttctgcttgcagctctgtgagaccaaggcctc

SEQ ID NO: 225 - DNA, 71 bp, chicken (Gallus Gallus)
  misc_feature (36): n=c or t
aatatttttaaatatcagtgaccgaaaatcacaaantatgtcacttggcaatctttgaaatctcttttccc

SEQ ID NO: 226 - DNA, 71 bp, chicken (Gallus Gallus)
  misc_feature (36): n=c or t
aatcaacataaaggcaggagaagaaatccagggtgncagaagctgttcagtctgctgactcagagttgaga

SEQ ID NO: 227 - DNA, 71 bp, chicken (Gallus Gallus)
  misc_feature (36): n=a or g
aatcagatgtcctgtgatattttctaccttgaatgnaacaaagtcagaggatctctctgcatcagctctgg

SEQ ID NO: 228 - DNA, 71 bp, chicken (Gallus Gallus)
  misc_feature (36): n=g or t
aatccacaaaaaataccactaaaagagatgtacganttaatagaaaagcacgaacggttcaaaaaagagca

SEQ ID NO: 229 - DNA, 71 bp, chicken (Gallus Gallus)
  misc_feature (36): n=g or t
aatcctcctgcaaggaaattttctaagtgacaaaantctgatctttgaaatagctagagtaggtcttacac

SEQ ID NO: 230 - DNA, 71 bp, chicken (Gallus Gallus)
  misc_feature (36): n=c or t
aatcttcacttatagatgatgtttgtcactgacttntgtttgtggggtttccatagctctgcaacagcagt

SEQ ID NO: 231 - DNA, 71 bp, chicken (Gallus Gallus)
  misc_feature (36): n=a or g
aatctttgatgccttcctaaagatcagatagcaaancataattcagtagtaatggcatcagattgtattgc

SEQ ID NO: 232 - DNA, 71 bp, chicken (Gallus Gallus)
  misc_feature (36): n=a or c
aatgaaattataatgttagaccacttgtaactgttnaaaggagatatttagcagttctggcaagttctgct

SEQ ID NO: 233 - DNA, 71 bp, chicken (Gallus Gallus)
  misc_feature (36): n=c or t
aatgaaatttctttggatttcagttctgttcatacnaccactacagcttatttctgttttctttctgaaga

SEQ ID NO: 234 - DNA, 71 bp, chicken (Gallus Gallus)
  misc_feature (36): n=a or g
aatgaaggatcacaggtggatagagtgaaatgaccnttgcccactctctgaaatgctggcagctgcagtac

SEQ ID NO: 235 - DNA, 71 bp, chicken (Gallus Gallus)
  misc_feature (36): n=c or t
aatgacattgacctcacgaattctcttaaggatcancaaaaagttacagtttttccccaaccccttagttt

SEQ ID NO: 236 - DNA, 71 bp, chicken (Gallus Gallus)
  misc_feature (36): n=c or t
aatgactatgaataggagttgctacagttaaataanggattacttactgtgttcttacaggtagcttgtct

SEQ ID NO: 237 - DNA, 71 bp, chicken (Gallus Gallus)
  misc_feature (36): n=a or g
aatgactattaagggcgtttgcagctgtgcacaccncagcagttggtggtgttctgatctgcacctgatcc

SEQ ID NO: 238 - DNA, 71 bp, chicken (Gallus Gallus)
  misc_feature (36): n=c or t
aatgagaattctcttgcaatcattcaaaatgtcacntgtttcacctgtcacttttgctagctagtatgtat

SEQ ID NO: 239 - DNA, 71 bp, chicken (Gallus Gallus)
  misc_feature (36): n=g or t
aatgatacagggaaaggctagtgttttactgagatnagagatgccctggggagtgattctttctgatttcc

SEQ ID NO: 240 - DNA, 71 bp, chicken (Gallus Gallus)
  misc_feature (36): n=a or g
aatgatatgcatataattgcacaactcagttatacncgcatagtggcaccaatattttgggcagagctcca

SEQ ID NO: 241 - DNA, 71 bp, chicken (Gallus Gallus)
  misc_feature (36): n=c or t
aatgcagaaatgaggagaacagcaatttgtagctgngctgtgatactgcagtcctcctcctccttttgatt

SEQ ID NO: 242 - DNA, 71 bp, chicken (Gallus Gallus)
  misc_feature (36): n=c or t
aatggatttttgccatttatccactcctggtctagncccatcaagccaactcagctcgaataaaattcgtt

SEQ ID NO: 243 - DNA, 71 bp, chicken (Gallus Gallus)
  misc_feature (36): n=a or g
aatgtctgaaagaggaagtgacgatagctctgtgcnccacgtcgcaatgggacattcattcctataagtga

SEQ ID NO: 244 - DNA, 71 bp, chicken (Gallus Gallus)
  misc_feature (36): n=c or t
aatgtgtttaaacaggacactactcttattgtctantttcttttgcttttactaccaggggggcaacacag

SEQ ID NO: 245 - DNA, 71 bp, chicken (Gallus Gallus)
  misc_feature (36): n=a or c
aattcaagtttttttatgaatgtttcccaagcttangcagaaggtctctgggcaattagctcttacactca

SEQ ID NO: 246 - DNA, 71 bp, chicken (Gallus Gallus)
  misc_feature (36): n=a or g
aattgggagctgggttaaggagcttgaatttgaacntctgcaagatgctatgccttttagtgtagttcctc

SEQ ID NO: 247 - DNA, 71 bp, chicken (Gallus Gallus)
  misc_feature (36): n=a or g
aatttcagaaagtataagtctaacataagtattatnatatactgaaacttgagctgtcatgagtttaaaac

SEQ ID NO: 248 - DNA, 71 bp, chicken (Gallus Gallus)
  misc_feature (36): n=a or g
acaaaacatttgaaatgagacataaaaagtagatanaaaaggttctttgttaactagatagcatgcagcag

SEQ ID NO: 249 - DNA, 71 bp, chicken (Gallus Gallus)
  misc_feature (36): n=a or c
acaaaataaatggagctgaaaatagaggggaaaaangcaacacaaatgagctcagagacaaacagatgcta

SEQ ID NO: 250 - DNA, 71 bp, chicken (Gallus Gallus)
  misc_feature (36): n=a or g
acaaacatgagatttcaagagaatggaagtgtcaanaacatccaggaagataaggttgctaatccagttac

SEQ ID NO: 251 - DNA, 71 bp, chicken (Gallus Gallus)
  misc_feature (36): n=c or t
acaagatttctccaaacacttcgttcttaaagctanccccgtttaagacacccctgccatctgcagcgttt

SEQ ID NO: 252 - DNA, 71 bp, chicken (Gallus Gallus)
  misc_feature (36): n=c or t
acaaggacaaagatactggaaacacagacaaaaggncaaaaagcctgtaagtacagaggaaattaagttat

SEQ ID NO: 253 - DNA, 71 bp, chicken (Gallus Gallus)
  misc_feature (36): n=a or g
acacaaagcagatctgcattaaatctccaacgctancaccccagctccaggcaccagcatgggtgggcacc

SEQ ID NO: 254 - DNA, 71 bp, chicken (Gallus Gallus)
  misc_feature (36): n=a or g
acacctttgattgggccagcatgtaggattagaatnaatagacaagctttgagccatagcagtccttccag

SEQ ID NO: 255 - DNA, 71 bp, chicken (Gallus Gallus)
  misc_feature (36): n=g or t
acacgtatacttcacatttatcctggttaaaccaanaatactaaataactgataacgttgttcatatttat

SEQ ID NO: 256 - DNA, 71 bp, chicken (Gallus Gallus)
  misc_feature (36): n=a or g
acactctaaaatagctttgagatgagccaggcttcncagggtgtcaggacaagaccagacccctgggctca

SEQ ID NO: 257 - DNA, 71 bp, chicken (Gallus Gallus)
  misc_feature (36): n=c or t
acagattactggggtatatctacactttgctccatnccctccttattccatcagtatcattatattgtatt

SEQ ID NO: 258 - DNA, 71 bp, chicken (Gallus Gallus)
  misc_feature (36): n=c or t
acagcgggggaataaattatgtgctttgttttatgngacccagtgctctcagtgaagtgtgtgcctgtcca

SEQ ID NO: 259 - DNA, 71 bp, chicken (Gallus Gallus)
  misc_feature (36): n=a or g
acagctgaggaggcagcctaaaggctttctttttangcataaaacaaaatatttacctgaaatgagaaccc

SEQ ID NO: 260 - DNA, 71 bp, chicken (Gallus Gallus)
  misc_feature (36): n=a or g
acagggatgaagatggagaaggtttatgatggcagngaatgcaaaggctcactttgtcagactaattgaaa

SEQ ID NO: 261 - DNA, 71 bp, chicken (Gallus Gallus)
  misc_feature (36): n=a or g
acagttacgtatgtccaattcaatctgaattaaatntttaaagtcaaaggctgagcttaacttcaaataaa

SEQ ID NO: 262 - DNA, 71 bp, chicken (Gallus Gallus)
  misc_feature (36): n=a or g
acataatagtctgcagttacataaaaggtttctgcnaagaagaagagaataatttgttccgcatgttcatt

SEQ ID NO: 263 - DNA, 71 bp, chicken (Gallus Gallus)
  misc_feature (36): n=c or t
acatatcccttaattctgtgaaaggtcaaactttcnctcacagacctcatctccttaacgcaagtggctgt

SEQ ID NO: 264 - DNA, 71 bp, chicken (Gallus Gallus)
  misc_feature (36): n=c or t
acatctatgaggacccctggtcaaagttatgccaangcagctcttgtttgtttgctgatggtttgtctctg

SEQ ID NO: 265 - DNA, 71 bp, chicken (Gallus Gallus)
  misc_feature (36): n=g or t
acatgacatcgcagcagttccagcttaaaccagtcngctcttctgacagaagaaaacacactgatgacaag

SEQ ID NO: 266 - DNA, 71 bp, chicken (Gallus Gallus)
  misc_feature (36): n=c or t
acatttccactgaaaatctgaagcggtccaaacacngaaaaacaggaggtgatggtaggcagggaggagat

SEQ ID NO: 267 - DNA, 71 bp, chicken (Gallus Gallus)
  misc_feature (36): n=c or t
acatttctaattcttggcaagcagattctccgttantcttcaactccatcagcaacagtgaacaatttgag

SEQ ID NO: 268 - DNA, 71 bp, chicken (Gallus Gallus)
  misc_feature (36): n=a or g
accaaagattagaaacatatttcttcagtaataagntaccttgagctgttggtagcaccttgcaaatatta

SEQ ID NO: 269 - DNA, 71 bp, chicken (Gallus Gallus)
  misc_feature (36): n=c or t
accaatctgaagctaaagaaatttactcacaggtancatttacctttttggttttatggatttctaatcac

SEQ ID NO: 270 - DNA, 71 bp, chicken (Gallus Gallus)
  misc_feature (36): n=c or t
accagctacaaaccatccagccaaaataattttccnatttttctggtatcatcccagtcatgtgggttttt

SEQ ID NO: 271 - DNA, 71 bp, chicken (Gallus Gallus)
  misc_feature (36): n=a or g
accagtacattttactgtacttttaacactttaacncagctgcggggagtttggccatgttcccaggcagg

SEQ ID NO: 272 - DNA, 71 bp, chicken (Gallus Gallus)
  misc_feature (36): n=c or t
accatttttatgatattgataaagccattttgactncttgcaccagtggctttaattgctaaattcagaca

SEQ ID NO: 273 - DNA, 71 bp, chicken (Gallus Gallus)
  misc_feature (36): n=a or g
accccaagcttaaaaggaaatgtatataagttttcnaaacgtataaaaacttttacagaaataattcaact

SEQ ID NO: 274 - DNA, 71 bp, chicken (Gallus Gallus)
  misc_feature (36): n=c or t
acccttagctaacacacaacctctagtaattactangggcctgggactctttttcttccaagatccagact

SEQ ID NO: 275 - DNA, 71 bp, chicken (Gallus Gallus)
  misc_feature (36): n=a or g
acccttttgtcacccaacttgtattgacagtgggcnttgccatgaaccaggtgcgagacctcatgcttgtc

SEQ ID NO: 276 - DNA, 71 bp, chicken (Gallus Gallus)
  misc_feature (36): n=a or g
accgttattttcaagaacgaaatgcaatgcaaatgntaatacaacacatcacaactcgggtatggcagaca

SEQ ID NO: 277 - DNA, 71 bp, chicken (Gallus Gallus)
  misc_feature (36): n=a or g
acctacatattcacttttagactaacatatacaacngaagctactgtgcacctcatcctgccagtccacaa

SEQ ID NO: 278 - DNA, 71 bp, chicken (Gallus Gallus)
  misc_feature (36): n=c or t
acctatttagcaactcataaaagacattgttcctangctgatgagtctctcaagctccccaaactgaacgc

SEQ ID NO: 279 - DNA, 71 bp, chicken (Gallus Gallus)
  misc_feature (36): n=a or g
acctcaagttatgcacagatagctttggtaccctcngggaggtgatgtgtggccacgctgctgtgccaggc

SEQ ID NO: 280 - DNA, 71 bp, chicken (Gallus Gallus)
  misc_feature (36): n=a or g
acctccataagtgattactctttggagatgagtgangctgccagagagcagagggaggagattggagtatg

SEQ ID NO: 281 - DNA, 71 bp, chicken (Gallus Gallus)
  misc_feature (36): n=a or c
acctctgcctgtctccatttgggtgagttcacactntgccttaggcttgtggggtagccagctcagccctg

SEQ ID NO: 282 - DNA, 71 bp, chicken (Gallus Gallus)
  misc_feature (36): n=c or t
acctctgttcttgttgctacaggtataatttgtatnggagttgtttcaaatgtgtattgaaagaggtggaa

SEQ ID NO: 283 - DNA, 71 bp, chicken (Gallus Gallus)
  misc_feature (36): n=a or g
acctggttttatgcagagaagcccagttaaattccntcctcactgcactgagtttgggcagcagcatcact

SEQ ID NO: 284 - DNA, 71 bp, chicken (Gallus Gallus)
  misc_feature (36): n=c or t
acctttgctcaataccgaagctagtgctgctttgcncccgaacttccctgctcctccccatagccaaactc

SEQ ID NO: 285 - DNA, 71 bp, chicken (Gallus Gallus)
  misc_feature (36): n=c or t
acgcagttttattaaaagcttgtcctgtgtgaagangtcactgcttgaattgagcacttaccaaccagctg

SEQ ID NO: 286 - DNA, 71 bp, chicken (Gallus Gallus)
  misc_feature (36): n=a or g
acggccagagcaggactacagcaatgtcggcagttnatagctggggccgggcgagcgaaatcccgataatg

SEQ ID NO: 287 - DNA, 71 bp, chicken (Gallus Gallus)
  misc_feature (36): n=a or g
acgtttctgatttttctctacagcttttcttcaagnccttaagtccagctttgtcattttgtattctgcac

SEQ ID NO: 288 - DNA, 71 bp, chicken (Gallus Gallus)
  misc_feature (36): n=c or t
actaacataagcttgattcatttttcatcatcattnctcttccctaggcccctatctatctgaagtctaat

SEQ ID NO: 289 - DNA, 71 bp, chicken (Gallus Gallus)
  misc_feature (36): n=a or g
actaacatttgaacataagtgaaggtaactttgggncacaaggatagtttcagagtgtgtggcaaagagaa

SEQ ID NO: 290 - DNA, 71 bp, chicken (Gallus Gallus)
  misc_feature (36): n=a or g
actaactgttcatgtctgatgctgggaaatgaaggnggcattggtgagagccccagctcactttccctgca

SEQ ID NO: 291 - DNA, 71 bp, chicken (Gallus Gallus)
  misc_feature (36): n=a or g
actaataaacagtgcatgtctgcacagcttaacagngaagatataaaggcaacggacattcagcagtcata

SEQ ID NO: 292 - DNA, 71 bp, chicken (Gallus Gallus)
  misc_feature (36): n=c or t
actacactacaaaatggttttattgaaaatgtatcntgtaatgctcagttcattctcgtaaacaattcact

SEQ ID NO: 293 - DNA, 71 bp, chicken (Gallus Gallus)
  misc_feature (36): n=a or g
actagagatccaccatctctccttgtttgaaacacngctactggggaaagatatttaattctttattggag

SEQ ID NO: 294 - DNA, 71 bp, chicken (Gallus Gallus)
  misc_feature (36): n=a or g
actccagcatgttcagagcctaatgtactaataacngtgcattttaaaattcagcagcataaaacaatcaa

SEQ ID NO: 295 - DNA, 71 bp, chicken (Gallus Gallus)
  misc_feature (36): n=c or t
actccccaccactgtcattagatgagatgcttgtcngggtgctcaaaagctgtgttgttgccagagagctg

SEQ ID NO: 296 - DNA, 71 bp, chicken (Gallus Gallus)
  misc_feature (36): n=c or t
actcctggaaacagctcagctcctcacatacaatgntgggaagaaaaaagagaaagcaaagaggagggggc

SEQ ID NO: 297 - DNA, 71 bp, chicken (Gallus Gallus)
  misc_feature (36): n=c or t
actccttaagttgagccatcttctacttctcactcntccttctggcacccacagcacatcaaagaatcata

SEQ ID NO: 298 - DNA, 71 bp, chicken (Gallus Gallus)
  misc_feature (36): n=c or t
actgatagttgtatcattaaaactcagccctcccangagttttgtagctatctcctggacttaccttgtgt

SEQ ID NO: 299 - DNA, 71 bp, chicken (Gallus Gallus)
  misc_feature (36): n=c or t
actgattcatcagtgcagggtctgcctcagtaacangaccagaaaaagcacaattcctgcccacggttgct

SEQ ID NO: 300 - DNA, 71 bp, chicken (Gallus Gallus)
  misc_feature (36): n=a or g
actgggagatggctgtggaacatttcagctgcccanaacagccacaacaacagcagttaagcaccagcacg

SEQ ID NO: 301 - DNA, 71 bp, chicken (Gallus Gallus)
  misc_feature (36): n=c or t
actgtgctctggtttacttgttctgggaaggatttnattgaagtagttggggtgccctgtgagctgattta

SEQ ID NO: 302 - DNA, 71 bp, chicken (Gallus Gallus)
  misc_feature (36): n=g or t
acttcacagtggcttagcttgttctgaaatggctanagggcagaccatatatgtacatagtatgatgtgac

SEQ ID NO: 303 - DNA, 71 bp, chicken (Gallus Gallus)
  misc_feature (36): n=c or t
acttcacctccactagttcagagtatctttcagacnacagcatctgtaccagcactgaagaaactttttat

SEQ ID NO: 304 - DNA, 71 bp, chicken (Gallus Gallus)
  misc_feature (36): n=c or t
acttcagcattttgcagtttcataactgcaaagaanggagctctgtttgtaggtgtgtttctacagtacca

SEQ ID NO: 305 - DNA, 71 bp, chicken (Gallus Gallus)
  misc_feature (36): n=a or g
actttctgttcagtgtcttaacattcctaacagacnccacctgtgttcagaaggaattgatcaactgctga

SEQ ID NO: 306 - DNA, 71 bp, chicken (Gallus Gallus)
  misc_feature (36): n=c or t
agaaacaacaacgtgttttgtttcggctatatgtgnagcctggttgagctggatgatctccttcacaaaag

SEQ ID NO: 307 - DNA, 71 bp, chicken (Gallus Gallus)
  misc_feature (36): n=c or t
agaaagaaaatatatcaataacaacgtctcctttgngtcagcgtctcctttgccatcacagctcacaaaaa

SEQ ID NO: 308 - DNA, 71 bp, chicken (Gallus Gallus)
  misc_feature (36): n=a or g
agaaagaaggatggacttcactgtcaccttctgttntgatcacctgtgctgtggaattccctcatccagaa

SEQ ID NO: 309 - DNA, 71 bp, chicken (Gallus Gallus)
  misc_feature (36): n=c or t
agaaagcgttcctcttgctccgtgccagctccaatnccatttcaacacaggcagactggcttcctccctgt

SEQ ID NO: 310 - DNA, 71 bp, chicken (Gallus Gallus)
  misc_feature (36): n=a or g
agaaagctaattaaccaaactcaaatccagaaggtntactgtgctttctgcagtgcagagtattttttcaa

SEQ ID NO: 311 - DNA, 71 bp, chicken (Gallus Gallus)
  misc_feature (36): n=c or t
agaaatccatctcatatgggatttaaagtaaagttncccaagcctttggggagctcattcgttttgtttct

SEQ ID NO: 312 - DNA, 71 bp, chicken (Gallus Gallus)
  misc_feature (36): n=a or g
agaaatgattcttgaatgacatactaatctcttggncccctttatcttccaatgctctaacacatgggata

SEQ ID NO: 313 - DNA, 71 bp, chicken (Gallus Gallus)
  misc_feature (36): n=a or g
agaacgtgatggttgttgcacctgacttgtaatggnacataactaacagagcaccgtgtgattatgccttg

SEQ ID NO: 314 - DNA, 71 bp, chicken (Gallus Gallus)
  misc_feature (36): n=a or g
agaagggaagaaatgctggtgtgcccactctgttgnacccatggaaaggagacagctgctatgaggacaat

SEQ ID NO: 315 - DNA, 71 bp, chicken (Gallus Gallus)
  misc_feature (36): n=c or t
agaagggaataagtagtgggcagaattgtgcattanagaagctgcgtgtgttctagaagttagcaatattt

SEQ ID NO: 316 - DNA, 71 bp, chicken (Gallus Gallus)
  misc_feature (36): n=c or t
agacacagatcatactactgggatatttgtagatanaccaccagcttcgcactgcaagcagggctaaaaga

SEQ ID NO: 317 - DNA, 71 bp, chicken (Gallus Gallus)
  misc_feature (36): n=a or g
agacaaactcaagagcagctggggacagcaattacnagatgatcttgatttactccatgggggtggcatct

SEQ ID NO: 318 - DNA, 71 bp, chicken (Gallus Gallus)
  misc_feature (36): n=a or g
agacagcacttctatgccgtgactcctgtctccatntcttgccgctaagagcggggctaagcatagggtag

SEQ ID NO: 319 - DNA, 71 bp, chicken (Gallus Gallus)
  misc_feature (36): n=c or t
agaccctggccactagatgagctgtattttggctcnggagagcatgcaggccctgagtcctgcctccacga

SEQ ID NO: 320 - DNA, 71 bp, chicken (Gallus Gallus)
  misc_feature (36): n=g or t
agacgtgcaagttctggaacagacaagatgtccacnttctaaaaataccatgagttccaagtgtttcaata

SEQ ID NO: 321 - DNA, 71 bp, chicken (Gallus Gallus)
  misc_feature (36): n=a or g
agagcccaggtgtttaatgtggctttgaggaagacncagcagaaaagcaaagtgttaccctcagcacagcg

SEQ ID NO: 322 - DNA, 71 bp, chicken (Gallus Gallus)
  misc_feature (36): n=c or t
agagctgagggctttgttggttatgtggcactgagngtgcacggctccttgcctggctcaggaacagctct

SEQ ID NO: 323 - DNA, 71 bp, chicken (Gallus Gallus)
  misc_feature (36): n=a or g
agagctggctgcagtactccatctgctatagggacnttgctggaggtgagggtgtgtgtgggaggggaatt

SEQ ID NO: 324 - DNA, 71 bp, chicken (Gallus Gallus)
  misc_feature (36): n=c or t
agaggtctgatctcagataacttgatatcctagcanagtaaaatgatattaacagcctaatcagtagaaaa

SEQ ID NO: 325 - DNA, 71 bp, chicken (Gallus Gallus)
  misc_feature (36): n=a or g
agagttgccactcatgcaatcagttctcaggattantggtgtgtgagtttattttaagcacaggactaggg

SEQ ID NO: 326 - DNA, 71 bp, chicken (Gallus Gallus)
  misc_feature (36): n=a or g
agataagcacctaaatgctagctaaaggatgtgtcntaagtcacagtcaggaaaacatatccataatgacc

SEQ ID NO: 327 - DNA, 71 bp, chicken (Gallus Gallus)
  misc_feature (36): n=c or t
agatatttaaaagcagtttggattttgatagtttgnagctcattgtcaggggtcagagacatactaataaa

SEQ ID NO: 328 - DNA, 71 bp, chicken (Gallus Gallus)
  misc_feature (36): n=g or t
agatgaacacagcaatacattgtctggagagcctgngggtttccatccttggaggtattccaaacccaatt

SEQ ID NO: 329 - DNA, 71 bp, chicken (Gallus Gallus)
  misc_feature (36): n=c or t
agatgagttcatataaggtgtgatgtgagctgactngctctctgtgtctgtctctttccatctgtacgtca

SEQ ID NO: 330 - DNA, 71 bp, chicken (Gallus Gallus)
  misc_feature (36): n=a or g
agattaaattgttaatttctcagtaaaagtatttcnaatccaagaaattggtttacattttcaaccccaaa

SEQ ID NO: 331 - DNA, 71 bp, chicken (Gallus Gallus)
  misc_feature (36): n=a or g
agcaaatgagttatctgtaaaactgcttcagcattncaagctgctggttggccgaagcatttgtttggctc

SEQ ID NO: 332 - DNA, 71 bp, chicken (Gallus Gallus)
  misc_feature (36): n=g or t
agcagcctgaaatgcagcaacaccgagcttaaaagntggtgttgaaaacccagtcagagtgtgaagtctga

SEQ ID NO: 333 - DNA, 71 bp, chicken (Gallus Gallus)
  misc_feature (36): n=c or t
agcagtctgctgtaccaaagacaccatttcaagcantgaactataaacagaaatgcaagagcttacagtag

SEQ ID NO: 334 - DNA, 71 bp, chicken (Gallus Gallus)
  misc_feature (36): n=a or g
agcagtgcaggatctctggaacacagctcctgaaancacccttcacctgctttcatgggatttgtctatac

SEQ ID NO: 335 - DNA, 71 bp, chicken (Gallus Gallus)
  misc_feature (36): n=g or t
agcagttaagtactgcatatgctaccaatggatttntggggaagttgtaggttagtcatggatttaatatt

SEQ ID NO: 336 - DNA, 71 bp, chicken (Gallus Gallus)
  misc_feature (36): n=a or g
agcatgctgctctgagaagaacagattgctgcaacntatctattttctcagcagataaacatggctttttt

SEQ ID NO: 337 - DNA, 71 bp, chicken (Gallus Gallus)
  misc_feature (36): n=c or t
agcattctaataccttgttctggcaactctttccangtaaattaagccctgcttccaagttagcaggaatg

SEQ ID NO: 338 - DNA, 71 bp, chicken (Gallus Gallus)
  misc_feature (36): n=c or t
agccaactggttcctcacgctaaagaagaccacacngtggtcctcagcagtctgtcattcagatgatctac

SEQ ID NO: 339 - DNA, 71 bp, chicken (Gallus Gallus)
  misc_feature (36): n=a or g
agcctacctttgtttcttccacacttatctagttcncgcctgttgaacaagctgatatgaggtttataggc

SEQ ID NO: 340 - DNA, 71 bp, chicken (Gallus Gallus)
  misc_feature (36): n=c or t
agccttaagatttctcctcccaaggcctcatcgggnggcaaagctctgacaatggcccccaccttcggcca

SEQ ID NO: 341 - DNA, 71 bp, chicken (Gallus Gallus)
  misc_feature (36): n=a or g
agctcagctgtcacgaaaccttcattagaagagagncatcactacaagccacctgagtcatgaaagccacc

SEQ ID NO: 342 - DNA, 71 bp, chicken (Gallus Gallus)
  misc_feature (36): n=c or t
agctcttggttccacctggcttcgtagcacgcaaangcacaccttgccccgttgtccccctctcttctctc

SEQ ID NO: 343 - DNA, 71 bp, chicken (Gallus Gallus)
  misc_feature (36): n=a or g
agctgatagtcaccgaagggagctgtgtttggatangaagtgtgggaggccatatgggacatcctggatac

SEQ ID NO: 344 - DNA, 71 bp, chicken (Gallus Gallus)
  misc_feature (36): n=a or g
agctgggacttactgagaagagaagctcataagctntgtacaaaggattgctctttgaagtagtaatttgt

SEQ ID NO: 345 - DNA, 71 bp, chicken (Gallus Gallus)
  misc_feature (36): n=a or g
agctgtttgctgtgagcaatttagaaaatatccctngagttaaatacacatcctatacctcctgcagtttc

SEQ ID NO: 346 - DNA, 71 bp, chicken (Gallus Gallus)
  misc_feature (36): n=a or g
agcttcagctctgaacgccatggccttaaattaaangcttacaagacagcatctacttaaagaaaatcctg

SEQ ID NO: 347 - DNA, 71 bp, chicken (Gallus Gallus)
  misc_feature (36): n=a or g
aggaagggggaaaggagctgagcttagattttcagnctacgtgagaggagcaaaacactatgatttgtggt

SEQ ID NO: 348 - DNA, 71 bp, chicken (Gallus Gallus)
  misc_feature (36): n=g or t
aggacagtgaaacggttatggtttatataactgttngctctgtattacagtcaggggagacacttctaacg

SEQ ID NO: 349 - DNA, 71 bp, chicken (Gallus Gallus)
  misc_feature (36): n=c or t
aggacgatttaaaattcaggaggatttaaaattaangattactgagtagcaaacaaagcaaagttagtgta

SEQ ID NO: 350 - DNA, 71 bp, chicken (Gallus Gallus)
  misc_feature (36): n=c or t
aggagttagctgatagaagcacagacaggtttttcntgttctagagagccccaagcccactaaagcagccc

SEQ ID NO: 351 - DNA, 71 bp, chicken (Gallus Gallus)
  misc_feature (36): n=c or t
aggattttggcctggaattgtgagatctggttcatngcttgggatcttcatgcagctgggaaacaagaaga

SEQ ID NO: 352 - DNA, 71 bp, chicken (Gallus Gallus)
  misc_feature (36): n=c or t
aggcagagcaatagtgtacttttgaccacaggttgncagctagcacttactgacaattaaatatgtccttc

SEQ ID NO: 353 - DNA, 71 bp, chicken (Gallus Gallus)
  misc_feature (36): n=c or t
aggcagtaagaaagctgaaccaactttctcaaacanaaagtagtatacagacaatacaaggtttaagagaa

SEQ ID NO: 354 - DNA, 71 bp, chicken (Gallus Gallus)
  misc_feature (36): n=c or t
agggaaactattaatcatgttgttctaaaatgatgntggaaagttgtagggttatgagtgtgagatctcct

SEQ ID NO: 355 - DNA, 71 bp, chicken (Gallus Gallus)
  misc_feature (36): n=c or t
agggaatagaattatagctaagcctgcaattaaaanatgcttcatatgtgtatgcttcatattatatgatt

SEQ ID NO: 356 - DNA, 71 bp, chicken (Gallus Gallus)
  misc_feature (36): n=a or g
agggacacacagtgttaaactaatggttgtctgtcngtgtcagtcagggaactggtggaactgaggaaaaa

SEQ ID NO: 357 - DNA, 71 bp, chicken (Gallus Gallus)
  misc_feature (36): n=c or t
agggagagatgccatctccgaccaagaatggacctnagaatgactgctattggcaaggctccattctgcca

SEQ ID NO: 358 - DNA, 71 bp, chicken (Gallus Gallus)
  misc_feature (36): n=a or g
agggcatactaaaggtaagcctaaacactggattanggacatattaaaaataaaactgcatttagagaatg

SEQ ID NO: 359 - DNA, 71 bp, chicken (Gallus Gallus)
  misc_feature (36): n=c or t
agggcctacagaagctgtgatgtgtaacagatactncagttagccacagcagtgcctgggatagaaaatag

SEQ ID NO: 360 - DNA, 71 bp, chicken (Gallus Gallus)
  misc_feature (36): n=c or t
agggggttgagacttggtttgctttcagagcccagncaccccatcagcagctagcaaaaaggactctgggt

SEQ ID NO: 361 - DNA, 71 bp, chicken (Gallus Gallus)
  misc_feature (36): n=c or t
aggggtgttcagttcctcttccattccttgtttcangtggaaccaaagctttcacttttgattcaggcagc

SEQ ID NO: 362 - DNA, 71 bp, chicken (Gallus Gallus)
  misc_feature (36): n=c or t
agggtaagatcctggggcttagagctcagatccacncgacctgagaggctgactgaccttctgttctctcc

SEQ ID NO: 363 - DNA, 71 bp, chicken (Gallus Gallus)
  misc_feature (36): n=a or c
aggtcggtcagtctctcagagtagcatgtaagtggncagctgacagtctattaaagactgcatgaggtttc

SEQ ID NO: 364 - DNA, 71 bp, chicken (Gallus Gallus)
  misc_feature (36): n=a or g
aggtgcatttggaaaggtgtatttggaaagcaaacnccagtgttgtttggggatggaatttccagctgctg

SEQ ID NO: 365 - DNA, 71 bp, chicken (Gallus Gallus)
  misc_feature (36): n=a or c
aggtggaatattgtagtcatcatacttatcatagtnattttatattgttatttaaaataaatgccttgttt

SEQ ID NO: 366 - DNA, 71 bp, chicken (Gallus Gallus)
  misc_feature (36): n=a or g
aggtttggtagcaaagatgagaggtggaaagtgaangaagagtcagcttggggagtactgtaggctgtctc

SEQ ID NO: 367 - DNA, 71 bp, chicken (Gallus Gallus)
  misc_feature (36): n=c or t
agtaaacgtgatctgtacagcactttaaggagacanacacccaaaggaacctaaccaggcactgaaggctg

SEQ ID NO: 368 - DNA, 71 bp, chicken (Gallus Gallus)
  misc_feature (36): n=g or t
agtaagaccatggaagaaccgatcttgaactagtgntgtgatgggggccagtagaagggacaatgtatgtg

SEQ ID NO: 369 - DNA, 71 bp, chicken (Gallus Gallus)
  misc_feature (36): n=a or g
agtaatccctcagacttttcttcaaacacattaccnaccacagataagcaaggataaaatttatctccaag

SEQ ID NO: 370 - DNA, 71 bp, chicken (Gallus Gallus)
  misc_feature (36): n=g or t
agtacaaagcctggagcactcacaaacacagcttgngcacagcccaggtgcaatgtagtgcacagcaggct

SEQ ID NO: 371 - DNA, 71 bp, chicken (Gallus Gallus)
  misc_feature (36): n=a or c
agtactggttaaggaagcatggactaatacatatangctgcatctgctatctgtgctgctgcactaagagg

SEQ ID NO: 372 - DNA, 71 bp, chicken (Gallus Gallus)
  misc_feature (36): n=a or g
agtatactgaaatacgctctgcaaaagagccctacnttactgtgctcttctgccagtagagctcagataat

SEQ ID NO: 373 - DNA, 71 bp, chicken (Gallus Gallus)
  misc_feature (36): n=a or c
agtcatgcagaaggccacaggattagcaggtcttanagaatcacaatgaaattgataggatgcacaaagaa

SEQ ID NO: 374 - DNA, 71 bp, chicken (Gallus Gallus)
  misc_feature (36): n=a or g
agtcattgttttttcatagctaacttgcatgtcctncaaagtaaatcttcatatattcaaaacaaagacac

SEQ ID NO: 375 - DNA, 71 bp, chicken (Gallus Gallus)
  misc_feature (36): n=a or g
agtctgttgttagggtctagatctactacagcatgncttctattatgccagcagaggatcatagaattgtt

SEQ ID NO: 376 - DNA, 71 bp, chicken (Gallus Gallus)
  misc_feature (36): n=c or t
agtgcttcagatggaataaattttttctacgtatgngctgcacggctgtgtgattttgtgctgatgttttc

SEQ ID NO: 377 - DNA, 71 bp, chicken (Gallus Gallus)
  misc_feature (36): n=a or c
agtgagaaagaagaaaatcgttgaaagctggatggngtgccagtactgaagccaggaacataacacaggtt

SEQ ID NO: 378 - DNA, 71 bp, chicken (Gallus Gallus)
  misc_feature (36): n=c or t
agtgtagctgtaaatcttgattcaaaactattaaangtagatatttgaactgaagaattgagagaagaaca

SEQ ID NO: 379 - DNA, 71 bp, chicken (Gallus Gallus)
  misc_feature (36): n=a or g
agtgtcactctttgcccaaactcatgagctggactnaaaaactggtcaggatctagtccacaaccctgcta

SEQ ID NO: 380 - DNA, 71 bp, chicken (Gallus Gallus)
  misc_feature (36): n=a or g
agttatggtggtttttctttctcagttaaaactacnttgatctgttgtaaaaataactgtagtatttttat

SEQ ID NO: 381 - DNA, 71 bp, chicken (Gallus Gallus)
  misc_feature (36): n=a or c
agttctcccacaccacagcagtatgaccttatcagngggagaagcccgcccagctgagcccactcacccat

SEQ ID NO: 382 - DNA, 71 bp, chicken (Gallus Gallus)
  misc_feature (36): n=c or t
agttcttccgaatgttgataggccctattatctcangtctgtctggacagtaacggtcagggtgactaagt

SEQ ID NO: 383 - DNA, 71 bp, chicken (Gallus Gallus)
  misc_feature (36): n=a or g
agttgtgcagagtattccaccagagcatttgagtangcagcccgtgaagctgaatttcttgtaccacagac

SEQ ID NO: 384 - DNA, 71 bp, chicken (Gallus Gallus)
  misc_feature (36): n=c or t
agtttaaatgtcttcagaaaaggtcaaattatctangcttaagacccactaaacacacaggcactatcacc

SEQ ID NO: 385 - DNA, 71 bp, chicken (Gallus Gallus)
  misc_feature (36): n=g or t
agtttgccaactacactcttctcagttcagtgaaancaacagttaagctccatatagcaaaacagatgcaa

SEQ ID NO: 386 - DNA, 71 bp, chicken (Gallus Gallus)
  misc_feature (36): n=a or c
agtttgtccgtctgtctgacttggttaaaggagcantgagacataatgctctggggcagaaatttcttccc

SEQ ID NO: 387 - DNA, 71 bp, chicken (Gallus Gallus)
  misc_feature (36): n=g or t
agttttcctttgctggagaaacccttgagggaaacngtgtgcatgtgccctttccacccatcttttctaca

SEQ ID NO: 388 - DNA, 71 bp, chicken (Gallus Gallus)
  misc_feature (36): n=a or g
ataaaaacaggtgtttctttccatctggtgccacantagctatcgtaagttggaggagatgaatcagagtg

SEQ ID NO: 389 - DNA, 71 bp, chicken (Gallus Gallus)
  misc_feature (36): n=c or t
ataaacatggatgcctgtgtcttcagatgttcttanaaaatgtgaagtagctttctcagatgtcttcatgt

SEQ ID NO: 390 - DNA, 71 bp, chicken (Gallus Gallus)
  misc_feature (36): n=a or g
ataacagcaaagctgatccttcttgtaatgcagagngtgtcagtagtgaattaattacctgcacagaaggc

SEQ ID NO: 391 - DNA, 71 bp, chicken (Gallus Gallus)
  misc_feature (36): n=c or t
ataagtagatgaataagagagactgaaatacaaatnaatagaaagactcttcagtcttctctgatagacca

SEQ ID NO: 392 - DNA, 71 bp, chicken (Gallus Gallus)
  misc_feature (36): n=a or c
ataagttccatagaaatggaagagctacaggagaanagtgcaacaggtggtccaagacactgcctagggat

SEQ ID NO: 393 - DNA, 71 bp, chicken (Gallus Gallus)
  misc_feature (36): n=a or g
atacaaattaacagcctcttgcgtgtctgcccattnccctcaccatctgctgcgggagctgatcaaaggga

SEQ ID NO: 394 - DNA, 71 bp, chicken (Gallus Gallus)
  misc_feature (36): n=g or t
atacaagtctgaatgtggatggattcatcatgttanctgtcataaattttaacttgtgttgttgtgataga

SEQ ID NO: 395 - DNA, 71 bp, chicken (Gallus Gallus)
  misc_feature (36): n=a or g
atacagcaacagtgatgagatggtccctggaaaatnccataaagaaacagaaaatcttttggaatgtagaa

SEQ ID NO: 396 - DNA, 71 bp, chicken (Gallus Gallus)
  misc_feature (36): n=c or t
atacctctgattcactgtttgtaagatttccataangtgttatgctggggttacttctgtgcttttattgc

SEQ ID NO: 397 - DNA, 71 bp, chicken (Gallus Gallus)
  misc_feature (36): n=a or g
atacttgggcattgttttattctcagttacaggganaaggacagcaccagctgcatcgctatctttagccc

SEQ ID NO: 398 - DNA, 71 bp, chicken (Gallus Gallus)
  misc_feature (36): n=g or t
atagtagacaacaaaacctatctatcattatttacncactcatcaaagctataaaaacagtttactgtgta

SEQ ID NO: 399 - DNA, 71 bp, chicken (Gallus Gallus)
  misc_feature (36): n=a or g
atattttctccacccttctttatttcttgagactcnggagagctggaaaagaaatggaggaattccagtgc

SEQ ID NO: 400 - DNA, 71 bp, chicken (Gallus Gallus)
  misc_feature (36): n=a or g
atcacaggtttaatacataacagtgctaaagaactntttctgcaagagctacgatgcaactatctatctgc

SEQ ID NO: 401 - DNA, 71 bp, chicken (Gallus Gallus)
  misc_feature (36): n=a or g
atcagataaaaccaataatctgtgatgagctttacngacacacagaaaagtcaaaccgtgcaacaaaagac

SEQ ID NO: 402 - DNA, 71 bp, chicken (Gallus Gallus)
  misc_feature (36): n=c or t
atcagctctgtatataatcacatttctaccaccagnctgggaggaaacagcagcaaaggtgactgatatta

SEQ ID NO: 403 - DNA, 71 bp, chicken (Gallus Gallus)
  misc_feature (36): n=c or t
atcagtaagtcaactcgggctcctatttttactttncatgtccctgaattagggacctcagctgagtgagt

SEQ ID NO: 404 - DNA, 71 bp, chicken (Gallus Gallus)
  misc_feature (36): n=a or g
atcatgtcaaccagaaacaggttgggatgaagaacnggagagagcaagggacaatgtaggttagctttact

SEQ ID NO: 405 - DNA, 71 bp, chicken (Gallus Gallus)
  misc_feature (36): n=a or g
atccattgacatatagatcattaacaaaacaactcnggcatagcctagccttgaagaaggtcagcttgaaa

SEQ ID NO: 406 - DNA, 71 bp, chicken (Gallus Gallus)
  misc_feature (36): n=c or t
atccctaatagctgagcaaccctcagcagtgcttcnaacaagactgaggtctatcatatatattttctgtt

SEQ ID NO: 407 - DNA, 71 bp, chicken (Gallus Gallus)
  misc_feature (36): n=c or t
atcctcctaaattctggagtctccagaatattcatntattacatttctaagcttcagcttctgccaagtgt

SEQ ID NO: 408 - DNA, 71 bp, chicken (Gallus Gallus)
  misc_feature (36): n=a or g
atctcaaaccttagctgcatctcttatctatatacntatgtatgcacacgcagcacagactgccctgtaaa

SEQ ID NO: 409 - DNA, 71 bp, chicken (Gallus Gallus)
  misc_feature (36): n=a or c
atctcaatagcctactaaattaaggagagctactgnaataaacctgggctgcgtgttactagcatggtatt

SEQ ID NO: 410 - DNA, 71 bp, chicken (Gallus Gallus)
  misc_feature (36): n=c or t
atctcccaggaaactgcccttaggaacagtgtaacngaacacagctggcagaactttaagaatgcctttct

SEQ ID NO: 411 - DNA, 71 bp, chicken (Gallus Gallus)
  misc_feature (36): n=c or t
atcttttcatatttccaagaagaacataagagacangtagcttcattagctttcctgttaatgtttttaac

SEQ ID NO: 412 - DNA, 71 bp, chicken (Gallus Gallus)
  misc_feature (36): n=c or t
atgactatgatgacttaaaatagaagctcagcccanatgcagaatctgtggacacagaaataaaggaaaaa

SEQ ID NO: 413 - DNA, 71 bp, chicken (Gallus Gallus)
  misc_feature (36): n=c or t
atgactttcttctcttggtgttttcttgaacgatancatgctgtattctgtttgcttgtgccttacagtgc

SEQ ID NO: 414 - DNA, 71 bp, chicken (Gallus Gallus)
  misc_feature (36): n=c or t
atgagaatgagtggatgacgcctactagcaaagctntaacatgtaatccctgacctaactgttctgaaaca

SEQ ID NO: 415 - DNA, 71 bp, chicken (Gallus Gallus)
  misc_feature (36): n=a or g
atgagctgtactgccagtcgtgacagacatttgtantatgtgatgtacagtgagatgaacaactgttaatt

SEQ ID NO: 416 - DNA, 71 bp, chicken (Gallus Gallus)
  misc_feature (36): n=c or t
atgatgttaaaacttaaaggactgttttaagtcacnggggttagaaatgtctggaaacttattaaattaaa

SEQ ID NO: 417 - DNA, 71 bp, chicken (Gallus Gallus)
  misc_feature (36): n=a or g
atgattttacaaaacaaggcaatacagatcaggcangggaagcttaagatggatgtcaaggaagaagaatt

SEQ ID NO: 418 - DNA, 71 bp, chicken (Gallus Gallus)
  misc_feature (36): n=g or t
atgcacatgcatcttccttgtctgaagagtgagctntggtgggctagcaggcttgctgccccatcaataga

SEQ ID NO: 419 - DNA, 71 bp, chicken (Gallus Gallus)
  misc_feature (36): n=c or t
atgcagcagagctgttgaaaattgaagatttgagangttccatttagacagtactggcatggtttaaggca

SEQ ID NO: 420 - DNA, 71 bp, chicken (Gallus Gallus)
  misc_feature (36): n=a or g
atgcagttcttaaaaaacaaagtcagatgaacagcntgaaccaggctggaatgcatacatatgcccttcaa

SEQ ID NO: 421 - DNA, 71 bp, chicken (Gallus Gallus)
  misc_feature (36): n=a or g
atggcaggtgcaactccaggagatggaataattcantatctgcagtcagctcaataaacatgaatatggct

SEQ ID NO: 422 - DNA, 71 bp, chicken (Gallus Gallus)
  misc_feature (36): n=c or t
atgggaatttgggagaagagatgacatttttgtttncctcccttctcccaccaaaaccaacataaaattct

SEQ ID NO: 423 - DNA, 71 bp, chicken (Gallus Gallus)
  misc_feature (36): n=a or g
atgggagcattgatgcagatcacggaaaccaagctncagcaagatcattcctgggatttgttgaagattct

SEQ ID NO: 424 - DNA, 71 bp, chicken (Gallus Gallus)
  misc_feature (36): n=a or g
atgggctagtcgtggcaatacatctgcaagttagancatcctgtggaagcagaataaagaagcaacaaagc

SEQ ID NO: 425 - DNA, 71 bp, chicken (Gallus Gallus)
  misc_feature (36): n=c or t
atgggctataaaaagaagagttattaagctgttctngagttgcagtctcaacacttggctaagtctttagg

SEQ ID NO: 426 - DNA, 71 bp, chicken (Gallus Gallus)
  misc_feature (36): n=a or c
atggtctgcatcaggatttgagatgtagagttaganccgctcttagctttttcatgcagtagggtgccacg

SEQ ID NO: 427 - DNA, 71 bp, chicken (Gallus Gallus)
  misc_feature (36): n=a or g
atgtagttttttctattacataataccaagatactnaagtgcttgtggaccagagttactgtagtttaact

SEQ ID NO: 428 - DNA, 71 bp, chicken (Gallus Gallus)
  misc_feature (36): n=a or g
atgttagtgcagcttgataatatcaattagactgcnaagctttattttaagttttctgaactatcactact

SEQ ID NO: 429 - DNA, 71 bp, chicken (Gallus Gallus)
  misc_feature (36): n=c or t
atgttccctgttctgatttgttctgattgaaaagangactgaaaggaacagaagcataactgtctgcattg

SEQ ID NO: 430 - DNA, 71 bp, chicken (Gallus Gallus)
  misc_feature (36): n=a or g
atgtttgaactacatttggcttagattatctgattntccatgcaactagtcaaaacagcaacagctgaaag

SEQ ID NO: 431 - DNA, 71 bp, chicken (Gallus Gallus)
  misc_feature (36): n=c or t
atgttttataactgtgctgttgccagtcattttgcngagacagtggggaatttggagctattcagctttta

SEQ ID NO: 432 - DNA, 71 bp, chicken (Gallus Gallus)
  misc_feature (36): n=c or t
attaaaaaaaacccaaataattaacaactgtccttncccagtgtttcttctgagcaggctcaagctgcaat

SEQ ID NO: 433 - DNA, 71 bp, chicken (Gallus Gallus)
  misc_feature (36): n=a or g
attaaatactgttcacaagacgctttcatttgtaangaagcttaattggaatgtcctcctaataaccttgt

SEQ ID NO: 434 - DNA, 71 bp, chicken (Gallus Gallus)
  misc_feature (36): n=a or g
attaaggttctatttgttttggattcagggccaacnaagctgtcactgtaggtataaacacgctctgggct

SEQ ID NO: 435 - DNA, 71 bp, chicken (Gallus Gallus)
  misc_feature (36): n=a or g
attaccataaatgatgcagacaagtccagatctagnagcagcttttcctctttcatcccaagccagtcgtg

SEQ ID NO: 436 - DNA, 71 bp, chicken (Gallus Gallus)
  misc_feature (36): n=c or t
attacgcaacatacccttcttttggaggtacatatnagaaaggacagtcctatacctgtctgatccctatc

SEQ ID NO: 437 - DNA, 71 bp, chicken (Gallus Gallus)
  misc_feature (36): n=c or t
attatcggtgtttgtgggcatgcctactgtaagaangaagtatgagaaaatatgtgaaagaaggggataat

SEQ ID NO: 438 - DNA, 71 bp, chicken (Gallus Gallus)
  misc_feature (36): n=a or g
tttcatacatacacgagaatatgtgcaaaaaagctnagcagttctaacacctatcaggaagacaatacata

SEQ ID NO: 439 - DNA, 71 bp, chicken (Gallus Gallus)
  misc_feature (36): n=c or t
attccatctgggttaaaaaccagttgcctgttgaancactacaggcatgttgcagctcactctacaagcca

SEQ ID NO: 440 - DNA, 71 bp, chicken (Gallus Gallus)
  misc_feature (36): n=a or g
attccttccaggaaggctacctttttttttaactcncctcactaggcagctagataaattactgtgtggtg

SEQ ID NO: 441 - DNA, 71 bp, chicken (Gallus Gallus)
  misc_feature (36): n=a or g
attgaaacagagctcatactcagtctgtgcagaaangaggtgtgagcagggcaacactcatctgaagggaa

SEQ ID NO: 442 - DNA, 71 bp, chicken (Gallus Gallus)
  misc_feature (36): n=a or g
attgaatgagttaggtaaagctcagacagacctgtncaaaacaagcaatgagactggtcatcagatcttgt

SEQ ID NO: 443 - DNA, 71 bp, chicken (Gallus Gallus)
  misc_feature (36): n=c or t
attggagcagggagtggtggtagtttgcatcatttnctactgaaatactgagctgtgggggaactgtggac

SEQ ID NO: 444 - DNA, 71 bp, chicken (Gallus Gallus)
  misc_feature (36): n=a or g
attgtgctttttgttggccatggtttggcaagagcngagttctcctgtgttgctgcactcagcagctttca

SEQ ID NO: 445 - DNA, 71 bp, chicken (Gallus Gallus)
  misc_feature (36): n=c or t
atttagaatatatgtgggaaattacttattttatangcttagcaataagcaacatttctaaacaagcacag

SEQ ID NO: 446 - DNA, 71 bp, chicken (Gallus Gallus)
  misc_feature (36): n=g or t
atttatgatgaaccctgtctgggtactgtagtttanatcagcagacagctaagcaccacacagctatttgc

SEQ ID NO: 447 - DNA, 71 bp, chicken (Gallus Gallus)
  misc_feature (36): n=g or t
atttcaattaagtatacttaacaaagtgatcacagnaatctctgaattgtaggacttatgtcagggagttg

SEQ ID NO: 448 - DNA, 71 bp, chicken (Gallus Gallus)
  misc_feature (36): n=c or t
attttaaacaataaaaagctccaggtagcttaggangttcctagttaataaccatagctttcctctaccat

SEQ ID NO: 449 - DNA, 71 bp, chicken (Gallus Gallus)
  misc_feature (36): n=c or t
attttgtagctttacattagccaacaatgcaactantactttaaaaggcttaaaaaaacatatatgctgaa

SEQ ID NO: 450 - DNA, 71 bp, chicken (Gallus Gallus)
  misc_feature (36): n=c or t
attttttatagtgtagtaaggaaagctccaggatgnctcaatgttgggctgctgcacatcaccctggtggg

SEQ ID NO: 451 - DNA, 71 bp, chicken (Gallus Gallus)
  misc_feature (36): n=c or t
caaaaaaaaaatgccgtaggaaaaagaaaagttaantttatgcctgctgagggtgtcacagctggagagga

SEQ ID NO: 452 - DNA, 71 bp, chicken (Gallus Gallus)
  misc_feature (36): n=c or t
caaacatacactgagtggtttattccagtcctacanaaaaatgggaaaaaagcccatccaaaatttcagat

SEQ ID NO: 453 - DNA, 71 bp, chicken (Gallus Gallus)
  misc_feature (36): n=a or c
caaactaatttattcttgagtaattctagtttcttncgatacctgggtcaaaccttaacaccaaaagtata

SEQ ID NO: 454 - DNA, 71 bp, chicken (Gallus Gallus)
  misc_feature (36): n=c or t
caaactttgttgtgctgtatttcctccagtacacangtacttcacgccaggctgcattgtcagagctgtct

SEQ ID NO: 455 - DNA, 71 bp, chicken (Gallus Gallus)
  misc_feature (36): n=c or t
caaagcaggatttcaagactacagaagctgtcaagngagttaggaacttgcatacagtttgttcatgagtt

SEQ ID NO: 456 - DNA, 71 bp, chicken (Gallus Gallus)
  misc_feature (36): n=a or g
caaaggggcatgttcagaaggtagttgaaatctggnccggtagctgcagctgattcttcaccactctcatc

SEQ ID NO: 457 - DNA, 71 bp, chicken (Gallus Gallus)
  misc_feature (36): n=a or c
caaattaatgctggtagataggagatggagcttagncctgttatcctagacagaagagcgcataaagtcat

SEQ ID NO: 458 - DNA, 71 bp, chicken (Gallus Gallus)
  misc_feature (36): n=a or g
caacacattcactgttgcatttatagaaacattagntgcctcagaaactgtagctttctaggttattatag

SEQ ID NO: 459 - DNA, 71 bp, chicken (Gallus Gallus)
  misc_feature (36): n=c or t
caacatcctttttggaaagcttatcaatgtagcatncacactaattcactccatacagaaaccgacggctc

SEQ ID NO: 460 - DNA, 71 bp, chicken (Gallus Gallus)
  misc_feature (36): n=g or t
caagagtcactcagaacctcataaggagaatgagtntcccttggcagcagctgacctgtggcaatattata

SEQ ID NO: 461 - DNA, 71 bp, chicken (Gallus Gallus)
  misc_feature (36): n=a or g
caagctgttattttaaggcctgtaaacacccatccntgctttgacacctccttttccaacaccagggactc

SEQ ID NO: 462 - DNA, 71 bp, chicken (Gallus Gallus)
  misc_feature (36): n=c or t
caagccttatactctttttcaacaatgtaaagaaanagaatagctgaaatgttccttagcaacacaaaaga

SEQ ID NO: 463 - DNA, 71 bp, chicken (Gallus Gallus)
  misc_feature (36): n=c or t
caaggtactaagaagtggaaaagccattgagctgcngcagcacagtttcttcaccatttgaattctgccct

SEQ ID NO: 464 - DNA, 71 bp, chicken (Gallus Gallus)
  misc_feature (36): n=a or c
caaggtatgtagctacacccgtcagccagttttctntccctgcctctaaaagtccacgatccaatctttca

SEQ ID NO: 465 - DNA, 71 bp, chicken (Gallus Gallus)
  misc_feature (36): n=a or c
caattgctgctttaatgtgaggataaagccactgcngtctgggagcttgttctaggctgtatgtgagcttt

SEQ ID NO: 466 - DNA, 71 bp, chicken (Gallus Gallus)
  misc_feature (36): n=a or g
caagtcttctttagctgctggttttgtgtaactatncataagaagctgtatagcagaaaaaaatctttcag

SEQ ID NO: 467 - DNA, 71 bp, chicken (Gallus Gallus)
  misc_feature (36): n=c or t
caatacctgcagtaatgccgtctgctggaatgaatnctcggccacaaaacattatttttcaatatagtcac

SEQ ID NO: 468 - DNA, 71 bp, chicken (Gallus Gallus)
  misc_feature (36): n=c or t
caatccatattacttggcttaagcactgttctttangtagcactgcaaaacaaagatacagaaacatttca

SEQ ID NO: 469 - DNA, 71 bp, chicken (Gallus Gallus)
  misc_feature (36): n=a or g
cacaatattccaacattgctaccataatttccaacncactaaagtcagtatttggtcctatacatagttcc

SEQ ID NO: 470 - DNA, 71 bp, chicken (Gallus Gallus)
  misc_feature (36): n=a or g
cacacaagattatctcactggaacatgggcatcctntcaggatgtgctctcttcttctgggtcatggtgcc

SEQ ID NO: 471 - DNA, 71 bp, chicken (Gallus Gallus)
  misc_feature (36): n=g or t
cacagaacacattcctcagcatcagaaacaaagctnggcatcaccttggacggttttgccgaggtagtctc

SEQ ID NO: 472 - DNA, 71 bp, chicken (Gallus Gallus)
  misc_feature (36): n=a or c
cacagagaatctgcaaacattgttccttacagctancaggagtactcccagaggtcccttcccctccatca

SEQ ID NO: 473 - DNA, 71 bp, chicken (Gallus Gallus)
  misc_feature (36): n=a or c
cacagctgtcgtctgtctccaacagaaggaaaaagnaaagaggtggggaagggaaaaagcgactgcagaac

SEQ ID NO: 474 - DNA, 71 bp, chicken (Gallus Gallus)
  misc_feature (36): n=a or g
cacatggagtagcttcctgccttctagagtctgctntgataggacaaggggaaatggttccaaactaaaag

SEQ ID NO: 475 - DNA, 71 bp, chicken (Gallus Gallus)
  misc_feature (36): n=a or g
cacatgttgcagactgagtgctaatggcaacatggnccattctggtaggaagctaccatgcaccagtaaag

SEQ ID NO: 476 - DNA, 71 bp, chicken (Gallus Gallus)
  misc_feature (36): n=c or t
caccacacatgagtgcctgaaggataacaaacaacnactggtttcacgctgacagtgcagctcatcaccat

SEQ ID NO: 477 - DNA, 71 bp, chicken (Gallus Gallus)
  misc_feature (36): n=a or g
cacctacaagcagcctatttgtacaggaacaactcnagaaaggcaaaccaggtgctactgtagccaagcag

SEQ ID NO: 478 - DNA, 71 bp, chicken (Gallus Gallus)
  misc_feature (36): n=a or g
caccttctgtctttcagtacattggtagcttggacntacccaggcccagcagccgcgtggagatcgtggca

SEQ ID NO: 479 - DNA, 71 bp, chicken (Gallus Gallus)
  misc_feature (36): n=c or t
caccttgactcttctgctctgatatcctttatctgngagctcctgaaaactggcattggctaggagagata

SEQ ID NO: 480 - DNA, 71 bp, chicken (Gallus Gallus)
  misc_feature (36): n=a or g
cactagtttaaggaaaagctaaagtactgaacattnaggtaagccagcaaataagtacagtggtggacatc

SEQ ID NO: 481 - DNA, 71 bp, chicken (Gallus Gallus)
  misc_feature (36): n=g or t
cactgatttctccaagaaaaaatagacatgtgcagnctgaagagaagctggggagtgcttcacttgagata

SEQ ID NO: 482 - DNA, 71 bp, chicken (Gallus Gallus)
  misc_feature (36): n=c or t
cagaaaggtagatgctggccaacacaaattctgcangaaaatcgagaacaagattaatcataaggcagctc

SEQ ID NO: 483 - DNA, 71 bp, chicken (Gallus Gallus)
  misc_feature (36): n=g or t
cagaagtctttcagtagtacccactgtgcacccatnaccagatgaagctgttagagttgaaaaaaacaaac

SEQ ID NO: 484 - DNA, 71 bp, chicken (Gallus Gallus)
  misc_feature (36): n=c or t
cagaatatcttgtttcaaatccgtatctgcgctggnggtggcagtcgggtgctctgagtagttccgtacaa

SEQ ID NO: 485 - DNA, 71 bp, chicken (Gallus Gallus)
  misc_feature (36): n=a or g
cagaattcagactttctcaaacacttggagtacatnattgtatatagcccttagcttcatccacagctaca

SEQ ID NO: 486 - DNA, 71 bp, chicken (Gallus Gallus)
  misc_feature (36): n=c or t
cagacaattctctccacgttatatttatatgtattngttctcaagatgtcgtgttccacctcagccttttg

SEQ ID NO: 487 - DNA, 71 bp, chicken (Gallus Gallus)
  misc_feature (36): n=a or g
cagacattgtgccagctaatataaagccagtcaaancaaccttttcacagaaatattacacagaaatgtat

SEQ ID NO: 488 - DNA, 71 bp, chicken (Gallus Gallus)
  misc_feature (36): n=c or t
cagagcaggaatttctcacagtttatgagatctcgnaggatcagtaacagtgttgtgaaagactgcatgac

SEQ ID NO: 489 - DNA, 71 bp, chicken (Gallus Gallus)
  misc_feature (36): n=a or g
cagagttgagtgaacaaggcatatctagtttcagtngggtgatgtaacgtgacttcagtgacagggcacct

SEQ ID NO: 490 - DNA, 71 bp, chicken (Gallus Gallus)
  misc_feature (36): n=a or g
cagcagaaagtcatcactcttggtgccacgtgtcantatgtccatacagaagctagcagtgtaattaagga

SEQ ID NO: 491 - DNA, 71 bp, chicken (Gallus Gallus)
  misc_feature (36): n=a or c
cagcatcctatttgagcctccctgtggatccttgcntctcaactccattaacaaaaaggaaggactctgtc

SEQ ID NO: 492 - DNA, 71 bp, chicken (Gallus Gallus)
  misc_feature (36): n=a or g
cagcatttgctatgaatcattggttcatggcagctntggaaggagggggtggtcataaagggcagccaggg

SEQ ID NO: 493 - DNA, 71 bp, chicken (Gallus Gallus)
  misc_feature (36): n=a or g
cagccaaacctctgcaattcccttaagcacaatgcntcactagggtgagacccagaataacctgcagctgc

SEQ ID NO: 494 - DNA, 71 bp, chicken (Gallus Gallus)
  misc_feature (36): n=a or g
cagccagagagctgacaaataaaactattcaaactntaatttcctccgtaaccaagaaatatctcaggggt

SEQ ID NO: 495 - DNA, 71 bp, chicken (Gallus Gallus)
  misc_feature (36): n=a or g
caggaacagcttgtttcagttctcacacagaacacncagaaagcatagagctcaggctctgggtggtatag

SEQ ID NO: 496 - DNA, 71 bp, chicken (Gallus Gallus)
  misc_feature (36): n=a or c
caggaatcattgaatcaaagctggaaagatcactgngatcatccagtccgaccatcagcccatccccactc

SEQ ID NO: 497 - DNA, 71 bp, chicken (Gallus Gallus)
  misc_feature (36): n=a or g
caggaatggtatcatggtgctctgaaagagctgganaacaaaacaaagcactatactccactgatatgtga

SEQ ID NO: 498 - DNA, 71 bp, chicken (Gallus Gallus)
  misc_feature (36): n=g or t
caggtattaaaacagggtttagaatgttcttaaaantgtatgtagcattttagctactacagtgtttttct

SEQ ID NO: 499 - DNA, 71 bp, chicken (Gallus Gallus)
  misc_feature (36): n=c or t
caggtttcctttttttggcggaacagcagagaaaangacggtgaattaaggcaagatctatggctccaggt

SEQ ID NO: 500 - DNA, 71 bp, chicken (Gallus Gallus)
  misc_feature (36): n=a or g
cagtaaccagcagtgatgctaatacaatgaaaggcnatcagatgcccggaggtcttacctggtgcaccaga

SEQ ID NO: 501 - DNA, 71 bp, chicken (Gallus Gallus)
  misc_feature (36): n=a or g
cagtatttgctattttgttttgagactgtgccatgnggaaaagaacccgactagaatacacaatggtttat

SEQ ID NO: 502 - DNA, 71 bp, chicken (Gallus Gallus)
  misc_feature (36): n=c or t
cagtgcagcagatctagtatattcttttagctgcangtatacagaattgcctgactagatgtgaatgaatt

SEQ ID NO: 503 - DNA, 71 bp, chicken (Gallus Gallus)
  misc_feature (36): n=c or t
cagtggaaaaattaaggcatggagtaggcaagacanggaggtagttgtgtgctccaagaaaaggcaatggg

SEQ ID NO: 504 - DNA, 71 bp, chicken (Gallus Gallus)
  misc_feature (36): n=a or g
cagtggcagagagcgccataaacgtgctggtaaacntgttgaagctcccggtctagaacaaggcacataga

SEQ ID NO: 505 - DNA, 71 bp, chicken (Gallus Gallus)
  misc_feature (36): n=a or g
cagttataattggaacctgtattcattttgcacaanaacgttgtaggattcagaaaagtgaggttaaaaag

SEQ ID NO: 506 - DNA, 71 bp, chicken (Gallus Gallus)
  misc_feature (36): n=c or t
cagttttcttcctccaaactttgtgttttcaaaacngaatgaggttctttttgccagtagcttgtgttctg

SEQ ID NO: 507 - DNA, 71 bp, chicken (Gallus Gallus)
  misc_feature (36): n=c or t
catagtagttctttaggtatctaggttttaccaagngcctgcattatggccctatttatatttattttctc

SEQ ID NO: 508 - DNA, 71 bp, chicken (Gallus Gallus)
  misc_feature (36): n=c or t
catatctagactaggcatctaacaacacaacagagngaacccactgtaaaaaggagacaattcatacagtt

SEQ ID NO: 509 - DNA, 71 bp, chicken (Gallus Gallus)
  misc_feature (36): n=a or g
catcagtccctccaaacagccaaaatattttcctcnggtttcagcgtgccacagagcaagaagctgtcccc

SEQ ID NO: 510 - DNA, 71 bp, chicken (Gallus Gallus)
  misc_feature (36): n=a or g
catccccagaatgtttccttcataacttgccatttngccccagaaataattccttttcttgaaacccaaaa

SEQ ID NO: 511 - DNA, 71 bp, chicken (Gallus Gallus)
  misc_feature (36): n=a or g
catctcccaggagccagattaggtggtgtacatgancagaagtaatctcctggcctctgtctgggaacaca

SEQ ID NO: 512 - DNA, 71 bp, chicken (Gallus Gallus)
  misc_feature (36): n=c or t
catctcccttagatggctacgaaagccatttagttntcatctgcatactgcgatgtcagcagcttccccat

SEQ ID NO: 513 - DNA, 71 bp, chicken (Gallus Gallus)
  misc_feature (36): n=a or c
catgataaagcctaaggaggtgaagccaacaactgngaatttccaggcattaatctaaaaagaagtggaaa

SEQ ID NO: 514 - DNA, 71 bp, chicken (Gallus Gallus)
  misc_feature (36): n=c or t
catgtcaatatttctgccacatgaataacattaccnaataatgttttactccaggtatatcaaagagacta

SEQ ID NO: 515 - DNA, 71 bp, chicken (Gallus Gallus)
  misc_feature (36): n=c or t
cattaatactgtgcaaaagggcaaaaataaaactcngagctgcatgccaagaggcagcagcagcacacagt

SEQ ID NO: 516 - DNA, 71 bp, chicken (Gallus Gallus)
  misc_feature (36): n=a or g
cattacaggtgctgtaagaaatgtgtccatagaagngaaacatgctgtcccccacagtgcacagtcatcaa

SEQ ID NO: 517 - DNA, 71 bp, chicken (Gallus Gallus)
  misc_feature (36): n=a or g
cattgggtgaacaggaaaagatgcttaaacacagcntgcctcgtgcttgaggtgctgttctgttctggagg

SEQ ID NO: 518 - DNA, 71 bp, chicken (Gallus Gallus)
  misc_feature (36): n=a or g
catttctgctccatccacgtgttgataaaggagacngtgcagccccaactatccccagcccagctgggaag

SEQ ID NO: 519 - DNA, 71 bp, chicken (Gallus Gallus)
  misc_feature (36): n=a or g
catttgcaacatgtagcaatttgactcattttgcangtatccatctcagcttgctggtaaaatgacataga

SEQ ID NO: 520 - DNA, 71 bp, chicken (Gallus Gallus)
  misc_feature (36): n=c or t
cattttagcagtttgcatgctccacaacacaggcangagagtcttaccaaagcatctgctactgcctcttc

SEQ ID NO: 521 - DNA, 71 bp, chicken (Gallus Gallus)
  misc_feature (36): n=c or t
ccaacctggccttgaaaagtgacagccttgcaaagnaacagctcaccagcctccttcacacagggaaggag

SEQ ID NO: 522 - DNA, 71 bp, chicken (Gallus Gallus)
  misc_feature (36): n=a or g
ccaagtctacagcagccacaatttgcaatggatganatattaacaccctgaaaaattggggtaatgatgtg

SEQ ID NO: 523 - DNA, 71 bp, chicken (Gallus Gallus)
  misc_feature (36): n=a or g
ccaagtttatggagctgcaagttattttgtggtgancctgaaacagaaccagagacaacttatttttttgc

SEQ ID NO: 524 - DNA, 71 bp, chicken (Gallus Gallus)
  misc_feature (36): n=a or c
ccaccacgcgttcctatgctgtgggagtattcctcntcactgctggggctctccttgtgtgcatcccaccc

SEQ ID NO: 525 - DNA, 71 bp, chicken (Gallus Gallus)
  misc_feature (36): n=c or t
ccacgtatcactgtttagcagtaatacttgttttanatatgaaatatccttttgcaagtaaagagacggct

SEQ ID NO: 526 - DNA, 71 bp, chicken (Gallus Gallus)
  misc_feature (36): n=a or g
ccactatgacttgtgtccatagttctctaccatgangtaaacatactttcagccacacaggattgtggaga

SEQ ID NO: 527 - DNA, 71 bp, chicken (Gallus Gallus)
  misc_feature (36): n=c or t
ccagaagattgaaataagtacctaatagaattgttngcaaaaatgacaccattatgtttcatttaaagctc

SEQ ID NO: 528 - DNA, 71 bp, chicken (Gallus Gallus)
  misc_feature (36): n=c or t
ccagaagtggttggagatgtcgttttatatctgtgnggaagagtcccacctctttcccatttctgattgca

SEQ ID NO: 529 - DNA, 71 bp, chicken (Gallus Gallus)
  misc_feature (36): n=c or t
ccagatcagaagatttttgtagtggaaaaataatanggaatagatactacatattgactgacaagtacctt

SEQ ID NO: 530 - DNA, 71 bp, chicken (Gallus Gallus)
  misc_feature (36): n=c or t
ccagatcccaaatgttgtgcaaaccagagcctccanggagctcctcagcatggtgcttccctgcagggaat

SEQ ID NO: 531 - DNA, 71 bp, chicken (Gallus Gallus)
  misc_feature (36): n=c or t
ccaggcacattaggactggggacattttattgcatncaaggtcttgcgaagctttcagtacacatggggaa

SEQ ID NO: 532 - DNA, 71 bp, chicken (Gallus Gallus)
  misc_feature (36): n=a or g
ccatgggatgttaaacttctttggagctgcccaccnacaaacagcggttagttgctctgtgaggttttccg

SEQ ID NO: 533 - DNA, 71 bp, chicken (Gallus Gallus)
  misc_feature (36): n=c or t
cccacttactgcatgagggtagcaagatgaacaagncttcccaatgcagtaacacattccctggctcaccc

SEQ ID NO: 534 - DNA, 71 bp, chicken (Gallus Gallus)
  misc_feature (36): n=c or t
cccagtattttgcctcatacttcttgttacaatgtnatctctattctggttcttatctaataatctcaaga

SEQ ID NO: 535 - DNA, 71 bp, chicken (Gallus Gallus)
  misc_feature (36): n=c or t
ccccttgatgctgttaaatttagttgcccaagaggnggtaggtgccctgtccctggagacatccaaggtca

SEQ ID NO: 536 - DNA, 71 bp, chicken (Gallus Gallus)
  misc_feature (36): n=c or t
cccctttctctcaaagcatctgtgctagagaagaanagtgacagagcacctgaggtaagtgcagctttgat

SEQ ID NO: 537 - DNA, 71 bp, chicken (Gallus Gallus)
  misc_feature (36): n=a or g
ccctcaatgcaataaagcgttgaccttgaattgacnatgcactgacatcgtccctaaatcacaccatccct

SEQ ID NO: 538 - DNA, 71 bp, chicken (Gallus Gallus)
  misc_feature (36): n=a or g
ccctgatagtaaagtgtacactcacaagaaaagtcnaattccttgagagaacagagtttgactcagtctgc

SEQ ID NO: 539 - DNA, 71 bp, chicken (Gallus Gallus)
  misc_feature (36): n=c or t
cccttagcagcactcagtactttgtgtgatggtatngggcagctaatacagttcaggctaacgtgctgaat

SEQ ID NO: 540 - DNA, 71 bp, chicken (Gallus Gallus)
  misc_feature (36): n=c or t
cccttttaaatttagttgggtcatttctgctgatangaaatgctcatatttagttttgagctggaggctgc

SEQ ID NO: 541 - DNA, 71 bp, chicken (Gallus Gallus)
  misc_feature (36): n=a or g
ccgagatcttcactgacccgtattaaagggaggacntccacaggactgtttgggctgagctgcttagtaat

SEQ ID NO: 542 - DNA, 71 bp, chicken (Gallus Gallus)
  misc_feature (36): n=a or g
ccgagccgtggtggtgtgattttcagagacattccnaaatgttattaaagctaaacaaactcatttaagca

SEQ ID NO: 543 - DNA, 71 bp, chicken (Gallus Gallus)
  misc_feature (36): n=a or c
ccggatggtgatcttgtgtcagccttggtgtagaanagtgtcagctgtagctctgtctgttcttgtgtgtt

SEQ ID NO: 544 - DNA, 71 bp, chicken (Gallus Gallus)
  misc_feature (36): n=c or t
ccgtagagttattaggaggtgttgctacaacagccntgcaaagctggattctgctgtgctccgctctgcag

SEQ ID NO: 545 - DNA, 71 bp, chicken (Gallus Gallus)
  misc_feature (36): n=a or g
ccgtgctgattggaaaacttgcagcaaatggcagantcttgcacatggtctttgtctaatcagcttcaagg

SEQ ID NO: 546 - DNA, 71 bp, chicken (Gallus Gallus)
  misc_feature (36): n=a or g
cctacagcaagcagtatgaacatgtttgccatgccnagctacagaaccatgtgcctcagaaagatgttttc

SEQ ID NO: 547 - DNA, 71 bp, chicken (Gallus Gallus)
  misc_feature (36): n=c or t
cctacttctgagataaaagcagcacctttatttcanttaacaactgaattaaacagattttttttcatgtg

SEQ ID NO: 548 - DNA, 71 bp, chicken (Gallus Gallus)
  misc_feature (36): n=c or t
cctagaaatgaccctggacttgcttctgaggcaaangttttgccagctttaatttcattttatagtttaac

SEQ ID NO: 549 - DNA, 71 bp, chicken (Gallus Gallus)
  misc_feature (36): n=a or g
cctatgaaaggaatacaacagactgttatgttaagnctcagtcacatcttctggttttctgtggaaaccga

SEQ ID NO: 550 - DNA, 71 bp, chicken (Gallus Gallus)
  misc_feature (36): n=c or t
cctcaagggttctagttaggagatgtggctgaatgnacaagagctcatttctgacatttcaacctccctgc

SEQ ID NO: 551 - DNA, 71 bp, chicken (Gallus Gallus)
  misc_feature (36): n=a or g
cctcatatgatggctgttttttaggcacctgcactntgccctaagcacttgctgggtgctccctgaatgcc

SEQ ID NO: 552 - DNA, 71 bp, chicken (Gallus Gallus)
  misc_feature (36): n=a or g
cctcatgtttatcaaatataaattccagagtacaanggtttaaatacactactttaatatttgtgtatctt

SEQ ID NO: 553 - DNA, 71 bp, chicken (Gallus Gallus)
  misc_feature (36): n=c or t
cctcattttgaatgagcagctttctgtgcagcttgngccgggctccgggaccctcaaagtaaaggtcttcc

SEQ ID NO: 554 - DNA, 71 bp, chicken (Gallus Gallus)
  misc_feature (36): n=c or t
cctccatcccagatgtccacatagcccacagttttnctgttgcagagctcctttcactgccagaatggagg

SEQ ID NO: 555 - DNA, 71 bp, chicken (Gallus Gallus)
  misc_feature (36): n=c or t
cctcctggtcagatcatcatttgctagtgctaacanagaatcatagaatcatctgagttggaaagaacatt

SEQ ID NO: 556 - DNA, 71 bp, chicken (Gallus Gallus)
  misc_feature (36): n=c or t
cctctgcttttcctcaatgcctatatgaaatcccancttccacaacctgggaggaagctctctggtggccc

SEQ ID NO: 557 - DNA, 71 bp, chicken (Gallus Gallus)
  misc_feature (36): n=c or t
cctgaaaagacaaggtggtgcagtctgcacctattncttcctgttttagagtccaccagatgtccttttgc

SEQ ID NO: 558 - DNA, 71 bp, chicken (Gallus Gallus)
  misc_feature (36): n=a or g
cctgcgttaacagctacaagttcaaagtgtcagttnatagttcctgctgctccacatgggtgtcattccac

SEQ ID NO: 559 - DNA, 71 bp, chicken (Gallus Gallus)
  misc_feature (36): n=a or g
cctggagaaaaacagcccggagaggaaatggagctntacatgtgcctggctgccggctgtgcagttgcagg

SEQ ID NO: 560 - DNA, 71 bp, chicken (Gallus Gallus)
  misc_feature (36): n=a or g
cctggcctcagggcagcttgttcactttacaagatncagcccttttatctatgtagcccagggacagaaag

SEQ ID NO: 561 - DNA, 71 bp, chicken (Gallus Gallus)
  misc_feature (36): n=a or g
ccttaagcttacaccagaaacttccgtaactccctncttctcccaaattcttcctctttttgtgccctcta

SEQ ID NO: 562 - DNA, 71 bp, chicken (Gallus Gallus)
  misc_feature (36): n=a or g
ccttcagagagctgtcaaggaggaaaaaccatgacnggttgtgtgggagtgcaaggaatatgggacagtgc

SEQ ID NO: 563 - DNA, 71 bp, chicken (Gallus Gallus)
  misc_feature (36): n=c or t
ccttcttccatgtctttaaaagaaaagctatccagnaagtgagcctcacaggacccatgggaagcacaggt

SEQ ID NO: 564 - DNA, 71 bp, chicken (Gallus Gallus)
  misc_feature (36): n=a or g
ccttttcattccatccaaatgcgtatttacataatntactcctttccatttattgaatagtatgctttgat

SEQ ID NO: 565 - DNA, 71 bp, chicken (Gallus Gallus)
  misc_feature (36): n=a or g
cgacaatagaagatctgagcagacgtgtgcggcacncacacatacaccagctggcattatttagcaatgag

SEQ ID NO: 566 - DNA, 71 bp, chicken (Gallus Gallus)
  misc_feature (36): n=a or g
cgacccagcagtcacatttaatccaatgacaaactnctaagcttcttccgctctgatattcttgcaccatt

SEQ ID NO: 567 - DNA, 71 bp, chicken (Gallus Gallus)
  misc_feature (36): n=a or g
cgaccccagactcagagcaagtatgcagtaaattcnccatagctttctgttttcttgactgttcgccgaaa

SEQ ID NO: 568 - DNA, 71 bp, chicken (Gallus Gallus)
  misc_feature (36): n=c or t
cgagcctcaccgtaaggagttaaaaagctccagtgngatgcttcttactgctaaagagaacagaaacaagt

SEQ ID NO: 569 - DNA, 71 bp, chicken (Gallus Gallus)
  misc_feature (36): n=c or t
cgagtcagagatttaaagaaaatgaaagctaagagnggacaacaggaatggtgtatacaggggattcagaa

SEQ ID NO: 570 - DNA, 71 bp, chicken (Gallus Gallus)
  misc_feature (36): n=c or t
cgagtgtaaggaatagaggagagctgtacgtgtgcnactgcgggctctgcgtaggaaggaagccctggtaa

SEQ ID NO: 571 - DNA, 71 bp, chicken (Gallus Gallus)
  misc_feature (36): n=c or t
cgcctgttgctttagtgaaacatgcacgactgattntcacctcaagagcaagctgtctagtgacttcagcc

SEQ ID NO: 572 - DNA, 71 bp, chicken (Gallus Gallus)
  misc_feature (36): n=a or g
cggggatgctcaaatctcagaatttaacaacctctntggttttaaaggctgggggtagattctacatctaa

SEQ ID NO: 573 - DNA, 71 bp, chicken (Gallus Gallus)
  misc_feature (36): n=a or g
cgggggaagctcctgttgtgttgggctcgttgtaancatgggtcttgtgtgaggtggaggagcagaagcgg

SEQ ID NO: 574 - DNA, 71 bp, chicken (Gallus Gallus)
  misc_feature (36): n=a or g
cggtgcttattttgtgcacagttttgtgagaactgncacccagtgtttccagctgacgtgcagctttggga

SEQ ID NO: 575 - DNA, 71 bp, chicken (Gallus Gallus)
  misc_feature (36): n=a or g
cgtctggtgacatttgtcccttttgctgttgttatncctgatgaccacatggtagcaggcagaactgacca

SEQ ID NO: 576 - DNA, 71 bp, chicken (Gallus Gallus)
  misc_feature (36): n=a or g
cgtgctctatctgatcagctattctgctttgaaganggatggagaaaggctatcaactctaatgaagagag

SEQ ID NO: 577 - DNA, 71 bp, chicken (Gallus Gallus)
  misc_feature (36): n=c or t
cgttggtagtgcacactttggaatttaaaccaggangtgcacctagcaagtggcagtacagcatgactgca

SEQ ID NO: 578 - DNA, 71 bp, chicken (Gallus Gallus)
  misc_feature (36): n=a or g
cgtttggatgtgaggagatgggtatggacaggaatngagagcggggagctttaatcacgttcacagcaaat

SEQ ID NO: 579 - DNA, 71 bp, chicken (Gallus Gallus)
  misc_feature (36): n=c or t
ctaagctttgtcataagaaatatatataagagttgncacaacatgtgtgatgattctgggttacagctctg

SEQ ID NO: 580 - DNA, 71 bp, chicken (Gallus Gallus)
  misc_feature (36): n=a or c
ctaaggttatccttgcttatttgaagctatggcagnaggttggactgtgctctgcccatggctgtaaatgt

SEQ ID NO: 581 - DNA, 71 bp, chicken (Gallus Gallus)
  misc_feature (36): n=c or t
ctaagtgatcttctagagcacgaaacaggtgttagntgtcctaagtgtactgcagactaatgcataggaaa

SEQ ID NO: 582 - DNA, 71 bp, chicken (Gallus Gallus)
  misc_feature (36): n=a or g
ctaatatacagtgctttgaccttaacattctgtggntttgtttcatgaagggaggaagagaaggggaccat

SEQ ID NO: 583 - DNA, 71 bp, chicken (Gallus Gallus)
  misc_feature (36): n=c or t
ctaatcaaactctatctttgcaacccaattctttgnattacaattgttttcctgacttccgtcgctcctcc

SEQ ID NO: 584 - DNA, 71 bp, chicken (Gallus Gallus)
  misc_feature (36): n=c or t
ctacaccaacagctctctgagcgttgttacattgantgtactgtatggtactgactgtcccttccgccagc

SEQ ID NO: 585 - DNA, 71 bp, chicken (Gallus Gallus)
  misc_feature (36): n=a or g
ctacatattaattgggtcgttgttgaagataaaatnctgtaataaattttatgactgtgaagggaacaatg

SEQ ID NO: 586 - DNA, 71 bp, chicken (Gallus Gallus)
  misc_feature (36): n=c or t
ctaggaggtaaaaaggatatttcacttttatcacantctacttagccgcactgaagggacgtggcctaacc

SEQ ID NO: 587 - DNA, 71 bp, chicken (Gallus Gallus)
  misc_feature (36): n=g or t
ctagtttatgattgagttttagtttataaatcattntgtgcacaaagaagctagcactaagacaaaaaagg

SEQ ID NO: 588 - DNA, 71 bp, chicken (Gallus Gallus)
  misc_feature (36): n=c or t
ctatagacaaacagatttttcattgcaaatattaangtacagatcaagtgtctctcaagctatgtaatgac

SEQ ID NO: 589 - DNA, 71 bp, chicken (Gallus Gallus)
  misc_feature (36): n=c or t
ctatccacaagccatttgaagccagtcccagatgtngccaccaggtgatgttcggtgctcaccaagcaagc

SEQ ID NO: 590 - DNA, 71 bp, chicken (Gallus Gallus)
  misc_feature (36): n=c or t
ctcaagaactaaactaatttgaaactataacctcanctactgctgaaaaatttatcaaaaacaaaaagcag

SEQ ID NO: 591 - DNA, 71 bp, chicken (Gallus Gallus)
  misc_feature (36): n=c or t
ctcacaaacagttgcccagaattcactttttccttncattcagcccagcaaagtatcaactaaaaaccatt

SEQ ID NO: 592 - DNA, 71 bp, chicken (Gallus Gallus)
  misc_feature (36): n=c or t
ctcagaatgctacagttttatagtttcaagtcacantctgcagctgcaaatatgaattttactgtcacctc

SEQ ID NO: 593 - DNA, 71 bp, chicken (Gallus Gallus)
  misc_feature (36): n=a or g
ctcatctatgttaatactaatacgggttttgctctnagctggagtgaatctgcaccagatggccacctgag

SEQ ID NO: 594 - DNA, 71 bp, chicken (Gallus Gallus)
  misc_feature (36): n=c or t
ctccaagtagctcctcatcttaattgtaccagtgtncccgggcctggatgcagtagtccagatgggatctc

SEQ ID NO: 595 - DNA, 71 bp, chicken (Gallus Gallus)
  misc_feature (36): n=g or t
ctccaatgccatcaacgcttcccgaataaaggaacngaacagtagaaattctaatgcttttctttccactt

SEQ ID NO: 596 - DNA, 71 bp, chicken (Gallus Gallus)
  misc_feature (36): n=c or t
ctcccgctttctgacctctctgagttttccatctcnggggatcagacaagctgcctctgcagcacacccag

SEQ ID NO: 597 - DNA, 71 bp, chicken (Gallus Gallus)
  misc_feature (36): n=c or t
ctccttgcttccttcaacaaggaagcaattcctgangtgcatttgagtttatcaaggcaggaaaataccct

SEQ ID NO: 598 - DNA, 71 bp, chicken (Gallus Gallus)
  misc_feature (36): n=a or c
ctcgcatttaaaatggaatactggtaattaaatccncctgagaactacggaaaacttttgcccatatgtgc

SEQ ID NO: 599 - DNA, 71 bp, chicken (Gallus Gallus)
  misc_feature (36): n=a or g
ctctcagttaaaatgttaagctttttttccaaatcncattgcgttttgctgtctctcctcttcttgcctct

SEQ ID NO: 600 - DNA, 71 bp, chicken (Gallus Gallus)
  misc_feature (36): n=g or t
ctctctgcaatgtctgtgcctcttagatttaggaangaataaattgagcttctaccagaacctaccaatgc

SEQ ID NO: 601 - DNA, 71 bp, chicken (Gallus Gallus)
  misc_feature (36): n=c or t
ctctggacagtaaggagaatacattctgttagtatngggggagtgggaatggccagctctaataactaatc

SEQ ID NO: 602 - DNA, 71 bp, chicken (Gallus Gallus)
  misc_feature (36): n=a or g
ctctgggtaaacaaaatcaagatgcagcttgtagcntttctgcagcgtgggacaggctttggttgtagcat

SEQ ID NO: 603 - DNA, 71 bp, chicken (Gallus Gallus)
  misc_feature (36): n=a or g
ctgaaacataagcaaaacagtggatgaacagacctngaagaaaatgcacttcagcatgaatgaagactgct

SEQ ID NO: 604 - DNA, 71 bp, chicken (Gallus Gallus)
  misc_feature (36): n=a or g
ctgagctctccattgctggagctacttgaatctttnggatgttaagctgtccttgctctgagcatgccttg

SEQ ID NO: 605 - DNA, 71 bp, chicken (Gallus Gallus)
  misc_feature (36): n=c or t
ctgattgtagcgggtaatgtttggagctacatgacntccaaggtcccttccagcctaaactgtcctatggt

SEQ ID NO: 606 - DNA, 71 bp, chicken (Gallus Gallus)
  misc_feature (36): n=c or t
ctgcaagaagtttgcatttcattcttactaattaangggcaggaatttcaagttacagaagggtgaagaag

SEQ ID NO: 607 - DNA, 71 bp, chicken (Gallus Gallus)
  misc_feature (36): n=c or t
ctgcacagcactgaaaatgtctccagaactgttgcncaaggaattcttttgttttgttggcatcattagga

SEQ ID NO: 608 - DNA, 71 bp, chicken (Gallus Gallus)
  misc_feature (36): n=c or t
ctgcacttaggagatgtaggatatcctgcactctgntgcggagttctgctgagcttgtgccgtgaatgtgg

SEQ ID NO: 609 - DNA, 71 bp, chicken (Gallus Gallus)
  misc_feature (36): n=c or t
ctgcagctgggattttcattaacttgtgtgctctangtgtctcttgtcagaatattcctcctcttcaagaa

SEQ ID NO: 610 - DNA, 71 bp, chicken (Gallus Gallus)
  misc_feature (36): n=a or g
ctgccatatattcaattgcccttgatttcaatggcnctacagatgtgaaaaagcccaactaactccttgtc

SEQ ID NO: 611 - DNA, 71 bp, chicken (Gallus Gallus)
  misc_feature (36): n=c or t
ctgccccacatgcatttctatacctagttcttccancccagtttcatgagctcagcaattacctgaactga

SEQ ID NO: 612 - DNA, 71 bp, chicken (Gallus Gallus)
  misc_feature (36): n=a or c
ctgccttcacctgtggaataatttgcattcatgtanagtagagatgtaagaccatcctcctccttggtttt

SEQ ID NO: 613 - DNA, 71 bp, chicken (Gallus Gallus)
  misc_feature (36): n=a or g
ctgctccttgtgtcagcaagacaagcttgctttccnttgtgatgggacatcgtgtcctgctccactggctg

SEQ ID NO: 614 - DNA, 71 bp, chicken (Gallus Gallus)
  misc_feature (36): n=a or g
ctgctgtagtttgtaaacccttgcaggcttcagcanatgagcacagtcaccccagagagcagagatgtgaa

SEQ ID NO: 615 - DNA, 71 bp, chicken (Gallus Gallus)
  misc_feature (36): n=a or g
ctgctgtttccacaagtctggcaaggcttcaattcncaaccatttgaaatgtagctttttttatttatctc

SEQ ID NO: 616 - DNA, 71 bp, chicken (Gallus Gallus)
  misc_feature (36): n=c or t
ctggagactgcgctgctttgttgggtttttataccngaaaggttgcagaagtggcctaaccctgagtctgt

SEQ ID NO: 617 - DNA, 71 bp, chicken (Gallus Gallus)
  misc_feature (36): n=a or g
ctgggtcaggaaactggatctgacagctaacagaantaactgtcagacccacgctcttccctcagctgctc

SEQ ID NO: 618 - DNA, 71 bp, chicken (Gallus Gallus)
  misc_feature (36): n=c or t
ctggtgtaaatgttctgcctataaggccacagggantgagctgctttcctctggagggcttgatgaaggct

SEQ ID NO: 619 - DNA, 71 bp, chicken (Gallus Gallus)
  misc_feature (36): n=a or g
ctggtgtcttaattttaacatgaatgaggctaacgngaataaaggagtccagttatgcaagctgtggcatt

SEQ ID NO: 620 - DNA, 71 bp, chicken (Gallus Gallus)
  misc_feature (36): n=a or g
ctggttgtaccattgcacggatgtgttttcccaacnctggagcatgaacgcagtgctagagctaacacagc

SEQ ID NO: 621 - DNA, 71 bp, chicken (Gallus Gallus)
  misc_feature (36): n=a or g
ctgtacaatgttttctcccttagtacatttccttcnttaggaagatcacaggctgactgaactcttctttt

SEQ ID NO: 622 - DNA, 71 bp, chicken (Gallus Gallus)
  misc_feature (36): n=c or t
ctgtagtattgcttctctctgcagaatagcataccngctagaaacatgaacagacgaacatagcaggtttt

SEQ ID NO: 623 - DNA, 71 bp, chicken (Gallus Gallus)
  misc_feature (36): n=a or g
ctgtatccaacccattgcggaaaacgtgaaagacanctggccctaaaatggaaattagaaggatgcagaaa

SEQ ID NO: 624 - DNA, 71 bp, chicken (Gallus Gallus)
  misc_feature (36): n=a or g
ctgtatgtagaaagctgctaggtgcaaacttaccantcgctttgagattattgctgggagaaaaggagaag

SEQ ID NO: 625 - DNA, 71 bp, chicken (Gallus Gallus)
  misc_feature (36): n=a or g
ctgtgataatcatgaaaaaaacatgagcttgaaacntttcaagtttctaaatcttttgtctcattaaagga

SEQ ID NO: 626 - DNA, 71 bp, chicken (Gallus Gallus)
  misc_feature (36): n=a or g
ctgtgcttcatccttaagaccagttgttcacaaatntttttactaccaaaaaagaggtggcatgaataagg

SEQ ID NO: 627 - DNA, 71 bp, chicken (Gallus Gallus)
  misc_feature (36): n=a or g
ctgtgttctgcctgcctggaggcttttagctgaganacactgaccagtaactctgaggaagctccaccagt

SEQ ID NO: 628 - DNA, 71 bp, chicken (Gallus Gallus)
  misc_feature (36): n=g or t
cttaattttactgttattattaagttgagaggtttncaggtttactttgcaaataatataaaatattaata

SEQ ID NO: 629 - DNA, 71 bp, chicken (Gallus Gallus)
  misc_feature (36): n=c or t
cttagttactgaacaactctaccttcttatttaccnagcctacccttcctatagagcttgattatgtcttt

SEQ ID NO: 630 - DNA, 71 bp, chicken (Gallus Gallus)
  misc_feature (36): n=c or t
cttataagaactgacgtcaaaaagcgtggagccgcngctctcctcttgctctggttgtcactctgagctca

SEQ ID NO: 631 - DNA, 71 bp, chicken (Gallus Gallus)
  misc_feature (36): n=a or c
cttcaattcaaaggctacatatgggcatgcagtaanatgcactgtactttggaaaagaagtcactcttagg

SEQ ID NO: 632 - DNA, 71 bp, chicken (Gallus Gallus)
  misc_feature (36): n=c or t
cttcaggccaagactcatcttcagggatgagacatncacttctctgggcaatttgttccagcaccccacca

SEQ ID NO: 633 - DNA, 71 bp, chicken (Gallus Gallus)
  misc_feature (36): n=c or t
cttcctactcaacttcaggcacctaacagaagctangttaggggactttatttgcaaccgtcttcctccat

SEQ ID NO: 634 - DNA, 71 bp, chicken (Gallus Gallus)
  misc_feature (36): n=g or t
cttctcaggatgtagttgtgggttaaaatctaaatncttactatagaacttcacatcttttatcttatcaa

SEQ ID NO: 635 - DNA, 71 bp, chicken (Gallus Gallus)
  misc_feature (36): n=a or g
cttgcatactataagacagtgactcaaacagtgtcnttagatagttcagctttggattgattgtactttga

SEQ ID NO: 636 - DNA, 71 bp, chicken (Gallus Gallus)
  misc_feature (36): n=c or t
cttggaagagatgcctgtctgaaatagcattaaagngctgggagctagcaccttcctaggtaatttgggta

SEQ ID NO: 637 - DNA, 71 bp, chicken (Gallus Gallus)
  misc_feature (36): n=a or g
cttggctctgctgggacaggatttctgctggtcttngggcaaggaagtgctggggggcatctgtgctccaa

SEQ ID NO: 638 - DNA, 71 bp, chicken (Gallus Gallus)
  misc_feature (36): n=g or t
cttgtaggtttacagagaaaggctccttgaggagangctcagactacagtccttgccagcctcgtgcaaca

SEQ ID NO: 639 - DNA, 71 bp, chicken (Gallus Gallus)
  misc_feature (36): n=a or g
cttgtcacaaagactataaacttcaatggtaaaccntttggtgtagaggtattatttctgtttagacaact

SEQ ID NO: 640 - DNA, 71 bp, chicken (Gallus Gallus)
  misc_feature (36): n=a or g
cttgttttcatgaagaaagtcttctcaaattagctntgcagaaggaaaagctttacccccttgcaatgctc

SEQ ID NO: 641 - DNA, 71 bp, chicken (Gallus Gallus)
  misc_feature (36): n=c or t
aagtgctttatttctgttgttaagcagcaagctccntgatacgcaggcagccgctgatcctgaaaaacaag

SEQ ID NO: 642 - DNA, 71 bp, chicken (Gallus Gallus)
  misc_feature (36): n=a or g
ctttacagagttttgagaaaaccttttttgtcactntcttagtttcagctgggacagtgatttccttcata

SEQ ID NO: 643 - DNA, 71 bp, chicken (Gallus Gallus)
  misc_feature (36): n=c or t
ctttactagcacaaagattttcatgccctgagaganagttatctggcataaaatgtaaattaagacgtatg

SEQ ID NO: 644 - DNA, 71 bp, chicken (Gallus Gallus)
  misc_feature (36): n=c or t
ctttagtgtcaatacagaaagaatagtaatttaaanctgtcactgacaactgcccattttcagctctagcc

SEQ ID NO: 645 - DNA, 71 bp, chicken (Gallus Gallus)
  misc_feature (36): n=c or t
ctttccaataatgaaataaatgtttgtgatgagtanatgtaatgatagggactcacctggagttttcactc

SEQ ID NO: 646 - DNA, 71 bp, chicken (Gallus Gallus)
  misc_feature (36): n=a or g
ctttgatggcatttcagaagtccttctggtgacaantaggaacaaggagagcttctcaccaacaaacctca

SEQ ID NO: 647 - DNA, 71 bp, chicken (Gallus Gallus)
  misc_feature (36): n=a or c
cttttctggcaaattatgaaacaaggctgagtccangtagcttttctattcctcttatccagtgtgtgaca

SEQ ID NO: 648 - DNA, 71 bp, chicken (Gallus Gallus)
  misc_feature (36): n=c or t
cttttttctcacgtcttcttttccagtatgtcctanagggcaaaagattttgctcttgacagctggcttca

SEQ ID NO: 649 - DNA, 71 bp, chicken (Gallus Gallus)
  misc_feature (36): n=a or g
cttttttgctacattgttttggaaaacaaaatcctngtggttttttttttttttcattactcagttaatta

SEQ ID NO: 650 - DNA, 71 bp, chicken (Gallus Gallus)
  misc_feature (36): n=g or t
gaaaaatctgaggcaatgtctgatagttgattcaancctccttagagctatatatgggctattgcaccgat

SEQ ID NO: 651 - DNA, 71 bp, chicken (Gallus Gallus)
  misc_feature (36): n=c or t
gaaaaattgctgagccctgactgatcatttagaagngatcatgaccctagctgagtcattagcagataaaa

SEQ ID NO: 652 - DNA, 71 bp, chicken (Gallus Gallus)
  misc_feature (36): n=a or g
gaaaagaatgaattttgaagatttaaagaaccatantggcactgttgcttgactgtatggtattcactggc

SEQ ID NO: 653 - DNA, 71 bp, chicken (Gallus Gallus)
  misc_feature (36): n=a or g
gaaaagctgtactgtggaaaatagcacccaatcctncatagaggataggatgacctgaagggtgaaatgca

SEQ ID NO: 654 - DNA, 71 bp, chicken (Gallus Gallus)
  misc_feature (36): n=c or t
gaaaatagatgttctggtggtggataaatcctcacnggccctgtagggaattattggggaagctaattagc

SEQ ID NO: 655 - DNA, 71 bp, chicken (Gallus Gallus)
  misc_feature (36): n=c or t
gaaaatggaaaacaagcctcagtaaaccacaccagncacctggcagagcagtccccacttgccagctttct

SEQ ID NO: 656 - DNA, 71 bp, chicken (Gallus Gallus)
  misc_feature (36): n=c or t
gaaaccttcacctgcaccaaaagttctttcagtacnaaacaacatcacaggacaatgggaagcttcccagc

SEQ ID NO: 657 - DNA, 71 bp, chicken (Gallus Gallus)
  misc_feature (36): n=c or t
gaaactgaatataggatatctttctttgcacagttntagaggttcacatataatctccttaagcaagagaa

SEQ ID NO: 658 - DNA, 71 bp, chicken (Gallus Gallus)
  misc_feature (36): n=a or g
gaaagcaccagtattatgaatagttgagaagtcagnaggaagggatatgttgtggctttgttcaggaaatg

SEQ ID NO: 659 - DNA, 71 bp, chicken (Gallus Gallus)
  misc_feature (36): n=g or t
gaaagcccgtggctgctgtggtagccattcctaaanaaggaggatgggatgcagggcataactaatttcca

SEQ ID NO: 660 - DNA, 71 bp, chicken (Gallus Gallus)
  misc_feature (36): n=a or g
gaaagtttccagaggtccaagagcatgggattttcntcagcctgatgggcagaggggctcaatgctcttgc

SEQ ID NO: 661 - DNA, 71 bp, chicken (Gallus Gallus)
  misc_feature (36): n=a or c
gaaatatcacaattccacctatgaagttagctcagnaaatatttttcttcagaacttctctttcatgtgtc

SEQ ID NO: 662 - DNA, 71 bp, chicken (Gallus Gallus)
  misc_feature (36): n=a or g
gaaatctctcttccattggtcattattccttattcntgctcatgggttccacccattaaatgcacgctgag

SEQ ID NO: 663 - DNA, 71 bp, chicken (Gallus Gallus)
  misc_feature (36): n=a or g
gaacccaccatttcaggtttggtatatattgggatntgaacttgttctcagtttccccatgagccttcatt

SEQ ID NO: 664 - DNA, 71 bp, chicken (Gallus Gallus)
  misc_feature (36): n=a or g
gaactactgaagcttagtactggaatgagataaacncacaaaattaattttctattgtaacttatcttcca

SEQ ID NO: 665 - DNA, 71 bp, chicken (Gallus Gallus)
  misc_feature (36): n=a or c
gaactcactcattccagttaatttttaagtactttntaaagctccaccatttaactctgatacacttaatt

SEQ ID NO: 666 - DNA, 71 bp, chicken (Gallus Gallus)
  misc_feature (36): n=c or t
gaactgtagataattttatccaagctgttacttacngcaggtgcagtttctagacccagatgaagtctgcc

SEQ ID NO: 667 - DNA, 71 bp, chicken (Gallus Gallus)
  misc_feature (36): n=c or t
gaacttcttaaatctcagatgctcttgatttcccangatcacatccatttgttcttatcactgctgactaa

SEQ ID NO: 668 - DNA, 71 bp, chicken (Gallus Gallus)
  misc_feature (36): n=a or g
gaagaagtgagaagtggcatatttgatacacactgnatcttcctgcagctgggggtgactgaaatccacat

SEQ ID NO: 669 - DNA, 71 bp, chicken (Gallus Gallus)
  misc_feature (36): n=a or g
gaagcacctacacagcttcttccagctctgaaaatnttgtgggactggctgcagcaagagcaaagcttaag

SEQ ID NO: 670 - DNA, 71 bp, chicken (Gallus Gallus)
  misc_feature (36): n=g or t
gaagcagctgtctgtcttcccaggttagctcctaancccatggagatggaaggagattcctgatgtgggca

SEQ ID NO: 671 - DNA, 71 bp, chicken (Gallus Gallus)
  misc_feature (36): n=c or t
gaagcgattgcctttcattgttttgtatgctatgtnaaattggaaaagtagtctttaaaattttcacactg

SEQ ID NO: 672 - DNA, 71 bp, chicken (Gallus Gallus)
  misc_feature (36): n=a or g
gaagggcttcatatgcagatccaggactgcgatgtntgatgctttgctgcagggaatggctttctctgggg

SEQ ID NO: 673 - DNA, 71 bp, chicken (Gallus Gallus)
  misc_feature (36): n=c or t
gaataaagactttccaattttgctggcaaagctgcngaagcttgcagttcatttaatctgctcaaggtagc

SEQ ID NO: 674 - DNA, 71 bp, chicken (Gallus Gallus)
  misc_feature (36): n=a or g
gaataatactttggagtaataaattggtagagaaantagaaagaaaagagagctgctttatggcttacagg

SEQ ID NO: 675 - DNA, 71 bp, chicken (Gallus Gallus)
  misc_feature (36): n=c or t
gaatatcatagtaccacctttttacacagcacatangtgatggattggttagtttgctcttactctatggg

SEQ ID NO: 676 - DNA, 71 bp, chicken (Gallus Gallus)
  misc_feature (36): n=c or t
gaatatctagcatttcaattagctatctgatgttgnaatcatggggaaaaaaagaaagacaaggcacatca

SEQ ID NO: 677 - DNA, 71 bp, chicken (Gallus Gallus)
  misc_feature (36): n=a or g
gaatgcctagcaaccagttgtggataaacccactgnctcattttcccctgtacttctacagtgaactgaaa

SEQ ID NO: 678 - DNA, 71 bp, chicken (Gallus Gallus)
  misc_feature (36): n=g or t
gaattatggaggcaggaagataaagaaggaattgtnttgcaatggtatacctattactagatggaaagtct

SEQ ID NO: 679 - DNA, 71 bp, chicken (Gallus Gallus)
  misc_feature (36): n=g or t
gaattggtaatagagacagacaggttttagtgtgcnctgagaagctctgaatcaatgataccaaggggatg

SEQ ID NO: 680 - DNA, 71 bp, chicken (Gallus Gallus)
  misc_feature (36): n=a or c
gacaatatcctcagtgatgtacttcaactctggttngccttcaagtggtcaggaggctgacctagatgatc

SEQ ID NO: 681 - DNA, 71 bp, chicken (Gallus Gallus)
  misc_feature (36): n=a or g
gacaattggctaaatggggtcaaggcgttgcataantctcaacaaatgagcagaggaggcagatagaaata

SEQ ID NO: 682 - DNA, 71 bp, chicken (Gallus Gallus)
  misc_feature (36): n=a or g
gacacagagaactggaaaacatgttttaatgaaggnagcttgctagttgattttactcctccttttgtgct

SEQ ID NO: 683 - DNA, 71 bp, chicken (Gallus Gallus)
  misc_feature (36): n=c or t
gacatcatacaggaagaagtcatttagcttttattntctgtggccgaccacagccagcagagcaccatgca

SEQ ID NO: 684 - DNA, 71 bp, chicken (Gallus Gallus)
  misc_feature (36): n=a or g
gactcaacaccctgagcctttaaggaaaacatcatnggaatgtatcaagaattggtaacagtgatcatacc

SEQ ID NO: 685 - DNA, 71 bp, chicken (Gallus Gallus)
  misc_feature (36): n=a or g
gactgcctgacttgctctcctccaaaactactgacnatagggaagggacagcatggtctgctcttccgagt

SEQ ID NO: 686 - DNA, 71 bp, chicken (Gallus Gallus)
  misc_feature (36): n=a or g
gactgcttggtttaggctttgatggtaaccatcagngaggtgaccagagctggctcttataagaccggtct

SEQ ID NO: 687 - DNA, 71 bp, chicken (Gallus Gallus)
  misc_feature (36): n=a or g
gacttcacatcttgaaatcaagtttaaataatccancttccgcatataatggatgtggttttgggaagaac

SEQ ID NO: 688 - DNA, 71 bp, chicken (Gallus Gallus)
  misc_feature (36): n=a or g
gagaaaagaggtgtatttaccagaattcaaaaactnctgaagaacttatcttctgaagaaaatgtcttcat

SEQ ID NO: 689 - DNA, 71 bp, chicken (Gallus Gallus)
  misc_feature (36): n=a or g
gagaacttaaaaactctcaaaatgaatagttacacntatcaaactgattagaagaatatagataacacatg

SEQ ID NO: 690 - DNA, 71 bp, chicken (Gallus Gallus)
  misc_feature (36): n=a or c
gagattctttggataccgtgaagctttggaaatctngtgcaggaactatacttgcccaggatctcacatag

SEQ ID NO: 691 - DNA, 71 bp, chicken (Gallus Gallus)
  misc_feature (36): n=a or g
gagcatctatcagtgctttagattccacaggaatanctcctttattcagcttataatctccagccatacca

SEQ ID NO: 692 - DNA, 71 bp, chicken (Gallus Gallus)
  misc_feature (36): n=a or c
gagcgttttgctgcattcagctgctggaaggaaagngagcttctcctcagggctgttgccaggaaaaccaa

SEQ ID NO: 693 - DNA, 71 bp, chicken (Gallus Gallus)
  misc_feature (36): n=g or t
gagctgtggattgcctgggcatgcttatcagacaanaacgttgtgagaaggccttgctgttggacatctgg

SEQ ID NO: 694 - DNA, 71 bp, chicken (Gallus Gallus)
  misc_feature (36): n=c or t
gaggaggatggatggaggtgtatttagtttactttnagtttctcattgctctggtctagtaataggtaata

SEQ ID NO: 695 - DNA, 71 bp, chicken (Gallus Gallus)
  misc_feature (36): n=a or g
gagggatggaactactggtaagagtgaaacaatagngcaggacaatgattaagagacagactgcagtatct

SEQ ID NO: 696 - DNA, 71 bp, chicken (Gallus Gallus)
  misc_feature (36): n=a or c
gaggtaccaaacaacaccaaacaatagaatagtagnatggtttggcttgaaagggctcttaaacgccattt

SEQ ID NO: 697 - DNA, 71 bp, chicken (Gallus Gallus)
  misc_feature (36): n=a or g
gaggtaggtgaagtaaggtgaggaaagagcactggnggaggacatgctccccggagagaaagggaatagct

SEQ ID NO: 698 - DNA, 71 bp, chicken (Gallus Gallus)
  misc_feature (36): n=c or t
gaggtgtgtttctggagttgctcttgcatgatacangatgcaacagacctcagcttaaagcatctcttgtg

SEQ ID NO: 699 - DNA, 71 bp, chicken (Gallus Gallus)
  misc_feature (36): n=g or t
gagtatcaggacagttaccactgctgaactctactntagtgaatgcagacaaaagctacacgggactatga

SEQ ID NO: 700 - DNA, 71 bp, chicken (Gallus Gallus)
  misc_feature (36): n=a or g
gagttggtctccaaaattactgcagcatactcatanctgaatagaagttgttgacaaagaatttctcttaa

SEQ ID NO: 701 - DNA, 71 bp, chicken (Gallus Gallus)
  misc_feature (36): n=a or g
gagtttgcataattatgattaattaggatgtgcctntgcgctgtctctaagagctgtgtggttaatgctag

SEQ ID NO: 702 - DNA, 71 bp, chicken (Gallus Gallus)
  misc_feature (36): n=a or g
aactgacatctgggtgtctgttgtaattcaacggcncaaaaccacactgtcagaacattaagttacttatc

SEQ ID NO: 703 - DNA, 71 bp, chicken (Gallus Gallus)
  misc_feature (36): n=c or t
gataccgtttcattatcaatgtaaagcaggattttntaaaaatatatactcctgattgagcaggttcttgc

SEQ ID NO: 704 - DNA, 71 bp, chicken (Gallus Gallus)
  misc_feature (36): n=a or g
gatatcaaagatacctgctgaataggggctactgtncaaagaggcgatagggagaaagaagaaatcagagc

SEQ ID NO: 705 - DNA, 71 bp, chicken (Gallus Gallus)
  misc_feature (36): n=c or t
gatattctaaaagttataaagcacagctatcatttnccttcccacttctttgaccttttaacacagtaaca

SEQ ID NO: 706 - DNA, 71 bp, chicken (Gallus Gallus)
  misc_feature (36): n=a or g
gatatttctttagaggaatgatggttttcttttaangactaaacaaactcttgggcactttaagctggagt

SEQ ID NO: 707 - DNA, 71 bp, chicken (Gallus Gallus)
  misc_feature (36): n=c or t
gatccaatacctcaccaaacaagtcttcctagacanttaacatggtttttgtgtgctcgtgtcacacaaac

SEQ ID NO: 708 - DNA, 71 bp, chicken (Gallus Gallus)
  misc_feature (36): n=a or g
gatcctggggtgctgatacagatctgctcacagtcntggtcgccagtggcacacaggtctgacaccactga

SEQ ID NO: 709 - DNA, 71 bp, chicken (Gallus Gallus)
  misc_feature (36): n=a or g
gatctgcctctcagtgccatttgttaataaaatatnccaaataaagattttgacaccagagccagtgggat

SEQ ID NO: 710 - DNA, 71 bp, chicken (Gallus Gallus)
  misc_feature (36): n=a or g
gatgactatgtctgttgagaacgcgctgatgtgacnctgaaactcagtggagcttcttgcctctacatgta

SEQ ID NO: 711 - DNA, 71 bp, chicken (Gallus Gallus)
  misc_feature (36): n=a or g
gatgagaagggaacctaaagaccagagctagcaaantattcaatagaaacctttcgtgccaagtcctttaa

SEQ ID NO: 712 - DNA, 71 bp, chicken (Gallus Gallus)
  misc_feature (36): n=c or t
gatgctatgaaggttctggtcttcagctcagcctcngctgtgccctgttgggccatggagatccttgagcc

SEQ ID NO: 713 - DNA, 71 bp, chicken (Gallus Gallus)
  misc_feature (36): n=c or t
gatgggttaaatattgttcccatatgaatgacagtnaacttgctgtatgtatggggcatgctgggaccaaa

SEQ ID NO: 714 - DNA, 71 bp, chicken (Gallus Gallus)
  misc_feature (36): n=a or g
gatggtatcttatgtttccattgcttagttaaactntggatcagtgtcctcagttatgactacatgcaaac

SEQ ID NO: 715 - DNA, 71 bp, chicken (Gallus Gallus)
  misc_feature (36): n=c or t
gatgtgaatttaaaaagagcaatattattcctttcngacaagaagatctctccagctcagctcaacacgtg

SEQ ID NO: 716 - DNA, 71 bp, chicken (Gallus Gallus)
  misc_feature (36): n=a or g
gatgtgcatagacaggagacgtggaaattctcaatngttagctcatgtggtaggtagatggaaaggtaagg

SEQ ID NO: 717 - DNA, 71 bp, chicken (Gallus Gallus)
  misc_feature (36): n=a or g
gatgtggtacttgttcagtttttattccctgtaatntttcagtttaatataagtgttgtggctttctgctt

SEQ ID NO: 718 - DNA, 71 bp, chicken (Gallus Gallus)
  misc_feature (36): n=a or g
gattaaaacagagctaagggtatgctcaaatctacnaactattctaccctcttatagcaaaaatgtttaag

SEQ ID NO: 719 - DNA, 71 bp, chicken (Gallus Gallus)
  misc_feature (36): n=a or g
gattctgtcacaagccgttacagaaacatcaaagtncaagccaggatgaagcatcatagaccccattcaca

SEQ ID NO: 720 - DNA, 71 bp, chicken (Gallus Gallus)
  misc_feature (36): n=c or t
gattgtcacaactgaattctgcttatgagacagccngaggtacatgattgatggtcccatcctttaaaaca

SEQ ID NO: 721 - DNA, 71 bp, chicken (Gallus Gallus)
  misc_feature (36): n=a or g
gatttgtgaggagctcataaaagtgttacagcttancttgatccagaaaattaaggaagttccacatgaac

SEQ ID NO: 722 - DNA, 71 bp, chicken (Gallus Gallus)
  misc_feature (36): n=a or g
gatttttaactacagtatgacttaggactaaggctnatgaagccctggaacaaagtgcaacagtgactatg

SEQ ID NO: 723 - DNA, 71 bp, chicken (Gallus Gallus)
  misc_feature (36): n=c or t
gcaaatgatgtaagccaataacaatacagcagcctntcagttttccttccttctgtagctgttctgaggaa

SEQ ID NO: 724 - DNA, 71 bp, chicken (Gallus Gallus)
  misc_feature (36): n=a or g
gcaagaaataatactccacctgaagagatcatcttntcatcttcccacagctttagaaccaagcccttact

SEQ ID NO: 725 - DNA, 71 bp, chicken (Gallus Gallus)
  misc_feature (36): n=c or t
gcaagggaaaggacggagaaatcaagctgtagaatnggcagtaagagaggatgaaaaaccagtgaaaagca

SEQ ID NO: 726 - DNA, 71 bp, chicken (Gallus Gallus)
  misc_feature (36): n=a or c
gcaataaagtgtgacgagttaattctcttatgcttntttctagagcttcagagatgagattagaacttgca

SEQ ID NO: 727 - DNA, 71 bp, chicken (Gallus Gallus)
  misc_feature (36): n=g or t
gcacactgatggcaaactcactgatgggtgaagtcnctggatgtgcacagcatgcgcatcaacagccattg

SEQ ID NO: 728 - DNA, 71 bp, chicken (Gallus Gallus)
  misc_feature (36): n=c or t
gcacatccatcatttaatagagtccctctcaaaaangagtgtgcaatgggaagccctgacccccaaaacac

SEQ ID NO: 729 - DNA, 71 bp, chicken (Gallus Gallus)
  misc_feature (36): n=c or t
gcacatttccataagagaggtgcagattgcactgcncgggagataaatatttctcttcagctgtgaatggc

SEQ ID NO: 730 - DNA, 71 bp, chicken (Gallus Gallus)
  misc_feature (36): n=c or t
gcactgattaagataagtcagaacacaagcgatccncttgcaggcaatcaaagaacgcctgggcaaaagag

SEQ ID NO: 731 - DNA, 71 bp, chicken (Gallus Gallus)
  misc_feature (36): n=c or t
gcacttggttagtgttcaggtgaggatgtcttcaanctgtccacaaggaagattttcatgtagggatggaa

SEQ ID NO: 732 - DNA, 71 bp, chicken (Gallus Gallus)
  misc_feature (36): n=a or g
gcagaaatattcaccagaattaaatgaagtgggtcngtaacatggcagttcaagggccagagagaatgaac

SEQ ID NO: 733 - DNA, 71 bp, chicken (Gallus Gallus)
  misc_feature (36): n=c or t
gcagaacccgaatagaagtgttttcttgaaagagcnatggaataagtctcagtgaatatcttggctgggat

SEQ ID NO: 734 - DNA, 71 bp, chicken (Gallus Gallus)
  misc_feature (36): n=c or t
gcagaactacccagggagttaagctactctagatangttgcagtaaagtagggaaggtggacctaattata

SEQ ID NO: 735 - DNA, 71 bp, chicken (Gallus Gallus)
  misc_feature (36): n=a or g
gcagaattgacagaaatagaactatcctactgtagnctcaactggaacataggaaagctaagtcaaatgag

SEQ ID NO: 736 - DNA, 71 bp, chicken (Gallus Gallus)
  misc_feature (36): n=c or t
gcagatcggggtctttttctctctccatcttcaaangcctccactgagtcccatagcagggacagaaagag

SEQ ID NO: 737 - DNA, 71 bp, chicken (Gallus Gallus)
  misc_feature (36): n=c or t
gcaggcgtcctgagtctaattgcacggccacatagnctctgcacataatacttggtctgtcagctgttcat

SEQ ID NO: 738 - DNA, 71 bp, chicken (Gallus Gallus)
  misc_feature (36): n=c or t
gcaggttgctttcgtgacagcacagtacgcagcttngggaggaatggctctgccctcttcctttttgtttt

SEQ ID NO: 739 - DNA, 71 bp, chicken (Gallus Gallus)
  misc_feature (36): n=a or g
gcagtattggttgtatgcatagctttcacccttacngtggtatcagtatagataacagaccaattaaccac

SEQ ID NO: 740 - DNA, 71 bp, chicken (Gallus Gallus)
  misc_feature (36): n=a or g
gcagtgcgccaactatttctcaacctgtactttcantctggggtaacatcttgcacaggcaagaaaggagc

SEQ ID NO: 741 - DNA, 71 bp, chicken (Gallus Gallus)
  misc_feature (36): n=c or t
gcagtgcttttttcagcacttaaagcacaagtttcngtggttcagatggcttttcttgaagaggatgggtg

SEQ ID NO: 742 - DNA, 71 bp, chicken (Gallus Gallus)
  misc_feature (36): n=a or g
gcatactgagaaagatcagcaaatagtaggaagacntagtatggctatagagctgttacatcatcagagtt

SEQ ID NO: 743 - DNA, 71 bp, chicken (Gallus Gallus)
  misc_feature (36): n=a or g
gcatattttcactccactgtgattgctatcagcccntctgctgtgcagtcctgtttgctgagcagctctgt

SEQ ID NO: 744 - DNA, 71 bp, chicken (Gallus Gallus)
  misc_feature (36): n=a or g
gcatccctgtgaaagaaaaaaaccaattcatgctcntccttctgcctgcacctccatcgagctgcccacgt

SEQ ID NO: 745 - DNA, 71 bp, chicken (Gallus Gallus)
  misc_feature (36): n=c or t
gcatctgcatagctggagaatgtgtatatcgagcanatgtgtgtacacgaacacatgcctttgtgtttgta

SEQ ID NO: 746 - DNA, 71 bp, chicken (Gallus Gallus)
  misc_feature (36): n=a or c
gcatgcaacgtttcagtgaacagaaaccattctaanagctggaagcatgcatggagaatagggggagttaa

SEQ ID NO: 747 - DNA, 71 bp, chicken (Gallus Gallus)
  misc_feature (36): n=a or c
gcatgcaagaggtgaagtcggaattaggtgaaaacnaccatcctggctctcgtaagaaagcaccaggagct

SEQ ID NO: 748 - DNA, 71 bp, chicken (Gallus Gallus)
  misc_feature (36): n=a or g
gccaaagtgtctacagaacacaggaataatgtttanattttatttattttgtttacttattttaaggaaag

SEQ ID NO: 749 - DNA, 71 bp, chicken (Gallus Gallus)
  misc_feature (36): n=a or g
gccacaacatcatgcaacattacaggactggagcanagtggctggaaagctgattggaggtaaaggatctg

SEQ ID NO: 750 - DNA, 71 bp, chicken (Gallus Gallus)
  misc_feature (36): n=a or c
gccacatgatttttgcatctcttatttcttattatncccagatttcttccagttttcttatctcctccaca

SEQ ID NO: 751 - DNA, 71 bp, chicken (Gallus Gallus)
  misc_feature (36): n=a or g
gccagttgatcaaataccctgctttgggaatcttcncaaatgcagggccatggaggaagatatgcaagtaa

SEQ ID NO: 752 - DNA, 71 bp, chicken (Gallus Gallus)
  misc_feature (36): n=a or g
gcccagaaattggaaatgaacaatgacttaaagaangaacattgaggacagtatctctgacctgatcatgg

SEQ ID NO: 753 - DNA, 71 bp, chicken (Gallus Gallus)
  misc_feature (36): n=c or t
gccctgaagtggatgctcagtccattctggatcacngttccagctgtggtcagctggaaagctgataatgc

SEQ ID NO: 754 - DNA, 71 bp, chicken (Gallus Gallus)
  misc_feature (36): n=c or t
gcctgtgaacttagacaaattgtaaggagtgtaaangtgaatggtacagctccactctccattcagattgc

SEQ ID NO: 755 - DNA, 71 bp, chicken (Gallus Gallus)
  misc_feature (36): n=c or t
gcctgtgagccaagagagttgtgtatttcccatgancactggcacccagtttctcatgttcctcagtaccc

SEQ ID NO: 756 - DNA, 71 bp, chicken (Gallus Gallus)
  misc_feature (36): n=g or t
gccttgttgctcttctttttgaatgttaatttcctnttaattagaaatgaagaaataactaattgtttctc

SEQ ID NO: 757 - DNA, 71 bp, chicken (Gallus Gallus)
  misc_feature (36): n=a or g
gctaacctacttttgcaagtgtagcctccagggagntgattggcagacctttactactggggccttaagtc

SEQ ID NO: 758 - DNA, 71 bp, chicken (Gallus Gallus)
  misc_feature (36): n=a or g
gctaatagagttatttaagacttttctctagctgcngtttgactggtacatgtctaatatggacacataag

SEQ ID NO: 759 - DNA, 71 bp, chicken (Gallus Gallus)
  misc_feature (36): n=a or g
gctaatgcacaaaatggtggattgactgggaagctntgaatgacaagtctttttagcatgctgatagcata

SEQ ID NO: 760 - DNA, 71 bp, chicken (Gallus Gallus)
  misc_feature (36): n=a or g
gctatagtcctttatgttgcaaagactttactaacnaagaacaagctcttctttctatcagtgaattaaca

SEQ ID NO: 761 - DNA, 71 bp, chicken (Gallus Gallus)
  misc_feature (36): n=c or t
gctcctgttggaactactgcattcctggccatcacngcagctctgttctcttaaggctcttaatcgtgctc

SEQ ID NO: 762 - DNA, 71 bp, chicken (Gallus Gallus)
  misc_feature (36): n=c or t
gctctgctatccctcttgtaatttctttctcacttngaaaaggatgactgaatgtggtgtggattggggaa

SEQ ID NO: 763 - DNA, 71 bp, chicken (Gallus Gallus)
  misc_feature (36): n=c or t
gctgaactgttcttggattttctgtaaattgactgnttaatgctaaagatgaaaatgggcttttccttaac

SEQ ID NO: 764 - DNA, 71 bp, chicken (Gallus Gallus)
  misc_feature (36): n=a or g
gctgagtagtttctgggaatgtggtttttgtctgantcagtagtgttgagatgttcagtgtgtgtgttaat

SEQ ID NO: 765 - DNA, 71 bp, chicken (Gallus Gallus)
  misc_feature (36): n=a or g
gctgatatgtactgttttagcgtaagtgaaaagcantatagctcataaggcatgtgattgtaatggttgaa

SEQ ID NO: 766 - DNA, 71 bp, chicken (Gallus Gallus)
  misc_feature (36): n=c or t
gctgcatagaggcctcccactgctgagtggataaancctctcacaattgtgtgcagtatgaaggaaagaat

SEQ ID NO: 767 - DNA, 71 bp, chicken (Gallus Gallus)
  misc_feature (36): n=a or g
gctgctgggtcactttgccttctctattggcaaatncaatccataccaaaacacaatcttgtgtagagaaa

SEQ ID NO: 768 - DNA, 71 bp, chicken (Gallus Gallus)
  misc_feature (36): n=a or g
gctgtaatgagctacaggttctgtgagccactccangccctcaaagtaaaccattccggtagatgacacta

SEQ ID NO: 769 - DNA, 71 bp, chicken (Gallus Gallus)
  misc_feature (36): n=a or c
gctgtcccaaactcctgtggagttccagtgatgcantggatccaaatcacgcaacacagtggtggtgcagt

SEQ ID NO: 770 - DNA, 71 bp, chicken (Gallus Gallus)
  misc_feature (36): n=c or t
gctgtttgaagccattccattatttggaagggactngtgtcttctagctggcatgatagcaggtcagagag

SEQ ID NO: 771 - DNA, 71 bp, chicken (Gallus Gallus)
  misc_feature (36): n=c or t
gcttaagtaagaagtaatcacctgtattgtacacanattcttaaagctctagaatgaccagccgcactccc

SEQ ID NO: 772 - DNA, 71 bp, chicken (Gallus Gallus)
  misc_feature (36): n=a or g
gcttctgcagttcccaatctcctgttctgatagctncaataaacacacttctggtattgtgcactttgaac

SEQ ID NO: 773 - DNA, 71 bp, chicken (Gallus Gallus)
  misc_feature (36): n=a or g
gcttgttttcttggtaccagaagcttttgtatcagnttctctgaggcagcctgtaattatggttaatttct

SEQ ID NO: 774 - DNA, 71 bp, chicken (Gallus Gallus)
  misc_feature (36): n=c or t
gctttgcatccaaagaggctttctaaggctggctgnttcccccactgcaatccatcactggcgagggggca

SEQ ID NO: 775 - DNA, 71 bp, chicken (Gallus Gallus)
  misc_feature (36): n=c or t
gcttttggaaattgttagcattgtaaacactgaagncattagttggtcgtgttataggctctgctgcattt

SEQ ID NO: 776 - DNA, 71 bp, chicken (Gallus Gallus)
  misc_feature (36): n=a or g
gctttttgttaattctcctttgccacaaaaatagantgacacattaagctccgctcttagaaacccaatgt

SEQ ID NO: 777 - DNA, 71 bp, chicken (Gallus Gallus)
  misc_feature (36): n=c or t
gcttttttctgctgtcacaaccttctctgactgtanagatgagatgtgtcttggtatcactgcagctctga

SEQ ID NO: 778 - DNA, 71 bp, chicken (Gallus Gallus)
  misc_feature (36): n=c or t
ggaaacaccctgtgcaacttgtgcatgtaggtgtangccctacccagaaaagaaagaagtatgtcaatcaa

SEQ ID NO: 779 - DNA, 71 bp, chicken (Gallus Gallus)
  misc_feature (36): n=a or c
ggaaagtaatttataggctattagctgggtctgccncaggagaacatgcatcccatgctgtgggtatggca

SEQ ID NO: 780 - DNA, 71 bp, chicken (Gallus Gallus)
  misc_feature (36): n=c or t
ggaacacttacaggaacgattgctgcaaatcgtctncagctctgtcacttaccaattagataactgcatat

SEQ ID NO: 781 - DNA, 71 bp, chicken (Gallus Gallus)
  misc_feature (36): n=c or t
ggaacaggaactaatgggtcagaaatcagcgatagngattatcaggcagaatacccagatgactatcacgg

SEQ ID NO: 782 - DNA, 71 bp, chicken (Gallus Gallus)
  misc_feature (36): n=a or g
ggaaccatgccctcaggtcaacaaaagaaccacagnaaacaagctcagaatatcttttgcacttctgaaac

SEQ ID NO: 783 - DNA, 71 bp, chicken (Gallus Gallus)
  misc_feature (36): n=c or t
ggaagaaatgctgaccaggcattgcattgatggagnattacagctctcacaacaaacttaacttgcaaact

SEQ ID NO: 784 - DNA, 71 bp, chicken (Gallus Gallus)
  misc_feature (36): n=c or t
ggaatacacaatatggacaaacttagacacaaacantaagaaaatacagtagatcttgagatggatttgca

SEQ ID NO: 785 - DNA, 71 bp, chicken (Gallus Gallus)
  misc_feature (36): n=c or t
ggaatagaaaggtgtcagcttgggtagctcccatcnagaggggaaccatggagcctgggctcatccccaac

SEQ ID NO: 786 - DNA, 71 bp, chicken (Gallus Gallus)
  misc_feature (36): n=c or t
ggacaagaattgatcaaatcatatttgaagccaaangggagggatagaaatccagatcagagcttgagacc

SEQ ID NO: 787 - DNA, 71 bp, chicken (Gallus Gallus)
  misc_feature (36): n=a or g
ggacaagtgggtcaagcccagctgtgaactatgagngcaaagtacacaagtctgaagcctcatcatagtct

SEQ ID NO: 788 - DNA, 71 bp, chicken (Gallus Gallus)
  misc_feature (36): n=c or t
ggacactactctcttccagtgttagtgttgtcacanattacaagcagtagccatctgccacatagctgtat

SEQ ID NO: 789 - DNA, 71 bp, chicken (Gallus Gallus)
  misc_feature (36): n=a or g
ggactggcaagtgtttgaaaacagagttgttaaatntctttttgatccttgatgcagtaaaggaaaagata

SEQ ID NO: 790 - DNA, 71 bp, chicken (Gallus Gallus)
  misc_feature (36): n=c or t
ggagaaaggcaccaaggctgacagaagtgtcctaanggccgggtctggctgctgagctgcccaaaggatca

SEQ ID NO: 791 - DNA, 71 bp, chicken (Gallus Gallus)
  misc_feature (36): n=a or g
ggagattctcagtgcttatagtagttggacacaaancccatttcccagatcttctctgtgttggttttcag

SEQ ID NO: 792 - DNA, 71 bp, chicken (Gallus Gallus)
  misc_feature (36): n=a or c
ggagcaggagcacctctgtgcaatgtagggaaatancccgtagcatccctgaaaatttctctttggataca

SEQ ID NO: 793 - DNA, 71 bp, chicken (Gallus Gallus)
  misc_feature (36): n=a or g
ggagcctctgcctcatctgactgctgtagatatgcntgtcatgtccgtgccttgtcaccaggcgattaaaa

SEQ ID NO: 794 - DNA, 71 bp, chicken (Gallus Gallus)
  misc_feature (36): n=a or g
ggagctatttggtactgcaaatttatcagtgacacngcactgatggactgatgaacttaaaccacttaaag

SEQ ID NO: 795 - DNA, 71 bp, chicken (Gallus Gallus)
  misc_feature (36): n=c or t
ggagggagagggaacacttcctttggttaaagacgnttgcagtttcggaaaaacagaagtccttgaaaaaa

SEQ ID NO: 796 - DNA, 71 bp, chicken (Gallus Gallus)
  misc_feature (36): n=a or g
ggagggggtgatgcatcagtggtggttgacccatanttgggcagctcctctgcagctgaacgtgctgccct

SEQ ID NO: 797 - DNA, 71 bp, chicken (Gallus Gallus)
  misc_feature (36): n=a or g
ggagtttgggcaacaggaagcacaaaaacagcaganaagaaatgcactaataaatactgggggccacccag

SEQ ID NO: 798 - DNA, 71 bp, chicken (Gallus Gallus)
  misc_feature (36): n=g or t
ggagttttttccactatccagctagtactgtgctgnagacacagacatttttgtttggggacagaaatctt

SEQ ID NO: 799 - DNA, 71 bp, chicken (Gallus Gallus)
  misc_feature (36): n=c or t
ggatgagggtgggggaatcacattttcactgaatgngggcatgtttcagattcatctggcccatggacagc

SEQ ID NO: 800 - DNA, 71 bp, chicken (Gallus Gallus)
  misc_feature (36): n=a or c
ggattcatttagaacttattaattacatttgcatangcctgaaagctgacagaagaatgagcactcgtctt

SEQ ID NO: 801 - DNA, 71 bp, chicken (Gallus Gallus)
  misc_feature (36): n=c or t
ggcacatcactccatctatgactcattagtatgtgntgagactcagcacgacagcagctcaatacttccct

SEQ ID NO: 802 - DNA, 71 bp, chicken (Gallus Gallus)
  misc_feature (36): n=a or g
ggccagagctaaatcatgcgttgatgggaggggtangataccatgtaagcaaaagaagtggagttgcatcc

SEQ ID NO: 803 - DNA, 71 bp, chicken (Gallus Gallus)
  misc_feature (36): n=a or g
ggcccacttctccagtgtgttaaggtcctctgaatngcagcacaaccagctagttgctcctggctgtttgg

SEQ ID NO: 804 - DNA, 71 bp, chicken (Gallus Gallus)
  misc_feature (36): n=a or g
ggcctaagatctcagtctacttaagtgactcagctnaggctaaggaattgactttgttgtgatctgctaat

SEQ ID NO: 805 - DNA, 71 bp, chicken (Gallus Gallus)
  misc_feature (36): n=a or g
ggcgaagaagtagctgaaatagatagcatgaaaatntctgagcatgttttgacaagactacattctttcgg

SEQ ID NO: 806 - DNA, 71 bp, chicken (Gallus Gallus)
  misc_feature (36): n=a or g
ggcggtcatttagagagttgggtctgagctggaatnttctgtcaccccacatgcgttgtgcccagtgcatt

SEQ ID NO: 807 - DNA, 71 bp, chicken (Gallus Gallus)
  misc_feature (36): n=c or t
ggctaatcttgaagtaccttcaagagagatgaacancacaggagacggtggcattgcccatggtggcacag

SEQ ID NO: 808 - DNA, 71 bp, chicken (Gallus Gallus)
  misc_feature (36): n=c or t
gggaagcaggccaggtagagatatagaaattatacngtcaggaaacttctgggttttcaggtccccccagt

SEQ ID NO: 809 - DNA, 71 bp, chicken (Gallus Gallus)
  misc_feature (36): n=a or g
gggaataacaccattagctactaaaaatgttcagancttcagagtcactcagtctattcccctgtaatagg

SEQ ID NO: 810 - DNA, 71 bp, chicken (Gallus Gallus)
  misc_feature (36): n=a or g
gggatctagattttgcacagatgctagttaaggtcnggcaataggaatcttcccatcaagctgagatcttc

SEQ ID NO: 811 - DNA, 71 bp, chicken (Gallus Gallus)
  misc_feature (36): n=a or g
gggcaggtcttcctgtactgtgaaagcagagtatcngtataaatagtggcagtgagatctgagctgaaata

SEQ ID NO: 812 - DNA, 71 bp, chicken (Gallus Gallus)
  misc_feature (36): n=c or t
ggggcagtttctcttgaagcaggcagatgtgcaagnccttcagaggaactgggctggatcctcaagctgtg

SEQ ID NO: 813 - DNA, 71 bp, chicken (Gallus Gallus)
  misc_feature (36): n=c or t
ggggcatcttcctccggatccagctcaagctgaatngcttccaggggttccacatctagaatgttatcagc

SEQ ID NO: 814 - DNA, 71 bp, chicken (Gallus Gallus)
  misc_feature (36): n=c or t
gggggagaaatatgaatgggagaggagtcaagaacnatggcaagctgcaattcctgcactgctgttgctgg

SEQ ID NO: 815 - DNA, 71 bp, chicken (Gallus Gallus)
  misc_feature (36): n=c or t
gggtaaagttcttacctcctctccagatgtaggtcncagagctgcaccatccacctccaggaaaaaaaaaa

SEQ ID NO: 816 - DNA, 71 bp, chicken (Gallus Gallus)
  misc_feature (36): n=a or g
gggttaaaatctcactcatggatttatgggacggcnctgatcctgcttgccgtgcggtgatgacattgtac

SEQ ID NO: 817 - DNA, 71 bp, chicken (Gallus Gallus)
  misc_feature (36): n=c or t
gggttgaaccagaaacccacatcccaagcttcatcncaacacatctctgggacccaggtctctttctaaac

SEQ ID NO: 818 - DNA, 71 bp, chicken (Gallus Gallus)
  misc_feature (36): n=g or t
gggttgctttatatttagcaattatgtttctaccanccacaatgaagtaagagagatatttccatgtaatc

SEQ ID NO: 819 - DNA, 71 bp, chicken (Gallus Gallus)
  misc_feature (36): n=c or t
ggtcaggacaaaactattcaagtaaacagttctaangctaagacatagataaaggaaatacattctgaaga

SEQ ID NO: 820 - DNA, 71 bp, chicken (Gallus Gallus)
  misc_feature (36): n=c or t
ggtcatcattgtccaggacagaagttgagggtcatntgcctacacatatgttggttggtagtaatctccat

SEQ ID NO: 821 - DNA, 71 bp, chicken (Gallus Gallus)
  misc_feature (36): n=a or g
ggtccaacgaggcacccaatttttcttgtataagancagtaagaggcattttccaggatgaatccctacac

SEQ ID NO: 822 - DNA, 71 bp, chicken (Gallus Gallus)
  misc_feature (36): n=a or g
ggtctagagcagggagcaaacgcaaaaggaaacaantgcaatttcccactggtaagctgtgacaagtagga

SEQ ID NO: 823 - DNA, 71 bp, chicken (Gallus Gallus)
  misc_feature (36): n=a or g
ggtgacaaaaggttgcctggaattttcatctcttcnttcaaggacatagtccagggaagagcagtactgag

SEQ ID NO: 824 - DNA, 71 bp, chicken (Gallus Gallus)
  misc_feature (36): n=c or t
ggtgagccttttcttattgtgtgctaccagtaacgnatttattctcacctagaacgtttccatttctctga

SEQ ID NO: 825 - DNA, 71 bp, chicken (Gallus Gallus)
  misc_feature (36): n=a or g
ggtgattcacccttcctctgagcttatctgccatgnctcctgtaggctgcggtgggcaacagggagctctg

SEQ ID NO: 826 - DNA, 71 bp, chicken (Gallus Gallus)
  misc_feature (36): n=a or c
ggtggatgagatttgaatatttaaaatctaccctgnaaggggatatggcatacatcctgtctgggaccaga

SEQ ID NO: 827 - DNA, 71 bp, chicken (Gallus Gallus)
  misc_feature (36): n=c or t
ggtggaacgtcacatccatccatgcgtttacaccantgaagggcttttcagggtgagctgttaaggctgtt

SEQ ID NO: 828 - DNA, 71 bp, chicken (Gallus Gallus)
  misc_feature (36): n=c or t
ggtgtgcggtgatatttcagtcgggaccactacaanttgtggtacagagctgaaagtattttacattcaga

SEQ ID NO: 829 - DNA, 71 bp, chicken (Gallus Gallus)
  misc_feature (36): n=a or g
ggtttgtgtgagacttactcagcctcagacctgctncccgtgatgtgaaagctgtcacaggcttttatagg

SEQ ID NO: 830 - DNA, 71 bp, chicken (Gallus Gallus)
  misc_feature (36): n=a or g
ggttttgaaaggtccaatggtttcctcaggctgttncatgcctccttgggtgtgacaggaagatccagagt

SEQ ID NO: 831 - DNA, 71 bp, chicken (Gallus Gallus)
  misc_feature (36): n=c or t
gtaaaaagttcgaattaggagatttcaggcaaaatnaaggaatttaaattctgtcttctgttttttttttt

SEQ ID NO: 832 - DNA, 71 bp, chicken (Gallus Gallus)
  misc_feature (36): n=a or g
gtaaagtacaactaaaatggcggttgaggatagatnattccaccaacattccaaagaattccccacaaaca

SEQ ID NO: 833 - DNA, 71 bp, chicken (Gallus Gallus)
  misc_feature (36): n=c or t
gtaaatactgaagtatgactagtttataaggtcagnctcacaaacaaacacagctttcatcacacttttca

SEQ ID NO: 834 - DNA, 71 bp, chicken (Gallus Gallus)
  misc_feature (36): n=c or t
gtaaggccatgtcccagctgaaagtttcatccactnactacttctcatctgctgcctcagcaggatattta

SEQ ID NO: 835 - DNA, 71 bp, chicken (Gallus Gallus)
  misc_feature (36): n=c or t
gtaaggtgggagctgtaaagccatggttcctccaangtgtaacaggcagcaatgctcctggctcataactt

SEQ ID NO: 836 - DNA, 71 bp, chicken (Gallus Gallus)
  misc_feature (36): n=c or t
gtaatagaagtgatgcaggcttgggggtaaactatnttccaggcatgtagccaaattcatctcttgcaata

SEQ ID NO: 837 - DNA, 71 bp, chicken (Gallus Gallus)
  misc_feature (36): n=c or t
gtacaatagctttttgtcagggtgtgtgtgttaaantacttatgtacttctagcccaaagtgcacagatgt

SEQ ID NO: 838 - DNA, 71 bp, chicken (Gallus Gallus)
  misc_feature (36): n=c or t
gtacataaccaagtatccaagtgtatgtagattcangggagagtagggcaccctaccctcccaggcaagcc

SEQ ID NO: 839 - DNA, 71 bp, chicken (Gallus Gallus)
  misc_feature (36): n=a or g
gtacctgaatgattaatattagctgattatctagcntaaagcactctaagtaaattgtgagaaagtaggct

SEQ ID NO: 840 - DNA, 71 bp, chicken (Gallus Gallus)
  misc_feature (36): n=c or t
gtactcccatgcactttagttacatgcttacgatantctgtgagatataagctcatgtgtcttcctttgtg

SEQ ID NO: 841 - DNA, 71 bp, chicken (Gallus Gallus)
  misc_feature (36): n=a or g
gtagacatatttgtcagctcccagaatagactgaancagaaatgctaagatctcaggtttgaagctctctt

SEQ ID NO: 842 - DNA, 71 bp, chicken (Gallus Gallus)
  misc_feature (36): n=a or g
gtagactagaactatacctaggttcaaggcagggangaacaaaccttctattaaaaaatagttgataaagt

SEQ ID NO: 843 - DNA, 71 bp, chicken (Gallus Gallus)
  misc_feature (36): n=a or g
gtagcctgacaagttgcctttaacaaaatctgagantcttttttgaaatggctttgaatggttgacataaa

SEQ ID NO: 844 - DNA, 71 bp, chicken (Gallus Gallus)
  misc_feature (36): n=a or g
gtaggtaataagatagctactagggttaggagagcnaagaatttgtatgggacaacatccctcttgatttc

SEQ ID NO: 845 - DNA, 71 bp, chicken (Gallus Gallus)
  misc_feature (36): n=a or g
gtataacatgaaataagtcatagtttggaaggcacngtgcttggataaatgaactttctccatggagctta

SEQ ID NO: 846 - DNA, 71 bp, chicken (Gallus Gallus)
  misc_feature (36): n=a or g
gtatatacatttaggttaacaaatgtaacctatgtntcacattgtttccaggtagtgaatagcactaagct

SEQ ID NO: 847 - DNA, 71 bp, chicken (Gallus Gallus)
  misc_feature (36): n=g or t
gtatctgcaagttctcagctgctaacgcaatgaagngaatgaagttcaggttcaaatggcatggaattgag

SEQ ID NO: 848 - DNA, 71 bp, chicken (Gallus Gallus)
  misc_feature (36): n=a or g
gtatgcttatgttatataatacagagataacagaangatacccaatgttgcagtattcatgttgggctttg

SEQ ID NO: 849 - DNA, 71 bp, chicken (Gallus Gallus)
  misc_feature (36): n=a or g
gtatttaatgtacattataattttctgaaccataanatgtgcaacatgcactccctgaagcttgataatga

SEQ ID NO: 850 - DNA, 71 bp, chicken (Gallus Gallus)
  misc_feature (36): n=a or g
gtcagcagttctgtatgttgcagcctaaaatgcacncaagataccaacctgctgggatgctgagctccagc

SEQ ID NO: 851 - DNA, 71 bp, chicken (Gallus Gallus)
  misc_feature (36): n=a or g
gtcatctcataactctactccttggcttatggtgtngttggcaagctgtacctgttgcctctcaggtagtg

SEQ ID NO: 852 - DNA, 71 bp, chicken (Gallus Gallus)
  misc_feature (36): n=c or t
gtcccgaacttaggaatttactgatggctccaacangaccccattgtcacacctgcacccagcccaaacct

SEQ ID NO: 853 - DNA, 71 bp, chicken (Gallus Gallus)
  misc_feature (36): n=a or c
gtctaatctctgctattgttgggcaaagaagagcantagggtcagcatggtttatgtacaagctgtttctt

SEQ ID NO: 854 - DNA, 71 bp, chicken (Gallus Gallus)
  misc_feature (36): n=a or g
gtctagatacttgcttcatatagacttctaaaggantaaggttttgcacagcaggagcaaaaagcatcaaa

SEQ ID NO: 855 - DNA, 71 bp, chicken (Gallus Gallus)
  misc_feature (36): n=a or g
gtcttgaacagctgccttaagtacatctgttagtcngtgtggagaggtaggagattccagggggtccctca

SEQ ID NO: 856 - DNA, 71 bp, chicken (Gallus Gallus)
  misc_feature (36): n=c or t
gtctttttgcttttgtgtttgtgcatgcaattaaangaaagggcattttgcaacatttgtacttaaatgta

SEQ ID NO: 857 - DNA, 71 bp, chicken (Gallus Gallus)
  misc_feature (36): n=c or t
gtgaagacagtacacattttgttcccaagctgctangaaacaaattggcaaactgaccacgcttctgcact

SEQ ID NO: 858 - DNA, 71 bp, chicken (Gallus Gallus)
  misc_feature (36): n=c or t
gtgaatgcgttaagacgaatggttattttcctaaangtaaagcttggattctccttccttgagttcctgtg

SEQ ID NO: 859 - DNA, 71 bp, chicken (Gallus Gallus)
  misc_feature (36): n=c or t
gtgacattcaggcaagatctttgaagctatagctgngattgtgaccttacaggtctataatagtctgagag

SEQ ID NO: 860 - DNA, 71 bp, chicken (Gallus Gallus)
  misc_feature (36): n=c or t
gtgacctcaagcttctgcattccaaacgtgaagacngctgacttccctgtggctccaactctcgtaaaact

SEQ ID NO: 861 - DNA, 71 bp, chicken (Gallus Gallus)
  misc_feature (36): n=c or t
gtgcaaatatagtgcagcacacactgcttctcaganccccctccacagcagctgtcagtgccccccagcag

SEQ ID NO: 862 - DNA, 71 bp, chicken (Gallus Gallus)
  misc_feature (36): n=c or t
gtgcaaccagagcagtgagtttagcaagcagcaacngactgtgcttcggcactgaaggtggctttgaatac

SEQ ID NO: 863 - DNA, 71 bp, chicken (Gallus Gallus)
  misc_feature (36): n=a or g
gtgctattttctaatccttttaaccataccacatgntatataaccctaccactgggcataaatagctttgg

SEQ ID NO: 864 - DNA, 71 bp, chicken (Gallus Gallus)
  misc_feature (36): n=a or g
gtgctctgctgtacttctgaggcttttatgtgtacngtaatcttgtccctgatcttgcttgcaagctagaa

SEQ ID NO: 865 - DNA, 71 bp, chicken (Gallus Gallus)
  misc_feature (36): n=c or t
gtggttgcttactctttgcttgtaataattctcatnctcactcattcctctttttccactgaggagcatga

SEQ ID NO: 866 - DNA, 71 bp, chicken (Gallus Gallus)
  misc_feature (36): n=c or t
gtggtttaaactcagccaaatccagagggcatctgnggggtcctggggtgaaacgggtaacatgggtccca

SEQ ID NO: 867 - DNA, 71 bp, chicken (Gallus Gallus)
  misc_feature (36): n=a or g
gtgtctgcacacatccatgcaatggcagctgcatcnctttgggttcttgtgagctggatgcactgagcgct

SEQ ID NO: 868 - DNA, 71 bp, chicken (Gallus Gallus)
  misc_feature (36): n=g or t
gtgtctgtgcctgtacaagaagcctttctgtggccnctgtacacagcggtctgctcctagtcacaagttcc

SEQ ID NO: 869 - DNA, 71 bp, chicken (Gallus Gallus)
  misc_feature (36): n=g or t
gtgtgtacatatgtaagagagatttaaaatccaatncttttctttcagaatgataaatttacatttgctga

SEQ ID NO: 870 - DNA, 71 bp, chicken (Gallus Gallus)
  misc_feature (36): n=a or g
gtgtgtccctggctttttagggccttgctaatggtngtgagccttgcagagtttcacctctcctctgcttg

SEQ ID NO: 871 - DNA, 71 bp, chicken (Gallus Gallus)
  misc_feature (36): n=a or g
gtgtttaacatatacaataacaagtgtacttggganggctccttgcatcccttggagcctgcagggagatc

SEQ ID NO: 872 - DNA, 71 bp, chicken (Gallus Gallus)
  misc_feature (36): n=c or t
gtgtttcttcaaaacaaaacaataagaagctaaaanattaaatacagaattcactatgaaggtgtgaaatg

SEQ ID NO: 873 - DNA, 71 bp, chicken (Gallus Gallus)
  misc_feature (36): n=g or t
gttaatccatcattctaagggaacaagtgccaaagngaaggaacagacctggtccagaccagctcaagaag

SEQ ID NO: 874 - DNA, 71 bp, chicken (Gallus Gallus)
  misc_feature (36): n=a or c
gttagaagcagatagtgagagggaacagaggactangggagaaaaagaggatgctgcatcctctgaggtga

SEQ ID NO: 875 - DNA, 71 bp, chicken (Gallus Gallus)
  misc_feature (36): n=c or t
gttagaatgcctaagcttaagttcttagcttctacncgacaagtcgattttaaaacaaagctttaaacaaa

SEQ ID NO: 876 - DNA, 71 bp, chicken (Gallus Gallus)
  misc_feature (36): n=c or t
gttataaaattgttctctgataattttgttaggtgncccttgctttactgctataggaagcagtaaataac

SEQ ID NO: 877 - DNA, 71 bp, chicken (Gallus Gallus)
  misc_feature (36): n=c or t
gttatttaaagccttggaggtagcagctccaaatanatttttactggcaagcactttggtgtgcaagagtt

SEQ ID NO: 878 - DNA, 71 bp, chicken (Gallus Gallus)
  misc_feature (36): n=c or t
gttattttcctcttgaggaatcagataaatctcctnctttcacgtttcttcaaaagcttcttcccgaccat

SEQ ID NO: 879 - DNA, 71 bp, chicken (Gallus Gallus)
  misc_feature (36): n=a or g
gttcatccactaaaatgcttgtttcacagtagaagnctgtcaggttggtcaagtactttaccttcataaaa

SEQ ID NO: 880 - DNA, 71 bp, chicken (Gallus Gallus)
  misc_feature (36): n=c or t
gttcccataattagagaataactgcacaggttcaangtagaactaactataggctgtaatatgtggattgg

SEQ ID NO: 881 - DNA, 71 bp, chicken (Gallus Gallus)
  misc_feature (36): n=c or t
gttgaagagctgaatctaatggttccttatctatcnatggggctcatatgtgctgttggacacccgagaca

SEQ ID NO: 882 - DNA, 71 bp, chicken (Gallus Gallus)
  misc_feature (36): n=a or g
gttgcaattacaaaggacagaagttccaagacaacngtgcagttaatttaagatataatgctaccttcatg

SEQ ID NO: 883 - DNA, 71 bp, chicken (Gallus Gallus)
  misc_feature (36): n=c or t
gttgctgtgtgggattttttcattttaaacatatcntccagatccacagcttctagaaattgcttcttttc

SEQ ID NO: 884 - DNA, 71 bp, chicken (Gallus Gallus)
  misc_feature (36): n=c or t
gttgctttacagaaagcaacttgcctttaaaaatgnagggggctgcttccagctatttgaacaatggactt

SEQ ID NO: 885 - DNA, 71 bp, chicken (Gallus Gallus)
  misc_feature (36): n=a or g
gttgtagccttcacttgcctgtttcttttcagacanctgggaaaaattctttgttgttttcctccccattt

SEQ ID NO: 886 - DNA, 71 bp, chicken (Gallus Gallus)
  misc_feature (36): n=c or t
gttgtcatcaaggatgaaaaaacatggaaggtgaanagtggtgactagttttagctgtggatctcaaataa

SEQ ID NO: 887 - DNA, 71 bp, chicken (Gallus Gallus)
  misc_feature (36): n=a or g
gtttaacttacggggcaccaaacaataaggtgggancatttctggggaaacaaacaagctagtggtaaacc

SEQ ID NO: 888 - DNA, 71 bp, chicken (Gallus Gallus)
  misc_feature (36): n=a or g
gtttcattgttatggtccacagtaggcagttgccancgtgatatgctatgaaatctgtagctgtgattcta

SEQ ID NO: 889 - DNA, 71 bp, chicken (Gallus Gallus)
  misc_feature (36): n=a or g
gtttccagcaccatttgcattgtgacctgggcatcnacagcagcctgtaggagctgggcagttttattgcc

SEQ ID NO: 890 - DNA, 71 bp, chicken (Gallus Gallus)
  misc_feature (36): n=c or t
gtttgaagtcctacattctttgttcaggaccagttnagcagcttaaaatatgaagtactccaggtataaag

SEQ ID NO: 891 - DNA, 71 bp, chicken (Gallus Gallus)
  misc_feature (36): n=a or g
gtttgatattatcagtgtgaggaacgcagaagggtntttgaggggaaggatagagggagggaggttgtcct

SEQ ID NO: 892 - DNA, 71 bp, chicken (Gallus Gallus)
  misc_feature (36): n=c or t
gtttgggtctggcagaaaggttttatcttcaagttnctacgggtagatgtgtttggagtgtgggccttggt

SEQ ID NO: 893 - DNA, 71 bp, chicken (Gallus Gallus)
  misc_feature (36): n=c or t
gttttataataactgagaagattgtgaagtagctgncagaagttcacctccacctgcttgttcagcagcat

SEQ ID NO: 894 - DNA, 71 bp, chicken (Gallus Gallus)
  misc_feature (36): n=a or g
gtttttcttctgacttgttatggtgctatggccaanaccagagcttcagtttgatgtcagattctgcagag

SEQ ID NO: 895 - DNA, 71 bp, chicken (Gallus Gallus)
  misc_feature (36): n=g or t
taaaagtactggaaagatgttctgcaattttcccancattcctatggctgaatccaagatcaggtttgtca

SEQ ID NO: 896 - DNA, 71 bp, chicken (Gallus Gallus)
  misc_feature (36): n=a or g
taaaatggtcacgtgtgattcaagagccataaagcngctgcctgctgaactggggagggcagctcaccatt

SEQ ID NO: 897 - DNA, 71 bp, chicken (Gallus Gallus)
  misc_feature (36): n=a or g
taaactgtctcttttaagatctagagggaaaagaanttgccttaccaagttcaagccacattaccctagga

SEQ ID NO: 898 - DNA, 71 bp, chicken (Gallus Gallus)
  misc_feature (36): n=c or t
taaagagcagattaataatcaattattaatcaagcntaatggggtatagctagcagacttccaaggctctc

SEQ ID NO: 899 - DNA, 71 bp, chicken (Gallus Gallus)
  misc_feature (36): n=a or g
taaaggagaaataaagccacgtttttatcagtccantttcttcacccaaggcgtgcagctaagagcgaagg

SEQ ID NO: 900 - DNA, 71 bp, chicken (Gallus Gallus)
  misc_feature (36): n=a or g
taaaggagtgtaagtggaggccggcaaaagcatcancattatgcagcttctcacaagacagatttctaggt

SEQ ID NO: 901 - DNA, 71 bp, chicken (Gallus Gallus)
  misc_feature (36): n=c or t
taacaaaattctttctagtaaacatagcgaccctgntcacagagaaagcagctgcatctttggaaagattc

SEQ ID NO: 902 - DNA, 71 bp, chicken (Gallus Gallus)
  misc_feature (36): n=a or c
taacatataagctgttctgctctaagcacagcacanatatacctccttataatgcatgcctctttacagcc

SEQ ID NO: 903 - DNA, 71 bp, chicken (Gallus Gallus)
  misc_feature (36): n=a or g
taactagggtagtctcctgcagtcttcttaacccantctattttaggaaatagtgtgcatttccaatgtgc

SEQ ID NO: 904 - DNA, 71 bp, chicken (Gallus Gallus)
  misc_feature (36): n=c or t
taagaaaaaatataaatgcctcatttcaatatgtgntttgaagtagatgctctaaaataagcagaattgta

SEQ ID NO: 905 - DNA, 71 bp, chicken (Gallus Gallus)
  misc_feature (36): n=a or g
taagaaaacagtagtataaaaaatagtctgttaggnccccaaaataggctttgcttaacacaaagaaataa

SEQ ID NO: 906 - DNA, 71 bp, chicken (Gallus Gallus)
  misc_feature (36): n=a or g
taagattgtcatggagaaaactttagcaacaatgcntaagcaactgatgatattatctttactcaaatctg

SEQ ID NO: 907 - DNA, 71 bp, chicken (Gallus Gallus)
  misc_feature (36): n=c or t
taagattgtgatgtccaaccttatctctgacagcangttgcctcccagctacgaatgttcaagtgtttata

SEQ ID NO: 908 - DNA, 71 bp, chicken (Gallus Gallus)
  misc_feature (36): n=a or g
taagcaatgtgctgtagctgaccctgatagaaacangggggtgggcctgatcacctccagaagccccttcc

SEQ ID NO: 909 - DNA, 71 bp, chicken (Gallus Gallus)
  misc_feature (36): n=c or t
taaggaataaaaaggcacttttcccagtactacctngcaacatgaatttgtaagacagcacccagacttcg

SEQ ID NO: 910 - DNA, 71 bp, chicken (Gallus Gallus)
  misc_feature (36): n=a or g
taatagtgtcaagatctatcagagtatattgagatnaatgacagaaggtgggaagagtctggaaagaaatc

SEQ ID NO: 911 - DNA, 71 bp, chicken (Gallus Gallus)
  misc_feature (36): n=a or g
taatgctgagctctctttcagatgattattgtgaanactcagggcttaaccacatatgaggcttttggagt

SEQ ID NO: 912 - DNA, 71 bp, chicken (Gallus Gallus)
  misc_feature (36): n=a or g
taatgtaattgttatttatggaattacagagcggtnaacagcttcatgtgcctgctgggggttttgttgct

SEQ ID NO: 913 - DNA, 71 bp, chicken (Gallus Gallus)
  misc_feature (36): n=c or t
taattaatcatgtttgtataacaataatatgcaaanaggagctactctttttacctgccaccattgagttt

SEQ ID NO: 914 - DNA, 71 bp, chicken (Gallus Gallus)
  misc_feature (36): n=c or t
taattactgtaaatatttttagtatcagctaatcanggctctcccttctgtgcctgtcttgttaggtggtc

SEQ ID NO: 915 - DNA, 71 bp, chicken (Gallus Gallus)
  misc_feature (36): n=a or g
taattcattgaaaagtgcagtttcaaatgataaaangtgatcaggaatttggtttcagattttattttcat

SEQ ID NO: 916 - DNA, 71 bp, chicken (Gallus Gallus)
  misc_feature (36): n=a or g
tacacgtggttttctaggcactgaccgttagacaanggcagcccgcagcttttagcagcagctctgagcga

SEQ ID NO: 917 - DNA, 71 bp, chicken (Gallus Gallus)
  misc_feature (36): n=g or t
tacactgaatttcctatgagatagtgggtagtgatntgggctctgaatcttaaaggtctttactgatacat

SEQ ID NO: 918 - DNA, 71 bp, chicken (Gallus Gallus)
  misc_feature (36): n=a or g
tacagagatgttttcccaccctgttctgcgctgtcncagcctcaagtcaagcactgggtgcagttttgaat

SEQ ID NO: 919 - DNA, 71 bp, chicken (Gallus Gallus)
  misc_feature (36): n=c or t
tacagcaatggggaacgaataggacaaaaccagctntggatcaaacactgctgccccaaaagtggatgggt

SEQ ID NO: 920 - DNA, 71 bp, chicken (Gallus Gallus)
  misc_feature (36): n=a or g
tacagctactcattttgatgacctccatgaaaatcngtagttgctgctgaggtgcaatgggataacatgac

SEQ ID NO: 921 - DNA, 71 bp, chicken (Gallus Gallus)
  misc_feature (36): n=c or t
tacatggggccatgtacgtatatgtacatgatgaangatgtagggaaaagaccactcatatgtccagggga

SEQ ID NO: 922 - DNA, 71 bp, chicken (Gallus Gallus)
  misc_feature (36): n=a or g
taccaagtcagagtttggccaggacaatggacttanatctactacttttgagatgattggttttaatactc

SEQ ID NO: 923 - DNA, 71 bp, chicken (Gallus Gallus)
  misc_feature (36): n=a or g
taccaattttagtaaagagttagcgaggggacatgngtaacttgagctcagaataattttgctgccacaga

SEQ ID NO: 924 - DNA, 71 bp, chicken (Gallus Gallus)
  misc_feature (36): n=c or t
tacgtacacatcatggatgaaatgacatgagatttncaggagcttatctacaggcaacaagcaccaaatga

SEQ ID NO: 925 - DNA, 71 bp, chicken (Gallus Gallus)
  misc_feature (36): n=c or t
tacgtatctgtcacaggcactaacatttggaagtcntactgtggtgaataagctaaagagaagttatagcc

SEQ ID NO: 926 - DNA, 71 bp, chicken (Gallus Gallus)
  misc_feature (36): n=c or t
tacgtgttacattagacaaagagcctttctgcaccngaagaagaggctcaggggagaccttatccctctct

SEQ ID NO: 927 - DNA, 71 bp, chicken (Gallus Gallus)
  misc_feature (36): n=a or g
tactaataatcttaatgttttgtggccttgtcagtncctttgtcataaccccggggtcagctgccagctgc

SEQ ID NO: 928 - DNA, 71 bp, chicken (Gallus Gallus)
  misc_feature (36): n=a or c
tactactttattctcaatatacactgctctctttgnacctctgctcttctttcttcctttcagttcattac

SEQ ID NO: 929 - DNA, 71 bp, chicken (Gallus Gallus)
  misc_feature (36): n=a or g
tactgattcatttgtagttaagattattcatacctntctggtcctgaaacatttgtgtttggagaaactct

SEQ ID NO: 930 - DNA, 71 bp, chicken (Gallus Gallus)
  misc_feature (36): n=a or g
tactgtagtcaaagacttccagaagtaagtcctgtncatttaaatgttggtaaagaagctcttcatctgaa

SEQ ID NO: 931 - DNA, 71 bp, chicken (Gallus Gallus)
  misc_feature (36): n=g or t
tactgtatttactagtggtactcacctgaaaaatgntttgtctgtcaatattgaagtaacaaaatgcttaa

SEQ ID NO: 932 - DNA, 71 bp, chicken (Gallus Gallus)
  misc_feature (36): n=c or t
tactgtcttaagcacaacacaaacacaacaaagcangattcatgtcacctgagcagtcattcatagctaca

SEQ ID NO: 933 - DNA, 71 bp, chicken (Gallus Gallus)
  misc_feature (36): n=a or g
tactgtggtcggcagcaatgtcaaataaactgctcngtgtctctcttctgtttggtaactgttcaatgagg

SEQ ID NO: 934 - DNA, 71 bp, chicken (Gallus Gallus)
  misc_feature (36): n=c or t
tacttcaaagagcttctcaactaatttgattatcangagaggggaaattttaatccaaatagttttaaaaa

SEQ ID NO: 935 - DNA, 71 bp, chicken (Gallus Gallus)
  misc_feature (36): n=a or g
tagaataacttgtgttcttcagaatctgtaagtcantgtgtgctgttttcaaatctcaactgcatcactaa

SEQ ID NO: 936 - DNA, 71 bp, chicken (Gallus Gallus)
  misc_feature (36): n=a or c
tagagatcttcggccagtgagtgatgctatgtaagntgaacgttacactagcaagttattatgatcataat

SEQ ID NO: 937 - DNA, 71 bp, chicken (Gallus Gallus)
  misc_feature (36): n=c or t
tagaggtatgtggttgtaccactgtctgccagaacnggagtagcaagtaggagatttgtacaacatatctg

SEQ ID NO: 938 - DNA, 71 bp, chicken (Gallus Gallus)
  misc_feature (36): n=a or g
tagcaaaagtcccggcctttctgagctctgaactanttgctgtgacgtgctgctgcgaggaggagagtggt

SEQ ID NO: 939 - DNA, 71 bp, chicken (Gallus Gallus)
  misc_feature (36): n=c or t
tagcaaaataatacaaaagaggcaagagagacttcnctcgagttctgtggtctttgaattatattctaaac

SEQ ID NO: 940 - DNA, 71 bp, chicken (Gallus Gallus)
  misc_feature (36): n=a or g
tagccacagggtcaagatacaacttaatgtagtacnctgttgtaatgctataatgggatgataatagcagg

SEQ ID NO: 941 - DNA, 71 bp, chicken (Gallus Gallus)
  misc_feature (36): n=a or g
tagccatgggtgagctgtgcctatgaacaggtttgncatatgtcacggttgacgtgacatccttccctctg

SEQ ID NO: 942 - DNA, 71 bp, chicken (Gallus Gallus)
  misc_feature (36): n=a or g
tagctgaaggagttggagactgggttttagcttcantgtgatttttattcttttaaagttggcgttttatc

SEQ ID NO: 943 - DNA, 71 bp, chicken (Gallus Gallus)
  misc_feature (36): n=a or c
tagctgctataatcaacaaagaaatagaagggaatnatttattaccatttttcttcttacaccaaaaccac

SEQ ID NO: 944 - DNA, 71 bp, chicken (Gallus Gallus)
  misc_feature (36): n=a or g
taggaaggtaatgtatccaaaagcttgactgaagcncctctataccaatgcacacagcatggaaaataagc

SEQ ID NO: 945 - DNA, 71 bp, chicken (Gallus Gallus)
  misc_feature (36): n=c or t
taggtactgttctgtgtattcttatgtataacaaanacaattattgttagaaacttgtaaaaggcattgca

SEQ ID NO: 946 - DNA, 71 bp, chicken (Gallus Gallus)
  misc_feature (36): n=g or t
tagtagtgatctcctactgatgttagtgaatggaancacagacatctccagtttcatttttctctgattca

SEQ ID NO: 947 - DNA, 71 bp, chicken (Gallus Gallus)
  misc_feature (36): n=a or g
tagtagtttcaggaatacatggatacttttggaagntgtaagatcagactgttgatttccttagcctagat

SEQ ID NO: 948 - DNA, 71 bp, chicken (Gallus Gallus)
  misc_feature (36): n=a or g
tagtatcatctaggtctgtgatatgctcctgcaatntgaattcttgagctggcagtgggagctccaggaag

SEQ ID NO: 949 - DNA, 71 bp, chicken (Gallus Gallus)
  misc_feature (36): n=a or g
tagtcaaactgtttaatgagaaagagaaaaaagttnccagctcttatttttcaaaatcacacaagcactta

SEQ ID NO: 950 - DNA, 71 bp, chicken (Gallus Gallus)
  misc_feature (36): n=g or t
tataaaggagaaaagtgtagctgtggaccatgttgnacagcagaccagaggaacaaacagtgagtatatac

SEQ ID NO: 951 - DNA, 71 bp, chicken (Gallus Gallus)
  misc_feature (36): n=c or t
tataatttcaggctctattttagccagactacaaantgactttcaaagctgcttagaaatagcagaaagat

SEQ ID NO: 952 - DNA, 71 bp, chicken (Gallus Gallus)
  misc_feature (36): n=a or c
tatagaggtgctatgtccacgaggccattttgtttnacactcagcagctgtgctgacctgcagtatcccca

SEQ ID NO: 953 - DNA, 71 bp, chicken (Gallus Gallus)
  misc_feature (36): n=c or t
tataggaatcaagatcgatggatttattagtacatntgcttaactgctttacagtgctattttcttattta

SEQ ID NO: 954 - DNA, 71 bp, chicken (Gallus Gallus)
  misc_feature (36): n=c or t
tatagtagctattttaggaaacaaaagaaaaatccnaaaccatattcaagttgtgttaattctaaaataaa

SEQ ID NO: 955 - DNA, 71 bp, chicken (Gallus Gallus)
  misc_feature (36): n=a or g
tatatgaatagctttgtaggtttcagggctgcaaanacatttatactaacgctgtatctggtccagatgca

SEQ ID NO: 956 - DNA, 71 bp, chicken (Gallus Gallus)
  misc_feature (36): n=c or t
tatatggtgtttgccctgggcattaatagtaaaganagcaataaatgtgtgcaatgaatacagctcttttc

SEQ ID NO: 957 - DNA, 71 bp, chicken (Gallus Gallus)
  misc_feature (36): n=c or t
tatcaaattcagacataatgccacaagctagctctncttttttacacagtttatttgggcaatggtaaatt

SEQ ID NO: 958 - DNA, 71 bp, chicken (Gallus Gallus)
  misc_feature (36): n=c or t
tatcacacactttacgaatagacttctttcccagantgaatagattttgtgcagcttctcctggtagagaa

SEQ ID NO: 959 - DNA, 71 bp, chicken (Gallus Gallus)
  misc_feature (36): n=c or t
tatgagcataggcacttatgacatcagaagtatttngttttgatggcctcagctggaaaaaacattccctg

SEQ ID NO: 960 - DNA, 71 bp, chicken (Gallus Gallus)
  misc_feature (36): n=c or t
tatggtaaaatacatacacatacgcagtgatgttcnccactgtgagagctaggaaagaccttagatagata

SEQ ID NO: 961 - DNA, 71 bp, chicken (Gallus Gallus)
  misc_feature (36): n=c or t
tatgtcaacttagtaacatcctgggtttaacactangtgttatttttcattagctactgggattttgtgta

SEQ ID NO: 962 - DNA, 71 bp, chicken (Gallus Gallus)
  misc_feature (36): n=a or g
tatgtttctaccaccgtaaactattaccttgggtcnctgggatcggaaatcacaggaaaagcacacactgg

SEQ ID NO: 963 - DNA, 71 bp, chicken (Gallus Gallus)
  misc_feature (36): n=c or t
tattcttcaggtatcggtcagatccagctgtgctgncctgtggggattagagtgccctgctgttgttggag

SEQ ID NO: 964 - DNA, 71 bp, chicken (Gallus Gallus)
  misc_feature (36): n=a or g
tattgcatacagatatacagagattttttaaaaagnacgcattatcttccatctgccttaaatcaatcatg

SEQ ID NO: 965 - DNA, 71 bp, chicken (Gallus Gallus)
  misc_feature (36): n=c or t
tattgtgtaaaaattcagtaagcagtctatttcttncaataatactttcctttggagaaacgtaaaatatg

SEQ ID NO: 966 - DNA, 71 bp, chicken (Gallus Gallus)
  misc_feature (36): n=a or g
tatttccctcacagacacaaagagaagagagcttcnacttagaacagtcccacatttccagttatgaacac

SEQ ID NO: 967 - DNA, 71 bp, chicken (Gallus Gallus)
  misc_feature (36): n=g or t
tatttttaattgatgctagacgaacgtaaatacttnaagctggcgttaagcagcgcagccctttttctccc

SEQ ID NO: 968 - DNA, 71 bp, chicken (Gallus Gallus)
  misc_feature (36): n=c or t
tcaaaacctcttttttctgagcccacagataatgangtgcccccttggaggaggctgctgtaatcctgata

SEQ ID NO: 969 - DNA, 71 bp, chicken (Gallus Gallus)
  misc_feature (36): n=c or t
tcaccaacaatctgaaaagagtcagcagacagactntcagcagcagcatcacaaacgtgaacaacttgaga

SEQ ID NO: 970 - DNA, 71 bp, chicken (Gallus Gallus)
  misc_feature (36): n=c or t
tcactggaagacaaattaaaatatcatatttagagncacttctaaggtacatttgataagactggttcaat

SEQ ID NO: 971 - DNA, 71 bp, chicken (Gallus Gallus)
  misc_feature (36): n=c or t
tcagaattcatttctaacatgataggattgcagcanagagaaaaaagttctctaaccctacctcaacaact

SEQ ID NO: 972 - DNA, 71 bp, chicken (Gallus Gallus)
  misc_feature (36): n=c or t
tcagagttgtgccttgacaagaactcagttgggacngacatgccattcatgtccatgcacaccggagagct

SEQ ID NO: 973 - DNA, 71 bp, chicken (Gallus Gallus)
  misc_feature (36): n=a or g
tcagcatttgatttcggggggatgtgcagcactcanaacagcaccagtttgggggatccggggagaaagca

SEQ ID NO: 974 - DNA, 71 bp, chicken (Gallus Gallus)
  misc_feature (36): n=c or t
tcagctcaccctgcctcctgtctttaacatacgttnaggaacatatgttcaggagtaatgttcaggaaact

SEQ ID NO: 975 - DNA, 71 bp, chicken (Gallus Gallus)
  misc_feature (36): n=a or g
tcagctgtagttgctttgtgccattgataatgagcntagaaggaaaactgtagtgagcccaaaggtgagct

SEQ ID NO: 976 - DNA, 71 bp, chicken (Gallus Gallus)
  misc_feature (36): n=a or g
tcagcttgcctcactcattcatttctaatgtgtttntttccttctctcaattaggtgatttgacggaagac

SEQ ID NO: 977 - DNA, 71 bp, chicken (Gallus Gallus)
  misc_feature (36): n=a or c
tcaggtattaatttggtgttgcagtgcagtatttcnaaagcaaagatttaattagttattatcaccaatct

SEQ ID NO: 978 - DNA, 71 bp, chicken (Gallus Gallus)
  misc_feature (36): n=a or g
tcagttttctgttcttttctttccttagtagatgtntaggcacctcagtaagtttgttttgtgggtgtggg

SEQ ID NO: 979 - DNA, 71 bp, chicken (Gallus Gallus)
  misc_feature (36): n=c or t
tcataaaaagccatacggaattagagaaaatactgntgataactgttaaagcaaagtttaaaaatgccatt

SEQ ID NO: 980 - DNA, 71 bp, chicken (Gallus Gallus)
  misc_feature (36): n=a or c
tcataatgtgcagcaatggatccctttctaactcanctgactggggggtgttttctgtccgtactgccatc

SEQ ID NO: 981 - DNA, 71 bp, chicken (Gallus Gallus)
  misc_feature (36): n=a or g
tcatccctggagttatactagcatttctgtgccacntaagtggctctgtagggatgtagctctcaggctgc

SEQ ID NO: 982 - DNA, 71 bp, chicken (Gallus Gallus)
  misc_feature (36): n=a or g
tcatgagatgatgagagagattttttaaacagcccnagtccgtcgagtgccacctccaggtcgtttgctgt

SEQ ID NO: 983 - DNA, 71 bp, chicken (Gallus Gallus)
  misc_feature (36): n=a or g
tcatgcagctcaatcaaatagtactcatagaaactncagtttatgattgtttcatggtataattagaatac

SEQ ID NO: 984 - DNA, 71 bp, chicken (Gallus Gallus)
  misc_feature (36): n=c or t
tcatgtacaaggtactacacagatttctcaacttcntggagctataacggatgctcctatcaccagctgat

SEQ ID NO: 985 - DNA, 71 bp, chicken (Gallus Gallus)
  misc_feature (36): n=c or t
tcattagtagcaacctacagaggcactgatgctctnattggactttcagggcacctcttcagcgtgcactg

SEQ ID NO: 986 - DNA, 71 bp, chicken (Gallus Gallus)
  misc_feature (36): n=g or t
tcattcaaaggtcaacgttcgggtggaagaaacatntgagggacagaagagacataactgagaaataaaaa

SEQ ID NO: 987 - DNA, 71 bp, chicken (Gallus Gallus)
  misc_feature (36): n=a or g
tcattcaacttgaaaagctcagtaaagaaaacagtnctacacagagaaagactccagaacactatcactgt

SEQ ID NO: 988 - DNA, 71 bp, chicken (Gallus Gallus)
  misc_feature (36): n=c or t
tccaagccacattctcatggtaaacagcacagctanttgcagtagacccaggagagcagacacaccagccc

SEQ ID NO: 989 - DNA, 71 bp, chicken (Gallus Gallus)
  misc_feature (36): n=a or g
tccactataaaagttcttgccatggggtccaccctnccaacagcttcaccaaccctttggcagcaaaggga

SEQ ID NO: 990 - DNA, 71 bp, chicken (Gallus Gallus)
  misc_feature (36): n=a or c
tccactggaaatagcactgcaacctccatacagctnctgaaggctctgcatggggcagaagagacactgaa

SEQ ID NO: 991 - DNA, 71 bp, chicken (Gallus Gallus)
  misc_feature (36): n=c or t
tccagtattaagcaaagctctacagctcaatatccnaatggggtctatctgaattcactgaattgtttggt

SEQ ID NO: 992 - DNA, 71 bp, chicken (Gallus Gallus)
  misc_feature (36): n=c or t
tcccaaccaccacatcataagtacacatagaaacancgagctaatgcctttcaaagggaaaatgtgcatgc

SEQ ID NO: 993 - DNA, 71 bp, chicken (Gallus Gallus)
  misc_feature (36): n=a or g
tcccacattttgaacagtgcattctaagctaaggcnttcactccatgctgcctgcatcttaaaggcttttt

SEQ ID NO: 994 - DNA, 71 bp, chicken (Gallus Gallus)
  misc_feature (36): n=a or g
tccctcttgagtccatttgcacagtgcttgtcccanacatcatgtttagtggctggaagctggtgctaatc

SEQ ID NO: 995 - DNA, 71 bp, chicken (Gallus Gallus)
  misc_feature (36): n=c or t
tcctattctcttggtaaatagttttcatctcaactnacaagctctactttgtggtgtttttttggggtttt

SEQ ID NO: 996 - DNA, 71 bp, chicken (Gallus Gallus)
  misc_feature (36): n=a or g
tcctccactcccatccgttttactattctcaatacnttattctgtcacagatgatgttaggcttaacaaga

SEQ ID NO: 997 - DNA, 71 bp, chicken (Gallus Gallus)
  misc_feature (36): n=c or t
tcctgcaaatgatgttctactttaattagaagttcntctctttattacagcatgatggatgtccactttat

SEQ ID NO: 998 - DNA, 71 bp, chicken (Gallus Gallus)
  misc_feature (36): n=c or t
tccttcagttttgtgttcataccactctgagaatangaagacaaaagtggcaacatggtttgatattttag

SEQ ID NO: 999 - DNA, 71 bp, chicken (Gallus Gallus)
  misc_feature (36): n=c or t
tcctttcagaactggatatgctgcatgctgaattanttgctggcgagcacagctaaggactcccttagaga

SEQ ID NO: 1000 - DNA, 71 bp, chicken (Gallus Gallus)
  misc_feature (36): n=c or t
tccttttcatggctattttctttatgtgattgcagngagatctaaacctccctgcaggtgttataggagtt

SEQ ID NO: 1001 - DNA, 71 bp, chicken (Gallus Gallus)
  misc_feature (36): n=a or g
tcgctatattgattcacctactattattagacactnaaagattgcacctatgacaagcatttgtagttgta

SEQ ID NO: 1002 - DNA, 71 bp, chicken (Gallus Gallus)
  misc_feature (36): n=a or g
tcggtctgaaatataaggagctccgatctctcttantctaccccaatattttcagatctagatttctttta

SEQ ID NO: 1003 - DNA, 71 bp, chicken (Gallus Gallus)
  misc_feature (36): n=c or t
tcgtcataaaattctatccagttaatagaggagacncatcaatacagattactagaaactctcccctttaa

SEQ ID NO: 1004 - DNA, 71 bp, chicken (Gallus Gallus)
  misc_feature (36): n=c or t
tctaaacttcaatttgctttcatctttgcagtctangtatgttcactattttaaggaatagaagctccctg

SEQ ID NO: 1005 - DNA, 71 bp, chicken (Gallus Gallus)
  misc_feature (36): n=c or t
tctaagcacaggactaagaccatgggaggaacatanagacgtagtcctcaagcttgacccaacacagccaa

SEQ ID NO: 1006 - DNA, 71 bp, chicken (Gallus Gallus)
  misc_feature (36): n=a or g
tctagctctgagattacttgacagggtgttctgagngtctcccaggtggaacaccgggccgatacacccta

SEQ ID NO: 1007 - DNA, 71 bp, chicken (Gallus Gallus)
  misc_feature (36): n=a or g
tctagcttgcaattctgccatctgaagttagactgngcctgatgaagttagcaaggaatgtgtgagaaagt

SEQ ID NO: 1008 - DNA, 71 bp, chicken (Gallus Gallus)
  misc_feature (36): n=g or t
tctcatatattttcatggagatagactgaaggctangtgttgaattgtgttgaatctcattccagatattt

SEQ ID NO: 1009 - DNA, 71 bp, chicken (Gallus Gallus)
  misc_feature (36): n=c or t
tctccaagtgatctgcgaacttctgtcattacactntgtatatcctcctttgtgctgcagtactctccaag

SEQ ID NO: 1010 - DNA, 71 bp, chicken (Gallus Gallus)
  misc_feature (36): n=c or t
tctctaactaaaatatatgtgtttgtatgtatgttnacaaaacaaacaagtacaccttcttctactacaca

SEQ ID NO: 1011 - DNA, 71 bp, chicken (Gallus Gallus)
  misc_feature (36): n=c or t
tctctccagcaaggatctaaggtagaacagagtcantgtgacagaagctctaagggtccatggattttaga

SEQ ID NO: 1012 - DNA, 71 bp, chicken (Gallus Gallus)
  misc_feature (36): n=c or t
tctgatcgtatggtgaaattggctgctcctgatttntgagctctctggggctgtattttaatttgtacttt

SEQ ID NO: 1013 - DNA, 71 bp, chicken (Gallus Gallus)
  misc_feature (36): n=c or t
tctgcctaattcttaaatttctatatcacttcccantgttccagcatacatggattaccaccccacatctc

SEQ ID NO: 1014 - DNA, 71 bp, chicken (Gallus Gallus)
  misc_feature (36): n=a or c
tctgcctgagggaaacatacgctgagctctgaaatnagcaaatcgaaaaagaaacgtggaaaaatccattt

SEQ ID NO: 1015 - DNA, 71 bp, chicken (Gallus Gallus)
  misc_feature (36): n=a or g
tctgcttcccgtgtgttgagagcatcactgttaggngagagctggcagggacctggaggagtctgaatttg

SEQ ID NO: 1016 - DNA, 71 bp, chicken (Gallus Gallus)
  misc_feature (36): n=a or g
tctgcttgaggcttcctgcagcctactacaaattcnggcagcaaagggacaccaaggaaactcactgatgc

SEQ ID NO: 1017 - DNA, 71 bp, chicken (Gallus Gallus)
  misc_feature (36): n=a or g
tctgtacataaatatctgatatatgtgcatatactnaaatgtctgtccaagcaacctatttagaactctat

SEQ ID NO: 1018 - DNA, 71 bp, chicken (Gallus Gallus)
  misc_feature (36): n=c or t
tctgtagggcttttttgttttctgttgggaaggagngaatcccaaagccacagagctgaccagagagtcac

SEQ ID NO: 1019 - DNA, 71 bp, chicken (Gallus Gallus)
  misc_feature (36): n=c or t
tcttaacctgatctaaaaacgagttttgacacaagngccataggaatcagtctacttggtgccatcattaa

SEQ ID NO: 1020 - DNA, 71 bp, chicken (Gallus Gallus)
  misc_feature (36): n=c or t
tcttaatcttcacaatctttctgttggtttgttgangagtgaagcaaatagacagggagtgtgaggataga

SEQ ID NO: 1021 - DNA, 71 bp, chicken (Gallus Gallus)
  misc_feature (36): n=a or g
tcttcagctgtcacatgtctggactgtagggtcacngatctctatggcagacctgttgtcctccatgcaga

SEQ ID NO: 1022 - DNA, 71 bp, chicken (Gallus Gallus)
  misc_feature (36): n=c or t
tcttccaaggctctcactagttttggcatgatttcnaagctctctgtttctttgggcccctgacgtctcac

SEQ ID NO: 1023 - DNA, 71 bp, chicken (Gallus Gallus)
  misc_feature (36): n=g or t
tcttggactatttgcggaagactttcatcagcctgngctgaagaaacacccattaaatgtattcgtgtact

SEQ ID NO: 1024 - DNA, 71 bp, chicken (Gallus Gallus)
  misc_feature (36): n=c or t
tcttggttctcagaccaaagctcctcatgctctcantgctcaggacttcagagcaaactggtatgcccaca

SEQ ID NO: 1025 - DNA, 71 bp, chicken (Gallus Gallus)
  misc_feature (36): n=c or t
tcttgtgggataaaatgtgaaggacaagaccactanatcatcagcataatacagcagccatgaggttgaaa

SEQ ID NO: 1026 - DNA, 71 bp, chicken (Gallus Gallus)
  misc_feature (36): n=c or t
tgaaaaaatagcaaagtaaaaaaacaatgtagctcnggatctgcatgctatgcatcctgtagaggttttac

SEQ ID NO: 1027 - DNA, 71 bp, chicken (Gallus Gallus)
  misc_feature (36): n=c or t
tgaaaaagcccaacaaacccagcggtatggaaaatnctaacaagctagtactggaaagcacacagaaaatg

SEQ ID NO: 1028 - DNA, 71 bp, chicken (Gallus Gallus)
  misc_feature (36): n=a or g
tgaaaattggcatagataaaggtttttatagtagcnaaaaagttttaagtctttaactcctaacttactgc

SEQ ID NO: 1029 - DNA, 71 bp, chicken (Gallus Gallus)
  misc_feature (36): n=c or t
tgaacaaagaagaaatgactggagactacgtgctanatgatgtagaagtaggttggatgacagcgcattaa

SEQ ID NO: 1030 - DNA, 71 bp, chicken (Gallus Gallus)
  misc_feature (36): n=a or g
tgaactgaaaacatgaatcagcaaaaacagagagcngtttctgtactctttaatgtgcagctcagcatatt

SEQ ID NO: 1031 - DNA, 71 bp, chicken (Gallus Gallus)
  misc_feature (36): n=a or g
tgaagaaaaagagctggagattttggcagcagcacnatgacaactggggcttctggctccccagaacagta

SEQ ID NO: 1032 - DNA, 71 bp, chicken (Gallus Gallus)
  misc_feature (36): n=a or g
tgaagttttaagaggcaaacagtgtgggtcattcancatctatccagaattaaagaaactcccacgctatg

SEQ ID NO: 1033 - DNA, 71 bp, chicken (Gallus Gallus)
  misc_feature (36): n=a or g
tgaatcaggtgtaccaaaatgaaagtggcaaatatnttgattagatggttttccaacagagaatagcaaaa

SEQ ID NO: 1034 - DNA, 71 bp, chicken (Gallus Gallus)
  misc_feature (36): n=a or g
tgacagtgatgaataggacaaaaatgaatggatgcntattgcagcaagaaagatttaggttagatatgaat

SEQ ID NO: 1035 - DNA, 71 bp, chicken (Gallus Gallus)
  misc_feature (36): n=c or t
tgacatatacatcaaggaaaactgcacaggattcantggggagagcctcctggacaggaagatcaggatcc

SEQ ID NO: 1036 - DNA, 71 bp, chicken (Gallus Gallus)
  misc_feature (36): n=c or t
tgacatgttctttgccaaataccctaaccagcaacnagcaactcttttaagcttgcattcaatttgcaaac

SEQ ID NO: 1037 - DNA, 71 bp, chicken (Gallus Gallus)
  misc_feature (36): n=g or t
tgaccacgtatgcgtattaacgtctctgaactcgtncatgcgtactgccgcctataacctcccgcatgcgt

SEQ ID NO: 1038 - DNA, 71 bp, chicken (Gallus Gallus)
  misc_feature (36): n=g or t
tgacccagtgtgtcttaacgttgttcctcatcatgntctgatgaaaaaatatctttttttttttttgttaa

SEQ ID NO: 1039 - DNA, 71 bp, chicken (Gallus Gallus)
  misc_feature (36): n=c or t
tgactaggaaaaagagagtgtctgaattttgtaaanaaatatccagttgcctaactgtcagctatattgcg

SEQ ID NO: 1040 - DNA, 71 bp, chicken (Gallus Gallus)
  misc_feature (36): n=c or t
tgactttgtaagaaggcatgttgtaccctgcctaangaatagaaagtatgagccagaatggcaggaaaatt

SEQ ID NO: 1041 - DNA, 71 bp, chicken (Gallus Gallus)
  misc_feature (36): n=g or t
tgagaactgagatgcatttctcattagccacccaanagccgtggcacactgacagcactttgagcaagcca

SEQ ID NO: 1042 - DNA, 71 bp, chicken (Gallus Gallus)
  misc_feature (36): n=a or c
tgagacctcattaccaataaaggtaatgttaaccanaagagtccggaagctgctgactgagactgggcaat

SEQ ID NO: 1043 - DNA, 71 bp, chicken (Gallus Gallus)
  misc_feature (36): n=c or t
tgagccacacaaatcagcccaaagagtacaaaatangtcgtcaaagctttagactaaaattctgggcagaa

SEQ ID NO: 1044 - DNA, 71 bp, chicken (Gallus Gallus)
  misc_feature (36): n=a or g
tgagccatcaaattgcaaaaacttttaaattgccantatatttcagaagcaaactccttaccgttcaatct

SEQ ID NO: 1045 - DNA, 71 bp, chicken (Gallus Gallus)
  misc_feature (36): n=a or g
tgagctatggtaagagtttacctagcgatgcaaacngatccgataggagcattcacctccatctcctcggg

SEQ ID NO: 1046 - DNA, 71 bp, chicken (Gallus Gallus)
  misc_feature (36): n=a or g
tgaggagctttgtgtaagtgccacacttagtgctancgtgagcctggggtgtatggccagatacaggcagg

SEQ ID NO: 1047 - DNA, 71 bp, chicken (Gallus Gallus)
  misc_feature (36): n=g or t
tgagtaggtggatggtgaccagctgaactacgtgtngtgagcagcagtacaaagttcaccaggtgcctggt

SEQ ID NO: 1048 - DNA, 71 bp, chicken (Gallus Gallus)
  misc_feature (36): n=c or t
tgagttttggctttttctcctttatccacctccacnagagcctttcccaggagctgggctttggatcacgc

SEQ ID NO: 1049 - DNA, 71 bp, chicken (Gallus Gallus)
  misc_feature (36): n=c or t
tgatacagtaaatagccataattatagtcttctgancctccagatttcctttgattagctgccatatgtct

SEQ ID NO: 1050 - DNA, 71 bp, chicken (Gallus Gallus)
  misc_feature (36): n=c or t
tgatactggaggtaccgattttgcactgaaatgtgngtagaacacacagcaagcagccatttgagattttc

SEQ ID NO: 1051 - DNA, 71 bp, chicken (Gallus Gallus)
  misc_feature (36): n=c or t
tgatcaaactcatttcccacttgggaactacaaagngattatgaaaaaaaaagtcttcctaatcacagcat

SEQ ID NO: 1052 - DNA, 71 bp, chicken (Gallus Gallus)
  misc_feature (36): n=c or t
tgatgatgttacatgaactgtacagcaaagcatatngacagtaagttttctgagtttagtgtttgttgggc

SEQ ID NO: 1053 - DNA, 71 bp, chicken (Gallus Gallus)
  misc_feature (36): n=c or t
tgattgtcatacattgctagctgttgcaaactgcanagtgtttttagtgaattgcagggagatctgaacag

SEQ ID NO: 1054 - DNA, 71 bp, chicken (Gallus Gallus)
  misc_feature (36): n=a or g
tgattgtcctgctggacatcactggagtagataatngtgaagctgccattgggggaaaggaggaggacatc

SEQ ID NO: 1055 - DNA, 71 bp, chicken (Gallus Gallus)
  misc_feature (36): n=c or t
tgatttctctttcaatctgaaataaaccagctgtantgaacataaacacgctcagccacaattccttctac

SEQ ID NO: 1056 - DNA, 71 bp, chicken (Gallus Gallus)
  misc_feature (36): n=c or t
tgatttgaggctacatttatataagttgtacaatangaatttccaaaaagtaaatctttgcaaacaagctt

SEQ ID NO: 1057 - DNA, 71 bp, chicken (Gallus Gallus)
  misc_feature (36): n=a or c
tgcacagtaattacatctagaaggcaggctctaggnacgctggaggaaaacaagctgcgatgtgggcttaa

SEQ ID NO: 1058 - DNA, 71 bp, chicken (Gallus Gallus)
  misc_feature (36): n=a or c
tgcagacatcttcttctgtgactcatctaaatcccngaagtggtgatagtgtcgttaggatgtttcaggat

SEQ ID NO: 1059 - DNA, 71 bp, chicken (Gallus Gallus)
  misc_feature (36): n=c or t
tgcagatgagcacagaggatgggaatgctttaaaangatagtttctgagtcatgaaactgtatcccggagt

SEQ ID NO: 1060 - DNA, 71 bp, chicken (Gallus Gallus)
  misc_feature (36): n=a or g
tgcaggaaggttttccagtgttgcagctgacaccantgcttgtaacagaaaacagtgctggggagatgtag

SEQ ID NO: 1061 - DNA, 71 bp, chicken (Gallus Gallus)
  misc_feature (36): n=a or c
tgcatttttagagtgtaaaacatcttaaaatatacngcttcagtagacattggtggagctctctcaggttg

SEQ ID NO: 1062 - DNA, 71 bp, chicken (Gallus Gallus)
  misc_feature (36): n=a or g
ccacaccttgccccttcatgttcttgttttgttcangcagctgttttgcatcaaactgagatgtagtggca

SEQ ID NO: 1063 - DNA, 71 bp, chicken (Gallus Gallus)
  misc_feature (36): n=c or t
tgcctactcacatatagctaagagaagtgttatcanggccatctgacatgctggcctaatcaataatcaag

SEQ ID NO: 1064 - DNA, 71 bp, chicken (Gallus Gallus)
  misc_feature (36): n=a or g
tgcctcctgaattgctaaggcctgaagtaaaatgancttatgcagcatggtgggaaggaagtaagggacat

SEQ ID NO: 1065 - DNA, 71 bp, chicken (Gallus Gallus)
  misc_feature (36): n=a or g
tgccttctcttcagttttcccagctggagaaaggangaagccagaagtagatatataatgtatatcaattt

SEQ ID NO: 1066 - DNA, 71 bp, chicken (Gallus Gallus)
  misc_feature (36): n=g or t
tgcctttgccttctctgacatggacagtgtggtganggcacttgctgatgaaggttgaggcaaaaagttga

SEQ ID NO: 1067 - DNA, 71 bp, chicken (Gallus Gallus)
  misc_feature (36): n=a or g
tgcgtttgcctacctgatagataccacaaggctgcngccacactcccttcctcactctgcaacagctgtgc

SEQ ID NO: 1068 - DNA, 71 bp, chicken (Gallus Gallus)
  misc_feature (36): n=a or g
tgctaactgggcccattatctgtaaatttatcacancgtagctgcattaaaagcatttaatactccttgca

SEQ ID NO: 1069 - DNA, 71 bp, chicken (Gallus Gallus)
  misc_feature (36): n=a or g
tgctccatcaaactctgcatcttcctttatgtagangaaacgcattgctttgaaatatattttgtaacaag

SEQ ID NO: 1070 - DNA, 71 bp, chicken (Gallus Gallus)
  misc_feature (36): n=c or t
tgctctgcatactctgcactttggctgtctgcaaantgacagagctacaacaccaaccgctgtgcgtcagt

SEQ ID NO: 1071 - DNA, 71 bp, chicken (Gallus Gallus)
  misc_feature (36): n=g or t
tgctgaaatgccttctgtgtccttgactgaaatgtnttagtgctccatcacagctgaagtgaaacagagcc

SEQ ID NO: 1072 - DNA, 71 bp, chicken (Gallus Gallus)
  misc_feature (36): n=a or g
ctgctggagagtgtcctcttcgctttgaacaagacncgttcctgaactggaagctgtttttgtggggctgt

SEQ ID NO: 1073 - DNA, 71 bp, chicken (Gallus Gallus)
  misc_feature (36): n=c or t
tgctgtcggggggaagaaatgttaattaatctcacngtgtaggtctggattatgaggggcagtttcccatc

SEQ ID NO: 1074 - DNA, 71 bp, chicken (Gallus Gallus)
  misc_feature (36): n=a or g
tgctgtgactttcaaaggtcagaccttccagtagtngaagtagatgtgaaagctcacattcctataagctg

SEQ ID NO: 1075 - DNA, 71 bp, chicken (Gallus Gallus)
  misc_feature (36): n=a or g
tggaattataattatctgacttttgtgtctgtgaantacatgtgagctagatgcctaaactcctttgatat

SEQ ID NO: 1076 - DNA, 71 bp, chicken (Gallus Gallus)
  misc_feature (36): n=g or t
tggactcagttatatctaccactttcatactctatnaaacaattttttgtacatgtcattttccgaagtgc

SEQ ID NO: 1077 - DNA, 71 bp, chicken (Gallus Gallus)
  misc_feature (36): n=a or g
tggcactaaactcctgaagaacgtggcaagacagcnctgctggttctcatgtctggatgagcatgctgctc

SEQ ID NO: 1078 - DNA, 71 bp, chicken (Gallus Gallus)
  misc_feature (36): n=a or g
tggcctgtgagagtttgaagagcattgacaagcccngaatctggtcccacagggagtcaaaggttctctga

SEQ ID NO: 1079 - DNA, 71 bp, chicken (Gallus Gallus)
  misc_feature (36): n=c or t
tggctgtgtgatccaatagatgcactgagcagctcngcacttcccacctgtcatgactcagaaagcattca

SEQ ID NO: 1080 - DNA, 71 bp, chicken (Gallus Gallus)
  misc_feature (36): n=a or g
tggcttggttcaccggaatgcagtattaacttccanacactcagtttgcctctatcaaaagctgactctgt

SEQ ID NO: 1081 - DNA, 71 bp, chicken (Gallus Gallus)
  misc_feature (36): n=c or t
tggcttttcagagggaagtcctcaaactattgcccngcgttcttcctgaagctgcactatgaatgaaaaaa

SEQ ID NO: 1082 - DNA, 71 bp, chicken (Gallus Gallus)
  misc_feature (36): n=g or t
tgggaaccactgtcagcacacatatgaagcagaacnggtgctcattctgaggctaggcatccttattgctc

SEQ ID NO: 1083 - DNA, 71 bp, chicken (Gallus Gallus)
  misc_feature (36): n=c or t
tgggactgtggagactgagcacaatgctactagttnacaaaagacaagagctgctcagggctggtaagcac

SEQ ID NO: 1084 - DNA, 71 bp, chicken (Gallus Gallus)
  misc_feature (36): n=a or g
tgggcacgtaaatggcagcttatgagttggtattgncagaaaatgagactgtaacctggaagtgatgctcc

SEQ ID NO: 1085 - DNA, 71 bp, chicken (Gallus Gallus)
  misc_feature (36): n=a or g
tggggatgcagggaattctggagtaaccttagagcnagaagcttgcccttttgtacttgctgatttgctct

SEQ ID NO: 1086 - DNA, 71 bp, chicken (Gallus Gallus)
  misc_feature (36): n=c or t
tggtacacctgtgacctgtcagtgtgggttctcaanggagacaatcaaaaatcccacaaaattggcttaaa

SEQ ID NO: 1087 - DNA, 71 bp, chicken (Gallus Gallus)
  misc_feature (36): n=a or c
tggtatttaagctttaatagtttctagtggcagctngcctgttgtttgcatgatcttcagtggtttgttaa

SEQ ID NO: 1088 - DNA, 71 bp, chicken (Gallus Gallus)
  misc_feature (36): n=c or t
tggtcaatatgacgagtgatgagcgatgtcccttangggtcagtgctgggactggagctctttatagcctc

SEQ ID NO: 1089 - DNA, 71 bp, chicken (Gallus Gallus)
  misc_feature (36): n=a or g
tggtcagccactttggaacagcacagctttactgcncgcagctcttctgataaacttctctcaatttacag

SEQ ID NO: 1090 - DNA, 71 bp, chicken (Gallus Gallus)
  misc_feature (36): n=a or g
tggtttcagctagaatttaatagggtcactcctcanctgcatcaaacacaaatgtccagatgatgagatta

SEQ ID NO: 1091 - DNA, 71 bp, chicken (Gallus Gallus)
  misc_feature (36): n=a or c
tgtaaattggcactttctctatagacagtgagaacnaggtacagcagctcaggacttcttgtaaagtatac

SEQ ID NO: 1092 - DNA, 71 bp, chicken (Gallus Gallus)
  misc_feature (36): n=c or t
tgtaatgttaaacaaccatgctgttgcaatatcagnatcctagtggaagggttaaacagctagaaaacatc

SEQ ID NO: 1093 - DNA, 71 bp, chicken (Gallus Gallus)
  misc_feature (36): n=a or c
tgtacaagaactgtgaccggcagatagatgataagncttaagtgtagtatctgcagtggctgcctttaaaa

SEQ ID NO: 1094 - DNA, 71 bp, chicken (Gallus Gallus)
  misc_feature (36): n=c or t
tgtacctagttttagccatttaaaagttggggtgtntaagctggtgatccaggtttcatctaaaggctgcg

SEQ ID NO: 1095 - DNA, 71 bp, chicken (Gallus Gallus)
  misc_feature (36): n=c or t
tgtagcttcatgaaaagcagaactagaccggaaaangttcccaacagagcagtttgctcaggaattgccat

SEQ ID NO: 1096 - DNA, 71 bp, chicken (Gallus Gallus)
  misc_feature (36): n=a or g
tgtcaactttgcacaatggatagcagcagctgtgtncccctttgctttgcctcctttccagactaaacact

SEQ ID NO: 1097 - DNA, 71 bp, chicken (Gallus Gallus)
  misc_feature (36): n=c or t
tgtcactaagagacttaaacagaggctgctggctanatcaaaatgaagcgtggttgtgtggcatgtaggag

SEQ ID NO: 1098 - DNA, 71 bp, chicken (Gallus Gallus)
  misc_feature (36): n=a or g
tgtcactcagtcccacgtgtgcaaggcttaaaatancattatacagacagctgtgaaaacatgagagagag

SEQ ID NO: 1099 - DNA, 71 bp, chicken (Gallus Gallus)
  misc_feature (36): n=a or g
tgtcactgcaaaaatatttacatggagatatgctcntgaagctccaaaacaaatgtgatgtcatctgcgtt

SEQ ID NO: 1100 - DNA, 71 bp, chicken (Gallus Gallus)
  misc_feature (36): n=a or c
tgtccttgtccatggcgtggaggttggaacataatnatctctaaggcccttttgaacccaaactatgattc

SEQ ID NO: 1101 - DNA, 71 bp, chicken (Gallus Gallus)
  misc_feature (36): n=c or t
tgtgaaaatattctaaagcttctagtgaggtacttnaccttccttctttcttttatcaaacgttttattct

SEQ ID NO: 1102 - DNA, 71 bp, chicken (Gallus Gallus)
  misc_feature (36): n=c or t
tgtgatctgtagacttcaaatgctattaaacctttngaaaagaagtgtagaaacttgaaaacgagctgcct

SEQ ID NO: 1103 - DNA, 71 bp, chicken (Gallus Gallus)
  misc_feature (36): n=a or g
tgtgattttctggtgatttgtttataagtcatattngaactgaaatgtgcttttgtgtcggcagctcttca

SEQ ID NO: 1104 - DNA, 71 bp, chicken (Gallus Gallus)
  misc_feature (36): n=g or t
tgtgccatacacaagtcaacagctggttggataagnactgatgttgaccactctaggacaaaatacttctc

SEQ ID NO: 1105 - DNA, 71 bp, chicken (Gallus Gallus)
  misc_feature (36): n=a or c
tgtgctgtgatttattttcctccaggtacaacagtnagcagtaagaagctgagcacagaggaggacaacca

SEQ ID NO: 1106 - DNA, 71 bp, chicken (Gallus Gallus)
  misc_feature (36): n=a or g
tgtgtcacttttgtaagacagctcatcagcaggcanaaggagggggaagaccttaaacaatctccttggca

SEQ ID NO: 1107 - DNA, 71 bp, chicken (Gallus Gallus)
  misc_feature (36): n=c or t
tgtgtcctctggttagtttacatctcacatgagctnaagcttctgaaggtaccacactcagttgcttttgc

SEQ ID NO: 1108 - DNA, 71 bp, chicken (Gallus Gallus)
  misc_feature (36): n=a or g
tgtgtgaaaatagctcaatctttgattcattaaggngaatctctttttgaatggagaaagaaaacagaaat

SEQ ID NO: 1109 - DNA, 71 bp, chicken (Gallus Gallus)
  misc_feature (36): n=a or g
tgttacgattttagttctccttgtgcatggtagctntgggcagacctgcagttagtattttgccagatgta

SEQ ID NO: 1110 - DNA, 71 bp, chicken (Gallus Gallus)
  misc_feature (36): n=c or t
tgttctacaaattagtgcttgcactacactgaaagntgcaggagttttttacgtgaaaaacaaacaaacaa

SEQ ID NO: 1111 - DNA, 71 bp, chicken (Gallus Gallus)
  misc_feature (36): n=a or g
tgttctttttttcatcttcatgtacatcacacatanacctccaaacactggaatttaatactgtaagagtt

SEQ ID NO: 1112 - DNA, 71 bp, chicken (Gallus Gallus)
  misc_feature (36): n=a or g
tgttgacttcaaagggagcaaaaactccaactgtgnttctacaaaggggtgttctgctggcaccagctttc

SEQ ID NO: 1113 - DNA, 71 bp, chicken (Gallus Gallus)
  misc_feature (36): n=c or t
tgttgctgctggtttactttttgctgatccaatccngccaggtctcaaatcaaatcatccccatgcctcca

SEQ ID NO: 1114 - DNA, 71 bp, chicken (Gallus Gallus)
  misc_feature (36): n=a or g
tgttgttgttcacaagcctgcctgaagggttacatnaagtcacagtaatagtttttagttcctcacgctaa

SEQ ID NO: 1115 - DNA, 71 bp, chicken (Gallus Gallus)
  misc_feature (36): n=a or g
tgtttctgaaatgtatcctctaacattctttagaantaggattaaagcagtccccgatacaattcttttta

SEQ ID NO: 1116 - DNA, 71 bp, chicken (Gallus Gallus)
  misc_feature (36): n=c or t
tgtttgaaatattttgtcgatgaggtttttaaaagnaattttcaaggtaagtatttgaatctaacttgtat

SEQ ID NO: 1117 - DNA, 71 bp, chicken (Gallus Gallus)
  misc_feature (36): n=c or t
tgttttcttttttgttgttcttcatcagtcattgcnttcgtctcccagaacgactgcgcgtggagctgact

SEQ ID NO: 1118 - DNA, 71 bp, chicken (Gallus Gallus)
  misc_feature (36): n=c or t
ttaagtctcagttggcctattaaaaacagcacttgntggctgctgtggaaagctctcctagatcacatgag

SEQ ID NO: 1119 - DNA, 71 bp, chicken (Gallus Gallus)
  misc_feature (36): n=a or c
ttaatgcgaccagggctgataaatcaatcagcacanccagaaatagcgacctgcagctgctaggagaagga

SEQ ID NO: 1120 - DNA, 71 bp, chicken (Gallus Gallus)
  misc_feature (36): n=a or g
ttacagaattgtctgcggacatgagatacacaatanatcatacctgtttgtttatgttggcccccacttgg

SEQ ID NO: 1121 - DNA, 71 bp, chicken (Gallus Gallus)
  misc_feature (36): n=c or t
ttacgtgcaagaataaaaatcaccatcggttagcanaaacctctccctctctctgatgaaagttcaggatc

SEQ ID NO: 1122 - DNA, 71 bp, chicken (Gallus Gallus)
  misc_feature (36): n=c or t
ttactttagtgttgtaaatgacatctcaaatgaaanttcccagttaattagtgccatgaggtccacaaaaa

SEQ ID NO: 1123 - DNA, 71 bp, chicken (Gallus Gallus)
  misc_feature (36): n=a or g
ttagatctaaagggaaaccgtacggagcacagaacngcacaggagagatgaagcagctaaggaaaccgacc

SEQ ID NO: 1124 - DNA, 71 bp, chicken (Gallus Gallus)
  misc_feature (36): n=a or g
ttagcaaaagtgctgtgtgcaccattagtgggctgncagagcttagattgggaaaaaaaatacatgactac

SEQ ID NO: 1125 - DNA, 71 bp, chicken (Gallus Gallus)
  misc_feature (36): n=c or t
ttagctgaatcaacagccaaagttgttcttaagccntgggagtccttacactgagatgtggatgccttaac

SEQ ID NO: 1126 - DNA, 71 bp, chicken (Gallus Gallus)
  misc_feature (36): n=c or t
ttagtctacattagtttgaacaggaaatgtcatatnttccttctgagagaagcattaacaaatgaattact

SEQ ID NO: 1127 - DNA, 71 bp, chicken (Gallus Gallus)
  misc_feature (36): n=c or t
ttatataaactaatactacagccatttttcagtcangctgttttataaaatccttctccatttttacctga

SEQ ID NO: 1128 - DNA, 71 bp, chicken (Gallus Gallus)
  misc_feature (36): n=c or t
ttatctgtatgtgcagaaaagttacactccattagnttatgttaaattcacattttcttttcaccactaaa

SEQ ID NO: 1129 - DNA, 71 bp, chicken (Gallus Gallus)
  misc_feature (36): n=c or t
ttcagctcagaggaccaaggacaagcagattaaaangttttaatctggccacttaacatagagactaacct

SEQ ID NO: 1130 - DNA, 71 bp, chicken (Gallus Gallus)
  misc_feature (36): n=a or g
ttcagtcacctgcaaattctttcaaaaatgagagantaaatacaggaacaaaaccttggcattgggaagat

SEQ ID NO: 1131 - DNA, 71 bp, chicken (Gallus Gallus)
  misc_feature (36): n=c or t
ttcatcttcctcatatgacgtggcgtgttttgatgncatctactctctctgactcatcaggtcagttaatc

SEQ ID NO: 1132 - DNA, 71 bp, chicken (Gallus Gallus)
  misc_feature (36): n=c or t
ttccacctttgtgtaattaacaaatctcattcatancatcctctttcttttgtgccaagataactaattaa

SEQ ID NO: 1133 - DNA, 71 bp, chicken (Gallus Gallus)
  misc_feature (36): n=c or t
ttccagaaacgctcagtacatctgctgacaatgcangtccagctgctcaagccttactgacactgcagtca

SEQ ID NO: 1134 - DNA, 71 bp, chicken (Gallus Gallus)
  misc_feature (36): n=a or g
ttccattttgttgacctcgctgggtctgaaaggttnaagcgaacaggagcgacgggagaaagggcaaaaga

SEQ ID NO: 1135 - DNA, 71 bp, chicken (Gallus Gallus)
  misc_feature (36): n=a or g
ttcccatcaatccagtatgtatcagctggatcccanaatgttcttacgcattccagatattctggggagga

SEQ ID NO: 1136 - DNA, 71 bp, chicken (Gallus Gallus)
  misc_feature (36): n=c or t
ttcctatgaatcctaggaagagacagcagtggaaangaacacagcctgaatttgagctttaactagtgaaa

SEQ ID NO: 1137 - DNA, 71 bp, chicken (Gallus Gallus)
  misc_feature (36): n=c or t
ttcctctgtgccttcagctttgttgactttttctanccttttggccaaggtaaagaggaaaggtggtgaga

SEQ ID NO: 1138 - DNA, 71 bp, chicken (Gallus Gallus)
  misc_feature (36): n=c or t
ttcctgaaagatgatcacaacagacatcaacaaatntgttagaaagtacactccactagaatattaaacat

SEQ ID NO: 1139 - DNA, 71 bp, chicken (Gallus Gallus)
  misc_feature (36): n=g or t
ttcctgaggagccagtactccatgctggaaaaacanctgctctaattgcctccttcctttacttcctccag

SEQ ID NO: 1140 - DNA, 71 bp, chicken (Gallus Gallus)
  misc_feature (36): n=a or g
ttccttttcttctcactgcagaaatgagagtacaanagtgaaatgagaagaaaaagcagctgccaaaagct

SEQ ID NO: 1141 - DNA, 71 bp, chicken (Gallus Gallus)
  misc_feature (36): n=a or c
ttctaaatgttgttttggggtttggttgttatcctnagggagtggtagccccccccagaaagcagcatgca

SEQ ID NO: 1142 - DNA, 71 bp, chicken (Gallus Gallus)
  misc_feature (36): n=a or g
ttctaactgcttctcttcaaaatttgaacattcacnaacatttatcagtttgtaacttgggtgacatcctt

SEQ ID NO: 1143 - DNA, 71 bp, chicken (Gallus Gallus)
  misc_feature (36): n=a or g
ttctcagatgcttataagattttttattaagatgangaatgaacaaacacacagtaaaccaggtttgcaaa

SEQ ID NO: 1144 - DNA, 71 bp, chicken (Gallus Gallus)
  misc_feature (36): n=a or g
ttctcctgatccagctttgtttcctcaaatgcaacnaggagtgagagcagcgcaacacccacccgcgtccc

SEQ ID NO: 1145 - DNA, 71 bp, chicken (Gallus Gallus)
  misc_feature (36): n=a or g
ttctctagccctggttctgaaacctgtgttaatccntgtgtgctagcagtgtagctcacaggcacacatca

SEQ ID NO: 1146 - DNA, 71 bp, chicken (Gallus Gallus)
  misc_feature (36): n=c or t
ttctctgtagaagttccagctgaccatcaaacatanaccatccactgcccatcctcagatgagcctcccta

SEQ ID NO: 1147 - DNA, 71 bp, chicken (Gallus Gallus)
  misc_feature (36): n=c or t
ttctgcatacagttttatctttgggtccctgtgtgnggcatccttctcttctactgtgtcagctgcaccat

SEQ ID NO: 1148 - DNA, 71 bp, chicken (Gallus Gallus)
  misc_feature (36): n=c or t
ttctgtaaacactaatccaaacattagaaatcctancattacaaaaataaaaagcctacatgtaaaaatat

SEQ ID NO: 1149 - DNA, 71 bp, chicken (Gallus Gallus)
  misc_feature (36): n=a or g
ttctgtgaaggagcacaacaagaatgggttttacangaatggactggagctgagaatgacatatctgcatt

SEQ ID NO: 1150 - DNA, 71 bp, chicken (Gallus Gallus)
  misc_feature (36): n=c or t
ttctgtgtaacctgatctaatggttatggttaattnatttaactgtgctttaaaaaatattttaatatttt

SEQ ID NO: 1151 - DNA, 71 bp, chicken (Gallus Gallus)
  misc_feature (36): n=c or t
ttctgtgtttttatcaacagatgatgggacctgaangtgttcagagccaatggacagaagaaaactgcgtt

SEQ ID NO: 1152 - DNA, 71 bp, chicken (Gallus Gallus)
  misc_feature (36): n=a or g
ttcttggtaggtaacagtcagattgagttaaaaacngagaaataaataacctaaatactgtttctgataca

SEQ ID NO: 1153 - DNA, 71 bp, chicken (Gallus Gallus)
  misc_feature (36): n=c or t
ttctttgcttagtgcaggcaaagattaagagttccnaaggctttccctcagtttgaaaatggaagcagaga

SEQ ID NO: 1154 - DNA, 71 bp, chicken (Gallus Gallus)
  misc_feature (36): n=a or g
ttgaacagagtgacaagagacaagaatcagaggaancttcagcttaaggcaaaatacatgctttgatcaga

SEQ ID NO: 1155 - DNA, 71 bp, chicken (Gallus Gallus)
  misc_feature (36): n=c or t
ttgaaggatgtggttatacaataaattctcctcacntcataagtgacattgtgagacaggacagcggggat

SEQ ID NO: 1156 - DNA, 71 bp, chicken (Gallus Gallus)
  misc_feature (36): n=c or t
ttgactgagtgtggcctaaggacagaccttgtgtgnagctgggtgctgctgcagactgtcactctggctga

SEQ ID NO: 1157 - DNA, 71 bp, chicken (Gallus Gallus)
  misc_feature (36): n=c or t
ttgagcacacaacgtgatgagatgcaggtggtttcntagctaagatgcaatcacaaacagaagtatcctca

SEQ ID NO: 1158 - DNA, 71 bp, chicken (Gallus Gallus)
  misc_feature (36): n=a or g
ttgagtgttcagccagcgaatgatagcttgctatantaagaatgttctgctttccattagatcacactcac

SEQ ID NO: 1159 - DNA, 71 bp, chicken (Gallus Gallus)
  misc_feature (36): n=a or g
ttgattttctttggtacagctcagatagactttctnaaagttccacttcagactggtctgcatcatccttc

SEQ ID NO: 1160 - DNA, 71 bp, chicken (Gallus Gallus)
  misc_feature (36): n=a or g
ttgcagagatagtgaatgcccaaccatattattccnaacttcattgtccacacctcaggagtagctgctcc

SEQ ID NO: 1161 - DNA, 71 bp, chicken (Gallus Gallus)
  misc_feature (36): n=a or g
ttgcatattcaatctgggctgtgatgtaatttttcntcactggggagcttaaattagtgtacgtcagtcct

SEQ ID NO: 1162 - DNA, 71 bp, chicken (Gallus Gallus)
  misc_feature (36): n=c or t
ttgctggaagtcttcaagtcttcccatgctcaatcngtgggcctgaagaatgtgatggagtccatcaaccg

SEQ ID NO: 1163 - DNA, 71 bp, chicken (Gallus Gallus)
  misc_feature (36): n=a or c
ttgcttatgaatggtcacctatgcacaacgagcaanatcaatgttttcagtagtttccacaaccaatagca

SEQ ID NO: 1164 - DNA, 71 bp, chicken (Gallus Gallus)
  misc_feature (36): n=a or g
ttggaaaaaataggagtgaaaagcattatgagaacntactttcattttgaaaggcagccgtgggagctttc

SEQ ID NO: 1165 - DNA, 71 bp, chicken (Gallus Gallus)
  misc_feature (36): n=c or t
ttggcatggacttcagttatctcagtttgtaagtanagcctctgccacagctgtcttatgcaccctaatat

SEQ ID NO: 1166 - DNA, 71 bp, chicken (Gallus Gallus)
  misc_feature (36): n=a or g
ttggtggggagagaactgaatcgtaggtctgtgctncttaagtgtatttcagaacacacagtccttctttg

SEQ ID NO: 1167 - DNA, 71 bp, chicken (Gallus Gallus)
  misc_feature (36): n=g or t
ttgtagaaaatcctcaaggaggtgatttaccttgtntaacacaagccaaaggattaacttgaaaacagtga

SEQ ID NO: 1168 - DNA, 71 bp, chicken (Gallus Gallus)
  misc_feature (36): n=c or t
ttgtagtaaatgaaaagctgctgtattagagatctnggctcatctggtttcatgcagttatgctgctttta

SEQ ID NO: 1169 - DNA, 71 bp, chicken (Gallus Gallus)
  misc_feature (36): n=g or t
ttgtatctgacaacattttaatcggtagctgacctnactgcagccgaaagactgtgaaagggccacaagca

SEQ ID NO: 1170 - DNA, 71 bp, chicken (Gallus Gallus)
  misc_feature (36): n=c or t
ttgtcaagcttacgtaagacaaatcagttccagctngcgccttatttctgaaaggaacaaatcctgtgtga

SEQ ID NO: 1171 - DNA, 71 bp, chicken (Gallus Gallus)
  misc_feature (36): n=c or t
ttgtcctaccctagctagactaaacttgtccagtancaagaaaaaaaacacttagaaatccattttaggtt

SEQ ID NO: 1172 - DNA, 71 bp, chicken (Gallus Gallus)
  misc_feature (36): n=c or t
ttgtctggaacttctatatcttccatgcatgtagtnctggcaggatgtaaaacatgagtgtccaaactttt

SEQ ID NO: 1173 - DNA, 71 bp, chicken (Gallus Gallus)
  misc_feature (36): n=c or t
ttgtgaatgcatagtgatgtggcagtattgtaccantgccagtttctgtgagctgctgaagatgcttattt

SEQ ID NO: 1174 - DNA, 71 bp, chicken (Gallus Gallus)
  misc_feature (36): n=g or t
ttgtgtgcgcacggtggtgatatcttccttacaagnctggctgattgatgatccacttctcccgaatcaca

SEQ ID NO: 1175 - DNA, 71 bp, chicken (Gallus Gallus)
  misc_feature (36): n=c or t
ttgttttctggataaagtcctgaagctggaaatgcntccttagaggtataaaaggagagtgaccttctgct

SEQ ID NO: 1176 - DNA, 71 bp, chicken (Gallus Gallus)
  misc_feature (36): n=c or t
tttaagatgtagtttatatagctctccatcctcttntgggaggggagggtttgccaacaattatgaagaag

SEQ ID NO: 1177 - DNA, 71 bp, chicken (Gallus Gallus)
  misc_feature (36): n=a or g
tttacattctctaaataaaatgtgtgtattaatgtnggatagcctaaatattcaaatgagttagaatagtg

SEQ ID NO: 1178 - DNA, 71 bp, chicken (Gallus Gallus)
  misc_feature (36): n=a or g
tttagctacatgatctacataaatcaaacatagaancactattgaatacaagaattttcttctctgcaggc

SEQ ID NO: 1179 - DNA, 71 bp, chicken (Gallus Gallus)
  misc_feature (36): n=c or t
tttaggccctgagactgctactaacctttaaaaagngctcagtcaatttcttgggcatcctcctattgcct

SEQ ID NO: 1180 - DNA, 71 bp, chicken (Gallus Gallus)
  misc_feature (36): n=g or t
tttattaattcctgtggatttatttctgagctactncatacatacagggaagacagcaagggactgttatg

SEQ ID NO: 1181 - DNA, 71 bp, chicken (Gallus Gallus)
  misc_feature (36): n=c or t
tttccattattgcaaatctaatttgctaccactaangtgggaatgcctgatatttttccatttgctgtgta

SEQ ID NO: 1182 - DNA, 71 bp, chicken (Gallus Gallus)
  misc_feature (36): n=c or t
tttctgtctcaatgtccatcacacgttatgggtagntgacatgcaccaaccttacaggttgtcatggtttt

SEQ ID NO: 1183 - DNA, 71 bp, chicken (Gallus Gallus)
  misc_feature (36): n=c or t
tttctttgccatgactgtagctgttatgaaaacaangatgtctatagttttcatggcaacagcctcattta

SEQ ID NO: 1184 - DNA, 71 bp, chicken (Gallus Gallus)
  misc_feature (36): n=a or g
tttgaggtcatcattttctaatgcttatgcaaaacnatcagattacgaggggatcatctatttctaaacag

SEQ ID NO: 1185 - DNA, 71 bp, chicken (Gallus Gallus)
  misc_feature (36): n=a or g
tttgatagctggactaattggtggataaataattgnttagatcatcacagccaaaaggttgtgaggtcaat

SEQ ID NO: 1186 - DNA, 71 bp, chicken (Gallus Gallus)
  misc_feature (36): n=c or t
tttgatcgtctaaaatgaggcacattaagcaaaacngaatgcgatacgtagtgagtatctgtgacaagagc

SEQ ID NO: 1187 - DNA, 71 bp, chicken (Gallus Gallus)
  misc_feature (36): n=a or g
tttgcgaaagcacaaaagaaaacagctcttcaaacntaagaatgcctcctcacaaatgtctgcaggctgca

SEQ ID NO: 1188 - DNA, 71 bp, chicken (Gallus Gallus)
  misc_feature (36): n=g or t
tttgcttaagaaccagaaggaatggaaatatattancctctgaattgttcgctatcttacctaataaaata

SEQ ID NO: 1189 - DNA, 71 bp, chicken (Gallus Gallus)
  misc_feature (36): n=c or t
tttggaccacatacttcaaatcatttggagaaaaangataagagctggccagttcttgttttttttttaaa

SEQ ID NO: 1190 - DNA, 71 bp, chicken (Gallus Gallus)
  misc_feature (36): n=c or t
tttggatgtcaccattcttttcctcccgatacattnctctcatgtcttgaaagcagcaggttctccctgct

SEQ ID NO: 1191 - DNA, 71 bp, chicken (Gallus Gallus)
  misc_feature (36): n=c or t
tttggctcctgttttatcatggtgagcataaagacngactgcaaaaggtcctgtgagattgctgtgagttc

SEQ ID NO: 1192 - DNA, 71 bp, chicken (Gallus Gallus)
  misc_feature (36): n=a or g
tttgggagaggataggggtaatgagagcagacttcncactgagctgggaggagcagaggaccgagagatca

SEQ ID NO: 1193 - DNA, 71 bp, chicken (Gallus Gallus)
  misc_feature (36): n=a or g
tttgggtaacaaaggcctcctagaactacttacagntggtactggtttgcattatgtataacttaagatga

SEQ ID NO: 1194 - DNA, 71 bp, chicken (Gallus Gallus)
  misc_feature (36): n=a or c
tttggtattcttttctgtacctttcaaaaaataaanagccaagacacacaagttttgcttgtttgtttaaa

SEQ ID NO: 1195 - DNA, 71 bp, chicken (Gallus Gallus)
  misc_feature (36): n=g or t
tttggttgtagattcttctgttttagatcagggatntggggtaagaagtaaggaaggaggagtgccttatt

SEQ ID NO: 1196 - DNA, 71 bp, chicken (Gallus Gallus)
  misc_feature (36): n=a or c
tttgttgtttcaattttgtcagacattaagcagagnggaggaaaaactgactggaagctaacctcccccga

SEQ ID NO: 1197 - DNA, 71 bp, chicken (Gallus Gallus)
  misc_feature (36): n=a or g
tttgttttgaaaagcactgtatgtcattggtgttcntgcccgtccagctctactgaactttgtgccagaga

SEQ ID NO: 1198 - DNA, 71 bp, chicken (Gallus Gallus)
  misc_feature (36): n=a or g
ttttacttaagcaaaatattttggcatacaaaaaancagacttagaatttcagctaaccaacatcaagcct

SEQ ID NO: 1199 - DNA, 71 bp, chicken (Gallus Gallus)
  misc_feature (36): n=c or t
ttttagctgactttgagtgtagcataactggcttanacaaatttgttcaacatgtggccacttttgtatga

SEQ ID NO: 1200 - DNA, 71 bp, chicken (Gallus Gallus)
  misc_feature (36): n=c or t
ttttgaaatgttaacatcaacagcagagttagcagngtgtgcccaggtctgggctcgaagcacatcctgcc

SEQ ID NO: 1201 - DNA, 71 bp, chicken (Gallus Gallus)
  misc_feature (36): n=a or g
ttttgatttagaagttataaattcctgctttgaatntaggccataatatgaatatggtcttcagccaaatt

SEQ ID NO: 1202 - DNA, 71 bp, chicken (Gallus Gallus)
  misc_feature (36): n=a or g
ttttgcttgttttccttttgatatagtgttgtcatnctatagtaataaaaaaaactgcaaggagctaatgg

SEQ ID NO: 1203 - DNA, 71 bp, chicken (Gallus Gallus)
  misc_feature (36): n=c or t
ttttgtgttgttccggcacaaagctggccttgaacngagaaggcagcaagaggtatgaggggtgcacacat

SEQ ID NO: 1204 - DNA, 71 bp, chicken (Gallus Gallus)
  misc_feature (36): n=a or g
ttttgttttccaaacgtggggtttatggaggaaacnctctgccctccaatcctcgtctccaggcagaggga

SEQ ID NO: 1205 - DNA, 71 bp, chicken (Gallus Gallus)
  misc_feature (36): n=a or g
ttttttaaggttatttctgagagtttcacttttgancctagtacagcttagttctgcagagctgttttgga

SEQ ID NO: 1206 - DNA, 71 bp, chicken (Gallus Gallus)
  misc_feature (36): n=a or g
ttttttgctgactgcactctaggaatttgactaacncaaacatgaagagctgagtgcagaacagctatggt

SEQ ID NO: 1207 - DNA, 71 bp, chicken (Gallus Gallus)
  misc_feature (36): n=c or t
aaaaaaaaaaaaaaaagccatttaaaattccttctnttacagtcagcatgaaaatactgaacaagatctgg

SEQ ID NO: 1208 - DNA, 71 bp, chicken (Gallus Gallus)
  misc_feature (36): n=a or g
aaaaaaaaagaaaaaaacccagacaaatcacacggngtttcaaactggaacatttaaatcactttgttctc

SEQ ID NO: 1209 - DNA, 71 bp, chicken (Gallus Gallus)
  misc_feature (36): n=a or g
aaaaaacagaaacctggctgtttctttacagaaagnctaagctatttccctaaggagtacagtaatgtgga

SEQ ID NO: 1210 - DNA, 71 bp, chicken (Gallus Gallus)
  misc_feature (36): n=c or t
aaaaatcatacagtttagctgataactatagtttangggttcaatgtcagtcaatctctttaggctgggtt

SEQ ID NO: 1211 - DNA, 71 bp, chicken (Gallus Gallus)
  misc_feature (36): n=a or g
aaaacaaaaccaaccaaacaacaatcagtataaccnaagactagcaagtgctattagaattgtcactgagg

SEQ ID NO: 1212 - DNA, 71 bp, chicken (Gallus Gallus)
  misc_feature (36): n=g or t
aaaacaattcaaaattcagcagcagaagagaaatanttgcctatgtatcctggtttttagagcatttcttt

SEQ ID NO: 1213 - DNA, 71 bp, chicken (Gallus Gallus)
  misc_feature (36): n=a or g
aaaacttgaccctgttttctaataaacacttgcacnaggtctcatgactttgtgaaccgtaagtaaactgc

SEQ ID NO: 1214 - DNA, 71 bp, chicken (Gallus Gallus)
  misc_feature (36): n=a or g
aaaactttgagcattctgggataactttgagagcantttctaacactgaaaatttactgttttcgttttat

SEQ ID NO: 1215 - DNA, 71 bp, chicken (Gallus Gallus)
  misc_feature (36): n=c or t
aaaagaaaatgtatcaggtggcagctcaaaaacttnggttcattcaaatatcttgaaaattcatacatttt

SEQ ID NO: 1216 - DNA, 71 bp, chicken (Gallus Gallus)
  misc_feature (36): n=a or g
aaaagaacatttgagaaaaaagtgaagcaaaagccnggagtgtaatgaaaacagagtttattctataaaaa

SEQ ID NO: 1217 - DNA, 71 bp, chicken (Gallus Gallus)
  misc_feature (36): n=a or g
aaaagcaggtggcagcaggaacttctcctggctggnctgcatgacaaaacctgaacatttactgggcaggg

SEQ ID NO: 1218 - DNA, 71 bp, chicken (Gallus Gallus)
  misc_feature (36): n=a or g
aaaatcaaacagtgtattacaagctcaggaaaaacncctgtaacttcagagcaggatttacccagatcaga

SEQ ID NO: 1219 - DNA, 71 bp, chicken (Gallus Gallus)
  misc_feature (36): n=a or g
aaaatcacacaattctttatcattgagataattctngattttcaagtcactcttctgaatgtcttcatcct

SEQ ID NO: 1220 - DNA, 71 bp, chicken (Gallus Gallus)
  misc_feature (36): n=c or t
aaaatcattattagccaggaatcatgcatttcattnggcattttcttatcaagcccagagaactgcagaca

SEQ ID NO: 1221 - DNA, 71 bp, chicken (Gallus Gallus)
  misc_feature (36): n=a or g
aaaatggcacaaaaaaaaggagttagcattgagttnggaagtgtgtttcccagcttcagaagaattcatga

SEQ ID NO: 1222 - DNA, 71 bp, chicken (Gallus Gallus)
  misc_feature (36): n=c or t
aaaattcctttctttgtgctatttgtgtttcatttnttgtttgttattgcaaaaagttctgcacagctcta

SEQ ID NO: 1223 - DNA, 71 bp, chicken (Gallus Gallus)
  misc_feature (36): n=c or t
aaaattgaatctgcgtacagaaatgggaacttaggnctgaagggatgctacagattagcttttttttcccc

SEQ ID NO: 1224 - DNA, 71 bp, chicken (Gallus Gallus)
  misc_feature (36): n=c or t
aaacaatgccttttgttagcagcaaccagcatttcnagctcccttccaagagggtgaaaaacagaacaccc

SEQ ID NO: 1225 - DNA, 71 bp, chicken (Gallus Gallus)
  misc_feature (36): n=c or t
aaacagcagaggactgtgtgaaagcaggactcaganataccatgctgatgtgacctcctatcagggcagaa

SEQ ID NO: 1226 - DNA, 71 bp, chicken (Gallus Gallus)
  misc_feature (36): n=g or t
aaaccacaaaacttgttttaatatatgtgaagaganattttgtgaagagatgtatttgagcgatatgttga

SEQ ID NO: 1227 - DNA, 71 bp, chicken (Gallus Gallus)
  misc_feature (36): n=c or t
aaaccagatgaaaccatgtccatgcttctaaattanatatttcatatcattaagtcctgagcaactaacct

SEQ ID NO: 1228 - DNA, 71 bp, chicken (Gallus Gallus)
  misc_feature (36): n=a or g
aaacctttatgagagctgcattactgtaagcagacntattttttatgtggccaaaaggcacttgtgtagca

SEQ ID NO: 1229 - DNA, 71 bp, chicken (Gallus Gallus)
  misc_feature (36): n=c or t
aaagagctgtcagcaagttcacccagaaacagcctnttggcaggaatggattaataagagaatttaatgtg

SEQ ID NO: 1230 - DNA, 71 bp, chicken (Gallus Gallus)
  misc_feature (36): n=a or g
aaagcaagtttcaaataaaggactcacaggcctccnagcttacaaattaggtaaagtaacactcagagcat

SEQ ID NO: 1231 - DNA, 71 bp, chicken (Gallus Gallus)
  misc_feature (36): n=c or t
aaagcagtacactggaattacatgagagctatcagngcatactgtgtatcagaatcaactagtcgggagtg

SEQ ID NO: 1232 - DNA, 71 bp, chicken (Gallus Gallus)
  misc_feature (36): n=c or t
aaagcattcatctgatctctgtgtatcgtttgctgngttttagccacttgtcttaggcctctgtattcctt

SEQ ID NO: 1233 - DNA, 71 bp, chicken (Gallus Gallus)
  misc_feature (36): n=c or t
aaaggagctagtaacagtcagaagcacccctttgcngaacttcttagcaggccactattctgaaactacag

SEQ ID NO: 1234 - DNA, 71 bp, chicken (Gallus Gallus)
  misc_feature (36): n=a or g
aaaggcataggattgcagagggtaagtgtcttactngtatgcagttactctctttccttggtgagtcttcc

SEQ ID NO: 1235 - DNA, 71 bp, chicken (Gallus Gallus)
  misc_feature (36): n=c or t
aaagtctgcagtgtctcactgtagaaccagaccagnggcttcatccaccatatgcattgattttagcagat

SEQ ID NO: 1236 - DNA, 71 bp, chicken (Gallus Gallus)
  misc_feature (36): n=c or t
aaatactaggaagttatcagttccactcaatcaatnatcttttaatacaacactttcatcgtatttctggt

SEQ ID NO: 1237 - DNA, 71 bp, chicken (Gallus Gallus)
  misc_feature (36): n=c or t
aaatattctatctatgcagtaggagcttcatttaangacttttcatttaagataacacccaacacaggaag

SEQ ID NO: 1238 - DNA, 71 bp, chicken (Gallus Gallus)
  misc_feature (36): n=c or t
aaatcagctttatctctgtaaggtggaaaggcagantttagttaagacgataataatttaaaatgctatga

SEQ ID NO: 1239 - DNA, 71 bp, chicken (Gallus Gallus)
  misc_feature (36): n=a or g
aaatgaaacgcagctagcaagagaaattacaagtgntatgaaatgtttgcataaggctatttttcagcgat

SEQ ID NO: 1240 - DNA, 71 bp, chicken (Gallus Gallus)
  misc_feature (36): n=c or t
aaattttcacaccataatacttgcctacagagctanttccgagtgtgtgatactacagttattgtatgatg

SEQ ID NO: 1241 - DNA, 71 bp, chicken (Gallus Gallus)
  misc_feature (36): n=c or t
aacaaaaaaaactcatacgttgccatagactttgancttgatttcttctgtttggttcaaaccctcactgt

SEQ ID NO: 1242 - DNA, 71 bp, chicken (Gallus Gallus)
  misc_feature (36): n=a or c
aacaagtgtgaatatgaaagggccttggtctcctgnaaaactattttccaatggatagcttctcagcatgt

SEQ ID NO: 1243 - DNA, 71 bp, chicken (Gallus Gallus)
  misc_feature (36): n=a or g
aacattgagtaatattgatagcttgagaaatgcatnggctatccaaacacaataccattgctcttgaaaaa

SEQ ID NO: 1244 - DNA, 71 bp, chicken (Gallus Gallus)
  misc_feature (36): n=a or g
aaccaagagttttcatagatattacttggctgcatnacttcaattgttttaaaaatttcaccttgttttat

SEQ ID NO: 1245 - DNA, 71 bp, chicken (Gallus Gallus)
  misc_feature (36): n=a or g
aaccagagctgacagtcttccatcatacacaccacntggtataactcatccttcagcacatgaagaaatta

SEQ ID NO: 1246 - DNA, 71 bp, chicken (Gallus Gallus)
  misc_feature (36): n=a or g
aactaaggagacataaaggatgctaacgagttaatntattcagccctgtagtcagagctgaacaaatgaca

SEQ ID NO: 1247 - DNA, 71 bp, chicken (Gallus Gallus)
  misc_feature (36): n=a or g
aactaattgttctcatctataaagtactataacaancttccagacttaaaccgtttcctttaagagcagga

SEQ ID NO: 1248 - DNA, 71 bp, chicken (Gallus Gallus)
  misc_feature (36): n=a or g
aactagcacaagcagcagcacatgttctgagcagcnttcagctgaccatatccctggactgcagttagcag

SEQ ID NO: 1249 - DNA, 71 bp, chicken (Gallus Gallus)
  misc_feature (36): n=a or g
aactccaaatttgaccaagtctgatcttactaattngacgtttctaccagctggttcacaaatcctgtaac

SEQ ID NO: 1250 - DNA, 71 bp, chicken (Gallus Gallus)
  misc_feature (36): n=a or g
aacttattgtccaagaagcctttgttttctcggatnctgtgcgttagtgacattcaagttttatactctgc

SEQ ID NO: 1251 - DNA, 71 bp, chicken (Gallus Gallus)
  misc_feature (36): n=c or t
aagaaaaactaaaatatttcatcgaccacctcagtnttcatctcaaactacaccagaattctgaagaattt

SEQ ID NO: 1252 - DNA, 71 bp, chicken (Gallus Gallus)
  misc_feature (36): n=c or t
aagaaagtgactgcaagagtgaaatgaatgttcatngtgagctttgcggagtaaggtttaaattttggagt

SEQ ID NO: 1253 - DNA, 71 bp, chicken (Gallus Gallus)
  misc_feature (36): n=a or g
aagaaatgattagaagctctcactgcaataggcacngtggtgtggttcattccatgttactgaaatgctta

SEQ ID NO: 1254 - DNA, 71 bp, chicken (Gallus Gallus)
  misc_feature (36): n=a or g
aagaagcaacagtgtggaagaagctgcattacggcngatctaaataaagccaggtgggattccgaaagcga

SEQ ID NO: 1255 - DNA, 71 bp, chicken (Gallus Gallus)
  misc_feature (36): n=c or t
aagaagcatcttgcatcttggttggtttacctacanttcctatcctgtccacagagagactatttcccact

SEQ ID NO: 1256 - DNA, 71 bp, chicken (Gallus Gallus)
  misc_feature (36): n=c or t
aagaagctctcatattttcctttataaagagcagtnctttgtgagattgaaatgagaaggtgccatccctg

SEQ ID NO: 1257 - DNA, 71 bp, chicken (Gallus Gallus)
  misc_feature (36): n=a or g
aagaaggaggaaagctttacgttgacataattaatntactggtgatcagcttagagttaggaatagcatga

SEQ ID NO: 1258 - DNA, 71 bp, chicken (Gallus Gallus)
  misc_feature (36): n=a or g
aagagagaaatgaaaacagcaagtcagttgtctgtnatgtagctacccatgatatattaaaaatattgacg

SEQ ID NO: 1259 - DNA, 71 bp, chicken (Gallus Gallus)
  misc_feature (36): n=c or t
aagagtgatacgtgggttccttttcccatcccatcnccattcagataaatcctcaggcaaactttgtagcc

SEQ ID NO: 1260 - DNA, 71 bp, chicken (Gallus Gallus)
  misc_feature (36): n=a or g
aagataaatcattgctctcaaaaagctattaagccntaagtgttaatttcccttagttaaatctttgctcc

SEQ ID NO: 1261 - DNA, 71 bp, chicken (Gallus Gallus)
  misc_feature (36): n=c or t
aagatagcctcctttcaggggaggttctggttggtntgtgcaccctgtttctcctctaaatgagcttgaga

SEQ ID NO: 1262 - DNA, 71 bp, chicken (Gallus Gallus)
  misc_feature (36): n=a or c
aagatgtgaatatttaaataatttaccaaataatgntttttgacgttatttacttttcattccatggtgct

SEQ ID NO: 1263 - DNA, 71 bp, chicken (Gallus Gallus)
  misc_feature (36): n=a or g
aagcaagaacaagtggcaggaaataattgatgcatnagagctggtccatcctattcaacgttaagtaattc

SEQ ID NO: 1264 - DNA, 71 bp, chicken (Gallus Gallus)
  misc_feature (36): n=g or t
aagctccagccaactcaacctcaaaccaactgctgnggaaatcggtgtctactaaatgggcaaaaactgtc

SEQ ID NO: 1265 - DNA, 71 bp, chicken (Gallus Gallus)
  misc_feature (36): n=a or g
aaggaaaataaatgtgcaagaagggacaaagggacntttaatagcagccacagccattgcagccaccccac

SEQ ID NO: 1266 - DNA, 71 bp, chicken (Gallus Gallus)
  misc_feature (36): n=a or g
aaggagaatcagctttattgctgtcctgaccctcanggatgttcttgtagcaccatcagcttcgttgtttt

SEQ ID NO: 1267 - DNA, 71 bp, chicken (Gallus Gallus)
  misc_feature (36): n=g or t
aaggagtggaactttggctgcgatcttcaggagttnactgtaagaatataaagaaaaaatggccatttttg

SEQ ID NO: 1268 - DNA, 71 bp, chicken (Gallus Gallus)
  misc_feature (36): n=a or g
aaggatgctgaactggaggttgttcttgtgatgagnatagcagtgtaatggagatgggtaatttattattt

SEQ ID NO: 1269 - DNA, 71 bp, chicken (Gallus Gallus)
  misc_feature (36): n=a or g
aagggaaataccctggggaaatgccctacttccctngtcggtcacaagctccaatttgatcctatgaaagc

SEQ ID NO: 1270 - DNA, 71 bp, chicken (Gallus Gallus)
  misc_feature (36): n=c or t
aaggtcctcccatccttcaccctggttgcaaagatnactgcatagctcttgtagtccgtgtccagcacctc

SEQ ID NO: 1271 - DNA, 71 bp, chicken (Gallus Gallus)
  misc_feature (36): n=c or t
aagtatcatctacagaaaaaaaaagagattgcatangagtggtcacatgcagtgcttgcctgtcttatgta

SEQ ID NO: 1272 - DNA, 71 bp, chicken (Gallus Gallus)
  misc_feature (36): n=a or g
aagtctcctaacattgtaagttgtctaagccactgnaagagctcatagatcataaacagcttaagacattc

SEQ ID NO: 1273 - DNA, 71 bp, chicken (Gallus Gallus)
  misc_feature (36): n=a or g
aagttcagtgtgttcttcaagctcaaggtactactngtatttgagacttgagaaaaataccccaaacctta

SEQ ID NO: 1274 - DNA, 71 bp, chicken (Gallus Gallus)
  misc_feature (36): n=c or t
aagtttatagacttgtaagctggctgcgaaaatacnttcatggtgatcagttgacctagaggttgccttct

SEQ ID NO: 1275 - DNA, 71 bp, chicken (Gallus Gallus)
  misc_feature (36): n=c or t
aagtttgaatgaattagctggatcaattcctatganaaaagtgatatttacctctttcaactacacatttt

SEQ ID NO: 1276 - DNA, 71 bp, chicken (Gallus Gallus)
  misc_feature (36): n=c or t
aataaatcctgagaaaaatgcagtgtagtaacaaanacttcagctaaatctctctataacgtagaagctaa

SEQ ID NO: 1277 - DNA, 71 bp, chicken (Gallus Gallus)
  misc_feature (36): n=a or g
aataaccaggtacccaggcaaagcacagtcagaagnaaagagctcctgctatgaacaagctgtttcgccag

SEQ ID NO: 1278 - DNA, 71 bp, chicken (Gallus Gallus)
  misc_feature (36): n=a or g
aataatgttatggacactgaaacctatagttctggnaaaacatataatcctgcagctcaaatgtatttttg

SEQ ID NO: 1279 - DNA, 71 bp, chicken (Gallus Gallus)
  misc_feature (36): n=a or c
aatacacaagaacaaaggtaccattcaatgtcttantcagctggattgggtacttatgtttgtgacaatga

SEQ ID NO: 1280 - DNA, 71 bp, chicken (Gallus Gallus)
  misc_feature (36): n=g or t
aatagatcatgtagacttattgtcaggagctttagnctaggtgttgttcaactgaagtagcatgatgcaat

SEQ ID NO: 1281 - DNA, 71 bp, chicken (Gallus Gallus)
  misc_feature (36): n=a or g
aatatcctagtgatggttatcgtatgttcatactcntaaaaatatgccagaactgccaacttgtctctttg

SEQ ID NO: 1282 - DNA, 71 bp, chicken (Gallus Gallus)
  misc_feature (36): n=a or g
aatatgaatctcagtgtcaaacgctttgtcctgcanattgcttaatactcgtgcaacttcagcagattagt

SEQ ID NO: 1283 - DNA, 71 bp, chicken (Gallus Gallus)
  misc_feature (36): n=c or t
aatcaccgcagcttcccttctctcttcctcttactncctaagtaaagaggtcaaggtcagaactgcagagc

SEQ ID NO: 1284 - DNA, 71 bp, chicken (Gallus Gallus)
  misc_feature (36): n=c or t
aatccagatgcacagttgccttgaaggagaggccantgggacgcataagcacaatgtcacacagctttttc

SEQ ID NO: 1285 - DNA, 71 bp, chicken (Gallus Gallus)
  misc_feature (36): n=a or g
aatcctttagattactttttaaaatatgtgtatgcntgttctctggtttcagtttcccttcttttatattc

SEQ ID NO: 1286 - DNA, 71 bp, chicken (Gallus Gallus)
  misc_feature (36): n=a or g
aatcgggtttagtccagagaagaggaggctcagggnagacattatcaccctctactactgtctcaaaggag

SEQ ID NO: 1287 - DNA, 71 bp, chicken (Gallus Gallus)
  misc_feature (36): n=a or g
aatctaacatggattttagctaccgatgaacttctnttgatcagtgtgttgctagatgccttgcctcttac

SEQ ID NO: 1288 - DNA, 71 bp, chicken (Gallus Gallus)
  misc_feature (36): n=a or c
aatctcctgaagaaaaaccgatgtattgcaaatttngctcagagtagtgaaaaagcagctttaaaatgtca

SEQ ID NO: 1289 - DNA, 71 bp, chicken (Gallus Gallus)
  misc_feature (36): n=c or t
aatctggtttagttccactcaaagagatcctaaagnctttgccttgcaatgccagagttttgaagagcaaa

SEQ ID NO: 1290 - DNA, 71 bp, chicken (Gallus Gallus)
  misc_feature (36): n=c or t
aatgagttctgaagcaaaggtgtggaactgaattcntccatgcagaaaaagtagcacccatcatagctgaa

SEQ ID NO: 1291 - DNA, 71 bp, chicken (Gallus Gallus)
  misc_feature (36): n=a or g
aatgatttagaccttaaaatgggctccttatgtatnaggacgctataaaactaaattctgtaactggaaaa

SEQ ID NO: 1292 - DNA, 71 bp, chicken (Gallus Gallus)
  misc_feature (36): n=c or t
aatgctgcatgaggtgggggctcagaaggagaccancagccttcaggatacattctccaaagaaaggcttc

SEQ ID NO: 1293 - DNA, 71 bp, chicken (Gallus Gallus)
  misc_feature (36): n=a or g
aatgttgagacatgctgacagatgggaatatagtgngataaaactttcttaatccaaggaaagaagagaaa

SEQ ID NO: 1294 - DNA, 71 bp, chicken (Gallus Gallus)
  misc_feature (36): n=a or g
aatgttgccttttcagtgcattttttcagctttacnttggactttgcttttaagtgttctgtactattttc

SEQ ID NO: 1295 - DNA, 71 bp, chicken (Gallus Gallus)
  misc_feature (36): n=a or g
aattaataaacagacaaaaagcctaccattttgatntagctggtttgttgagttctccatctaccactgta

SEQ ID NO: 1296 - DNA, 71 bp, chicken (Gallus Gallus)
  misc_feature (36): n=g or t
aattatttctatacaacagctgtacaaagagcagangagcggagggtaattacaccaggtatgccttccac

SEQ ID NO: 1297 - DNA, 71 bp, chicken (Gallus Gallus)
  misc_feature (36): n=c or t
aattcttggccattcaatagctcttctgattctacngcagatatctcctcatgcttcacattgatagggaa

SEQ ID NO: 1298 - DNA, 71 bp, chicken (Gallus Gallus)
  misc_feature (36): n=a or c
aatttagagaatttggtatttcccacagttaggaantgaaaagcattagagtcagactatacaaatatgcc

SEQ ID NO: 1299 - DNA, 71 bp, chicken (Gallus Gallus)
  misc_feature (36): n=c or t
aatttcctggcatggccaatcctcctagtgtgatcnatgctcacaagctagaaatctgaatctccacattg

SEQ ID NO: 1300 - DNA, 71 bp, chicken (Gallus Gallus)
  misc_feature (36): n=c or t
aattttaataggggggagggaggaataaaaatggangggaaaatttaccaccagaaacttgtgcttaatct

SEQ ID NO: 1301 - DNA, 71 bp, chicken (Gallus Gallus)
  misc_feature (36): n=a or c
acaaaaagccattgctgagcactgttgctctctctnctggagcgcttttcttttgaatttgttgaagcaat

SEQ ID NO: 1302 - DNA, 71 bp, chicken (Gallus Gallus)
  misc_feature (36): n=g or t
acaaaaatatagaagtcaacatcagctggaactcantgtaaattctggtgcatttaaatgtggtttactac

SEQ ID NO: 1303 - DNA, 71 bp, chicken (Gallus Gallus)
  misc_feature (36): n=a or c
acaaacaaatctcacccccaagagatgattccaccntgacaatcacagagatcagagtatgaacgtctgtc

SEQ ID NO: 1304 - DNA, 71 bp, chicken (Gallus Gallus)
  misc_feature (36): n=c or t
acaacgtagtgagctgtccctctgtactgactgcantggttcagatcactatgacttatctaataattaat

SEQ ID NO: 1305 - DNA, 71 bp, chicken (Gallus Gallus)
  misc_feature (36): n=c or t
acaactcgactcagctcagccacctcacagtcttgnaggtgatgggtcacatttttttgatacccttacct

SEQ ID NO: 1306 - DNA, 71 bp, chicken (Gallus Gallus)
  misc_feature (36): n=a or g
acaacttcaggtatgccatgaaaagaactggaaagngagctacatcagaatattgaaaaacacagagagtt

SEQ ID NO: 1307 - DNA, 71 bp, chicken (Gallus Gallus)
  misc_feature (36): n=c or t
acaagaagtcatggaagaagctgtgtgtgcatgcangtgtgtatgtctgagtgtataaaaccaccttccga

SEQ ID NO: 1308 - DNA, 71 bp, chicken (Gallus Gallus)
  misc_feature (36): n=c or t
acaagagaaactgcaagttgacttaggtggagcaangtagcagatgtgggatagagaaacaaaatgaaacg

SEQ ID NO: 1309 - DNA, 71 bp, chicken (Gallus Gallus)
  misc_feature (36): n=a or g
acaaggttttgttgtagcagtaaatgtgccaccacntaccttccacatagccaaaatgttttaaaacctga

SEQ ID NO: 1310 - DNA, 71 bp, chicken (Gallus Gallus)
  misc_feature (36): n=g or t
acaatatcttgctagctacatgagatggggggctanacactgcaacagaacatgtagtgtatagaagtcta

SEQ ID NO: 1311 - DNA, 71 bp, chicken (Gallus Gallus)
  misc_feature (36): n=a or g
acaattggcagaacttctaatgatattagtgatacncaaatatactaaaaagaacatagggaattagagat

SEQ ID NO: 1312 - DNA, 71 bp, chicken (Gallus Gallus)
  misc_feature (36): n=c or t
acacgtgtttcacctgcggccatgctcaggcacttnggtgatgggagttagatgacaatccacgacagaac

SEQ ID NO: 1313 - DNA, 71 bp, chicken (Gallus Gallus)
  misc_feature (36): n=a or g
acactcagctgtttatgaacagcaataccataattntacataattgctctgaggttctgctatctgaccac

SEQ ID NO: 1314 - DNA, 71 bp, chicken (Gallus Gallus)
  misc_feature (36): n=c or t
acactgaattaaaatgggatcaaaatgatattttcngtctgtttgtattttgtatctttatcagaacagct

SEQ ID NO: 1315 - DNA, 71 bp, chicken (Gallus Gallus)
  misc_feature (36): n=c or t
acactgagcttgtgggaggagaaaccagtgttttgntgttcctctgggattagttagtagatgaccacagc

SEQ ID NO: 1316 - DNA, 71 bp, chicken (Gallus Gallus)
  misc_feature (36): n=a or g
acacttcatggcctctggacctcattatttctgctntttgacagaagggtaattaaagctccactgtaaga

SEQ ID NO: 1317 - DNA, 71 bp, chicken (Gallus Gallus)
  misc_feature (36): n=c or t
acagaaataggtgtgttagcaatgcttaagcagtgnttcctatacctctccttgctggtgatggagtacta

SEQ ID NO: 1318 - DNA, 71 bp, chicken (Gallus Gallus)
  misc_feature (36): n=a or g
acagagcaggtactgcctgaacagcaggcacttaantcgcacgacactgacctgatgatgtgtcttggccc

SEQ ID NO: 1319 - DNA, 71 bp, chicken (Gallus Gallus)
  misc_feature (36): n=a or g
acagattttaattttctaccaagatcttggtggtantgagcttattatatctgtaatgtaggagctgaagt

SEQ ID NO: 1320 - DNA, 71 bp, chicken (Gallus Gallus)
  misc_feature (36): n=g or t
acagcaaaacaaaacaaatatattcttaatgagaangaaaatttggccaacagtttatctatgaaggaagg

SEQ ID NO: 1321 - DNA, 71 bp, chicken (Gallus Gallus)
  misc_feature (36): n=a or g
acagccctgtggagcactggggctcgaggagatgcntctgagcgtagaccatagctgaaagccagtgacaa

SEQ ID NO: 1322 - DNA, 71 bp, chicken (Gallus Gallus)
  misc_feature (36): n=a or g
acagccctttcattggactggaaggtgctgggtacntcctgtcatttggaaagacagctgagatttacgag

SEQ ID NO: 1323 - DNA, 71 bp, chicken (Gallus Gallus)
  misc_feature (36): n=c or t
acagggctacgctgcgtattccgtgatggagagaangggcttcctctacaccctctgttttcctttaatta

SEQ ID NO: 1324 - DNA, 71 bp, chicken (Gallus Gallus)
  misc_feature (36): n=a or g
acagtgctggccagtgccacagcacagctgcatganagaaaatcacaggtgggtgtgatacagtccatagc

SEQ ID NO: 1325 - DNA, 71 bp, chicken (Gallus Gallus)
  misc_feature (36): n=g or t
acagtttggttttccatgcaggattgaatccttcanatcagtagagaaaatggcttcatattcatttcatg

SEQ ID NO: 1326 - DNA, 71 bp, chicken (Gallus Gallus)
  misc_feature (36): n=c or t
acatcacctatgctggcagcacagcatttgagcacngatcttgagacagccctgatccaaaacgtcccatg

SEQ ID NO: 1327 - DNA, 71 bp, chicken (Gallus Gallus)
  misc_feature (36): n=c or t
acatgaaattcacagaatcaaaataaccatattgtnctcactcagttcgtatcaaaccatttcccagtcac

SEQ ID NO: 1328 - DNA, 71 bp, chicken (Gallus Gallus)
  misc_feature (36): n=a or g
acatgggattaaaagaaataaaataaaatagggctnctttttcctaaaatctacttcgtttctgcacacag

SEQ ID NO: 1329 - DNA, 71 bp, chicken (Gallus Gallus)
  misc_feature (36): n=c or t
acatttatctgaaaaaatttgctaatctcaatgtgngttttagacaacagcagccacgtctatcagctcca

SEQ ID NO: 1330 - DNA, 71 bp, chicken (Gallus Gallus)
  misc_feature (36): n=c or t
accaaatccctacctcactgtttcaatacctgcgcntagtgcctggattgccttacattcagctctgtaac

SEQ ID NO: 1331 - DNA, 71 bp, chicken (Gallus Gallus)
  misc_feature (36): n=a or g
accaagctgagttctcccgagaggttcagccacacngcatcagatcattaatgaccatcaggctgcacttt

SEQ ID NO: 1332 - DNA, 71 bp, chicken (Gallus Gallus)
  misc_feature (36): n=a or c
accaatataccctatctccttcctcccatctccaanctttgttattccttgtggagaggtattggcacatg

SEQ ID NO: 1333 - DNA, 71 bp, chicken (Gallus Gallus)
  misc_feature (36): n=c or t
accaatgctgtgttggtgagagatgttctcaggttntccatctatcagtcttgcaagctcagagcagaaca

SEQ ID NO: 1334 - DNA, 71 bp, chicken (Gallus Gallus)
  misc_feature (36): n=c or t
accactgacctaattcatccctttgctctcatgaanagaatccaagtaaagtttaaaccagtgcagctgct

SEQ ID NO: 1335 - DNA, 71 bp, chicken (Gallus Gallus)
  misc_feature (36): n=a or g
accattgggtgggtctgcagatccccgctgcattcntttggagctgtgattaaaaggacatcaggtgctcc

SEQ ID NO: 1336 - DNA, 71 bp, chicken (Gallus Gallus)
  misc_feature (36): n=a or g
acccacccaccagtccagagaagtcagagatcaagntctaaactttccagatcagctgtccagaataattt

SEQ ID NO: 1337 - DNA, 71 bp, chicken (Gallus Gallus)
  misc_feature (36): n=a or g
accccaatgatgcagcatataaaaataaacacaaangaaaattttgtaacttaggaatgatttgtgcttga

SEQ ID NO: 1338 - DNA, 71 bp, chicken (Gallus Gallus)
  misc_feature (36): n=a or g
acctcatgacccttactacactttcctcttgtcctntgtatatatgtaggcaaatagctggtgtctcagta

SEQ ID NO: 1339 - DNA, 71 bp, chicken (Gallus Gallus)
  misc_feature (36): n=a or g
acctcttcccactgctttttgaagcaaagctggatngaaaccatttctcccatcctaccacggtacttggg

SEQ ID NO: 1340 - DNA, 71 bp, chicken (Gallus Gallus)
  misc_feature (36): n=a or g
acctgagacttttctttttccttctttgagatctancaaacaaatggaaagctttctacctccatgtctgt

SEQ ID NO: 1341 - DNA, 71 bp, chicken (Gallus Gallus)
  misc_feature (36): n=a or g
accttgaagagttcacacgaggtttaactgcgtacnttcacccttttcagtcggttcagctactcaaatgt

SEQ ID NO: 1342 - DNA, 71 bp, chicken (Gallus Gallus)
  misc_feature (36): n=c or t
acgcatttcttttctttgggatgctactcatatctntgccctgatttaccatggaaaagtagagcttgcca

SEQ ID NO: 1343 - DNA, 71 bp, chicken (Gallus Gallus)
  misc_feature (36): n=c or t
acggatgtgggggcaacagggtaaggctcaaggacngcaatcttatcaaggacctgatgcagggaaaagtg

SEQ ID NO: 1344 - DNA, 71 bp, chicken (Gallus Gallus)
  misc_feature (36): n=c or t
acgggatattatggtacaattctataactggcatgnataaaaaaatcctgaaattgaaatgacatataaaa

SEQ ID NO: 1345 - DNA, 71 bp, chicken (Gallus Gallus)
  misc_feature (36): n=a or c
acggtgatggcactgtccaactgttgtttcctggtnttttttgccccttagggaagctgtgagttcccttc

SEQ ID NO: 1346 - DNA, 71 bp, chicken (Gallus Gallus)
  misc_feature (36): n=g or t
actccattctgcattcccatagtctctctccaaagntttttctctgcttcagctttagcagctggtgattt

SEQ ID NO: 1347 - DNA, 71 bp, chicken (Gallus Gallus)
  misc_feature (36): n=c or t
actccctcagttcacagagagaaagagagacctatncagaacaatgaggaagaagttgatgagcttgaaag

SEQ ID NO: 1348 - DNA, 71 bp, chicken (Gallus Gallus)
  misc_feature (36): n=a or g
actcctccaccagttttcagcattcaaataccccanttctaaagttcctccatataaagccctgctttcat

SEQ ID NO: 1349 - DNA, 71 bp, chicken (Gallus Gallus)
  misc_feature (36): n=a or g
actctggctgcctggtagacttctctgctttcaacnatcctaacaatgagagtgaaagaaataacaagttc

SEQ ID NO: 1350 - DNA, 71 bp, chicken (Gallus Gallus)
  misc_feature (36): n=a or g
actgatgttgaataaaacttactattcttcagctgnggttgacttgttcttctcagccctaaataaatgtg

SEQ ID NO: 1351 - DNA, 71 bp, chicken (Gallus Gallus)
  misc_feature (36): n=a or g
actgctctctgtgcgctgtggtttcatggtgctcanttccctcctctatacagaaggttaagaattcatct

SEQ ID NO: 1352 - DNA, 71 bp, chicken (Gallus Gallus)
  misc_feature (36): n=c or t
actggaaagaagatgcgtaagaaagccgtaaccctntgctaaaaatagtttaagtcacacagcagaatgat

SEQ ID NO: 1353 - DNA, 71 bp, chicken (Gallus Gallus)
  misc_feature (36): n=a or g
actgggtggtggactgcacctccagtggctgcatgnacacatcccatagacacggatgctcttctctctta

SEQ ID NO: 1354 - DNA, 71 bp, chicken (Gallus Gallus)
  misc_feature (36): n=a or g
acttacagtgaacaactgctttactcatcatgcatnttatggtttgctaaatacaacttagatttgtgtat

SEQ ID NO: 1355 - DNA, 71 bp, chicken (Gallus Gallus)
  misc_feature (36): n=a or g
acttcagtagattcttcgtatagacagcttattacnatagtactcatgtcgttcttgtaacatgactgtgg

SEQ ID NO: 1356 - DNA, 71 bp, chicken (Gallus Gallus)
  misc_feature (36): n=c or t
acttctttagctccatccccctcatttttttatggngttcagtgaggtggtagagtagttagagatcccac

SEQ ID NO: 1357 - DNA, 71 bp, chicken (Gallus Gallus)
  misc_feature (36): n=c or t
acttggtgaggggtatgaaaacaaagaagattctanaggtatattgattagaggagatagacaaaggagaa

SEQ ID NO: 1358 - DNA, 71 bp, chicken (Gallus Gallus)
  misc_feature (36): n=a or g
actttaacgtcagtcattcagggaaagtttgtgttntagttctagctggaaggccattggcatactttttt

SEQ ID NO: 1359 - DNA, 71 bp, chicken (Gallus Gallus)
  misc_feature (36): n=a or g
actttcacttatagttgttatacttactctctagtncccattcaaatgcttttaacactgtatgttcaaga

SEQ ID NO: 1360 - DNA, 71 bp, chicken (Gallus Gallus)
  misc_feature (36): n=a or c
agaaaagacagtcttgctccaaattcaaaaacaaanaatttcctggcaaaaggtcttacttttgtttcaca

SEQ ID NO: 1361 - DNA, 71 bp, chicken (Gallus Gallus)
  misc_feature (36): n=c or t
agaacacagctttcttccctatgggatgccggatcnttaagagatgacaactattttcagtcatttttgac

SEQ ID NO: 1362 - DNA, 71 bp, chicken (Gallus Gallus)
  misc_feature (36): n=a or g
agaactttactaccaaggatgatgcatgaggtaganacaacagctttactgtccaatgccagcactgagtt

SEQ ID NO: 1363 - DNA, 71 bp, chicken (Gallus Gallus)
  misc_feature (36): n=a or g
agaagagagaaagggagagaaataaccatatcactncaccaatacacttatgacctgagcattttggaaga

SEQ ID NO: 1364 - DNA, 71 bp, chicken (Gallus Gallus)
  misc_feature (36): n=c or t
agaagctagcaatgagatatttattgtcaggcttanggttaacacgctggatgccagtgagaaactgagaa

SEQ ID NO: 1365 - DNA, 71 bp, chicken (Gallus Gallus)
  misc_feature (36): n=a or g
agaatatctttcctcccaagccaggcacatgcccanacatactaacatcactggttccatgtagagtgatt

SEQ ID NO: 1366 - DNA, 71 bp, chicken (Gallus Gallus)
  misc_feature (36): n=c or t
agaatttttgtttctgcccatgttgcagttcttcanaccttgtttagacttgtgttttctgcagctctact

SEQ ID NO: 1367 - DNA, 71 bp, chicken (Gallus Gallus)
  misc_feature (36): n=a or g
agacactggccaaggtattagctttggtttgtgaangagatttgagaagagaacatttttgtgtgcacagc

SEQ ID NO: 1368 - DNA, 71 bp, chicken (Gallus Gallus)
  misc_feature (36): n=c or t
agacagaaatagagttagtggtagaaaagattaatnttgagtatcaagctgagtatttcagacatctgaat

SEQ ID NO: 1369 - DNA, 71 bp, chicken (Gallus Gallus)
  misc_feature (36): n=c or t
agacagtttcttgtttccagttcacgactgtgtggnagctcacagtaattcaagacagctgctggagtgtt

SEQ ID NO: 1370 - DNA, 71 bp, chicken (Gallus Gallus)
  misc_feature (36): n=c or t
agactggggtgtcattccctgccacaattaactccngcatttaactcttgtctggaaacctgttcaaggac

SEQ ID NO: 1371 - DNA, 71 bp, chicken (Gallus Gallus)
  misc_feature (36): n=a or g
agacttcagctcaatccagccactgccacggttgcngtgaggattatctccacacaccaaccgttgaggat

SEQ ID NO: 1372 - DNA, 71 bp, chicken (Gallus Gallus)
  misc_feature (36): n=c or t
agagaagagttagtaacacaagagaggccccctacntaacagtggaagacaactctatgcacacaagatca

SEQ ID NO: 1373 - DNA, 71 bp, chicken (Gallus Gallus)
  misc_feature (36): n=a or c
agagaagtgaaaaagctcttccctaggaaagcagtngaatctgtttactatgatatatttattccaaaggt

SEQ ID NO: 1374 - DNA, 71 bp, chicken (Gallus Gallus)
  misc_feature (36): n=a or g
agagacattcattgctcagtatgtaaatctcactcntttcaagcctttgcttacagctccacatctgtcag

SEQ ID NO: 1375 - DNA, 71 bp, chicken (Gallus Gallus)
  misc_feature (36): n=a or g
agagagctgaaacaaaaggggcagcgccattgtcanagggagcgcgtttccaaatggctaatgacgatgat

SEQ ID NO: 1376 - DNA, 71 bp, chicken (Gallus Gallus)
  misc_feature (36): n=g or t
agagcaaatatttgatttaaataaatatgtctattntgtctatctaatgagaaaaggcagtctagtggatc

SEQ ID NO: 1377 - DNA, 71 bp, chicken (Gallus Gallus)
  misc_feature (36): n=a or g
agagcagaaaacgcaaagtacttctttcttttatcnttggttaaagatatcacttagcttcgaaaaagcca

SEQ ID NO: 1378 - DNA, 71 bp, chicken (Gallus Gallus)
  misc_feature (36): n=a or g
agagccacggttattttagaaagctcaaacaaaacntcaagaaaatacatattaatacacctcattggctg

SEQ ID NO: 1379 - DNA, 71 bp, chicken (Gallus Gallus)
  misc_feature (36): n=c or t
agagctattgtaagtcgccatccctgactctcattntgcgctggcgttcttcctttcctaacaagctgacc

SEQ ID NO: 1380 - DNA, 71 bp, chicken (Gallus Gallus)
  misc_feature (36): n=a or g
agagcttcacattgaccaccttttcacctatcttcncacacaggttcatttctaacaagtacttggtaaag

SEQ ID NO: 1381 - DNA, 71 bp, chicken (Gallus Gallus)
  misc_feature (36): n=g or t
agagtagtgccatacaccgtagctcctggtgcgctngttaagaaaacattcgccacttctgagttatttgc

SEQ ID NO: 1382 - DNA, 71 bp, chicken (Gallus Gallus)
  misc_feature (36): n=a or c
agagtctcagttcaaagtcttgccagttaccttctnttgttattactacagagctgtccagaaatgttctc

SEQ ID NO: 1383 - DNA, 71 bp, chicken (Gallus Gallus)
  misc_feature (36): n=a or g
agatctaaaagattttctgagcctgtagaaaagctngatcctacagttccctatggagggagagttaattt

SEQ ID NO: 1384 - DNA, 71 bp, chicken (Gallus Gallus)
  misc_feature (36): n=a or g
agatgtgaagaaccgctggagcacaccagtcaccangactatcagcaagagcaaaaatacaagaaaccaat

SEQ ID NO: 1385 - DNA, 71 bp, chicken (Gallus Gallus)
  misc_feature (36): n=g or t
agattgaagtaaatgcctctcatctgtagaggtctnttctttgaactaaggaatcattaagtcagactcaa

SEQ ID NO: 1386 - DNA, 71 bp, chicken (Gallus Gallus)
  misc_feature (36): n=a or g
agatttagcttaatgcattcttggaggtagcttcancaatctgaacaggtagatggtcaaaactattttta

SEQ ID NO: 1387 - DNA, 71 bp, chicken (Gallus Gallus)
  misc_feature (36): n=c or t
agatttcctgctctctgcctgtttttgtgctagacnctgatacaggtattgttttgcctcatctctgccct

SEQ ID NO: 1388 - DNA, 71 bp, chicken (Gallus Gallus)
  misc_feature (36): n=c or t
agcaaccagctgtgacagcacctctggtttatatgngagtgaagatgttacaggttgctgattgttcttgt

SEQ ID NO: 1389 - DNA, 71 bp, chicken (Gallus Gallus)
  misc_feature (36): n=a or c
agcaatgcacttccctgggttaaccaacaagcttgntgctcctgtgaatgagacccatgcaatggtttgat

SEQ ID NO: 1390 - DNA, 71 bp, chicken (Gallus Gallus)
  misc_feature (36): n=a or g
agcatcgctctctatccctaaagagcaaataaatcngtatcttaccttttgtgagatcagatgaatggctc

SEQ ID NO: 1391 - DNA, 71 bp, chicken (Gallus Gallus)
  misc_feature (36): n=a or c
agcatctactctagttctctcgttagtcttctggcntaatttcctcccaggtggagatgccatgaatggtg

SEQ ID NO: 1392 - DNA, 71 bp, chicken (Gallus Gallus)
  misc_feature (36): n=a or g
agcatgtcatttacggcagctgacgaagtgttgagngaactgaatatcttaagagactgataatgcagaga

SEQ ID NO: 1393 - DNA, 71 bp, chicken (Gallus Gallus)
  misc_feature (36): n=a or c
agcattgtgaacaattcccaagggaatgtgatgatntgttccccgtttctcctcaagacatctagctaaga

SEQ ID NO: 1394 - DNA, 71 bp, chicken (Gallus Gallus)
  misc_feature (36): n=a or g
agccagagctgtgaaagatgtccttttcactgtacntttatgtgctgaggaacacatctgcctcaccagta

SEQ ID NO: 1395 - DNA, 71 bp, chicken (Gallus Gallus)
  misc_feature (36): n=c or t
agccctcatgctgctgagctccccagggcctccagngtctgctgattctggtcttgcagcacttgcctctt

SEQ ID NO: 1396 - DNA, 71 bp, chicken (Gallus Gallus)
  misc_feature (36): n=c or t
agcgacatacctgtgatttgtagttgcatttttttncctattgatgattgtgttgtctcttttttgggggg

SEQ ID NO: 1397 - DNA, 71 bp, chicken (Gallus Gallus)
  misc_feature (36): n=g or t
agctgggctcctcagtatattcacgtacgttgcaancagataagaaggacactgataacttcagctgatac

SEQ ID NO: 1398 - DNA, 71 bp, chicken (Gallus Gallus)
  misc_feature (36): n=c or t
agctgttcctggagcagatctgggattgccttttcngcttactcagtaaccaaatcacaaatgcagtttac

SEQ ID NO: 1399 - DNA, 71 bp, chicken (Gallus Gallus)
  misc_feature (36): n=a or g
agcttcaaagggattttccctgtaggggcagagatntgaagtgtcactgtgaagaattccttaaaaactat

SEQ ID NO: 1400 - DNA, 71 bp, chicken (Gallus Gallus)
  misc_feature (36): n=c or t
agcttcagtgattttctatcatttgcacacaagttngcatgggtagtattagtaaagaaatacctagtaca

SEQ ID NO: 1401 - DNA, 71 bp, chicken (Gallus Gallus)
  misc_feature (36): n=a or c
aggaccgctaggtaaaagtatccaaaaataagtagngtttatgaagtccgcttgctttctgttcactgtag

SEQ ID NO: 1402 - DNA, 71 bp, chicken (Gallus Gallus)
  misc_feature (36): n=c or t
aggacgaagctggaaactgcacagcctgtatcacanggtgtatggtactaacatttcctatgcttttgact

SEQ ID NO: 1403 - DNA, 71 bp, chicken (Gallus Gallus)
  misc_feature (36): n=c or t
aggagtgattagcaacaccattttgaaaattcaggnatcatataactatagctgaaaacatagccaagtat

SEQ ID NO: 1404 - DNA, 71 bp, chicken (Gallus Gallus)
  misc_feature (36): n=c or t
aggcaaagaagataacccctgtgtagcaagtggagnaagtctgtatgttgaagtgcagcttcatgcattgc

SEQ ID NO: 1405 - DNA, 71 bp, chicken (Gallus Gallus)
  misc_feature (36): n=g or t
agggaaaagttaatcccatttctgttgcttccatantgaaattccaagtacattcacatggacattaatga

SEQ ID NO: 1406 - DNA, 71 bp, chicken (Gallus Gallus)
  misc_feature (36): n=a or c
agggatgagagcctctttagtgtgggagtctcaggntctgcttaatgacagctgtacaaatggcatcacag

SEQ ID NO: 1407 - DNA, 71 bp, chicken (Gallus Gallus)
  misc_feature (36): n=a or g
agggatgggacacccacagcttctgtgggcagtctntttgtgaggagatgagaaattctatcttcattctc

SEQ ID NO: 1408 - DNA, 71 bp, chicken (Gallus Gallus)
  misc_feature (36): n=c or t
agggccctgggggtattttaagtcactcattacatncatttctttaaaagtctaatgcttttcagagtccc

SEQ ID NO: 1409 - DNA, 71 bp, chicken (Gallus Gallus)
  misc_feature (36): n=a or g
aggtaaagatgaccttagacatgttgtcagcaatcngatgaatttcaaaccaggaaggatttttttaattc

SEQ ID NO: 1410 - DNA, 71 bp, chicken (Gallus Gallus)
  misc_feature (36): n=c or t
aggtggaaggtctaaaaataagagtgagaccatagntttgaggaggtcagtttcagatatctgaaagtgga

SEQ ID NO: 1411 - DNA, 71 bp, chicken (Gallus Gallus)
  misc_feature (36): n=a or g
aggtggctggtggacaaggaacaaagtgaaacaagntatgtttggtcacagcatctatctgccaggcacca

SEQ ID NO: 1412 - DNA, 71 bp, chicken (Gallus Gallus)
  misc_feature (36): n=c or t
aggtgggatttgaatatactgtggatatttaaatangctttctgtgtgtaacttaaggcagaaatgctcct

SEQ ID NO: 1413 - DNA, 71 bp, chicken (Gallus Gallus)
  misc_feature (36): n=a or g
aggtgtgctgggatacaggtttacattgggatggcnatggcttgcttgggttccatcagtacaagaaaaca

SEQ ID NO: 1414 - DNA, 71 bp, chicken (Gallus Gallus)
  misc_feature (36): n=a or g
aggttattacagctatctggccttacatagcagagnattccatttttatacagatttttctgacaaacttt

SEQ ID NO: 1415 - DNA, 71 bp, chicken (Gallus Gallus)
  misc_feature (36): n=g or t
aggttgtacagaggggctgtacagtctctgtctttngagttttcaatatcagactggatattggactagca

SEQ ID NO: 1416 - DNA, 71 bp, chicken (Gallus Gallus)
  misc_feature (36): n=c or t
agtcctaacacctcttcaggaaggagcagaggtggnatggatgctctttgtcttctgagcatgaaaagtag

SEQ ID NO: 1417 - DNA, 71 bp, chicken (Gallus Gallus)
  misc_feature (36): n=a or g
agtctatcttgatatgtgatcttaaggatgcttcanctcatcatatttgcatactactggtgcagacttca

SEQ ID NO: 1418 - DNA, 71 bp, chicken (Gallus Gallus)
  misc_feature (36): n=a or c
agtcttgtttgcttatggattttaagaacatccatngaagattatttgaaaaccacctcattagaatgaca

SEQ ID NO: 1419 - DNA, 71 bp, chicken (Gallus Gallus)
  misc_feature (36): n=a or g
agtgcccatcacacaccattgtgaaggtgctggggntgatggatgtgtgaccaggaccgatttggggaaca

SEQ ID NO: 1420 - DNA, 71 bp, chicken (Gallus Gallus)
  misc_feature (36): n=c or t
agtggagcaggtgcaacctggaaacagtgcagcttnatcttggaaagttatagtacttgctgcttttcagt

SEQ ID NO: 1421 - DNA, 71 bp, chicken (Gallus Gallus)
  misc_feature (36): n=a or g
agtggccaggttgcaagaggagatcaccacacagcntattacctgggaatcggagagagagattgctgcgt

SEQ ID NO: 1422 - DNA, 71 bp, chicken (Gallus Gallus)
  misc_feature (36): n=c or t
agtgggcaatatcaatgtatgatacaatctgtaagngttgaatctatatagatttacatgagcatacacag

SEQ ID NO: 1423 - DNA, 71 bp, chicken (Gallus Gallus)
  misc_feature (36): n=c or t
agtgtactgaagagtcactacaggctgtattacaangagttcaatgcagctttttaaaacagcagatgtgc

SEQ ID NO: 1424 - DNA, 71 bp, chicken (Gallus Gallus)
  misc_feature (36): n=c or t
agtgttttctcaagtcttgggtcttctctttcgttntcaaagcaataaggatgatcacacaagttagaaaa

SEQ ID NO: 1425 - DNA, 71 bp, chicken (Gallus Gallus)
  misc_feature (36): n=a or g
agtttagtggaggtgcttgggaggaagtcatcttcntccaaaatggtgcttggcctcagatcaagcttttg

SEQ ID NO: 1426 - DNA, 71 bp, chicken (Gallus Gallus)
  misc_feature (36): n=c or t
agtttgcctgtgctcctgaaggggtgagttgtcttngttcttctcgtgtccatagttggtctgttcgtggg

SEQ ID NO: 1427 - DNA, 71 bp, chicken (Gallus Gallus)
  misc_feature (36): n=c or t
ataataggaaatgacaatgagcttaacaaatgacanatcaaggaataaatactcccatcattagattatgc

SEQ ID NO: 1428 - DNA, 71 bp, chicken (Gallus Gallus)
  misc_feature (36): n=c or t
ataaactatcaattacagctaaaatacagacggtgnagttcttacctgtgtaaattataggccagatcgat

SEQ ID NO: 1429 - DNA, 71 bp, chicken (Gallus Gallus)
  misc_feature (36): n=c or t
ataaataggacattgttggtgaccaagtgtgcactnacatttaaatacaatcacaacagctgctgtacaga

SEQ ID NO: 1430 - DNA, 71 bp, chicken (Gallus Gallus)
  misc_feature (36): n=a or g
ataaggaagtactgaccacagtacgtgcaatcagtngcgagacagctctactaaatttcagctttaattta

SEQ ID NO: 1431 - DNA, 71 bp, chicken (Gallus Gallus)
  misc_feature (36): n=c or t
ataattagagatcaaatcaatgccttaaatgaatgnatttttcatatggattcaggctcccatattatttt

SEQ ID NO: 1432 - DNA, 71 bp, chicken (Gallus Gallus)
  misc_feature (36): n=c or t
ataattgttcaggaaaagctttgagaacactgttgngagatgtgctaaagggatggagtcttgcatttagg

SEQ ID NO: 1433 - DNA, 71 bp, chicken (Gallus Gallus)
  misc_feature (36): n=a or g
atacatcagactacaccctggtgtgtcatcttgggnagcttttccagactgtcagagaaactcttaaaagc

SEQ ID NO: 1434 - DNA, 71 bp, chicken (Gallus Gallus)
  misc_feature (36): n=a or g
atacatttatccaaaggaaactcacaaccttcttgngtaggatgctctcagacatccaaaatggcactggg

SEQ ID NO: 1435 - DNA, 71 bp, chicken (Gallus Gallus)
  misc_feature (36): n=c or t
ataggtaatggcagcatgtatggcaaacaggtatangtgtattggaccagtgagattatcacgtaacaaag

SEQ ID NO: 1436 - DNA, 71 bp, chicken (Gallus Gallus)
  misc_feature (36): n=c or t
atagtgcccatacccacttagcaacaggggcacatngtgtttgcctgcaaagcttgcagtgtgaaagctgg

SEQ ID NO: 1437 - DNA, 71 bp, chicken (Gallus Gallus)
  misc_feature (36): n=a or g
atatacatacactgaatcaacagctgtgctaaggtnttactcccacagattcaccaacaggtgaacgtttt

SEQ ID NO: 1438 - DNA, 71 bp, chicken (Gallus Gallus)
  misc_feature (36): n=c or t
atatccccaactatttgttgatgaacacaatgttgnataggctgccacagctagtgacagtctgttctaag

SEQ ID NO: 1439 - DNA, 71 bp, chicken (Gallus Gallus)
  misc_feature (36): n=g or t
atatctgtttatgcaagatattgcccaggttagtgntttttttacaatcactatggcaattcaccctacga

SEQ ID NO: 1440 - DNA, 71 bp, chicken (Gallus Gallus)
  misc_feature (36): n=c or t
atatgtgcatgacctgctttatccactctaaggcancctgaagagtcttacaattagcttgtattgatgga

SEQ ID NO: 1441 - DNA, 71 bp, chicken (Gallus Gallus)
  misc_feature (36): n=c or t
atatttgggctttaacaaggattactttcaaaatantgctttattaggaaaatttatcccgatttattaca

SEQ ID NO: 1442 - DNA, 71 bp, chicken (Gallus Gallus)
  misc_feature (36): n=c or t
atcaaatacagattgtaatatttagtcttgtcttgncactgttaactatctcagtcccataacatggttca

SEQ ID NO: 1443 - DNA, 71 bp, chicken (Gallus Gallus)
  misc_feature (36): n=a or g
atcactgggctgttgctggcattgtactgcctgtangtgggtctttcaaaaccttcatacaaggaggtgct

SEQ ID NO: 1444 - DNA, 71 bp, chicken (Gallus Gallus)
  misc_feature (36): n=a or g
atcagaagggcataagctattggaacactcatagcntatgtgaaccttaagcatgtgtgaataatccctct

SEQ ID NO: 1445 - DNA, 71 bp, chicken (Gallus Gallus)
  misc_feature (36): n=a or c
atcatcaataacaagccaggtctcacctggtccagntgagaaccttcatctggaggctctgtttctgtagg

SEQ ID NO: 1446 - DNA, 71 bp, chicken (Gallus Gallus)
  misc_feature (36): n=a or g
atcccaaccaccagaacgattttccttatgttagantttcccattgcagttttaagcttgttactcttctc

SEQ ID NO: 1447 - DNA, 71 bp, chicken (Gallus Gallus)
  misc_feature (36): n=a or c
atccctttggttggcatcccttctttctcttgtcanctggacaacttagcttagtatcaaaccaactcaga

SEQ ID NO: 1448 - DNA, 71 bp, chicken (Gallus Gallus)
  misc_feature (36): n=c or t
atctcaagcaagagcctctaatggctggcacctgcntgtctgaggatacccagaggcatatgcggagtgtg

SEQ ID NO: 1449 - DNA, 71 bp, chicken (Gallus Gallus)
  misc_feature (36): n=c or t
atctcccctgtttagcttcagcctgccacagcctcnagagaaggcttttctacctgccaagcattttctac

SEQ ID NO: 1450 - DNA, 71 bp, chicken (Gallus Gallus)
  misc_feature (36): n=c or t
atctctgcctgaagatctgcacttctttctgtagantgcagaaagttttacagctccattgctcaccccca

SEQ ID NO: 1451 - DNA, 71 bp, chicken (Gallus Gallus)
  misc_feature (36): n=a or g
atctgatactgatccatcaaacttagctattagttntgttctatcctttgatttcatggaacataaataaa

SEQ ID NO: 1452 - DNA, 71 bp, chicken (Gallus Gallus)
  misc_feature (36): n=c or t
atcttgacatagagatattcataagattgtatatangaattgattgttgaataaaatttcaagagataaca

SEQ ID NO: 1453 - DNA, 71 bp, chicken (Gallus Gallus)
  misc_feature (36): n=c or t
atcttgctggatctaggagtcttaattccacaatgnatatttcatttgaaaatcacttcagaggagttctc

SEQ ID NO: 1454 - DNA, 71 bp, chicken (Gallus Gallus)
  misc_feature (36): n=c or t
atgaaacactcacaatgctcagcagcatttgtgccnatgtcagtgtatctcagtgtctctgctaacacgca

SEQ ID NO: 1455 - DNA, 71 bp, chicken (Gallus Gallus)
  misc_feature (36): n=c or t
atgaagcttacagcagtggaacatccatctgcctanctccaagggctgcctcttttcacgtgatcatgatc

SEQ ID NO: 1456 - DNA, 71 bp, chicken (Gallus Gallus)
  misc_feature (36): n=g or t
atgagcctcctgtttgaggatgacattgccttatcncattgtctagctttctattgactatgacagaagtg

SEQ ID NO: 1457 - DNA, 71 bp, chicken (Gallus Gallus)
  misc_feature (36): n=c or t
atgatctgagaaaactgagacatttctatattcctnttcttgttgtatgtctttgtggacaatgcagtata

SEQ ID NO: 1458 - DNA, 71 bp, chicken (Gallus Gallus)
  misc_feature (36): n=a or g
atgatttgaggatgcaattaaagatgatccacagtntttccatgtgcctgctagcttgtaacaaagtcagt

SEQ ID NO: 1459 - DNA, 71 bp, chicken (Gallus Gallus)
  misc_feature (36): n=c or t
atgcagtgtgggcaacaaatagaaggagctggaagncatcatgcagtgggtaaactatggcttagttgcca

SEQ ID NO: 1460 - DNA, 71 bp, chicken (Gallus Gallus)
  misc_feature (36): n=c or t
atgccaccatgaatcctgcactagaatcttggcggngtagtgtcacaaagaagctgacaacttgacatcag

SEQ ID NO: 1461 - DNA, 71 bp, chicken (Gallus Gallus)
  misc_feature (36): n=c or t
atgctatagagtcatagagtccttagggttggaagngtgattaagaattgtttatacaccagaagaaatgc

SEQ ID NO: 1462 - DNA, 71 bp, chicken (Gallus Gallus)
  misc_feature (36): n=a or g
atgctcaatgctcatgtcctccgtgctggagttccnggaggcattggcttcaatctccagatcacaatttg

SEQ ID NO: 1463 - DNA, 71 bp, chicken (Gallus Gallus)
  misc_feature (36): n=c or t
atgctcctggtgcagatgcagcactgcttttactgncatgctgtttccatagcagttacagacaagctgta

SEQ ID NO: 1464 - DNA, 71 bp, chicken (Gallus Gallus)
  misc_feature (36): n=a or g
atgctgccagtcttcctccattaatacagagagagnagcactttatttgacctgataatcagaaattgtag

SEQ ID NO: 1465 - DNA, 71 bp, chicken (Gallus Gallus)
  misc_feature (36): n=c or t
atgctgtacttccaaggtttcggtaattcagtttanggacactaaaaagtcttactctgagagaaggaatc

SEQ ID NO: 1466 - DNA, 71 bp, chicken (Gallus Gallus)
  misc_feature (36): n=c or t
atggacgaatcatttcccagtttgttagttagaggngaatgtccatttccttagttctgagtgagcctatt

SEQ ID NO: 1467 - DNA, 71 bp, chicken (Gallus Gallus)
  misc_feature (36): n=c or t
atggacttgaacttaatttaaattgctttttggagngtacacctatgctagcttgtcatacttggtctgct

SEQ ID NO: 1468 - DNA, 71 bp, chicken (Gallus Gallus)
  misc_feature (36): n=a or g
atggcatacagctcaatgtacttcttatgacttcanaatgagaaaacattaagttggaagaagacttagag

SEQ ID NO: 1469 - DNA, 71 bp, chicken (Gallus Gallus)
  misc_feature (36): n=c or t
atggccaaaaccaggtgcacatagccccagctcagnattagtgcttgaggccaaatctcagtgtacccaga

SEQ ID NO: 1470 - DNA, 71 bp, chicken (Gallus Gallus)
  misc_feature (36): n=a or c
atggccttttctgtaaaggagaagtgagaggagggncgtttgtcttttccaaacatcagatctgctgaact

SEQ ID NO: 1471 - DNA, 71 bp, chicken (Gallus Gallus)
  misc_feature (36): n=a or c
atggtcctctgggactggctctgtaggcagaaccantgcatctccctcaaagctgggagaagctcaagtca

SEQ ID NO: 1472 - DNA, 71 bp, chicken (Gallus Gallus)
  misc_feature (36): n=c or t
atggtgatgcagtttctgaaagaataaattaattcnttttaggaggaaaagaagaggatgaaggaagaaat

SEQ ID NO: 1473 - DNA, 71 bp, chicken (Gallus Gallus)
  misc_feature (36): n=a or g
atggtgcgggatgggccagcatccagaacaaggccntactggaaaatccccaaaacattttagatgaatac

SEQ ID NO: 1474 - DNA, 71 bp, chicken (Gallus Gallus)
  misc_feature (36): n=c or t
atggtgggccaccaaagaagtgaaaggagcattgtnggtatgaaaatgtattttggacacctgtaattgaa

SEQ ID NO: 1475 - DNA, 71 bp, chicken (Gallus Gallus)
  misc_feature (36): n=c or t
atgttattacaatcataaaaaatatataaaaatctnactcctaaaacttcaataagcaggcatctgtctgc

SEQ ID NO: 1476 - DNA, 71 bp, chicken (Gallus Gallus)
  misc_feature (36): n=a or g
atgtttcaaaaagcttagaggggcaatgtctcaatnaatatgccagaaaaacagaatttaacaccaaaaag

SEQ ID NO: 1477 - DNA, 71 bp, chicken (Gallus Gallus)
  misc_feature (36): n=a or g
atgttttggggctgttatcaccagctttttgcaccngagtcattacagtattctttaaactgttagatgtc

SEQ ID NO: 1478 - DNA, 71 bp, chicken (Gallus Gallus)
  misc_feature (36): n=a or g
attaaagctcctctttctctgagctcaggctgctcntttagccaatccacttccacattcggaaaaaggga

SEQ ID NO: 1479 - DNA, 71 bp, chicken (Gallus Gallus)
  misc_feature (36): n=c or t
attaaatgaagcaaagaatgaattatttcacttctngtgaccaatttcatccttctttatgcagagttaat

SEQ ID NO: 1480 - DNA, 71 bp, chicken (Gallus Gallus)
  misc_feature (36): n=a or c
attaatgggaaagccagaagttgcatgtcttatatntgcttttacattatatggcattttcgtgctttcaa

SEQ ID NO: 1481 - DNA, 71 bp, chicken (Gallus Gallus)
  misc_feature (36): n=a or g
attacaggagagggtgtatagcgcaaatacaggganaggcatctcctccgtgaaagaagctgatgtcttgc

SEQ ID NO: 1482 - DNA, 71 bp, chicken (Gallus Gallus)
  misc_feature (36): n=a or g
attaggcattaattaatgctaaaacaaagctaaccntgccaaaatttatgtaaacagtaaatttgtaagta

SEQ ID NO: 1483 - DNA, 71 bp, chicken (Gallus Gallus)
  misc_feature (36): n=a or g
attataattacaatccagccctaagctggtgcctanacatcttctcactgaaacatcagcaaagttggcag

SEQ ID NO: 1484 - DNA, 71 bp, chicken (Gallus Gallus)
  misc_feature (36): n=c or t
attcagaaattggaacaaaaatgcctaaaacagctnaggttttacaagagaagaaaatgtccataaaacta

SEQ ID NO: 1485 - DNA, 71 bp, chicken (Gallus Gallus)
  misc_feature (36): n=c or t
attcattaagagcttccatcagtccgaactggctgngatctcacagagatgggatgtaaatatgatcagtg

SEQ ID NO: 1486 - DNA, 71 bp, chicken (Gallus Gallus)
  misc_feature (36): n=a or g
attccagctcaggctgtgaagccaagaagcacctcngccactcttaccatgaaggcccaggatatcctcca

SEQ ID NO: 1487 - DNA, 71 bp, chicken (Gallus Gallus)
  misc_feature (36): n=a or g
attctgaagctctgaaggacccttagctctgaactntgtttatatacaattgtcttacactaaagggtcta

SEQ ID NO: 1488 - DNA, 71 bp, chicken (Gallus Gallus)
  misc_feature (36): n=c or t
attcttttatgggttttcattttagttgttaaatanggagaaagaaaggatgctatatctatatttgaaag

SEQ ID NO: 1489 - DNA, 71 bp, chicken (Gallus Gallus)
  misc_feature (36): n=c or t
attgctgtagcagcagtgcctgtgagccacacagcnggtaaagagcaatggtctccaaaaaaaaaaaccca

SEQ ID NO: 1490 - DNA, 71 bp, chicken (Gallus Gallus)
  misc_feature (36): n=a or g
atttcagaatatatagcatgagtgctgtgtcagcantccctttaacagaaaggcagtaaacgctgacaaca

SEQ ID NO: 1491 - DNA, 71 bp, chicken (Gallus Gallus)
  misc_feature (36): n=a or g
atttgagatgctactgggggagcctgctttatctcngtgagaaatctaggaaagtcagtagttgaaaataa

SEQ ID NO: 1492 - DNA, 71 bp, chicken (Gallus Gallus)
  misc_feature (36): n=c or t
atttgcatggttcttgaaaatctattttatcagcantgaattgcagacagtactgtatctcctagctcccc

SEQ ID NO: 1493 - DNA, 71 bp, chicken (Gallus Gallus)
  misc_feature (36): n=a or g
atttttaagtggaaaatactccaatatcaatagtgntattgaatacttgtgacaattataaacagctaatg

SEQ ID NO: 1494 - DNA, 71 bp, chicken (Gallus Gallus)
  misc_feature (36): n=a or g
caaaagactcacagcaccatcttgaaaaaaatcacngggcagaaattacaacctcttctctctgggctgtt

SEQ ID NO: 1495 - DNA, 71 bp, chicken (Gallus Gallus)
  misc_feature (36): n=c or t
caaagagagcagctggtttgaaaggagtttgttggngcagacaattatatgcaccaggtctgtgctaaagg

SEQ ID NO: 1496 - DNA, 71 bp, chicken (Gallus Gallus)
  misc_feature (36): n=a or c
caaaggaaattattatgattcccttcttaagcatcncatctctgtctcagtacaagaatgaattgttgact

SEQ ID NO: 1497 - DNA, 71 bp, chicken (Gallus Gallus)
  misc_feature (36): n=a or g
caaatagatgtcaagttgttaacagctttccctctnacaatgctaaatgagattaaggcaagcaaaaataa

SEQ ID NO: 1498 - DNA, 71 bp, chicken (Gallus Gallus)
  misc_feature (36): n=a or g
caacaatgcctggctagtattgcatatgtaattgcncatgtttttgtggtaaatgaatgatacattttaag

SEQ ID NO: 1499 - DNA, 71 bp, chicken (Gallus Gallus)
  misc_feature (36): n=a or g
caaccacattgcaacccagggctctcagacttacangcttaaaccccagtatttcattttttcaacatctc

SEQ ID NO: 1500 - DNA, 71 bp, chicken (Gallus Gallus)
  misc_feature (36): n=c or t
caaccaggtcagtgcagctgggcacagtggagcagngtggctccaactactcatgcagtgctgcttgcact

SEQ ID NO: 1501 - DNA, 71 bp, chicken (Gallus Gallus)
  misc_feature (36): n=a or g
caacctgcaaatcatagatgcacaagctttcttgcngtgtttgctttcagataaatgagagtagatttcat

SEQ ID NO: 1502 - DNA, 71 bp, chicken (Gallus Gallus)
  misc_feature (36): n=a or g
caactcagtcccactacactcaactccaactgtacnttacttttcttatccccaatcattaaaaacaaaac

SEQ ID NO: 1503 - DNA, 71 bp, chicken (Gallus Gallus)
  misc_feature (36): n=c or t
caagaagtgcatttaaataacttggtttttgagtgntagccactgacagctgagatgaaaggtaatttctg

SEQ ID NO: 1504 - DNA, 71 bp, chicken (Gallus Gallus)
  misc_feature (36): n=c or t
caagaggaaagcttaggtgggagctgcagtccttcnatgcaaacggtaagtgctgtgaggtactggaacac

SEQ ID NO: 1505 - DNA, 71 bp, chicken (Gallus Gallus)
  misc_feature (36): n=a or c
caagagtatggagctgtgcaagctggaacagcagcntgcagtgtcaatatggcacctgctgtgacatccag

SEQ ID NO: 1506 - DNA, 71 bp, chicken (Gallus Gallus)
  misc_feature (36): n=a or g
caagcggcacgtcacacctgcaggctgggcagagcnagctaacactgaccgcacgtacagctgtctgatac

SEQ ID NO: 1507 - DNA, 71 bp, chicken (Gallus Gallus)
  misc_feature (36): n=c or t
caagtctggctcaaaaatgttttctccttaagctgnctcatccttagaaataacaaaaatgtgatatgtag

SEQ ID NO: 1508 - DNA, 71 bp, chicken (Gallus Gallus)
  misc_feature (36): n=a or g
caatataccacaactcctccccaaatgaggcctatnccatcatttcaacatctaaatattaagctcccaag

SEQ ID NO: 1509 - DNA, 71 bp, chicken (Gallus Gallus)
  misc_feature (36): n=g or t
caatctgggacagtagaagaagagagagaagacagncttctgttcagtaggactgttaaggcactagttgg

SEQ ID NO: 1510 - DNA, 71 bp, chicken (Gallus Gallus)
  misc_feature (36): n=c or t
caatgcagtatataaatcgtttcttttttttttttncccttagataagttagattccagctggacacagaa

SEQ ID NO: 1511 - DNA, 71 bp, chicken (Gallus Gallus)
  misc_feature (36): n=c or t
cacaaatatgaatgataaatgatgttaagatggttnagctaatgactacatgtgtgctgtgcttgctgcaa

SEQ ID NO: 1512 - DNA, 71 bp, chicken (Gallus Gallus)
  misc_feature (36): n=a or g
cacaaggatactgcattttaattcactttcaatacnaaatagttgctttgatattcctgagaacaagcgcc

SEQ ID NO: 1513 - DNA, 71 bp, chicken (Gallus Gallus)
  misc_feature (36): n=a or c
cacaccacttgtgcacatacttggaccccctctgcntgttggtagaagaggaggataggaattgtatccct

SEQ ID NO: 1514 - DNA, 71 bp, chicken (Gallus Gallus)
  misc_feature (36): n=a or g
cacacctggcagaagacataaacagggagactatgnacttaattcagtcctagtgccctaaaaaatcccac

SEQ ID NO: 1515 - DNA, 71 bp, chicken (Gallus Gallus)
  misc_feature (36): n=a or g
cacagaaggcatgcacagcccgacctctgaacgcanagctttttcctgtttatgttggccaagacccttag

SEQ ID NO: 1516 - DNA, 71 bp, chicken (Gallus Gallus)
  misc_feature (36): n=a or g
cacagctagatagtcacactgaattcatattgatcnattgcctttggagcaaatccataatttaacctgtt

SEQ ID NO: 1517 - DNA, 71 bp, chicken (Gallus Gallus)
  misc_feature (36): n=a or g
cacagctgggcacatagccctgcttgtttaactccntgtaaatggcactctaatattccccttaactgctg

SEQ ID NO: 1518 - DNA, 71 bp, chicken (Gallus Gallus)
  misc_feature (36): n=a or g
cacatgggacctgaaatgcaggaggaagagcagcangacacatccaaaaccatgaggatggagcagtgggt

SEQ ID NO: 1519 - DNA, 71 bp, chicken (Gallus Gallus)
  misc_feature (36): n=a or g
caccagagttctttattttagaaatgctctttgggntgagagaaaccatgttagaaatccttggtttgctg

SEQ ID NO: 1520 - DNA, 71 bp, chicken (Gallus Gallus)
  misc_feature (36): n=c or t
cacctgaagatcaaaagaacaaaagctagaagggangaggctgacagtgtagtggatgcatttcaaatccc

SEQ ID NO: 1521 - DNA, 71 bp, chicken (Gallus Gallus)
  misc_feature (36): n=a or g
cacgccttctacctagcacccatgtggatggcaggngagctgagccatatcagtgcatctgagcaaatggg

SEQ ID NO: 1522 - DNA, 71 bp, chicken (Gallus Gallus)
  misc_feature (36): n=a or c
cacgctctgccttggaccaacctcccccaccccccngactaagctctgcttctctcaaatcaaagtgacaa

SEQ ID NO: 1523 - DNA, 71 bp, chicken (Gallus Gallus)
  misc_feature (36): n=a or g
cacggaaaaacaaaccaggagggccgggcgacgccncgatggatcaaccacagccaaggaaatcgtggtga

SEQ ID NO: 1524 - DNA, 71 bp, chicken (Gallus Gallus)
  misc_feature (36): n=a or g
cacggcctcagctcgctccctcgctttggtgatgcntgcagttgtgttgaaggatgctcaaagagcacaga

SEQ ID NO: 1525 - DNA, 71 bp, chicken (Gallus Gallus)
  misc_feature (36): n=c or t
cactatggagcttccttgtttggatcaggcttgtgntcattcagccttggcatctcttgttggtaggctct

SEQ ID NO: 1526 - DNA, 71 bp, chicken (Gallus Gallus)
  misc_feature (36): n=a or g
cactcaactgcacataattcagtaggactactgacnctgagactagtaagttaacatcaaacttaacaatc

SEQ ID NO: 1527 - DNA, 71 bp, chicken (Gallus Gallus)
  misc_feature (36): n=c or t
cactgaaaggagaaaggaaggctttttttttttttntctgctgtccaggctgtttacatttcagctgaagg

SEQ ID NO: 1528 - DNA, 71 bp, chicken (Gallus Gallus)
  misc_feature (36): n=a or g
cactgacacacgcagcatatcatggaacacagcccnaaggtcaatcagctaccttagaaatcacttccaag

SEQ ID NO: 1529 - DNA, 71 bp, chicken (Gallus Gallus)
  misc_feature (36): n=c or t
cactggggacaaaaggtggttgacacaggggagtanattctctggcagagtaaattcctcatatataatgc

SEQ ID NO: 1530 - DNA, 71 bp, chicken (Gallus Gallus)
  misc_feature (36): n=a or c
cacttgctctcatggcccagggtcatttatctgtgnatgtagccagctttgtcaaatctctcatatactct

SEQ ID NO: 1531 - DNA, 71 bp, chicken (Gallus Gallus)
  misc_feature (36): n=c or t
cagaaagctgtaacttttctcttttctcattagatntttttgtaattgtgtcctttgctgcccttggttat

SEQ ID NO: 1532 - DNA, 71 bp, chicken (Gallus Gallus)
  misc_feature (36): n=c or t
cagaagagcgagctgcgtgccatcactaatggcttnggaatagatcagaaaatgaacaagagggaagaaga

SEQ ID NO: 1533 - DNA, 71 bp, chicken (Gallus Gallus)
  misc_feature (36): n=c or t
cagaagcttgtcaggaatagttaatacaaacacagngtaccatgtgcatcataaaatgcctttgttgcact

SEQ ID NO: 1534 - DNA, 71 bp, chicken (Gallus Gallus)
  misc_feature (36): n=a or g
cagacagtaaataaataattgcagggagctatcgcncatagatttctttgaagcacagaatttaattaaat

SEQ ID NO: 1535 - DNA, 71 bp, chicken (Gallus Gallus)
  misc_feature (36): n=g or t
cagagagagcgatgctgacagctgtccctgttggangctgagaggcagtatattaccctgaagccaccagt

SEQ ID NO: 1536 - DNA, 71 bp, chicken (Gallus Gallus)
  misc_feature (36): n=c or t
cagagcgcatgcacacgtgtacaataggaacccccnggcatgcttcagctgcagatgcaaatgttagagct

SEQ ID NO: 1537 - DNA, 71 bp, chicken (Gallus Gallus)
  misc_feature (36): n=c or t
cagatactgaaaacatctacctgcctgctggtcctnctgtttttcatacccactgttctgggtatctgtcc

SEQ ID NO: 1538 - DNA, 71 bp, chicken (Gallus Gallus)
  misc_feature (36): n=c or t
cagtcatatttaagaagatgtgctgcaaatgactgngaaacaggggtgaataaagttcccctgaaaatctg

SEQ ID NO: 1539 - DNA, 71 bp, chicken (Gallus Gallus)
  misc_feature (36): n=c or t
cagcaccaagaagtaaagcagaggcttttcctgccncagagagttcacattttaggacataaaaaaaacaa

SEQ ID NO: 1540 - DNA, 71 bp, chicken (Gallus Gallus)
  misc_feature (36): n=a or g
cagcatctctcatagatctgcatgtccacagagctntgaggtactgaaaagcattgcaagacatataagca

SEQ ID NO: 1541 - DNA, 71 bp, chicken (Gallus Gallus)
  misc_feature (36): n=c or t
cagcatggggagctctggagaaaaatggcacccaantgatgatccgttcatatgaacttggagtccttttc

SEQ ID NO: 1542 - DNA, 71 bp, chicken (Gallus Gallus)
  misc_feature (36): n=c or t
cagccagagtaattagcattcagcatcaatgctganaggaaatagaggtaggcaataaaaggcaaatgact

SEQ ID NO: 1543 - DNA, 71 bp, chicken (Gallus Gallus)
  misc_feature (36): n=a or g
cagccttggacccagcagaatgtctgggatgagganttctcctcacatcttccattctctcagcagtgcca

SEQ ID NO: 1544 - DNA, 71 bp, chicken (Gallus Gallus)
  misc_feature (36): n=a or g
cagctcagtatggaatagcctgtgtcaagaagcacncatctcttcatcctatatcagttataatttgtgtt

SEQ ID NO: 1545 - DNA, 71 bp, chicken (Gallus Gallus)
  misc_feature (36): n=a or g
cagcttataatgcagcatgtgatttgctttccacanaatatgcctgaacgttgcttgggccagcattccgt

SEQ ID NO: 1546 - DNA, 71 bp, chicken (Gallus Gallus)
  misc_feature (36): n=g or t
cagctttgagggtccaatctcctccatttcttccancaccagtaagtacttgaatctcttcactctgatct

SEQ ID NO: 1547 - DNA, 71 bp, chicken (Gallus Gallus)
  misc_feature (36): n=a or g
cagcttttccattcaaacactgcatatagccactcnatagcaatcaaccatagtattgttgcacagcactt

SEQ ID NO: 1548 - DNA, 71 bp, chicken (Gallus Gallus)
  misc_feature (36): n=a or g
caggatgtgttcaagcaccaacctgccagatgatcntgtattaataatacctgaaaaatcatgtaatgatt

SEQ ID NO: 1549 - DNA, 71 bp, chicken (Gallus Gallus)
  misc_feature (36): n=c or t
caggcacaactttacagcagcctgaactgtgactgngtcgcagcttctgtgtagtgagaatacagctccct

SEQ ID NO: 1550 - DNA, 71 bp, chicken (Gallus Gallus)
  misc_feature (36): n=a or g
caggcagggaacattcctgtctatggacatctaatntgctaaaaatgaaatgacaccaacatcaaaccctg

SEQ ID NO: 1551 - DNA, 71 bp, chicken (Gallus Gallus)
  misc_feature (36): n=a or g
caggttgttccctggagcccaagcatctcccctccnatgctggcactcagaaatacctgcatgacagagct

SEQ ID NO: 1552 - DNA, 71 bp, chicken (Gallus Gallus)
  misc_feature (36): n=a or g
cagtaataagactacagctctgcctgtgtctgctgnccctggcttttcatagtgtacaaaaacctcctgtc

SEQ ID NO: 1553 - DNA, 71 bp, chicken (Gallus Gallus)
  misc_feature (36): n=c or t
cagtaggacagctgtattgtagccatcctttacaancagtacaagtgtaaatacacaacaagcagtaaact

SEQ ID NO: 1554 - DNA, 71 bp, chicken (Gallus Gallus)
  misc_feature (36): n=c or t
cagtggatgtcaatctccttcaccttcacgtcttcntctgtctatagctcacacttccagtttctctcacc

SEQ ID NO: 1555 - DNA, 71 bp, chicken (Gallus Gallus)
  misc_feature (36): n=a or g
cagtggtcaaatattttccttgccccatatccaacngttattgcttctttatccatcaagcttatgcgatt

SEQ ID NO: 1556 - DNA, 71 bp, chicken (Gallus Gallus)
  misc_feature (36): n=c or t
cagtgtgttgtgtcaagaagggggagtgtgctgagngcttattatctgtttaggtacaagaagagcacatt

SEQ ID NO: 1557 - DNA, 71 bp, chicken (Gallus Gallus)
  misc_feature (36): n=a or c
cagttttttattccagtagagtttttttcttcttcnaaaatattcacttggatttagcttcagaactcttt

SEQ ID NO: 1558 - DNA, 71 bp, chicken (Gallus Gallus)
  misc_feature (36): n=g or t
cataatggcagcagtaacagaattttctcaaaattnctttgttttgctactgtgcatccatgtgttgtatc

SEQ ID NO: 1559 - DNA, 71 bp, chicken (Gallus Gallus)
  misc_feature (36): n=g or t
catagattccagctgcattgcactgcaatacttggntttcatctgggcatgtcttaaaatcaaagttactg

SEQ ID NO: 1560 - DNA, 71 bp, chicken (Gallus Gallus)
  misc_feature (36): n=c or t
catagctactgacctgacccttggtggccatgactntattgagggaaatgcttgaagcccatgggatcatt

SEQ ID NO: 1561 - DNA, 71 bp, chicken (Gallus Gallus)
  misc_feature (36): n=a or c
cataggagtgggaacctcagctcagggcatcccagngttccctgctgtgtcccattcccatagcactcagg

SEQ ID NO: 1562 - DNA, 71 bp, chicken (Gallus Gallus)
  misc_feature (36): n=c or t
catataataggaggcattacttttggaatagccctngcagagtgaaggtcatttgccaatggtttatctaa

SEQ ID NO: 1563 - DNA, 71 bp, chicken (Gallus Gallus)
  misc_feature (36): n=g or t
catcaaaaacttaaacctgcttcatcccacacagantgaaacatatgttagaaaaagattaagtactgcag

SEQ ID NO: 1564 - DNA, 71 bp, chicken (Gallus Gallus)
  misc_feature (36): n=c or t
catgcataatgcacaccgcagcccacgcacagctcnggttgcatggctctccattaattctttatcgggct

SEQ ID NO: 1565 - DNA, 71 bp, chicken (Gallus Gallus)
  misc_feature (36): n=a or g
catgcctacttcccagctcttacttcttggccttcnctccttggagatatgctggctgatgcaattaactg

SEQ ID NO: 1566 - DNA, 71 bp, chicken (Gallus Gallus)
  misc_feature (36): n=a or g
catgcgcatccatgcgccctgcacatactgtaagtnaatgcaagagagtgggtgccaacacaaccctcagc

SEQ ID NO: 1567 - DNA, 71 bp, chicken (Gallus Gallus)
  misc_feature (36): n=a or g
catggacaagcctttctgtgccgtcatagaccatgnactgtgaaagtgatgcaagctcaactagtcttctt

SEQ ID NO: 1568 - DNA, 71 bp, chicken (Gallus Gallus)
  misc_feature (36): n=a or g
catggtcaaatatcctgtccagctggaaaaggctgngagtaaagtgtctcttacgtggttgagatccatca

SEQ ID NO: 1569 - DNA, 71 bp, chicken (Gallus Gallus)
  misc_feature (36): n=c or t
catgtcagaagcaagggatctcttccatggcagagnattcattttgaattacaaggttctgagttaaagac

SEQ ID NO: 1570 - DNA, 71 bp, chicken (Gallus Gallus)
  misc_feature (36): n=c or t
catgttatatagaaagttgctggcaagcacataggnataggtggatgaagtttgcagaaaagctgacaaag

SEQ ID NO: 1571 - DNA, 71 bp, chicken (Gallus Gallus)
  misc_feature (36): n=a or g
cattatgtagtgagacagagtgttcccagacagacngggtcgaagtctggaaggcttcagaaaatgacagc

SEQ ID NO: 1572 - DNA, 71 bp, chicken (Gallus Gallus)
  misc_feature (36): n=c or t
cattgctgcttttctgaagggttggttcatgttttngtttttttaactctctatcccttcctcttaaaaag

SEQ ID NO: 1573 - DNA, 71 bp, chicken (Gallus Gallus)
  misc_feature (36): n=a or g
ccaacacattgggaggcagtaaccatgtcgtttggnggaagacagtatcttctggagggtcaagctgaagc

SEQ ID NO: 1574 - DNA, 71 bp, chicken (Gallus Gallus)
  misc_feature (36): n=c or t
ccaagcgtccttgccttttgcaagtctctgttccanttagctcacacttgcaaactgcaaatcattcataa

SEQ ID NO: 1575 - DNA, 71 bp, chicken (Gallus Gallus)
  misc_feature (36): n=a or c
ccacaccagtggggcatgaaagcagctgatcgtgangttagggttcaggaaacacagataccttcctctgt

SEQ ID NO: 1576 - DNA, 71 bp, chicken (Gallus Gallus)
  misc_feature (36): n=c or t
ccacaggacattttcttgttttaatcaccaccggcngcctcttttgctatcaaaggagttcctttagctag

SEQ ID NO: 1577 - DNA, 71 bp, chicken (Gallus Gallus)
  misc_feature (36): n=c or t
ccaccaaagggctgtgcttctgccctgggaaagggngagttttccagctggaaatattgactgcatatcac

SEQ ID NO: 1578 - DNA, 71 bp, chicken (Gallus Gallus)
  misc_feature (36): n=a or g
ccaccatgtgatcatacaggttggaaggaatatctngagatcaggtagctcaaaccccaccttttgttatg

SEQ ID NO: 1579 - DNA, 71 bp, chicken (Gallus Gallus)
  misc_feature (36): n=a or g
ccactgcatgaccccacagtctgtctttcagccccnaaacagccaattatgtgacacaaaggcaaattccc

SEQ ID NO: 1580 - DNA, 71 bp, chicken (Gallus Gallus)
  misc_feature (36): n=a or g
ccacttccccagttacacttgtatagctctgacacnttgtcagcaattacctgaatgtcgatgtttgtaag

SEQ ID NO: 1581 - DNA, 71 bp, chicken (Gallus Gallus)
  misc_feature (36): n=c or t
ccagaaacctcctcccaaagctgcaatgcagccctnagtgtaccactgctgctcctaacatccaacccaca

SEQ ID NO: 1582 - DNA, 71 bp, chicken (Gallus Gallus)
  misc_feature (36): n=a or g
ccagccatcctgagacttttttttcttaaagcttcngaaacaaactaggctcatgtctgtattttacctat

SEQ ID NO: 1583 - DNA, 71 bp, chicken (Gallus Gallus)
  misc_feature (36): n=c or t
ccagctccaattaaacattatttgtttttctttcanatttagagatacagagagaagaatagaatcctagt

SEQ ID NO: 1584 - DNA, 71 bp, chicken (Gallus Gallus)
  misc_feature (36): n=a or c
ccagtgcaattcttcctgtgtcttccccttcagagngctgcaatctgcattcctctggttagcagaaagcc

SEQ ID NO: 1585 - DNA, 71 bp, chicken (Gallus Gallus)
  misc_feature (36): n=c or t
ccagttacagctgggacagatttgtttcttcatagngcactgatgtttttcgttttaggagaagaacatcg

SEQ ID NO: 1586 - DNA, 71 bp, chicken (Gallus Gallus)
  misc_feature (36): n=a or g
ccagtttggctcttcagttgatgtttagcccacccntaccagctcataaatctctgaagaaaccactgatg

SEQ ID NO: 1587 - DNA, 71 bp, chicken (Gallus Gallus)
  misc_feature (36): n=a or g
ccatgaaaggtgaggatgatgtctgaatacctaacncatccaaagcccttttaacatattcaaaaccttgt

SEQ ID NO: 1588 - DNA, 71 bp, chicken (Gallus Gallus)
  misc_feature (36): n=c or t
ccatgagcaccgtttcaccttttcaggacgtggggnacaatcagtgtttgcatttgggctcgctaacgcct

SEQ ID NO: 1589 - DNA, 71 bp, chicken (Gallus Gallus)
  misc_feature (36): n=c or t
ccatgggagggtgcagagctgctttcctgagcaaanttggctgaaaatgaaactggtcagccctgagtcag

SEQ ID NO: 1590 - DNA, 71 bp, chicken (Gallus Gallus)
  misc_feature (36): n=a or g
ccattcaataacaaaacatgcaggtctgggggaaanaaatcacctaaatttccagctagaccatttgattt

SEQ ID NO: 1591 - DNA, 71 bp, chicken (Gallus Gallus)
  misc_feature (36): n=a or g
ccattttaaaatctactatcaaaatcaataagttanttattggaatggcagccagctgaatcagacaggcg

SEQ ID NO: 1592 - DNA, 71 bp, chicken (Gallus Gallus)
  misc_feature (36): n=c or t
cccaaagctttgattttgttagaacatgttatttantgctggacattcaagagaattgtcaatgccacata

SEQ ID NO: 1593 - DNA, 71 bp, chicken (Gallus Gallus)
  misc_feature (36): n=c or t
cccatggaaatcttctaacagagcagagtttagagnggttgtttcccacctccgtaaatctgaccataggg

SEQ ID NO: 1594 - DNA, 71 bp, chicken (Gallus Gallus)
  misc_feature (36): n=a or g
ccccctgaaagtcatttagcttaggctctggttgcnaacaaactggattatggaagtgctgtcatcaagaa

SEQ ID NO: 1595 - DNA, 71 bp, chicken (Gallus Gallus)
  misc_feature (36): n=c or t
cccgtttggcactgctgagctttcctgactgctccncatatctccttgctgagaacgaatggcttccagca

SEQ ID NO: 1596 - DNA, 71 bp, chicken (Gallus Gallus)
  misc_feature (36): n=a or g
ccctagcaaatcatactccagttggtgctttccatnctaaactccctgtgatccctttaaggaaacaagga

SEQ ID NO: 1597 - DNA, 71 bp, chicken (Gallus Gallus)
  misc_feature (36): n=c or t
ccctgaagatgtcagtactttgcatgcatgtgcatnagatctaagtatccccatctgcctggtgctgagga

SEQ ID NO: 1598 - DNA, 71 bp, chicken (Gallus Gallus)
  misc_feature (36): n=c or t
ccctgcaacagcctaaaatgtgactcatggctctgntttgtgcggatcattcagctctttccctgctaagc

SEQ ID NO: 1599 - DNA, 71 bp, chicken (Gallus Gallus)
  misc_feature (36): n=a or g
ccctggatctggctgctgaactgaagagcttctccntggctttaggatgataagtgtacatctgtaaatca

SEQ ID NO: 1600 - DNA, 71 bp, chicken (Gallus Gallus)
  misc_feature (36): n=a or g
ccctggtaatgggatgctgagaaggcagagaagctnaacatctttgcttcaatctctactgctaggactgc

SEQ ID NO: 1601 - DNA, 71 bp, chicken (Gallus Gallus)
  misc_feature (36): n=a or g
ccctgtgcaggaacaggcagtttctgtgccttttcngtgcaaaaccacattctgcctctcagctttcacaa

SEQ ID NO: 1602 - DNA, 71 bp, chicken (Gallus Gallus)
  misc_feature (36): n=a or g
cccttgtatctcagtttgtgccaacattgcctctcntcctgtaactgagtcaagctctattctccatatgt

SEQ ID NO: 1603 - DNA, 71 bp, chicken (Gallus Gallus)
  misc_feature (36): n=c or t
ccgttcctaaagcctctgggaggcagatttcacagncttcccaagacatctctaccagcactcagctcccc

SEQ ID NO: 1604 - DNA, 71 bp, chicken (Gallus Gallus)
  misc_feature (36): n=c or t
cctaatagcttccacagtttagtaaacacattccanatattacagtaaaaaatttcagatccaaccttttc

SEQ ID NO: 1605 - DNA, 71 bp, chicken (Gallus Gallus)
  misc_feature (36): n=c or t
cctaggcttttccagcataaggaatatctgcatctnttctatgtgaaacttcagaaatgtgcatggagttt

SEQ ID NO: 1606 - DNA, 71 bp, chicken (Gallus Gallus)
  misc_feature (36): n=c or t
cctatattgtcatttagtcatcgtggaagtgctcangtcataactattcagaggtatcaagaaagaggatc

SEQ ID NO: 1607 - DNA, 71 bp, chicken (Gallus Gallus)
  misc_feature (36): n=a or g
cctcctcaaagaggcatcgcaaagggggagaagccntagcacgtcccataaatgtcacaccgccaaatggt

SEQ ID NO: 1608 - DNA, 71 bp, chicken (Gallus Gallus)
  misc_feature (36): n=a or g
cctgatacaaccatcttacctcccactgggattctnatcccagctgaacacttctcagagatctttctaga

SEQ ID NO: 1609 - DNA, 71 bp, chicken (Gallus Gallus)
  misc_feature (36): n=a or g
cctgtagctactctctcttgtatctctgtaaaggcnctgtccacgaacttactgatatgatatagtttaac

SEQ ID NO: 1610 - DNA, 71 bp, chicken (Gallus Gallus)
  misc_feature (36): n=a or c
cctgtgctactacgttcctctgtcaagccaccatanaatcttactttcttttaatcaactgtgatgaggga

SEQ ID NO: 1611 - DNA, 71 bp, chicken (Gallus Gallus)
  misc_feature (36): n=a or g
cctgtgctgaaagctcttcgcttgcttgccattcantatgagcattattcttttcactacatttcacaggc

SEQ ID NO: 1612 - DNA, 71 bp, chicken (Gallus Gallus)
  misc_feature (36): n=c or t
ccttattggagagatcagcaagactgacgtcagatnttaagcttgattgtaagaaatgatcttatattaaa

SEQ ID NO: 1613 - DNA, 71 bp, chicken (Gallus Gallus)
  misc_feature (36): n=c or t
ccttctcgagcaatgcggagccaagagcctcctctngcaacaggattttgcaggtcttggcccataggcaa

SEQ ID NO: 1614 - DNA, 71 bp, chicken (Gallus Gallus)
  misc_feature (36): n=a or c
ccttctgaaattattagcacatttcacttgatttanttttacacttttttgaccttaagcagctaagtttg

SEQ ID NO: 1615 - DNA, 71 bp, chicken (Gallus Gallus)
  misc_feature (36): n=a or g
cctttaactaataagtaacaaaaaatgaaagtcaantgttaaaatccttatgttccttttaaattgtatgt

SEQ ID NO: 1616 - DNA, 71 bp, chicken (Gallus Gallus)
  misc_feature (36): n=a or g
cctttaagctgtcataagtttgggagctgcaaagantagcagttttgtagtttgcttgcactttttatatt

SEQ ID NO: 1617 - DNA, 71 bp, chicken (Gallus Gallus)
  misc_feature (36): n=a or c
cctttgtgaatttcaacttactgtttaaatgggcanaatgcactagaacctgtgattctttaagaacatgt

SEQ ID NO: 1618 - DNA, 71 bp, chicken (Gallus Gallus)
  misc_feature (36): n=g or t
cgaacacaaaatcccagcagtttcactgcagttttntcttgtttgtgaaagcttataaaaagatgtaacaa

SEQ ID NO: 1619 - DNA, 71 bp, chicken (Gallus Gallus)
  misc_feature (36): n=a or c
cgaagtactgcttaataatttgcaggtgtgactttncagacttactttgtgattctacttctctacttccc

SEQ ID NO: 1620 - DNA, 71 bp, chicken (Gallus Gallus)
  misc_feature (36): n=g or t
cgacaagtcctttggttaccctttcttcagtggganctcctactggttataacaatgtttgcccgcctgac

SEQ ID NO: 1621 - DNA, 71 bp, chicken (Gallus Gallus)
  misc_feature (36): n=a or c
cggctgtgaactggctgtggactgatatattattcncgtttctgaatcatgtttacatcattcccaaagaa

SEQ ID NO: 1622 - DNA, 71 bp, chicken (Gallus Gallus)
  misc_feature (36): n=a or g
cggcttcaatcttctgcagagctactaaacgtatcnccaggtgtagaagtttcctagttgtttccctggct

SEQ ID NO: 1623 - DNA, 71 bp, chicken (Gallus Gallus)
  misc_feature (36): n=a or c
cggggagcttcctgggacttccacagtgttcatacnaattaattgcatgtgattttaattggaaaagtgca

SEQ ID NO: 1624 - DNA, 71 bp, chicken (Gallus Gallus)
  misc_feature (36): n=c or t
cgggtcctgcactgttttgctccaaggagcaagatntgctttctgatgaagggaaaagacacggtaccgtt

SEQ ID NO: 1625 - DNA, 71 bp, chicken (Gallus Gallus)
  misc_feature (36): n=c or t
cggtctttcacacggatgggtcagcgaggggcaacncttggttggctttcagtacttggcctatccactca

SEQ ID NO: 1626 - DNA, 71 bp, chicken (Gallus Gallus)
  misc_feature (36): n=a or g
cgtaattcaaattactgctgagtcagcagtaaggcnggttagctaaaagctagatgatgatttttattcat

SEQ ID NO: 1627 - DNA, 71 bp, chicken (Gallus Gallus)
  misc_feature (36): n=c or t
cgtattcaaacttgcataagtttctcagtaatgctntctttatgagtaacatctttgagggctgatacaag

SEQ ID NO: 1628 - DNA, 71 bp, chicken (Gallus Gallus)
  misc_feature (36): n=a or g
cgtttcacttgttaacagcaggctcagcaaaggggnaagagggagatctgccagatttgtgctttgagtcc

SEQ ID NO: 1629 - DNA, 71 bp, chicken (Gallus Gallus)
  misc_feature (36): n=a or g
cgtctgctcgcagccctgtgctcctgcccagccttncaacagcctcactcaaaaaacacgacgcagccaaa

SEQ ID NO: 1630 - DNA, 71 bp, chicken (Gallus Gallus)
  misc_feature (36): n=g or t
ctaaatgagcccagaaagtggtggtgaagagtcctnttgcatcagtgatgtagctgcatgtgtgtttggtt

SEQ ID NO: 1631 - DNA, 71 bp, chicken (Gallus Gallus)
  misc_feature (36): n=a or c
ctaagatttccaaactggaagaagcagctccccaantctgccagtccatctgtgtagcacttcttgttgag

SEQ ID NO: 1632 - DNA, 71 bp, chicken (Gallus Gallus)
  misc_feature (36): n=a or g
ctacaaagctgcaaattccctaagagattacgtttngcacttcattggcttatacggtcttgctccttgca

SEQ ID NO: 1633 - DNA, 71 bp, chicken (Gallus Gallus)
  misc_feature (36): n=a or g
ctacccatggaaagacatgtcagatttctgtgtatnaaaatcaatggaagggaccaccaacttactgtaga

SEQ ID NO: 1634 - DNA, 71 bp, chicken (Gallus Gallus)
  misc_feature (36): n=g or t
ctacctaaaatgcagcctctgcaattgtttctttgnctcccttcagcagttaaaaagcaacctatctgctt

SEQ ID NO: 1635 - DNA, 71 bp, chicken (Gallus Gallus)
  misc_feature (36): n=a or g
ctacttcactgcctttcctccataagtcatcacgtntttcttggccttgtttctcatcccaggaaggatca

SEQ ID NO: 1636 - DNA, 71 bp, chicken (Gallus Gallus)
  misc_feature (36): n=a or g
ctacttgatatgattaaaatcttccgtggcaacgcncatataatttttactataagaaatcacaagtttac

SEQ ID NO: 1637 - DNA, 71 bp, chicken (Gallus Gallus)
  misc_feature (36): n=a or g
ctagatgaaactaaaatggtggcattttaggccccntgataccctttgcttgttgaaagttgaaagagcag

SEQ ID NO: 1638 - DNA, 71 bp, chicken (Gallus Gallus)
  misc_feature (36): n=a or g
ctagctttaccacaccagactggttgatgggtgcantgttggaaggaaaatcagtgaaataatgcttttta

SEQ ID NO: 1639 - DNA, 71 bp, chicken (Gallus Gallus)
  misc_feature (36): n=a or c
ctagttgtcctcagattatttatttccaaaaataancattatgcccataacagctgtggaatcaatctcaa

SEQ ID NO: 1640 - DNA, 71 bp, chicken (Gallus Gallus)
  misc_feature (36): n=c or t
ctataatgtgcaataagtgacaaagaaaaagcagcncctacaaattattttaagaagagctgcatttctct

SEQ ID NO: 1641 - DNA, 71 bp, chicken (Gallus Gallus)
  misc_feature (36): n=c or t
ctatacacagaatttattcccacctccccacacttncttgcttcgcacacaatgggcaggaaaattgtacc

SEQ ID NO: 1642 - DNA, 71 bp, chicken (Gallus Gallus)
  misc_feature (36): n=c or t
cctatagcagaaagctggtgagctccctcacctccnattaaaacctgaatggcagcaaagtccttctgaag

SEQ ID NO: 1643 - DNA, 71 bp, chicken (Gallus Gallus)
  misc_feature (36): n=a or c
ctatgcaatatcttcttctctgagcagggtagcttnagcagcaaatatgtatttactgaagagaactttct

SEQ ID NO: 1644 - DNA, 71 bp, chicken (Gallus Gallus)
  misc_feature (36): n=a or g
ctatggctctgtcatttgccaagctgcttctgtacntggtccatggacttgtggaatgtaaagcaatgacg

SEQ ID NO: 1645 - DNA, 71 bp, chicken (Gallus Gallus)
  misc_feature (36): n=a or g
ctcaagctgctgcagcaacacgatagttttgtttcntctcagttttgctattttgcttttcctgttctact

SEQ ID NO: 1646 - DNA, 71 bp, chicken (Gallus Gallus)
  misc_feature (36): n=c or t
ctcacgtggcttacacccaaagtctgactgtttcangttttcaagtaagataaacctcagcatgacctatt

SEQ ID NO: 1647 - DNA, 71 bp, chicken (Gallus Gallus)
  misc_feature (36): n=a or g
ctcaccctttctcaccctcacctgctcaccctgcantgagcttccgaaggcaagcgatgtgacgaaaacat

SEQ ID NO: 1648 - DNA, 71 bp, chicken (Gallus Gallus)
  misc_feature (36): n=a or g
ctcacgtcccatgacctgatcacattactgaaggtntagcaaggatgggtactactaatagcttttatgaa

SEQ ID NO: 1649 - DNA, 71 bp, chicken (Gallus Gallus)
  misc_feature (36): n=c or t
ctcagctgtgattctgtgtgactgcacgactccctnggttcactctctgggtctttatctccgctttgcat

SEQ ID NO: 1650 - DNA, 71 bp, chicken (Gallus Gallus)
  misc_feature (36): n=c or t
ctcatttggatctgtccaactcctatttccagctantgaagctttttaaaactctctctgcttttagattt

SEQ ID NO: 1651 - DNA, 71 bp, chicken (Gallus Gallus)
  misc_feature (36): n=a or g
ctccccaagcagccctcagaggctgcaccactgccntcccacaaatgggtggagcagagaccaaagagctc

SEQ ID NO: 1652 - DNA, 71 bp, chicken (Gallus Gallus)
  misc_feature (36): n=g or t
ctcccccacaccaggggttgctcctctcattcacanttctaccatttggtgagcttagttaaagaacatca

SEQ ID NO: 1653 - DNA, 71 bp, chicken (Gallus Gallus)
  misc_feature (36): n=c or t
ctcctagatttcatgtgtataaagcctggtagatangttatgtcctatgtttgtgtaacgggcttcctgac

SEQ ID NO: 1654 - DNA, 71 bp, chicken (Gallus Gallus)
  misc_feature (36): n=a or g
ctcctctcgcacggagaaaacatcatgaggaaaacntgtgtgaaaataagaagctgctcgtttccctgtgg

SEQ ID NO: 1655 - DNA, 71 bp, chicken (Gallus Gallus)
  misc_feature (36): n=a or g
ctcgtttcatttccagttcaagtgattgctgggctntgcttttttctggatagctgtgcatgaagtgaagg

SEQ ID NO: 1656 - DNA, 71 bp, chicken (Gallus Gallus)
  misc_feature (36): n=c or t
ctctataggtagtttatgatagtctgtaaatgaatnttatcaacattttaaatatctgtaacacctatttt

SEQ ID NO: 1657 - DNA, 71 bp, chicken (Gallus Gallus)
  misc_feature (36): n=c or t
ctctattcactggtggaccttatgaggtggagtcangtaatattgttgttcttcataccgaaagacaagac

SEQ ID NO: 1658 - DNA, 71 bp, chicken (Gallus Gallus)
  misc_feature (36): n=a or c
ctctgaaaaaataaataaccagggagaaaagggagncattgctctttggttcagatgtggtctggcaagct

SEQ ID NO: 1659 - DNA, 71 bp, chicken (Gallus Gallus)
  misc_feature (36): n=c or t
ctctgacaggggtcacatttccttcctgcttgcaangagacaactgccttcccataacactgactccctct

SEQ ID NO: 1660 - DNA, 71 bp, chicken (Gallus Gallus)
  misc_feature (36): n=g or t
ctgaaaacgttcaaatctacagcagaggaagaatgncactttataatttatcttaccatcttcaaagaaaa

SEQ ID NO: 1661 - DNA, 71 bp, chicken (Gallus Gallus)
  misc_feature (36): n=a or g
ctgaaaatgggcaaccgaaacttcagagagagctcngcaccatgctatcatttatgatgatgtgtctgacg

SEQ ID NO: 1662 - DNA, 71 bp, chicken (Gallus Gallus)
  misc_feature (36): n=c or t
ctgagaagcaagggagggaaaggggaaagctcggangtaagattgaaaagaacatttccagtttcaaaacc

SEQ ID NO: 1663 - DNA, 71 bp, chicken (Gallus Gallus)
  misc_feature (36): n=a or g
ctgagagtcatagctaccatttcaaagggaaaatcnaatacttgcacaaaccagcacaactgctgctcctt

SEQ ID NO: 1664 - DNA, 71 bp, chicken (Gallus Gallus)
  misc_feature (36): n=c or t
ctgcacagctagttaattctagcatttacttttgantgatgcttaacaattccatgaagtttgccaacagt

SEQ ID NO: 1665 - DNA, 71 bp, chicken (Gallus Gallus)
  misc_feature (36): n=g or t
ctgcacctcccgcaggtaatgtctcatttgtttctngctaagccagctgggtttgcttggactcttcatgc

SEQ ID NO: 1666 - DNA, 71 bp, chicken (Gallus Gallus)
  misc_feature (36): n=c or t
ctgcccagaaacacactgagcaaagccatgtgttangaggagccactggaatgacttgaagcaagctgaga

SEQ ID NO: 1667 - DNA, 71 bp, chicken (Gallus Gallus)
  misc_feature (36): n=c or t
ctgctgagacttgcagaagttgggcagctgggaagnatctctgccagtcattcttccaaaggaactctgca

SEQ ID NO: 1668 - DNA, 71 bp, chicken (Gallus Gallus)
  misc_feature (36): n=c or t
ctgctgcggaagacagctgcaaaaagaccagcccgngtgcaaaatgtaaagacaagcagtagtgaatcact

SEQ ID NO: 1669 - DNA, 71 bp, chicken (Gallus Gallus)
  misc_feature (36): n=a or c
ctgctttactatttctgttatgaagcagctgaaggnctaacattaagtttgttctataaatttcctataat

SEQ ID NO: 1670 - DNA, 71 bp, chicken (Gallus Gallus)
  misc_feature (36): n=g or t
ctggagacaaaaaagttgtgcatagctgatgttgangtaattatatatatcaggcagaattgggtgaaatt

SEQ ID NO: 1671 - DNA, 71 bp, chicken (Gallus Gallus)
  misc_feature (36): n=a or g
ctggagtgaagaaatgaaatctttgcagtgttttcntacaagcgtcgctaagaacctcagagctccatcct

SEQ ID NO: 1672 - DNA, 71 bp, chicken (Gallus Gallus)
  misc_feature (36): n=c or t
ctggctgtttgcctccaagcctcctcctctgccatngctttcagtgatctgcctgaagagcttgctttaat

SEQ ID NO: 1673 - DNA, 71 bp, chicken (Gallus Gallus)
  misc_feature (36): n=a or g
ctggttctttttgttctgtggttttatgttctgacnttttcatcctattcatagtggatactacagattct

SEQ ID NO: 1674 - DNA, 71 bp, chicken (Gallus Gallus)
  misc_feature (36): n=a or g
ctgtaacgtgaaaagaacagcgatgagctcaggttngcaaataaagcccttcacccctacctgtctgcaag

SEQ ID NO: 1675 - DNA, 71 bp, chicken (Gallus Gallus)
  misc_feature (36): n=a or g
ctgtactgctttaaggctctttactgctcagcagtngagtgacttctgggaaatcacgatgagaccacata

SEQ ID NO: 1676 - DNA, 71 bp, chicken (Gallus Gallus)
  misc_feature (36): n=c or t
ctgtagccatcaccagctcgctatattgatctcgtngtacagcaccaagcaccattattacaaacagtcag

SEQ ID NO: 1677 - DNA, 71 bp, chicken (Gallus Gallus)
  misc_feature (36): n=a or c
ctgtgctattcccgtattcattctttgatgtaaggncttgtgactaatctgaactgaagctggacacattt

SEQ ID NO: 1678 - DNA, 71 bp, chicken (Gallus Gallus)
  misc_feature (36): n=g or t
ctgtttaatgaagcaaacaactgggaaaggactttnttcttgcagcttcttatccattctttaaaaccaca

SEQ ID NO: 1679 - DNA, 71 bp, chicken (Gallus Gallus)
  misc_feature (36): n=a or g
cttaaaatccttcagagtcacttcccctaacctgcnaaaagaatccaacactattccatagtacactggac

SEQ ID NO: 1680 - DNA, 71 bp, chicken (Gallus Gallus)
  misc_feature (36): n=c or t
cttaagcagtattccccaggatttattaactcagangaaaagtatagcttctaaacagaccagagcttcag

SEQ ID NO: 1681 - DNA, 71 bp, chicken (Gallus Gallus)
  misc_feature (36): n=a or g
cttaaggcaaaaacaattcacataatgcaaacaatnggaagtatacaattaaaggagctatttatgcttct

SEQ ID NO: 1682 - DNA, 71 bp, chicken (Gallus Gallus)
  misc_feature (36): n=a or g
cttaatgcaagttagcagttttctctacaggcttcntacagagcttcaagaactttctgggagctgcagta

SEQ ID NO: 1683 - DNA, 71 bp, chicken (Gallus Gallus)
  misc_feature (36): n=c or t
cttaatgttcaaatcttccaggctgctatagagctnagtcaactatattattttcctctgttgaacttcag

SEQ ID NO: 1684 - DNA, 71 bp, chicken (Gallus Gallus)
  misc_feature (36): n=c or t
cttaattcagaaggcaaagcttgccttcttatctgnacgtgttctgctgcactggtgtctttttgcagaag

SEQ ID NO: 1685 - DNA, 71 bp, chicken (Gallus Gallus)
  misc_feature (36): n=a or g
cttatagctttcagggggaagtctgattccatgcanaattaatcccttatcaccagcactcacatttagaa

SEQ ID NO: 1686 - DNA, 71 bp, chicken (Gallus Gallus)
  misc_feature (36): n=c or t
cttatctgcataacattgtggtttgcctgctctgtngatttcagtgggactcttcatacgccttaagttct

SEQ ID NO: 1687 - DNA, 71 bp, chicken (Gallus Gallus)
  misc_feature (36): n=a or g
cttcaactgaacagggattttctgtctgaacacaanaagtaaatgctccactcagacgaaaacaactgcga

SEQ ID NO: 1688 - DNA, 71 bp, chicken (Gallus Gallus)
  misc_feature (36): n=c or t
cttcaccacctcgggtgcagatatcgctgcagatcnctcttttcttggaaatttccccttcccgtgcaacc

SEQ ID NO: 1689 - DNA, 71 bp, chicken (Gallus Gallus)
  misc_feature (36): n=c or t
cttcagctacctgcagaagcctgagctgggaaacangtgcaaacagagtcctcacggatgagaatttggga

SEQ ID NO: 1690 - DNA, 71 bp, chicken (Gallus Gallus)
  misc_feature (36): n=a or g
cttccatctgtttgggctgatgagagatgtactatntgtgcaacaatttctggtaacaatgccagcgtcat

SEQ ID NO: 1691 - DNA, 71 bp, chicken (Gallus Gallus)
  misc_feature (36): n=a or g
cttccattctgtactgctgtgctttcatgtcttganggtaatagtagcagcactttctctttatctacttg

SEQ ID NO: 1692 - DNA, 71 bp, chicken (Gallus Gallus)
  misc_feature (36): n=c or t
cttccttttaaaacagtattttacatactaacattntgtactctctactgtccttttctactcacttctct

SEQ ID NO: 1693 - DNA, 71 bp, chicken (Gallus Gallus)
  misc_feature (36): n=a or g
cttctgcaggctgcccactgaagaaataatgtatcntatacagtatatatgaaaaacaggtttaagaacat

SEQ ID NO: 1694 - DNA, 71 bp, chicken (Gallus Gallus)
  misc_feature (36): n=c or t
cttgagcctgcctatcagctcctaaattcaggcttngctttcccatgcaaccaccaacttgctcttggaca

SEQ ID NO: 1695 - DNA, 71 bp, chicken (Gallus Gallus)
  misc_feature (36): n=a or g
cttgcaatgaaaattacattttactctacaattaantgaccacagtttaggtgctacagatatcccaggtt

SEQ ID NO: 1696 - DNA, 71 bp, chicken (Gallus Gallus)
  misc_feature (36): n=a or g
ctttagcttagatttctgcaacagaagaagagcaantatttaatagatgggaaaaggctggattcgtgtca

SEQ ID NO: 1697 - DNA, 71 bp, chicken (Gallus Gallus)
  misc_feature (36): n=a or g
ctttccagggaaagtatttcagcctgtgactgcagnacaaatagagctgtgcgtagtcctgtaccaatgca

SEQ ID NO: 1698 - DNA, 71 bp, chicken (Gallus Gallus)
  misc_feature (36): n=c or t
ctttccatatggccatcctttttctcatttttaatnattgtttttacccctcattctagtgcagcttcagt

SEQ ID NO: 1699 - DNA, 71 bp, chicken (Gallus Gallus)
  misc_feature (36): n=c or t
ctttgtttataactagtcttcaagcgtaactttttnccccctctatatttatgataagcaatctgttgtcc

SEQ ID NO: 1700 - DNA, 71 bp, chicken (Gallus Gallus)
  misc_feature (36): n=a or c
cttttaaaacatttttatgtttacatctttctttgnctttaacaacttaattccttgtcttgaggaacttt

SEQ ID NO: 1701 - DNA, 71 bp, chicken (Gallus Gallus)
  misc_feature (36): n=c or t
cttttctgcctgtgttccagtgtagctctttccatngctcttcttgaccacaaagcaagaagctttctgtc

SEQ ID NO: 1702 - DNA, 71 bp, chicken (Gallus Gallus)
  misc_feature (36): n=c or t
cttttgatctggaagcaagaacaacttagctatgcnttacagatagcttctactaattttttggccataat

SEQ ID NO: 1703 - DNA, 71 bp, chicken (Gallus Gallus)
  misc_feature (36): n=a or c
ctttttgtgggtcaaagaaaaactagagctgtgtantctaagatatgccagtatcaatgttccatacgtaa

SEQ ID NO: 1704 - DNA, 71 bp, chicken (Gallus Gallus)
  misc_feature (36): n=c or t
cttttttactagctgtaccacataaagttggtgtgntttgttttattttatgagatcatgtaatgtgtaac

SEQ ID NO: 1705 - DNA, 71 bp, chicken (Gallus Gallus)
  misc_feature (36): n=a or g
cttttttggaggccttcagcatctcaaggagagagntgtgtggcttcactactcctcttgtctgcttaact

SEQ ID NO: 1706 - DNA, 71 bp, chicken (Gallus Gallus)
  misc_feature (36): n=c or t
gaaaacatgctcagctgctcactgacactggaatcnctcagttctgatgcttcatcaaagggatttgtgaa

SEQ ID NO: 1707 - DNA, 71 bp, chicken (Gallus Gallus)
  misc_feature (36): n=a or g
gaaaagaatctgagagcaacagtgcaaaactctttngaacgtttcaggtaaagggcgtttcattggatatt

SEQ ID NO: 1708 - DNA, 71 bp, chicken (Gallus Gallus)
  misc_feature (36): n=a or c
gaaaatatttttcctcacttccgctcaagaaaatgntggaaaataaactacagtgtatggctggtttacag

SEQ ID NO: 1709 - DNA, 71 bp, chicken (Gallus Gallus)
  misc_feature (36): n=c or t
gaaactacctgcatggacagtaaagtgatgatttgntagaaagctgtttttatctgtagcctaaacgtata

SEQ ID NO: 1710 - DNA, 71 bp, chicken (Gallus Gallus)
  misc_feature (36): n=a or g
gaaactctatgtaaaaatccagcttcttaaatacgntacattcacttcctcacagaatatttaaatattca

SEQ ID NO: 1711 - DNA, 71 bp, chicken (Gallus Gallus)
  misc_feature (36): n=a or g
gaaagatctcagaaaactgacagggtgaatgaaggnagttcaatgccatttagtccaaagtaatggaaaca

SEQ ID NO: 1712 - DNA, 71 bp, chicken (Gallus Gallus)
  misc_feature (36): n=g or t
gaaattatatatcaaccaattaattatttatttttngcaataagaaaacccattttctttattaaaagcta

SEQ ID NO: 1713 - DNA, 71 bp, chicken (Gallus Gallus)
  misc_feature (36): n=g or t
gaacagctatcatacagtatgaaaatgctgcctganatacctggacgacacgttccatgcagaaatatgtg

SEQ ID NO: 1714 - DNA, 71 bp, chicken (Gallus Gallus)
  misc_feature (36): n=a or g
gaacatatgacttgtgacttaccatgtaaagcttcntaagattgctgtgtggttagatgcaaactgcatgc

SEQ ID NO: 1715 - DNA, 71 bp, chicken (Gallus Gallus)
  misc_feature (36): n=a or c
gaacatcaaaataagagcttgggatttaattaaatngttgaaatttggctttgagaggaatacacttgttt

SEQ ID NO: 1716 - DNA, 71 bp, chicken (Gallus Gallus)
  misc_feature (36): n=a or g
gaacatggggacacccagactcaagcagtgtctganttattgccttacagtaaaagcagggatgggatgga

SEQ ID NO: 1717 - DNA, 71 bp, chicken (Gallus Gallus)
  misc_feature (36): n=a or c
gaacccatctgcagcgggtcttcttagcttgctccncactcaggtggtcattcatcatcctgtgtgatact

SEQ ID NO: 1718 - DNA, 71 bp, chicken (Gallus Gallus)
  misc_feature (36): n=c or t
gaacgactctaacttaactgattaggttttcatacncctaaacttgagagtctggaaaaactagatcttcc

SEQ ID NO: 1719 - DNA, 71 bp, chicken (Gallus Gallus)
  misc_feature (36): n=a or g
gaacgttccccagggctctacaagacagagtgaacnatttccagcagcttcagtgggcttgtttcatcttt

SEQ ID NO: 1720 - DNA, 71 bp, chicken (Gallus Gallus)
  misc_feature (36): n=a or g
gaagaaggagcagaagggtcccacgggactactcangcattttttggcctttcccttaccaaaatcgtggg

SEQ ID NO: 1721 - DNA, 71 bp, chicken (Gallus Gallus)
  misc_feature (36): n=a or g
tgaagatgatgaggatgatgatgaggatgagagcantagtgagagctcatcagagagcgaggagagctctg

SEQ ID NO: 1722 - DNA, 71 bp, chicken (Gallus Gallus)
  misc_feature (36): n=c or t
gaagcagcatctaacaatggcattcttttcctggantgctggaaaagctggcctcattgaaaaggatgtga

SEQ ID NO: 1723 - DNA, 71 bp, chicken (Gallus Gallus)
  misc_feature (36): n=a or g
gaagcagctgaacatctgcctgccaatgggaagtangggcttaattccttctcacgctttgcttgtacatg

SEQ ID NO: 1724 - DNA, 71 bp, chicken (Gallus Gallus)
  misc_feature (36): n=a or g
gaaggtatctagggatcaccaagtccaaactccctnataaagaaggttccctacagtatataaaagtgtca

SEQ ID NO: 1725 - DNA, 71 bp, chicken (Gallus Gallus)
  misc_feature (36): n=a or c
gaagtgagaaaagctttgtgtaccatttgcagtgtntgtcattgcatctacaaagcctggattgagtctac

SEQ ID NO: 1726 - DNA, 71 bp, chicken (Gallus Gallus)
  misc_feature (36): n=a or g
gaagttattcaaattttagtataagtgttttcctantacttgagttgactggccatcagaaggtatagctg

SEQ ID NO: 1727 - DNA, 71 bp, chicken (Gallus Gallus)
  misc_feature (36): n=a or g
gaatacagggaaaatatccagcctcagtgtagcacntttcaaacttttgaaataaagtggaatattttgaa

SEQ ID NO: 1728 - DNA, 71 bp, chicken (Gallus Gallus)
  misc_feature (36): n=g or t
gaataggttgctgttgtaccatggacacctgaagtnaagtgatgtaactgagcagagggttactggcaata

SEQ ID NO: 1729 - DNA, 71 bp, chicken (Gallus Gallus)
  misc_feature (36): n=g or t
gaatatttattttactaccaataaaaatgaagaaangtatgtaaccaatctgtacggagaattttaattca

SEQ ID NO: 1730 - DNA, 71 bp, chicken (Gallus Gallus)
  misc_feature (36): n=a or g
gaatcctgccctcttctcctcttcttttgcagtacntgagctctgtctttggtgcaaaaatatttcccttc

SEQ ID NO: 1731 - DNA, 71 bp, chicken (Gallus Gallus)
  misc_feature (36): n=c or t
gaatggctgtttactgctgcagtcagtgcgaattgngtacttcgttttacctcgtgaggatctgtaacaca

SEQ ID NO: 1732 - DNA, 71 bp, chicken (Gallus Gallus)
  misc_feature (36): n=a or g
gaattaaacagattccaaatgtgggtgcaggacagnaattctttggacatgtaggcagaacccctcctcct

SEQ ID NO: 1733 - DNA, 71 bp, chicken (Gallus Gallus)
  misc_feature (36): n=c or t
gaattgaataaggctgctggttctcctggccttggnaatgtagtcagctctggctcatcatttcttacaaa

SEQ ID NO: 1734 - DNA, 71 bp, chicken (Gallus Gallus)
  misc_feature (36): n=a or g
gaattgctccacactttttgcagaagccaacaccanttcagctttcccattaaagacagctcctgccttca

SEQ ID NO: 1735 - DNA, 71 bp, chicken (Gallus Gallus)
  misc_feature (36): n=a or g
gacaaagcaaggctcttcactgcgccgctcttaacnggctcggtacacagataccccatgatgtaacttat

SEQ ID NO: 1736 - DNA, 71 bp, chicken (Gallus Gallus)
  misc_feature (36): n=c or t
gacagtctgaaatccccaaggcctgcatctcttctnctgcctgccaaagtagaagcttcaccaaacactgc

SEQ ID NO: 1737 - DNA, 71 bp, chicken (Gallus Gallus)
  misc_feature (36): n=a or g
gacatgtgtttttggactaagtagcctgctgtagantaaaacaagctttatatgttgaggatggctgatgg

SEQ ID NO: 1738 - DNA, 71 bp, chicken (Gallus Gallus)
  misc_feature (36): n=c or t
gactaaacaaggccggcttcctcagcctttccacantgggctgcatgctctgagttcctaacagttctggt

SEQ ID NO: 1739 - DNA, 71 bp, chicken (Gallus Gallus)
  misc_feature (36): n=c or t
gactacctgtttctctaagatggcagataaaacagntgagaagagctctgtatttcttttgttcgtgtcaa

SEQ ID NO: 1740 - DNA, 71 bp, chicken (Gallus Gallus)
  misc_feature (36): n=c or t
gactcaaaagctgcgtaagctccaacagagagcggnaactgcttcagtgtacagagactgacaacatatat

SEQ ID NO: 1741 - DNA, 71 bp, chicken (Gallus Gallus)
  misc_feature (36): n=c or t
gactcttaggtgctgctttgctcctcgctcaatgtntttcctgattagtggtcactgtggagcttttaaaa

SEQ ID NO: 1742 - DNA, 71 bp, chicken (Gallus Gallus)
  misc_feature (36): n=a or c
gactgctaacctcttctcccgttctgtaggctgganacataaagcttattctgctatttcaaaggctgcac

SEQ ID NO: 1743 - DNA, 71 bp, chicken (Gallus Gallus)
  misc_feature (36): n=a or g
gagaagggtcgcactgcacagtcaatcgtgtctgcntgtgctgagctgaatgagtggcaagtctttatttc

SEQ ID NO: 1744 - DNA, 71 bp, chicken (Gallus Gallus)
  misc_feature (36): n=g or t
gagacctgcagcaaaagcagaaaggctgcttttacngattgattcagctaattcaagtgtctggaatgtgt

SEQ ID NO: 1745 - DNA, 71 bp, chicken (Gallus Gallus)
  misc_feature (36): n=a or g
gagactgagacgagaggatgaagcacaagacctgcntgagttcaatatattttgaactctccaatgtctca

SEQ ID NO: 1746 - DNA, 71 bp, chicken (Gallus Gallus)
  misc_feature (36): n=c or t
gagagggatttagtatctgacatttgcatcttcttnggagactcagatgcatggtcataggaatgcagctt

SEQ ID NO: 1747 - DNA, 71 bp, chicken (Gallus Gallus)
  misc_feature (36): n=c or t
gagatggctcagtgttattattgcagcgtcataacnaagctgatagatttgaggctcctttctttgccttc

SEQ ID NO: 1748 - DNA, 71 bp, chicken (Gallus Gallus)
  misc_feature (36): n=c or t
gagcaagtctgcttgttttatttcattgtcctttgngaataaaaagggaatgatttttgatattatgctta

SEQ ID NO: 1749 - DNA, 71 bp, chicken (Gallus Gallus)
  misc_feature (36): n=a or g
gagcagaaatgcattcaggagttcctggcctggggntcacgtgccagcagttcctaggaaataaaccaatt

SEQ ID NO: 1750 - DNA, 71 bp, chicken (Gallus Gallus)
  misc_feature (36): n=a or g
gagcagtaaatagtcctgcatctgctgcttctactnccagtgcattagaaagaaataaggtaggaagctac

SEQ ID NO: 1751 - DNA, 71 bp, chicken (Gallus Gallus)
  misc_feature (36): n=a or g
gagcctggaacacttaatcctctcctttcaccatcngctgcaggtaagccagcaaatcaagaactgcatga

SEQ ID NO: 1752 - DNA, 71 bp, chicken (Gallus Gallus)
  misc_feature (36): n=c or t
gagctgaagttactgcagctcaggttttgtttaagnactccttactcccactgcatcaccataattactgt

SEQ ID NO: 1753 - DNA, 71 bp, chicken (Gallus Gallus)
  misc_feature (36): n=c or t
gagctgcccgctggataaacagcactttcaaaactncaggctctgtcagctactattcatgtcttgcttct

SEQ ID NO: 1754 - DNA, 71 bp, chicken (Gallus Gallus)
  misc_feature (36): n=a or g
gagctgttgaaaggaaggtgtaggaaatgaggtggnagaaaccattctccagaggagctccaggtccttca

SEQ ID NO: 1755 - DNA, 71 bp, chicken (Gallus Gallus)
  misc_feature (36): n=a or g
gaggcagctgtcagtggggcagcccagctgggtctngatgacagtacttctggtcagaactgtggtccatc

SEQ ID NO: 1756 - DNA, 71 bp, chicken (Gallus Gallus)
  misc_feature (36): n=a or g
gaggcccatggaaacctcttgctggtagctatgtangcccagagtattagtataaacgttttcatatgtaa

SEQ ID NO: 1757 - DNA, 71 bp, chicken (Gallus Gallus)
  misc_feature (36): n=c or t
gagggtctcttcagcatgatcctaaaagtgccattncacagaagggtattcagggtttgtgtgtgaccctc

SEQ ID NO: 1758 - DNA, 71 bp, chicken (Gallus Gallus)
  misc_feature (36): n=a or g
gaggtgaaatagctgggcacccctgggcagtgaacnaagcagcctctttgtgttgccagtgctccagtcac

SEQ ID NO: 1759 - DNA, 71 bp, chicken (Gallus Gallus)
  misc_feature (36): n=a or g
gaggtttgttttcaatcacgacttgcgttggatgcntttttctgcctggtggttcagctgtgatcataaac

SEQ ID NO: 1760 - DNA, 71 bp, chicken (Gallus Gallus)
  misc_feature (36): n=c or t
gagtcactgtgatttcatcggatgttgcaggtgctngaacacctccgctcaatatcctatcactgtgattg

SEQ ID NO: 1761 - DNA, 71 bp, chicken (Gallus Gallus)
  misc_feature (36): n=a or g
gagtcccagatagcttaacattgaacttcaccatcntatgttcaatctttacatttacaaattagaaggca

SEQ ID NO: 1762 - DNA, 71 bp, chicken (Gallus Gallus)
  misc_feature (36): n=c or t
gagtctggctgctgcatcagctgtctttaattgcanggatgtctagtttgaaaatggagaaggtttgcaca

SEQ ID NO: 1763 - DNA, 71 bp, chicken (Gallus Gallus)
  misc_feature (36): n=c or t
gagttagaaggaaatcccaacggtttcttggagatnatgccaaacttttattatattatatcactgcattc

SEQ ID NO: 1764 - DNA, 71 bp, chicken (Gallus Gallus)
  misc_feature (36): n=c or t
gagttcccagcctagctcctctctgcttctctgctncagggactggctgtctccttgtttccttctccctg

SEQ ID NO: 1765 - DNA, 71 bp, chicken (Gallus Gallus)
  misc_feature (36): n=c or t
gataaaccaagtcctcctcagggtggaaaaaggagnaaattataaactacgaaaatgcgaacaattttgaa

SEQ ID NO: 1766 - DNA, 71 bp, chicken (Gallus Gallus)
  misc_feature (36): n=a or g
gataaatcatgagtttaggttagtttaaacagatgntttgcaagatagtttccaataatatacataacatt

SEQ ID NO: 1767 - DNA, 71 bp, chicken (Gallus Gallus)
  misc_feature (36): n=a or g
gataatagctgattttctctgtgatgatttgcatangaagttaaatgagaagaatagtattgcccagtaat

SEQ ID NO: 1768 - DNA, 71 bp, chicken (Gallus Gallus)
  misc_feature (36): n=g or t
gatagtggttttctttaaatattacattaattcatnaagcatagagaaattcataggtcactgtggaaagc

SEQ ID NO: 1769 - DNA, 71 bp, chicken (Gallus Gallus)
  misc_feature (36): n=c or t
gatattccggttcagacgtgggtgtgatggtaaatntcaagtcctgaaatttccatcccgtgataaagcgg

SEQ ID NO: 1770 - DNA, 71 bp, chicken (Gallus Gallus)
  misc_feature (36): n=c or t
gatcacctcccttggcatactggctgcactgctttngatgcagcccaaattctagtggtgcattacagaat

SEQ ID NO: 1771 - DNA, 71 bp, chicken (Gallus Gallus)
  misc_feature (36): n=c or t
gatcagattgcgttgcagatgagtctgactaatacntttgcatgcaatagtttacagccttggtaaatggt

SEQ ID NO: 1772 - DNA, 71 bp, chicken (Gallus Gallus)
  misc_feature (36): n=c or t
gatgagctagacaatttttgtgggaagtggtaatancttttatgagatcatctactacttttgcattcagt

SEQ ID NO: 1773 - DNA, 71 bp, chicken (Gallus Gallus)
  misc_feature (36): n=c or t
gatgatacaaaatactgctctcaaccctcagcttcngatatgccccagtcaaaaagatttttcttttgctc

SEQ ID NO: 1774 - DNA, 71 bp, chicken (Gallus Gallus)
  misc_feature (36): n=a or g
gatgcaacaagctcaattatgttataaacaggaggnaaaccttcctggccaaagagcagtagaatgggtat

SEQ ID NO: 1775 - DNA, 71 bp, chicken (Gallus Gallus)
  misc_feature (36): n=a or g
gatgcactgtaaagtcagtggggctctagctaagcntgctaagcatgtttacttctctgaagggcacactc

SEQ ID NO: 1776 - DNA, 71 bp, chicken (Gallus Gallus)
  misc_feature (36): n=a or g
gatgtcaggcagtcccaggtgtgggctgggaaatcngcccctaaatgctgctcctctggattttttactgt

SEQ ID NO: 1777 - DNA, 71 bp, chicken (Gallus Gallus)
  misc_feature (36): n=c or t
gatgtgagaagctgtttctctatgatgtgctcttgnttgtttaaacaggaggatgggagagccacagaacc

SEQ ID NO: 1778 - DNA, 71 bp, chicken (Gallus Gallus)
  misc_feature (36): n=a or c
gattgctctgtggtgaagggcctcataggtcacagncacagcaagaagcttgagaccagaaagcggatgaa

SEQ ID NO: 1779 - DNA, 71 bp, chicken (Gallus Gallus)
  misc_feature (36): n=c or t
gattgtgtgtgtttttcccttatttccacaaggaanattgcttctctgacaatattttatctgtagtcaac

SEQ ID NO: 1780 - DNA, 71 bp, chicken (Gallus Gallus)
  misc_feature (36): n=a or g
gattgttttaaaggacaactgtagctagttatattngtttactatcagaatttgtcctgttgtctaagtgc

SEQ ID NO: 1781 - DNA, 71 bp, chicken (Gallus Gallus)
  misc_feature (36): n=a or c
gcaaaaaccacagcatagttgagaggggaaaagggnagacttcacagtgattagctgagatttggacggtg

SEQ ID NO: 1782 - DNA, 71 bp, chicken (Gallus Gallus)
  misc_feature (36): n=c or t
gcaaaagttggttgtaagaggatgcctatgactaangtaagagctaaaagcctcccacgctagatttcctt

SEQ ID NO: 1783 - DNA, 71 bp, chicken (Gallus Gallus)
  misc_feature (36): n=c or t
gcaaccgtccctaaatttaatgaaaagtaaacatangaagcaagatctaaaaagtttattagttatcggag

SEQ ID NO: 1784 - DNA, 71 bp, chicken (Gallus Gallus)
  misc_feature (36): n=c or t
gcaatgcatctgaccagggtggggtcaccttggcanatctttagacaacaaattctctagagctttcaatc

SEQ ID NO: 1785 - DNA, 71 bp, chicken (Gallus Gallus)
  misc_feature (36): n=c or t
gcacagttagagcacctcagccctgtgcagagtggngggtgctatttctaatagttcaggctcaagatcct

SEQ ID NO: 1786 - DNA, 71 bp, chicken (Gallus Gallus)
  misc_feature (36): n=c or t
gcacccacctgccccacatttttgctcctcctgcantgtattaagcacatcctgcctcctaggccagagcc

SEQ ID NO: 1787 - DNA, 71 bp, chicken (Gallus Gallus)
  misc_feature (36): n=c or t
gcacgcagctcctgcatcttccaacccatttgcagnaggacgcttggctgcattttgcattttgaagcact

SEQ ID NO: 1788 - DNA, 71 bp, chicken (Gallus Gallus)
  misc_feature (36): n=a or g
gcagaaatggaggggtaggtgagtgaaggagccagngcttgaagctgtgggtttacaatgaatagagcaac

SEQ ID NO: 1789 - DNA, 71 bp, chicken (Gallus Gallus)
  misc_feature (36): n=g or t
gcagaattttaatctaatatgcataaatgttatatntatttgtaatgtaactattgttaccaaagccgcta

SEQ ID NO: 1790 - DNA, 71 bp, chicken (Gallus Gallus)
  misc_feature (36): n=c or t
gcagagcatgtgtcaatgtcccattgatgggggtantgaataacagcattactgaatggttcctgaagatg

SEQ ID NO: 1791 - DNA, 71 bp, chicken (Gallus Gallus)
  misc_feature (36): n=c or t
gcagatacagcacaaagatggtgtgttcttgtgttntgcagtttaagtatagctactaaaacatcttccag

SEQ ID NO: 1792 - DNA, 71 bp, chicken (Gallus Gallus)
  misc_feature (36): n=c or t
gcagcagctgaggaaggctgtagcgggatgcaacanctctagtcagaaactcattacagtgagtaatgctg

SEQ ID NO: 1793 - DNA, 71 bp, chicken (Gallus Gallus)
  misc_feature (36): n=c or t
gcagcgaagcagaggaggaagcaggcaattccccgncatctgaaagctcgctttctaaatcaaatcaattt

SEQ ID NO: 1794 - DNA, 71 bp, chicken (Gallus Gallus)
  misc_feature (36): n=c or t
gcagcttcccattggcacgcagtcaccattcccttncaaaccgctacctcacaacagaaagactgaatgcc

SEQ ID NO: 1795 - DNA, 71 bp, chicken (Gallus Gallus)
  misc_feature (36): n=c or t
gcaggctactcaggtctagaatataaatggattagngtcctggtttgtccttgcaagaagataaacagctg

SEQ ID NO: 1796 - DNA, 71 bp, chicken (Gallus Gallus)
  misc_feature (36): n=a or g
gcagttgcccatatacagtcttaaggtctcactcantagctgaatactttccaaattagatgttacagttt

SEQ ID NO: 1797 - DNA, 71 bp, chicken (Gallus Gallus)
  misc_feature (36): n=c or t
gcataagttcagagctgagatctgagacaaccattntatcccagatcttctgcaagagtcacattgtaagt

SEQ ID NO: 1798 - DNA, 71 bp, chicken (Gallus Gallus)
  misc_feature (36): n=a or g
gcatcacacaaagagctggaattttcagagcctttnattaagaagaaacttacttgggtagatgtagtagc

SEQ ID NO: 1799 - DNA, 71 bp, chicken (Gallus Gallus)
  misc_feature (36): n=c or t
gcatggccctccagaggagatgagcacatcaggagngttgccaccagttcagatgttctcccaaagctatg

SEQ ID NO: 1800 - DNA, 71 bp, chicken (Gallus Gallus)
  misc_feature (36): n=c or t
gccaacctggtcttctccagctcctgtcttgctctngagtctcctctacttaaacctgctgttgtggagaa

SEQ ID NO: 1801 - DNA, 71 bp, chicken (Gallus Gallus)
  misc_feature (36): n=a or g
gccatcctggtctgatacagccccttctgtgctctnatacaaggatttcaggtgggtaccccagctccctg

SEQ ID NO: 1802 - DNA, 71 bp, chicken (Gallus Gallus)
  misc_feature (36): n=a or g
gccctgttggaatgtgaaaagccgaagtaggacacnctctgtttttaattcatttcattagttacaaacaa

SEQ ID NO: 1803 - DNA, 71 bp, chicken (Gallus Gallus)
  misc_feature (36): n=c or t
gcctggcttgctgttcaccttcacacaagcaattanaatggcttaaagctgagactagaaaaagaagagag

SEQ ID NO: 1804 - DNA, 71 bp, chicken (Gallus Gallus)
  misc_feature (36): n=a or g
gcctttgcagctcatcccttctcgtacaaaactganatattctatttatattaaaaactgcaactccgttg

SEQ ID NO: 1805 - DNA, 71 bp, chicken (Gallus Gallus)
  misc_feature (36): n=c or t
gcggcacccataaattttggcctttcagaaaagccnacatattgtgaaggtatcacccaaagccctcatta

SEQ ID NO: 1806 - DNA, 71 bp, chicken (Gallus Gallus)
  misc_feature (36): n=g or t
gcgtcccttccaacccaaggcatcctatgattctangatactatgatttggtagtgaagttaccttccata

SEQ ID NO: 1807 - DNA, 71 bp, chicken (Gallus Gallus)
  misc_feature (36): n=a or g
gctaagctgccccctgtgaccccatacacttatacncatcctttcatctcagtgctataacacaatagccc

SEQ ID NO: 1808 - DNA, 71 bp, chicken (Gallus Gallus)
  misc_feature (36): n=c or t
gctagatgacctttaaggtccctttcaaactaagcnatcctataattctttggtttatggaaattgatctc

SEQ ID NO: 1809 - DNA, 71 bp, chicken (Gallus Gallus)
  misc_feature (36): n=c or t
gctaggaatagacttctatggcctatgtaatctaanaagtcaaagtgcatgatctaatagccctcggttac

SEQ ID NO: 1810 - DNA, 71 bp, chicken (Gallus Gallus)
  misc_feature (36): n=a or g
gctataactgaagctaaatcttttgtaacccctcanagtccagccacacatctcccttatccaaagatgga

SEQ ID NO: 1811 - DNA, 71 bp, chicken (Gallus Gallus)
  misc_feature (36): n=c or t
gctcacctcacatcagcctgaagagcccacagagtngctgccctgctctgaagttaggcaaacctacattg

SEQ ID NO: 1812 - DNA, 71 bp, chicken (Gallus Gallus)
  misc_feature (36): n=c or t
gctcagctttctggcatgaacccttttctccccgcncttctctgctctgctccgtattttttcaagcctca

SEQ ID NO: 1813 - DNA, 71 bp, chicken (Gallus Gallus)
  misc_feature (36): n=c or t
gctcattatcaggtaaattttttagtaaaattcagntctagctacagaagttctgtaattatctgtatttt

SEQ ID NO: 1814 - DNA, 71 bp, chicken (Gallus Gallus)
  misc_feature (36): n=c or t
gctccaaaactcagccccaggactgggaacgcttangggactgggaatgattagagctcatttgatgaccc

SEQ ID NO: 1815 - DNA, 71 bp, chicken (Gallus Gallus)
  misc_feature (36): n=c or t
gctcctagaacatgtggtcattcagggggaggtttntggatccctgctgagattttacaacttcagtcaat

SEQ ID NO: 1816 - DNA, 71 bp, chicken (Gallus Gallus)
  misc_feature (36): n=a or g
gctcgtgtgtttattcccacagttcttgttgtaggngattaaacctgtgtctggcgtaggagctgggactg

SEQ ID NO: 1817 - DNA, 71 bp, chicken (Gallus Gallus)
  misc_feature (36): n=a or g
gctgaagatgaccccaattaaacaactccatagcancactattctatttaaacaatcttgagaagtctcag

SEQ ID NO: 1818 - DNA, 71 bp, chicken (Gallus Gallus)
  misc_feature (36): n=c or t
gctgaagggcaggcagggaatgggtgcctgagcagngtgcaatatttgatgttgactttgggaggagggca

SEQ ID NO: 1819 - DNA, 71 bp, chicken (Gallus Gallus)
  misc_feature (36): n=c or t
gctgcgttcctgtcttaaacacattgctctggtcanatagtggagttttgttacagaatgagttttgaaca

SEQ ID NO: 1820 - DNA, 71 bp, chicken (Gallus Gallus)
  misc_feature (36): n=g or t
gctggtagcattctgagtgatcattagcaagagaanttggagcttctagagctcccagagtaaatgatttc

SEQ ID NO: 1821 - DNA, 71 bp, chicken (Gallus Gallus)
  misc_feature (36): n=c or t
gctggtttagcactggtgtggctgactgaggaaagngtgaatgacaaatctggtctgtggagatctagctt

SEQ ID NO: 1822 - DNA, 71 bp, chicken (Gallus Gallus)
  misc_feature (36): n=c or t
gctgtaatttactcgacacacatcgcctgcctcccngtaggtttcaaacctataataatggaccacttgcg

SEQ ID NO: 1823 - DNA, 71 bp, chicken (Gallus Gallus)
  misc_feature (36): n=c or t
gctgtctccaaaacctaaaggctggaaatacattgntttctgttagctagaagtaaacccatttccctggc

SEQ ID NO: 1824 - DNA, 71 bp, chicken (Gallus Gallus)
  misc_feature (36): n=g or t
gctgttgaaataaactctttctgacctgcagtttgntgggaccacagtcacatcaccaaggatcatattgt

SEQ ID NO: 1825 - DNA, 71 bp, chicken (Gallus Gallus)
  misc_feature (36): n=a or g
gctttcagtatcattcacactcatgtgaaactgcantagtggatagtagcctgtgctcttgacaagcccat

SEQ ID NO: 1826 - DNA, 71 bp, chicken (Gallus Gallus)
  misc_feature (36): n=g or t
ggaaaaaagtgctgttaccatttaactacctctgangcatgtagcgatgaaggtagaaactcaagtaatta

SEQ ID NO: 1827 - DNA, 71 bp, chicken (Gallus Gallus)
  misc_feature (36): n=a or g
ggaaacaaagctttgctcagttagagcaactgcagntttactttgaaactatcagaagtttgggtctctgg

SEQ ID NO: 1828 - DNA, 71 bp, chicken (Gallus Gallus)
  misc_feature (36): n=a or g
ggaaacaaggcttagagaggttcttgtgtttgtctngttttctacccatcacccttgtcttcctcatttcc

SEQ ID NO: 1829 - DNA, 71 bp, chicken (Gallus Gallus)
  misc_feature (36): n=a or g
ggaaagaattggatatattggatacaatcctgttcnctgctttaggttgtgatgagctaacaacaagtgcc

SEQ ID NO: 1830 - DNA, 71 bp, chicken (Gallus Gallus)
  misc_feature (36): n=c or t
ggaagataactacagcctcacaagtagctacaaganagcacatttgatctgtctcactaacgagagatttt

SEQ ID NO: 1831 - DNA, 71 bp, chicken (Gallus Gallus)
  misc_feature (36): n=c or t
ggaagtcagttgtgtgaggcagagatttagtgcatntttagctgcattttgtggaacccttgccctggaaa

SEQ ID NO: 1832 - DNA, 71 bp, chicken (Gallus Gallus)
  misc_feature (36): n=c or t
ggaatgcatttacctggatcttctgtgaattttaangaatccacaaatactgagactgttttactactata

SEQ ID NO: 1833 - DNA, 71 bp, chicken (Gallus Gallus)
  misc_feature (36): n=a or c
ggaatggcttgggctggaagggacctcaaggaccangttccatccccctcaccttatctataatggtgaaa

SEQ ID NO: 1834 - DNA, 71 bp, chicken (Gallus Gallus)
  misc_feature (36): n=a or g
ggagaaaagtagttgctctgtcaatgtcagtgggcntgtaggtcacaccagaaccattccacttttgcaaa

SEQ ID NO: 1835 - DNA, 71 bp, chicken (Gallus Gallus)
  misc_feature (36): n=a or g
ggagctgccacccttgtgctgccagctctacctgtncacctcctatgcacatccagcaaggagacaagtta

SEQ ID NO: 1836 - DNA, 71 bp, chicken (Gallus Gallus)
  misc_feature (36): n=a or g
ggaggatagctattaataaaaagcctacttctgttntatgcattttcaaaagaaatgaaagggtagacata

SEQ ID NO: 1837 - DNA, 71 bp, chicken (Gallus Gallus)
  misc_feature (36): n=a or g
ggatggaagctggacgctgcactgcttgtttgaacnctaactggcagcatcttcagatttacaatatcctg

SEQ ID NO: 1838 - DNA, 71 bp, chicken (Gallus Gallus)
  misc_feature (36): n=c or t
ggatggtggctggactgcatgatgttaaaggtcttntgtgacaggctaccagtatgcaaggtcctttaaaa

SEQ ID NO: 1839 - DNA, 71 bp, chicken (Gallus Gallus)
  misc_feature (36): n=a or g
ggattcttcttcagtgtcattacagctgcttttgtnttctgacgctgaagcataaagctttttttggcata

SEQ ID NO: 1840 - DNA, 71 bp, chicken (Gallus Gallus)
  misc_feature (36): n=a or g
ggcaaagttcctgctgttggttctttgttgccgtcncagtctctagctggattaaagccagcaggagtgtg

SEQ ID NO: 1841 - DNA, 71 bp, chicken (Gallus Gallus)
  misc_feature (36): n=c or t
ggcactattttcacagtgacagaggggtcagtggtncgtgaagaggttttagttgtgttacattttcaaaa

SEQ ID NO: 1842 - DNA, 71 bp, chicken (Gallus Gallus)
  misc_feature (36): n=g or t
ggcagactggtccagcagctaagccaccagcctggnacacatagatcccatctctgcctgcaacacagttt

SEQ ID NO: 1843 - DNA, 71 bp, chicken (Gallus Gallus)
  misc_feature (36): n=c or t
ggcagaggctaagactattacaggctctctctgcanggtcagcaatttcattacacgtgcttcattctttc

SEQ ID NO: 1844 - DNA, 71 bp, chicken (Gallus Gallus)
  misc_feature (36): n=c or t
ggcagtctgaaagggcactgggtgaccccaattggnacgtgggtgctcaaggcaagatgcttttcccctgc

SEQ ID NO: 1845 - DNA, 71 bp, chicken (Gallus Gallus)
  misc_feature (36): n=c or t
ggcatgtttaacaacgatgcatacaaacattattantttgctgtagtcatctgagaagttatcgatggtgt

SEQ ID NO: 1846 - DNA, 71 bp, chicken (Gallus Gallus)
  misc_feature (36): n=c or t
ggcctgagggaggagcacagaggtggtttgcagtangtgaatggtgcttaaatccacgctgctccctcttc

SEQ ID NO: 1847 - DNA, 71 bp, chicken (Gallus Gallus)
  misc_feature (36): n=a or g
ggctaattgcaagagcactacagcattgtcacctcntttacctcccttaacaggttgtctgctcttgcaac

SEQ ID NO: 1848 - DNA, 71 bp, chicken (Gallus Gallus)
  misc_feature (36): n=a or g
ggctcctgctgcctcgatggggagaaggagcagtcngcatagactgtgaggtttggaaatgcatatatgta

SEQ ID NO: 1849 - DNA, 71 bp, chicken (Gallus Gallus)
  misc_feature (36): n=c or t
ggctccttaactggatcccatccaagtttacaaagngcttccacagagataatggagaacattccagcctc

SEQ ID NO: 1850 - DNA, 71 bp, chicken (Gallus Gallus)
  misc_feature (36): n=c or t
ggctttcaatcttcaccccatagacaagttgttacngcagctctcaattcgagggtgaagagaagcatgcc

SEQ ID NO: 1851 - DNA, 71 bp, chicken (Gallus Gallus)
  misc_feature (36): n=a or g
gggaagaagacactaagaacacaaattaaagctgcnttggcataaacattgcatcatgcattcctaaatta

SEQ ID NO: 1852 - DNA, 71 bp, chicken (Gallus Gallus)
  misc_feature (36): n=a or g
gggaatggccctgggacagcttcctccatcccacanttatcagcaactgtcaagaggaaactgctctatct

SEQ ID NO: 1853 - DNA, 71 bp, chicken (Gallus Gallus)
  misc_feature (36): n=c or t
gggacaaagcgactgtaccagctgcactgcaggggnatttgtgcgtatcccaccatcagccaggacccacg

SEQ ID NO: 1854 - DNA, 71 bp, chicken (Gallus Gallus)
  misc_feature (36): n=c or t
gggagctactgtgggccaatttatgactaagcttangaggcactgcttgaccacacaggcaaagattttta

SEQ ID NO: 1855 - DNA, 71 bp, chicken (Gallus Gallus)
  misc_feature (36): n=c or t
gggcctcagattctggggtcaggcagagcaaccccncaaatcatcgcccaacccttttatggcacatctgg

SEQ ID NO: 1856 - DNA, 71 bp, chicken (Gallus Gallus)
  misc_feature (36): n=c or t
ggggagctgctgttgatgcagcctgactgtggcacngaaccaggtgtgttagtattaaatatgaacttgta

SEQ ID NO: 1857 - DNA, 71 bp, chicken (Gallus Gallus)
  misc_feature (36): n=c or t
gggggcagttgttcctgtgtggcagcgcttggagcngttctgtgggtctcattttcactgaatattttgag

SEQ ID NO: 1858 - DNA, 71 bp, chicken (Gallus Gallus)
  misc_feature (36): n=a or g
gggttgaacatagatgttcaccctgtttggagagcnggaagttgactggtgacctccagaaattcactgta

SEQ ID NO: 1859 - DNA, 71 bp, chicken (Gallus Gallus)
  misc_feature (36): n=a or g
ggtaaataaaaaaggaaaataaatgcttgaccatantacatctcaatatatttgaaggcttcaaaatgctt

SEQ ID NO: 1860 - DNA, 71 bp, chicken (Gallus Gallus)
  misc_feature (36): n=c or t
ggtataaatatacctgcatattagaaatgggaacgngtctttgaaatacgctcaattagagaagtgagaga

SEQ ID NO: 1861 - DNA, 71 bp, chicken (Gallus Gallus)
  misc_feature (36): n=a or g
ggtccctcccaattcaagccattccatgattctacnagcctcaatttctgtgtatagctgaggtgcagtga

SEQ ID NO: 1862 - DNA, 71 bp, chicken (Gallus Gallus)
  misc_feature (36): n=c or t
ggtgattaaagcaggctgcagtgggacttgctctcngttcagccccacaacacaagaggaggataatgctc

SEQ ID NO: 1863 - DNA, 71 bp, chicken (Gallus Gallus)
  misc_feature (36): n=c or t
ggtgcagctggtcagtaaattaaagtcatcccctgnctacttagacccagtctgtgggatggtatcaagag

SEQ ID NO: 1864 - DNA, 71 bp, chicken (Gallus Gallus)
  misc_feature (36): n=a or g
ggtggtgctttgcacacaggtaaccctaacataatngttaataccttgaaactatcctaacaacatttttg

SEQ ID NO: 1865 - DNA, 71 bp, chicken (Gallus Gallus)
  misc_feature (36): n=c or t
ggtgtacaaattatgacatgtgaacagatgaacttntgttagaagaaaccaatcatgctatagcagatgct

SEQ ID NO: 1866 - DNA, 71 bp, chicken (Gallus Gallus)
  misc_feature (36): n=c or t
ggtgttagtactgggaagtgctgaaagggggacatnttgtagctgcagaagaaagtaaggtaatatatctg

SEQ ID NO: 1867 - DNA, 71 bp, chicken (Gallus Gallus)
  misc_feature (36): n=c or t
ggttaattcaagttgcatgatttcagcaaagcttgngttcggtacagtttatttaatactagaagtgtagt

SEQ ID NO: 1868 - DNA, 71 bp, chicken (Gallus Gallus)
  misc_feature (36): n=c or t
ggttgttgtcttgaattctgccccagcctcctcttnccccatccctcacaatctggttttaataaaggcct

SEQ ID NO: 1869 - DNA, 71 bp, chicken (Gallus Gallus)
  misc_feature (36): n=g or t
ggttttgagtcttctcagtgctatttataaggggantgagagcagctattgttatctttatgaatatttgg

SEQ ID NO: 1870 - DNA, 71 bp, chicken (Gallus Gallus)
  misc_feature (36): n=c or t
gtaaattatttcaaggtgaataaaaatatttaaggngtcctcaaataatcaatttttgaccaatcagcatc

SEQ ID NO: 1871 - DNA, 71 bp, chicken (Gallus Gallus)
  misc_feature (36): n=c or t
gtaagtattccacagggctgctttccagaagatganatggacacaggtaggaacctcttccagagccaggc

SEQ ID NO: 1872 - DNA, 71 bp, chicken (Gallus Gallus)
  misc_feature (36): n=g or t
gtacctagttttagccatttaaaagttggggtgtcnaagctggtgatccaggtttcatctaaaggctgcgg

SEQ ID NO: 1873 - DNA, 71 bp, chicken (Gallus Gallus)
  misc_feature (36): n=a or c
gtactgttccacacctgcctttctgtgttgtattgngcctttcctttgatcctttttctcaagcagtggtt

SEQ ID NO: 1874 - DNA, 71 bp, chicken (Gallus Gallus)
  misc_feature (36): n=c or t
gtagctaacatgagatcaaacttgctgtgaaagagnaattttcataattgaatggctgccgtgtaggaatc

SEQ ID NO: 1875 - DNA, 71 bp, chicken (Gallus Gallus)
  misc_feature (36): n=c or t
gtaggacacgttgaagctcatggtagagacttcatncatgctaactgtgccagtttaagtgtgttgagtgt

SEQ ID NO: 1876 - DNA, 71 bp, chicken (Gallus Gallus)
  misc_feature (36): n=c or t
gtatacacaaacagaaaggcactgcggaaggactgnggttaagcattcaaagttacatgctcaaaattcac

SEQ ID NO: 1877 - DNA, 71 bp, chicken (Gallus Gallus)
  misc_feature (36): n=c or t
gtatcattctagtggaaaatggtaccatttacaccncgtgcaaaagaatttatatcccaaaaatgtatggc

SEQ ID NO: 1878 - DNA, 71 bp, chicken (Gallus Gallus)
  misc_feature (36): n=a or g
gtatggaacttcccgtgttccactttgtgctcatcntctcttgtttagtcaataaggtggtcctgtgtgga

SEQ ID NO: 1879 - DNA, 71 bp, chicken (Gallus Gallus)
  misc_feature (36): n=c or t
gtatggggcaggtgggtgtgatcattatgcacctancaagatgccttgtggttttccagaggtaaatgatg

SEQ ID NO: 1880 - DNA, 71 bp, chicken (Gallus Gallus)
  misc_feature (36): n=a or g
gtattgtcagctgacaaccttgtacagaagcttctnttcatggagaaaagagatgctttagttgtagtaac

SEQ ID NO: 1881 - DNA, 71 bp, chicken (Gallus Gallus)
  misc_feature (36): n=a or c
gtcacacatgtgggacccaccagtaaagctgcttcngttatggactcacgtgagaaaatgagggtggttct

SEQ ID NO: 1882 - DNA, 71 bp, chicken (Gallus Gallus)
  misc_feature (36): n=a or g
gtcacagtaggaaaagaaaataattaagctaagaanaactaatgggaatgagctggccataaataatttag

SEQ ID NO: 1883 - DNA, 71 bp, chicken (Gallus Gallus)
  misc_feature (36): n=c or t
gtcaggagtgctgtatgatgtaccatggaacgcaantgcactttatgcagtaataaccatggatctgttct

SEQ ID NO: 1884 - DNA, 71 bp, chicken (Gallus Gallus)
  misc_feature (36): n=a or g
gtcaggcagcaaagaaaccataagaacattgtagtnatttaaccatcacattataatgcaatagagaaaag

SEQ ID NO: 1885 - DNA, 71 bp, chicken (Gallus Gallus)
  misc_feature (36): n=a or g
gtcaggtccccttgtgtgaagtatctatatttaatngagcttttcttgggtagaatggttacaatacaaag

SEQ ID NO: 1886 - DNA, 71 bp, chicken (Gallus Gallus)
  misc_feature (36): n=c or t
gtccagagctgaccacgccgagtgaaggttggaaantttgtacttaaatgaggagtcactgctgtccattg

SEQ ID NO: 1887 - DNA, 71 bp, chicken (Gallus Gallus)
  misc_feature (36): n=c or t
gtccatcgacatctccacgccttggagaaacgtgcngccacgttcctgcaccctcttccttattttagggc

SEQ ID NO: 1888 - DNA, 71 bp, chicken (Gallus Gallus)
  misc_feature (36): n=c or t
gtcctgggaggccaccaagtgacgtcctctctctgnactgaaattcaggctcaaagatgaagatgcacctg

SEQ ID NO: 1889 - DNA, 71 bp, chicken (Gallus Gallus)
  misc_feature (36): n=c or t
gtctcccacctcttcgcatttcaaagctgcacttgnctgttgagcaactgagtcatttccttcccagatcc

SEQ ID NO: 1890 - DNA, 71 bp, chicken (Gallus Gallus)
  misc_feature (36): n=c or t
gtcttgaaaaagaaaagggattcaggataactgttngatttttcaatggtcacatcctccaagctcaagaa

SEQ ID NO: 1891 - DNA, 71 bp, chicken (Gallus Gallus)
  misc_feature (36): n=c or t
gtctttgcagttggtttttgttgcctttattgttgntgttggaaagctccggccaagtgtttactatcaag

SEQ ID NO: 1892 - DNA, 71 bp, chicken (Gallus Gallus)
  misc_feature (36): n=c or t
gtgaacactgtgctttctgggcataaccagctcccngttcacagctcacatgtgaaatgaattgccaattc

SEQ ID NO: 1893 - DNA, 71 bp, chicken (Gallus Gallus)
  misc_feature (36): n=c or t
gtgaatttaatttactttgggttaacacttgcatgnttgcaggctagatgagtaacaaagccagtggaaga

SEQ ID NO: 1894 - DNA, 71 bp, chicken (Gallus Gallus)
  misc_feature (36): n=c or t
gtgacggtaaaacatcgcatctcatttctgtagtanatttccgtaccacaaatcccttgcaatagctgttg

SEQ ID NO: 1895 - DNA, 71 bp, chicken (Gallus Gallus)
  misc_feature (36): n=c or t
gtgagctgcttctgcagtctgtgcagcagcaacctngctgtctgcagaggatagtgcagttacacagggac

SEQ ID NO: 1896 - DNA, 71 bp, chicken (Gallus Gallus)
  misc_feature (36): n=c or t
gtgagtgtaggaggggatgctgagctgcagcctggngttggaaaagttattgaatccctggtggactacag

SEQ ID NO: 1897 - DNA, 71 bp, chicken (Gallus Gallus)
  misc_feature (36): n=g or t
gtgatattacataagcaaagctcaaatggtttgtgntggcatcagatgccctaagacaacctgactcatac

SEQ ID NO: 1898 - DNA, 71 bp, chicken (Gallus Gallus)
  misc_feature (36): n=c or t
gtgatgttgaaagctgcaccatcttttctgaacagntttcatcgtctggttgcttctgtcatggttgaagg

SEQ ID NO: 1899 - DNA, 71 bp, chicken (Gallus Gallus)
  misc_feature (36): n=c or t
gtgcacagcaacagcagctctgcaggatttgggcantgcatcccaagaggttcccacagaaaggtgaagcc

SEQ ID NO: 1900 - DNA, 71 bp, chicken (Gallus Gallus)
  misc_feature (36): n=c or t
gtgcagctctggttgggcgtgcgtgcctcgcagcangaacttcggctcagtgaaaccaggacttatctcag

SEQ ID NO: 1901 - DNA, 71 bp, chicken (Gallus Gallus)
  misc_feature (36): n=c or t
gtgcatgagaggggatgagcgcaggcagtatttcancctttctgctttgaggatttcaaagcacctcaatc

SEQ ID NO: 1902 - DNA, 71 bp, chicken (Gallus Gallus)
  misc_feature (36): n=a or g
gtgcctacactccccagtgacaagcaggggactgcntccacactcagatatctctgtgcatgtctaggaaa

SEQ ID NO: 1903 - DNA, 71 bp, chicken (Gallus Gallus)
  misc_feature (36): n=c or t
gtgggctttgtggcagcccctggggaagatgactcnacttcactgcattctttttggcttcaactcctgcc

SEQ ID NO: 1904 - DNA, 71 bp, chicken (Gallus Gallus)
  misc_feature (36): n=c or t
gtggggctgtcgctgcggattgaagctaccattcgnaccaacacacacttgcaggaccataattattgaca

SEQ ID NO: 1905 - DNA, 71 bp, chicken (Gallus Gallus)
  misc_feature (36): n=c or t
gtgtccccaggccgtgtgacaatgcccggggtttgnctgtggatctctgtccccaaaaattcaccttgcag

SEQ ID NO: 1906 - DNA, 71 bp, chicken (Gallus Gallus)
  misc_feature (36): n=c or t
gtgtgcatgggggggaaatcactgcttccactgtgnaccaccaggagctataaagcacatgggtcttatac

SEQ ID NO: 1907 - DNA, 71 bp, chicken (Gallus Gallus)
  misc_feature (36): n=a or g
gtgtttccagagacaaagcactcctctgcctggtcntgactctctttggagcaaggtcatggacatgcggg

SEQ ID NO: 1908 - DNA, 71 bp, chicken (Gallus Gallus)
  misc_feature (36): n=g or t
gtgtttctttggcaggactggagattccagagggtnctccagtggcaagttaagcaaaagccataatattt

SEQ ID NO: 1909 - DNA, 71 bp, chicken (Gallus Gallus)
  misc_feature (36): n=a or c
gttaaaagtcttcagtacaaataaaaactgtattcnaagtctcagtggcttcataaaacatatccttgcag

SEQ ID NO: 1910 - DNA, 71 bp, chicken (Gallus Gallus)
  misc_feature (36): n=a or g
gttacagccacgctttgggaaggagtgggacaccanggagtgagtgttaaagctcactgtcaaaacaggcg

SEQ ID NO: 1911 - DNA, 71 bp, chicken (Gallus Gallus)
  misc_feature (36): n=c or t
gttactggagatgaagtattgcttgcctgcttctcnaactgggtccagcatcaaaccagcttaaaaaaccc

SEQ ID NO: 1912 - DNA, 71 bp, chicken (Gallus Gallus)
  misc_feature (36): n=a or g
gttccagcaaagtaatggcccgggccaggctttccnatcgtgttcctctaacatgtcagattggttcttcc

SEQ ID NO: 1913 - DNA, 71 bp, chicken (Gallus Gallus)
  misc_feature (36): n=c or t
gttggctttctttctttttgtgatttgttgagtttnatcttgttttatgtaggaggtgtacttagtcttga

SEQ ID NO: 1914 - DNA, 71 bp, chicken (Gallus Gallus)
  misc_feature (36): n=a or g
gttgtcacctgccaccattcctctctggcattaccntgcggttctgtttggatcatgacaaaagctgtggg

SEQ ID NO: 1915 - DNA, 71 bp, chicken (Gallus Gallus)
  misc_feature (36): n=a or g
gttgttctgttcaaactcccatttaatattgcttgngcactcagttaatacagacgacaaggatgcgtgca

SEQ ID NO: 1916 - DNA, 71 bp, chicken (Gallus Gallus)
  misc_feature (36): n=a or g
gttgtttcaagagaaataattaaactgaatccaacncattccatttcacatcttatctaagtaaagcagct

SEQ ID NO: 1917 - DNA, 71 bp, chicken (Gallus Gallus)
  misc_feature (36): n=a or g
gtttatattattaaatactattattatttttaattncgcttatctcaaagaattcctgctttttatgagac

SEQ ID NO: 1918 - DNA, 71 bp, chicken (Gallus Gallus)
  misc_feature (36): n=g or t
gtttctgctctttgggttcaatttgctggaggcttngagaagtgcttagtatggtattttttttatataga

SEQ ID NO: 1919 - DNA, 71 bp, chicken (Gallus Gallus)
  misc_feature (36): n=c or t
gtttgcagcttaaatgttgtgaattgatacaattcngtttactgcaagggaaggttcactctggtttatac

SEQ ID NO: 1920 - DNA, 71 bp, chicken (Gallus Gallus)
  misc_feature (36): n=a or c
gtttgcttgctgcccacaggccaccactgactatcncagctctgtggggtacctccatcctaatgaggtaa

SEQ ID NO: 1921 - DNA, 71 bp, chicken (Gallus Gallus)
  misc_feature (36): n=a or g
gtttgtggagtcaggcaaggacttggtagataccantagcttccttggagaaggcttggtgtttggagagc

SEQ ID NO: 1922 - DNA, 71 bp, chicken (Gallus Gallus)
  misc_feature (36): n=a or g
gttttgctgtcacctatgacaggtcccctattcctnaggcagaaagcttcaaagtgagaccaaagctgtga

SEQ ID NO: 1923 - DNA, 71 bp, chicken (Gallus Gallus)
  misc_feature (36): n=a or c
gttttttaaaaattttttacattatatgaagaaatntttcccatttttctcttacaaatatctcaacacaa

SEQ ID NO: 1924 - DNA, 71 bp, chicken (Gallus Gallus)
  misc_feature (36): n=a or g
taaaaatacaagcattgtgcctatgagcccaggagngtaacttaagactgtatgttttactttatacaagc

SEQ ID NO: 1925 - DNA, 71 bp, chicken (Gallus Gallus)
  misc_feature (36): n=c or t
taaaacagacataacattttggaaatgatctctgantttctggatactggatttgagaatgcatgatccaa

SEQ ID NO: 1926 - DNA, 71 bp, chicken (Gallus Gallus)
  misc_feature (36): n=c or t
taaaatgatgcacattgctgaaggatattgctgcanagctttcagcagctcatacaaggtttcgtaacttg

SEQ ID NO: 1927 - DNA, 71 bp, chicken (Gallus Gallus)
  misc_feature (36): n=a or c
taaaccttttcccagaccacatgctttctcctaaanttgcacatacccttacttttgtcattttactttag

SEQ ID NO: 1928 - DNA, 71 bp, chicken (Gallus Gallus)
  misc_feature (36): n=c or t
taaagagatgtaatctttgttgtatgcacacacacngtgtttctccttaggactgcttctcctgatttttc

SEQ ID NO: 1929 - DNA, 71 bp, chicken (Gallus Gallus)
  misc_feature (36): n=c or t
taaagggcaaaactgcacagtttggaagtgaatgangtagcaggaggataacattagaggaaaagtgtgca

SEQ ID NO: 1930 - DNA, 71 bp, chicken (Gallus Gallus)
  misc_feature (36): n=c or t
taaagttaagtagctgttttctgatagaaagataanggcaacgtcttgttcatgtatatatgaaacatgca

SEQ ID NO: 1931 - DNA, 71 bp, chicken (Gallus Gallus)
  misc_feature (36): n=a or g
taaataaatgccaaaacgatttctgttatttcaggngacgtatgaatcttcttaacacgacattcacagta

SEQ ID NO: 1932 - DNA, 71 bp, chicken (Gallus Gallus)
  misc_feature (36): n=a or g
taacatattgctgaaggattgtaggaatacaatttnttgagcaagttcttgagcaagttctgatttataaa

SEQ ID NO: 1933 - DNA, 71 bp, chicken (Gallus Gallus)
  misc_feature (36): n=c or t
taacctctccataatacatcagtagctcttagtacngtacaaattaaatatgcttcagttttgattttgtc

SEQ ID NO: 1934 - DNA, 71 bp, chicken (Gallus Gallus)
  misc_feature (36): n=c or t
taacgcttcatgtcttaacggttgggtcggtcacangtagtggaattgcataatgagtcaacagaaaatta

SEQ ID NO: 1935 - DNA, 71 bp, chicken (Gallus Gallus)
  misc_feature (36): n=a or g
taactacatttgtgggtagaagtagaggacagcccncgctagctggcaccagcaattaagagaagagatgg

SEQ ID NO: 1936 - DNA, 71 bp, chicken (Gallus Gallus)
  misc_feature (36): n=c or t
taactgacatgaggagcatttcaaatggtctattanccattgctaggatttttaatcactgaagtatcaga

SEQ ID NO: 1937 - DNA, 71 bp, chicken (Gallus Gallus)
  misc_feature (36): n=a or g
taagccacatccagctccagccttaatacacaggcnttagcccatctctaggtaccctcagggaagaccat

SEQ ID NO: 1938 - DNA, 71 bp, chicken (Gallus Gallus)
  misc_feature (36): n=a or g
taagtagccagaggggtggggttcttggctactccnagcttctcgggaggtgaatgagtgacctgaagaaa

SEQ ID NO: 1939 - DNA, 71 bp, chicken (Gallus Gallus)
  misc_feature (36): n=c or t
taatacactctggagaaagctgcttggagcaggctngtgactaaaccaattctggacaaaaaggagtttga

SEQ ID NO: 1940 - DNA, 71 bp, chicken (Gallus Gallus)
  misc_feature (36): n=c or t
taatgcttacagtgcaaaatgaaagtaagcaaagcngcctcagacaacttttactccaatacatgacgcaa

SEQ ID NO: 1941 - DNA, 71 bp, chicken (Gallus Gallus)
  misc_feature (36): n=c or t
taatggcaggcagctgtcaatgctgaaatttttcangagttttacctttcatttctcagctcagctcagca

SEQ ID NO: 1942 - DNA, 71 bp, chicken (Gallus Gallus)
  misc_feature (36): n=c or t
taatgtttccacctccttcacttgtaacttctctanggacaaatcgcagctctatgatactcacagatcaa

SEQ ID NO: 1943 - DNA, 71 bp, chicken (Gallus Gallus)
  misc_feature (36): n=g or t
tacagcagaaagtgtctatttctgacatgcttctgnagccaggaaatccctcagactttcctttgccaagt

SEQ ID NO: 1944 - DNA, 71 bp, chicken (Gallus Gallus)
  misc_feature (36): n=c or t
tacataaagaaacttctgcctttgtgggttattttnctcctctaaccaaggtactctgttttctactagaa

SEQ ID NO: 1945 - DNA, 71 bp, chicken (Gallus Gallus)
  misc_feature (36): n=c or t
tacatttggggctgagaattaatatgatactgtganatgacttcttgttttacaaaccctacctcagaatt

SEQ ID NO: 1946 - DNA, 71 bp, chicken (Gallus Gallus)
  misc_feature (36): n=c or t
taccagggcagattttacccatgatgaagctgcaangcaatcactttatagaaacaccaggaaagaatcca

SEQ ID NO: 1947 - DNA, 71 bp, chicken (Gallus Gallus)
  misc_feature (36): n=a or g
taccttccacaaaaagctccgtaggaactgccatcntctcagaatggagagatcagacacaaaaatctatg

SEQ ID NO: 1948 - DNA, 71 bp, chicken (Gallus Gallus)
  misc_feature (36): n=a or g
tactcaggaccaaacactgctaagaggtttgatgtngtacatgtatatctcctgtgtggctctgctgaaaa

SEQ ID NO: 1949 - DNA, 71 bp, chicken (Gallus Gallus)
  misc_feature (36): n=a or g
tactgatgtgtcagcttctgcctctctcacatctcntagtgcaaataaaacatttatcaaactcacgcaga

SEQ ID NO: 1950 - DNA, 71 bp, chicken (Gallus Gallus)
  misc_feature (36): n=a or g
tactttaaggaagaaaaggtttttgaacctgctacnagagttcaaaactccttcccatcccccatttattt

SEQ ID NO: 1951 - DNA, 71 bp, chicken (Gallus Gallus)
  misc_feature (36): n=a or g
tagaaatgaaaaatgcaattattcctttgagctgcntgcatagtatgttgcttaccattttcagaagatac

SEQ ID NO: 1952 - DNA, 71 bp, chicken (Gallus Gallus)
  misc_feature (36): n=a or g
tagaacaaagaaagcaagcagcttgtggtctccacncagtggaactgcagccagttaagtgttttatctgc

SEQ ID NO: 1953 - DNA, 71 bp, chicken (Gallus Gallus)
  misc_feature (36): n=a or g
tagacaagcttgtattacacgccatgtccttagttntaggcttgtaaggtaggattcagttttaaattaga

SEQ ID NO: 1954 - DNA, 71 bp, chicken (Gallus Gallus)
  misc_feature (36): n=c or t
tagagcttccagaaccatactcacagcataaaggtnttcaatcattccagtttaatgggtgattctcacgc

SEQ ID NO: 1955 - DNA, 71 bp, chicken (Gallus Gallus)
  misc_feature (36): n=c or t
ctagaggaaaaaaaaaacaacaggggaagattgatnatctcttagaagactacaccatcaccccatgtaac

SEQ ID NO: 1956 - DNA, 71 bp, chicken (Gallus Gallus)
  misc_feature (36): n=a or c
tagcagaagatcaggtttgagaccgtgtgaatgtgnataagtccacgggacctgacaaaattataggatgg

SEQ ID NO: 1957 - DNA, 71 bp, chicken (Gallus Gallus)
  misc_feature (36): n=c or t
tagcttctattcatgcagcgcttggaggtccctggnaggttcaccatccctaatttccacataatcatatg

SEQ ID NO: 1958 - DNA, 71 bp, chicken (Gallus Gallus)
  misc_feature (36): n=a or c
tagcttcttgggatcattaccatcaatacccctaanttatataccaaggaattacataaacagatctgtta

SEQ ID NO: 1959 - DNA, 71 bp, chicken (Gallus Gallus)
  misc_feature (36): n=a or g
taggaaactgatagaaatcaggttgcttgtcccaantcaggctgagaaagctattttcttaaaacttgaaa

SEQ ID NO: 1960 - DNA, 71 bp, chicken (Gallus Gallus)
  misc_feature (36): n=c or t
taggcctcagatttcaggacggacaaaacaaatcangctaatgttcagaatcatccaaattctcaaactat

SEQ ID NO: 1961 - DNA, 71 bp, chicken (Gallus Gallus)
  misc_feature (36): n=a or g
taggtgaatagggattcttttcctgcagcagctggngtgctttcttatgctgtgcctaccagaaagctttg

SEQ ID NO: 1962 - DNA, 71 bp, chicken (Gallus Gallus)
  misc_feature (36): n=a or g
tagtatcaggtgcagacctgagagcattggaacccnagggtattcattgcatgactccagcctcactgatt

SEQ ID NO: 1963 - DNA, 71 bp, chicken (Gallus Gallus)
  misc_feature (36): n=c or t
tagttctatagcttctaagtcgtccagcattgtggnttactgtgcagaattattttactgtggtcttatct

SEQ ID NO: 1964 - DNA, 71 bp, chicken (Gallus Gallus)
  misc_feature (36): n=c or t
tatcattaactgtaatcattatttttaatacagaangtgatatcagaaaggtaactatgaaaattgaattt

SEQ ID NO: 1965 - DNA, 71 bp, chicken (Gallus Gallus)
  misc_feature (36): n=a or g
tatgaattttcttgttagatttccagaaactaattnatggatgaaactgtgactttaagtctgaaacactt

SEQ ID NO: 1966 - DNA, 71 bp, chicken (Gallus Gallus)
  misc_feature (36): n=a or g
tatgtagatgcgctctttgctgctgtgagaaatgantgactcagtagaactaatttctgaaagtcagagta

SEQ ID NO: 1967 - DNA, 71 bp, chicken (Gallus Gallus)
  misc_feature (36): n=a or g
tattctcttttcagcaaggcaccctggcggcctgcntagtaagattgtagctcagcaagctcctgcttgca

SEQ ID NO: 1968 - DNA, 71 bp, chicken (Gallus Gallus)
  misc_feature (36): n=g or t
tattctggaccacccaggaaggcaccttactcagantccttaacagagccaatctgttactgggctgcaca

SEQ ID NO: 1969 - DNA, 71 bp, chicken (Gallus Gallus)
  misc_feature (36): n=a or g
tattgtcacaggcaaggcatgtaacctgtaaaacantatttcacaaattggttacacccaaaagcttactt

SEQ ID NO: 1970 - DNA, 71 bp, chicken (Gallus Gallus)
  misc_feature (36): n=c or t
tatttacatgagctgagttacaagacagtaaaaggntgtatttgctttctatatctgaaaagttgctttgt

SEQ ID NO: 1971 - DNA, 71 bp, chicken (Gallus Gallus)
  misc_feature (36): n=a or g
tatttcttttgctccatttcagcctctatagcttanaggaacttgtcgtgtagttgtctttctgtacctac

SEQ ID NO: 1972 - DNA, 71 bp, chicken (Gallus Gallus)
  misc_feature (36): n=a or g
tcaaataaaagcaaccttggttttaacaagagctcncagggagattgaacacggtttaattaatctgcttg

SEQ ID NO: 1973 - DNA, 71 bp, chicken (Gallus Gallus)
  misc_feature (36): n=c or t
tcaaccacactctcttaaaggagaggaagacattcntcgacgttcctccagtaccaccaatgatcatcagt

SEQ ID NO: 1974 - DNA, 71 bp, chicken (Gallus Gallus)
  misc_feature (36): n=a or g
tcaaggtatgtattgtgctattaaagtgcacatgtncaaaatgtccattatatcccaaatatttcagattt

SEQ ID NO: 1975 - DNA, 71 bp, chicken (Gallus Gallus)
  misc_feature (36): n=c or t
tcacaaggataaattcctatccatgcacccagagangcttacaccaatataaactttgtttatgaattcag

SEQ ID NO: 1976 - DNA, 71 bp, chicken (Gallus Gallus)
  misc_feature (36): n=g or t
tcacactccctccaggtggcagggagctgaggtgantgttaagtgtctgatctacaaaacacacaagttag

SEQ ID NO: 1977 - DNA, 71 bp, chicken (Gallus Gallus)
  misc_feature (36): n=c or t
tcacacttcaatgaaacatcagaatatttgcaaagnatggtgatcatttatcttttgttctttgcccttat

SEQ ID NO: 1978 - DNA, 71 bp, chicken (Gallus Gallus)
  misc_feature (36): n=c or t
tcacagagattaacagtatgatctcaaacgagatantgtgagaatgctacaagctgattgccatagttcta

SEQ ID NO: 1979 - DNA, 71 bp, chicken (Gallus Gallus)
  misc_feature (36): n=a or g
tcaccccggtccccggataatgtggattctgtgtcncgctgggcctcaacgggttaatttttgtgcttctc

SEQ ID NO: 1980 - DNA, 71 bp, chicken (Gallus Gallus)
  misc_feature (36): n=c or t
tcacttggctcagcaaagctccttctcttccacccntgcatttcccagtggaaatacttgtcctggtgcaa

SEQ ID NO: 1981 - DNA, 71 bp, chicken (Gallus Gallus)
  misc_feature (36): n=c or t
tcagagcttgagatgttgattcttcaagaaggttcnccagattgtttctgccataaggaaaagtttgtcgt

SEQ ID NO: 1982 - DNA, 71 bp, chicken (Gallus Gallus)
  misc_feature (36): n=a or g
tcagattaactccctcattccaaatcagcttaagcngaggttaatgccaatcttgtgctcacacctgtgct

SEQ ID NO: 1983 - DNA, 71 bp, chicken (Gallus Gallus)
  misc_feature (36): n=a or g
tcagcccaggagccactgtggagctctgctgggcanccctagtctgtgttgtgcgtgcactgtatatattc

SEQ ID NO: 1984 - DNA, 71 bp, chicken (Gallus Gallus)
  misc_feature (36): n=c or t
tcagcctggagtctagctggaaggatttagttctgntatcttctcaaatttcctcagcttttcctgttaaa

SEQ ID NO: 1985 - DNA, 71 bp, chicken (Gallus Gallus)
  misc_feature (36): n=c or t
tcagctgaaagcattaacttcccatgacgattatanagcctgctacttcataatcactctttgctactggc

SEQ ID NO: 1986 - DNA, 71 bp, chicken (Gallus Gallus)
  misc_feature (36): n=a or g
tcaggtttcttcctttcttggaagctggttgtggantggattggtttccacccatgtgatactaccacagc

SEQ ID NO: 1987 - DNA, 71 bp, chicken (Gallus Gallus)
  misc_feature (36): n=a or g
tcagtaagctgaaaagatactttgggcagtgttganacttctctatagaaagctgatcttagtctttggcc

SEQ ID NO: 1988 - DNA, 71 bp, chicken (Gallus Gallus)
  misc_feature (36): n=c or t
tcagtcttctttggccatgttattatttttttcttnacacttcccatttcatctcacttctatttactacc

SEQ ID NO: 1989 - DNA, 71 bp, chicken (Gallus Gallus)
  misc_feature (36): n=c or t
tcatgcatgatttaaaacagaaggaaaaaagagacngagggagtgtcactgtcatcgatcaccgattgttt

SEQ ID NO: 1990 - DNA, 71 bp, chicken (Gallus Gallus)
  misc_feature (36): n=g or t
tcatggagcctcctgatgaactgcatccacacaccnatcattaagcttgaatgaaggtgttaatcctcaag

SEQ ID NO: 1991 - DNA, 71 bp, chicken (Gallus Gallus)
  misc_feature (36): n=a or g
tcatggctttgaaaacaagcagtaaggattaaacanttgcttagcagttaaacttcaaaagagatgtgaaa

SEQ ID NO: 1992 - DNA, 71 bp, chicken (Gallus Gallus)
  misc_feature (36): n=a or c
tcatgtactctgctgtttggcagcagcagatctcanttctcagtgaccgtaccattcatgcagcttaggta

SEQ ID NO: 1993 - DNA, 71 bp, chicken (Gallus Gallus)
  misc_feature (36): n=a or g
tcattacttacccctctaggcatattccactttgangagtcctaaacagagcaagtacacaaacaagcaaa

SEQ ID NO: 1994 - DNA, 71 bp, chicken (Gallus Gallus)
  misc_feature (36): n=a or c
tcattatccctgcctaaaaaacctaatcagtacccntttggttcatttgcagctcagaggtcagtaattca

SEQ ID NO: 1995 - DNA, 71 bp, chicken (Gallus Gallus)
  misc_feature (36): n=a or g
tcattccccagtgcatgctgaagccagaatcaccanggaattgagctcaaggagtactaacaggacaataa

SEQ ID NO: 1996 - DNA, 71 bp, chicken (Gallus Gallus)
  misc_feature (36): n=a or g
tcattccgctgactactttacttgcagaatcaatcnttacttagctttagcaatgggtgtgaagaaacaga

SEQ ID NO: 1997 - DNA, 71 bp, chicken (Gallus Gallus)
  misc_feature (36): n=a or g
tccaccaaaaataaacataaagatgctgccagcttnatggaagtttagttcaaatgccaaccagaatttgt

SEQ ID NO: 1998 - DNA, 71 bp, chicken (Gallus Gallus)
  misc_feature (36): n=a or g
tcccaaggaattctagcagctcttaccagtgaggtntcattgcactgaaccatgttttattcatactcagt

SEQ ID NO: 1999 - DNA, 71 bp, chicken (Gallus Gallus)
  misc_feature (36): n=c or t
tcccactgtgatggcctggtcttgctcctccctgcnggtaaagaaggagcttccatcacagagatactaag

SEQ ID NO: 2000 - DNA, 71 bp, chicken (Gallus Gallus)
  misc_feature (36): n=c or t
tcccagggagatgctgcagggggcagcggcctcctnagctgtcttgattgcaggatggcctgtgtttaatt

SEQ ID NO: 2001 - DNA, 71 bp, chicken (Gallus Gallus)
  misc_feature (36): n=c or t
tcccagtgctgctaaagctcctcaaacccacatttngtgcatcactcaaaatgcagatacaccttgactta

SEQ ID NO: 2002 - DNA, 71 bp, chicken (Gallus Gallus)
  misc_feature (36): n=c or t
tccccccaagaactaccatccttccagatctgcatngcaaacttcaggctgtagattactcaaatattatt

SEQ ID NO: 2003 - DNA, 71 bp, chicken (Gallus Gallus)
  misc_feature (36): n=c or t
tcccttccaacctgttacagttggaaagatcagtgnggtagaaaggtgaaacaagagtgaaatggcaaaag

SEQ ID NO: 2004 - DNA, 71 bp, chicken (Gallus Gallus)
  misc_feature (36): n=a or g
tcctagaaaggagttaaaacatatggatgcattcgnaattgaggcaactattattagaacaaataataagg

SEQ ID NO: 2005 - DNA, 71 bp, chicken (Gallus Gallus)
  misc_feature (36): n=a or g
tcctccgagtgatggagggggtttttggagctggtntatgcaatacagaatgatgccactcagtagacgca

SEQ ID NO: 2006 - DNA, 71 bp, chicken (Gallus Gallus)
  misc_feature (36): n=c or t
tcctgcttccccatcccagcttggggggatatgcangtgtaaattaaagctaaaatgaggctgctttgctc

SEQ ID NO: 2007 - DNA, 71 bp, chicken (Gallus Gallus)
  misc_feature (36): n=a or c
tcctggaacggatcatttcctgcccttctttccttngagctttgcttaatcccgtttggaacagcgcagat

SEQ ID NO: 2008 - DNA, 71 bp, chicken (Gallus Gallus)
  misc_feature (36): n=c or t
tcctggctcaaactctcttgtgttcagacacctgangttttaaatgataaaaagtctaacacaaaaggaag

SEQ ID NO: 2009 - DNA, 71 bp, chicken (Gallus Gallus)
  misc_feature (36): n=a or g
tcctggtttgcggagcacgcctttcagctgggctcngggattcatttgaatctgactcagaagagttttac

SEQ ID NO: 2010 - DNA, 71 bp, chicken (Gallus Gallus)
  misc_feature (36): n=c or t
tccttaaaaaaaacttataagcaaagaagctgtggnacaatttggtgttgaccagatctttctttcctcat

SEQ ID NO: 2011 - DNA, 71 bp, chicken (Gallus Gallus)
  misc_feature (36): n=c or t
tcgacaaagatacagtaatagcttctttatgtcctntcctgatttacatgggcaaatgattgaaaattgag

SEQ ID NO: 2012 - DNA, 71 bp, chicken (Gallus Gallus)
  misc_feature (36): n=g or t
tcgcataggacaatcagagattgagaaagctccacnaatcgtaaaaatcaaatgtatcatttaagagtgtt

SEQ ID NO: 2013 - DNA, 71 bp, chicken (Gallus Gallus)
  misc_feature (36): n=a or g
tctacttcacaagtaattgtttaaaaaatcaagttnctatccctgatactaacagctaaatttgatacttg

SEQ ID NO: 2014 - DNA, 71 bp, chicken (Gallus Gallus)
  misc_feature (36): n=c or t
tctagtttaaagacctctctactagtccatacatangtgggtatgtcaccattctttcaaaaagaagttga

SEQ ID NO: 2015 - DNA, 71 bp, chicken (Gallus Gallus)
  misc_feature (36): n=a or g
tctatgccaaactgttcattttctaggcttaagaanaatgttagcttaaaagacagaagcagaaatattcc

SEQ ID NO: 2016 - DNA, 71 bp, chicken (Gallus Gallus)
  misc_feature (36): n=a or g
tctccaaaaacaaagagttgctcttataagtattanaacacgttaaaatgctgcaattaagatttttcttt

SEQ ID NO: 2017 - DNA, 71 bp, chicken (Gallus Gallus)
  misc_feature (36): n=c or t
tctccttcattttctgcagcatttgaacagaccacngtagctgtatttgtacacagaggtagatatgaggt

SEQ ID NO: 2018 - DNA, 71 bp, chicken (Gallus Gallus)
  misc_feature (36): n=c or t
tctctcaccctgggtatgacactttggcaaaccacngagcaggtttgtttcaaatatggactcagcttttg

SEQ ID NO: 2019 - DNA, 71 bp, chicken (Gallus Gallus)
  misc_feature (36): n=c or t
tctctctctctccctccttctcatttttaacaatantgtagatacagtaccagctgaaatcctgccagttc

SEQ ID NO: 2020 - DNA, 71 bp, chicken (Gallus Gallus)
  misc_feature (36): n=c or t
tctgaggctggaacaccattctcttgtggtctactngtgtaataaagtgaaacaattattttaatcaatga

SEQ ID NO: 2021 - DNA, 71 bp, chicken (Gallus Gallus)
  misc_feature (36): n=a or g
tctgccattggcatttttgctgatggatcccagacntcataaatgcaaggtgaccacagaaattacttcat

SEQ ID NO: 2022 - DNA, 71 bp, chicken (Gallus Gallus)
  misc_feature (36): n=c or t
tctggacatcactgcaatctcctgtggagtccctgncctaagagagacagtacctccatacccagctgtgc

SEQ ID NO: 2023 - DNA, 71 bp, chicken (Gallus Gallus)
  misc_feature (36): n=c or t
tctgggctcacagggaggaagagacctgaagtctcngaatttgatgataaaggatcacagctgggaggaca

SEQ ID NO: 2024 - DNA, 71 bp, chicken (Gallus Gallus)
  misc_feature (36): n=a or g
tctgggttgttgcagtgctgtgtatgaaggcatctntctgtagagttatggtggagataccagagctggtc

SEQ ID NO: 2025 - DNA, 71 bp, chicken (Gallus Gallus)
  misc_feature (36): n=a or g
tctgtaatggctgctcagtctatggatgctgttgcnatttttgtatttttgcagtggagttacatgttgct

SEQ ID NO: 2026 - DNA, 71 bp, chicken (Gallus Gallus)
  misc_feature (36): n=c or t
tcttatcatcatcagtcagctctgcagttgtaacgnatgcattttcatgttcttggtaggcaaagaggcaa

SEQ ID NO: 2027 - DNA, 71 bp, chicken (Gallus Gallus)
  misc_feature (36): n=a or g
tcttcatttttataagaggaggaggaagaagagaangaaaggaagacagtttcacatggttattaatgtcc

SEQ ID NO: 2028 - DNA, 71 bp, chicken (Gallus Gallus)
  misc_feature (36): n=g or t
tcttcttctcagttctgcagtgcactgaagcaaatnatctgtttttccatgcaaaatttccggtgtcagta

SEQ ID NO: 2029 - DNA, 71 bp, chicken (Gallus Gallus)
  misc_feature (36): n=a or g
tcttgagccaggaggcagtgagctttgcctcttgcngttgcttagccttcgtggcctaacatttcatacat

SEQ ID NO: 2030 - DNA, 71 bp, chicken (Gallus Gallus)
  misc_feature (36): n=a or g
tctttaagagggagctaagtccaggaacaactgacnactgatcgtagggaaaagaatattaagattaatgg

SEQ ID NO: 2031 - DNA, 71 bp, chicken (Gallus Gallus)
  misc_feature (36): n=a or g
tcttttgaaggagggaaaaaaaaaatcagctaaacntatttgtaatggtgtgatcccagcagatgggaaat

SEQ ID NO: 2032 - DNA, 71 bp, chicken (Gallus Gallus)
  misc_feature (36): n=c or t
tgaaagagcagaattaaaaccagagaaaacttatantactcagttcatccagcaacacacacacacattag

SEQ ID NO: 2033 - DNA, 71 bp, chicken (Gallus Gallus)
  misc_feature (36): n=a or c
tgaaatgaattacctaaataaggaaaatatatttcncttaaaatcaaatactccatgttcatgatgctatt

SEQ ID NO: 2034 - DNA, 71 bp, chicken (Gallus Gallus)
  misc_feature (36): n=c or t
tgaaatgcatcacttccattgtcctgcccatgacangggataatgccttgaacccattcagaatggatgaa

SEQ ID NO: 2035 - DNA, 71 bp, chicken (Gallus Gallus)
  misc_feature (36): n=c or t
tgaaatggacacagctctctgggagcctgctgacangctgtaggttgtctttgcgctgacacaacgctaat

SEQ ID NO: 2036 - DNA, 71 bp, chicken (Gallus Gallus)
  misc_feature (36): n=c or t
tgaatagtaactgctcagtgttggtgatatccttanagggtatttgatatgagagctctggtaatttctat

SEQ ID NO: 2037 - DNA, 71 bp, chicken (Gallus Gallus)
  misc_feature (36): n=c or t
tgacctcagggcactccaaatctccccagtgccacncatcaggctgcaattacctgacaagttgattacat

SEQ ID NO: 2038 - DNA, 71 bp, chicken (Gallus Gallus)
  misc_feature (36): n=a or g
tgagaaattaaatgaaataaactgagctatttccangttcgtactggtgacgatcagaatctggattaaat

SEQ ID NO: 2039 - DNA, 71 bp, chicken (Gallus Gallus)
  misc_feature (36): n=a or g
tgagacaggacaactgttgtttaagattcagggaantgagaatagaagcagaaaaaagggtgagctggagg

SEQ ID NO: 2040 - DNA, 71 bp, chicken (Gallus Gallus)
  misc_feature (36): n=a or g
tgagatattttctcctctccttcactgaaattaatnaaactgtagcagcatcattggctatttatatttga

SEQ ID NO: 2041 - DNA, 71 bp, chicken (Gallus Gallus)
  misc_feature (36): n=a or g
tgagtgtaagcagcaaactgtatatgagtaaggagntaagttttcaataatgtacatcactcaggaaccag

SEQ ID NO: 2042 - DNA, 71 bp, chicken (Gallus Gallus)
  misc_feature (36): n=a or g
tgagttattcagctggtgctgaacagtgcggaaatnctgaacaagaatgcagcaaattaggaaaactgtca

SEQ ID NO: 2043 - DNA, 71 bp, chicken (Gallus Gallus)
  misc_feature (36): n=c or t
tgataaatgtctttttccccacagcttatagtagtncaccagtcaagtgtactgctccaggaggaaggcag

SEQ ID NO: 2044 - DNA, 71 bp, chicken (Gallus Gallus)
  misc_feature (36): n=c or t
tgataaccaggaggggatgttttttttagagagggngaagacatgactgcgtgcttaaatgtaagcttttg

SEQ ID NO: 2045 - DNA, 71 bp, chicken (Gallus Gallus)
  misc_feature (36): n=a or g
tgatgccccaatctttgtgcattactttgagttttnaaataccaatagtctttcattttgatctttttttt

SEQ ID NO: 2046 - DNA, 71 bp, chicken (Gallus Gallus)
  misc_feature (36): n=a or g
tgattatagctgtgaattctaaagttagaagatttnttttggatttcttaaggtgtaaaatgggaggagtg

SEQ ID NO: 2047 - DNA, 71 bp, chicken (Gallus Gallus)
  misc_feature (36): n=c or t
tgatttgtgagctctgtgctaggtagtcacttcttnattcgctatcagttctgctcccaattaaaacagtt

SEQ ID NO: 2048 - DNA, 71 bp, chicken (Gallus Gallus)
  misc_feature (36): n=a or g
tgcaaaaattgcaaatatatttaagctgagctggangtcaagcaatttacaacaacgaagtgaaggagttc

SEQ ID NO: 2049 - DNA, 71 bp, chicken (Gallus Gallus)
  misc_feature (36): n=a or g
tgcaaggatttacagagggttttcatattgcagcangaagctctagtacctcagagagtctcatttttgat

SEQ ID NO: 2050 - DNA, 71 bp, chicken (Gallus Gallus)
  misc_feature (36): n=c or t
tgcactctgctctgcacttacttgactgtggatttntaaaagctgctctggaacatagttgtttttaggaa

SEQ ID NO: 2051 - DNA, 71 bp, chicken (Gallus Gallus)
  misc_feature (36): n=c or t
tgcaggcagcccagcacacctgtgagtgcaaggtanggtccacgtggagttttctcctaccttgcttttca

SEQ ID NO: 2052 - DNA, 71 bp, chicken (Gallus Gallus)
  misc_feature (36): n=a or g
tgcaggggatgctggaccaagcttggcatcctcctntttcacgtcctcaatgtgcagtggtagtactggga

SEQ ID NO: 2053 - DNA, 71 bp, chicken (Gallus Gallus)
  misc_feature (36): n=c or t
tgcagtgggagaggcagctgctattgcgggcagtgngtttgccacccatccatgtatggaagagtttatgg

SEQ ID NO: 2054 - DNA, 71 bp, chicken (Gallus Gallus)
  misc_feature (36): n=c or t
tgcagtttatttgaatcagtatgtaaaaacttcaangctgagagttagaaatgttcttcctctgtcactct

SEQ ID NO: 2055 - DNA, 71 bp, chicken (Gallus Gallus)
  misc_feature (36): n=c or t
tgcatgcaaactcactgtaattcggcccttaactgngtgacagcattgtgttttcacttgtgttattggac

SEQ ID NO: 2056 - DNA, 71 bp, chicken (Gallus Gallus)
  misc_feature (36): n=c or t
tgccaaatgtttgctctttttcttcctttatgatcntaattttgtgtctctcgtttcacttatttgtagag

SEQ ID NO: 2057 - DNA, 71 bp, chicken (Gallus Gallus)
  misc_feature (36): n=a or g
tgccagccagctaaactggcacactgcacgctgccnccacttcatgtttcagggcttttgaacagggaatt

SEQ ID NO: 2058 - DNA, 71 bp, chicken (Gallus Gallus)
  misc_feature (36): n=a or g
tgccagctgccccgtccaaagcaggatgtgtgcacncaaacttggagatcaatccgttccaggagatcaaa

SEQ ID NO: 2059 - DNA, 71 bp, chicken (Gallus Gallus)
  misc_feature (36): n=c or t
tgcctcgctgctcccaggatggagctgcctggttgngtagcactgcattttcaggaccttaattgccttca

SEQ ID NO: 2060 - DNA, 71 bp, chicken (Gallus Gallus)
  misc_feature (36): n=a or g
tgcctggatcgggttcagcccagctcccaggatccntgttttcctttgacttgagggaactctggattctg

SEQ ID NO: 2061 - DNA, 71 bp, chicken (Gallus Gallus)
  misc_feature (36): n=c or t
tgccttccttagtgggagtaagaggaggaggttgcnctgacatagtaggcttttgaacaagctctagttct

SEQ ID NO: 2062 - DNA, 71 bp, chicken (Gallus Gallus)
  misc_feature (36): n=c or t
tgcgtaacaatttgaaagcaattttgcagctgcctngtgataagaggcagaaccaggatgatgggcgcttg

SEQ ID NO: 2063 - DNA, 71 bp, chicken (Gallus Gallus)
  misc_feature (36): n=c or t
tgctacaccatggttaagaggacattgggtgtttgngctgatgagcctatttcactgtgataagctgcaat

SEQ ID NO: 2064 - DNA, 71 bp, chicken (Gallus Gallus)
  misc_feature (36): n=a or c
tgctccatggatagaggcagacagcagcagacacanaatgaccccatttcccaagcagtccccaaacagca

SEQ ID NO: 2065 - DNA, 71 bp, chicken (Gallus Gallus)
  misc_feature (36): n=g or t
tgctccgggagagcagcagccgaggaagaggcaatnatttgtcagaggtttggagctgcagttacagccca

SEQ ID NO: 2066 - DNA, 71 bp, chicken (Gallus Gallus)
  misc_feature (36): n=a or c
tgctgccgtctctgctgtgtttgaaatggctcctcnagtactgatgagtaaaaagctctaagccagatttg

SEQ ID NO: 2067 - DNA, 71 bp, chicken (Gallus Gallus)
  misc_feature (36): n=a or g
tgctggcaagatgaactagctgggaagtaattactntaatcctaatttgagtgctgaaagagaattcttac

SEQ ID NO: 2068 - DNA, 71 bp, chicken (Gallus Gallus)
  misc_feature (36): n=a or g
tgcttctggaaagacagcacctccagctggggcacnaattcagcactgattcaggagacaagaactctatc

SEQ ID NO: 2069 - DNA, 71 bp, chicken (Gallus Gallus)
  misc_feature (36): n=g or t
tggaaggaataagcagtgtctcctctttcttctgcnaaccccacaatattagcatctctcctaagagaaag

SEQ ID NO: 2070 - DNA, 71 bp, chicken (Gallus Gallus)
  misc_feature (36): n=a or g
tggacaggatgactaagatgctgagacagtctaatntcatgtaaaggctaaattcatagattgatttccct

SEQ ID NO: 2071 - DNA, 71 bp, chicken (Gallus Gallus)
  misc_feature (36): n=c or t
tggagctgatttggcattactggtcagtaatgccanggactgacaagacaccatgttcaggatcagccctg

SEQ ID NO: 2072 - DNA, 71 bp, chicken (Gallus Gallus)
  misc_feature (36): n=a or g
tggatctttctgggtatatttagtgttcttgcaggnttgccagatgtgtgctatggtagctgccttgctta

SEQ ID NO: 2073 - DNA, 71 bp, chicken (Gallus Gallus)
  misc_feature (36): n=a or g
tggatttatagctcagaactgcttctgctgtggttnttaagggtacctgttaaatgttttatgctaattct

SEQ ID NO: 2074 - DNA, 71 bp, chicken (Gallus Gallus)
  misc_feature (36): n=c or t
tggcaaggagagggaattgctgctgaattcctaacntgtttgatttcctgaggtcagcctgacagcgtcag

SEQ ID NO: 2075 - DNA, 71 bp, chicken (Gallus Gallus)
  misc_feature (36): n=a or c
tggctccagctcctctgcagagcaggccaacactanagccacaattcattcagtatatagagtgcatatga

SEQ ID NO: 2076 - DNA, 71 bp, chicken (Gallus Gallus)
  misc_feature (36): n=c or t
tggctgagaccgcttgcagtaggcaacttgcgtacnatcaccttattctggaagcttgggcagattgctag

SEQ ID NO: 2077 - DNA, 71 bp, chicken (Gallus Gallus)
  misc_feature (36): n=a or g
tggctgagctgccggtcccagcgagagctccgtgcngcagcggtaggcggtgaacaaaagccagatcgcag

SEQ ID NO: 2078 - DNA, 71 bp, chicken (Gallus Gallus)
  misc_feature (36): n=c or t
tggcttcttctaaattagaattatttctgtgtcttngaaattttaacagaaactcagtactgactactaaa

SEQ ID NO: 2079 - DNA, 71 bp, chicken (Gallus Gallus)
  misc_feature (36): n=c or t
tgggaatcaagtactagacaaggactcatgccattnagcttcatttctactagctaacggctccatggaca

SEQ ID NO: 2080 - DNA, 71 bp, chicken (Gallus Gallus)
  misc_feature (36): n=a or g
tggggctcctgcccccacctgccccaatgggcagcngctgtggatacatgaaaggagctgcattcttttta

SEQ ID NO: 2081 - DNA, 71 bp, chicken (Gallus Gallus)
  misc_feature (36): n=a or c
tggggctcctttcttagactggggatggcaattagnccaccattaggttggcttcttgatctttggcaggt

SEQ ID NO: 2082 - DNA, 71 bp, chicken (Gallus Gallus)
  misc_feature (36): n=a or g
tgggtttttttggcctcccatcgctgtgcacactgngcagacactgagctttctgagatacctgcttcatt

SEQ ID NO: 2083 - DNA, 71 bp, chicken (Gallus Gallus)
  misc_feature (36): n=c or t
tggtgcacagttttgttactggttgatataaatttntaatgggatattgaaatagaaagtttctaataaaa

SEQ ID NO: 2084 - DNA, 71 bp, chicken (Gallus Gallus)
  misc_feature (36): n=c or t
tgtaattcacaatttaagatgctcattttgctttcngttcgcgctgaatttatctagatactttggctgta

SEQ ID NO: 2085 - DNA, 71 bp, chicken (Gallus Gallus)
  misc_feature (36): n=a or g
tgtataataatgcatttccctggatgtccatgcagntatattcttaagcttgctgagcatcatcagtaata

SEQ ID NO: 2086 - DNA, 71 bp, chicken (Gallus Gallus)
  misc_feature (36): n=a or g
tgtccactgaccatgacccccagtgccacatccccncagttcatgaacacctcaatgaccactgacccttc

SEQ ID NO: 2087 - DNA, 71 bp, chicken (Gallus Gallus)
  misc_feature (36): n=a or g
tgtccctcagcagcacacctcccgagctccatcccntagccctcttcatttttccaccatgaatttcaacc

SEQ ID NO: 2088 - DNA, 71 bp, chicken (Gallus Gallus)
  misc_feature (36): n=c or t
tgtcttgtacttgttagcattattatttataattancattccattatctggcagttcatgtaaatgaggtt

SEQ ID NO: 2089 - DNA, 71 bp, chicken (Gallus Gallus)
  misc_feature (36): n=g or t
tgtgacatccctacttcaaactgtgcagcagctgtntctctagcagtatgtgttagtatggcctgctgact

SEQ ID NO: 2090 - DNA, 71 bp, chicken (Gallus Gallus)
  misc_feature (36): n=a or g
tgtgcaccgtacttatgtgagggtgaggtaaagccnatgcttctaaggagttaaaaattactgtttcaaat

SEQ ID NO: 2091 - DNA, 71 bp, chicken (Gallus Gallus)
  misc_feature (36): n=a or c
tgtgctctaatgaactgtatgtagcttctctagctntggcttggaggtttagatgagcagtacttaaggct

SEQ ID NO: 2092 - DNA, 71 bp, chicken (Gallus Gallus)
  misc_feature (36): n=a or g
tgtgctgctgagcagggacggttggtctttgccatnttcaaatagttaatttaagtgaagctaaaaaacaa

SEQ ID NO: 2093 - DNA, 71 bp, chicken (Gallus Gallus)
  misc_feature (36): n=c or t
tgtgcttcagtggaaagtcatgtgaggctctgggtngtcacttgaacacttgtctgcactgcaaaaccagg

SEQ ID NO: 2094 - DNA, 71 bp, chicken (Gallus Gallus)
  misc_feature (36): n=a or g
tgtgcttccccttcatacagtaagcttatattgatngagcagtaaatctcctaaataatatgggtccagca

SEQ ID NO: 2095 - DNA, 71 bp, chicken (Gallus Gallus)
  misc_feature (36): n=c or t
tgtggcgccaccactctgagcttgagtcaaaatagnagtctgtggaatagcatcatgtgaatttcccatca

SEQ ID NO: 2096 - DNA, 71 bp, chicken (Gallus Gallus)
  misc_feature (36): n=c or t
tgtgtctgacaagcacaaatctctttggtactgtgntgcttttcaccttggtttcccttctagttggtaca

SEQ ID NO: 2097 - DNA, 71 bp, chicken (Gallus Gallus)
  misc_feature (36): n=c or t
tgtgtttgctcctttgccacccaaacaccgtatacnaaaaacataagctttcacctacacgttgaaggaca

SEQ ID NO: 2098 - DNA, 71 bp, chicken (Gallus Gallus)
  misc_feature (36): n=c or t
tgttcaagctgaggctgcaccaatgggatatacagngggaggatcatcttcactcagtgggaccatcactc

SEQ ID NO: 2099 - DNA, 71 bp, chicken (Gallus Gallus)
  misc_feature (36): n=a or g
tgttgtgtgtgtggatattttttttcaataggctcncagctccaacagagtcagttttgcagctttataga

SEQ ID NO: 2100 - DNA, 71 bp, chicken (Gallus Gallus)
  misc_feature (36): n=a or g
tgtttcatccttccccaaagaaacattgtcctgcanaaggacagctttacagaaatcattcaaaaagccaa

SEQ ID NO: 2101 - DNA, 71 bp, chicken (Gallus Gallus)
  misc_feature (36): n=a or g
tgtttctgctcgcagtattctaaagctgaatgttanaagtgccttctgtcttaaaatcctaaaccaaatac

SEQ ID NO: 2102 - DNA, 71 bp, chicken (Gallus Gallus)
  misc_feature (36): n=a or g
tgttttgcagtgccttttccctgctggaatgtaccnccagcagatcagacagcttgatctgttgttgcacc

SEQ ID NO: 2103 - DNA, 71 bp, chicken (Gallus Gallus)
  misc_feature (36): n=a or g
tgtttttctctgcttccctttgctctcaacctcatnctaaagtacaatgatagtgtcaagactgtttgcac

SEQ ID NO: 2104 - DNA, 71 bp, chicken (Gallus Gallus)
  misc_feature (36): n=a or g
ttaaagtgaagtgcatctcagcactgtacacagacnagtatgtttgaaaaatctttaacactgttgttatt

SEQ ID NO: 2105 - DNA, 71 bp, chicken (Gallus Gallus)
  misc_feature (36): n=c or t
ttaaaagaagcacaacagcaaaaaaacagcaacaanaacaaaaaccaatgtgctgagtatatcattcatct

SEQ ID NO: 2106 - DNA, 71 bp, chicken (Gallus Gallus)
  misc_feature (36): n=a or g
ttaacagtcctacagcttcactcaggcaacttcacnggcacttttctgtagcaaatgcaactggcaatgga

SEQ ID NO: 2107 - DNA, 71 bp, chicken (Gallus Gallus)
  misc_feature (36): n=a or g
ttaagcacaggtaacaaactaaaaattccccagctngacccatttccaaacagctcctacatctccactgc

SEQ ID NO: 2108 - DNA, 71 bp, chicken (Gallus Gallus)
  misc_feature (36): n=g or t
ttaattaccaaactcttaaatatggtagaatcactngttctagtgccttatttttcctttatggatgagaa

SEQ ID NO: 2109 - DNA, 71 bp, chicken (Gallus Gallus)
  misc_feature (36): n=c or t
ttacaagcagtgcaagaacagaactaacattccatngcttgtgttttcagggagctgaaagagtaagtaaa

SEQ ID NO: 2110 - DNA, 71 bp, chicken (Gallus Gallus)
  misc_feature (36): n=a or g
ttacagcctgtgttcagttcctttacacctgtgggnaaattctcagctgcataaggcataggtaatctgta

SEQ ID NO: 2111 - DNA, 71 bp, chicken (Gallus Gallus)
  misc_feature (36): n=g or t
ttactcttgtcattctgtagattctggttttgatcncttgagttcttgaaggtagcaattgtgaaattgtc

SEQ ID NO: 2112 - DNA, 71 bp, chicken (Gallus Gallus)
  misc_feature (36): n=a or g
ttacttgcagaaactatttagcattttctcatgtcntccttactctgatttgttcatatcaagaagagtgc

SEQ ID NO: 2113 - DNA, 71 bp, chicken (Gallus Gallus)
  misc_feature (36): n=c or t
ttactttgcagagcttctttccagcaggtcagtccntaacctttactgatatttgctattaaatgtaaaac

SEQ ID NO: 2114 - DNA, 71 bp, chicken (Gallus Gallus)
  misc_feature (36): n=a or g
ttagaaacaagagatggggaagccttccagctggtnaaggtttgactcaaaagggaaaaagagcgcccagt

SEQ ID NO: 2115 - DNA, 71 bp, chicken (Gallus Gallus)
  misc_feature (36): n=c or t
ttaggcattttgcccattttgtaactgaaaacaatnaaatagcatcacaagttcagcccattgtaccttag

SEQ ID NO: 2116 - DNA, 71 bp, chicken (Gallus Gallus)
  misc_feature (36): n=c or t
ttagtaaaaataaatagaaaatgagaaaagcagttntaaaatttccagctggacctatttatatcctctgc

SEQ ID NO: 2117 - DNA, 71 bp, chicken (Gallus Gallus)
  misc_feature (36): n=c or t
ttagtttttttttttaattcatttttgctccacagncttctctgtggtgacccagggtatttgaattgaat

SEQ ID NO: 2118 - DNA, 71 bp, chicken (Gallus Gallus)
  misc_feature (36): n=a or g
ttatacagttcaccctatttagtagaatcttgatancattttactgtagtttcacattgttaaaattcatt

SEQ ID NO: 2119 - DNA, 71 bp, chicken (Gallus Gallus)
  misc_feature (36): n=a or g
ttatatctaggaaccctgagtgatttaaggcatgcnatgaaataaagaagcaggctgagctgaccttgctc

SEQ ID NO: 2120 - DNA, 71 bp, chicken (Gallus Gallus)
  misc_feature (36): n=a or g
ttattagctatcaatgaactaatgacaccagaaganaaggctaagctttttactgctattggctatagtga

SEQ ID NO: 2121 - DNA, 71 bp, chicken (Gallus Gallus)
  misc_feature (36): n=a or g
ttatttagtgcacagtgtggagagaagagggagtgngggatcctgccaggatagattgaaaagctattgat

SEQ ID NO: 2122 - DNA, 71 bp, chicken (Gallus Gallus)
  misc_feature (36): n=c or t
ttcactggagctgcttacatggagtcatgtttctgncgtgggatttctctgtttatagaaacttggggttt

SEQ ID NO: 2123 - DNA, 71 bp, chicken (Gallus Gallus)
  misc_feature (36): n=a or g
ttcagatcccatctgaaacaatggagcaagatctcncattgtttacagcttaactattagatgtcaagcac

SEQ ID NO: 2124 - DNA, 71 bp, chicken (Gallus Gallus)
  misc_feature (36): n=c or t
ttcagccagtggtaccttctaaacataattacttangtttattcatcacttgagctggtccaaagccactt

SEQ ID NO: 2125 - DNA, 71 bp, chicken (Gallus Gallus)
  misc_feature (36): n=a or g
ttcagtcctcatgagactggaagtactctatttagncatgtaaaataaccagtgaagagctgtgtgggttc

SEQ ID NO: 2126 - DNA, 71 bp, chicken (Gallus Gallus)
  misc_feature (36): n=c or t
ttcagtctcagtacctgtctggcagagtccaacccncatctgaccacatttcttcttgtccaatgcgtttc

SEQ ID NO: 2127 - DNA, 71 bp, chicken (Gallus Gallus)
  misc_feature (36): n=c or t
ttcatctttttataattactgtactgaactactcgngcatagtaggtataacttcataccctttccttaca

SEQ ID NO: 2128 - DNA, 71 bp, chicken (Gallus Gallus)
  misc_feature (36): n=a or g
ttcatgatgtttcactggaggttaatttatactcanacataacttattatcggatttgggacagagttatg

SEQ ID NO: 2129 - DNA, 71 bp, chicken (Gallus Gallus)
  misc_feature (36): n=a or g
ttcccctggtctcttcgtttttgcgttaggctcccngagatgcgattagctttaacgtagtttgttagaga

SEQ ID NO: 2130 - DNA, 71 bp, chicken (Gallus Gallus)
  misc_feature (36): n=a or g
ttccgagaggatgtttctgtcccaaatctcttacanttttgagttccaatcttctgtgccttgtttaaaac

SEQ ID NO: 2131 - DNA, 71 bp, chicken (Gallus Gallus)
  misc_feature (36): n=a or g
ttcctgagcctgtctagagtagatgtttttctttcnttagcttgtcatagttgtttgcaaattaactccat

SEQ ID NO: 2132 - DNA, 71 bp, chicken (Gallus Gallus)
  misc_feature (36): n=a or g
ttcctgcttgtcaggttaatcctgaatgaaatgganaaccagcttcatcttcactgttatcttccactttg

SEQ ID NO: 2133 - DNA, 71 bp, chicken (Gallus Gallus)
  misc_feature (36): n=c or t
ttctagcaatgtccgggtagctcttcctccagaagncttctctattaatacctgaacagagaggtgaaatc

SEQ ID NO: 2134 - DNA, 71 bp, chicken (Gallus Gallus)
  misc_feature (36): n=a or g
ttctatcccattcttggaaggcaggaaagtgagacngagaagatgccacagaaacccttgtttcaggagga

SEQ ID NO: 2135 - DNA, 71 bp, chicken (Gallus Gallus)
  misc_feature (36): n=c or t
ttctcaccaggagctccttcctggtggccagcagangtctggaaatgcttagcactagaacatcacatctc

SEQ ID NO: 2136 - DNA, 71 bp, chicken (Gallus Gallus)
  misc_feature (36): n=a or g
ttctgctatgctaattcagctgctcagtgcttgatnaaaaggaagctttgctcaggtcataacgctaggac

SEQ ID NO: 2137 - DNA, 71 bp, chicken (Gallus Gallus)
  misc_feature (36): n=a or g
ttctgggtgagaatttttgtatatagccatttctcngaagctggtctgcactttaataaaggagttactgg

SEQ ID NO: 2138 - DNA, 71 bp, chicken (Gallus Gallus)
  misc_feature (36): n=a or g
ttctggtatttacattctgcgatcaaagctgctgcnttccatgcaggtagtgtaatctttggtccaacata

SEQ ID NO: 2139 - DNA, 71 bp, chicken (Gallus Gallus)
  misc_feature (36): n=g or t
ttctgtcatgtctttcctaaaacaatttttttttcnaggctgaaagaatccaaagcttttaaaaacatata

SEQ ID NO: 2140 - DNA, 71 bp, chicken (Gallus Gallus)
  misc_feature (36): n=a or g
ttcttcctgttgtgctgtatttatttgtttttactnattacatagggatcctagaagttacttcaggttct

SEQ ID NO: 2141 - DNA, 71 bp, chicken (Gallus Gallus)
  misc_feature (36): n=a or g
ttcttctcctccacatactgattatcagctctgttnatatgggaatgtctccagtatctaatattacatca

SEQ ID NO: 2142 - DNA, 71 bp, chicken (Gallus Gallus)
  misc_feature (36): n=c or t
ttcttggccacctgggcacgctgctggctcatgttnaggcaagtgttgaccaacactctcagacccttttc

SEQ ID NO: 2143 - DNA, 71 bp, chicken (Gallus Gallus)
  misc_feature (36): n=a or g
ttgaaaacaagtagtttatttctgctttatcattantaagccttttaatagctctcaacaaattgtctcag

SEQ ID NO: 2144 - DNA, 71 bp, chicken (Gallus Gallus)
  misc_feature (36): n=a or g
ttgacttgccgaaactaaatatttgtgatgtgtgcntggcatttttcctgcttccagattttggcttgaaa

SEQ ID NO: 2145 - DNA, 71 bp, chicken (Gallus Gallus)
  misc_feature (36): n=a or g
ttgagccattgatgcttttgattgatttatggatcnggcatgaattctcgtaatctacaacagaatggcag

SEQ ID NO: 2146 - DNA, 71 bp, chicken (Gallus Gallus)
  misc_feature (36): n=a or g
ttgagtacccttgttttgacttaacagtgctgctcntgtatgcttactttatgcataagtggtctaataca

SEQ ID NO: 2147 - DNA, 71 bp, chicken (Gallus Gallus)
  misc_feature (36): n=a or g
ttgagtgggagggcacagcgtggcaggggagaagcncccgtgaggttttagaactagttctgtggtgtctg

SEQ ID NO: 2148 - DNA, 71 bp, chicken (Gallus Gallus)
  misc_feature (36): n=a or g
ttgagttcaagcccctgctaaagcaggtaccctacnatcattcacacaggtaggcaacgagagaggttttg

SEQ ID NO: 2149 - DNA, 71 bp, chicken (Gallus Gallus)
  misc_feature (36): n=c or t
ttgagttgttcttccttccccccctcagccccccancattttcaggttgtctggttgcagctttgttctga

SEQ ID NO: 2150 - DNA, 71 bp, chicken (Gallus Gallus)
  misc_feature (36): n=a or g
ttgatactgcaatggtgcatgcagtgaaatggcacntcccaagtgtggagctgccaatgagagatccaaga

SEQ ID NO: 2151 - DNA, 71 bp, chicken (Gallus Gallus)
  misc_feature (36): n=c or t
ttgatatgaaattgctttctctaatggttgcttgcnattcccagctgtgaatattcaatactttggtgcac

SEQ ID NO: 2152 - DNA, 71 bp, chicken (Gallus Gallus)
  misc_feature (36): n=a or c
ttgctcctccttgactcttggcagctcagccctggnctgtgatggccgcagtcttggaactgaattaccct

SEQ ID NO: 2153 - DNA, 71 bp, chicken (Gallus Gallus)
  misc_feature (36): n=a or g
ttgcttctggccacgaaccttaatcggaaactctgntgtactcaaccatgcgaaatagaagaccttgtcaa

SEQ ID NO: 2154 - DNA, 71 bp, chicken (Gallus Gallus)
  misc_feature (36): n=a or g
ttgctttgagccatgcaggaatttactcacatttcntaatgcgtttgtatgttagtagctccacaggagaa

SEQ ID NO: 2155 - DNA, 71 bp, chicken (Gallus Gallus)
  misc_feature (36): n=a or g
ttggccagcagctgtgactctgtgccttgctgtacnttgtaggagtgggacagtggctgacgatcaccact

SEQ ID NO: 2156 - DNA, 71 bp, chicken (Gallus Gallus)
  misc_feature (36): n=a or g
ttgtcatgttctggaagagatctctttgggatatcngtttgtacagaatggaggaatctgttgagtagcca

SEQ ID NO: 2157 - DNA, 71 bp, chicken (Gallus Gallus)
  misc_feature (36): n=c or t
ttgtgcctggcaggatttactcttcctaaactgtanagcttgtcttgctgtcctgtttttctcgagtcttc

SEQ ID NO: 2158 - DNA, 71 bp, chicken (Gallus Gallus)
  misc_feature (36): n=c or t
ttgtggagaaaacaaaattagaagtctaaaaatagnatttagtttgccatattttgttcctatgagctgga

SEQ ID NO: 2159 - DNA, 71 bp, chicken (Gallus Gallus)
  misc_feature (36): n=a or g
tttaaccaaatggcagaatggcctctgttttagagnaggcttatgatggtgtcttctggacttgaaatgag

SEQ ID NO: 2160 - DNA, 71 bp, chicken (Gallus Gallus)
  misc_feature (36): n=a or g
tttacaaactatttggatataaagattgcactgatngatgaacaataataagtaataaaacaggaaattag

SEQ ID NO: 2161 - DNA, 71 bp, chicken (Gallus Gallus)
  misc_feature (36): n=a or g
tttacttcattttaggcatagcatattagctgggtnctcaactaagccctaaaagcactcaagacaaacct

SEQ ID NO: 2162 - DNA, 71 bp, chicken (Gallus Gallus)
  misc_feature (36): n=c or t
tttagccgtggatttctgcatagctttatgttatcntacaagaactggtattggataattcctataattgc

SEQ ID NO: 2163 - DNA, 71 bp, chicken (Gallus Gallus)
  misc_feature (36): n=c or t
tttagctgctggagagaagtatttcagtcagaagtngctatactttggtgaagcacaacgatcacttataa

SEQ ID NO: 2164 - DNA, 71 bp, chicken (Gallus Gallus)
  misc_feature (36): n=c or t
tttagcttcctttgtatctcctcagagtcacaagtntcatagacaattggtttggacagctctgactcaat

SEQ ID NO: 2165 - DNA, 71 bp, chicken (Gallus Gallus)
  misc_feature (36): n=a or g
tttatatgtgcaagatttaccattccctgtcacccntgagctggaggaatcatttcctaattatcaggatt

SEQ ID NO: 2166 - DNA, 71 bp, chicken (Gallus Gallus)
  misc_feature (36): n=a or g
tttattttccccagtgttgccactaaaccagcagcntgaagctttcattgcagccatagagagaagcccac

SEQ ID NO: 2167 - DNA, 71 bp, chicken (Gallus Gallus)
  misc_feature (36): n=c or t
tttatttttctatattatgttactatttagctaatnctatttgtctgagaaattatctttgcaactgctga

SEQ ID NO: 2168 - DNA, 71 bp, chicken (Gallus Gallus)
  misc_feature (36): n=c or t
tttcaagctacatcagctctgaaactcttcttaggnggcagtcaattaatactcagtgccttgaaaaaaac

SEQ ID NO: 2169 - DNA, 71 bp, chicken (Gallus Gallus)
  misc_feature (36): n=c or t
tttcacgaatgtttataagctcagcttcctttacanggacatctatatatttgaaatcctctgcatcctcc

SEQ ID NO: 2170 - DNA, 71 bp, chicken (Gallus Gallus)
  misc_feature (36): n=c or t
tttcaggccttcaatgagtagaagaggaatttgcanggttaccacttgattttactactttttgcctccaa

SEQ ID NO: 2171 - DNA, 71 bp, chicken (Gallus Gallus)
  misc_feature (36): n=c or t
tttcctcataccacgctaattctcattttcttttcnaattagagagatagttctaaagtatggatccacca

SEQ ID NO: 2172 - DNA, 71 bp, chicken (Gallus Gallus)
  misc_feature (36): n=c or t
tttctacatatagctagtttctcatctggctcccantcttatgcttcttggtggttacttgtgtggcaaat

SEQ ID NO: 2173 - DNA, 71 bp, chicken (Gallus Gallus)
  misc_feature (36): n=a or g
tttctattttgttccaagtagcatatagccagatcntgtctagattagctaataatagattaggtatggta

SEQ ID NO: 2174 - DNA, 71 bp, chicken (Gallus Gallus)
  misc_feature (36): n=a or g
tttctgccaagcttccttaattccctgggggagcanattcaggcttctggcacctctagcaaaggttggtt

SEQ ID NO: 2175 - DNA, 71 bp, chicken (Gallus Gallus)
  misc_feature (36): n=a or c
tttgacaccatctttccgcaacccaatgttcatttnccaaataagattaaagagggatctttgtagacttt

SEQ ID NO: 2176 - DNA, 71 bp, chicken (Gallus Gallus)
  misc_feature (36): n=a or g
tttgagttaatactaccttattccagcagtgcatcntgaaaggtaaataagaggtgcgtactaagaactgt

SEQ ID NO: 2177 - DNA, 71 bp, chicken (Gallus Gallus)
  misc_feature (36): n=g or t
tttgctttaatttacctattgtgaggaatctttgtngtttgggtgggagcaactcaatgtaattatcatgt

SEQ ID NO: 2178 - DNA, 71 bp, chicken (Gallus Gallus)
  misc_feature (36): n=a or g
tttggtgtgttggtgcagagtcgaataggctatgtngaaatacatgattatctttaagtagaagggattta

SEQ ID NO: 2179 - DNA, 71 bp, chicken (Gallus Gallus)
  misc_feature (36): n=a or g
tttgtcaattcgaaaggcaagctaagcaattttctntcaaaatccattgtattcccaaatgaatgttgggt

SEQ ID NO: 2180 - DNA, 71 bp, chicken (Gallus Gallus)
  misc_feature (36): n=c or t
tttgtgtagcagtggtttcaggaacataaattgtcnctaaaatgccattatatttcactcagtctgagaaa

SEQ ID NO: 2181 - DNA, 71 bp, chicken (Gallus Gallus)
  misc_feature (36): n=c or t
tttgtgtgaaaaacttccccctaagttagaaatttncatgtgagggaatttgtttgctaaaagccctttct

SEQ ID NO: 2182 - DNA, 71 bp, chicken (Gallus Gallus)
  misc_feature (36): n=c or t
ttttaaatgagaaagtttacccaaacatctgacttngtgacgtaaagcttttgttcagactgcgttcagca

SEQ ID NO: 2183 - DNA, 71 bp, chicken (Gallus Gallus)
  misc_feature (36): n=a or g
ttttatgagctctacttattgagcagaggatccatnatttttagaccgcagaatttggccttctcaatcaa

SEQ ID NO: 2184 - DNA, 71 bp, chicken (Gallus Gallus)
  misc_feature (36): n=g or t
ttttattattttttttttaaaaaagcttctttccangttaaagggagttagtacagttgttgcctcttcct

SEQ ID NO: 2185 - DNA, 71 bp, chicken (Gallus Gallus)
  misc_feature (36): n=c or t
ttttcactgtttttgagtgcatagtttattaggtgnataatttaattgctgatattccactggcactagat

SEQ ID NO: 2186 - DNA, 71 bp, chicken (Gallus Gallus)
  misc_feature (36): n=a or c
ttttcagcaggcccagtgggaatgtgcagctctccnaatctgttcctgtatgccaaacataaggcagttta

SEQ ID NO: 2187 - DNA, 71 bp, chicken (Gallus Gallus)
  misc_feature (36): n=a or g
ttttggactgttttccaccacctgggaagtggggtnaaaacagattgtaaagctgtcagtcctatttaagt

SEQ ID NO: 2188 - DNA, 71 bp, chicken (Gallus Gallus)
  misc_feature (36): n=g or t
ttttggttacttggcactcacctcttttttggaagnctttccctagcagaggtataccagaattccctctt

SEQ ID NO: 2189 - DNA, 71 bp, chicken (Gallus Gallus)
  misc_feature (36): n=a or g
tttttaatatctgaagtacacaacaaaccgagtatngcaatgattacttactgtcctactttgcaagaata

SEQ ID NO: 2190 - DNA, 71 bp, chicken (Gallus Gallus)
  misc_feature (36): n=c or t
tttttacattccaaacattcacactgctgtgcttgnaagaactcaattatgcagctaaaggaaaagtcatt

SEQ ID NO: 2191 - DNA, 71 bp, chicken (Gallus Gallus)
  misc_feature (36): n=c or t
tttttcatgcatatcagcctcgagctcactcagtcnatcaataacctctgcaatgaaaatcggatgagaaa

SEQ ID NO: 2192 - DNA, 71 bp, chicken (Gallus Gallus)
  misc_feature (36): n=c or t
tttttctgatgacttttttaactttaaataaaatgntctatattacttgttccatttattttgctacattt

SEQ ID NO: 2193 - DNA, 71 bp, chicken (Gallus Gallus)
  misc_feature (36): n=c or t
tttttcttccaaaggctgcttttgtgaaagcaagcncaaaatatttaaacaagcctgggtccgtctgagga

SEQ ID NO: 2194 - DNA, 71 bp, chicken (Gallus Gallus)
  misc_feature (36): n=c or t
tttttttctcagattctctcccccatccccctcagngaaaggatatgtggcatttagctgtctgctgggct

SEQ ID NO: 2195 - DNA, 71 bp, chicken (Gallus Gallus)
  misc_feature (36): n=a or g
agggaagtgtccatgagctccatgcagatccaaacntcgccctgcaggtagagagaaagtagctataggga

SEQ ID NO: 2196 - DNA, 71 bp, chicken (Gallus Gallus)
  misc_feature (36): n=a or g
agtttacctggataggtcttcacgaagttcatcttnttgaagtcctctgaaatatgaaactcctaaaatca

SEQ ID NO: 2197 - DNA, 71 bp, chicken (Gallus Gallus)
  misc_feature (36): n=c or t
gtcaattagatgctaagagcaaaggcaggaattaanacccctagttcagaaggggaaagcaggagcaggct

SEQ ID NO: 2198 - DNA, 71 bp, chicken (Gallus Gallus)
  misc_feature (36): n=c or t
cctcttttgagcactacctccctctgctgtcctgcngcagctccacactttgactgcagaaggtgacctcc

SEQ ID NO: 2199 - DNA, 71 bp, chicken (Gallus Gallus)
  misc_feature (36): n=a or g
ggcagttaatgaaagcaccctctagcttggaaactnaagaaatgcgccatggcaaaaaagaaacaaagaat

SEQ ID NO: 2200 - DNA, 71 bp, chicken (Gallus Gallus)
  misc_feature (36): n=a or g
agctggtgccagcaagaaattacatgaaaaatacancgagtttctagctggaaaactgaatatatttcttc

SEQ ID NO: 2201 - DNA, 71 bp, chicken (Gallus Gallus)
  misc_feature (36): n=c or t
ttagttaccatctttgaaggagctttaccattgtgnggacagtaccaccagagatttgtcaggttatcttt

SEQ ID NO: 2202 - DNA, 71 bp, chicken (Gallus Gallus)
  misc_feature (36): n=c or t
tttcattacttgtgttcatataaatgaaatgtatgntcttctccttactgataactaaaaaaacccaccag

SEQ ID NO: 2203 - DNA, 71 bp, chicken (Gallus Gallus)
  misc_feature (36): n=a or g
cacgtggcaatttactgagaaaccaacagctgcttncttgtattttgagtgtcagtcatgttacaggatat

SEQ ID NO: 2204 - DNA, 71 bp, chicken (Gallus Gallus)
  misc_feature (36): n=c or t
aagttcaaacttctgtaggctcttgcggatgaggantttcccttaatctccccctctactgctatcagcaa

SEQ ID NO: 2205 - DNA, 71 bp, chicken (Gallus Gallus)
  misc_feature (36): n=a or g
tgcaggaaacatctagacagctcaaccaaacgagcncagtgacatatggatgtgctttgccatggagttct

SEQ ID NO: 2206 - DNA, 71 bp, chicken (Gallus Gallus)
  misc_feature (36): n=a or g
ccaaacaagtgttagacctctcttacacattcggtnggatctaaatactatgaatgaaatagctaaatctg

SEQ ID NO: 2207 - DNA, 71 bp, chicken (Gallus Gallus)
  misc_feature (36): n=c or t
atcctttccagttaccattcccacagctggaatcanagaatcattaaagttggcaagactaatatggtcat

SEQ ID NO: 2208 - DNA, 71 bp, chicken (Gallus Gallus)
  misc_feature (36): n=a or g
tgcatacaactagtgatcagaacaattgtgcctctntagtctttcactatttagttgattatgctttgtgg

SEQ ID NO: 2209 - DNA, 71 bp, chicken (Gallus Gallus)
  misc_feature (36): n=g or t
ttcagcacatggtcttgttgaacttcatgggattgntgatagctaattgtatctgaaacaacgctgttaga

SEQ ID NO: 2210 - DNA, 71 bp, chicken (Gallus Gallus)
  misc_feature (36): n=c or t
gctggaattgtgttatattagccctagggtatatgntattactaaagaaacaaattcagcatttaattaac

SEQ ID NO: 2211 - DNA, 71 bp, chicken (Gallus Gallus)
  misc_feature (36): n=a or g
taatgtgctcccaaagttcagccctatgctgggagntacagagagtaagctgaaattgtactttaacttct

SEQ ID NO: 2212 - DNA, 71 bp, chicken (Gallus Gallus)
  misc_feature (36): n=c or t
ctttttattgccaatcttttttccgacattatctgncttctcctgtacataaacacataagaacacataag

SEQ ID NO: 2213 - DNA, 71 bp, chicken (Gallus Gallus)
  misc_feature (36): n=a or g
caaggagaaaactgttacaaggaacattggtagtcntacatcccaattctgagcttcactgtcaattcaga

SEQ ID NO: 2214 - DNA, 71 bp, chicken (Gallus Gallus)
  misc_feature (36): n=a or g
gcctacagatagtggcagccttttcccagtcccacngtagctctagcacctgtggtatttcaaggaaagaa

SEQ ID NO: 2215 - DNA, 71 bp, chicken (Gallus Gallus)
  misc_feature (36): n=a or g
tcgtctccttccagattctattgtttaccacaggcncaaatgaagtagctgaagatgtaaacaaagtccag

SEQ ID NO: 2216 - DNA, 71 bp, chicken (Gallus Gallus)
  misc_feature (36): n=c or t
caaaagtaaatctggcacctggctttccttttacangcttgtggatcagcaccgagagtagagctcatgtc

SEQ ID NO: 2217 - DNA, 71 bp, chicken (Gallus Gallus)
  misc_feature (36): n=c or t
catggaaaagcaaattgtctgccttttcactcgaanacttaggctggcctgcagtgcagctcccagagcat

SEQ ID NO: 2218 - DNA, 71 bp, chicken (Gallus Gallus)
  misc_feature (36): n=a or g
gtaccacatccttatctctaaattggagagatatgnatttgaacgttggacaatttggtggataaataatt

SEQ ID NO: 2219 - DNA, 71 bp, chicken (Gallus Gallus)
  misc_feature (36): n=c or t
ctgaatgtctgcattaaatctcacattagtggaaancagaagtgaaaagctagtttaattcacagtgtcat

SEQ ID NO: 2220 - DNA, 71 bp, chicken (Gallus Gallus)
  misc_feature (36): n=a or g
attgcagaagtatacagaaaaatgtcatctgcagtnccagtttgtaccttgcagtagagcagtttttttag

SEQ ID NO: 2221 - DNA, 71 bp, chicken (Gallus Gallus)
  misc_feature (36): n=c or t
agagctacttttgtccattaattctctgcagacatncagacacatttgggagaaactcaacatccttcaaa

SEQ ID NO: 2222 - DNA, 71 bp, chicken (Gallus Gallus)
  misc_feature (36): n=c or t
ttatgtctagtctagcttaacattcccttctcttcnctttttgtaaggatttctttctttactctttctct

SEQ ID NO: 2223 - DNA, 71 bp, chicken (Gallus Gallus)
  misc_feature (36): n=c or t
ctgcacggccacccagagctgcttgctcagaaccangtcctggtgacttttgaaggtctccatggatggag

SEQ ID NO: 2224 - DNA, 71 bp, chicken (Gallus Gallus)
  misc_feature (36): n=g or t
gcagcaccaggcactgctcacccgtgtctgtgttanggagaaatggtgtttggaggcgatgcagtttgcta

SEQ ID NO: 2225 - DNA, 71 bp, chicken (Gallus Gallus)
  misc_feature (36): n=c or t
cattggatgcctatatttaagcaaatgaacaaaggnctgtgatcaccttggccagcttagatggaaggggg

SEQ ID NO: 2226 - DNA, 71 bp, chicken (Gallus Gallus)
  misc_feature (36): n=c or t
caaacctcacttggaacaacttaagcccacagtttnctttacccagcagctttcctctctacatctgtctc

SEQ ID NO: 2227 - DNA, 71 bp, chicken (Gallus Gallus)
  misc_feature (36): n=c or t
tttttgctgttaacaaagcaacaaagcagcagaacnttactttagagaaacaatttccatagaatttttta

SEQ ID NO: 2228 - DNA, 71 bp, chicken (Gallus Gallus)
  misc_feature (36): n=a or c
taaccaaatacactttagaactctaacttcagtacngagtttgaactttaagagttctcgttacaaaaaac

SEQ ID NO: 2229 - DNA, 71 bp, chicken (Gallus Gallus)
  misc_feature (36): n=c or t
gattgcattcatcagtgcctaataaggtaaagttcntactgacactttccccatggtttgaatatttctaa

SEQ ID NO: 2230 - DNA, 71 bp, chicken (Gallus Gallus)
  misc_feature (36): n=c or t
gctcattaacattttttgaaggaaaatataagcccncttctcttatgagttccatacacatagaccactgt

SEQ ID NO: 2231 - DNA, 71 bp, chicken (Gallus Gallus)
  misc_feature (36): n=a or g
tggttatgtcccaggtcccacctgaagccaagacgncactggatcataaactcagacctaggaatccagaa

SEQ ID NO: 2232 - DNA, 71 bp, chicken (Gallus Gallus)
  misc_feature (36): n=c or t
tcatattcattagaaaggtagaaatcgtagaatcanagaatccttacagttagaaattaaagggagattgc

SEQ ID NO: 2233 - DNA, 71 bp, chicken (Gallus Gallus)
  misc_feature (36): n=a or g
gactgcagctgattacaggtgaaagagatctctacngttgttcttcagaaaggtggaaagtacttggacaa

SEQ ID NO: 2234 - DNA, 71 bp, chicken (Gallus Gallus)
  misc_feature (36): n=g or t
agtttttgcaccttcctactgtagctcagaatgganaggaagactgtccacaggctttgtggctgaaactt

SEQ ID NO: 2235 - DNA, 71 bp, chicken (Gallus Gallus)
  misc_feature (36): n=c or t
cagactgtatcaccagtgtctcaaggaatccacttngtagcaacatatttacactgtgagccattctccac

SEQ ID NO: 2236 - DNA, 71 bp, chicken (Gallus Gallus)
  misc_feature (36): n=a or g
acaacagaaagaaaggaaggaaatagccttgactcntgaacactgtgacaatcaagaaaaacgattgtaca

SEQ ID NO: 2237 - DNA, 71 bp, chicken (Gallus Gallus)
  misc_feature (36): n=a or g
tctagcatcttgttaagaagctaattttaagtaacncttttgactgaaaaccagaacaatttcttttttat

SEQ ID NO: 2238 - DNA, 71 bp, chicken (Gallus Gallus)
  misc_feature (36): n=a or g
catgagctatgaacttcaagttagcagaaaatgatngaagttacactttaaaaatgggaacttaaaaatgt

SEQ ID NO: 2239 - DNA, 71 bp, chicken (Gallus Gallus)
  misc_feature (36): n=c or t
ggctactgtgatttcataaaaactaccagttagctngtggctccacatcattgtatcactctgttgtagga

SEQ ID NO: 2240 - DNA, 71 bp, chicken (Gallus Gallus)
  misc_feature (36): n=a or g
tcagtccatcacaaaatgaccttcaaaatggagacngggcaagcttctgtatgcttgaagattcataacat

SEQ ID NO: 2241 - DNA, 71 bp, chicken (Gallus Gallus)
  misc_feature (36): n=a or g
ttgtacctttgctttcttctgttttcagaagatgcncttctgccaactttcacatagctttatgctgcttt

SEQ ID NO: 2242 - DNA, 71 bp, chicken (Gallus Gallus)
  misc_feature (36): n=c or t
atttctttgcaaatgatcatagcagacagaccaganagcttttctgttttcaggattaaaagaaataaaat

SEQ ID NO: 2243 - DNA, 71 bp, chicken (Gallus Gallus)
  misc_feature (36): n=a or g
tgctggtggagaaaaatgccaccgaactgtataaangaagtactgagctagagcttttaaactgtcaaatc

SEQ ID NO: 2244 - DNA, 71 bp, chicken (Gallus Gallus)
  misc_feature (36): n=c or t
agaatttgggttcttcttctcatcatggtgtaaganacagctcagaaactctttccccttgagagtcaaaa

SEQ ID NO: 2245 - DNA, 71 bp, chicken (Gallus Gallus)
  misc_feature (36): n=a or c
agagcaggatattttaataatataatagaatgattnatctccgctatagctcacagatgtccaacacaaaa

SEQ ID NO: 2246 - DNA, 71 bp, chicken (Gallus Gallus)
  misc_feature (36): n=a or g
cacacctatattaaagagagatatcttcctactcgntctccactgcacatgatggagggagagctgtgcgt

SEQ ID NO: 2247 - DNA, 71 bp, chicken (Gallus Gallus)
  misc_feature (36): n=g or t
caggctctagaggtaaaaaatgcttactgggaaaanatgttgaattcttaatattccattaaaagcaatat

SEQ ID NO: 2248 - DNA, 71 bp, chicken (Gallus Gallus)
  misc_feature (36): n=c or t
ttcctcacagctaccttcaggacgatgacattcccntcacctgagctcaatgtacagtatgtgaccttctc

SEQ ID NO: 2249 - DNA, 71 bp, chicken (Gallus Gallus)
  misc_feature (36): n=c or t
ccaaaatctgctttctctcagagctcataaaaatgnaccacaaactaggagcaaaatcttaattggggcaa

SEQ ID NO: 2250 - DNA, 71 bp, chicken (Gallus Gallus)
  misc_feature (36): n=a or g
ttcagattcttcaaaggtcagagatactcagcaaanaagccaagaagtttctgcactcccctttccactac

SEQ ID NO: 2251 - DNA, 71 bp, chicken (Gallus Gallus)
  misc_feature (36): n=c or t
tgctggatacaatctcaacaactccatctgttaganccaagtgtattttccaaagcccagctttagagaga

SEQ ID NO: 2252 - DNA, 71 bp, chicken (Gallus Gallus)
  misc_feature (36): n=a or g
gcacctaacctgctctggtgtcagctttgccttgcngataaatggtgacacctttcagagctgtggacacc

SEQ ID NO: 2253 - DNA, 71 bp, chicken (Gallus Gallus)
  misc_feature (36): n=a or c
tagtagtttccaatctcagggttgattgtactgtgngcttggtgatgggaaatgccagtggtctggcattc

SEQ ID NO: 2254 - DNA, 71 bp, chicken (Gallus Gallus)
  misc_feature (36): n=c or t
tccctgatttgaattcagttgagtaacatctgtgcnacgaagctaagagcacagatttttcctgtggtatt

SEQ ID NO: 2255 - DNA, 71 bp, chicken (Gallus Gallus)
  misc_feature (36): n=c or t
acaaattaaagtgctatgtgcattttttcagctaanacatccgttctcttatgtattttgtgcttatttat

SEQ ID NO: 2256 - DNA, 71 bp, chicken (Gallus Gallus)
  misc_feature (36): n=c or t
tgacttctttttagggcttgggagaacagagcaccngtgtgtgtagcagcttgaggcaattaccaaattgc

SEQ ID NO: 2257 - DNA, 71 bp, chicken (Gallus Gallus)
  misc_feature (36): n=g or t
atgacacgagcaaaatccagtgactgagttttggtnctacactccttgcagttgtaaattagcagggttct

SEQ ID NO: 2258 - DNA, 71 bp, chicken (Gallus Gallus)
  misc_feature (36): n=a or g
tagcctttccagctcacagaagcaaaactcaactcnttgattattacaggacaaagagagagagaatgaaa

SEQ ID NO: 2259 - DNA, 71 bp, chicken (Gallus Gallus)
  misc_feature (36): n=a or g
ctcaacgtaggtttgaacagaggcattttttatcanataaacagatgggcaatatgtggactaattaaagc

SEQ ID NO: 2260 - DNA, 71 bp, chicken (Gallus Gallus)
  misc_feature (36): n=c or t
ctcacagctcattaatccttctgctcagggaattantctaattttaatctgctgagcagatacatagtact

SEQ ID NO: 2261 - DNA, 71 bp, chicken (Gallus Gallus)
  misc_feature (36): n=a or g
gggcattttgctccaaactatataccttgttggccnggcagaaaagtctgagcttggatctgtggccatct

SEQ ID NO: 2262 - DNA, 71 bp, chicken (Gallus Gallus)
  misc_feature (36): n=c or t
gtggtataacagatcagaaaaatatccatacccttntcccagtcttcattatagtaagccattctctcgct

SEQ ID NO: 2263 - DNA, 71 bp, chicken (Gallus Gallus)
  misc_feature (36): n=c or t
gacatttaaggggatgatgtcaatcaactcaagganggagacacagtcaatagtcactttacccactttac

SEQ ID NO: 2264 - DNA, 71 bp, chicken (Gallus Gallus)
  misc_feature (36): n=g or t
tagattccattttagcttctgagccattctattgancatttttgttttcctgagatttccaggacatacag

SEQ ID NO: 2265 - DNA, 71 bp, chicken (Gallus Gallus)
  misc_feature (36): n=a or g
aacactgtagaaattaccatttcctttgtactgctnaaaatactctaaaagagatgaaatattacttctaa

SEQ ID NO: 2266 - DNA, 71 bp, chicken (Gallus Gallus)
  misc_feature (36): n=c or t
acactcaacccctttactcaaccgttctccaaatcngaagatagctgcatactaaaattttttggattttt

SEQ ID NO: 2267 - DNA, 71 bp, chicken (Gallus Gallus)
  misc_feature (36): n=c or t
ttctgcttagcttatttttctcttgatgttctcagngcaaaaagcaatatgaactgcggtctatcttgttc

SEQ ID NO: 2268 - DNA, 71 bp, chicken (Gallus Gallus)
  misc_feature (36): n=c or t
tctgcctacttgtctcctgcatgaacttaagtgtcntcaaaattgaatgaagatttttgaaaaaaagaata

SEQ ID NO: 2269 - DNA, 71 bp, chicken (Gallus Gallus)
  misc_feature (36): n=a or c
ttaaaagtaacacaatttttcttagtggaacagaanatgcaaagaagcagctgtaatattagaaggaaagg

SEQ ID NO: 2270 - DNA, 71 bp, chicken (Gallus Gallus)
  misc_feature (36): n=a or g
tcattttatttcttcccaatcctgtattcacttacntttctgcaaatctagtgactctaaacagcacagat

SEQ ID NO: 2271 - DNA, 71 bp, chicken (Gallus Gallus)
  misc_feature (36): n=c or t
accaccaccaacaacaaaagaatcatgtgtgttacntaaaattatccaactgtaaatttataaccaacagt

SEQ ID NO: 2272 - DNA, 71 bp, chicken (Gallus Gallus)
  misc_feature (36): n=c or t
aaatatttccagctcctgattgcagcatgcaaaacngagcatgatcactacttctgaagtagttttaagac

SEQ ID NO: 2273 - DNA, 71 bp, chicken (Gallus Gallus)
  misc_feature (36): n=a or g
ataggacagcaactgcaccccagttctgtatatgantatgtcacagaagataagagttagaactcaggttg

SEQ ID NO: 2274 - DNA, 71 bp, chicken (Gallus Gallus)
  misc_feature (36): n=a or g
aataaaagctgtgtaaatagccatcttggatcgggnaagcattttagacttcttctggctgaaagttgcta

SEQ ID NO: 2275 - DNA, 71 bp, chicken (Gallus Gallus)
  misc_feature (36): n=a or g
ggcagggccagaggagagtcctgcagggctctgtgngtatttgagctggaaggtcccagctgctgaagagt

SEQ ID NO: 2276 - DNA, 71 bp, chicken (Gallus Gallus)
  misc_feature (36): n=a or g
ccatgatacttcttttgttatttgttgcgagttaantgccccatttttactctcgtccaactatcactccc

SEQ ID NO: 2277 - DNA, 71 bp, chicken (Gallus Gallus)
  misc_feature (36): n=c or t
atagggcaatgcactggtggctttctcaggagtacngcctggtaggaagctggatcaatatgggtactcga

SEQ ID NO: 2278 - DNA, 71 bp, chicken (Gallus Gallus)
  misc_feature (36): n=a or c
ctaatagaaagttccttgtctcaacagagaagtagnaattgcaaaatacctccattattaaggtgcttgaa

SEQ ID NO: 2279 - DNA, 71 bp, chicken (Gallus Gallus)
  misc_feature (36): n=c or t
agatgggagctagaactggtctaggagtgacataanattgctttctaataagaagacactggatatgggct

SEQ ID NO: 2280 - DNA, 71 bp, chicken (Gallus Gallus)
  misc_feature (36): n=a or g
ttttttttttttttccactacagctgcaagtagttncatcaacttgttagtggaccttagagatctaagta

SEQ ID NO: 2281 - DNA, 71 bp, chicken (Gallus Gallus)
  misc_feature (36): n=a or t
atctctgtagaggaactaatccagctctggcgaacnctgtcatgtttatacacgacactaaaattacttca

SEQ ID NO: 2282 - DNA, 71 bp, chicken (Gallus Gallus)
  misc_feature (36): n=g or t
ctgacaccgctattctagacttgacagatgggcagntcctccagctaggttgctctgagttgaggcaactg

SEQ ID NO: 2283 - DNA, 71 bp, chicken (Gallus Gallus)
  misc_feature (36): n=a or g
ctcagagctttgggatcccattctataaagcggccntttagtgccacttacactctgggatatagaatgcc

SEQ ID NO: 2284 - DNA, 71 bp, chicken (Gallus Gallus)
  misc_feature (36): n=a or t
ctgtaatgcaaagcacaaaataaataattgtatatntttagacttgggaaaataagtacatgctctgagat

SEQ ID NO: 2285 - DNA, 71 bp, chicken (Gallus Gallus)
  misc_feature (36): n=c or t
tagttatgtgcattttatatagtgtgcaaggcaaanggaattgttttaaagattccaaaatatgaaacaaa

SEQ ID NO: 2286 - DNA, 71 bp, chicken (Gallus Gallus)
  misc_feature (36): n=a or g
cttcatttcttacttcttgaaaatttgtaacatctntttcacccctgtaataatcataaaatgagaactgc

SEQ ID NO: 2287 - DNA, 71 bp, chicken (Gallus Gallus)
  misc_feature (36): n=g or t
atcggggcagtgaaacagccagggactctgcactgngaagcttgtctctacatggtcagtgggtctagaga

SEQ ID NO: 2288 - DNA, 71 bp, chicken (Gallus Gallus)
  misc_feature (36): n=c or t
gtacagaatagcaacacaaaattgcctccatttacngaaagtgcttgaaaccacctgctgaaatggtatat

SEQ ID NO: 2289 - DNA, 71 bp, chicken (Gallus Gallus)
  misc_feature (36): n=a or g
ctgccacaacaagcatggtccctggcttgttctaanctcctcactgtacctggacactgattcaggaaatg

SEQ ID NO: 2290 - DNA, 71 bp, chicken (Gallus Gallus)
  misc_feature (36): n=c or t
tggattttattagcttctgttagcaagatcgcagcnggacaaagaattaaagagcatatgtagtgcttcaa

SEQ ID NO: 2291 - DNA, 71 bp, chicken (Gallus Gallus)
  misc_feature (36): n=a or g
gaactcgaatgaaatcgctgagcttctctttactcncgagcaaatccaagatttgattgatgcttctgatt

SEQ ID NO: 2292 - DNA, 71 bp, chicken (Gallus Gallus)
  misc_feature (36): n=a or g
ctttatgccagcatctggcatatagcttcaaactanaatttttcttctgaataggattctgcttttgtgct

SEQ ID NO: 2293 - DNA, 71 bp, chicken (Gallus Gallus)
  misc_feature (36): n=c or t
gctcttctcaatgtgtgggcattgctatgtacagangtccctaaagcagttggtggaattgtggtctgaat

SEQ ID NO: 2294 - DNA, 71 bp, chicken (Gallus Gallus)
  misc_feature (36): n=c or t
tattccaggtatcagaaaatcttacatcatccaganacatccaataaatctctcttattactcagatatga

SEQ ID NO: 2295 - DNA, 71 bp, chicken (Gallus Gallus)
  misc_feature (36): n=a or g
tgtgaatgttagtatgctgtagcagtatatggattnttttatttggagtagcttaattttaccttttagaa

SEQ ID NO: 2296 - DNA, 71 bp, chicken (Gallus Gallus)
  misc_feature (36): n=a or g
agacagcacacagcagggagagcacaggagctcatncacagcattgcagttttacttcactggtggagaga

SEQ ID NO: 2297 - DNA, 71 bp, chicken (Gallus Gallus)
  misc_feature (36): n=a or g
agctgtagataatactctaatttgggagacaaagtnccttcaaaagtaaggtaattctccttttcagtgta

SEQ ID NO: 2298 - DNA, 71 bp, chicken (Gallus Gallus)
  misc_feature (36): n=a or g
ttgcaatagtgttgattcagcaaatatgagatcggnagtcagacagcagggtaccattaaaacatgaacca

SEQ ID NO: 2299 - DNA, 71 bp, chicken (Gallus Gallus)
  misc_feature (36): n=g or t
tggcttaatgcacttctcaagggaaatggactttgnccccatgcagcagctgagccatccgccatgaggtt

SEQ ID NO: 2300 - DNA, 71 bp, chicken (Gallus Gallus)
  misc_feature (36): n=a or c
gccaagcaagaagactaaagagtgtttcaacaaacnctgtggcgtactgttctgaagatgagctatgatga

SEQ ID NO: 2301 - DNA, 71 bp, chicken (Gallus Gallus)
  misc_feature (36): n=a or c
agcagaacagagccactttcaaacccagaagtcatnatcactgcacagcttcatgatgccgcactgaagct

SEQ ID NO: 2302 - DNA, 71 bp, chicken (Gallus Gallus)
  misc_feature (36): n=c or t
ggctgcttgttgtcctgcattggctgcagcactcancttctgccgatggtgctgtgcacagtgcaggctgg

SEQ ID NO: 2303 - DNA, 71 bp, chicken (Gallus Gallus)
  misc_feature (36): n=a or g
aaggagccttctctcatcctttcagtgcatggtgangggctctgtgtcccaagagaaagagtggtgagtaa

SEQ ID NO: 2304 - DNA, 71 bp, chicken (Gallus Gallus)
  misc_feature (36): n=a or g
taacagagattcatgtatttctaggcactagctttntttttcttcctctctgcatttagtagcagtggcgg

SEQ ID NO: 2305 - DNA, 71 bp, chicken (Gallus Gallus)
  misc_feature (36): n=c or t
attctctccttaatatctccattgtacctcagcacnggtgatgccacaaacattcgggtctaagaggagcc

SEQ ID NO: 2306 - DNA, 71 bp, chicken (Gallus Gallus)
  misc_feature (36): n=a or g
catataatcactgcactgattgttcactcattgcantgactgtttactcaaagcactgattaaaaagtttt

SEQ ID NO: 2307 - DNA, 71 bp, chicken (Gallus Gallus)
  misc_feature (36): n=a or g
gatgtcagattagaagggaagtgagctataggcctnttactgttgtgccttctgcaccttcatttgctgcc

SEQ ID NO: 2308 - DNA, 71 bp, chicken (Gallus Gallus)
  misc_feature (36): n=g or t
gtgcaaccaccctggactcatataagggctagccanggaagggagagtgtttcttgaagctaggttgcttg

SEQ ID NO: 2309 - DNA, 71 bp, chicken (Gallus Gallus)
  misc_feature (36): n=c or t
ggcaatgcaccacctacctacagacttcaggctctnggtgtaaaacaataaagacgcttttcagaagccag

SEQ ID NO: 2310 - DNA, 71 bp, chicken (Gallus Gallus)
  misc_feature (36): n=a or g
tgctgtacctagggctaggagactaatgtcttccangataatttttagctatgttttgggacccaacccag

SEQ ID NO: 2311 - DNA, 71 bp, chicken (Gallus Gallus)
  misc_feature (36): n=a or g
ctagcagaaagaagagctaggggtgaagactacgtncactggtgctgctgccaaagtttgttcatcaaact

SEQ ID NO: 2312 - DNA, 71 bp, chicken (Gallus Gallus)
  misc_feature (36): n=c or t
aaatcaggcattcagatcacagaagctgcagaacanattctacaaaactggcagtgaatgatcactgagaa

SEQ ID NO: 2313 - DNA, 71 bp, chicken (Gallus Gallus)
  misc_feature (36): n=c or t
aattagacaggactaagaagcccaagaattcactanagagactatgcatgaggttttgttttaggactgac

SEQ ID NO: 2314 - DNA, 71 bp, chicken (Gallus Gallus)
  misc_feature (36): n=c or t
tgtttttggcagctacaattaggactggggcactgnttgttgaatcaggccctccaggcacgtatggagga

SEQ ID NO: 2315 - DNA, 71 bp, chicken (Gallus Gallus)
  misc_feature (36): n=c or t
cagacctcctgacagtagctgcaagcaaaaccaganagagcatatccatttgcactgtgttgtataaattt

SEQ ID NO: 2316 - DNA, 71 bp, chicken (Gallus Gallus)
  misc_feature (36): n=c or t
gctgctgctcatggggccctgacataagccagcccngagtgaaggaaaataaaggctcccaatggaaaaag

SEQ ID NO: 2317 - DNA, 71 bp, chicken (Gallus Gallus)
  misc_feature (36): n=c or t
ggattagcagcctgagactgatctcattggtctgcngctagcatgagtcgcttgtttgagcagcattaata

SEQ ID NO: 2318 - DNA, 71 bp, chicken (Gallus Gallus)
  misc_feature (36): n=c or t
gacaatggaaagtatgtctctattgcctaactaacngaatgaaaaagtattgggtgaaataaacgagccag

SEQ ID NO: 2319 - DNA, 71 bp, chicken (Gallus Gallus)
  misc_feature (36): n=a or g
gtgacaataaacatcactgctgagcatttagctcancatcacttggagaaggattgccttttcttgtgctc

SEQ ID NO: 2320 - DNA, 71 bp, chicken (Gallus Gallus)
  misc_feature (36): n=a or c
ctactacttgaagaatcttgccttttgctccatttngtgaacagctgaagtcctctcttttggaaacataa

SEQ ID NO: 2321 - DNA, 71 bp, chicken (Gallus Gallus)
  misc_feature (36): n=a or g
ttagtaaaactgacaaaagaaagcaagacaaccacnctgctgagtggcacactgcaaaaccagtttatccc

SEQ ID NO: 2322 - DNA, 71 bp, chicken (Gallus Gallus)
  misc_feature (36): n=a or g
gattgtgtgacttactcaaaggctatttttaccatnaaattttcctcacaatgaggatgcttcattctgtt

SEQ ID NO: 2323 - DNA, 71 bp, chicken (Gallus Gallus)
  misc_feature (36): n=a or g
gcctgatggacctggtgcagcctaaccgtgggagcngggcatctgtgagacgtgttctgcattgttccagt

SEQ ID NO: 2324 - DNA, 71 bp, chicken (Gallus Gallus)
  misc_feature (36): n=a or g
gcagtcatactgtggatcaatgcagtcttcctcaancagggagctatgataaatctgttcagatctcaccc

SEQ ID NO: 2325 - DNA, 71 bp, chicken (Gallus Gallus)
  misc_feature (36): n=c or t
tttcagattctggtattacaagaccactttgttagnagctgtcaagggtgtaaatatgtgtgtttgtttgt

SEQ ID NO: 2326 - DNA, 71 bp, chicken (Gallus Gallus)
  misc_feature (36): n=g or t
tgaaataaatttaagaccgcctttccagctgagaangtctggaggagtccctcaggaacatgttgttccca

SEQ ID NO: 2327 - DNA, 71 bp, chicken (Gallus Gallus)
  misc_feature (36): n=a or g
ggacaacacccctttcacataactagaagttatggntaaaactgtatttgcttttctttcagctgttatct

SEQ ID NO: 2328 - DNA, 71 bp, chicken (Gallus Gallus)
  misc_feature (36): n=g or t
ataatacatgctgtgatttctgtttcagaatatggnatgtgaagtgatgaatcttaagcctgattctagat

SEQ ID NO: 2329 - DNA, 71 bp, chicken (Gallus Gallus)
  misc_feature (36): n=c or t
ctgctccttgcaccatgagcttcaggacctggatcntctggttctacataatattcactgctgcagattaa

SEQ ID NO: 2330 - DNA, 71 bp, chicken (Gallus Gallus)
  misc_feature (36): n=a or g
ttggagctcactgatgttacttgctggccagcaccntatcaatcactgctgccagatgcaaatgcagcctg

SEQ ID NO: 2331 - DNA, 71 bp, chicken (Gallus Gallus)
  misc_feature (36): n=a or g
tggagctgttaaaaaagtgtgtagttgtggtacttngggacatgctttcatgggcagtattgatggtgggt

SEQ ID NO: 2332 - DNA, 71 bp, chicken (Gallus Gallus)
  misc_feature (36): n=a or g
cagaaatcagaggaatgcctttttctctacccacanagaagaaacatataagtaatatgctctaaagcaga

SEQ ID NO: 2333 - DNA, 71 bp, chicken (Gallus Gallus)
  misc_feature (36): n=c or t
gagcttaggagacctttggatgtcttgtgaaggatncttagtgcattttgccagggcaaactcatagctga

SEQ ID NO: 2334 - DNA, 71 bp, chicken (Gallus Gallus)
  misc_feature (36): n=c or t
ttaaagatcaactacagaaaaattacaggtgttgcntgatgagtataaagcatatatctctgtgtgaaagg

SEQ ID NO: 2335 - DNA, 71 bp, chicken (Gallus Gallus)
  misc_feature (36): n=a or g
tggtgggaggagagtctatctcctctgaacctggcntgcatgtgtgcattcacccacaaaatgtaacttcc

SEQ ID NO: 2336 - DNA, 71 bp, chicken (Gallus Gallus)
  misc_feature (36): n=a or g
atgtttttaattagctggggtcctttctgaatctgnagagaattcccacctctcagtgtgctcatagccct

SEQ ID NO: 2337 - DNA, 71 bp, chicken (Gallus Gallus)
  misc_feature (36): n=c or t
ctactttgggagaactcagatccacttgacatacantaattatccattccgctgcataagagaggttatta

SEQ ID NO: 2338 - DNA, 71 bp, chicken (Gallus Gallus)
  misc_feature (36): n=c or t
aactgtaaaatcattctgacgtagcaatcatgacangtttttaatgtcacaaaggtttagctaatagaaat

SEQ ID NO: 2339 - DNA, 71 bp, chicken (Gallus Gallus)
  misc_feature (36): n=g or t
cattcctccttcaggctcttccttcttctattaatntttgctttaggttttcatattcttggaaaaaatgt

SEQ ID NO: 2340 - DNA, 71 bp, chicken (Gallus Gallus)
  misc_feature (36): n=a or g
atcatgcaatgactgaggttgggtggcacctcactnggttatcacatctcacccatttctcaaacatatcc

SEQ ID NO: 2341 - DNA, 71 bp, chicken (Gallus Gallus)
  misc_feature (36): n=a or g
tgattttaagcttataaaaaatggaaagaaaaggcngtgtggaagactacaggcttcctgtctttcctctg

SEQ ID NO: 2342 - DNA, 71 bp, chicken (Gallus Gallus)
  misc_feature (36): n=c or g
gcttcttctatggaggtgtaatagaatgcagtgttnaggagagcatcagaatctggttgtgtaggcttagg

SEQ ID NO: 2343 - DNA, 71 bp, chicken (Gallus Gallus)
  misc_feature (36): n=a or g
tgtatggttgttaaaggagtccaaacatataacagngggaagccaattaaaaaggttctaaatacagaaga

SEQ ID NO: 2344 - DNA, 71 bp, chicken (Gallus Gallus)
  misc_feature (36): n=c or t
ggaaaaatgaagggagagacccgacaaatacatctngtattgttacataaatgctaagaataaaagcatga

SEQ ID NO: 2345 - DNA, 71 bp, chicken (Gallus Gallus)
  misc_feature (36): n=c or t
gctttagggtatgtgacatggtagcagcacagccanctggagtgtggttgcacatggctctcctcttcctt

SEQ ID NO: 2346 - DNA, 71 bp, chicken (Gallus Gallus)
  misc_feature (36): n=g or t
aatcacatctgatccacctgataatcctctgtgaanataccactggtttggtgggtgagaggagatcagca

SEQ ID NO: 2347 - DNA, 71 bp, chicken (Gallus Gallus)
  misc_feature (36): n=a or g
atttgtcttctagatgaatgcacgaactttgggccngcacccttcgctgtctgctcaaccacttcaaaggt

SEQ ID NO: 2348 - DNA, 71 bp, chicken (Gallus Gallus)
  misc_feature (36): n=c or t
tatgtatggtaaggggcatggctttgtttttcctgnggggaaaatataatacattttgtcttcgtacaaca

SEQ ID NO: 2349 - DNA, 71 bp, chicken (Gallus Gallus)
  misc_feature (36): n=c or t
agtgggtggatgtaggagaatgcaggacagctctcnacaactggacccactaaagtaggttcgaccccttc

SEQ ID NO: 2350 - DNA, 71 bp, chicken (Gallus Gallus)
  misc_feature (36): n=a or g
attttacttttttatccatgcatattcactgaatcngaattgtaactacacacatttaatttggatatgaa

SEQ ID NO: 2351 - DNA, 71 bp, chicken (Gallus Gallus)
  misc_feature (36): n=c or t
gggaatgggatgtgacttagtggtgtgcttcctacngttcctgatggagtgtagagttctcttgaaccctt

SEQ ID NO: 2352 - DNA, 71 bp, chicken (Gallus Gallus)
  misc_feature (36): n=a or g
gagaagatagcttacatttctgagaatgaagtcttntgatatggaatataatttttgtcagtttaggtcag

SEQ ID NO: 2353 - DNA, 71 bp, chicken (Gallus Gallus)
  misc_feature (36): n=a or t
tactctgggtggggcctcacaagggctgagcagagngggatttgcattggaagtttctagttcaagaaatg

SEQ ID NO: 2354 - DNA, 71 bp, chicken (Gallus Gallus)
  misc_feature (36): n=g or t
aactgggcacagacggtccaggacgttccactgagntctgttgataactttctaatacagaaagttgagga

SEQ ID NO: 2355 - DNA, 71 bp, chicken (Gallus Gallus)
  misc_feature (36): n=c or t
aatgcatccaagggataggatgtcatctagaagggnctagacagacttcagcaatgggtccaggcaaactt

SEQ ID NO: 2356 - DNA, 71 bp, chicken (Gallus Gallus)
  misc_feature (36): n=a or t
atgggtgctgtccatcagttctgcacataggatcangaaaacaagcttttaaaaccttgatctgatttcag

SEQ ID NO: 2357 - DNA, 71 bp, chicken (Gallus Gallus)
  misc_feature (36): n=c or t
ataaatcaacatgttacaggctgaactagatttccngaaggacacaaaattattacaattaattctgtaaa

SEQ ID NO: 2358 - DNA, 71 bp, chicken (Gallus Gallus)
  misc_feature (36): n=g or t
gatctgagaaaaaaaacatatttttaagtcagaganatcacctagacagaaacctcacacctgacttaaga

SEQ ID NO: 2359 - DNA, 71 bp, chicken (Gallus Gallus)
  misc_feature (36): n=a or g
ctctaaaatctcactgtagcaatgcctctagggtanaagtctcctttcctgtgttgcttttgttttcactg

SEQ ID NO: 2360 - DNA, 71 bp, chicken (Gallus Gallus)
  misc_feature (36): n=c or t
tctcctgataaattccacctcccatatacactgctncaaaactgaagagtcattgatgagaatgaaagcta

SEQ ID NO: 2361 - DNA, 71 bp, chicken (Gallus Gallus)
  misc_feature (36): n=a or c
aatctgaaggagagctacatatgttctatattcggnagaaaatatctattttaaaagaacttaatttacag

SEQ ID NO: 2362 - DNA, 71 bp, chicken (Gallus Gallus)
  misc_feature (36): n=c or t
tttcatctttcttatctttgttttcataaccaattntgtttccagggaagttaatagtacttttgctactg

SEQ ID NO: 2363 - DNA, 71 bp, chicken (Gallus Gallus)
  misc_feature (36): n=a or c
ttgccactcagaaatgtaggtttagtccccaaaagnatcagtaattgctgtactggcagtccattgagcac

SEQ ID NO: 2364 - DNA, 71 bp, chicken (Gallus Gallus)
  misc_feature (36): n=g or t
cagctgatgagtacttatcactcctcctgaagaagncattccatttgatattcctcctcccgactttatac

SEQ ID NO: 2365 - DNA, 71 bp, chicken (Gallus Gallus)
  misc_feature (36): n=c or t
aaaatgatctttcatcaaccttctcttttctgcatncactgctctgatttttccagtattttcttggaagt

SEQ ID NO: 2366 - DNA, 71 bp, chicken (Gallus Gallus)
  misc_feature (36): n=a or g
cagtggagtaattctgttttcttctgcctttctccnaattacggtcagcaccagtgaaatgttagtgtcat

SEQ ID NO: 2367 - DNA, 71 bp, chicken (Gallus Gallus)
  misc_feature (36): n=a or g
actgtgttcattgctggtctcccacatacaagaagnatatggacatactgtaaagagtccagaaaagggac

SEQ ID NO: 2368 - DNA, 71 bp, chicken (Gallus Gallus)
  misc_feature (36): n=a or c
ttggcttcgctcttttctgcttgttctgcagtgggnagtgttaggagctgagaccacagggtcgtcttctc

SEQ ID NO: 2369 - DNA, 71 bp, chicken (Gallus Gallus)
  misc_feature (36): n=c or t
ttccagagagggaaatgatttattttttaaattctngaggagcattctgggatttgtttgtggtttttgtc

SEQ ID NO: 2370 - DNA, 71 bp, chicken (Gallus Gallus)
  misc_feature (36): n=a or g
cctgaaatgggtcaaggaaaagcaggatctactgcngaacaagcattcaatgatatgccacacacctgcct

SEQ ID NO: 2371 - DNA, 71 bp, chicken (Gallus Gallus)
  misc_feature (36): n=c or t
aaacagaatgttaacatacaccaatgaccattgtgnatgaatgtcttgaattgtcatcaagatctgccacc

SEQ ID NO: 2372 - DNA, 71 bp, chicken (Gallus Gallus)
  misc_feature (36): n=c or t
agctctctcaccataaaagcggtgattcagcggcanggcttgtccttggttcacattcatgcgactcagag

SEQ ID NO: 2373 - DNA, 71 bp, chicken (Gallus Gallus)
  misc_feature (36): n=a or g
cttgttactgtgctctctgagttgaaggctaatttnaatctttgatgaacataaaatgagataccataaga

SEQ ID NO: 2374 - DNA, 71 bp, chicken (Gallus Gallus)
  misc_feature (36): n=c or t
gggcttcctacgcctgctggcttggaacagacacantcagcacgttcaccccatccttcattacgtgctcg

SEQ ID NO: 2375 - DNA, 71 bp, chicken (Gallus Gallus)
  misc_feature (36): n=a or c
gacaaacagctctttgcaccgtcagtcatgggcctnaacaagattgcctctttctaatgttcacataagca

SEQ ID NO: 2376 - DNA, 71 bp, chicken (Gallus Gallus)
  misc_feature (36): n=c or t
ctttaagcctggtgctggatcagtggggtgacacangtgcagcccacggtgatcattttcttctccaggcg

SEQ ID NO: 2377 - DNA, 71 bp, chicken (Gallus Gallus)
  misc_feature (36): n=a or g
ttttctttttgttgaactaagccagggagaaaaaanaaaaaagaaaagagatgagaaagaaatcgcaaatg

SEQ ID NO: 2378 - DNA, 71 bp, chicken (Gallus Gallus)
  misc_feature (36): n=c or t
gaatgctgtagcgtccttccactgtttaatatccangtaattttcccatgcaaacttcatacttgggtccc

SEQ ID NO: 2379 - DNA, 71 bp, chicken (Gallus Gallus)
  misc_feature (36): n=a or g
ctgccctcaacatgtgcatgtgattaatactcctcnggagcaggactttgcatttctctttgtggaatgtc

SEQ ID NO: 2380 - DNA, 71 bp, chicken (Gallus Gallus)
  misc_feature (36): n=c or t
accaaggcaacgggcatcttctgagaagatggatgngtttgctctgcagaccactagagatggagaaccca

SEQ ID NO: 2381 - DNA, 71 bp, chicken (Gallus Gallus)
  misc_feature (36): n=a or g
ttcttaattggcttgaaagagcctaatattgatatntttacatgtctaaaggcaaataaatctagtggtat

SEQ ID NO: 2382 - DNA, 71 bp, chicken (Gallus Gallus)
  misc_feature (36): n=c or t
taactgttggaaaatatttgagttgtcatggctctncagaataaactttggaagatcaggcttatatattg

SEQ ID NO: 2383 - DNA, 71 bp, chicken (Gallus Gallus)
  misc_feature (36): n=c or t
acggtgggcttggggctgaaagagaggagaatgcantcacgtctgaaaaggagcatctcactatcaaattc

SEQ ID NO: 2384 - DNA, 71 bp, chicken (Gallus Gallus)
  misc_feature (36): n=c or g
gtgaagcgagtaatttgtcctcttacagcaaggtanaggatgcagctttggaggcctggcaagtccttgtt

SEQ ID NO: 2385 - DNA, 71 bp, chicken (Gallus Gallus)
  misc_feature (36): n=c or t
aaaaagcaggagtgagatgagccgcccctgctccgntgctaaaaacagcccggcttgcttttattgaacac

SEQ ID NO: 2386 - DNA, 71 bp, chicken (Gallus Gallus)
  misc_feature (36): n=a or g
caaatgttagcctacatttttgtgactggtagcccnaagcacacccctacactgagatcttaagagagaga

SEQ ID NO: 2387 - DNA, 71 bp, chicken (Gallus Gallus)
  misc_feature (36): n=c or t
aacaaagttctgagttacaaatatttgattgccctncagtgagagtatggtaattgatcctgaaggttata

SEQ ID NO: 2388 - DNA, 71 bp, chicken (Gallus Gallus)
  misc_feature (36): n=c or g
aaaagatgcagcggggatccaagcaagaacttcctnattagcaacagcgctacagaagagaggagaagaaa

SEQ ID NO: 2389 - DNA, 71 bp, chicken (Gallus Gallus)
  misc_feature (36): n=g or t
ttggcttgcagagcactcattatatcaatatagagntactgctatatcatttttacactgtatatacatgg

SEQ ID NO: 2390 - DNA, 71 bp, chicken (Gallus Gallus)
  misc_feature (36): n=a or g
aaaatagttttattgcttatatcccagagtagtagnacttacaacttttttcacagaaggatgggataaaa

SEQ ID NO: 2391 - DNA, 71 bp, chicken (Gallus Gallus)
  misc_feature (36): n=c or t
tttgtaccttttgatgctgtttatggtctgtgacanagggatcaaataaaaatcagtggttctggaatctg

SEQ ID NO: 2392 - DNA, 71 bp, chicken (Gallus Gallus)
  misc_feature (36): n=c or g
tggtagctgtgggctggggaggtgcccttcatgggnacatgggcgtacatgggagtcattctgggatgtgg

SEQ ID NO: 2393 - DNA, 71 bp, chicken (Gallus Gallus)
  misc_feature (36): n=c or t
gtgctgcacggcagcggctgtgctcagctcggaacnggcttctgtgagccattaaacttgcactgaactgg

SEQ ID NO: 2394 - DNA, 71 bp, chicken (Gallus Gallus)
  misc_feature (36): n=c or t
gaaggaactgttgtgaaatactgcagactgtttcanagaaaatgcaaccaagaagtgtagtgtttctcatt

SEQ ID NO: 2395 - DNA, 71 bp, chicken (Gallus Gallus)
  misc_feature (36): n=c or t
caactggatttcattccaatggaaaccaacatgganggtgaaaggtaggtgataatttttagaccttgcag

SEQ ID NO: 2396 - DNA, 71 bp, chicken (Gallus Gallus)
  misc_feature (36): n=a or g
tgctaaattctttttcttaaggcaaacaatataccnatgctagtctgagaaatttcttttaaattaatgtc

SEQ ID NO: 2397 - DNA, 71 bp, chicken (Gallus Gallus)
  misc_feature (36): n=c or t
tattgcataacacagaggaaacatcctgataactangtctgcatgtgagtatgtcaattttatagtaccgt

SEQ ID NO: 2398 - DNA, 71 bp, chicken (Gallus Gallus)
  misc_feature (36): n=c or t
cttatggtcagtcttgtcaagctttaaagaatctcncacttcagccatctcaaaaaggcagtaaatctaga

SEQ ID NO: 2399 - DNA, 71 bp, chicken (Gallus Gallus)
  misc_feature (36): n=a or g
ctcatcacaccgcaaggacccctgcaaagagagcangaatgcagcacctacatccctctctaagcctcagc

SEQ ID NO: 2400 - DNA, 71 bp, chicken (Gallus Gallus)
  misc_feature (36): n=a or g
agtaactacagctataatagtaagaggtaggattcntggttaatatagtttataatgggggtagaagtcat

SEQ ID NO: 2401 - DNA, 71 bp, chicken (Gallus Gallus)
  misc_feature (36): n=g or t
aaaaaagtcacagtacatcctcatgttagagctatngagttttacctgaaaacgctcattctgatttagca

SEQ ID NO: 2402 - DNA, 71 bp, chicken (Gallus Gallus)
  misc_feature (36): n=c or t
agcttttccatattgacatcttgtttcactaactcncataccggccatagcacaataatgcgatagaaagt

SEQ ID NO: 2403 - DNA, 71 bp, chicken (Gallus Gallus)
  misc_feature (36): n=g or t
atttgtatgtgcatataggtcaattgcaaataaatnaatagataaataagagcagatctgatagagctctc

SEQ ID NO: 2404 - DNA, 71 bp, chicken (Gallus Gallus)
  misc_feature (36): n=a or g
ggaattgtggctgagttttaaaagcacagctcaccntgttgacttctagggttatcccagccattatttca

SEQ ID NO: 2405 - DNA, 71 bp, chicken (Gallus Gallus)
  misc_feature (36): n=g or t
ttgtttggtttattttgcttttttgagggagtgtgnggaagaggaaggaagaaagacaacaaaacccttct

SEQ ID NO: 2406 - DNA, 71 bp, chicken (Gallus Gallus)
  misc_feature (36): n=a or g
tgttggagtcagcagcctgcaaagccttttggcttngagtgtcgaaaggacgtcagaaagcactgcagcta

SEQ ID NO: 2407 - DNA, 71 bp, chicken (Gallus Gallus)
  misc_feature (36): n=a or t
acttaaatgacacagtgtatttaagtcaatctcatnaaatatgtgttttgggatgtaaagagatagcagaa

SEQ ID NO: 2408 - DNA, 71 bp, chicken (Gallus Gallus)
  misc_feature (36): n=c or t
cagaagaaaaaaatctcactgttttcatcctatagnattaactacgttaaggatctgcctggaaaaacaca

SEQ ID NO: 2409 - DNA, 71 bp, chicken (Gallus Gallus)
  misc_feature (36): n=a or g
ctttgttgctcaggaagatttagtgctgtgttttcntgctgcagggttagcagtgcaggatggttgagctc

SEQ ID NO: 2410 - DNA, 71 bp, chicken (Gallus Gallus)
  misc_feature (36): n=c or g
agagcacaataacactatttgatggagaaaattctnagctacgaaacactctcttccaacactgtcaccac

SEQ ID NO: 2411 - DNA, 71 bp, chicken (Gallus Gallus)
  misc_feature (36): n=a or g
ctctgtgtgatattcagtatgtaccagcgtgaggcntttaaaagagcctctagaattaatactgcctagat

SEQ ID NO: 2412 - DNA, 71 bp, chicken (Gallus Gallus)
  misc_feature (36): n=c or t
tttcttagagttattttattatctggaaaagtcagnagcctagcaaccctggagacagatgttccttccct

SEQ ID NO: 2413 - DNA, 71 bp, chicken (Gallus Gallus)
  misc_feature (36): n=c or t
agctttgtgtaccaccgtgcgcatcgcgtgctgttngctgcaatctgaacacattaaatgctgaacgatga

SEQ ID NO: 2414 - DNA, 71 bp, chicken (Gallus Gallus)
  misc_feature (36): n=a or g
aatgatcttacagaaaaaatgtaataagcgcttctntgtagcactctctgttctgcttttccctccccaaa

SEQ ID NO: 2415 - DNA, 71 bp, chicken (Gallus Gallus)
  misc_feature (36): n=g or t
cctcctgaaaagaaaaattaagaaaccccaacagantataatcttaatattttgtggtttctgaattctct

SEQ ID NO: 2416 - DNA, 71 bp, chicken (Gallus Gallus)
  misc_feature (36): n=a or g
gtggacaacaaatttcaacaatgccactgttatagnctgcttacatgtgtggcttttagacttgtgtatga

SEQ ID NO: 2417 - DNA, 71 bp, chicken (Gallus Gallus)
  misc_feature (36): n=c or t
acaaccagcatacatgctgtgtttttcagccaaatnagagctctaaaaagatatcagtcagagccctaaga

SEQ ID NO: 2418 - DNA, 71 bp, chicken (Gallus Gallus)
  misc_feature (36): n=a or t
aataatggttgtcagagatttaggatttgggtcatntcccatagtatcaacatttattccagcatttatgg

SEQ ID NO: 2419 - DNA, 71 bp, chicken (Gallus Gallus)
  misc_feature (36): n=a or g
gattccaatacttctcgtcacgttatcctggaaagngggaaaagcagccttagttccatgtagcctcactt

SEQ ID NO: 2420 - DNA, 71 bp, chicken (Gallus Gallus)
  misc_feature (36): n=c or t
gcttgcaccttaccatctttttttaggatgacatcnctgcctttgtgtttccagatgatggtaggaggcag

SEQ ID NO: 2421 - DNA, 71 bp, chicken (Gallus Gallus)
  misc_feature (36): n=a or g
acaagactacgagactgctcttctgagaggatgagngagcaaatagtgagcaactgatctattaaacttcc

SEQ ID NO: 2422 - DNA, 71 bp, chicken (Gallus Gallus)
  misc_feature (36): n=c or t
gctgtaacatcaaaaccaaccgccgaaaccatctgncatgagcacactgctgtggttgcagtgctgaacac

SEQ ID NO: 2423 - DNA, 71 bp, chicken (Gallus Gallus)
  misc_feature (36): n=a or g
cattttagggtcagttctctttgatgtttttatgantgttctagatgcaggattcaaatgcatgctaagtt

SEQ ID NO: 2424 - DNA, 71 bp, chicken (Gallus Gallus)
  misc_feature (36): n=a or g
catcttcagaggtatgactgtgactctgaagagtgnaggagcataatacccattgatgtttcctgaatgtt

SEQ ID NO: 2425 - DNA, 71 bp, chicken (Gallus Gallus)
  misc_feature (36): n=a or g
gtttcttctagctttttgacagcatatttctatacnaggctaaggccagaatcttctatgtaagaggagct

SEQ ID NO: 2426 - DNA, 71 bp, chicken (Gallus Gallus)
  misc_feature (36): n=a or g
agagaggagctcaatttgctgcctggatcatatctntgcataaaccaggctgtgatgtatatgtggaattc

SEQ ID NO: 2427 - DNA, 71 bp, chicken (Gallus Gallus)
  misc_feature (36): n=a or g
ccacctcgacaataagcttacttgaatatatgaagncatgttccacagttcacaattagtggtttaggata

SEQ ID NO: 2428 - DNA, 71 bp, chicken (Gallus Gallus)
  misc_feature (36): n=a or g
tcagagctgaccagggctgcggtcttgggtactgcncgcacctgttttgacaaggcaaaaatacagcttgc

SEQ ID NO: 2429 - DNA, 71 bp, chicken (Gallus Gallus)
  misc_feature (36): n=c or t
ttgttactgaagacataataggcttttctgaaatantgtgaagctatggtccaagtttcaaatgacatagc

SEQ ID NO: 2430 - DNA, 71 bp, chicken (Gallus Gallus)
  misc_feature (36): n=a or g
cttttcttagttctctttgccacatcaggaaaatgntctttttcaaatatagttatatggaaggtcatctt

SEQ ID NO: 2431 - DNA, 71 bp, chicken (Gallus Gallus)
  misc_feature (36): n=c or t
tgtttactggctttaaaacctgaggcacaagtcttntaacttcagtaacaatgctaattgattattttaaa

SEQ ID NO: 2432 - DNA, 71 bp, chicken (Gallus Gallus)
  misc_feature (36): n=c or t
gagacatcctccttcagcttacgcttcatcagaganaccagcccaggctcctcgccgggttgaggccccct

SEQ ID NO: 2433 - DNA, 71 bp, chicken (Gallus Gallus)
  misc_feature (36): n=c or t
catcctgtttgttagggttgcttgacttgtgccatnggctttgtgagggcagggagctctcagctggtgct

SEQ ID NO: 2434 - DNA, 71 bp, chicken (Gallus Gallus)
  misc_feature (36): n=a or c
cttgctgcagccatccgaggacttgttagtgctagnctgttcttgttcattcactgaaactatcagctctc

SEQ ID NO: 2435 - DNA, 71 bp, chicken (Gallus Gallus)
  misc_feature (36): n=a or g
tgtgtgacagacatctgcaaaaaatgtgagcgcatncaaaattccagctttctgacaactcaagctaaatt

SEQ ID NO: 2436 - DNA, 71 bp, chicken (Gallus Gallus)
  misc_feature (36): n=g or t
aggttttttttttttgtttttttttttttttttttngtgaggtgattaataagcttatttaatgggtttta

SEQ ID NO: 2437 - DNA, 71 bp, chicken (Gallus Gallus)
  misc_feature (36): n=a or c
ctaaggaaaaccacccgtgcttgaagaatttaaacntagagagaggtggtagctacggactgatgccagtg

SEQ ID NO: 2438 - DNA, 71 bp, chicken (Gallus Gallus)
  misc_feature (36): n=g or t
cctggttaagtaatgacctccactatggtggatatngagtttctcacctcattgaggggaacctgtgagta

SEQ ID NO: 2439 - DNA, 71 bp, chicken (Gallus Gallus)
  misc_feature (36): n=a or t
gtgaaaaataggtgaagtgctgaaaggtaaagctcncactttactgcctgaggacaaccgtagatctaaat

SEQ ID NO: 2440 - DNA, 71 bp, chicken (Gallus Gallus)
  misc_feature (36): n=a or t
acatactgccagtggttttcttaactcttcacatanattatagcacaactagctagcgtggtaacagtagt

SEQ ID NO: 2441 - DNA, 71 bp, chicken (Gallus Gallus)
  misc_feature (36): n=c or t
ctgggaattatccacccataagtgaacaaagggcanggtcatctttaagtaggatcattggcctgctactg

SEQ ID NO: 2442 - DNA, 71 bp, chicken (Gallus Gallus)
  misc_feature (36): n=a or g
tccctgaagtgctttttcatcctactctgaattacncataaaacccacacccaagcaaccatcttgtctgt

SEQ ID NO: 2443 - DNA, 71 bp, chicken (Gallus Gallus)
  misc_feature (36): n=a or t
attcagatggaaaaagctgtttagaaacctatctgnaaatgaaggaaactgctattttggaaagctgaaat

SEQ ID NO: 2444 - DNA, 71 bp, chicken (Gallus Gallus)
  misc_feature (36): n=c or t
gatctccaactgattgtgtaactcagccacgcaacngaaacctttgtgtatgtttaactagtttaactcat

SEQ ID NO: 2445 - DNA, 71 bp, chicken (Gallus Gallus)
  misc_feature (36): n=c or t
cagagcctttttctttttaatcatggcagtatagantggctgatgcctaagggtggaagaagtacaagtag

SEQ ID NO: 2446 - DNA, 71 bp, chicken (Gallus Gallus)
  misc_feature (36): n=c or t
agttttgtatccaactttcactcactttccacttanatgcaaaaatttctgcgaaagattttcaaggaacc

SEQ ID NO: 2447 - DNA, 71 bp, chicken (Gallus Gallus)
  misc_feature (36): n=a or t
tttgcaacttcttctacagcctcttagtagtaaaanacgtcataggttgtccttcctttttgttggtagct

SEQ ID NO: 2448 - DNA, 71 bp, chicken (Gallus Gallus)
  misc_feature (36): n=g or t
tcgacatttctacctctccttgaaaatattcatctnctgtaccagcattggagctggagtgatgcggaagc

SEQ ID NO: 2449 - DNA, 71 bp, chicken (Gallus Gallus)
  misc_feature (36): n=c or t
aggccaatgctaactattgttttgctcccttttccnggacaaaagggagagttgttgtaggtcagagtaag

SEQ ID NO: 2450 - DNA, 71 bp, chicken (Gallus Gallus)
  misc_feature (36): n=a or g
catagcaagaagaggtcattctttccctttgcccgngatatttatgaggacttaaagaatgattaactgag

SEQ ID NO: 2451 - DNA, 71 bp, chicken (Gallus Gallus)
  misc_feature (36): n=a or g
tccttgcctgcagtgctacaccacaagtatgatgcntccaaatctagcacctatgtggagaatggcactga

SEQ ID NO: 2452 - DNA, 71 bp, chicken (Gallus Gallus)
  misc_feature (36): n=c or t
aaactgtggctgggtctgaaaagctgtgaataaagntagcgaggcatatacgtatattcacctcatgttaa

SEQ ID NO: 2453 - DNA, 71 bp, chicken (Gallus Gallus)
  misc_feature (36): n=a or g
ctgtaaatccatttctttactctcagattttttttncatttcttcacagcagcgtttcaccccgtcatcca

SEQ ID NO: 2454 - DNA, 71 bp, chicken (Gallus Gallus)
  misc_feature (36): n=c or t
tgcagtacgaaaaggcacgttcttctgtacacactnctcatgcttctgtttgacttcctcagagcctcgag

SEQ ID NO: 2455 - DNA, 71 bp, chicken (Gallus Gallus)
  misc_feature (36): n=a or g
gttataaacattttaaaataaataagacaacatctntgtgaacttatcaaatatatttctttgtgggaaca

SEQ ID NO: 2456 - DNA, 71 bp, chicken (Gallus Gallus)
  misc_feature (36): n=a or g
ttgtgaggccttctgggctggacttcacgagtcgcngtagggccggtttcagaacagacctggtttttagg

SEQ ID NO: 2457 - DNA, 71 bp, chicken (Gallus Gallus)
  misc_feature (36): n=c or t
gcagagtggtagttcataggagcattgttcagaaanatgcaattcattttcacccacatttaagatggtac

SEQ ID NO: 2458 - DNA, 71 bp, chicken (Gallus Gallus)
  misc_feature (36): n=a or g
ccgcttgactggaaagaaggcattagaagcaaaggnagaaattgctgcagctgccctttccttgaagtcat

SEQ ID NO: 2459 - DNA, 71 bp, chicken (Gallus Gallus)
  misc_feature (36): n=g or t
cccacaactttattattctctgctctttttcaagtnagttcattttggctacgtggtactgtcccctgtgc

SEQ ID NO: 2460 - DNA, 71 bp, chicken (Gallus Gallus)
  misc_feature (36): n=c or g
gaaacaaccggctatttttgatgtgtttgttgtaanaatcaagcaaggaactacctgtttaatgtgaacat

SEQ ID NO: 2461 - DNA, 71 bp, chicken (Gallus Gallus)
  misc_feature (36): n=c or t
tgacgtgcagtgctcgctggcagtgccctggggtangttggaaactgcactaggctcaattatttgctgca

SEQ ID NO: 2462 - DNA, 71 bp, chicken (Gallus Gallus)
  misc_feature (36): n=g or t
aaataccagtctcatagagctctaaactgcctctgngtatgggctagggtcaccttgtatgcagttttgtc

SEQ ID NO: 2463 - DNA, 71 bp, chicken (Gallus Gallus)
  misc_feature (36): n=a or g
ttcttttcttggtcagagctgccttgggtaaagcanttggtagggggaaagtctttgtcatgagtatgagt

SEQ ID NO: 2464 - DNA, 71 bp, chicken (Gallus Gallus)
  misc_feature (36): n=c or t
tttgtttatctcagcggtagctctcccatgtccccngagagtcaactaggctgcaaaaaaacttggaagcg

SEQ ID NO: 2465 - DNA, 71 bp, chicken (Gallus Gallus)
  misc_feature (36): n=a or g
gcatccacctctgatataataggccaacgttataanagaggaagcattacttttggagcagccctcatata

SEQ ID NO: 2466 - DNA, 71 bp, chicken (Gallus Gallus)
  misc_feature (36): n=c or t
tatggagctgaaatttcttggtaaatcaaagaaagnaggaataatggagaagattgactaatttttaattt

SEQ ID NO: 2467 - DNA, 71 bp, chicken (Gallus Gallus)
  misc_feature (36): n=g or t
agaggaaaaaaataaataaataaaacatcaggaacngattcactggtgttgaagctaagtccacttcatgt

SEQ ID NO: 2468 - DNA, 71 bp, chicken (Gallus Gallus)
  misc_feature (36): n=c or t
ctcaccccaggcttttcagggtgattctgaaatgtntgtcctccaactgacttcatagctggaggaggacg

SEQ ID NO: 2469 - DNA, 71 bp, chicken (Gallus Gallus)
  misc_feature (36): n=a or g
gacagatgaggttttcttagcactccatgcttccanttattattacaactttttacctattaacagactgg

SEQ ID NO: 2470 - DNA, 71 bp, chicken (Gallus Gallus)
  misc_feature (36): n=g or t
cttaggtcttggatctgttgtcatattgcaccaagngtgagaagctgcttcagttctgttccaaggaacga

SEQ ID NO: 2471 - DNA, 71 bp, chicken (Gallus Gallus)
  misc_feature (36): n=a or g
acctgatgtaaattagccgttgcactgactcaaacngaactctatgcatttcttacaattgagaatctaat

SEQ ID NO: 2472 - DNA, 71 bp, chicken (Gallus Gallus)
  misc_feature (36): n=a or g
acagaaaagtggggagagaagctaagcaatttcaanaaacttgctttcctacatcatctattttgtgtgct

SEQ ID NO: 2473 - DNA, 71 bp, chicken (Gallus Gallus)
  misc_feature (36): n=a or g
ggggaaggttcagaatttaagagcacaaacaaaatntgttctttcttgaaagtacaatgacaaatagtaca

SEQ ID NO: 2474 - DNA, 71 bp, chicken (Gallus Gallus)
  misc_feature (36): n=a or t
gagtcctgtagcagctgttaagtactgatccttcgnaggaagctgtagtttccagtgaatctctggatgtg

SEQ ID NO: 2475 - DNA, 71 bp, chicken (Gallus Gallus)
  misc_feature (36): n=a or g
ggtaacatggtgtccccaccatgagaagaagggaangaaaaacaggatctgcattctgatatattctgtgt

SEQ ID NO: 2476 - DNA, 71 bp, chicken (Gallus Gallus)
  misc_feature (36): n=c or t
aagtgcatcgtgttaggtgtggcaaactcgatgagngaaagagaagaggaggtagtatgtaagctcagttt

SEQ ID NO: 2477 - DNA, 71 bp, chicken (Gallus Gallus)
  misc_feature (36): n=a or c
tttaggaagtgtaaagatagcaagtctgtccttctnaggatcacttaattgttaatgcttcatgtagaatg

SEQ ID NO: 2478 - DNA, 71 bp, chicken (Gallus Gallus)
  misc_feature (36): n=c or t
ttgtcagcaacactattaacctcagtatgattcagncatcatcagagccattctctaaattcttattgctt

SEQ ID NO: 2479 - DNA, 71 bp, chicken (Gallus Gallus)
  misc_feature (36): n=c or t
tcagcttttatcccaaatcaagcctctttgcttccngctccactaagactgaaatttggttgtagctgaac

SEQ ID NO: 2480 - DNA, 71 bp, chicken (Gallus Gallus)
  misc_feature (36): n=a or g
gcttgtactgctggctttcagaagtgggaagaggtncttaaggtcttaatttgacacttaacatcatactg

SEQ ID NO: 2481 - DNA, 71 bp, chicken (Gallus Gallus)
  misc_feature (36): n=c or g
tttagttgttgttacttctggtggaaataaccattncaaaaccgggaaataatgtacaatgtgagttccag

SEQ ID NO: 2482 - DNA, 71 bp, chicken (Gallus Gallus)
  misc_feature (36): n=c or t
tcaaaaagattttttctggatccatcctgatgatanactttatttgaataaaacatccacagaacctgaca

SEQ ID NO: 2483 - DNA, 71 bp, chicken (Gallus Gallus)
  misc_feature (36): n=a or g
aatccaaagaatgtggggcataggataggaaagacnaaactgtttgtcaggaattagccgaggaaatgtgg

SEQ ID NO: 2484 - DNA, 71 bp, chicken (Gallus Gallus)
  misc_feature (36): n=c or t
ttaaacagataactttccaagccaaaactggtcttngtgctgagctcttgttaaaatgaccaccaatacca

SEQ ID NO: 2485 - DNA, 71 bp, chicken (Gallus Gallus)
  misc_feature (36): n=a or c
gtaaattctctatattagtaaaaagccttgattcangtctataggttggatagttttctcaaaacagctat

SEQ ID NO: 2486 - DNA, 71 bp, chicken (Gallus Gallus)
  misc_feature (36): n=c or g
ccaatgaaaaggagaaatagactggaaaaaggaagngaagctgcacactcccacagcagtcaaagtgtggg

SEQ ID NO: 2487 - DNA, 71 bp, chicken (Gallus Gallus)
  misc_feature (36): n=a or g
aatgcatcttctgacctgagctgagggtcggatccncagatattccccttaacttcccaggtataaataca

SEQ ID NO: 2488 - DNA, 71 bp, chicken (Gallus Gallus)
  misc_feature (36): n=c or t
gtattttggaagctctccgttgtgttggtgtgatcnttctgctgctggagtatttttgtgctgtcccaggg

SEQ ID NO: 2489 - DNA, 71 bp, chicken (Gallus Gallus)
  misc_feature (36): n=a or g
tttgattttcaataactttaaacaaaaaatgatggnaacaaaatacttgatcttattaacagcagatacat

SEQ ID NO: 2490 - DNA, 71 bp, chicken (Gallus Gallus)
  misc_feature (36): n=a or g
atagaggtgaatttggccattggtagagaaagtccntcagtttcagctttggtagcatagttaaaagaagc

SEQ ID NO: 2491 - DNA, 71 bp, chicken (Gallus Gallus)
  misc_feature (36): n=a or g
gtagggctccaaactcccagtagctgctttaatgcncatgcaactataacgtgttctatttacagtcttac

SEQ ID NO: 2492 - DNA, 71 bp, chicken (Gallus Gallus)
  misc_feature (36): n=c or t
gatggtttcttgcccttctcctgacttctaggatangcttctgccattgcctatgagttgtctatatagca

SEQ ID NO: 2493 - DNA, 71 bp, chicken (Gallus Gallus)
  misc_feature (36): n=c or t
gggtggaaagaagcagtgtctgtgtaccactaaaantacctaacctctgctttttttgaatccagcctgca

SEQ ID NO: 2494 - DNA, 71 bp, chicken (Gallus Gallus)
  misc_feature (36): n=c or t
cagaacagcaaggtcctaataaaaatcctgaagtgnatttgtatatttttttcttacatatccattttaac

SEQ ID NO: 2495 - DNA, 71 bp, chicken (Gallus Gallus)
  misc_feature (36): n=a or g
tcttcttctttttttttttttttttagctaaaaaanccaccttagctaacctaaaaaccatcatggtcaaa

SEQ ID NO: 2496 - DNA, 71 bp, chicken (Gallus Gallus)
  misc_feature (36): n=a or c
ttcctgttcacatccctcagcgatgtgctgcttctnagcttattgtcaagaaaaaggtatatctctttgca

SEQ ID NO: 2497 - DNA, 71 bp, chicken (Gallus Gallus)
  misc_feature (36): n=a or g
tgaaatttcccccaattcctttccttccaaaagtcntgttctcataatatagttattctttcaggaaaaat

SEQ ID NO: 2498 - DNA, 71 bp, chicken (Gallus Gallus)
  misc_feature (36): n=c or t
ttattctttcaggaaaaattctgacttccatgcaanaatctcagataaaacatatttgaatacaaaattat

SEQ ID NO: 2499 - DNA, 71 bp, chicken (Gallus Gallus)
  misc_feature (36): n=a or g
ccatcctccagcctcctccaggctgaagcatttggnttttgctccatctaatgttgaaggagcagctggga

SEQ ID NO: 2500 - DNA, 71 bp, chicken (Gallus Gallus)
  misc_feature (36): n=a or g
taaataggctctacaggccctgcatccagccggggnagaacttctctgagaacaagctcctctggcagctg

SEQ ID NO: 2501 - DNA, 71 bp, chicken (Gallus Gallus)
  misc_feature (36): n=c or t
ctgctcctgaaaatttgcattggttggtagctagantgtgggcagatggagatgccacattagcgcatgac

SEQ ID NO: 2502 - DNA, 71 bp, chicken (Gallus Gallus)
  misc_feature (36): n=c or t
aaccgtatggatgaaatgactaagcaaatttggtcnatcagatacttgtctggataagcacaagctgcatc

SEQ ID NO: 2503 - DNA, 71 bp, chicken (Gallus Gallus)
  misc_feature (36): n=a or c
agtggagcatgtgaagtttgatgaaaggccagctgnactgagctcaccagattagtaatgcaggaaacaat

SEQ ID NO: 2504 - DNA, 71 bp, chicken (Gallus Gallus)
  misc_feature (36): n=c or t
cagatcttcattattcaaacctaacaccccccttgnattggttaatcatgaagagtttaaattagcatact

SEQ ID NO: 2505 - DNA, 71 bp, chicken (Gallus Gallus)
  misc_feature (36): n=c or t
aaaagaccctccactaattcagattacacacgtggncaattgtcattagcctgttttagtgcttttacagt

SEQ ID NO: 2506 - DNA, 71 bp, chicken (Gallus Gallus)
  misc_feature (36): n=c or t
gtagatgtaaccagttttgaccagattaagcttgancttctagtattacaagaactcaaatatgtcaaaga

SEQ ID NO: 2507 - DNA, 71 bp, chicken (Gallus Gallus)
  misc_feature (36): n=a or g
aagtgcttttcttgcttctctgaggctgcctcggcnagatgaagcatgagctatgagtcttcttcagccca

SEQ ID NO: 2508 - DNA, 71 bp, chicken (Gallus Gallus)
  misc_feature (36): n=a or g
caggactgacagtgtccacatccatcctgttgctgnctgtggcattaatggatgctggcctggctgttcct

SEQ ID NO: 2509 - DNA, 71 bp, chicken (Gallus Gallus)
  misc_feature (36): n=a or g
ttgaccagtaaatctgaccaactcttggagtgtgcntcacaatgacttatgactctcagctccacaaccac

SEQ ID NO: 2510 - DNA, 71 bp, chicken (Gallus Gallus)
  misc_feature (36): n=a or g
gtaaggcactgagcaagcggcttgccgtggataganagctgagatctatagcagaatttcatagcagatag

SEQ ID NO: 2511 - DNA, 71 bp, chicken (Gallus Gallus)
  misc_feature (36): n=a or g
cagccagcttgccaaccttcctgatgatactgcagnttttctcaaaataacctgtttaaaaatgagaggtt

SEQ ID NO: 2512 - DNA, 71 bp, chicken (Gallus Gallus)
  misc_feature (36): n=a or g
gtttgctttggagactttcaaagtctgttagtatcnaagctcacaaacaaaagagcaagcagcaggaaaat

SEQ ID NO: 2513 - DNA, 71 bp, chicken (Gallus Gallus)
  misc_feature (36): n=g or t
ttattttagcattgtgaacaccatcaaaagcctcgntttcttgccccagcttcaatctaccccagatgaat

SEQ ID NO: 2514 - DNA, 71 bp, chicken (Gallus Gallus)
  misc_feature (36): n=g or t
actcaatgaggaatgaaagctccagatgctctgccntccagccccaatctctgatcaattccctttggatc

SEQ ID NO: 2515 - DNA, 71 bp, chicken (Gallus Gallus)
  misc_feature (36): n=a or g
ctgagtggaagtttagaagatggtaattcagctctntatctatgcaaggaaattaaatggaataaggcatt

SEQ ID NO: 2516 - DNA, 71 bp, chicken (Gallus Gallus)
  misc_feature (36): n=c or t
ctatctaggggtagaggtcttttcaaattatttggngtccagtttttccttttactttcaacaagcttctc

SEQ ID NO: 2517 - DNA, 71 bp, chicken (Gallus Gallus)
  misc_feature (36): n=c or t
aaccaaataagaatcacaaccaaatgttactagctnttgtgtatcactgctttcatttggttatcttcagt

SEQ ID NO: 2518 - DNA, 71 bp, chicken (Gallus Gallus)
  misc_feature (36): n=g or t
acgctctgagactcagccagccaagctagacagatnaatctaagatgcacatgatttgttatatattttat

SEQ ID NO: 2519 - DNA, 71 bp, chicken (Gallus Gallus)
  misc_feature (36): n=a or g
ggtcataatcagctgaacaaatactcagcacccaanagtccttaggaaatcccattagtcctaaaacaata

SEQ ID NO: 2520 - DNA, 71 bp, chicken (Gallus Gallus)
  misc_feature (36): n=a or g
aacctattatgttggatgtgttttctatccagatcnttccctccaaagatactgaaatagctgtgaagtga

SEQ ID NO: 2521 - DNA, 71 bp, chicken (Gallus Gallus)
  misc_feature (36): n=a or g
caaaacccaaggcttccaaactaaacaaacttttcnataaatatgtatacattttgctcacagcatacttg

SEQ ID NO: 2522 - DNA, 71 bp, chicken (Gallus Gallus)
  misc_feature (36): n=a or g
tgtctcttatattttctgtatcagtgtttggtagangagaaaaaaatcaaatctctttttattttgatttt

SEQ ID NO: 2523 - DNA, 71 bp, chicken (Gallus Gallus)
  misc_feature (36): n=a or g
ctgtgccataggactcatgtatctgacactggtcangaaagaaatgaagggtggaagtagggctaactggg

SEQ ID NO: 2524 - DNA, 71 bp, chicken (Gallus Gallus)
  misc_feature (36): n=a or g
attcctaaatccatgctgactgggcctgatcccctngttgacctttaatttatcctgatattatctgttcc

SEQ ID NO: 2525 - DNA, 71 bp, chicken (Gallus Gallus)
  misc_feature (36): n=c or t
ttcagtctgtaatgaaatagggcaaagaaagtaagnagcgaagtgaaagaggattttaaaatggtcatttc

SEQ ID NO: 2526 - DNA, 71 bp, chicken (Gallus Gallus)
  misc_feature (36): n=g or t
ctaccacaggaaagaagggtagaggagatgtatgantattatattttactataatatatgcaatagagcaa

SEQ ID NO: 2527 - DNA, 71 bp, chicken (Gallus Gallus)
  misc_feature (36): n=c or t
gaagtgttcagagaccagcattggaataggaggagngtgctttctctaagtgattctaattcatcctctgt

SEQ ID NO: 2528 - DNA, 71 bp, chicken (Gallus Gallus)
  misc_feature (36): n=c or t
taagtcactacaaaagtaaaagaagctaagacagangttagccatacaaagatacatcatctaaaaattgt

SEQ ID NO: 2529 - DNA, 71 bp, chicken (Gallus Gallus)
  misc_feature (36): n=c or t
acatttcaggagaagttgcttctcagtgatgaatcnacactaaatttatctcaattccagaatagcaattt

SEQ ID NO: 2530 - DNA, 71 bp, chicken (Gallus Gallus)
  misc_feature (36): n=c or t
gccacctaattggataaattgcatagctccatggtngcctaccagcatttaatctcaagattaatttctgt

SEQ ID NO: 2531 - DNA, 71 bp, chicken (Gallus Gallus)
  misc_feature (36): n=c or t
gctaataaacaaaatgagagctagtgtctgaaaacngaagaccttactctaatgctgagacagacatctag

SEQ ID NO: 2532 - DNA, 71 bp, chicken (Gallus Gallus)
  misc_feature (36): n=c or t
attttacaaaatctctttggtagcagggaaaaatantgagaggagtaggaaaacccacctgatcaatgtgg

SEQ ID NO: 2533 - DNA, 71 bp, chicken (Gallus Gallus)
  misc_feature (36): n=c or t
ttgtttactgcttagagatattcacagagtgtaatntatggataatggagcagaaatatgcctctaacctt

SEQ ID NO: 2534 - DNA, 71 bp, chicken (Gallus Gallus)
  misc_feature (36): n=a or g
agagaataaggcgtccaaaaaaaatgaaaccagtanaaacatgcctcttgcagacctttctgttttcagca

SEQ ID NO: 2535 - DNA, 71 bp, chicken (Gallus Gallus)
  misc_feature (36): n=a or c
tcactagtttccctgctgtcaggtccaagttggcangaagtcctagttttagaatcactcaaacattttac

SEQ ID NO: 2536 - DNA, 71 bp, chicken (Gallus Gallus)
  misc_feature (36): n=a or g
cttcaagctggtctgtagaagtgctgaagtaaatgntcaagagctatctctcagccccattcgcaagtact

SEQ ID NO: 2537 - DNA, 71 bp, chicken (Gallus Gallus)
  misc_feature (36): n=g or t
tgacatgaagggataggacatggtgtgtgactgtanattgtagagaactgaaaaattcacaccatcaattc

SEQ ID NO: 2538 - DNA, 71 bp, chicken (Gallus Gallus)
  misc_feature (36): n=a or g
cccttttcgtatccttgcaaaatatatcattattgnttttcccagtgatactttgcctggtatcacgaaga

SEQ ID NO: 2539 - DNA, 71 bp, chicken (Gallus Gallus)
  misc_feature (36): n=a or g
aggaaactgaggagatacataactttgaaataatcntagtgtacaagtttagctaaacatgtaaagaatgt

SEQ ID NO: 2540 - DNA, 71 bp, chicken (Gallus Gallus)
  misc_feature (36): n=a or g
ttgccacaaacacaagtcctatgtcaaaaggaaccngagtcacacaggcaaaaatgatatgtcccaaagct

SEQ ID NO: 2541 - DNA, 71 bp, chicken (Gallus Gallus)
  misc_feature (36): n=a or g
gcaacacatcctgaaaggatgcagatgcaaatgcanggcataacgcatgaactgtccacagttcctgttaa

SEQ ID NO: 2542 - DNA, 71 bp, chicken (Gallus Gallus)
  misc_feature (36): n=a or g
tgaatcttttctttggaataatatgtttagactagncattcataagtcattgcctattcccataatttgtt

SEQ ID NO: 2543 - DNA, 71 bp, chicken (Gallus Gallus)
  misc_feature (36): n=c or t
cccttctctttctgcagctcttagtgacccatggtngtagcactctcctgtctgcacaggtgttcatgaga

SEQ ID NO: 2544 - DNA, 71 bp, chicken (Gallus Gallus)
  misc_feature (36): n=a or g
gaattatgagaacagattcattaacttatttggctngcttacaattacagaaataaattgttgacctgact

SEQ ID NO: 2545 - DNA, 71 bp, chicken (Gallus Gallus)
  misc_feature (36): n=a or g
ggtagttgtccagcccactaatttgtcaagatcttntgataggcgtccctgtcatcagctcctcctaagtt

SEQ ID NO: 2546 - DNA, 71 bp, chicken (Gallus Gallus)
  misc_feature (36): n=a or g
catcttttccatatcatgatcttcagttgacttcanagatcatggaagaaggagtaaatagggtgaagttg

SEQ ID NO: 2547 - DNA, 71 bp, chicken (Gallus Gallus)
  misc_feature (36): n=c or t
ggagacgtttctatcctaaagcatttcactcacagnggtagcatttgctgtaggagtactgagttctcaaa

SEQ ID NO: 2548 - DNA, 71 bp, chicken (Gallus Gallus)
  misc_feature (36): n=c or t
acttgctgtgattagaaacaccttcctattacctcngttgagctgaggattctaagtacgactgatttagc

SEQ ID NO: 2549 - DNA, 71 bp, chicken (Gallus Gallus)
  misc_feature (36): n=a or g
gcacagtgaggtggtgggcaatgtatttcagcagtngcaagagtgactttcaaaggtacccttcaactcaa

SEQ ID NO: 2550 - DNA, 71 bp, chicken (Gallus Gallus)
  misc_feature (36): n=a or g
aaccagcttacaagttggcaggtttttaataggagngataggaaacaaccaaatgaataaactatggcaca

SEQ ID NO: 2551 - DNA, 71 bp, chicken (Gallus Gallus)
  misc_feature (36): n=c or t
ttcccctcaaatcttgtagccagaaggaggccacgntttgcttggcagccttgtagaagcagtgaatacac

SEQ ID NO: 2552 - DNA, 71 bp, chicken (Gallus Gallus)
  misc_feature (36): n=a or g
tgctcatacaatgcttctgtctgtagcaacttcagntaataattacccctctaattacaaagacattcacg

SEQ ID NO: 2553 - DNA, 71 bp, chicken (Gallus Gallus)
  misc_feature (36): n=a or g
tagtcccccctcagttcctgacaagaaaggagaggngaactacctccatcacaactgagtccctcccacgc

SEQ ID NO: 2554 - DNA, 71 bp, chicken (Gallus Gallus)
  misc_feature (36): n=a or c
agtatcagggacatttgcttcctggctttattctgnagtgattaatgttcagaaaatctagctagaagggc

SEQ ID NO: 2555 - DNA, 71 bp, chicken (Gallus Gallus)
  misc_feature (36): n=a or g
tgatgtgtgtgcagctgaagcagccccgtggctctntgctgtgcatatgtgtgtgaaaggccataaataac

SEQ ID NO: 2556 - DNA, 71 bp, chicken (Gallus Gallus)
  misc_feature (36): n=a or g
acttgtatataaaacgtgcactaaatgcatctatcngggagctaatgcagagcatcaaccatgtaagcaca

SEQ ID NO: 2557 - DNA, 71 bp, chicken (Gallus Gallus)
  misc_feature (36): n=g or t
cactgaactgaccagtatgcacactgggtagcttgncaatagcaagtgttcgtatttgaccaggaatgtta

SEQ ID NO: 2558 - DNA, 71 bp, chicken (Gallus Gallus)
  misc_feature (36): n=a or c
acctccagggcttaacgtggatggatagtggggagnactgtgcattgttcaaagtctccaatgaccctgaa

SEQ ID NO: 2559 - DNA, 71 bp, chicken (Gallus Gallus)
  misc_feature (36): n=g or t
tcttatggggtagagaacacagagagtttgaactcngtatacttttatcagatgaagaaacttgacagact

SEQ ID NO: 2560 - DNA, 71 bp, chicken (Gallus Gallus)
  misc_feature (36): n=c or t
agagagaggggaagtttcccttaaaatagcacgccnagctcctgtggaataaggaagatgctaacacatct

SEQ ID NO: 2561 - DNA, 71 bp, chicken (Gallus Gallus)
  misc_feature (36): n=a or g
caataggtgataggttagtctattacgttgcaaggntgcacaaccacgaaacagttaacactttcaaatgc

SEQ ID NO: 2562 - DNA, 71 bp, chicken (Gallus Gallus)
  misc_feature (36): n=a or g
acatggacataattcttgaatttctagacaaactcnagcacttagatgtctgttgaaattagtcacagctg

SEQ ID NO: 2563 - DNA, 71 bp, chicken (Gallus Gallus)
  misc_feature (36): n=a or g
ctgaggaatggaagaaccagggaaaaagttattcanaggacatcaggttgccttccttgctgtggagggca

SEQ ID NO: 2564 - DNA, 71 bp, chicken (Gallus Gallus)
  misc_feature (36): n=a or g
attcttttttcagaggatcctgcatgctctggtacntgtgcattggaatcttcagctgttccggtttcact

SEQ ID NO: 2565 - DNA, 71 bp, chicken (Gallus Gallus)
  misc_feature (36): n=c or t
aataatgagctatttcttgttgtacatcatcttttnatatgataaaatgtgctaaagcatttgtggttggc

SEQ ID NO: 2566 - DNA, 71 bp, chicken (Gallus Gallus)
  misc_feature (36): n=c or t
tgagagtccctggattctaaaactagaaatagccancttccacagctattttacaagatgaaaacctggga

SEQ ID NO: 2567 - DNA, 71 bp, chicken (Gallus Gallus)
  misc_feature (36): n=a or g
ctgctgtggcacaagcttcccctaccaagagagagnaggttagctggagcatgaaaggatagcactgagca

SEQ ID NO: 2568 - DNA, 71 bp, chicken (Gallus Gallus)
  misc_feature (36): n=a or g
ggcaacttaataccaagaaattactgtaacttccantggtaatttttaatatgacaaacccaaaactttaa

SEQ ID NO: 2569 - DNA, 71 bp, chicken (Gallus Gallus)
  misc_feature (36): n=a or g
gtgtccatgtaaccctcagccagttgattgccatgnttttcttctatcaattactaggaatgaaggacctg

SEQ ID NO: 2570 - DNA, 71 bp, chicken (Gallus Gallus)
  misc_feature (36): n=a or g
ggatgttaaaagctaattacttcgagattatttganggcttataaaaggttcttctatgctccgttctgat

SEQ ID NO: 2571 - DNA, 71 bp, chicken (Gallus Gallus)
  misc_feature (36): n=c or t
tcgtttcagttctttctgacgtatgaacagctgaanaaattagacttgtgatgtcctgacccatgtgctga

SEQ ID NO: 2572 - DNA, 71 bp, chicken (Gallus Gallus)
  misc_feature (36): n=a or g
gtacagttgttaaacacttcaacaatcttccaatcnttttggtcagatacaaactagcttatattgtgttc

SEQ ID NO: 2573 - DNA, 71 bp, chicken (Gallus Gallus)
  misc_feature (36): n=c or t
atcattttacagctttcagccatctgcagaataacngcagacttggggataacctgtgatcctaggaccac

SEQ ID NO: 2574 - DNA, 71 bp, chicken (Gallus Gallus)
  misc_feature (36): n=c or t
gtgcgagtcacgtgacagttctctctttggtggagnctcatcctctgtatgtgttcatagcatgactgggc

SEQ ID NO: 2575 - DNA, 71 bp, chicken (Gallus Gallus)
  misc_feature (36): n=a or g
catcccggtcttgatctaactaatcacagctcaacngccaaagaaagctgagggatgctgagggctagaaa

SEQ ID NO: 2576 - DNA, 71 bp, chicken (Gallus Gallus)
  misc_feature (36): n=a or g
tctacaaaagcatctgcaatgatacaaaagtctccngtcaagtgtctgtggtccatgaacatgacaaaaat

SEQ ID NO: 2577 - DNA, 71 bp, chicken (Gallus Gallus)
  misc_feature (36): n=c or t
agagccaaatatctctaatatcaactccagagtttnactaaatatcattaagccccacttctaagggcatt

SEQ ID NO: 2578 - DNA, 71 bp, chicken (Gallus Gallus)
  misc_feature (36): n=c or t
aactgaatttaggtggataagtatctgcaatttctnagtccattaagtgtaaattaaaatgttcaaataat

SEQ ID NO: 2579 - DNA, 71 bp, chicken (Gallus Gallus)
  misc_feature (36): n=c or t
ttcttgttaccttctactaaagctccaaatggaagnaaatactttgctgagtttgatggggtcgagtgctc

SEQ ID NO: 2580 - DNA, 71 bp, chicken (Gallus Gallus)
  misc_feature (36): n=c or t
acacaataattcatttatgatacacttcttaccaangaacatcgagaccatgatccccattcagacataac

SEQ ID NO: 2581 - DNA, 71 bp, chicken (Gallus Gallus)
  misc_feature (36): n=c or t
taaaaaagagatgttattttgcttgctggtgattgnggttttatttccgagggattatttgatttgtgaga

SEQ ID NO: 2582 - DNA, 71 bp, chicken (Gallus Gallus)
  misc_feature (36): n=a or c
ctatggcattttaatgtggaattagagtgaattaanaatagcatatttgttaagttgttctttttcttttt

SEQ ID NO: 2583 - DNA, 71 bp, chicken (Gallus Gallus)
  misc_feature (36): n=a or c
aatatatttggaataactaactcttaaatttgaganaaatctggcaaagggtttttaagaggtaaaaacac

SEQ ID NO: 2584 - DNA, 71 bp, chicken (Gallus Gallus)
  misc_feature (36): n=c or t
atttacagctgagtaggtcccagtatatactggtgnatgtggtacattcttccccaggtgcaggactttgt

SEQ ID NO: 2585 - DNA, 71 bp, chicken (Gallus Gallus)
  misc_feature (36): n=a or g
cttaaagcaaactgccagaacctagttccattgccntgacggaattcacacaatacagtgcagccttaaaa

SEQ ID NO: 2586 - DNA, 71 bp, chicken (Gallus Gallus)
  misc_feature (36): n=a or g
taagaatagctgctgctgttcttatgcagaaagccntgcatataagcaaattcattgttttccatcctttc

SEQ ID NO: 2587 - DNA, 71 bp, chicken (Gallus Gallus)
  misc_feature (36): n=a or g
tgtcctaacgcctacagatttctggaatctttgacntgtactgtttaatgtatgctgtggtattgctgaaa

SEQ ID NO: 2588 - DNA, 71 bp, chicken (Gallus Gallus)
  misc_feature (36): n=c or t
gctgaagctgtaccacaggagagcagacattcatancctctaaaaagccagcaattatgaaacccaagcct

SEQ ID NO: 2589 - DNA, 71 bp, chicken (Gallus Gallus)
  misc_feature (36): n=g or t
tggtctgtagtgtatcaaggccatccacctctggangtagctcatataagatagaattgctagacattaag

SEQ ID NO: 2590 - DNA, 71 bp, chicken (Gallus Gallus)
  misc_feature (36): n=g or t
gtggatcgttgtcagaatatctaatatggccttgtnctagtgttatatcatacaaatttatattcatgcat

SEQ ID NO: 2591 - DNA, 71 bp, chicken (Gallus Gallus)
  misc_feature (36): n=c or t
gatctgaggttctttgaatttctaatgatcagtttnactgggcaagactgaggcaaagaagacatccaata

SEQ ID NO: 2592 - DNA, 71 bp, chicken (Gallus Gallus)
  misc_feature (36): n=a or c
tgcatcgtaatagcatttggagatagattgttttcntcttttcatattgacactgatgctttgatcaattg

SEQ ID NO: 2593 - DNA, 71 bp, chicken (Gallus Gallus)
  misc_feature (36): n=a or g
ccagaatagatatctaagttgttgggcaaaattaancactacagtttgtgcagaatcttgaattccattac

SEQ ID NO: 2594 - DNA, 71 bp, chicken (Gallus Gallus)
  misc_feature (36): n=a or c
aggacgaaatggcctgcaataaacagcagtttgagngggataatttgatgcattgagttcttaagcttctc

SEQ ID NO: 2595 - DNA, 71 bp, chicken (Gallus Gallus)
  misc_feature (36): n=a or g
attcccaatactataacctgacaccagttctgagcnctgctcactgcggttagcacaagcagatgaatttt

SEQ ID NO: 2596 - DNA, 71 bp, chicken (Gallus Gallus)
  misc_feature (36): n=c or t
gagtgggtgctgaataacaaatgcaagactgatacngagctgcttttccatttgttaaatcttctttcaga

SEQ ID NO: 2597 - DNA, 71 bp, chicken (Gallus Gallus)
  misc_feature (36): n=c or t
agcatctatgtgctgtaacatactctgaagacttcntgttgaaatccctgaggaaaagttgccactgattt

SEQ ID NO: 2598 - DNA, 71 bp, chicken (Gallus Gallus)
  misc_feature (36): n=c or t
gacagtgagtttcagactggagcacttttgagcagngctatgtacaaatgcatgaaatttgattttgtctg

SEQ ID NO: 2599 - DNA, 71 bp, chicken (Gallus Gallus)
  misc_feature (36): n=c or t
ctcctgtgacaactctctccttagttggtacgaagncgaaacagccaagcaccacctggaggccttcttct

SEQ ID NO: 2600 - DNA, 71 bp, chicken (Gallus Gallus)
  misc_feature (36): n=a or g
ttaaaattttctctctatcatagtgaggatccttgnccattgcataatttctccattttgcagtctcacta

SEQ ID NO: 2601 - DNA, 71 bp, chicken (Gallus Gallus)
  misc_feature (36): n=a or g
gagacatttttctcaaaagctgatgactttctgtcntcaggagtgctcccattagttattaagattaatgg

SEQ ID NO: 2602 - DNA, 71 bp, chicken (Gallus Gallus)
  misc_feature (36): n=c or t
atacccaagaccacacaaagcagatgtggaaatttnctatagactaagcaacccaattattttacaacagt

SEQ ID NO: 2603 - DNA, 71 bp, chicken (Gallus Gallus)
  misc_feature (36): n=a or g
cagattcatgctagcacccttctttctccttaaggnctcatagttcttgttccttcttataaggatagtgt

SEQ ID NO: 2604 - DNA, 71 bp, chicken (Gallus Gallus)
  misc_feature (36): n=c or t
ataactctgacataaaaactaaaattatgtgtatgnaacccatataaatgatgtaatagcagatgcagaga

SEQ ID NO: 2605 - DNA, 71 bp, chicken (Gallus Gallus)
  misc_feature (36): n=c or t
gagggcctttacaacatgaattcttccttcattctnggattttaaatcccgggtaggttttgctcttcttg

SEQ ID NO: 2606 - DNA, 71 bp, chicken (Gallus Gallus)
  misc_feature (36): n=c or t
aaaaaaataacaacaaaaaagacattctgaacccangtagttgggctgatactgtaagttatttctcattc

SEQ ID NO: 2607 - DNA, 71 bp, chicken (Gallus Gallus)
  misc_feature (36): n=c or t
tgcagttttcaatatcctccctaaaatactgactcnaggactagacagaacaatacagcacttagaccctt

SEQ ID NO: 2608 - DNA, 71 bp, chicken (Gallus Gallus)
  misc_feature (36): n=a or g
ccaagtgtggcacaaggaattagctaattaatagtntgttgtgtagttaaaagtcaaattgcatgtgtttg

SEQ ID NO: 2609 - DNA, 71 bp, chicken (Gallus Gallus)
  misc_feature (36): n=g or t
gggcaaatatgcacccttcaggcatcttagctagtncagtcatactagcaaaaccaagtttgcaatgattc

SEQ ID NO: 2610 - DNA, 71 bp, chicken (Gallus Gallus)
  misc_feature (36): n=g or t
aacaggctgtcaggtctgcttatgccaatctgctcnaaaatgaacccactcgtttgaaattcacagttctc

SEQ ID NO: 2611 - DNA, 71 bp, chicken (Gallus Gallus)
  misc_feature (36): n=c or t
ctgtgcaggttaggaaagatgcctggaaaatgttanaagacagtgcagttcaaagacagattgaaatatgt

SEQ ID NO: 2612 - DNA, 71 bp, chicken (Gallus Gallus)
  misc_feature (36): n=a or g
tgaaagatgtttacagtcaccactttcccagtactntaacttttgattctgcctgatgtaatttattacag

SEQ ID NO: 2613 - DNA, 71 bp, chicken (Gallus Gallus)
  misc_feature (36): n=c or t
tcaaaaataccttaaaatcatatattctcattaagnaggtccttcacagatttcactactttttttttttt

SEQ ID NO: 2614 - DNA, 71 bp, chicken (Gallus Gallus)
  misc_feature (36): n=g or t
tgactaaaactactactttttttctctacaaatctngcttctctaaagctatataagcactaaagcttatc

SEQ ID NO: 2615 - DNA, 71 bp, chicken (Gallus Gallus)
  misc_feature (36): n=a or g
tttgggaccaacacaattagagggagatggatctcnctacacgttaatgactcaagtcaagggtgaaaaac

SEQ ID NO: 2616 - DNA, 71 bp, chicken (Gallus Gallus)
  misc_feature (36): n=a or c
tttctgtatctggtttgaattacatttaacaagttntgtttcaagtttcctttgcaagttagctgaatgat

SEQ ID NO: 2617 - DNA, 71 bp, chicken (Gallus Gallus)
  misc_feature (36): n=c or t
gccctttacccactcttttcttcatgatgtatggangagcctcagtgacttacaattctatgagctttatt

SEQ ID NO: 2618 - DNA, 71 bp, chicken (Gallus Gallus)
  misc_feature (36): n=c or t
gcagctctttgagctacatccaggcactgcaccatncgtttggcagtgtgaacaggttgggcacgtagagc

SEQ ID NO: 2619 - DNA, 71 bp, chicken (Gallus Gallus)
  misc_feature (36): n=c or t
cacagcctaacaccatagaccggtggaagcagcttnttaaatttagaagaaaaaattcttgacagagtaat

SEQ ID NO: 2620 - DNA, 71 bp, chicken (Gallus Gallus)
  misc_feature (36): n=c or g
ggatgagacctatttcatttgtagttaaccattcanaggtgacagattcaagtgcttaattttttttaaat

SEQ ID NO: 2621 - DNA, 71 bp, chicken (Gallus Gallus)
  misc_feature (36): n=a or g
agcacacagaagagaaggatgtgaagatgccagaangaggctcttctgtatttgtgaatctctccaaatgg

SEQ ID NO: 2622 - DNA, 71 bp, chicken (Gallus Gallus)
  misc_feature (36): n=a or g
tgagttctcacgttgttatccccaacacccacaagncctgtgaacaaggcctgattgctagaaagtttgct

SEQ ID NO: 2623 - DNA, 71 bp, chicken (Gallus Gallus)
  misc_feature (36): n=a or g
tggcttttgaaaagggatactgctactgggaacacntctgatgatttctaccaatgcttataagttttttt

SEQ ID NO: 2624 - DNA, 71 bp, chicken (Gallus Gallus)
  misc_feature (36): n=c or t
cagaagcaagcagccaaagcttgactctggaaacantccttgaaagaaaggtcggacacaaacatctctct

SEQ ID NO: 2625 - DNA, 71 bp, chicken (Gallus Gallus)
  misc_feature (36): n=a or g
tatgtgaattgcactcttttgaagattatattgganccacatccctaatcatagctggaaagagtttcgag

SEQ ID NO: 2626 - DNA, 71 bp, chicken (Gallus Gallus)
  misc_feature (36): n=a or g
ctagcagctgctctgctgcaacctgcagtgcagacntacccagaatcaagttgctcatgggcagaatacag

SEQ ID NO: 2627 - DNA, 71 bp, chicken (Gallus Gallus)
  misc_feature (36): n=a or g
ggtactaccaacagctgaataagtaccaaataccantgcaatttgagaggaatattttttatggtactaaa

SEQ ID NO: 2628 - DNA, 71 bp, chicken (Gallus Gallus)
  misc_feature (36): n=c or t
ttaaaatgtgacatctatttcattgtagataatagngaaccccagatagagaggactagaaataattctgc

SEQ ID NO: 2629 - DNA, 71 bp, chicken (Gallus Gallus)
  misc_feature (36): n=c or t
tgtagaccaataatactgcacactgatctaccattnctttaagatatgtagctggaaatacatttagggaa

SEQ ID NO: 2630 - DNA, 71 bp, chicken (Gallus Gallus)
  misc_feature (36): n=a or g
taaaagcccttaaaataaaagcttggtgtcaagccngacgatggattacagaaagcattaacagcagaatg

SEQ ID NO: 2631 - DNA, 71 bp, chicken (Gallus Gallus)
  misc_feature (36): n=a or g
tgtaaattgtctgcagatcttagcagaatccttaanagaaaaatagctgtttagatgactggaacacattt

SEQ ID NO: 2632 - DNA, 71 bp, chicken (Gallus Gallus)
  misc_feature (36): n=a or g
caagagtaatgtatagtgtttggaaattagaagaantatagctatcctaaagcacccaactgtattaacag

SEQ ID NO: 2633 - DNA, 71 bp, chicken (Gallus Gallus)
  misc_feature (36): n=c or t
tcatgctccacatttccaatggagtttttcaattcngtgagttgcatattagaaagtttatagctctgcat

SEQ ID NO: 2634 - DNA, 71 bp, chicken (Gallus Gallus)
  misc_feature (36): n=a or g
tcaaattctcacactatgctattacttgtttctccntaagcattactaaaacaagcttgactccaatagca

SEQ ID NO: 2635 - DNA, 71 bp, chicken (Gallus Gallus)
  misc_feature (36): n=c or t
agaaaacaggaacttcaccctgcaaatcagacactntaatttaaaaacaggctgtctctttggttaaaaaa

SEQ ID NO: 2636 - DNA, 71 bp, chicken (Gallus Gallus)
  misc_feature (36): n=c or t
agaggatatcccagtatgcttcaagctcttgcaacnttcatgtttctcagcacaatgtgtaatgagaagat

SEQ ID NO: 2637 - DNA, 71 bp, chicken (Gallus Gallus)
  misc_feature (36): n=c or t
tgaattccccagaacaaggtcatgtcattattggtnctgttattgttttgttctgtggcaatggcttggag

SEQ ID NO: 2638 - DNA, 71 bp, chicken (Gallus Gallus)
  misc_feature (36): n=c or t
ccttttggatctgaacccagctaatactgtgacagngttgagaaagacagcacctattttcgtaggttagt

SEQ ID NO: 2639 - DNA, 71 bp, chicken (Gallus Gallus)
  misc_feature (36): n=a or g
atgacctaaataaatgatttcctatttcatttcacntagtcatgacctccatgacatctccaactgggaca

SEQ ID NO: 2640 - DNA, 71 bp, chicken (Gallus Gallus)
  misc_feature (36): n=c or t
ataacagaaagaaatcccatcgctgctacaccttgntccttgcacatgtactgcacgaggccagcagtcag

SEQ ID NO: 2641 - DNA, 71 bp, chicken (Gallus Gallus)
  misc_feature (36): n=a or g
acccactcaagtacgtccaagttttccttatgctgngaaccacaagctgaatgcagtactccaggtggggt

SEQ ID NO: 2642 - DNA, 71 bp, chicken (Gallus Gallus)
  misc_feature (36): n=c or t
ttaattgagtttatagctactctgctttactcattnctcttcctgtagtattttcaatggagagtgagact

SEQ ID NO: 2643 - DNA, 71 bp, chicken (Gallus Gallus)
  misc_feature (36): n=c or t
ctgaagaggtgaagaatggctatgtgaattgcttanagtagcagagttttccagcaagcttagaaataatt

SEQ ID NO: 2644 - DNA, 71 bp, chicken (Gallus Gallus)
  misc_feature (36): n=a or g
aagaagcttattaatgaatggcttcaaaagccactngcagaggcaggtgtaagatgcaggctattggtcag

SEQ ID NO: 2645 - DNA, 71 bp, chicken (Gallus Gallus)
  misc_feature (36): n=c or t
gattaattttaaagcagtatagaatcccatggtttnagtatgttgcaccatgtgggtacagagctgagctg

SEQ ID NO: 2646 - DNA, 71 bp, chicken (Gallus Gallus)
  misc_feature (36): n=a or g
tggtctccagctgaaaagctatgttgtgcttctagnagttcagtcctatattgtgagaacatcaagagaac

SEQ ID NO: 2647 - DNA, 71 bp, chicken (Gallus Gallus)
  misc_feature (36): n=a or g
gaaaaatagtatcacagaagaacatgagctcatggntagagagaaagcaaaagaataaaatacacaagtta

SEQ ID NO: 2648 - DNA, 71 bp, chicken (Gallus Gallus)
  misc_feature (36): n=a or g
cgcccactaacagtttatcaagatcagaaacaaggnaaaataaaattacctgtcttataaatcacttctct

SEQ ID NO: 2649 - DNA, 71 bp, chicken (Gallus Gallus)
  misc_feature (36): n=a or g
aaaaaaaaaaaaagctgctcagagttaaagcttacntttcctgcatatttataaatgaagtcctgatgttg

SEQ ID NO: 2650 - DNA, 71 bp, chicken (Gallus Gallus)
  misc_feature (36): n=a or g
ttgggttacatactaagaattgttctcattctctgnaacagcttgcactctgaatctgaagatgttcaatg

SEQ ID NO: 2651 - DNA, 71 bp, chicken (Gallus Gallus)
  misc_feature (36): n=a or g
agtaccaacctaggggttatacatcttctgggatcngtaatcaaacactgcatgtcaccatacaagctagc

SEQ ID NO: 2652 - DNA, 71 bp, chicken (Gallus Gallus)
  misc_feature (36): n=a or g
gcccgttttgaagtttgccttatctttcatcctccnttttacgcagatggtctaatagattagcttttatg

SEQ ID NO: 2653 - DNA, 71 bp, chicken (Gallus Gallus)
  misc_feature (36): n=a or g
tgagatcagctataatttttttctaagtacactcangagtgcgttaccaaaagtattgctatgaataagga

SEQ ID NO: 2654 - DNA, 71 bp, chicken (Gallus Gallus)
  misc_feature (36): n=c or t
aaaagtacaacagagaggactgtgacaccatctgcnatctccttctatggcaaatcaaccccattcctaca

SEQ ID NO: 2655 - DNA, 71 bp, chicken (Gallus Gallus)
  misc_feature (36): n=c or t
tttcctctaccgctgtggcagtaagggctcctgtgnagagggacgctactttgaacgctaggcatatctgg

SEQ ID NO: 2656 - DNA, 71 bp, chicken (Gallus Gallus)
  misc_feature (36): n=a or g
tgtgttggactgtacaatttttcttcttgccccagngatgagtgaacatcgtgtagaatcaggaatgggca

SEQ ID NO: 2657 - DNA, 71 bp, chicken (Gallus Gallus)
  misc_feature (36): n=a or g
ctgcatctaaccattactgataggcaatggcattcnacaaaagcaggcctttgctgtggctcataccacag

SEQ ID NO: 2658 - DNA, 71 bp, chicken (Gallus Gallus)
  misc_feature (36): n=a or g
ttttaaacacaattagcctcatatacagtagtacanaatcaagttcagcagacagcttctactgaaacaga

SEQ ID NO: 2659 - DNA, 71 bp, chicken (Gallus Gallus)
  misc_feature (36): n=a or g
gatgcaaccctgtcacatccatacaaatgaacagcncccttccattctgcagctctgtgaacttctggtta

SEQ ID NO: 2660 - DNA, 71 bp, chicken (Gallus Gallus)
  misc_feature (36): n=a or g
catgctagcagagctgaattcaaatctcaatcattnaaacaatcaagatttaaggctatctaggcatctcc

SEQ ID NO: 2661 - DNA, 71 bp, chicken (Gallus Gallus)
  misc_feature (36): n=c or t
aagcatgcatgttagcattaattctgcagttgttancagagatcagtcttcagcagagatggagtgaagca

SEQ ID NO: 2662 - DNA, 71 bp, chicken (Gallus Gallus)
  misc_feature (36): n=c or t
tttgttcctagaaaagatttgcttgtgttcctagangtatatttccgtcttgatgcacagtgatttactcc

SEQ ID NO: 2663 - DNA, 71 bp, chicken (Gallus Gallus)
  misc_feature (36): n=c or t
atccttattgacagttaagaaaaataagcacttcanagcagaatataactcactctaaggcacttggctag

SEQ ID NO: 2664 - DNA, 71 bp, chicken (Gallus Gallus)
  misc_feature (36): n=c or t
tccagtgaaggcaaatctcataagctacctttggcnatgagtcctggcataggttttctacactcgtgtcc

SEQ ID NO: 2665 - DNA, 71 bp, chicken (Gallus Gallus)
  misc_feature (36): n=a or g
ccccaaccactcacagttcttatgccttaatcccantggttcagactgtcttcaggctcctggagtaacat

SEQ ID NO: 2666 - DNA, 71 bp, chicken (Gallus Gallus)
  misc_feature (36): n=a or g
agcatcattccctatgactaagacctgcacaggtgngtaattattccttgaccagctgcctctccccttac

SEQ ID NO: 2667 - DNA, 71 bp, chicken (Gallus Gallus)
  misc_feature (36): n=g or t
tatttatcttctgaattatatattgaagctaaatgntgttatcccaggttcatctatattcacaaaagggc

SEQ ID NO: 2668 - DNA, 71 bp, chicken (Gallus Gallus)
  misc_feature (36): n=a or g
gggtccttgagtgtctcagtgggtgtactgcgtcanttttttctcctaagtcacacgtaagcaactgatat

SEQ ID NO: 2669 - DNA, 71 bp, chicken (Gallus Gallus)
  misc_feature (36): n=c or t
ataaagtcagccttgaatgcactgccctgagtaaangccttgtgacaatgatgaaactaaccctaggtaca

SEQ ID NO: 2670 - DNA, 71 bp, chicken (Gallus Gallus)
  misc_feature (36): n=a or c
gacattggcacctgacaaggagttaagctgcttttnagagcttcgtggcattgcgcagcccagatgacagc

SEQ ID NO: 2671 - DNA, 71 bp, chicken (Gallus Gallus)
  misc_feature (36): n=a or g
caggcaggtggtggttgtgtttggaagctggcaaantggttatatgtaaatataggagcagactgcgtgga

SEQ ID NO: 2672 - DNA, 71 bp, chicken (Gallus Gallus)
  misc_feature (36): n=a or c
tacaagactgctgcttggaaaaactttgcttcatcnatcagatgcagcccttgcaaagctgttattcagtg

SEQ ID NO: 2673 - DNA, 71 bp, chicken (Gallus Gallus)
  misc_feature (36): n=a or g
agtctaggttgttaacacttaagcatcatctgtctntaccagaaggcaacatccagttagaataatgtgga

SEQ ID NO: 2674 - DNA, 71 bp, chicken (Gallus Gallus)
  misc_feature (36): n=c or t
tgtgtcattatttgaaattctgttgttaaaggaagnccaccaatggacactaatggtagtctacaacatcc

SEQ ID NO: 2675 - DNA, 71 bp, chicken (Gallus Gallus)
  misc_feature (36): n=c or t
tgagtgaagaacaacgactattttggagctgtcttncacctctactctgtatggtgccatattttctaagg

SEQ ID NO: 2676 - DNA, 71 bp, chicken (Gallus Gallus)
  misc_feature (36): n=a or c
gagtctggtcactttttcaagcagaacgaattcagncagagctgagaggggcgaggtttcagaccttaccc

SEQ ID NO: 2677 - DNA, 71 bp, chicken (Gallus Gallus)
  misc_feature (36): n=g or t
caacaggagaaggagatgcaggaagcttgtattcanagacccaaaacacccattctcaccttgctttagac

SEQ ID NO: 2678 - DNA, 71 bp, chicken (Gallus Gallus)
  misc_feature (36): n=a or g
atgttaaacactgtgcaagtaagtgcttccacaccncagacagcaccagaaagtaacaccatcttcagatt

SEQ ID NO: 2679 - DNA, 71 bp, chicken (Gallus Gallus)
  misc_feature (36): n=g or t
tggaggtgccccaggatgcagtgagctggtggggtngtaatatcccatgcaggtattgctcagtgagggct

SEQ ID NO: 2680 - DNA, 71 bp, chicken (Gallus Gallus)
  misc_feature (36): n=a or g
cctggaacaaacacagcctagatcaaacagggaaangaaaacacaagtgcacaagctactagatacactgt

SEQ ID NO: 2681 - DNA, 71 bp, chicken (Gallus Gallus)
  misc_feature (36): n=a or c
ccaactgcatccagagaactccaagacagactgtcngcatcacaagtttcatcataaagacatacagctct

SEQ ID NO: 2682 - DNA, 71 bp, chicken (Gallus Gallus)
  misc_feature (36): n=a or g
tcctgaaggaaatactattttttactagaccatttnacatgtcaagagaaagcaggtgtgctttctggaca

SEQ ID NO: 2683 - DNA, 71 bp, chicken (Gallus Gallus)
  misc_feature (36): n=a or g
acacagttgctgcctaggaagctctgtattatctgntcaggtgacatcttaaagacacactgggaggtcat

SEQ ID NO: 2684 - DNA, 71 bp, chicken (Gallus Gallus)
  misc_feature (36): n=a or g
gtgactgctacagccagcaagttggtttgacatggnctgtgcagcatgggttctatcagagttaaaagcag

SEQ ID NO: 2685 - DNA, 71 bp, chicken (Gallus Gallus)
  misc_feature (36): n=g or t
ctgactggagatatcgttccatctgcagggcgtgcngttatccgaactccaacagggtaaataatgcaggg

SEQ ID NO: 2686 - DNA, 71 bp, chicken (Gallus Gallus)
  misc_feature (36): n=a or g
ggtcagcacagagcaagaacagccacattctgaacnggactgatccagagacacatgaataaacttgaact

SEQ ID NO: 2687 - DNA, 71 bp, chicken (Gallus Gallus)
  misc_feature (36): n=g or t
ggatctatttataaatagcaaagtcccttaaagtanccataccatggatattttatcgagtttatatttta

SEQ ID NO: 2688 - DNA, 71 bp, chicken (Gallus Gallus)
  misc_feature (36): n=a or c
gcctggctgtctctttcttaggaatgtacgagtgancctcgtggagcaggcagctcacagtgtgtgttcct

SEQ ID NO: 2689 - DNA, 71 bp, chicken (Gallus Gallus)
  misc_feature (36): n=c or t
agtaggaaagcctcaaattttgcacaacgctgtaangtgggaaacagctagctttaatgtgctatatcaag

SEQ ID NO: 2690 - DNA, 71 bp, chicken (Gallus Gallus)
  misc_feature (36): n=a or g
catcttacacccatttaagcttttgtttcatgatancaaagttcttttcactctgaagggctttcttcttg

SEQ ID NO: 2691 - DNA, 71 bp, chicken (Gallus Gallus)
  misc_feature (36): n=a or g
taatgtagcagaggttacacacatttgccagtcacngatgctgagcttttattcactactggatgagatga

SEQ ID NO: 2692 - DNA, 71 bp, chicken (Gallus Gallus)
  misc_feature (36): n=a or g
tgtgtgaaatgggagaaaggaaaaattacaaagcgntaaaaaagcctggcttgggctgttgacctcagact

SEQ ID NO: 2693 - DNA, 71 bp, chicken (Gallus Gallus)
  misc_feature (36): n=c or t
taggcagtgttttgcattccttttttcatatggtantgtatatactgtgcgatgagaaagtccagatatga

SEQ ID NO: 2694 - DNA, 71 bp, chicken (Gallus Gallus)
  misc_feature (36): n=a or g
tcactacagctgagatatttgatcaaggtcatcatnttttcattgctcaatgaggctcagtagaccccttg

SEQ ID NO: 2695 - DNA, 71 bp, chicken (Gallus Gallus)
  misc_feature (36): n=c or t
tttcaagcaaatctactgagagctttgggtatctgnagttctgcttaaagacaggtgctggaaacaactca

SEQ ID NO: 2696 - DNA, 71 bp, chicken (Gallus Gallus)
  misc_feature (36): n=g or t
cttttctttcttaacacataattgaaacattggatnttctgttgttaccttcactacagacaacacagttt

SEQ ID NO: 2697 - DNA, 71 bp, chicken (Gallus Gallus)
  misc_feature (36): n=a or g
ctcatctttgccaggggtcacgcaaatttggtaaancatttaggcatgtctgaaatgtttgtgcacgttat

SEQ ID NO: 2698 - DNA, 71 bp, chicken (Gallus Gallus)
  misc_feature (36): n=c or t
atgtcttcaagggctagctgctgctattcagagaangtactacagcactactacaacaggagaggcaaaga

SEQ ID NO: 2699 - DNA, 71 bp, chicken (Gallus Gallus)
  misc_feature (36): n=a or g
agatggccaaagcttgttcctgtgctgtcagccctnggttgctctcgttaggtcagttgtacatgtttgtc

SEQ ID NO: 2700 - DNA, 71 bp, chicken (Gallus Gallus)
  misc_feature (36): n=c or t
ttgtatgactagatatgtggttgaacaagtttcatntatttttatgttgtggagcagagcaataaaaagtg

SEQ ID NO: 2701 - DNA, 71 bp, chicken (Gallus Gallus)
  misc_feature (36): n=c or t
gcagcagacagcagccttgtggagctgctggtcaanggagaaggatgggaatcatttacacaagatgaaga

SEQ ID NO: 2702 - DNA, 71 bp, chicken (Gallus Gallus)
  misc_feature (36): n=a or c
tgatcaacctttactctttcattttgtcattatggnagatattataaataaataacatatgaaaaaataaa

SEQ ID NO: 2703 - DNA, 71 bp, chicken (Gallus Gallus)
  misc_feature (36): n=c or t
aagttgctcctgtgttttcaggtgaggattcagacngaggggcattacaatggcatttggcactgcattca

SEQ ID NO: 2704 - DNA, 71 bp, chicken (Gallus Gallus)
  misc_feature (36): n=a or c
agcgctgggtcctgggctgcctggcagtgatgaganttctctcaatcactacatttccgctgtgaagtgtc

SEQ ID NO: 2705 - DNA, 71 bp, chicken (Gallus Gallus)
  misc_feature (36): n=c or t
taataaatggctatagtaatttagctaatcatctcntggggagttgtaatacatctactcttctcctgaca

SEQ ID NO: 2706 - DNA, 71 bp, chicken (Gallus Gallus)
  misc_feature (36): n=a or g
tttgtgacagtgtgaaaaatcatcagtgaacataanatatagatatctgaattgagcttgcagattttttg

SEQ ID NO: 2707 - DNA, 71 bp, chicken (Gallus Gallus)
  misc_feature (36): n=c or t
cagaggatctctcagcctacaatacaatgggaccanggttcaaataggccaaatatcacaagcctgatata

SEQ ID NO: 2708 - DNA, 71 bp, chicken (Gallus Gallus)
  misc_feature (36): n=a or g
catcaaacttttattaatttatcattcattaacgcnaatgtcactggcagtgtgggattttctggaactct

SEQ ID NO: 2709 - DNA, 71 bp, chicken (Gallus Gallus)
  misc_feature (36): n=a or c
aaaaagtgaaataatcggtgccacgtggaacgctcnatggacaggtactagctcatactaccagcaccttg

SEQ ID NO: 2710 - DNA, 71 bp, chicken (Gallus Gallus)
  misc_feature (36): n=g or t
cagttcccattacttcctttggcagtgcacacaaanagctgactcaataatggaactgactggaaaaaatg

SEQ ID NO: 2711 - DNA, 71 bp, chicken (Gallus Gallus)
  misc_feature (36): n=a or c
gctttatagcaaacctcacagctccctctcaggtcnaagaatggaaaagctgcactgcaaacagcagcaac

SEQ ID NO: 2712 - DNA, 71 bp, chicken (Gallus Gallus)
  misc_feature (36): n=a or g
tcttctatgcatgggcacatagggtaatgcttcccntgctttagcagctccctcgactacagctatgattc

SEQ ID NO: 2713 - DNA, 71 bp, chicken (Gallus Gallus)
  misc_feature (36): n=a or g
tttgtctgttttctttgcagacagaaatggtagatncggaatagctgcctaaagggaaggtgatttgacca

SEQ ID NO: 2714 - DNA, 71 bp, chicken (Gallus Gallus)
  misc_feature (36): n=a or g
tggatgagaaatgcatgctatgcaaatccagcctgngactgctccctgcctaatctagctttagattcaat

SEQ ID NO: 2715 - DNA, 71 bp, chicken (Gallus Gallus)
  misc_feature (36): n=a or c
cggttgcagctgatacagtcttagtgatatttaggnggttattttcttattctttcactccattatcaaaa

SEQ ID NO: 2716 - DNA, 71 bp, chicken (Gallus Gallus)
  misc_feature (36): n=a or t
aggggaaggaggattctgcagggataccaaaggacngcctggactgggcttggggagccactgactggtct

SEQ ID NO: 2717 - DNA, 71 bp, chicken (Gallus Gallus)
  misc_feature (36): n=c or g
gggatcagtaaccaccaagggcaacaatgtcctctngctctcagctcagtgcacctacactgcagcatgac

SEQ ID NO: 2718 - DNA, 71 bp, chicken (Gallus Gallus)
  misc_feature (36): n=a or c
cctcagcccaaatgcatggggatgcagaagagaccntgaaaattagaggacaggagagaactgcagaagga

SEQ ID NO: 2719 - DNA, 71 bp, chicken (Gallus Gallus)
  misc_feature (36): n=c or t
ggagttccatgcctgtccaagaggttttacagcatnggtttgaaaatcacttttaaacaggcacgatgtgc

SEQ ID NO: 2720 - DNA, 71 bp, chicken (Gallus Gallus)
  misc_feature (36): n=a or g
tctgcagccaaatctaagggcagcttggcctaatcnaataacctcaattttaaggatcaaaattaaaattc

SEQ ID NO: 2721 - DNA, 71 bp, chicken (Gallus Gallus)
  misc_feature (36): n=c or t
ctctaatcacacacacattatgtgcacaagctgtangtgtattacagatcttcaacactcagagaagctta

SEQ ID NO: 2722 - DNA, 71 bp, chicken (Gallus Gallus)
  misc_feature (36): n=a or g
tctgacttcagtctggcagctgggaaacagctgccngcatcacaaaaacctatcccgacagcaagaagtgg

SEQ ID NO: 2723 - DNA, 71 bp, chicken (Gallus Gallus)
  misc_feature (36): n=a or c
agcagcctcttcccaaggagtttggcaattgagtgntaccacaccgagccatcccagagcagctcatggga

SEQ ID NO: 2724 - DNA, 71 bp, chicken (Gallus Gallus)
  misc_feature (36): n=c or t
ttctgcaatttatgaaacttttgtttttcagagcangctgccatctggatctcaatttttttaagccatct

SEQ ID NO: 2725 - DNA, 71 bp, chicken (Gallus Gallus)
  misc_feature (36): n=c or t
cagaaggggcaccaaagtatctcattggagtagttntctagtttgggtagtgcaacaagcaaggaggcagt

SEQ ID NO: 2726 - DNA, 71 bp, chicken (Gallus Gallus)
  misc_feature (36): n=a or g
tggggcatatgggagctggagacagcaaaacaaagncaggggccatgggcaattcacagcatcagaaacag

SEQ ID NO: 2727 - DNA, 71 bp, chicken (Gallus Gallus)
  misc_feature (36): n=c or t
acctgcagcatcctcacactgggctgctaattctgngtgtctttgctgacagcagtcccacaatgatggac

SEQ ID NO: 2728 - DNA, 71 bp, chicken (Gallus Gallus)
  misc_feature (36): n=a or g
tgagcattgtggtccttttcaacccaggccattctntgattgtatgtgctcctggagaacgaaggttctaa

SEQ ID NO: 2729 - DNA, 71 bp, chicken (Gallus Gallus)
  misc_feature (36): n=a or c
gctcagccatgcttagtttgtgcatgtggaacatcnaatctcttgtccaatgcaactaaatacagccatgc

SEQ ID NO: 2730 - DNA, 71 bp, chicken (Gallus Gallus)
  misc_feature (36): n=c or g
tcagctgcatgaagtggttaaaataagacttgacanccccagccaaggagcttgctcatcaccccgcagac

SEQ ID NO: 2731 - DNA, 71 bp, chicken (Gallus Gallus)
  misc_feature (36): n=c or t
acctcactaattctgcaaaaaaagaaacatcaatanccatgtgctcttatgacagctcctccacctttctg

SEQ ID NO: 2732 - DNA, 71 bp, chicken (Gallus Gallus)
  misc_feature (36): n=c or t
ccatggaaactctgccctgtgatggaggtggaggangtgccaagtgaactgggtctacagtaataaaaggc

SEQ ID NO: 2733 - DNA, 71 bp, chicken (Gallus Gallus)
  misc_feature (36): n=a or g
ttgagctgaactttgggaacattagttgaaaaaagngtatatggaaggctaacaaatactgcagagtcatg

SEQ ID NO: 2734 - DNA, 71 bp, chicken (Gallus Gallus)
  misc_feature (36): n=c or t
ctgaaataggtggttcgtagatagtatgctctcctnctatacctggcattggatttgtggggcagatattc

SEQ ID NO: 2735 - DNA, 71 bp, chicken (Gallus Gallus)
  misc_feature (36): n=a or g
caggccacgtgagcactaacaggcttgcaggtgccncactcagcaaggtaaaggcattctacaaacacagt

SEQ ID NO: 2736 - DNA, 71 bp, chicken (Gallus Gallus)
  misc_feature (36): n=a or g
tgtgtccccctgtcctcatgccccaacatccttacntcaccatgtcaccgtatttccacatccctatgtcc

SEQ ID NO: 2737 - DNA, 71 bp, chicken (Gallus Gallus)
  misc_feature (36): n=c or g
gccacacatcaacaagccatggggaaaggaggaaangaaacaaggagtagaggaaagggcaaacaccccct

SEQ ID NO: 2738 - DNA, 71 bp, chicken (Gallus Gallus)
  misc_feature (36): n=c or t
tgacaaatattcacgtatttcttgtatgggaaactnactttgtagtatctaaaatagtcactttccagaag

SEQ ID NO: 2739 - DNA, 71 bp, chicken (Gallus Gallus)
  misc_feature (36): n=c or t
tcttaccactgagggctgaatcatggtgttgcagcngctctttcaacatacagaagggatttggcaacccc

SEQ ID NO: 2740 - DNA, 71 bp, chicken (Gallus Gallus)
  misc_feature (36): n=g or t
cacaaactatcccagcctgcaggcaaagaagttgcnttcactaggcagagctttccaaggcaacctgtgag

SEQ ID NO: 2741 - DNA, 71 bp, chicken (Gallus Gallus)
  misc_feature (36): n=a or g
cacatgactgctgcctctcaagtaccttacaatgcnaaggtgacagctgcctctttcttgaaatagatttc

SEQ ID NO: 2742 - DNA, 71 bp, chicken (Gallus Gallus)
  misc_feature (36): n=a or c
ttacacaaaatttatcatcaggtttcagtcttttcntttcttctcttttcctcgatcaataggagaccaat

SEQ ID NO: 2743 - DNA, 71 bp, chicken (Gallus Gallus)
  misc_feature (36): n=a or t
tctaattttactggggctggctatgctagccctcangtcagaacagcatagagttggtctgtaatgagggc

SEQ ID NO: 2744 - DNA, 71 bp, chicken (Gallus Gallus)
  misc_feature (36): n=g or t
agagagaacttagagaaaacttccagattttggganaaagcaacatctgccagagtgtcctggtttttttt

SEQ ID NO: 2745 - DNA, 71 bp, chicken (Gallus Gallus)
  misc_feature (36): n=c or t
acttccctcttgggtacccgggagagctccttcctncacatgtgtgggaatttctacctaaagtgcagaac

SEQ ID NO: 2746 - DNA, 71 bp, chicken (Gallus Gallus)
  misc_feature (36): n=a or c
acctgtgaacaagctgtgcctcagcgaatgctcatnttctctcagaagatgcatgttcccaaggagaaaag

SEQ ID NO: 2747 - DNA, 71 bp, chicken (Gallus Gallus)
  misc_feature (36): n=a or c
aaggctaccaccaccatcaatcctaagggaaagagngctctgaaagctctatatcctagaaatgggatttt

SEQ ID NO: 2748 - DNA, 71 bp, chicken (Gallus Gallus)
  misc_feature (36): n=c or t
catcactttttaactccagaaagatgatctataacngcacttcagaggaagaagctctgtccattctctaa

SEQ ID NO: 2749 - DNA, 71 bp, chicken (Gallus Gallus)
  misc_feature (36): n=c or t
ttgggaaaatatctcctaagtgaataaatgaagganagctatgcattcaccctgttgtagttttgaagaag

SEQ ID NO: 2750 - DNA, 71 bp, chicken (Gallus Gallus)
  misc_feature (36): n=a or g
cacaattcaggtaacaaggttccatcctgaaatccngagtcaaaagagtttctggaatcttcagtaggatt

SEQ ID NO: 2751 - DNA, 71 bp, chicken (Gallus Gallus)
  misc_feature (36): n=a or g
ctataaaacacagaagggtttaaaatcttaagtgtntggtccaaccctctgtcacactgcccctcctgctt

SEQ ID NO: 2752 - DNA, 71 bp, chicken (Gallus Gallus)
  misc_feature (36): n=a or g
acatttcacaaagtataacaaaataaataaatcccntgatgctagtgaggccgttcaattacattttgcaa

SEQ ID NO: 2753 - DNA, 71 bp, chicken (Gallus Gallus)
  misc_feature (36): n=a or g
attttatcttgaagttctgtattctgaatcgaatcnatgaacaattattaacaagcttatttttacaaaca

SEQ ID NO: 2754 - DNA, 71 bp, chicken (Gallus Gallus)
  misc_feature (36): n=c or t
caacaattcaacaggtcagtgcctcagggaggtaangacctatatctcataacacagcttgacctgtttcc

SEQ ID NO: 2755 - DNA, 71 bp, chicken (Gallus Gallus)
  misc_feature (36): n=a or c
caaccaccaggaaaaaaggatgggaagaagagttcngttttcttctggtaaaagtcaaaacaataaaaacc

SEQ ID NO: 2756 - DNA, 71 bp, chicken (Gallus Gallus)
  misc_feature (36): n=g or t
gcccaattgcatctgagctcacagttgctctgaatncatggagttcattcagacaaaactgcactaacatt

SEQ ID NO: 2757 - DNA, 71 bp, chicken (Gallus Gallus)
  misc_feature (36): n=a or g
ttacttcccagactaaatttgcataatgtaatttanggaaatagttgccgtatgcttgcattaactacgag

SEQ ID NO: 2758 - DNA, 71 bp, chicken (Gallus Gallus)
  misc_feature (36): n=a or g
ctgtgactgagtggtacctggtatgcaggcttgctnttataagtctagatagtatatcttagactacagag

SEQ ID NO: 2759 - DNA, 71 bp, chicken (Gallus Gallus)
  misc_feature (36): n=a or g
tgttagaaattctgtcagtagttcaccacttaaacnctggatttacagcagttgaaatctgcttaatagct

SEQ ID NO: 2760 - DNA, 71 bp, chicken (Gallus Gallus)
  misc_feature (36): n=a or g
actgtatgagaacacacagcccagcaggtgccctanaacacccaatgtaatcacagcaagtgaatgactaa

SEQ ID NO: 2761 - DNA, 71 bp, chicken (Gallus Gallus)
  misc_feature (36): n=c or t
cattcagctttctgcctctgtgctgccaacactgangtcaataacactgacccttggagcgttcagcaggc

SEQ ID NO: 2762 - DNA, 71 bp, chicken (Gallus Gallus)
  misc_feature (36): n=a or g
agaccttttttttcatgttattagaagagtcacttnttgcttcttgagatctcacctatcactgaggccat

SEQ ID NO: 2763 - DNA, 71 bp, chicken (Gallus Gallus)
  misc_feature (36): n=c or t
atgagctaccccagaacttttctggtgttcttccanttgaatccaccagccattttcttgttagagaattg

SEQ ID NO: 2764 - DNA, 71 bp, chicken (Gallus Gallus)
  misc_feature (36): n=c or t
tcctcttcctgtacagccgcattcttcagttttcancgttttgactgaaagttggaaggactctgcagaaa

SEQ ID NO: 2765 - DNA, 71 bp, chicken (Gallus Gallus)
  misc_feature (36): n=c or t
tacttcgcttagccaaactaattctggtaactcctngactgtaagggctgaagagctgacctctgggggct

SEQ ID NO: 2766 - DNA, 71 bp, chicken (Gallus Gallus)
  misc_feature (36): n=a or g
attgggaatggcacttctaactgcatcagtaagggngatagttctgttttattatgtggcaaaggcagctg

SEQ ID NO: 2767 - DNA, 71 bp, chicken (Gallus Gallus)
  misc_feature (36): n=c or t
ttattttcttaagttttttatatcccatccctttcntctggaattagaggtaacatttggctttggagcat

SEQ ID NO: 2768 - DNA, 71 bp, chicken (Gallus Gallus)
  misc_feature (36): n=a or g
tcaagggaggtttaatatcctaaatgagcttagctnttcttaccaggtgagaagactcagagtgaaacaga

SEQ ID NO: 2769 - DNA, 71 bp, chicken (Gallus Gallus)
  misc_feature (36): n=c or t
caagaggcatagatagcatcctcagttttccctgcntggcttctgtgatgcctctactctcagactctgct

SEQ ID NO: 2770 - DNA, 71 bp, chicken (Gallus Gallus)
  misc_feature (36): n=a or g
ctcacttgattacatgcaactgaatctgcggagacntagggctgcagctagtgtagtttgtaatgaagcaa

SEQ ID NO: 2771 - DNA, 71 bp, chicken (Gallus Gallus)
  misc_feature (36): n=a or g
tctgctctgagagccagctgcctgtgagctgtgctnacaggcatggtcattccacgtgctctgaaggtccc

SEQ ID NO: 2772 - DNA, 71 bp, chicken (Gallus Gallus)
  misc_feature (36): n=c or t
aagacagctctaatctaatctatgctcatctttgtntggatggtttatattcttgcaactgttatgatcgt

SEQ ID NO: 2773 - DNA, 71 bp, chicken (Gallus Gallus)
  misc_feature (36): n=a or c
tacagtacgttgtgtctcatctttgttttcgtagcnctggatgtgttataaacatagctaatacagcttta

SEQ ID NO: 2774 - DNA, 71 bp, chicken (Gallus Gallus)
  misc_feature (36): n=a or c
gtacttaacctgtcccatacatactgcttttttcanttgtgtattagtaattaatcctgattcattactat

SEQ ID NO: 2775 - DNA, 71 bp, chicken (Gallus Gallus)
  misc_feature (36): n=a or g
gctacttgtagcaaaaatgtatgtaaacagttgaantcctgtatgccccactgtgcttacaatgtatgtag

SEQ ID NO: 2776 - DNA, 71 bp, chicken (Gallus Gallus)
  misc_feature (36): n=a or g
cagaagggctaaagaagtttcaaaacaggacgcgcngaagttgaaatgtcactttccattacctcccagct

SEQ ID NO: 2777 - DNA, 71 bp, chicken (Gallus Gallus)
  misc_feature (36): n=a or g
atcgctctcagaacacatttctgttattttttagangttgttagttcaagtcttttcatacagcgtatgta

SEQ ID NO: 2778 - DNA, 71 bp, chicken (Gallus Gallus)
  misc_feature (36): n=a or g
gcctgtccttgtgtttcccttcaagtaagagttgcntttccaaggacctgagctgtttttattcgcagagt

SEQ ID NO: 2779 - DNA, 71 bp, chicken (Gallus Gallus)
  misc_feature (36): n=a or g
cagcacaggtttttaggctccttagctcaaaaggcngctgatgagggaggttggttttgagcaaggtcttc

SEQ ID NO: 2780 - DNA, 71 bp, chicken (Gallus Gallus)
  misc_feature (36): n=c or t
ggcagctccatctattccccagaggaaattaatccngatagcctcaaaactctaatttaatgaggatatac

SEQ ID NO: 2781 - DNA, 71 bp, chicken (Gallus Gallus)
  misc_feature (36): n=g or t
acttctctctctaacccatattttttactcaatttngcctagctaaatacaggttaaataaccctccaatt

SEQ ID NO: 2782 - DNA, 71 bp, chicken (Gallus Gallus)
  misc_feature (36): n=c or t
tctagctaaaacttatgtcacagatatgtcacaganaggagtggagactgttcaaaatcaagaactttcct

SEQ ID NO: 2783 - DNA, 71 bp, chicken (Gallus Gallus)
  misc_feature (36): n=a or g
ggtattggcttgtggctgtgccgaactaagaaacanctgagctgaaattcccaggctaaaagctatgatgg

SEQ ID NO: 2784 - DNA, 71 bp, chicken (Gallus Gallus)
  misc_feature (36): n=a or g
atttaaaagtacgcaaaaatctgtaaaacaatctcngtgttcaagcagcaagtctgcctttccaccaaata

SEQ ID NO: 2785 - DNA, 71 bp, chicken (Gallus Gallus)
  misc_feature (36): n=a or g
aacatctctgttaccactgaatcagtaatcccatcnctcctctatttcccttagttaaatgccttaaaaat

SEQ ID NO: 2786 - DNA, 71 bp, chicken (Gallus Gallus)
  misc_feature (36): n=a or g
taaagtctaagcaactagtgcagtaggaggggtgcnttagaggtgcagttttacaggagctatttgtcatt

SEQ ID NO: 2787 - DNA, 71 bp, chicken (Gallus Gallus)
  misc_feature (36): n=a or g
gataggctaaaagaagcagaagaaccatgccaggancagcacatccaccagcactactgtcacaagaagca

SEQ ID NO: 2788 - DNA, 71 bp, chicken (Gallus Gallus)
  misc_feature (36): n=c or t
tgtgctgtactgaaagctcaggagccagtcctcacntgggatcagtaagcaaggcctatctggtgaaaagc

SEQ ID NO: 2789 - DNA, 71 bp, chicken (Gallus Gallus)
  misc_feature (36): n=a or g
tgcactcctccatgtagccacgagcagtgttcatgnctggctagctatagccagatcatttttagtcatgt

SEQ ID NO: 2790 - DNA, 71 bp, chicken (Gallus Gallus)
  misc_feature (36): n=a or c
tggagcagaggtaacactgaacggggaggatagtcncaaaaggtcacaaaggtgaacataggctcaaatag

SEQ ID NO: 2791 - DNA, 71 bp, chicken (Gallus Gallus)
  misc_feature (36): n=c or t
aacacagaattgaacttagggtgttttactatcttncccctctggatctgtacctcaccagtgaggttctg

SEQ ID NO: 2792 - DNA, 71 bp, chicken (Gallus Gallus)
  misc_feature (36): n=c or t
tttgctgataaaactggttctttagtgagagatacngaatcctatctgtacagagcaatatcagtgctctg

SEQ ID NO: 2793 - DNA, 71 bp, chicken (Gallus Gallus)
  misc_feature (36): n=a or g
agtgacaccaggctctttctgtgattgtttttcagncattattctgagctcttccagaaatttagacacct

SEQ ID NO: 2794 - DNA, 71 bp, chicken (Gallus Gallus)
  misc_feature (36): n=c or t
gttaacagaaatgttggtggcagaagatggctgaantgaacccattctttgtatcttcagtaaaatttgta

SEQ ID NO: 2795 - DNA, 71 bp, chicken (Gallus Gallus)
  misc_feature (36): n=c or t
tttgtcatgtacggatagtcccaaatgacatctccnagagtgagctgggggaggccagaatggcagctgcc

SEQ ID NO: 2796 - DNA, 71 bp, chicken (Gallus Gallus)
  misc_feature (36): n=g or t
tttcccatctggaaacacccttgtacgtctttgctncacttcccccataccagctcccttttcagatatga

SEQ ID NO: 2797 - DNA, 71 bp, chicken (Gallus Gallus)
  misc_feature (36): n=a or g
aatagcaagcacctgcagacatgtagctacactgcntgtgtggtaagcccctgctcaatagtttgtccttc

SEQ ID NO: 2798 - DNA, 71 bp, chicken (Gallus Gallus)
  misc_feature (36): n=c or t
agaatcacggggattaagtaccacagagcaccatangcagctgagcccttgacttcctgcaggtattcttc

SEQ ID NO: 2799 - DNA, 71 bp, chicken (Gallus Gallus)
  misc_feature (36): n=c or t
tttgattaaagacctgttaaatacacatccacctanacacccagatggctgcaaatagttgcagcttttcc

SEQ ID NO: 2800 - DNA, 71 bp, chicken (Gallus Gallus)
  misc_feature (36): n=a or g
ggagaagtgccatcatgtgctaaacagcactgaaantaggcagaatgaagctgcagaggaaatacacaggc

SEQ ID NO: 2801 - DNA, 71 bp, chicken (Gallus Gallus)
  misc_feature (36): n=c or t
gaaacagtccaggggtatgggaatgcagtgtaagangtacatgtccacctcattagttttattgccctctt

SEQ ID NO: 2802 - DNA, 71 bp, chicken (Gallus Gallus)
  misc_feature (36): n=g or t
ttggtcttcccactgagatggtgataaaaatgtggnaatgaaacaatgggcgattactgaaccaaaacagc

SEQ ID NO: 2803 - DNA, 71 bp, chicken (Gallus Gallus)
  misc_feature (36): n=c or t
gagagggccacaagtactgaagttataaaatgatcngctgctatagcatttggtttgtccttcctcatata

SEQ ID NO: 2804 - DNA, 71 bp, chicken (Gallus Gallus)
  misc_feature (36): n=a or g
cctttccttccttaaaaaccaaagacaaatataatnctgatgaaatccaggaaatacactatcagatctga

SEQ ID NO: 2805 - DNA, 71 bp, chicken (Gallus Gallus)
  misc_feature (36): n=a or g
gcaggaattcttgtcaagaaccaaaatataaaaccnaactctgacatactaacaaaacatttcaatgatgg

SEQ ID NO: 2806 - DNA, 71 bp, chicken (Gallus Gallus)
  misc_feature (36): n=c or t
ttgctaatttagacatagctatatcacttggagaangcttactcatgtttgttgagcctttcaaactcaac

SEQ ID NO: 2807 - DNA, 71 bp, chicken (Gallus Gallus)
  misc_feature (36): n=c or t
caaggaataccaagtcagtagcatcgaactaggtgnttaagagaagacagcgatggtaacactgaacttgg

SEQ ID NO: 2808 - DNA, 71 bp, chicken (Gallus Gallus)
  misc_feature (36): n=a or g
accatacataccacatatgcgagtacactcacctgnaaattgccttccctggcacaagctgctgagagaag

SEQ ID NO: 2809 - DNA, 71 bp, chicken (Gallus Gallus)
  misc_feature (36): n=c or t
ggagcgactagccagagaagatttctaaacaagctnttctagagtttaagaagtggtttctttctatccat

SEQ ID NO: 2810 - DNA, 71 bp, chicken (Gallus Gallus)
  misc_feature (36): n=c or t
ccacagcaaaacataagtacttcaaagataccattngttttccctctctctccttcaaaaccgtttttcaa

SEQ ID NO: 2811 - DNA, 71 bp, chicken (Gallus Gallus)
  misc_feature (36): n=a or g
acagccccactggcttcagtccatctgaaacacacngagtatctgtgatcgcaggtcattcagaaatacag

SEQ ID NO: 2812 - DNA, 71 bp, chicken (Gallus Gallus)
  misc_feature (36): n=c or t
atattatcttcctctgaatataaccatcataatagnagaaaagtcaatcattttaaccattttaaaaaagc

SEQ ID NO: 2813 - DNA, 71 bp, chicken (Gallus Gallus)
  misc_feature (36): n=c or t
ggtaataaaagaaagctgcaatatataagctgcagntgtaaatgctgtaattatctgtgtacttcatgttt

SEQ ID NO: 2814 - DNA, 71 bp, chicken (Gallus Gallus)
  misc_feature (36): n=c or t
gtgctgctctacgtgttccgcccaggagcttcctanccccagggagtgaatggcaagatgctgcattttgc

SEQ ID NO: 2815 - DNA, 71 bp, chicken (Gallus Gallus)
  misc_feature (36): n=a or g
ttttttttttgaaagggcatggtaaaaaaaataagnaaccatttaactgtgttattatatgtatttctaac

SEQ ID NO: 2816 - DNA, 71 bp, chicken (Gallus Gallus)
  misc_feature (36): n=c or t
ctatgtttgcagatagcttactctctctcattgcanaaactggaccagtctcctcctgcagactttaagca

SEQ ID NO: 2817 - DNA, 71 bp, chicken (Gallus Gallus)
  misc_feature (36): n=a or g
tgtgctgttgtgtaaggacctcatgcaaaatgcagntactgttatccatgctgaggaaacagctacagaaa

SEQ ID NO: 2818 - DNA, 71 bp, chicken (Gallus Gallus)
  misc_feature (36): n=c or t
gagaggcaaaagggcagcattcactggctgcgcctnagtcagagctgaaattccaaataagactaaaagaa

SEQ ID NO: 2819 - DNA, 71 bp, chicken (Gallus Gallus)
  misc_feature (36): n=a or c
gaaatctggggttcagttcttttacaagtaacatanttttggttattacttctgttttttttcaaataaca

SEQ ID NO: 2820 - DNA, 71 bp, chicken (Gallus Gallus)
  misc_feature (36): n=a or g
tgtgcagagatggtttcaagcaaaacactgttaacnttagggcttcatgaatgattgattataaagtttct

SEQ ID NO: 2821 - DNA, 71 bp, chicken (Gallus Gallus)
  misc_feature (36): n=a or g
aaatctgcttggttaacttcaatgttagagcattcngccctcgatgtagcacagactttgggggatttcaa

SEQ ID NO: 2822 - DNA, 71 bp, chicken (Gallus Gallus)
  misc_feature (36): n=c or t
ggatacagggaggttcatgcttaacagttcatggtnggtgaaatagaaatgttaaaaaattctgaaaccaa

SEQ ID NO: 2823 - DNA, 71 bp, chicken (Gallus Gallus)
  misc_feature (36): n=a or g
actgctctataagactctgccaacagcccagctgcnctccctacagaacatgtggtcaacaattacagctc

SEQ ID NO: 2824 - DNA, 71 bp, chicken (Gallus Gallus)
  misc_feature (36): n=c or t
taggtaggaagtccatggcacatcatgccacattanaatgaggaaggaagctaggagaattttggaacaga

SEQ ID NO: 2825 - DNA, 71 bp, chicken (Gallus Gallus)
  misc_feature (36): n=c or t
gagtggtctgtgccatttggaaatcctgccttctantcactgttcaaagctgagtgaagggaaacaagcac

SEQ ID NO: 2826 - DNA, 71 bp, chicken (Gallus Gallus)
  misc_feature (36): n=c or t
tgtgataataaaaaaaaagcacagttcagatgtcanggattaattatttaagacagacatagcaattctct

SEQ ID NO: 2827 - DNA, 71 bp, chicken (Gallus Gallus)
  misc_feature (36): n=c or t
tcatcttagctagtaaataacacaggtgtttcacanaaccgcttactgatacatatgaagaaactgtcata

SEQ ID NO: 2828 - DNA, 71 bp, chicken (Gallus Gallus)
  misc_feature (36): n=a or g
tgttagttctatttacgatgaaggctttatggagcngctgtgtatgggtcaggtaggaaaaaaacacatct

SEQ ID NO: 2829 - DNA, 71 bp, chicken (Gallus Gallus)
  misc_feature (36): n=a or g
cacagcgctgtgtcccggtcagagcaccaatcaacntacacacagatcttacacagtaaatacaaaccacc

SEQ ID NO: 2830 - DNA, 71 bp, chicken (Gallus Gallus)
  misc_feature (36): n=g or t
aggatctgatagacttcatttttgttgtgtacagtnacctcctctaagcctttaataattacacctctctg

SEQ ID NO: 2831 - DNA, 71 bp, chicken (Gallus Gallus)
  misc_feature (36): n=a or g
tactcagccacttaaggaatgactgcagcaaaccantctttgttcagcagaacaagaaagtcagctgctcc

SEQ ID NO: 2832 - DNA, 71 bp, chicken (Gallus Gallus)
  misc_feature (36): n=c or t
tttttatagaggctagtgtaaagtaagaagaacagngcatctctcctacagtcagcataggtatatgttga

SEQ ID NO: 2833 - DNA, 71 bp, chicken (Gallus Gallus)
  misc_feature (36): n=a or g
caattgtgctaattactagaaatatggcaatatatntgtattatccacaaacatacaatatgccagcctgc

SEQ ID NO: 2834 - DNA, 71 bp, chicken (Gallus Gallus)
  misc_feature (36): n=a or g
tattgcttaatcagaggttatagcctcccctgattnctggtggcagttacagtgttttgatgcatttgcca

SEQ ID NO: 2835 - DNA, 71 bp, chicken (Gallus Gallus)
  misc_feature (36): n=a or g
cctgattgtagcaatagaagatttcagctcagatanagcaactaaaaggcgtttatagaagctgactggct

SEQ ID NO: 2836 - DNA, 71 bp, chicken (Gallus Gallus)
  misc_feature (36): n=a or g
tccaagatctatgacacgctgcagtggcaggtaacngggtacccaccgccccctccgttgcctatctgcag

SEQ ID NO: 2837 - DNA, 71 bp, chicken (Gallus Gallus)
  misc_feature (36): n=c or t
ctgccctacagcagaggctccagatgctttgaaatntggaccgcgaatgcggcctgtccctcctgctgccc

SEQ ID NO: 2838 - DNA, 71 bp, chicken (Gallus Gallus)
  misc_feature (36): n=c or t
tgtgcagagccagggggtgggctgggaggtcctgangtgccttctgacatgagatgttccgtgatcgtatg

SEQ ID NO: 2839 - DNA, 71 bp, chicken (Gallus Gallus)
  misc_feature (36): n=a or g
agctttaacttgcaaaatacccatgataagctacanccctttgtgcatggaatatccagctggaaaaggga

SEQ ID NO: 2840 - DNA, 71 bp, chicken (Gallus Gallus)
  misc_feature (36): n=c or t
tgcctcatattctcccgactgcttcatgctctgctnctctcggggagcagctctggagccaggcacccctc

SEQ ID NO: 2841 - DNA, 71 bp, chicken (Gallus Gallus)
  misc_feature (36): n=c or t
gtgtcagtgggttgtcccaagcccacggtcacacanacgacttcaaacgggagatggaagcattgcagccc

SEQ ID NO: 2842 - DNA, 71 bp, chicken (Gallus Gallus)
  misc_feature (36): n=c or t
caaggctgagcacggacggaacacagagtaattccncatcggggtatcattccccacgctgctgctggagg

SEQ ID NO: 2843 - DNA, 71 bp, chicken (Gallus Gallus)
  misc_feature (36): n=a or t
ctgtagtgggaggtaggaggaagagaagatgttttntatatacatatgtatgtttatttattccagtttat

SEQ ID NO: 2844 - DNA, 71 bp, chicken (Gallus Gallus)
  misc_feature (36): n=c or t
caagaatttgcttcctgaaaaatccagcaataatgngtctcaagtgttttatgtattatgccaatgttaac

SEQ ID NO: 2845 - DNA, 71 bp, chicken (Gallus Gallus)
  misc_feature (36): n=c or t
tacatgaatccaagcagtcttttctcagattataangttctgtttatgatgtgtttcctccactcagcatt

SEQ ID NO: 2846 - DNA, 71 bp, chicken (Gallus Gallus)
  misc_feature (36): n=c or t
ccttaactgcaaagtgatccttccttgaaggaccgnggcatagcgacatgatgagacgatgatacttttta

SEQ ID NO: 2847 - DNA, 71 bp, chicken (Gallus Gallus)
  misc_feature (36): n=c or t
tacacttgtcagacagtacatgtgcctgtcagtgtnaggccagctagtaagttgctgctaatcatgaaaat

SEQ ID NO: 2848 - DNA, 71 bp, chicken (Gallus Gallus)
  misc_feature (36): n=c or t
agccttacacagaatggaaccttccttaatgaccgngcaagcaactcgttgactcaacaactaacctttat

SEQ ID NO: 2849 - DNA, 71 bp, chicken (Gallus Gallus)
  misc_feature (36): n=c or t
acttcatgttaaaaaatttgacagcttattccaaantgttgaacggcaggtttttgtttttaaggccagag

SEQ ID NO: 2850 - DNA, 71 bp, chicken (Gallus Gallus)
  misc_feature (36): n=c or t
agacatcatttctctgactacactcaagtttgtggntcagatcacactccacatctgctccaggttggatt

SEQ ID NO: 2851 - DNA, 71 bp, chicken (Gallus Gallus)
  misc_feature (36): n=g or t
tttaccaaaatcacataacaaagctggcacttttcnatagctaaattgttgtgaatcctaactattgtagt

SEQ ID NO: 2852 - DNA, 71 bp, chicken (Gallus Gallus)
  misc_feature (36): n=a or c
tccgacatggaagtcatcgaactcaacaagcgcacntcggggcaatctttcgaggtcatcctgaagccccc

SEQ ID NO: 2853 - DNA, 71 bp, chicken (Gallus Gallus)
  misc_feature (36): n=a or g
ttaatatttcattctttattctacttggtaattctntgggctgcttctatactaaatacactgggcagaat

SEQ ID NO: 2854 - DNA, 71 bp, chicken (Gallus Gallus)
  misc_feature (36): n=c or t
agcagatgacgggtgatgctccaggattagcactcngaacagctgcatggtaccctcacactgcttcccac

SEQ ID NO: 2855 - DNA, 71 bp, chicken (Gallus Gallus)
  misc_feature (36): n=a or g
aagtctccatctctcatcatccctggagaaaattgngaaaggaaaagaaaaataaagcttggaagagttgg

SEQ ID NO: 2856 - DNA, 71 bp, chicken (Gallus Gallus)
  misc_feature (36): n=a or g
cctttgctttacttggaacattgataaataaatcantgattggtcacctcagcattgcagctcacacaaaa

SEQ ID NO: 2857 - DNA, 71 bp, chicken (Gallus Gallus)
  misc_feature (36): n=c or t
atttgaaatctttatttctcagtcctttctcaaacnctgtactggaccaactgctgctgttatttactttg

SEQ ID NO: 2858 - DNA, 71 bp, chicken (Gallus Gallus)
  misc_feature (36): n=a or g
gaatggcagctctgttttaggatctcatgactatcnctactgggagcataaagtagtacttgtgccagaag

SEQ ID NO: 2859 - DNA, 71 bp, chicken (Gallus Gallus)
  misc_feature (36): n=a or g
ctcttgtcctattgcttgctatccgaccatgaaacntgataatttcagtagtttggtatcagcttcacagg

SEQ ID NO: 2860 - DNA, 71 bp, chicken (Gallus Gallus)
  misc_feature (36): n=a or g
acctgttaatatcagacagcaataatatttatctanctctggcttctgtcaaaacttaccgattttcttac

SEQ ID NO: 2861 - DNA, 71 bp, chicken (Gallus Gallus)
  misc_feature (36): n=c or t
aaggagacgtctgcagcatttagtaaaagatacagngttaaccttcagatagcagaaatctgtcaagcttg

SEQ ID NO: 2862 - DNA, 71 bp, chicken (Gallus Gallus)
  misc_feature (36): n=c or t
gaattctcttctttgcaacacaagctaattagatgnacagcagaattatttagtaagtctttaaaaatgaa

SEQ ID NO: 2863 - DNA, 71 bp, chicken (Gallus Gallus)
  misc_feature (36): n=a or g
taggacagaaataacagaacagcagtaacagaagcnacagatatttccatatgaagatatggttgttttgg

SEQ ID NO: 2864 - DNA, 71 bp, chicken (Gallus Gallus)
  misc_feature (36): n=c or t
attaaggccatttattgcagctttgtgtaagcatgngtgtgcacagaaaatggagtgcaagcatttcaatc

SEQ ID NO: 2865 - DNA, 71 bp, chicken (Gallus Gallus)
  misc_feature (36): n=c or t
cttccctctttcttctctgacctgctgctaagatgnaaacttcctggactaggatcaggactgctccttat

SEQ ID NO: 2866 - DNA, 71 bp, chicken (Gallus Gallus)
  misc_feature (36): n=a or g
tggttagtttgtgtggcatgatgtggagtgagaggnacaggaatagaaagagaagaaatcgtttggagacc

SEQ ID NO: 2867 - DNA, 71 bp, chicken (Gallus Gallus)
  misc_feature (36): n=a or g
ggcacagcccacagaggagcccccaggaaaacaacntggcagaagctgagggtcaacacatctcagattgt

SEQ ID NO: 2868 - DNA, 71 bp, chicken (Gallus Gallus)
  misc_feature (36): n=c or t
aatcaaatagcaaaaagccagaattgctctacaagngaactcttaccctaattgctcttcaaatgcatctc

SEQ ID NO: 2869 - DNA, 71 bp, chicken (Gallus Gallus)
  misc_feature (36): n=c or t
tttagacttctgataaaataaataagtcaaactagnatacatttcattttctagacaggcttcagatgaaa

SEQ ID NO: 2870 - DNA, 71 bp, chicken (Gallus Gallus)
  misc_feature (36): n=a or g
aggaaggacatgtttcatcagtagcccttttcctcnctcttcttggcaagatcccaacttttgttctccct

SEQ ID NO: 2871 - DNA, 71 bp, chicken (Gallus Gallus)
  misc_feature (36): n=g or t
catgcagtaacacttcagtgctgggatagactgaantttactggtttctaactggttattcacctccaacc

SEQ ID NO: 2872 - DNA, 71 bp, chicken (Gallus Gallus)
  misc_feature (36): n=c or t
aagcagggctggactatagcaaatacagcagcaganaactgcccaggagcacatagcatctcaggaatggt

SEQ ID NO: 2873 - DNA, 71 bp, chicken (Gallus Gallus)
  misc_feature (36): n=c or t
cctccccatacacaagcacttttccttcctgtgaangttccctgctccaaacaaagctttctgattcatcc

SEQ ID NO: 2874 - DNA, 71 bp, chicken (Gallus Gallus)
  misc_feature (36): n=c or t
atttttatgagcttcctctgagttggagcccatggnagatttcagtaaatcacccatatagcactttttcc

SEQ ID NO: 2875 - DNA, 71 bp, chicken (Gallus Gallus)
  misc_feature (36): n=a or g
acatgcctgtcctgtagtttgggtgcaggaaatcanttttcctggaaacccattttttcagtttcctggct

SEQ ID NO: 2876 - DNA, 71 bp, chicken (Gallus Gallus)
  misc_feature (36): n=c or t
ctattaatgaggttgagtcttgaatatcatagttanctgaaatgttcctgcatatacttgttacattttta

SEQ ID NO: 2877 - DNA, 71 bp, chicken (Gallus Gallus)
  misc_feature (36): n=a or g
gacatcaaccttatctatactattttattgacatcngtctgctattgtcacaggcatttagtccatgatac

SEQ ID NO: 2878 - DNA, 71 bp, chicken (Gallus Gallus)
  misc_feature (36): n=c or t
ttgtgttggccaacgttgctttgctatgtcctaaancaacagctgtgctgtgcatccatgtcttgttttct

SEQ ID NO: 2879 - DNA, 71 bp, chicken (Gallus Gallus)
  misc_feature (36): n=a or g
accactgaatacccagcattggtccaaaggagagcncactgcaaagtcaacatgttttattaaaagacaag

SEQ ID NO: 2880 - DNA, 71 bp, chicken (Gallus Gallus)
  misc_feature (36): n=c or t
atctaagatatgctagcagcttggccttataatgcnataaaatattcacatgtatgtattttaacccatac

SEQ ID NO: 2881 - DNA, 71 bp, chicken (Gallus Gallus)
  misc_feature (36): n=c or t
tagtactgacaaagcttgaggattaatcaggaggantaacttcctcttgagtgatctggtcttgttcaata

SEQ ID NO: 2882 - DNA, 71 bp, chicken (Gallus Gallus)
  misc_feature (36): n=c or t
aacaaacttaattagttttcctttaattatctcctncaccaacaacccctccctttttttttcccctgaac

SEQ ID NO: 2883 - DNA, 71 bp, chicken (Gallus Gallus)
  misc_feature (36): n=a or g
cctgcctgtgaggatgagcaggtggtaattcccccntgagtgttttaaccaaacttgcaaacaacaacaaa

SEQ ID NO: 2884 - DNA, 71 bp, chicken (Gallus Gallus)
  misc_feature (36): n=c or t
tctcttgtgagaacagttgatgaagcagctggtggnactgaggtacagctcagcacagcttcccatcttcc

SEQ ID NO: 2885 - DNA, 71 bp, chicken (Gallus Gallus)
  misc_feature (36): n=a or g
caggtgcgaatgcaggtccaaccatgaaacgatccncacaagctttctcaaggtctaattcttccagcacg

SEQ ID NO: 2886 - DNA, 71 bp, chicken (Gallus Gallus)
  misc_feature (36): n=a or g
gcttgtgatagctgtggctgaggctgctgtgtgccnaaggagttctgaaggaccgtgaaatactgattaca

SEQ ID NO: 2887 - DNA, 71 bp, chicken (Gallus Gallus)
  misc_feature (36): n=a or c
aataattgttgacaacttgtgcttttctgtccccanatcaggaatttttcagtctttatggagcgtgaggt

SEQ ID NO: 2888 - DNA, 71 bp, chicken (Gallus Gallus)
  misc_feature (36): n=c or t
ttgtttggacaatccttgactttgatattgaatctntcctgtttcttatgcgctaggaaacatgtcctgat

SEQ ID NO: 2889 - DNA, 71 bp, chicken (Gallus Gallus)
  misc_feature (36): n=a or g
ctcatctgtcgctacatcattgtgcattttctaacnacaggtgttggcactgggacagttagtactatgaa

SEQ ID NO: 2890 - DNA, 71 bp, chicken (Gallus Gallus)
  misc_feature (36): n=c or t
cctgggccacgaggcgattgctacagagttcattanagctgaaaaatacacattttgacaaagggattttt

SEQ ID NO: 2891 - DNA, 71 bp, chicken (Gallus Gallus)
  misc_feature (36): n=a or g
taagctaaatatattttggctgaaaaaccaggtgcntactcctgcaacaacttcagcccactcagaacccc

SEQ ID NO: 2892 - DNA, 71 bp, chicken (Gallus Gallus)
  misc_feature (36): n=a or g
cgctacctggaagtttgcaagtggaaagccaccacntcctgactgccaactgtggagaattccacttatga

SEQ ID NO: 2893 - DNA, 71 bp, chicken (Gallus Gallus)
  misc_feature (36): n=a or g
cttggtgagtgcttcccctcctcaatacagagctancatcttatctcactgaaaagtttgctgcggcactt

SEQ ID NO: 2894 - DNA, 71 bp, chicken (Gallus Gallus)
  misc_feature (36): n=a or c
gtccttgctttgcacgtggttgtgtccactgagtcncgctgggaacactctggaaacactgcagcgtggtc

SEQ ID NO: 2895 - DNA, 71 bp, chicken (Gallus Gallus)
  misc_feature (36): n=c or t
cttgctgaagggggacagggcactgtcaggagctgnagtgaaggcaacaggattagttttgcacaagatgc

SEQ ID NO: 2896 - DNA, 71 bp, chicken (Gallus Gallus)
  misc_feature (36): n=a or g
cagaaaacttacttggccaccctgagaaggagctgnagccagaaaatgaagtcatacagtccatgcactaa

SEQ ID NO: 2897 - DNA, 71 bp, chicken (Gallus Gallus)
  misc_feature (36): n=c or t
catttataaccatctgtccctccctgggctgggatntatccattacttcaaacacaacataagcactagat

SEQ ID NO: 2898 - DNA, 71 bp, chicken (Gallus Gallus)
  misc_feature (36): n=a or g
taacagcagcaggatacatcagctgccacacaacantgttctcactgtaccaggcttttctagttaatgaa

SEQ ID NO: 2899 - DNA, 71 bp, chicken (Gallus Gallus)
  misc_feature (36): n=c or t
ccagtccagatatttgaccaaatccttcaaatcccngaaacagctgaaatatttatatgtatttatactcc

SEQ ID NO: 2900 - DNA, 71 bp, chicken (Gallus Gallus)
  misc_feature (36): n=c or t
ttagatacgtatctggtaccaaaaggaaggaattgnacagctggcaaggtcagatgactacctaaaaagga

SEQ ID NO: 2901 - DNA, 71 bp, chicken (Gallus Gallus)
  misc_feature (36): n=c or t
ttaaatttctgtctgtaagcaaaacttaaacaaaanaaaatcccaaacttttaaacaaagtaacatagact

SEQ ID NO: 2902 - DNA, 71 bp, chicken (Gallus Gallus)
  misc_feature (36): n=a or g
tcaaatctccttgtccacatgcaagcatgcctcttncatcaagtttcgtcttaaagatctccactctctga

SEQ ID NO: 2903 - DNA, 71 bp, chicken (Gallus Gallus)
  misc_feature (36): n=a or g
accagctcagtgacagactgaacctactatcctcantcatggagaacttgctgaagtcacgggagaaagct

SEQ ID NO: 2904 - DNA, 71 bp, chicken (Gallus Gallus)
  misc_feature (36): n=c or t
atgggaggagagagggaactaaatcgcagcaggtanctgtaaagcattgctgcctgcagccggtgacaaaa

SEQ ID NO: 2905 - DNA, 71 bp, chicken (Gallus Gallus)
  misc_feature (36): n=c or t
aagctaccctgggtctgctttattagttttcacctnaagctaaaaaggaatactttattatcccatggctg

SEQ ID NO: 2906 - DNA, 71 bp, chicken (Gallus Gallus)
  misc_feature (36): n=a or g
aacaggctacggcacatttcccaacgcagctgagcncttccaaactatgtcctgaacctgccactaaattg

SEQ ID NO: 2907 - DNA, 71 bp, chicken (Gallus Gallus)
  misc_feature (36): n=c or t
tatattgcgcctgcattaaaaagcaacttatcctancttcccatttgcagcaaacttagctgtatacaagc

SEQ ID NO: 2908 - DNA, 71 bp, chicken (Gallus Gallus)
  misc_feature (36): n=c or t
tcgttcaagtttagattatatatagtcatggctatncaggtgcacagccctattctccatccttatcagcc

SEQ ID NO: 2909 - DNA, 71 bp, chicken (Gallus Gallus)
  misc_feature (36): n=a or g
tcctgtctgtcaggagcacaagaacaggaaccactnccttcttccatatcagaatgcatttcagctaactg

SEQ ID NO: 2910 - DNA, 71 bp, chicken (Gallus Gallus)
  misc_feature (36): n=c or t
gaagaaactgaatcattgatatccatccagctacantttaatacctttaggaaccacctttttccaccttt

SEQ ID NO: 2911 - DNA, 71 bp, chicken (Gallus Gallus)
  misc_feature (36): n=a or g
tccatctcagctccaatccctaaggaacgccactcntcatctgtctccacttagacactgagtcgctgacc

SEQ ID NO: 2912 - DNA, 71 bp, chicken (Gallus Gallus)
  misc_feature (36): n=c or t
catacttttaatgaaggatataatcaagtttaggtncttgatttacaaaattatgggtttggatgtagcag

SEQ ID NO: 2913 - DNA, 71 bp, chicken (Gallus Gallus)
  misc_feature (36): n=c or t
tctggggtcctcaacataagaaagctgtggacctgntggagtaagttcagagtacagatacgaggatgacc

SEQ ID NO: 2914 - DNA, 71 bp, chicken (Gallus Gallus)
  misc_feature (36): n=a or g
agctactggcaaacctgttatgctgagctctccccntacaaactgtacctgtattgcctggacagcagtgg

SEQ ID NO: 2915 - DNA, 71 bp, chicken (Gallus Gallus)
  misc_feature (36): n=c or t
attctagtttcctttctctggttgttttcagctttntttgagttttatgctgttcctgatgggaagaaggc

SEQ ID NO: 2916 - DNA, 71 bp, chicken (Gallus Gallus)
  misc_feature (36): n=c or g
tgaaggtttaattcatattgcttgagcttctcatcntgttccatcaatgtgaagggactctggttatgaag

SEQ ID NO: 2917 - DNA, 71 bp, chicken (Gallus Gallus)
  misc_feature (36): n=a or c
atctttgcactgtaccagtgcattgtaaactcttanctagctcgttggattttccctgggactggcagcac

SEQ ID NO: 2918 - DNA, 71 bp, chicken (Gallus Gallus)
  misc_feature (36): n=a or g
agccattagcagggctagactcagggacagttgtcnttcttctaagtgcaagtgtcttgttagcatccatg

SEQ ID NO: 2919 - DNA, 71 bp, chicken (Gallus Gallus)
  misc_feature (36): n=c or t
aaatggtgcataaatctgtagtatctctcactatanatacaatgaaatgtaggactacaatttagtttgca

SEQ ID NO: 2920 - DNA, 71 bp, chicken (Gallus Gallus)
  misc_feature (36): n=c or t
agctaattgtgtctgagctcaaggcaaatcgaaacnaacacaacagttattttgcaatatattgcatactg

SEQ ID NO: 2921 - DNA, 71 bp, chicken (Gallus Gallus)
  misc_feature (36): n=c or t
cagccagctgtgataatagattttcttctttattcngagtgcaatctttgtacaattatcctatttatccc

SEQ ID NO: 2922 - DNA, 71 bp, chicken (Gallus Gallus)
  misc_feature (36): n=a or g
catcacttggatttatcagctgtattgtcctcaagncctctgtcagaagaagggcctcactggcctaccgt

SEQ ID NO: 2923 - DNA, 71 bp, chicken (Gallus Gallus)
  misc_feature (36): n=c or t
ggacaaaaaaaacttgatcaagaagtgcaaggtctncctatcttactaagatgagagatgctagtttttaa

SEQ ID NO: 2924 - DNA, 71 bp, chicken (Gallus Gallus)
  misc_feature (36): n=c or t
ggctgcataggtgggatgcttgcctagcatctctgnttgcctagctctacagaggcactgcaggaattagt

SEQ ID NO: 2925 - DNA, 71 bp, chicken (Gallus Gallus)
  misc_feature (36): n=a or c
aataaagtcttaattactttcttgcgggcagttgtntcaaatctttacgtgcagagatttcagatgtgata

SEQ ID NO: 2926 - DNA, 71 bp, chicken (Gallus Gallus)
  misc_feature (36): n=g or t
attttggttcagactcatcgctagttagaatgaaanggatacctatttttgctctgtagacatcccttcat

SEQ ID NO: 2927 - DNA, 71 bp, chicken (Gallus Gallus)
  misc_feature (36): n=a or g
gataatcaaacccaaagaagctgaaagatgagcaancagagaccacaaaagtaatctagcaaacaattatg

SEQ ID NO: 2928 - DNA, 71 bp, chicken (Gallus Gallus)
  misc_feature (36): n=c or t
gacagttgtcagaggagcacgtgtggagctgctcantgaggctgttaaatggaagatggcaggagttactg

SEQ ID NO: 2929 - DNA, 71 bp, chicken (Gallus Gallus)
  misc_feature (36): n=a or g
aatttagggcaaaagtagaagtcctgaaaagctgcnttgtctaagacaataaacaactgatcattcaagga

SEQ ID NO: 2930 - DNA, 71 bp, chicken (Gallus Gallus)
  misc_feature (36): n=c or t
tcatctgtatttaagacagcaaattgttatactgancaaaggaagcctgttctaagtggttagaagttgat

SEQ ID NO: 2931 - DNA, 71 bp, chicken (Gallus Gallus)
  misc_feature (36): n=a or g
ttattttgtaatgtatcagcaaaatagtttgaagtngtattttggctcatacgcaatggagtaaggttgta

SEQ ID NO: 2932 - DNA, 71 bp, chicken (Gallus Gallus)
  misc_feature (36): n=c or t
accccagctgacaacaagggcaccccacaaggtccnggatcaggaagacaagcagataccatacaataaaa

SEQ ID NO: 2933 - DNA, 71 bp, chicken (Gallus Gallus)
  misc_feature (36): n=a or g
ctttcaggaagaacatagctttcccatcagacagangacattttgattgcattaatagctagcactcaaaa

SEQ ID NO: 2934 - DNA, 71 bp, chicken (Gallus Gallus)
  misc_feature (36): n=c or t
ttcacgaagtccttgtctaaaattcactcatctgtngctacatcattgtgcattttctaacaacaggtgtt

SEQ ID NO: 2935 - DNA, 71 bp, chicken (Gallus Gallus)
  misc_feature (36): n=c or t
ggtttcactatgaatgaggacagttattccccaaantaccaatctgccattgtttacctaattccagtaat

SEQ ID NO: 2936 - DNA, 71 bp, chicken (Gallus Gallus)
  misc_feature (36): n=c or t
ctaaggatcagaaaatgttcctttccactctttctntagccagccatctaagctgacctggaattcagtcc

SEQ ID NO: 2937 - DNA, 71 bp, chicken (Gallus Gallus)
  misc_feature (36): n=a or g
caggaaccaccatttcctagaagtagtaaccatatntagacatgtgtagccagaactccatttttcttctg

SEQ ID NO: 2938 - DNA, 71 bp, chicken (Gallus Gallus)
  misc_feature (36): n=a or g
ttcatgggaactgtggagctgattcttgtagagtcnttgctgaagcagtgaagatgcaggttattatacta

SEQ ID NO: 2939 - DNA, 71 bp, chicken (Gallus Gallus)
  misc_feature (36): n=c or g
ttttttttttgctgtgaaatagctttgcatgacccnactttcaggacgtagagtagtatgggaagagtgca

SEQ ID NO: 2940 - DNA, 71 bp, chicken (Gallus Gallus)
  misc_feature (36): n=c or t
caatgagctaaaaactggagaggtgttagttgtagntttctttctaacttgcacgatctttcacagccttc

SEQ ID NO: 2941 - DNA, 71 bp, chicken (Gallus Gallus)
  misc_feature (36): n=a or g
ttctaagtattgggctggagtcgagaacacaaacantcatattggtcattgtgatctgcacgcagataatg

SEQ ID NO: 2942 - DNA, 71 bp, chicken (Gallus Gallus)
  misc_feature (36): n=c or t
acttagctttatgtcggtatcctgagctcatagcanatagatgcttcaagcacagcgtcctgctgctgtaa

SEQ ID NO: 2943 - DNA, 71 bp, chicken (Gallus Gallus)
  misc_feature (36): n=a or g
cactggtcttgtgttaaggacagcatatcaactctntcaggtgagctgctgtcaataaaaaaaggaagaaa

SEQ ID NO: 2944 - DNA, 71 bp, chicken (Gallus Gallus)
  misc_feature (36): n=a or g
ctattccttcaagcccttcttaaaagcttaaaatantcacagtacaaatatgcacacagacttctactgcc

SEQ ID NO: 2945 - DNA, 71 bp, chicken (Gallus Gallus)
  misc_feature (36): n=a or g
gcaagcacaaaaagagttaatttcctatcccagccngctgctgctgttccaaacacctttgccttccccac

SEQ ID NO: 2946 - DNA, 71 bp, chicken (Gallus Gallus)
  misc_feature (36): n=a or g
aagaaagtaaacttcatggatttgtgtcatgactcncacacccatgagagaaaaagagaaagaacccaagt

SEQ ID NO: 2947 - DNA, 71 bp, chicken (Gallus Gallus)
  misc_feature (36): n=c or t
ataattgccaggcaaactctcagtaggtaaaattcntcatcatatctgatatatctacagcagggctgtat

SEQ ID NO: 2948 - DNA, 71 bp, chicken (Gallus Gallus)
  misc_feature (36): n=c or t
gatgcagctgctacattctgaccctgtaagtgcagnactttggtagatcccctagtatctttgctcaatct

SEQ ID NO: 2949 - DNA, 71 bp, chicken (Gallus Gallus)
  misc_feature (36): n=a or g
gagggagggtcagtatgctttataaaacatgttctncttaaaaggatgtcagcaaaattcctttcaagtgg

SEQ ID NO: 2950 - DNA, 71 bp, chicken (Gallus Gallus)
  misc_feature (36): n=c or t
gaaaaaaaaacctctctactccatggctttcattanagttccatgattgtcttgacctaatatgatctgca

SEQ ID NO: 2951 - DNA, 71 bp, chicken (Gallus Gallus)
  misc_feature (36): n=a or g
aaagtgtaaagaaacagaaataaattcctggaaaanaaatcatacatttgttatctaaaggcacactttac

SEQ ID NO: 2952 - DNA, 71 bp, chicken (Gallus Gallus)
  misc_feature (36): n=c or t
ccgggtggctctgcactgccacagagcagctctggngctctgacatcaattcctgactgttatcagccaga

SEQ ID NO: 2953 - DNA, 71 bp, chicken (Gallus Gallus)
  misc_feature (36): n=a or g
gattgtgtttccaaggctctcccacaagcagctagntcagatctgaacaaaatgaaaaagcccaacaaaat

SEQ ID NO: 2954 - DNA, 71 bp, chicken (Gallus Gallus)
  misc_feature (36): n=c or t
tcaggcgtcctcacgtgggattggaatggatatagntgtctccgtgccaggcagcagagtgcgtggggcca

SEQ ID NO: 2955 - DNA, 71 bp, chicken (Gallus Gallus)
  misc_feature (36): n=a or g
ctggggtggccccgtggcctggctggtgaccatagntttcggtgccctgttctgaaagaggaaatgggtca

SEQ ID NO: 2956 - DNA, 71 bp, chicken (Gallus Gallus)
  misc_feature (36): n=a or g
ttctcaataaatcagctgagtctcttttgggcttgntgggtgggtggaaggatggacaattccttgcaggg

SEQ ID NO: 2957 - DNA, 71 bp, chicken (Gallus Gallus)
  misc_feature (36): n=a or g
tggggaagagttgcttcaaccaccagagcctttaangagcggatgttgaaaacagaaagaacaagctcgta

SEQ ID NO: 2958 - DNA, 71 bp, chicken (Gallus Gallus)
  misc_feature (36): n=c or g
tgcatctcccctctacacaacgaaccccaacccgantaccctgctctacgttctttgacaccacacagctc

SEQ ID NO: 2959 - DNA, 71 bp, chicken (Gallus Gallus)
  misc_feature (36): n=c or t
gcctgctttccaccgtgacctgtctcttggctctgncattatcgtttttagctcagacttgagcaaaccat

SEQ ID NO: 2960 - DNA, 71 bp, chicken (Gallus Gallus)
  misc_feature (36): n=g or t
aatcaaccaatacttgggtgcacacaaagcagaganataaccaatgggatcctcccagacaaacatttcaa

SEQ ID NO: 2961 - DNA, 71 bp, chicken (Gallus Gallus)
  misc_feature (36): n=a or g
aagggggaagcgaggctgggttcagccaaagttagngactgaatgtaggtgcccacagaaaaagccaagct

SEQ ID NO: 2962 - DNA, 71 bp, chicken (Gallus Gallus)
  misc_feature (36): n=a or c
atgagcttcttgggcattcagggtaccaggaaatgnaggagtctacctaatttgttaacatgaaattatag

SEQ ID NO: 2963 - DNA, 71 bp, chicken (Gallus Gallus)
  misc_feature (36): n=a or g
ggactccttgattcaacaaggaattgctcctagcancatcctttacaccagtgtcacatttgacaccaaga

SEQ ID NO: 2964 - DNA, 71 bp, chicken (Gallus Gallus)
  misc_feature (36): n=a or c
cagaggcaggggggtaggtgaccaagtgtattcacncaataggtatatgcaagagggtagcttgacttaga

SEQ ID NO: 2965 - DNA, 71 bp, chicken (Gallus Gallus)
  misc_feature (36): n=c or t
gagcagttattgaggaggagtgccttacagggcccntgcattcctgcagcgcagctctgtgtgaaatctca

SEQ ID NO: 2966 - DNA, 71 bp, chicken (Gallus Gallus)
  misc_feature (36): n=c or t
tataataagtgtgcaatagcatttttagcagccatnacttttgcaaagctctggaaagaccctatgaactg

SEQ ID NO: 2967 - DNA, 71 bp, chicken (Gallus Gallus)
  misc_feature (36): n=c or t
gtttcctttatgtgtcgtcacagctccactgcttgngcagataagggatggcacaactttgcctgattctt

SEQ ID NO: 2968 - DNA, 71 bp, chicken (Gallus Gallus)
  misc_feature (36): n=c or t
cacgttttcagctccctttgccatgatctcagaagnagacttttcttatctcagatgtatgactgcaagat

SEQ ID NO: 2969 - DNA, 71 bp, chicken (Gallus Gallus)
  misc_feature (36): n=c or t
taaatactatgaaataagatagaaggaagctaacangccataatgaaattcagatgttccaaagtcaatgg

SEQ ID NO: 2970 - DNA, 71 bp, chicken (Gallus Gallus)
  misc_feature (36): n=a or g
acaacttttaaggaagctacattgggaaattaggcntacttaaattttgttagtagttaatgttgtaatta

SEQ ID NO: 2971 - DNA, 71 bp, chicken (Gallus Gallus)
  misc_feature (36): n=a or t
gttgatgaagcatctgtagcaatataggcaatgggnagtaacatttacaatgccttacactgtaaatgcag

SEQ ID NO: 2972 - DNA, 71 bp, chicken (Gallus Gallus)
  misc_feature (36): n=a or g
aggaacccagggatggaagcaaagcaaggcactgtntagcatgttggttacccaacaccgctgcctagtgg

SEQ ID NO: 2973 - DNA, 71 bp, chicken (Gallus Gallus)
  misc_feature (36): n=c or t
tttttccagcttgcctgactcatgaacagcctctgntttacaagtcaaaatgccatgggtaagatttagtc

SEQ ID NO: 2974 - DNA, 71 bp, chicken (Gallus Gallus)
  misc_feature (36): n=a or g
tcctaacttattttcactaagaataaatatgggatngtgccacatgcaaaattaaatctcggccttgcaat

SEQ ID NO: 2975 - DNA, 71 bp, chicken (Gallus Gallus)
  misc_feature (36): n=c or t
acctctgtactgtcattcagagcacacagtgttgantgctctgggaatgggagaaattatggtctggcagc

SEQ ID NO: 2976 - DNA, 71 bp, chicken (Gallus Gallus)
  misc_feature (36): n=c or t
gatttcattttctttccagctgctactgccacaagnatgggattcacactaagcaggtgctctatgcatga

SEQ ID NO: 2977 - DNA, 71 bp, chicken (Gallus Gallus)
  misc_feature (36): n=c or t
tccccacatcacaagttaaaaaataaaattgccacngttgacagctctataccaatgcaactccagcctta

SEQ ID NO: 2978 - DNA, 71 bp, chicken (Gallus Gallus)
  misc_feature (36): n=a or g
caaattccatagatgatggagtaatgtgaatagagnagagggagtccaagctcccagatcctgtttctgat

SEQ ID NO: 2979 - DNA, 71 bp, chicken (Gallus Gallus)
  misc_feature (36): n=a or c
ttcttctggcttttcaaagcaattttatcattgcangaccaagagtaaagcacgttcatacacaaaatgat

SEQ ID NO: 2980 - DNA, 71 bp, chicken (Gallus Gallus)
  misc_feature (36): n=a or g
caaaaaataaggcaacttcagctttatggagaggtntttgggaattttctctgaagagatctgacagatca

SEQ ID NO: 2981 - DNA, 71 bp, chicken (Gallus Gallus)
  misc_feature (36): n=g or t
ggaaggtttgaatttgggttagaaagagctggagcngctgggagggaggtttgtgtcttgtatgtacatac

SEQ ID NO: 2982 - DNA, 71 bp, chicken (Gallus Gallus)
  misc_feature (36): n=c or t
acgctaatagctgtcatctatccagaacaccagaanttacagaaacacccattctttgactgtttctttgg

SEQ ID NO: 2983 - DNA, 71 bp, chicken (Gallus Gallus)
  misc_feature (36): n=a or g
gagctgcagcccatacacattaagttctccagctanaaatccagagatgtcattccagtcacttctaccct

SEQ ID NO: 2984 - DNA, 71 bp, chicken (Gallus Gallus)
  misc_feature (36): n=c or t
tgagctgtggatattctggttctgggtttccctgcntgagggaaaaactagcttgggaacctgcagtagaa

SEQ ID NO: 2985 - DNA, 71 bp, chicken (Gallus Gallus)
  misc_feature (36): n=a or g
ctgaatgtttgaatctacaatgtcacccaagttggnacacttagctccttaaaatccataaagcttatgct

SEQ ID NO: 2986 - DNA, 71 bp, chicken (Gallus Gallus)
  misc_feature (36): n=a or g
tcccagcttctgcagctcaaaaaataatatccaccncttcccttgcacttgcacgtccacaacgtaaggca

SEQ ID NO: 2987 - DNA, 71 bp, chicken (Gallus Gallus)
  misc_feature (36): n=a or g
aacatcttcagattcacctcctgggagatttcacancttttccccacggagggttttgaagttaaaacaca

SEQ ID NO: 2988 - DNA, 71 bp, chicken (Gallus Gallus)
  misc_feature (36): n=c or t
acatcctgcaagagctaactgtgcatgtggcacaantctaactttacaaagcaacttcctgggtagctgaa

SEQ ID NO: 2989 - DNA, 71 bp, chicken (Gallus Gallus)
  misc_feature (36): n=c or t
taaaatcaagatagaccacatccactgctttaccancatctatccccccggctatgtcttcataaaaggct

SEQ ID NO: 2990 - DNA, 71 bp, chicken (Gallus Gallus)
  misc_feature (36): n=a or g
gtctgataaagaggtttgacacagtttctgtcatgnaataatgctagtgtgtcagctctctggcaaagtca

SEQ ID NO: 2991 - DNA, 71 bp, chicken (Gallus Gallus)
  misc_feature (36): n=c or t
atttaagatttcaagtaacactcaaagttgaggtanaagggttgtatttgctgttactggggatttggttc

SEQ ID NO: 2992 - DNA, 71 bp, chicken (Gallus Gallus)
  misc_feature (36): n=a or g
tatgaatcacagatttcttccactatcttatctgcntttggaagagcaacaacagctccatgacctgcatc

SEQ ID NO: 2993 - DNA, 71 bp, chicken (Gallus Gallus)
  misc_feature (36): n=c or t
acaaaacctacgtcaaaatcctgtgaaagctcatgnataacctgacatgacctgattttatgagggacaca

SEQ ID NO: 2994 - DNA, 71 bp, chicken (Gallus Gallus)
  misc_feature (36): n=c or t
tgtgtagttctctttcaaaaataattagttattaantgtaacagtgtagcttgaatttggaagcctgatac

SEQ ID NO: 2995 - DNA, 71 bp, chicken (Gallus Gallus)
  misc_feature (36): n=a or g
ctgctcagaccagtggataatggcacgtttttggcnatagtggataatggcaaaggaagtgtggcaaaggg

SEQ ID NO: 2996 - DNA, 71 bp, chicken (Gallus Gallus)
  misc_feature (36): n=a or g
atattaagatggaaaaaagagaaaaaatcttcatcnatactgtgcaagcacttatgagcaataaagaaaat

SEQ ID NO: 2997 - DNA, 71 bp, chicken (Gallus Gallus)
  misc_feature (36): n=a or g
caaacttcaggcaggggagttttgttccagctttanaaactctgtcttccccagctaatgagttcatctga

SEQ ID NO: 2998 - DNA, 71 bp, chicken (Gallus Gallus)
  misc_feature (36): n=c or t
ctcaaaatttaatgcacaagatgggagtttgaattnagttggtacaataacaaatctatcaattttcagtc

SEQ ID NO: 2999 - DNA, 71 bp, chicken (Gallus Gallus)
  misc_feature (36): n=a or g
gagtattttttaattgtgagccatacagtgccactnatgtcttggatctcttgaattaatttaggaacaag

SEQ ID NO: 3000 - DNA, 71 bp, chicken (Gallus Gallus)
  misc_feature (36): n=c or t
ttttttccttctgtttcccctttgtaaaataagtangccattaaagggtaagataatttttattacataca

SEQ ID NO: 3001 - DNA, 71 bp, chicken (Gallus Gallus)
  misc_feature (36): n=a or g
aagacggccttaagtgaacggggatcacattcttcncaacataaaaatgacactaagcttcatgtgcttcc

SEQ ID NO: 3002 - DNA, 71 bp, chicken (Gallus Gallus)
  misc_feature (36): n=a or t
tacattataatagaaaataaattgaaatttaataantgacaacataagtgtgaattacaacatatttaatt

SEQ ID NO: 3003 - DNA, 71 bp, chicken (Gallus Gallus)
  misc_feature (36): n=c or t
aaatgctatttatttattgccgctatatacttgtanggcagtatatatcaagtatattacaaacattttaa

SEQ ID NO: 3004 - DNA, 71 bp, chicken (Gallus Gallus)
  misc_feature (36): n=c or t
tttcaatctattttgatttgctagttctggatagangggtggatgtcaggaacaatttcttccccaaaata

SEQ ID NO: 3005 - DNA, 71 bp, chicken (Gallus Gallus)
  misc_feature (36): n=a or g
cagttattactgaattgatcaacctatcattcacantctaagcagagcagaatgacaaacatttgtaagtt

SEQ ID NO: 3006 - DNA, 71 bp, chicken (Gallus Gallus)
  misc_feature (36): n=c or t
tccccctataccttcctatacgagctgctcagcaancaccctctgctaactgaaccaagtctgtactgcac

SEQ ID NO: 3007 - DNA, 71 bp, chicken (Gallus Gallus)
  misc_feature (36): n=a or g
catgcaggagctgcctgtggacagaccacacctggnaactagtaagggtttttcctgggcaaaggtcaaaa

SEQ ID NO: 3008 - DNA, 71 bp, chicken (Gallus Gallus)
  misc_feature (36): n=c or t
ccccagctatgctcttctgcttgatatggcaattgntgtcctctgaggcagcaaagaaaaattatcctggc

SEQ ID NO: 3009 - DNA, 71 bp, chicken (Gallus Gallus)
  misc_feature (36): n=c or t
tcttgacacatgaattaaagctgacatttttcttangtgtggaattaaaagggtgttctcacctgagctgc

SEQ ID NO: 3010 - DNA, 71 bp, chicken (Gallus Gallus)
  misc_feature (36): n=c or t
gtgtcaaggcagccaggtgcagctcgctgcaaagcntctggcacgcttgtttttagcattttagctcagtg

SEQ ID NO: 3011 - DNA, 71 bp, chicken (Gallus Gallus)
  misc_feature (36): n=a or g
cagcagtgcctctgagcagagcaagtaatagaaatntatcactgggaaagtgtttgctgctcaagtgaagc

SEQ ID NO: 3012 - DNA, 71 bp, chicken (Gallus Gallus)
  misc_feature (36): n=a or c
aagagagcaaataaggattgtttgagggagactgancagtagcttaagtcacaagagtccttgaggttccc

SEQ ID NO: 3013 - DNA, 71 bp, chicken (Gallus Gallus)
  misc_feature (36): n=a or g
tatgagctctccaaaggtatcccagtactcttcacnagatgtcaatctaaaagcacaccaattagaactga

SEQ ID NO: 3014 - DNA, 71 bp, chicken (Gallus Gallus)
  misc_feature (36): n=c or t
aggtgtacagctcttggctaaggggagtgccaactntttgcttcagtaactatgtaatggaagggtgtaag

SEQ ID NO: 3015 - DNA, 71 bp, chicken (Gallus Gallus)
  misc_feature (36): n=a or g
agatattacagttttctatgttagttcaaataacantttctactaagtgccctatattgtggcatctgttt

SEQ ID NO: 3016 - DNA, 71 bp, chicken (Gallus Gallus)
  misc_feature (36): n=c or g
gaatttcacgggctgccttttggggcatgtgttttntcaccttgctctttttctggtaactgtgttcagtt

SEQ ID NO: 3017 - DNA, 71 bp, chicken (Gallus Gallus)
  misc_feature (36): n=g or t
tgcttcccatatcaatctcaggctggcagatcaacngaggtaatgtgctctccctccaaagataagcacaa

SEQ ID NO: 3018 - DNA, 71 bp, chicken (Gallus Gallus)
  misc_feature (36): n=c or t
caaattgtgtgtattctgagagctaactgataatangtaacttggaattcttccaacaaaaaaaattgttt

SEQ ID NO: 3019 - DNA, 71 bp, chicken (Gallus Gallus)
  misc_feature (36): n=a or g
gacgctttgctgagcactgagcatcacaacaccacnttagcaatcaacagtttacataaggtttatagcaa

SEQ ID NO: 3020 - DNA, 71 bp, chicken (Gallus Gallus)
  misc_feature (36): n=a or g
ctgggggtggcacagaggccccgcagccgtcccacntgcactcaccttctccagcatcttctgccagaact

SEQ ID NO: 3021 - DNA, 71 bp, chicken (Gallus Gallus)
  misc_feature (36): n=a or g
acacaagttttcttcttgtgccagctctgctatgcncagccttccaaaggagacggcacaatgcattgtgg

SEQ ID NO: 3022 - DNA, 71 bp, chicken (Gallus Gallus)
  misc_feature (36): n=c or t
acctcaagaacacctatcagcaacccaacagtttgnctattactaagccaggtccccaagagttatgcagt

SEQ ID NO: 3023 - DNA, 71 bp, chicken (Gallus Gallus)
  misc_feature (36): n=a or c
atctgcatcacaaggatgctgcttcccacaaatagnaacactttattggttatgaattctcagtcacaatt

SEQ ID NO: 3024 - DNA, 71 bp, chicken (Gallus Gallus)
  misc_feature (36): n=a or c
aactggaaaatcctctctaagaacaacagctctgcnactgcacataagaccaccctattccaccacctctc

SEQ ID NO: 3025 - DNA, 71 bp, chicken (Gallus Gallus)
  misc_feature (36): n=a or g
atgaccaccgtgcccactaaaccacatcctttctcngttcagttccaacaacgccaaccaaaatcacactg

SEQ ID NO: 3026 - DNA, 71 bp, chicken (Gallus Gallus)
  misc_feature (36): n=c or t
taggtattgctgggccttcgagacaccagtgactcnattgtggcaataacgctgcacagcttagcagttct

SEQ ID NO: 3027 - DNA, 71 bp, chicken (Gallus Gallus)
  misc_feature (36): n=c or g
agttgttaatcaattatctccttaatgaaaagttanagtcagctttgagcccatactgctctctaagctgc

SEQ ID NO: 3028 - DNA, 71 bp, chicken (Gallus Gallus)
  misc_feature (36): n=c or t
cccagcaatggcagcgcagacccactgccctcaacnggtgtagcttctacatgaaagatagcatttagggt

SEQ ID NO: 3029 - DNA, 71 bp, chicken (Gallus Gallus)
  misc_feature (36): n=a or g
gtctttctgcttattcagctttgcaaatgcagccanccactatcatacatcaccactgtttttgacacgct

SEQ ID NO: 3030 - DNA, 71 bp, chicken (Gallus Gallus)
  misc_feature (36): n=a or g
ccgtcctttaattctaagtctgtgactgttctcatnaactctgaaaaagggaagtctttcttaaggcggta

SEQ ID NO: 3031 - DNA, 71 bp, chicken (Gallus Gallus)
  misc_feature (36): n=a or g
ggcgtccaaaaactggctgtgtgttagccttaactngcaccaccaataagtcattctagctccaaacctga

SEQ ID NO: 3032 - DNA, 71 bp, chicken (Gallus Gallus)
  misc_feature (36): n=a or g
aaaatgctgggatccacaataacagcttttagaaangcagcagtcacaattcaacttaaagactggtgaat

SEQ ID NO: 3033 - DNA, 71 bp, chicken (Gallus Gallus)
  misc_feature (36): n=a or g
atataattctagtgaaaatcctgcgctgccatctancaaatgctcacgttactgtagctgctttcaaactg

SEQ ID NO: 3034 - DNA, 71 bp, chicken (Gallus Gallus)
  misc_feature (36): n=c or t
cctctaaacttcacatacgcacataagctcctcaangtgcaaaacacccaaaagagatgcaaaaattccca

SEQ ID NO: 3035 - DNA, 71 bp, chicken (Gallus Gallus)
  misc_feature (36): n=c or t
gacatccttgggtatcaccagctctctatccccacnctagcgtgcttgatttttttgcaaggcatgaatca

SEQ ID NO: 3036 - DNA, 71 bp, chicken (Gallus Gallus)
  misc_feature (36): n=c or t
ctctgtttagtgttaatcccactgttgtgatatctngtctcaaaatagtataatttagaaaacagcaacaa

SEQ ID NO: 3037 - DNA, 71 bp, chicken (Gallus Gallus)
  misc_feature (36): n=a or g
cttttaatggcttgctctgatgcgctttacagaganaaacctgtcagtctgggtgaactcagttagcagcc

SEQ ID NO: 3038 - DNA, 71 bp, chicken (Gallus Gallus)
  misc_feature (36): n=a or g
cagactgcaagaattctcttcagaatcagctaaggngtaatggttgctattccagctggtcatacgtactg

SEQ ID NO: 3039 - DNA, 71 bp, chicken (Gallus Gallus)
  misc_feature (36): n=a or g
cagatggaacgacttgaagatttaagtgatatgcantagatgtacgttcatcgtaatgtctttgaaggaga

SEQ ID NO: 3040 - DNA, 71 bp, chicken (Gallus Gallus)
  misc_feature (36): n=c or g
ttttcaaaggatttttggaaggatttttattaccanagcattgagtttcatccttatagcatgatcgttgc

SEQ ID NO: 3041 - DNA, 71 bp, chicken (Gallus Gallus)
  misc_feature (36): n=a or g
actactctgtcctttgcctgtagtaggcacagaaancttttgccaaggtgtacttgtcatagatactttcg

SEQ ID NO: 3042 - DNA, 71 bp, chicken (Gallus Gallus)
  misc_feature (36): n=c or t
ttctatgtaaagaaaatccctcagtatcaagaatangtgatgttttctttttggtagttgcacactttcaa

SEQ ID NO: 3043 - DNA, 71 bp, chicken (Gallus Gallus)
  misc_feature (36): n=g or t
tcagagaaatctgctcattcagttctcagcctgacnatgacttcacttgcaaaggaagacgttttcccatt

SEQ ID NO: 3044 - DNA, 71 bp, chicken (Gallus Gallus)
  misc_feature (36): n=c or t
catgtttctagggcttgggtatttgtacacgtgcangtatgtgtatacactgcacatacatgcaaagcaaa

SEQ ID NO: 3045 - DNA, 71 bp, chicken (Gallus Gallus)
  misc_feature (36): n=a or g
ttcgcaaagtgcaaaacagagaaacaaagagatccngagatggaagaaaagcttgtttgtactcgttacgc

SEQ ID NO: 3046 - DNA, 71 bp, chicken (Gallus Gallus)
  misc_feature (36): n=c or t
tcatgatttaaggttagataaaggtgaagaatatanggtaattgagaagaatgacattcactggtggaagg

SEQ ID NO: 3047 - DNA, 71 bp, chicken (Gallus Gallus)
  misc_feature (36): n=a or g
tgggaataaatgggggtggcaaaatggtggtgtccntttccactgccctgtgctgcatgagcccacagcag

SEQ ID NO: 3048 - DNA, 71 bp, chicken (Gallus Gallus)
  misc_feature (36): n=c or t
caggccttgtgaaaagtcatttactcttctgcatgnaagttcctgtcaagtactgaaaggcctcaatcaga

SEQ ID NO: 3049 - DNA, 71 bp, chicken (Gallus Gallus)
  misc_feature (36): n=a or g
cccattggcaattagcatgactaggagggtggaagncaaggcacgcagtgatttaaacctatagcttcgtt

SEQ ID NO: 3050 - DNA, 71 bp, chicken (Gallus Gallus)
  misc_feature (36): n=c or t
tgtctagcaagttgcagctagatttatctcctgtgntctggcataggagagtgtgaaagtgttccttgtct

SEQ ID NO: 3051 - DNA, 71 bp, chicken (Gallus Gallus)
  misc_feature (36): n=c or t
catgttgcacaggatggtcacagagtcccctctcgntccctctgcagccttggaaattccaactgacctgt

SEQ ID NO: 3052 - DNA, 71 bp, chicken (Gallus Gallus)
  misc_feature (36): n=a or g
cggggaggatgaacatcaccaatgcccaatgcaggnacaagacggctctggagtggaaaagccagcacttc

SEQ ID NO: 3053 - DNA, 71 bp, chicken (Gallus Gallus)
  misc_feature (36): n=a or c
ttttcatagacactgaaaaatatcctcaaacttagnaggaccatgcagctgtagcactagtaatgtgatta

SEQ ID NO: 3054 - DNA, 71 bp, chicken (Gallus Gallus)
  misc_feature (36): n=c or t
agccggggtacagaaacctacgggatgatccaggtnacactgctggacaccgttgagctggcgacctacac

SEQ ID NO: 3055 - DNA, 71 bp, chicken (Gallus Gallus)
  misc_feature (36): n=a or g
gtacaagaaccacacaagaatttcagagagctttcnaggggggaggaggaggatatttgagatctggagcc

SEQ ID NO: 3056 - DNA, 71 bp, chicken (Gallus Gallus)
  misc_feature (36): n=c or g
cacaatggaatgcctgtgagatgctccagtgtcacntcgcagacccagggagctccgcgtcagaaggtgcc

SEQ ID NO: 3057 - DNA, 71 bp, chicken (Gallus Gallus)
  misc_feature (36): n=g or t
tttaataacatcccaaagggctggaaaagcggagcnggcagctcccggtgcagcctggcctgccatgccat

SEQ ID NO: 3058 - DNA, 71 bp, chicken (Gallus Gallus)
  misc_feature (36): n=a or g
gaccttctttccccatcttcagccagaaaatgcagncagcattattcatctgaaacttcagcactctgtct

SEQ ID NO: 3059 - DNA, 71 bp, chicken (Gallus Gallus)
  misc_feature (36): n=g or t
ggaatttctgctttgttccctagagatgtcctacanggatctatgacacatttcctcagaattttccagag

SEQ ID NO: 3060 - DNA, 71 bp, chicken (Gallus Gallus)
  misc_feature (36): n=c or g
ctcgtgttcagacagagcctcctgtgctccagtttntgcttggctaggtcattgtgttggttgactgttaa

SEQ ID NO: 3061 - DNA, 71 bp, chicken (Gallus Gallus)
  misc_feature (36): n=c or t
tggtgcaagtcaagacagggtgatttacagagcagngtctaacaatagtgtgctcctgtgtgtctccgaga

SEQ ID NO: 3062 - DNA, 71 bp, chicken (Gallus Gallus)
  misc_feature (36): n=c or t
ccccagaagcctcaaactctcgtgaagtcatagcangagtggtgtgattttttgcacttaatgtagcattg

SEQ ID NO: 3063 - DNA, 71 bp, chicken (Gallus Gallus)
  misc_feature (36): n=a or c
ttcattctgagtggctttaaaacatagagacaccanggatccagtgcttgatctgctggttggcaatgctg

SEQ ID NO: 3064 - DNA, 71 bp, chicken (Gallus Gallus)
  misc_feature (36): n=a or g
ccccctcacaaaacatgtaaagcaaggattatacanaaaatgaagctactttgccaagagtaggatattta

SEQ ID NO: 3065 - DNA, 71 bp, chicken (Gallus Gallus)
  misc_feature (36): n=a or g
gtttaacagtgtcagtaaagacactgtagcatgagntctgattccttatctcagtcacttctttgccagtt

SEQ ID NO: 3066 - DNA, 71 bp, chicken (Gallus Gallus)
  misc_feature (36): n=a or g
attttctttatacctcacaaagacctaattaataantgcacattcttgggaccataattttgaaatacagc

SEQ ID NO: 3067 - DNA, 71 bp, chicken (Gallus Gallus)
  misc_feature (36): n=a or g
ataacacacattattgggtctactgttaacgcacgntagagataagaagtaatttaatcatttggcagaaa

SEQ ID NO: 3068 - DNA, 71 bp, chicken (Gallus Gallus)
  misc_feature (36): n=g or t
gtaacccaacagcaaacacaacctgcagtcaccgtncctgtcctcgttctccacgctgatcggacaggcgt

SEQ ID NO: 3069 - DNA, 71 bp, chicken (Gallus Gallus)
  misc_feature (36): n=a or g
taaaacacgtaattaattattaacgacttacggaantctctgaaggctccaagagattttaaaaggtaaaa

SEQ ID NO: 3070 - DNA, 71 bp, chicken (Gallus Gallus)
  misc_feature (36): n=a or g
aaacacatggcttggagaaacagaactattgggtanagtttgtggcgaagtggaagacagcaatgactgat

SEQ ID NO: 3071 - DNA, 71 bp, chicken (Gallus Gallus)
  misc_feature (36): n=c or t
ttactgtatcatctactgtaagcacactgtcattgnctgagagcacaagtttgcatgctttaaaggtagct

SEQ ID NO: 3072 - DNA, 71 bp, chicken (Gallus Gallus)
  misc_feature (36): n=a or g
actcgtttcctccaagctcctctcttaagccaaganccatggctagcacagagaagtagatttccttagga

SEQ ID NO: 3073 - DNA, 71 bp, chicken (Gallus Gallus)
  misc_feature (36): n=c or t
tttgttttcatcactatccgccatgaaagaatgatnaaataaagctgctgaaatttgttgtgccaccaact

SEQ ID NO: 3074 - DNA, 71 bp, chicken (Gallus Gallus)
  misc_feature (36): n=a or g
actgcaggtgctttacttccactaaactgaactcanaagaagatggttggtttgtccgtagttaaggtcag

SEQ ID NO: 3075 - DNA, 71 bp, chicken (Gallus Gallus)
  misc_feature (36): n=a or g
aaatctggattccctatcctggaattcagtcttccngggtctgttactatcttagggtcagctttagaaac

SEQ ID NO: 3076 - DNA, 71 bp, chicken (Gallus Gallus)
  misc_feature (36): n=c or g
gaacgtactgctctccttccagctacctcagccagngtgacgaagtcattggtgacagcaatggaatttgg

SEQ ID NO: 3077 - DNA, 71 bp, chicken (Gallus Gallus)
  misc_feature (36): n=g or t
cagttcttctagcctgaattctcttcttttcaaaanacttatttattgctctaagtttgtttcaatccatt

SEQ ID NO: 3078 - DNA, 71 bp, chicken (Gallus Gallus)
  misc_feature (36): n=c or t
tgatagcgaaccaaagtgtggtttgctgcttggaantgaatgttttttgctgttgttgtttttcccccaag

SEQ ID NO: 3079 - DNA, 71 bp, chicken (Gallus Gallus)
  misc_feature (36): n=a or g
ttcagccatataaagccaagagaggagctccaaagntattacagtaaaggagatcagtctctgatctttca

SEQ ID NO: 3080 - DNA, 71 bp, chicken (Gallus Gallus)
  misc_feature (36): n=a or t
aaatgtctgtgggctgaaacttggcattcagggggnaggcccagcagtaaattgtttttacaaattaaaaa

SEQ ID NO: 3081 - DNA, 71 bp, chicken (Gallus Gallus)
  misc_feature (36): n=c or t
tattcttgtctaaatgctgcttaactacaataaacngaagccgaagtatttgtccagtttcaggaaatctt

SEQ ID NO: 3082 - DNA, 71 bp, chicken (Gallus Gallus)
  misc_feature (36): n=c or t
acactgttttccctccaagttcctggcaactaccgngataaataagctgctgcaaacatctcaaactgggt

SEQ ID NO: 3083 - DNA, 71 bp, chicken (Gallus Gallus)
  misc_feature (36): n=a or g
aggagcagagtgggccgcacagctgttggaaggttntgatatgaggttgtggagacctgggcgcacagcag

SEQ ID NO: 3084 - DNA, 71 bp, chicken (Gallus Gallus)
  misc_feature (36): n=c or t
agactgcccgacaatgtaaagtgaagctgatatggntgaaggctgccactatttcttcacatttttcattt

SEQ ID NO: 3085 - DNA, 71 bp, chicken (Gallus Gallus)
  misc_feature (36): n=c or t
agggaaacttcaagcttgtgtttcgttttgagctgnttaccctcttcagaccttgtaaggtggtctcaaga

SEQ ID NO: 3086 - DNA, 71 bp, chicken (Gallus Gallus)
  misc_feature (36): n=a or g
gccatgggtggagcactcaaagccagcaattaccancccccttttcctccagcattcttatctacttctcc

SEQ ID NO: 3087 - DNA, 71 bp, chicken (Gallus Gallus)
  misc_feature (36): n=a or c
gtatcaaaatgttgatgtaattcaccaccagttagngtccatgatccaattcactgtattaacagaactgc

SEQ ID NO: 3088 - DNA, 71 bp, chicken (Gallus Gallus)
  misc_feature (36): n=a or g
gaatgtagacacctatgcagcgcatgcagttggaanaaggctgtttaatagaacttgtagttttgcatgct

SEQ ID NO: 3089 - DNA, 71 bp, chicken (Gallus Gallus)
  misc_feature (36): n=c or t
tttgatatgtagtccttgggggggggggaacgaagngagagcagggatatctttcttatgtaaaagctgtc

SEQ ID NO: 3090 - DNA, 71 bp, chicken (Gallus Gallus)
  misc_feature (36): n=c or t
agcatgaggctagttaggatgtgggattgacagctnaccacccaccatgtgcacaggagacttctgtcatt

SEQ ID NO: 3091 - DNA, 71 bp, chicken (Gallus Gallus)
  misc_feature (36): n=a or g
agaactgtgcttcaacttcgcaagctgctgagaagncagtccatctcagagtgaaatctccatttcagatc

SEQ ID NO: 3092 - DNA, 71 bp, chicken (Gallus Gallus)
  misc_feature (36): n=g or t
ctgtggtctgtttcacacatctggccctgtgtaatngcaaaaagcagcttggagcaggtgacttctcttaa

SEQ ID NO: 3093 - DNA, 71 bp, chicken (Gallus Gallus)
  misc_feature (36): n=c or t
aatcagaggttcaggccgtgattcaacagttcccanacaccttgttaaggaaatattttcaagagccaaag

SEQ ID NO: 3094 - DNA, 71 bp, chicken (Gallus Gallus)
  misc_feature (36): n=c or t
taacaattcaaatcagtatcaatcacctcccagagncggctgtcagctgctcctaaacatgtccccatcgt

SEQ ID NO: 3095 - DNA, 71 bp, chicken (Gallus Gallus)
  misc_feature (36): n=a or g
tgagatgtgtctcaagctcagtgatgcctctgcctntgaaagaagacagcaccgtggtctgcaatggctta

SEQ ID NO: 3096 - DNA, 71 bp, chicken (Gallus Gallus)
  misc_feature (36): n=a or g
cttaataccagccttcttccctggccctggtgtttnttaattcttcatctaaagctgatgcattggatctt

SEQ ID NO: 3097 - DNA, 71 bp, chicken (Gallus Gallus)
  misc_feature (36): n=a or g
ccaaatccaaatagtctaccagtagttggtgtttgnggtacatactcactgtgtctaaaaagcaattgaga

SEQ ID NO: 3098 - DNA, 71 bp, chicken (Gallus Gallus)
  misc_feature (36): n=c or t
ctggatgaagggagagggtgaatttctactgcctgnagccctgaggagatcccagtgtgatgacactgtgt

SEQ ID NO: 3099 - DNA, 71 bp, chicken (Gallus Gallus)
  misc_feature (36): n=c or t
aagagaattcctgatttgattgattttcccagtagnctttgctagctaagttcttcctttatcacatacat

SEQ ID NO: 3100 - DNA, 71 bp, chicken (Gallus Gallus)
  misc_feature (36): n=a or c
atttaatacaaattaaatttgcttagacatacccantgtgcattttaaaaagtcattataaagacaggatc

SEQ ID NO: 3101 - DNA, 71 bp, chicken (Gallus Gallus)
  misc_feature (36): n=a or g
gttccactgagatcagagaagcagagctacctagangcctgaggccaccgaggaacattcccatgcattta

SEQ ID NO: 3102 - DNA, 71 bp, chicken (Gallus Gallus)
  misc_feature (36): n=c or t
agcatacgtagtcttcttgaagtgaggatattatanacaagataggaattgcatatactaccagatcataa

SEQ ID NO: 3103 - DNA, 71 bp, chicken (Gallus Gallus)
  misc_feature (36): n=c or t
tggcaagcaagcatgtggcggtaagagctccacagngaataaattcttaatgatggaaagtaggctaacac

SEQ ID NO: 3104 - DNA, 71 bp, chicken (Gallus Gallus)
  misc_feature (36): n=c or t
gctgtgctggtgtggtggtctgtgtcttcgcgctgngagctacttcgagatctttctgttttcttttttgt

SEQ ID NO: 3105 - DNA, 71 bp, chicken (Gallus Gallus)
  misc_feature (36): n=a or g
ttcactgtaagaatcccagattgcctatccttcatntgtttattttgtagacagggccagtcttgctctat

SEQ ID NO: 3106 - DNA, 71 bp, chicken (Gallus Gallus)
  misc_feature (36): n=c or t
atatttacagcataaatatagtccctttacatttanctttcaatgttgccactgtatccaatggaactctc

SEQ ID NO: 3107 - DNA, 71 bp, chicken (Gallus Gallus)
  misc_feature (36): n=a or g
gtccaagctaacaccccactgacagagccattggcntcacccagaacggttgacttgggtttcacataaat

SEQ ID NO: 3108 - DNA, 71 bp, chicken (Gallus Gallus)
  misc_feature (36): n=g or t
gtttgttttaatcaactccccccaaacaagcctgtntcacagctcggcatttcagcttcaccagaaataag

SEQ ID NO: 3109 - DNA, 71 bp, chicken (Gallus Gallus)
  misc_feature (36): n=a or g
aatttctctgctaaccttttgtattactctttttcnatgacttttcaattgtagtcaatgagcttctgaga

SEQ ID NO: 3110 - DNA, 71 bp, chicken (Gallus Gallus)
  misc_feature (36): n=c or t
ctttaaatcaatgttctctttgtctttttacattantcataacaagttctatgtactcacactctatagat

SEQ ID NO: 3111 - DNA, 71 bp, chicken (Gallus Gallus)
  misc_feature (36): n=a or g
agtttcaaccctggatctaccattttaaacagtgcnttctcaaaggacaaactgtgcttcaaagtcaacct

SEQ ID NO: 3112 - DNA, 71 bp, chicken (Gallus Gallus)
  misc_feature (36): n=a or g
tcaaggtgcattagaaggtgagcaaaatacaggagngacacatgagagtaacaacaaccgcagggaagacc

SEQ ID NO: 3113 - DNA, 71 bp, chicken (Gallus Gallus)
  misc_feature (36): n=a or g
aaatctgccctggaagattgtagctgttaccaaacncattacaatattaatgaacgctggaaaggatttgt

SEQ ID NO: 3114 - DNA, 71 bp, chicken (Gallus Gallus)
  misc_feature (36): n=c or t
ttcaaaatgaataaaagctgttcttactgtcacttnagttacttaagaaataatttcttattatggcagat

SEQ ID NO: 3115 - DNA, 71 bp, chicken (Gallus Gallus)
  misc_feature (36): n=c or t
tgtggaatatgacctgttttggctatttaaaaatanacctagctgtatttatcctgctttacagatgtatc

SEQ ID NO: 3116 - DNA, 71 bp, chicken (Gallus Gallus)
  misc_feature (36): n=c or t
aaaatttaaaacatggaagcaaagaaaaacagctanaaaaagagtaaagaatgtgtctgaggagagagtgg

SEQ ID NO: 3117 - DNA, 71 bp, chicken (Gallus Gallus)
  misc_feature (36): n=c or t
cagataatactcaacatctctaaaggtgcatttatngagtacttcaatttgactgtgagctcatgcttaaa

SEQ ID NO: 3118 - DNA, 71 bp, chicken (Gallus Gallus)
  misc_feature (36): n=a or g
tgctcactatcccagtcacagccattgctcctcccngcagagctcctatcaccatcgctaaaaacaaataa

SEQ ID NO: 3119 - DNA, 71 bp, chicken (Gallus Gallus)
  misc_feature (36): n=a or t
ggtaagatcagatgtgctgtagttttgtactgtatnctgcaactcttggttagattattttttttttcccc

SEQ ID NO: 3120 - DNA, 71 bp, chicken (Gallus Gallus)
  misc_feature (36): n=c or t
acagagcatggtcagcacatttctgaactttaggangactttgtatgaagctgtacaaaatacatgaaaaa

SEQ ID NO: 3121 - DNA, 71 bp, chicken (Gallus Gallus)
  misc_feature (36): n=c or t
cgtgtatgggtggtggtggtgtttgtctccccttangaatcagtgttgagctaagtcagaaaaagcttgag

SEQ ID NO: 3122 - DNA, 71 bp, chicken (Gallus Gallus)
  misc_feature (36): n=c or t
agccctaaacttctgaagttttaaggcagatttagngactgctcagccatcttcctcagtcttctggcctt

SEQ ID NO: 3123 - DNA, 71 bp, chicken (Gallus Gallus)
  misc_feature (36): n=a or g
tcactgggagataaatttggttgtcagtggatcaancagagagtcaataagtggaaaatacagtcagctgg

SEQ ID NO: 3124 - DNA, 71 bp, chicken (Gallus Gallus)
  misc_feature (36): n=c or t
ttcactgcaatcacatacatgtcacaacaactaccngaactgatgccaatgaaaattttggttgtgattgc

SEQ ID NO: 3125 - DNA, 71 bp, chicken (Gallus Gallus)
  misc_feature (36): n=c or t
tttggctctaactctcaccaacacccatgtcagctnagccctaaatatctgcaagtacctgtgacagtgca

SEQ ID NO: 3126 - DNA, 71 bp, chicken (Gallus Gallus)
  misc_feature (36): n=c or t
agaccccagctcagctctagccaagcaattcccctncccagaccttggttttatctgcttaattctgatta

SEQ ID NO: 3127 - DNA, 71 bp, chicken (Gallus Gallus)
  misc_feature (36): n=c or t
aacgagtcgggcaggtctggggaggcagtaggaggngagcaagccaaaacactcagtaaggtgagaagtaa

SEQ ID NO: 3128 - DNA, 71 bp, chicken (Gallus Gallus)
  misc_feature (36): n=c or t
tcgtgcgccatgcagagcacggggcagatccagtgnaaggtgtacgactcgctgcttaagctggagggtaa

SEQ ID NO: 3129 - DNA, 71 bp, chicken (Gallus Gallus)
  misc_feature (36): n=c or t
aacttcctccactctgtccaagtcagtgtaagctcnatcagtccaccctgtgcaatgagagtaaacaggaa

SEQ ID NO: 3130 - DNA, 71 bp, chicken (Gallus Gallus)
  misc_feature (36): n=a or g
acaggcagataacttagttgctggtggtctgactcnccaccctctggaagactcatgtctaagttagttgc

SEQ ID NO: 3131 - DNA, 71 bp, chicken (Gallus Gallus)
  misc_feature (36): n=c or t
gaactcaacgtcacccgcctgtcccacttcgagtangtcaaaaatgaggatctggagaagattggcatggg

SEQ ID NO: 3132 - DNA, 71 bp, chicken (Gallus Gallus)
  misc_feature (36): n=c or t
tgctgtaataaatagacaaacaaattgctttctccnagagctgccataatacaaagtgaagggcaagggac

SEQ ID NO: 3133 - DNA, 71 bp, chicken (Gallus Gallus)
  misc_feature (36): n=a or g
tggcagtgaagggacaaaggacagcttgtttagacntttagatgaaggaacctcccagcagagaaggacag

SEQ ID NO: 3134 - DNA, 71 bp, chicken (Gallus Gallus)
  misc_feature (36): n=c or t
tagcagctcaacagtgctaacctaggattttagacntggtgctgcaagggtaactaaacaaggcaatgtgg

SEQ ID NO: 3135 - DNA, 71 bp, chicken (Gallus Gallus)
  misc_feature (36): n=a or g
gggcgctgtgaaaggctgatgctcctgaatgcagcntgcagctggggaggggaggaagtagcccctggact

SEQ ID NO: 3136 - DNA, 71 bp, chicken (Gallus Gallus)
  misc_feature (36): n=c or t
ctaaggtgtcctcccacccctaggagctttgggganggaaaatgtagagttgtggtgttgtgctggatgag

SEQ ID NO: 3137 - DNA, 71 bp, chicken (Gallus Gallus)
  misc_feature (36): n=a or g
tggactggaatgttataagcttgtagcagacatttntctcattacttcctgacatgatttataatttgtcc

SEQ ID NO: 3138 - DNA, 71 bp, chicken (Gallus Gallus)
  misc_feature (36): n=c or t
aataagcaccttgtaattagtactaacccacctganggcaatactgcagtctcctactgatgcccatagct

SEQ ID NO: 3139 - DNA, 71 bp, chicken (Gallus Gallus)
  misc_feature (36): n=a or g
tagcctggcaccccaaatccagctgtggtcaaatgntgcctctgtatccctattcttgatgggagccgtgt

SEQ ID NO: 3140 - DNA, 71 bp, chicken (Gallus Gallus)
  misc_feature (36): n=a or c
ctcagatttctttggtaattatcagaatccttggtnattattctgtagggccaaactgattcttggtgcag

SEQ ID NO: 3141 - DNA, 71 bp, chicken (Gallus Gallus)
  misc_feature (36): n=a or g
actattcattccaacagctgtttatacagtctctgnggacaagttgtcttcgtcagggacagcaaaaatat

SEQ ID NO: 3142 - DNA, 71 bp, chicken (Gallus Gallus)
  misc_feature (36): n=a or g
tagtgcccctcataaacacacatccttccttccccngtaacagcccatttctgttctttttgtgggttctg

SEQ ID NO: 3143 - DNA, 71 bp, chicken (Gallus Gallus)
  misc_feature (36): n=a or g
aaacatgatgtctgcagacagaaccaccaaattatnatggaggcggtgtgaaaacaacaccactctgagtg

SEQ ID NO: 3144 - DNA, 71 bp, chicken (Gallus Gallus)
  misc_feature (36): n=a or g
accactgatcacaaaacgtcaccatttgtacagtcncggtttaacaacctccagagttagtgatgaactac

SEQ ID NO: 3145 - DNA, 71 bp, chicken (Gallus Gallus)
  misc_feature (36): n=c or t
caagcctgcacagtgccactgaatatagaagaaggnggcaagctacatttagatccaatggaaaagctcag

SEQ ID NO: 3146 - DNA, 71 bp, chicken (Gallus Gallus)
  misc_feature (36): n=a or g
atggtatcccttcttgtttggagtacttcagtgtgntcctatatgctggcccgtaaggatagttgggtgta

SEQ ID NO: 3147 - DNA, 71 bp, chicken (Gallus Gallus)
  misc_feature (36): n=c or t
tttgattcaatttctgacctgaacccaggtctgttngttgacaaaacactatgaaatgaggctaacgcccc

SEQ ID NO: 3148 - DNA, 71 bp, chicken (Gallus Gallus)
  misc_feature (36): n=c or g
agtttctcctgcgtcctacatatgtggcttgaagangatgtgctgacacaagctcagtgtacgtgtcactg

SEQ ID NO: 3149 - DNA, 71 bp, chicken (Gallus Gallus)
  misc_feature (36): n=a or g
catgcctagcaaaatgtgcctacagtatgctaccanagcttgggtgcattggtcttagctgtttaggctgt

SEQ ID NO: 3150 - DNA, 71 bp, chicken (Gallus Gallus)
  misc_feature (36): n=a or g
gctgttctttgggatttcagaatgagagaggtttgnttttcagaagtggcagattgaaggctgaacagtac

SEQ ID NO: 3151 - DNA, 71 bp, chicken (Gallus Gallus)
  misc_feature (36): n=a or g
actgtattcttaagcttttaaatgttttaaaggtgnatttctatattcacgccggcactttccctctcatt

SEQ ID NO: 3152 - DNA, 71 bp, chicken (Gallus Gallus)
  misc_feature (36): n=a or g
gaagagagggggagaaaaaagcagaatgtttagaanagatcagcttttgcctggaatgtgacatctgaata

SEQ ID NO: 3153 - DNA, 71 bp, chicken (Gallus Gallus)
  misc_feature (36): n=c or t
tatcatctactcatagccagcaaaaagcttagaatnttttttagctgtaaactgggggccattcatttttt

SEQ ID NO: 3154 - DNA, 71 bp, chicken (Gallus Gallus)
  misc_feature (36): n=c or t
caggtacatgacacacatcttttcctaaggaaatgnctgcaaaggagaagcttctttaagccattagcaga

SEQ ID NO: 3155 - DNA, 71 bp, chicken (Gallus Gallus)
  misc_feature (36): n=a or g
ttgagagtttctccccaaccatccccagcaccgacngtccctgtgcatagtaagaagctattgaaatgatg

SEQ ID NO: 3156 - DNA, 71 bp, chicken (Gallus Gallus)
  misc_feature (36): n=a or g
aaaatggaactgttccctactctgaacactgagcanatttttcagctcggtgaaagcctagctgataactg

SEQ ID NO: 3157 - DNA, 71 bp, chicken (Gallus Gallus)
  misc_feature (36): n=a or g
tgtcagagaccacgcgcaagtctaaaaatactcacntaagctcttcaagtgcttgacattgatctgtctgc

SEQ ID NO: 3158 - DNA, 71 bp, chicken (Gallus Gallus)
  misc_feature (36): n=a or g
agaaatgttctcgctgtagaaccttggccacgtacntgctagctgctgcaggtatgtgctgctaacagtcc

SEQ ID NO: 3159 - DNA, 71 bp, chicken (Gallus Gallus)
  misc_feature (36): n=c or t
tcatctctggcatatcactgacctcagctgaaatanaccaaagatgaattcaagacattgactagaaaacc

SEQ ID NO: 3160 - DNA, 71 bp, chicken (Gallus Gallus)
  misc_feature (36): n=a or g
gaaagcatactgcccacgagctaaagatgaagaganaagaggaaggtgaggcaggcatgagaagtaactta

SEQ ID NO: 3161 - DNA, 71 bp, chicken (Gallus Gallus)
  misc_feature (36): n=a or g
cttggtgcctacagggtcatgtatcctgggactcantgtggttcaggatccagcttcaatgatggcaacaa

SEQ ID NO: 3162 - DNA, 71 bp, chicken (Gallus Gallus)
  misc_feature (36): n=c or t
gagctaaggggttgaaataaacactcctaaaacatnactcattttaccctgaaatagacatttacaatgaa

SEQ ID NO: 3163 - DNA, 71 bp, chicken (Gallus Gallus)
  misc_feature (36): n=a or t
tatatattatattttgttatatttaatatatttttnatagaattttatatgttctctgttattacatagaa

SEQ ID NO: 3164 - DNA, 71 bp, chicken (Gallus Gallus)
  misc_feature (36): n=c or t
acaagagcttatatcaatacttggtgcttcatcagncatctatttcaacactttgaacctagataattaag

SEQ ID NO: 3165 - DNA, 71 bp, chicken (Gallus Gallus)
  misc_feature (36): n=g or t
tgaagataatcccttccatttattattgcaaagtgnttttctttttaggcatcagcctgctcaactttcag

SEQ ID NO: 3166 - DNA, 71 bp, chicken (Gallus Gallus)
  misc_feature (36): n=c or t
ctgtagtaccctgttactgtactttgttatgggaanataatacttacttgcagcttgccacaaattccttt

SEQ ID NO: 3167 - DNA, 71 bp, chicken (Gallus Gallus)
  misc_feature (36): n=g or t
acttagctaatcagacctcacattctcaccttcaantgtcgttatgtgaataaaaatgacctataattacc

SEQ ID NO: 3168 - DNA, 71 bp, chicken (Gallus Gallus)
  misc_feature (36): n=c or t
ccccacagatatatgatcatagtttgccaatacagntatgagtggttattaatttcttccattctcatact

SEQ ID NO: 3169 - DNA, 71 bp, chicken (Gallus Gallus)
  misc_feature (36): n=a or g
atcttcagaagggaactaatgcaaatcctcgatttnaacctcttctatttatgagaaagctagatgtggtc

SEQ ID NO: 3170 - DNA, 71 bp, chicken (Gallus Gallus)
  misc_feature (36): n=c or t
taatttgtatggacttgatttaggattgtgaaagcnagccagaattgtgcatctgaagtgatacttctgaa

SEQ ID NO: 3171 - DNA, 71 bp, chicken (Gallus Gallus)
  misc_feature (36): n=a or g
tactttttctaaatttcctcctatctgtgcaaaccncagcttatataacgcagtgtgaggtacttccattg

SEQ ID NO: 3172 - DNA, 71 bp, chicken (Gallus Gallus)
  misc_feature (36): n=a or g
gagtacgtaaagattgcacacagcatggttattgtnatcagctggtaacttattcagtaattagtcacaaa

SEQ ID NO: 3173 - DNA, 71 bp, chicken (Gallus Gallus)
  misc_feature (36): n=c or t
ttattatattcagttcttatcaaggtgttatatgtntaagagagacaggatttagtattgttcaaagctaa

SEQ ID NO: 3174 - DNA, 71 bp, chicken (Gallus Gallus)
  misc_feature (36): n=a or c
tcaagcaactaatcagggaggtgcagtgtgatttgnataaggaaactatggcagctaacccttaaggagtt

SEQ ID NO: 3175 - DNA, 71 bp, chicken (Gallus Gallus)
  misc_feature (36): n=a or g
tgaaggtctggaactgtctctgtaacaaagcattgnagcacttggagctgacaatgagagggcaatgcgat

SEQ ID NO: 3176 - DNA, 71 bp, chicken (Gallus Gallus)
  misc_feature (36): n=c or t
tttaaagccttctctgctgcacaaagtagaattggngtcctttcttactcttgcccagctgcacgaagatg

SEQ ID NO: 3177 - DNA, 71 bp, chicken (Gallus Gallus)
  misc_feature (36): n=c or t
tggcttactggaaccaaacgaaaggcacaagcctangtctgtggcaaatagccacatgcagctcaaacaca

SEQ ID NO: 3178 - DNA, 71 bp, chicken (Gallus Gallus)
  misc_feature (36): n=c or t
attaagtcaaatggttggacaattagtacagtcatngtgtcaagggagcagcctcaagatacagcaagcac

SEQ ID NO: 3179 - DNA, 71 bp, chicken (Gallus Gallus)
  misc_feature (36): n=a or g
gcctgttgtttgcttgctcaaaagcagagcttgttntgttcgttttgtttttcttaaatgattgctgagga

SEQ ID NO: 3180 - DNA, 71 bp, chicken (Gallus Gallus)
  misc_feature (36): n=c or g
ccagtgcccatcagcatcatgccatctgtgtgacantgtgtgcgccctgctggtggtaacgccggctgcac

SEQ ID NO: 3181 - DNA, 71 bp, chicken (Gallus Gallus)
  misc_feature (36): n=c or t
gagaaaaagaacttttatgtgctttctagccttttntgttctttgttttttaaagccatttaaatcacaag

SEQ ID NO: 3182 - DNA, 71 bp, chicken (Gallus Gallus)
  misc_feature (36): n=c or t
gtggtggtttcttttatgacgaggggttctggttantggattattgaagctgatggagcgattcctaacgt

SEQ ID NO: 3183 - DNA, 71 bp, chicken (Gallus Gallus)
  misc_feature (36): n=c or t
caaacttaaggaaagctttatctgaagatgaactgnttgttatgatgccttcaatttgtgatgtctgagag

SEQ ID NO: 3184 - DNA, 71 bp, chicken (Gallus Gallus)
  misc_feature (36): n=a or g
agggataacgttatttctgccctttcaaagtaactntcagcttgtgccttactaattaacaccagaagagt

SEQ ID NO: 3185 - DNA, 71 bp, chicken (Gallus Gallus)
  misc_feature (36): n=a or g
acaaacttaaggaaagctttatctgaagatgaactncttgttatgatgccttcaatttgtgatgtctgaga

SEQ ID NO: 3186 - DNA, 71 bp, chicken (Gallus Gallus)
  misc_feature (36): n=g or t
catcacatttgtatttctgaactggggaagatatgnatttgaaatgtaaactgttcagtggataaggaatt

SEQ ID NO: 3187 - DNA, 71 bp, chicken (Gallus Gallus)
  misc_feature (36): n=a or c
ttcagaaaacgcgtaaatgatgcgtaacgatgttcnagcaggtctgcaagcagctctcctttgtgtcacta

SEQ ID NO: 3188 - DNA, 71 bp, chicken (Gallus Gallus)
  misc_feature (36): n=a or g
agatcatcctgacacgtagctgttgctgggcacagnagacaaactgattggaaacatgctactctgtgcct

SEQ ID NO: 3189 - DNA, 71 bp, chicken (Gallus Gallus)
  misc_feature (36): n=a or c
atcaacattctctagcagagtcatttccacttttcnaagagatttccatgaaaatttgcctattaaagcat

SEQ ID NO: 3190 - DNA, 71 bp, chicken (Gallus Gallus)
  misc_feature (36): n=a or g
cgtgattgatgggcagtgcattaccacttgtgcacntttcagctatataactgatgctcaggccatgctat

SEQ ID NO: 3191 - DNA, 71 bp, chicken (Gallus Gallus)
  misc_feature (36): n=c or t
ttttcagctcagccaggacagaaaaggcttctgganttcgtgccagttgggctctctgatagccacgtgcc

SEQ ID NO: 3192 - DNA, 71 bp, chicken (Gallus Gallus)
  misc_feature (36): n=a or g
acccgggtcactgccagacagagagcagagctgctngatcacagctctaaagggacatattacaagatgca

SEQ ID NO: 3193 - DNA, 71 bp, chicken (Gallus Gallus)
  misc_feature (36): n=a or g
ggagatgcaacagcacatggaaaggaaaacaacacntggaaaggatggagtaagagagaaagcacagctgt

SEQ ID NO: 3194 - DNA, 71 bp, chicken (Gallus Gallus)
  misc_feature (36): n=a or g
gccaagccaagctacattccagctttggaacataantgatttgcagccctgcataccagcaataccccttc

SEQ ID NO: 3195 - DNA, 71 bp, chicken (Gallus Gallus)
  misc_feature (36): n=a or g
tcagtgcaagacgtccctgctggtgagctagttccntaatatactgagatactgagcagaagaaacagctt

SEQ ID NO: 3196 - DNA, 71 bp, chicken (Gallus Gallus)
  misc_feature (36): n=c or t
cctcctgctgctccgatgggggaaatcccattggangtcgatggtggagtggactttagctaaaaggtggt

SEQ ID NO: 3197 - DNA, 71 bp, chicken (Gallus Gallus)
  misc_feature (36): n=c or t
gaaaggatacccaaaacttactgacagggagaagcnattggatttctcttagaagctcagcattaccaata

SEQ ID NO: 3198 - DNA, 71 bp, chicken (Gallus Gallus)
  misc_feature (36): n=g or t
aagacttcaggtaataagccagaaatctgtgtgagntaaatcaactcaagctataataaagtgtgcaattc

SEQ ID NO: 3199 - DNA, 71 bp, chicken (Gallus Gallus)
  misc_feature (36): n=a or g
gcagagtgctccaaatccagctgtatgagtaagaanaggagaagaagtaaccaaagtggcagggggcagcc

SEQ ID NO: 3200 - DNA, 71 bp, chicken (Gallus Gallus)
  misc_feature (36): n=a or g
cgtcttctcataggttcgttaaggttggaatgaccnctaggatcatctcatccaaccaccagcccatcacc

SEQ ID NO: 3201 - DNA, 71 bp, chicken (Gallus Gallus)
  misc_feature (36): n=a or g
cgactgagctgtggtagtacaccagtttagtagggnctacttaatattgctgagaaaaataccataaatta

SEQ ID NO: 3202 - DNA, 71 bp, chicken (Gallus Gallus)
  misc_feature (36): n=c or t
ataaaccaatattgtttccttttgccagcagctttnagaaactgatgctgaaacattttacctgccgaaat

SEQ ID NO: 3203 - DNA, 71 bp, chicken (Gallus Gallus)
  misc_feature (36): n=a or g
ctcctgaggtcctgcttcttaggcagaagaaaacangatccagattatttagacttcatggtagatcaaag

SEQ ID NO: 3204 - DNA, 71 bp, chicken (Gallus Gallus)
  misc_feature (36): n=c or t
tcacactctgctaaagaacacagcaataagataatnaactggccagtagcgatcatcttaaatattttgaa

SEQ ID NO: 3205 - DNA, 71 bp, chicken (Gallus Gallus)
  misc_feature (36): n=c or t
tggtttcctagcccttagacatgtctatttaaaccngagctgtaagacatatagtcctttgtaagctctgg

SEQ ID NO: 3206 - DNA, 71 bp, chicken (Gallus Gallus)
  misc_feature (36): n=c or t
tgattaaaaagcagtaagaagcaaacaacagctctngataaaataatctgctgtgggataaaccagattcc

SEQ ID NO: 3207 - DNA, 71 bp, chicken (Gallus Gallus)
  misc_feature (36): n=a or g
gggttaacagctctactacaggcacaattcagagcntgcaagtcagtgcagcttgttttgtctagggaatc

SEQ ID NO: 3208 - DNA, 71 bp, chicken (Gallus Gallus)
  misc_feature (36): n=a or g
gcacttcagacaaagcctataagcatcatggtcacnggacttcactgactgtcagaaggtccctgtctctc

SEQ ID NO: 3209 - DNA, 71 bp, chicken (Gallus Gallus)
  misc_feature (36): n=g or t
tctttcacatttttgacacactgaattttcttcagncagaatttggaattaaatttcattgacctaatggt

SEQ ID NO: 3210 - DNA, 71 bp, chicken (Gallus Gallus)
  misc_feature (36): n=a or g
actctctctgctcttgaagaaactcaaacagttccngaggtaattatgtgttattttgttcagaagtttct

SEQ ID NO: 3211 - DNA, 71 bp, chicken (Gallus Gallus)
  misc_feature (36): n=c or t
aatcacaagcgtgacggagatgcacagggcttgtgnaccttttctcataccagagctcagggggttgatat

SEQ ID NO: 3212 - DNA, 71 bp, chicken (Gallus Gallus)
  misc_feature (36): n=c or t
gttagttcctgcagagatctgcttgttcttctacangtattaggaagctgcacagttgttaagttatatta

SEQ ID NO: 3213 - DNA, 71 bp, chicken (Gallus Gallus)
  misc_feature (36): n=c or t
atgcaagtcaaaagtcaaaatagttccagaaaggangatgctggaattttttggatgcaagcttctctgac

SEQ ID NO: 3214 - DNA, 71 bp, chicken (Gallus Gallus)
  misc_feature (36): n=c or t
tggatgatttgcaccttttcatcttctgaagtgttngtgtatacacagctgaataaaagtcacttcagaaa

SEQ ID NO: 3215 - DNA, 71 bp, chicken (Gallus Gallus)
  misc_feature (36): n=a or g
gatagaagaaaaatgaatggaaagaaacaaaaccangagctgcaatccaaaaggcaaataggttgttttag

SEQ ID NO: 3216 - DNA, 71 bp, chicken (Gallus Gallus)
  misc_feature (36): n=c or t
aacgtgagctgaggatgggcagctgagagaaatggngtcagtgagcaggaataaggatgagtttagtagca

SEQ ID NO: 3217 - DNA, 71 bp, chicken (Gallus Gallus)
  misc_feature (36): n=a or g
tattgcctttctgtcctgaaatttcttcctaagcantgttaaaaggaggaaaggcaaattaagcagaatac

SEQ ID NO: 3218 - DNA, 71 bp, chicken (Gallus Gallus)
  misc_feature (36): n=a or g
ttaaggcatcaatgtgcaaataaagccatctaatancaggtaaaatgagaaaggtgataagcgagtcatga

SEQ ID NO: 3219 - DNA, 71 bp, chicken (Gallus Gallus)
  misc_feature (36): n=c or t
gtgaggactaaaactctgccatcgagcattagattntcctttaaagctggacttaacagggagatgaagga

SEQ ID NO: 3220 - DNA, 71 bp, chicken (Gallus Gallus)
  misc_feature (36): n=c or t
ccaatttatagaagatagtcattttttgtgggtagnttatctcatgatcaagggagactttaatcttttaa

SEQ ID NO: 3221 - DNA, 71 bp, chicken (Gallus Gallus)
  misc_feature (36): n=c or t
gtgatagaacaagctgctagtaaaggaagtctgttnctgtatcacattcttgtctaggccaatcatagccc

SEQ ID NO: 3222 - DNA, 71 bp, chicken (Gallus Gallus)
  misc_feature (36): n=a or g
aaggtttagcttcatacatagaagaatcagatcccngaaaatctctaaggtatgtcatgttcaggggttat

SEQ ID NO: 3223 - DNA, 71 bp, chicken (Gallus Gallus)
  misc_feature (36): n=c or t
gtaagagggggattaggcagctagataatgggaganctgacaggggagtgattttctttagcatcgttcca

SEQ ID NO: 3224 - DNA, 71 bp, chicken (Gallus Gallus)
  misc_feature (36): n=c or t
aatagctatgaattttaggaacaggatttcacgaantggattctgtagcagaatgtatatagaacaggtct

SEQ ID NO: 3225 - DNA, 71 bp, chicken (Gallus Gallus)
  misc_feature (36): n=a or g
cctgagcgcctgtaaccaagagatgctttggcagcntttccaggctaaggctacgtgagagaaataccctt

SEQ ID NO: 3226 - DNA, 71 bp, chicken (Gallus Gallus)
  misc_feature (36): n=a or g
ggatgaaacatgacatacctgggtctgagcatggcngtgaagctctgcagaggtaggctggcttctgattc

SEQ ID NO: 3227 - DNA, 71 bp, chicken (Gallus Gallus)
  misc_feature (36): n=a or g
acattaggattctgttaggtagagatacagtacttnctgcctctaaagagagcttctcaaagccatagcag

SEQ ID NO: 3228 - DNA, 71 bp, chicken (Gallus Gallus)
  misc_feature (36): n=a or g
catgctaattcttcaacttttgtcacatagaaaaanaactgcaagctgagtgtgcacaccactgagggaga

SEQ ID NO: 3229 - DNA, 71 bp, chicken (Gallus Gallus)
  misc_feature (36): n=a or c
ctgtaagagagttcaagtatcatacctttttgcccngtattcttgtgttgctgttaccttgcttacatatg

SEQ ID NO: 3230 - DNA, 71 bp, chicken (Gallus Gallus)
  misc_feature (36): n=c or t
tcttagggtaaccctaagcctatccttagtgtagtnccagccagtggttcagcaccagtttggcctcacat

SEQ ID NO: 3231 - DNA, 71 bp, chicken (Gallus Gallus)
  misc_feature (36): n=a or g
tggcctcacatcctacttcccaaaccttttcttgcncagtactctgcagcatcccatggggtctggatact

SEQ ID NO: 3232 - DNA, 71 bp, chicken (Gallus Gallus)
  misc_feature (36): n=c or t
taaactttaagacttctcaaatctaggtaagacttnctggtcaaaaccttgaaggcagagatccctgtgtg

SEQ ID NO: 3233 - DNA, 71 bp, chicken (Gallus Gallus)
  misc_feature (36): n=g or t
tatccgcagtgtaaccgctgagctctgtgagactgngatttgtgccgttgttgtagtgaggaaacgttacc

SEQ ID NO: 3234 - DNA, 71 bp, chicken (Gallus Gallus)
  misc_feature (36): n=c or t
cagtgggcagtgccacaggacaatgggaccccatgnatggagacatcagtgcccatcactgtgtcacatca

SEQ ID NO: 3235 - DNA, 71 bp, chicken (Gallus Gallus)
  misc_feature (36): n=c or t
cggtggagaaaaagtaacatttttgctaagaaatancactagagctgctgaacgccccagaaggcacagcc

SEQ ID NO: 3236 - DNA, 71 bp, chicken (Gallus Gallus)
  misc_feature (36): n=g or t
aaggattttttttgcccaaggatgggccctgagganaccagagcagacaaagcagctggcctaagatgaca

SEQ ID NO: 3237 - DNA, 71 bp, chicken (Gallus Gallus)
  misc_feature (36): n=a or g
tgaaagctgtaaatttgcagcagttggatgtgcttnaaatgttaagtcaaccagaactgcttaaagaattg

SEQ ID NO: 3238 - DNA, 71 bp, chicken (Gallus Gallus)
  misc_feature (36): n=a or g
aaatagagcatatggacttttcttcagttcccaacnttcctgaaagtacttttgagtcattgtagcttgaa

SEQ ID NO: 3239 - DNA, 71 bp, chicken (Gallus Gallus)
  misc_feature (36): n=a or g
catgtcagggacagaggcaccaaagccttcaacacntcaggagatgtgttgtgaaaagctctcacaaggca

SEQ ID NO: 3240 - DNA, 71 bp, chicken (Gallus Gallus)
  misc_feature (36): n=c or t
tcctgcatgcttcttgctccactgttattcttcttngtggcaatgacctggatcagaaaacacgttcagct

SEQ ID NO: 3241 - DNA, 71 bp, chicken (Gallus Gallus)
  misc_feature (36): n=c or t
tgtgcagagctgtgaactcctcagtttcgggagtgncgttcagggtgggttgtcagaccctgtggtttcgg

SEQ ID NO: 3242 - DNA, 71 bp, chicken (Gallus Gallus)
  misc_feature (36): n=c or t
ttttcagtattggaaggctgaagtgaggaatctccngagtcttctcttgtttgggttgaaaaagcccagct

SEQ ID NO: 3243 - DNA, 71 bp, chicken (Gallus Gallus)
  misc_feature (36): n=a or c
aacggcattcccaatgcaaattaagaaaaggcgtgncacctgcttaccagaggtacccaaagcttctgctc

SEQ ID NO: 3244 - DNA, 71 bp, chicken (Gallus Gallus)
  misc_feature (36): n=c or t
gtgttgcaatgggacagtgttttggcctaagatttnggaatgtcgtcctttgccgttggctgctgtcacag

SEQ ID NO: 3245 - DNA, 71 bp, chicken (Gallus Gallus)
  misc_feature (36): n=a or g
cagtcagtgtagcctttgttgaagatgatcattacngattgtttcttgaagacagcaactgttgggagctg

SEQ ID NO: 3246 - DNA, 71 bp, chicken (Gallus Gallus)
  misc_feature (36): n=a or g
cacgtggcacttggcccatgagctgaatgctgcctngtgactaatacccacagctgtgtgttgtacaacat

SEQ ID NO: 3247 - DNA, 71 bp, chicken (Gallus Gallus)
  misc_feature (36): n=c or t
catctcaccttctcctgtaaaatccttccctctccntcccagaaaagggattcctaatgccccttcaccgt

SEQ ID NO: 3248 - DNA, 71 bp, chicken (Gallus Gallus)
  misc_feature (36): n=c or t
cttatcgcttttgtttacccactgcgaaactttgtnccccatcccctaagacagcaagcagcatacaaaga

SEQ ID NO: 3249 - DNA, 71 bp, chicken (Gallus Gallus)
  misc_feature (36): n=c or t
ctgagtgaccaccactgtgagctcaggaaggtaaangatccaaagaaccacagggactacacctctattgt

SEQ ID NO: 3250 - DNA, 71 bp, chicken (Gallus Gallus)
  misc_feature (36): n=g or t
tctttccaacgcatctcctggtgctgttttgttctntgtggggctcctccagcagacctgctcctttctgc

SEQ ID NO: 3251 - DNA, 71 bp, chicken (Gallus Gallus)
  misc_feature (36): n=c or t
cctacagggtccacacaagacagcaccatccatctnttcatggtccaagccaggagctacatcttgaacag

SEQ ID NO: 3252 - DNA, 71 bp, chicken (Gallus Gallus)
  misc_feature (36): n=a or g
gcttagggttggtggagaacactggatggtagcccnaagcttcctctaggttatcctatgtcttcaggatg

SEQ ID NO: 3253 - DNA, 71 bp, chicken (Gallus Gallus)
  misc_feature (36): n=a or g
acattaaagccttcagagcacagaaaactggaagtnagacagcaaaatcagaaccgtagggacagaggaga

SEQ ID NO: 3254 - DNA, 71 bp, chicken (Gallus Gallus)
  misc_feature (36): n=g or t
gggcaggcttctttctttccccccttctcatgtccnttgaatcagaagtcagacactacctcatagtctgt

SEQ ID NO: 3255 - DNA, 71 bp, chicken (Gallus Gallus)
  misc_feature (36): n=c or t
tccagtcactgacacatatgattacatcaaagttgnttgctcatgtgtgcgatgcgccagtgaggcatgaa

SEQ ID NO: 3256 - DNA, 71 bp, chicken (Gallus Gallus)
  misc_feature (36): n=a or g
tccaaagacaaaaaggctgaactggaaattctgtanaggagaaacacgagacactttattcgaacaacgtg

SEQ ID NO: 3257 - DNA, 71 bp, chicken (Gallus Gallus)
  misc_feature (36): n=g or t
cctccttggtgagggcagctatgacttgtgaatgtnttgaagtctgacaggtttaatgccatatttgcaca

SEQ ID NO: 3258 - DNA, 71 bp, chicken (Gallus Gallus)
  misc_feature (36): n=a or g
caagtgtaggaatgaaaaatgtttttccaagtgccngtaataaaacagagctctctgaaaatcaatctctg

SEQ ID NO: 3259 - DNA, 71 bp, chicken (Gallus Gallus)
  misc_feature (36): n=a or g
tgtgtttgataacattttaatattcacacagtgccngtaagaataagtgggattgttctgtagctcctttg

SEQ ID NO: 3260 - DNA, 71 bp, chicken (Gallus Gallus)
  misc_feature (36): n=a or g
gatacttctggcaaccttcatacctggtttcctccntggcccctcctccaccttgtaaaactcaagctgaa

SEQ ID NO: 3261 - DNA, 71 bp, chicken (Gallus Gallus)
  misc_feature (36): n=c or t
aacttcaccaaatttaggtgattgagtgattactgntactgcttacagcttaagatttggtgcctggcttt

SEQ ID NO: 3262 - DNA, 71 bp, chicken (Gallus Gallus)
  misc_feature (36): n=a or g
agacttcaggaaagattgatgcactaagataaatgnaagtggagcttgtaggcctggattgaaaagggcag

SEQ ID NO: 3263 - DNA, 71 bp, chicken (Gallus Gallus)
  misc_feature (36): n=c or t
ctcatctttgaatgctcatccatgtacttcaatttngaaactgtagtggcttttctttctttaaaatcaca

SEQ ID NO: 3264 - DNA, 71 bp, chicken (Gallus Gallus)
  misc_feature (36): n=a or g
agaaaagtaatccagcactgttttccccatctttgnctgcttacgtggtttctccaattgatttaacacta

SEQ ID NO: 3265 - DNA, 71 bp, chicken (Gallus Gallus)
  misc_feature (36): n=c or t
gctgctcaggctgtgagctgtacctgtacggttcanactcacagttttaaaatgcctctttttatcgcttt

SEQ ID NO: 3266 - DNA, 71 bp, chicken (Gallus Gallus)
  misc_feature (36): n=c or t
ctgaagtaggatagcacctctcccttaaataatagngtgagattcttccagagcacttctagcttactaac

SEQ ID NO: 3267 - DNA, 71 bp, chicken (Gallus Gallus)
  misc_feature (36): n=c or t
tccttctctgtcttcctagaagttgagtaacatttngccttttgtcagtttgttaacctcaaagtgccttt

SEQ ID NO: 3268 - DNA, 71 bp, chicken (Gallus Gallus)
  misc_feature (36): n=c or t
gggagaatttttagcagtgattatagcagtattcanaggtaagtgaatgtgaagctgtctaactgcaaaaa

SEQ ID NO: 3269 - DNA, 71 bp, chicken (Gallus Gallus)
  misc_feature (36): n=a or g
attaaagttcagaagtactattctgacaccaaagcntcatgcagacctattttcacctgcgtattccttca

SEQ ID NO: 3270 - DNA, 71 bp, chicken (Gallus Gallus)
  misc_feature (36): n=c or t
gtgtctataaaacataattattacgtcagatgagantgactgatgagatggaggatttcacaggcatgttt

SEQ ID NO: 3271 - DNA, 71 bp, chicken (Gallus Gallus)
  misc_feature (36): n=c or t
gactgaaaggactgagcttgttgacaagatcatacnaatcattttgcaatgctgaaaaatgctgattttgc

SEQ ID NO: 3272 - DNA, 71 bp, chicken (Gallus Gallus)
  misc_feature (36): n=c or t
agcccaggattagtatttctcagtaacatgaaggcngtgctgaggttcagaatatctaatttatctgtaat

SEQ ID NO: 3273 - DNA, 71 bp, chicken (Gallus Gallus)
  misc_feature (36): n=g or t
atttagaattagttttgggcaatgggagttgagtcntcatgatgacttgtgttctgttataggccaaaaaa

SEQ ID NO: 3274 - DNA, 71 bp, chicken (Gallus Gallus)
  misc_feature (36): n=a or g
aatcacagcttacaaagaatggttccatgctgccanaactcactggttcctggtggttcccaggctgtgtg

SEQ ID NO: 3275 - DNA, 71 bp, chicken (Gallus Gallus)
  misc_feature (36): n=c or t
ttgccactgatgcagctgtatatttgaaccaatccnatgaacaaagaacccagtcctgaaaactttgtttt

SEQ ID NO: 3276 - DNA, 71 bp, chicken (Gallus Gallus)
  misc_feature (36): n=a or t
caaaccttatgcacaacactcttgtaacagaagttnggagtgtaaggaaagaatgagagcctaaggtacat

SEQ ID NO: 3277 - DNA, 71 bp, chicken (Gallus Gallus)
  misc_feature (36): n=c or t
tggtgctctccagtgcagaaaatcaaaggaggttgnacatgcacgctggaaagcagaacctaagctctgat

SEQ ID NO: 3278 - DNA, 71 bp, chicken (Gallus Gallus)
  misc_feature (36): n=c or t
attttgtcggtgtggccctgtctcatactactgatnaaactcagtaggcatttaacactgagctaaccagg

SEQ ID NO: 3279 - DNA, 71 bp, chicken (Gallus Gallus)
  misc_feature (36): n=c or t
agttccaggactagaacataaatgtaaggaaaaagntttttttgttgtctttaaaacaaagctagaaacaa

SEQ ID NO: 3280 - DNA, 71 bp, chicken (Gallus Gallus)
  misc_feature (36): n=c or t
atcctgcattttctttctgtctccctccttctccanacatgttctacctgcagatccagaggaattcccag

SEQ ID NO: 3281 - DNA, 71 bp, chicken (Gallus Gallus)
  misc_feature (36): n=c or t
tatctagaggttaccatattaatggctgtggagagnagctatatgcagagtccctcagcctgttcttctct

SEQ ID NO: 3282 - DNA, 71 bp, chicken (Gallus Gallus)
  misc_feature (36): n=a or g
accagctttcttctacactttaagtccttcttagtncacatttgctctgtgactccactgccatgacctaa

SEQ ID NO: 3283 - DNA, 71 bp, chicken (Gallus Gallus)
  misc_feature (36): n=a or g
taacaccgtccttctcagagtatgctaataaaactnctacaccatgattgcatagaggacatacttgttgc

SEQ ID NO: 3284 - DNA, 71 bp, chicken (Gallus Gallus)
  misc_feature (36): n=a or g
aaatgattttatacatccctcatttaatttcttccnaagatggagactcgagaaagctgataataataata

SEQ ID NO: 3285 - DNA, 71 bp, chicken (Gallus Gallus)
  misc_feature (36): n=c or t
cttggttgggtgggttcacaatgttggtcactctcngggatttcagcaagctgatctacagacaagataag

SEQ ID NO: 3286 - DNA, 71 bp, chicken (Gallus Gallus)
  misc_feature (36): n=a or g
gtttctgtacattaagctctgtaaggtgtccagctnctagttttacaacctcttcgttactgagcatctcc

SEQ ID NO: 3287 - DNA, 71 bp, chicken (Gallus Gallus)
  misc_feature (36): n=c or t
ttgttcataaatgctgatttagtgtcagaaaatgtngatgtagatttgtagatttaggatcaagttacatt

SEQ ID NO: 3288 - DNA, 71 bp, chicken (Gallus Gallus)
  misc_feature (36): n=c or t
gacaacaatagctgaccacccaaggcagttgaactntacatgtgattgagaccaaacagtcagaattctca

SEQ ID NO: 3289 - DNA, 71 bp, chicken (Gallus Gallus)
  misc_feature (36): n=a or g
tgtattgtacattactatgaaatattattattactnataaagccctggaaatcatgtaaagcacgatatct

SEQ ID NO: 3290 - DNA, 71 bp, chicken (Gallus Gallus)
  misc_feature (36): n=a or g
acaaatgctgaactgtttctttcagaaggctaagtntgacttatcactacatcatataaaaagcatgttat

SEQ ID NO: 3291 - DNA, 71 bp, chicken (Gallus Gallus)
  misc_feature (36): n=c or t
aactgggacattctaccatttttaaatcacattaangatggtactgtcctacatagaaaatgctcataaat

SEQ ID NO: 3292 - DNA, 71 bp, chicken (Gallus Gallus)
  misc_feature (36): n=c or t
ctatgcaagacagtggaatatgaacagggcaggtgngggggtttccattattcaccagaataactagcaga

SEQ ID NO: 3293 - DNA, 71 bp, chicken (Gallus Gallus)
  misc_feature (36): n=a or g
gtatcaaattcagtgttttacagtatcttgccgcanaataaagtgacttacgctgaaagatgaaacaaaac

SEQ ID NO: 3294 - DNA, 71 bp, chicken (Gallus Gallus)
  misc_feature (36): n=c or t
atcatatcagttctgaatttttttttcctaatgttnccttacataaaagtatccctttgtaccctaatgct

SEQ ID NO: 3295 - DNA, 71 bp, chicken (Gallus Gallus)
  misc_feature (36): n=c or t
attcatctgcccacaaagtgtaaaaataaatatttnctattaaaaacaaatcccctttttgtaccatcact

SEQ ID NO: 3296 - DNA, 71 bp, chicken (Gallus Gallus)
  misc_feature (36): n=c or t
ttcagagggtttagtataaagttaatcactagaganagaactggactcttgtagtactagaaagtatagct

SEQ ID NO: 3297 - DNA, 71 bp, chicken (Gallus Gallus)
  misc_feature (36): n=g or t
tttctccctttttcccaaagcaaaaaagtaagatantgctctcactccaacagccaagccttatgggatct

SEQ ID NO: 3298 - DNA, 71 bp, chicken (Gallus Gallus)
  misc_feature (36): n=a or g
cctgaatgttaggtggcttgctttgcacgaagtcancaaaggtcttagcatttctcatcatgtttaaatat

SEQ ID NO: 3299 - DNA, 71 bp, chicken (Gallus Gallus)
  misc_feature (36): n=a or c
ctgcaactactttgatagaatctattagcaatgganaagcaaaatttaatactaacagcttagttcagcat

SEQ ID NO: 3300 - DNA, 71 bp, chicken (Gallus Gallus)
  misc_feature (36): n=g or t
ttttctaaaacatcatcgttacttagaggtgggagngtactctttattggagcttttgctttcagttgttc

SEQ ID NO: 3301 - DNA, 71 bp, chicken (Gallus Gallus)
  misc_feature (36): n=c or t
accatctattagaagcatttagtctgtccataaaanctgaatttctggggctgtccagtgacctggcaata

SEQ ID NO: 3302 - DNA, 71 bp, chicken (Gallus Gallus)
  misc_feature (36): n=a or c
aaattattttgtactcagtacaaaatagtagatggntataagtttgtgtaaacatatggcttgggctctgg

SEQ ID NO: 3303 - DNA, 71 bp, chicken (Gallus Gallus)
  misc_feature (36): n=g or t
agaaattgctgcgtgaaggattatagttaaacttangggaaataagagagcagaatgaaggagataagtgt

SEQ ID NO: 3304 - DNA, 71 bp, chicken (Gallus Gallus)
  misc_feature (36): n=c or t
aatagcgaaattgtgataaaggaaggtgaagatganggaataacacaaaattatgaatgatatgcatgtgg

SEQ ID NO: 3305 - DNA, 71 bp, chicken (Gallus Gallus)
  misc_feature (36): n=a or g
catggcagttgcagccttcagtcagctgtgtgtgtntttcacttggaactcatacgccgttacaggctagc

SEQ ID NO: 3306 - DNA, 71 bp, chicken (Gallus Gallus)
  misc_feature (36): n=c or t
tggaaagttttgaaatatatttgtgtacttcattanaaaaggaaggaaaggtacagcttcttgtagcgatt

SEQ ID NO: 3307 - DNA, 71 bp, chicken (Gallus Gallus)
  misc_feature (36): n=c or t
gtcttcctctgtgttcttacatttggtgaacagtantggagcttaccagccagtaaatctaattcatttgg

SEQ ID NO: 3308 - DNA, 71 bp, chicken (Gallus Gallus)
  misc_feature (36): n=c or t
taatttatcatatattttgcaagcatgctctgtaanggttgcaattagttcaagctgagcagaaaagtaaa

SEQ ID NO: 3309 - DNA, 71 bp, chicken (Gallus Gallus)
  misc_feature (36): n=c or t
tttagccctcagggaacatgtgagaatctgtctgtntctcttttgtaaacctaaaatacctgttgtgctaa

SEQ ID NO: 3310 - DNA, 71 bp, chicken (Gallus Gallus)
  misc_feature (36): n=a or g
agagagatcagtatagctttacagttgatatcttgnaaatgaatgttgttcatgcacgatgacattcaaaa

SEQ ID NO: 3311 - DNA, 71 bp, chicken (Gallus Gallus)
  misc_feature (36): n=a or g
tgtaaatgatgtgaagttgtgtatttgtgggtgggncgtttcagagaatgatggtgggatgtgtttactcc

SEQ ID NO: 3312 - DNA, 71 bp, chicken (Gallus Gallus)
  misc_feature (36): n=a or g
gtatgagcttaacagctgatgcgtcttcggtctganaaatctatcatgcagggtgaactgatgcagattag

SEQ ID NO: 3313 - DNA, 71 bp, chicken (Gallus Gallus)
  misc_feature (36): n=c or t
gggcagctgtagagtgagagtagtagagtgtagcanagagttcagatatgaactacttagagtgaaatcca

SEQ ID NO: 3314 - DNA, 71 bp, chicken (Gallus Gallus)
  misc_feature (36): n=a or g
cagaaacggagtttggagctctgccaggaatggtcncatataccacatgttatttatgaccgtataaagtg

SEQ ID NO: 3315 - DNA, 71 bp, chicken (Gallus Gallus)
  misc_feature (36): n=a or g
agcagtaagtgctaacaccaatccaggagcacatgngaaagctctgttgcatgcatgacagagtgcaaagc

SEQ ID NO: 3316 - DNA, 71 bp, chicken (Gallus Gallus)
  misc_feature (36): n=a or c
cccaaatctatgttttcatacgttggtagagtcatnttatttcacatacattaaaaaccacgtgtaagaag

SEQ ID NO: 3317 - DNA, 71 bp, chicken (Gallus Gallus)
  misc_feature (36): n=c or t
atctgaaaaatgtaagaaggttaaccctgagttacnaattatttaacaagagaagtagtaaaaggcttaat

SEQ ID NO: 3318 - DNA, 71 bp, chicken (Gallus Gallus)
  misc_feature (36): n=a or g
gctgctcgctgcagactgtgcgtgtgcattgaaaancaaggtattttgagaatgctggccacagaagcatg

SEQ ID NO: 3319 - DNA, 71 bp, chicken (Gallus Gallus)
  misc_feature (36): n=a or c
ctctgctctggatttaacaatgggtatttttccccnacctccacaactttagtaagcctaaatcacagccc

SEQ ID NO: 3320 - DNA, 71 bp, chicken (Gallus Gallus)
  misc_feature (36): n=a or g
aaggtgaggtactcaattacaaccagattaataaangctttggctatagctcccattgcaatcaaagcctt

SEQ ID NO: 3321 - DNA, 71 bp, chicken (Gallus Gallus)
  misc_feature (36): n=a or g
gagacactgctcccagatactgtaacaacagggagntctttgagcagctctggcagaggtacaataaaacc

SEQ ID NO: 3322 - DNA, 71 bp, chicken (Gallus Gallus)
  misc_feature (36): n=c or t
gagctgctgagctatctcatacctcaagcagagagngagaagcagagtctgagagctcagcacacctctaa

SEQ ID NO: 3323 - DNA, 71 bp, chicken (Gallus Gallus)
  misc_feature (36): n=c or t
tcttttattcagctagttgtagtcagtgtaaagganattttcaagatgagatgaaggaactgtatagaagt

SEQ ID NO: 3324 - DNA, 71 bp, chicken (Gallus Gallus)
  misc_feature (36): n=c or t
gaaactcaattcccacctgcatgagattgagctctntgtgggccccaaggtgtaggatggtggtttgaggt

SEQ ID NO: 3325 - DNA, 71 bp, chicken (Gallus Gallus)
  misc_feature (36): n=c or t
cccttgaagggaagagccccttcaaaccttcagtgntatcaagaacaggagagcacgtgctcagctgtgtt

SEQ ID NO: 3326 - DNA, 71 bp, chicken (Gallus Gallus)
  misc_feature (36): n=c or t
ctaatgtctggctttgtagggataccggataccacnggtacggggacgctgctgctgctcctccaggatgt

SEQ ID NO: 3327 - DNA, 71 bp, chicken (Gallus Gallus)
  misc_feature (36): n=c or t
cccaccatgtgtgctgaccgtgcccctcagtgccangtctccaaattcttgatgatcacctcttggtgacc

SEQ ID NO: 3328 - DNA, 71 bp, chicken (Gallus Gallus)
  misc_feature (36): n=a or g
ttttttccaacagagatgcaaacaagccttgagagnggcagacaagatttacccaggaagcaataggagcc

SEQ ID NO: 3329 - DNA, 71 bp, chicken (Gallus Gallus)
  misc_feature (36): n=a or g
aaagttctggttttagtcctcgttagcttttgatancaacaatggatgctgcatttttaaaacatgatctt

SEQ ID NO: 3330 - DNA, 71 bp, chicken (Gallus Gallus)
  misc_feature (36): n=a or g
agaacacagcactagcctgctatgaacatcagaaancagctcagttcagctcgagtacgttaaataaatat

SEQ ID NO: 3331 - DNA, 71 bp, chicken (Gallus Gallus)
  misc_feature (36): n=c or t
tgtgtcagtcatcttggcagcacatgcagatgtcanttaggtcttcacagaaaagatgcacaattccctag

SEQ ID NO: 3332 - DNA, 71 bp, chicken (Gallus Gallus)
  misc_feature (36): n=c or t
ttgatacgtaaagattaaaaggatgagatgcacttnctataactgcaatagctctaactgttcagttaaca

SEQ ID NO: 3333 - DNA, 71 bp, chicken (Gallus Gallus)
  misc_feature (36): n=a or g
agctttagagcacacagtcctgtacttaaacttacnttgcaacacactattaagattttagagaatgctgc

SEQ ID NO: 3334 - DNA, 71 bp, chicken (Gallus Gallus)
  misc_feature (36): n=c or t
gcagacaggaaaacaatgtcatcagacattgtcatnaaagcttgcttgcatcaagtgctggcatgctattg

SEQ ID NO: 3335 - DNA, 71 bp, chicken (Gallus Gallus)
  misc_feature (36): n=c or t
gcaggaaaaactacgcatccaaagaaaggatgaganactgtaacatgccattatctgagctgtgggcacgg

SEQ ID NO: 3336 - DNA, 71 bp, chicken (Gallus Gallus)
  misc_feature (36): n=a or g
ttcttcctatatgactgaacatggaaaaaaatggtnactcaggatgtgccagtgcttgttttcacaacact

SEQ ID NO: 3337 - DNA, 71 bp, chicken (Gallus Gallus)
  misc_feature (36): n=a or g
ggcctgtactgtaacaaaatgagaatttctctagcnctgtgaagtaactcaaagctctgaagaatctcaag

SEQ ID NO: 3338 - DNA, 71 bp, chicken (Gallus Gallus)
  misc_feature (36): n=a or g
ggatattgagtccctggttttacaatactactgcanaatgtataaattcagcaactgaggattactcgcca

SEQ ID NO: 3339 - DNA, 71 bp, chicken (Gallus Gallus)
  misc_feature (36): n=c or t
gggaagaacagtagttgcagtagagcaacatgatanagaaaccgatactgccaacacagcatctttcctta

SEQ ID NO: 3340 - DNA, 71 bp, chicken (Gallus Gallus)
  misc_feature (36): n=c or t
attaatatagcagcaagcatgttgttggtcatcgtngtcctttagtgcctaggaacaaaattgccctctgc

SEQ ID NO: 3341 - DNA, 71 bp, chicken (Gallus Gallus)
  misc_feature (36): n=c or t
ggaaacaactgatagaagaactttcagaaacagtcngacatgacttctcagcagtgagttcacaacggatg

SEQ ID NO: 3342 - DNA, 71 bp, chicken (Gallus Gallus)
  misc_feature (36): n=a or g
acgtattgttgtgtggcactcaccttgaaggacacnaatcccaagtaattccacactccaggaagctatct

SEQ ID NO: 3343 - DNA, 71 bp, chicken (Gallus Gallus)
  misc_feature (36): n=c or t
ctgtgattctctggacttccatggcaagtcagctcngaggcagccctgagcagcatttgcttcctgagcag

SEQ ID NO: 3344 - DNA, 71 bp, chicken (Gallus Gallus)
  misc_feature (36): n=a or g
caaccagggggcaacaaaatactcagccattagacnaaaggcttattatcccggtgtcctcactccagaag

SEQ ID NO: 3345 - DNA, 71 bp, chicken (Gallus Gallus)
  misc_feature (36): n=a or g
ccgatgtgtctgataataacagggattgctccttanatcagatgtttcatagctgaatagtaaaatatttt

SEQ ID NO: 3346 - DNA, 71 bp, chicken (Gallus Gallus)
  misc_feature (36): n=a or g
aagcttgatacagtgaaacaaagaaatgaataacanctgcatgggaaaaaagggggcttttgaagttttct

SEQ ID NO: 3347 - DNA, 71 bp, chicken (Gallus Gallus)
  misc_feature (36): n=a or g
tccctgtgtgaatgcctccttgactttagtgggggnagctttttcaacctgttgttgttctatgcgacttc

SEQ ID NO: 3348 - DNA, 71 bp, chicken (Gallus Gallus)
  misc_feature (36): n=g or t
aactgaagacagcatgtacaaatacagaaaataggntatgatgttttgagcacaaggcatcagatcattta

SEQ ID NO: 3349 - DNA, 71 bp, chicken (Gallus Gallus)
  misc_feature (36): n=a or g
atgtcaattttataaaactattctctcattaaaatnagtgaagaaagtaattgggaagcactgtctggcaa

SEQ ID NO: 3350 - DNA, 71 bp, chicken (Gallus Gallus)
  misc_feature (36): n=a or g
aacctaaattatcagtgattatggatgcatcaaacntgttacatgagtgctgtggctgtccctacaaagat

SEQ ID NO: 3351 - DNA, 71 bp, chicken (Gallus Gallus)
  misc_feature (36): n=c or t
tcgtatcagctcaaatctgatttctgtgcactgttnaagaagaaaccaggaggctgctttcccccttttgg

SEQ ID NO: 3352 - DNA, 71 bp, chicken (Gallus Gallus)
  misc_feature (36): n=a or g
ataagcagcattggcacagatgtgttacagtgaccnatgtgcacttccaggtacaaaagcagctgcaaggt

SEQ ID NO: 3353 - DNA, 71 bp, chicken (Gallus Gallus)
  misc_feature (36): n=c or t
gtttgattgatttgtagacagaaggctgtagaaggntccagttgagggctgcttctttacttatggtgatt

SEQ ID NO: 3354 - DNA, 71 bp, chicken (Gallus Gallus)
  misc_feature (36): n=a or g
aagttatatcattggcacttcatttgcctaagcaangctgctttcatgatgttgtgtttgtataaaagctt

SEQ ID NO: 3355 - DNA, 71 bp, chicken (Gallus Gallus)
  misc_feature (36): n=a or g
tcctgtttgcgtgtttaacagtgataacaagttganctggtacaagcagtgttgatgcttagtaaattaga

SEQ ID NO: 3356 - DNA, 71 bp, chicken (Gallus Gallus)
  misc_feature (36): n=c or t
acacttgtaaagaagttactacttttttagcctccntagtgctgctatacagtgatgctattgcaaataaa

SEQ ID NO: 3357 - DNA, 71 bp, chicken (Gallus Gallus)
  misc_feature (36): n=c or t
tgggagttctgtgggctggttcataataaataatangtgtgttttagagcacaaagacaaatgagaattgt

SEQ ID NO: 3358 - DNA, 71 bp, chicken (Gallus Gallus)
  misc_feature (36): n=a or g
ctattgcagtagagaaaaagctcaaggcaaatcatntgcagagaaagtcattgagtatacctgcatgtacc

SEQ ID NO: 3359 - DNA, 71 bp, chicken (Gallus Gallus)
  misc_feature (36): n=a or g
ctgttcatctcagtttcgtacactgaagagctgctnatgaaactgaaaaccttggttacctctcagtcaga

SEQ ID NO: 3360 - DNA, 71 bp, chicken (Gallus Gallus)
  misc_feature (36): n=a or c
cgaggtagttctgaccttacatctagctggtaagcnccagatgtttggacattggcattgccagatcattc

SEQ ID NO: 3361 - DNA, 71 bp, chicken (Gallus Gallus)
  misc_feature (36): n=c or t
tccttcatgcttctgtatgtcagttcatgttcctcngtctttaaaactgacatggaaatggagtgcatgaa

SEQ ID NO: 3362 - DNA, 71 bp, chicken (Gallus Gallus)
  misc_feature (36): n=c or t
taaggggtaaggtggtactgatttggcattctcagngtaggcagaactacccttaaagcaagccatgatga

SEQ ID NO: 3363 - DNA, 71 bp, chicken (Gallus Gallus)
  misc_feature (36): n=a or c
gttggaaaaaatataggaacacataactatactgcntttcagaaaggagactttcaacttctgcttaggtt

SEQ ID NO: 3364 - DNA, 71 bp, chicken (Gallus Gallus)
  misc_feature (36): n=c or t
tgggacgcaggggtggcatgcacaggaggacagccnagctcttggcctcctcacacctcttacttgtattc

SEQ ID NO: 3365 - DNA, 71 bp, chicken (Gallus Gallus)
  misc_feature (36): n=c or t
tgtatgagacacagcctgtgctgtttgcagctgctncaccggatgcttcttgcagtggaatcagcactgag

SEQ ID NO: 3366 - DNA, 71 bp, chicken (Gallus Gallus)
  misc_feature (36): n=c or t
gtctaattttcagtcttctggcctgattcttactcnagcctcaggaatgttgttctgcaatggaattacac

SEQ ID NO: 3367 - DNA, 71 bp, chicken (Gallus Gallus)
  misc_feature (36): n=g or t
caagtttctttgtccttctctgaagctatgcaacanttactgctgggagaagttcatccattgcttccttt

SEQ ID NO: 3368 - DNA, 71 bp, chicken (Gallus Gallus)
  misc_feature (36): n=a or g
caaatggtaggcaaagacagtagtagagtaagcagncacagtaactgggatcctcattcctcagccatggg

SEQ ID NO: 3369 - DNA, 71 bp, chicken (Gallus Gallus)
  misc_feature (36): n=c or t
aaatagcccaaatcccagagcaatgcaccacagctnctttactgcactgtatttggtaactgggacctgtg

SEQ ID NO: 3370 - DNA, 71 bp, chicken (Gallus Gallus)
  misc_feature (36): n=g or t
gataaaattgcatgctttcacaaatcagtctggagnctgctatgcttcaagcacagcctgttttaagtcaa

SEQ ID NO: 3371 - DNA, 71 bp, chicken (Gallus Gallus)
  misc_feature (36): n=c or t
ctgccttcagattttaaaggaccaagagaaagcacngtctgacttttaggggtatgtttggcgtatctcaa

SEQ ID NO: 3372 - DNA, 71 bp, chicken (Gallus Gallus)
  misc_feature (36): n=c or t
agagtagctttccctaacagctgcaaaatgtacttnactgtgcggccactgaaaaatagtttgaatgtact

SEQ ID NO: 3373 - DNA, 71 bp, chicken (Gallus Gallus)
  misc_feature (36): n=a or g
ggtgaagtacatggtttaattcagcctgagctgcantttgtgttcaaatgttgtagactgctgcgtataaa

SEQ ID NO: 3374 - DNA, 71 bp, chicken (Gallus Gallus)
  misc_feature (36): n=c or t
gtcaactaagaaacatacagcacgtaatttgctgcngagagttgcaagctgtgtcatcagcacataaataa

SEQ ID NO: 3375 - DNA, 71 bp, chicken (Gallus Gallus)
  misc_feature (36): n=a or g
acacagccagagactcctaaggattgaagaaaattntctgggctaactgcactcatttgagaagttttaac

SEQ ID NO: 3376 - DNA, 71 bp, chicken (Gallus Gallus)
  misc_feature (36): n=c or t
cacacgaggcagttcttctctacaacagaaaaacanttaccaagcattttaatatatttaccccattaaaa

SEQ ID NO: 3377 - DNA, 71 bp, chicken (Gallus Gallus)
  misc_feature (36): n=c or t
tggccagaacaaatagctaaatgtttctgaatcagnagccgaaccactccaaactctcacatgatgtttat

SEQ ID NO: 3378 - DNA, 71 bp, chicken (Gallus Gallus)
  misc_feature (36): n=a or g
aaaaaaaaacaagattctatattatttcttgaaagncatccagcatgaaatacaacatttatttgctagca

SEQ ID NO: 3379 - DNA, 71 bp, chicken (Gallus Gallus)
  misc_feature (36): n=c or t
gcagatagagtttacaacttgctagaaagctaatgnaagtacgctaccatcaagatccactgtgatgtaca

SEQ ID NO: 3380 - DNA, 71 bp, chicken (Gallus Gallus)
  misc_feature (36): n=c or t
cagcacatatccaacacaagacttctgctgcactgntgtatgagaagaaccttgtcatgtacaaaacccac

SEQ ID NO: 3381 - DNA, 71 bp, chicken (Gallus Gallus)
  misc_feature (36): n=c or t
gtaacttcagtgttcttcacacactgtctttcctgnctgcactgctcagctaacgtgctgggcaggaaaga

SEQ ID NO: 3382 - DNA, 71 bp, chicken (Gallus Gallus)
  misc_feature (36): n=c or t
gtgcatcttcccttcctggtcttcctctggcacttnttttttgcatctacagtatgtatctgtatgtgaag

SEQ ID NO: 3383 - DNA, 71 bp, chicken (Gallus Gallus)
  misc_feature (36): n=c or t
ctgacatgagctgtcacttaaatgttatactgtcanggtctcgtgtgaaagaacatttttccatataaact

SEQ ID NO: 3384 - DNA, 71 bp, chicken (Gallus Gallus)
  misc_feature (36): n=c or t
acagtgacctcttgtaagcgaaggctgttatcccgncctgccgctcagctgcacagcgtgattaagactgt

SEQ ID NO: 3385 - DNA, 71 bp, chicken (Gallus Gallus)
  misc_feature (36): n=a or g
cctctgattccattacagctcacaacccaaaatctncatccctggtgaggaccagactaatcctagaggca

SEQ ID NO: 3386 - DNA, 71 bp, chicken (Gallus Gallus)
  misc_feature (36): n=a or g
atggaacaacgatgccaagctagtgttctagaccgnagatgacagaaagggtgggggtacatattaagaaa

SEQ ID NO: 3387 - DNA, 71 bp, chicken (Gallus Gallus)
  misc_feature (36): n=c or t
tgagagcttacagagataccactctgtgcatctagnctgtcattctgtaggaatttagaaaaaaaaaacag

SEQ ID NO: 3388 - DNA, 71 bp, chicken (Gallus Gallus)
  misc_feature (36): n=c or t
gattcacattaaaaaagagctgcctgctcttccctntcctctcctctactctccatctttattactttgtc

SEQ ID NO: 3389 - DNA, 71 bp, chicken (Gallus Gallus)
  misc_feature (36): n=c or t
gcttaatggatgtttggaaatgtgttagctggaggngaggaggagccaaccggacagtgcctgcacagagc

SEQ ID NO: 3390 - DNA, 71 bp, chicken (Gallus Gallus)
  misc_feature (36): n=a or g
acctacagctcaaacatttgatatactgtatctggnttcagtaatgcttagaagtgtttttctcttttcct

SEQ ID NO: 3391 - DNA, 71 bp, chicken (Gallus Gallus)
  misc_feature (36): n=a or g
ctcttccatttaaagtaatttgcaaaagattttcanaattataaaccaatttgcaaataaacgatcatgat

SEQ ID NO: 3392 - DNA, 71 bp, chicken (Gallus Gallus)
  misc_feature (36): n=a or g
gacagtgctgctttatccccacatttacagaggganaagtgagacccagtcgtgcaacacatcagaggctt

SEQ ID NO: 3393 - DNA, 71 bp, chicken (Gallus Gallus)
  misc_feature (36): n=a or g
ttttgctgttcaaacgaagagggcaactttatatcngtctgtataatccagaatgtcttacatatatacat

SEQ ID NO: 3394 - DNA, 71 bp, chicken (Gallus Gallus)
  misc_feature (36): n=a or g
taaaacagcatggcagatagaaaaagcttgaagatnctttgaacatgaccatgtttattcttctgatctct

SEQ ID NO: 3395 - DNA, 71 bp, chicken (Gallus Gallus)
  misc_feature (36): n=c or t
aaatacccagatctttaccctcaagaggatgaaaangaagagaaggagaagtcaagcaaagatttggaagc

SEQ ID NO: 3396 - DNA, 71 bp, chicken (Gallus Gallus)
  misc_feature (36): n=c or t
cttgatttaagttggtcagggctaaatacagctgtngtgtgtgatccatatgcgtggcatctctgcaggga

SEQ ID NO: 3397 - DNA, 71 bp, chicken (Gallus Gallus)
  misc_feature (36): n=a or g
tgtgagatggaccttacaactgttcttaagaagaanttacctatctgtattctcacacataccagagaaaa

SEQ ID NO: 3398 - DNA, 71 bp, chicken (Gallus Gallus)
  misc_feature (36): n=a or g
gacagaagttgtagctttctctgcgcagtggtagtntgctttccctgtttccttcatatactcttattcat

SEQ ID NO: 3399 - DNA, 71 bp, chicken (Gallus Gallus)
  misc_feature (36): n=g or t
tgctgtgttaatccaaatgtcaggtaagagaaatancagagcgcaggcttccatcagtacgcagacctacc

SEQ ID NO: 3400 - DNA, 71 bp, chicken (Gallus Gallus)
  misc_feature (36): n=c or t
ctccccagctttgtgtgtacacatacacatgtacgntgcattataataatgccacccttggaaataaatct

SEQ ID NO: 3401 - DNA, 71 bp, chicken (Gallus Gallus)
  misc_feature (36): n=a or g
actggagttctgagcactcattttcttcacacaaancactattggcaaaaagttgcagtgattgctaagtg

SEQ ID NO: 3402 - DNA, 71 bp, chicken (Gallus Gallus)
  misc_feature (36): n=a or g
tcattttgaggatataattaactgcatgttgtaacngaatgtgtttgtctggttttgtgtgctgcgagatt

SEQ ID NO: 3403 - DNA, 71 bp, chicken (Gallus Gallus)
  misc_feature (36): n=c or t
cagtgaagggcccagggagatgggaggcagtagaantaggacagctggcttcaaccagccacagaaatatt

SEQ ID NO: 3404 - DNA, 71 bp, chicken (Gallus Gallus)
  misc_feature (36): n=a or g
gaaaagatgataacaaagctctctaatgcaacttcngagttctgtcctgcagtggcaaatgcaggtaccta

SEQ ID NO: 3405 - DNA, 71 bp, chicken (Gallus Gallus)
  misc_feature (36): n=c or t
gcttattactgatgcaaagcattcggggacttttgnccagcaaagaatctgatagctgaaatgtgcccagt

SEQ ID NO: 3406 - DNA, 71 bp, chicken (Gallus Gallus)
  misc_feature (36): n=a or g
gtacctggatttgaagaagcttacttatgtcatagncagtatacatctctcatgggggttcaatttggtcc

SEQ ID NO: 3407 - DNA, 71 bp, chicken (Gallus Gallus)
  misc_feature (36): n=c or t
agggaccttcaatagctagctgatggtctgtctcangcgtgtgaaaagttagtgctctgtgatcatcaggc

SEQ ID NO: 3408 - DNA, 71 bp, chicken (Gallus Gallus)
  misc_feature (36): n=c or t
tgaaatcatagcaggtgaacacttagatgccatgtntaatgttctcagtacagctgagaactagttatgtt

SEQ ID NO: 3409 - DNA, 71 bp, chicken (Gallus Gallus)
  misc_feature (36): n=c or t
acagaacagcagcaatctcatggaagggatgggaantataaaaactgattaagtagctagtccctaccttg

SEQ ID NO: 3410 - DNA, 71 bp, chicken (Gallus Gallus)
  misc_feature (36): n=a or g
gaacatgttcggatgcagactctgtgcttttggccntgctctctggattgtagtgcttctactatcctctg

SEQ ID NO: 3411 - DNA, 71 bp, chicken (Gallus Gallus)
  misc_feature (36): n=a or g
tgcatcgacctgatggaaatacttccctgtttcacngccattggttacgtaggggcttaggatcctgagag

SEQ ID NO: 3412 - DNA, 71 bp, chicken (Gallus Gallus)
  misc_feature (36): n=c or t
ggcagagctccagcctgaagcacatgcggcagctcngataacacatctgtatttttacaccagaagggtgg

SEQ ID NO: 3413 - DNA, 71 bp, chicken (Gallus Gallus)
  misc_feature (36): n=c or t
actgaaagatggttaattgtcttcactagctgcganaaagcaggaaaggtccatcactgggactaatggtg

SEQ ID NO: 3414 - DNA, 71 bp, chicken (Gallus Gallus)
  misc_feature (36): n=a or g
agtataaattatgcaactgaacttggatgagccaangaagataatggcaggtaatgagacatctgtatcac

SEQ ID NO: 3415 - DNA, 71 bp, chicken (Gallus Gallus)
  misc_feature (36): n=a or g
cgtgctggctggtggttgctatgggcaagaagtgtntgtaggcagctggtgcagctccgcgggcctgctgg

SEQ ID NO: 3416 - DNA, 71 bp, chicken (Gallus Gallus)
  misc_feature (36): n=a or g
ttctgtataactgctaacttgtgctgtgtccagctntaactatgcacaataatagcagaagtatggcattt

SEQ ID NO: 3417 - DNA, 71 bp, chicken (Gallus Gallus)
  misc_feature (36): n=a or g
gcatatacttaagcagttttcagaataatgtcactnggtgtatgatttcagataggatgacagcactggaa

SEQ ID NO: 3418 - DNA, 71 bp, chicken (Gallus Gallus)
  misc_feature (36): n=a or g
gtttggcagggaccactgcatgcctcaccacccacngacagaggtgttcccaaaatgagctcttcacatca

SEQ ID NO: 3419 - DNA, 71 bp, chicken (Gallus Gallus)
  misc_feature (36): n=a or g
ttctgccccagctcaggagacattttaccactctgnagaagacattgtacgttccccacatacaggtctgt

SEQ ID NO: 3420 - DNA, 71 bp, chicken (Gallus Gallus)
  misc_feature (36): n=a or g
tgcatcaccttcgagatgaaacatccagctcttgtnccatccaggatgcaggctcttaggaaatccacact

SEQ ID NO: 3421 - DNA, 71 bp, chicken (Gallus Gallus)
  misc_feature (36): n=a or c
ttccttgtgccctgttatctcaggagtgggctgggntagcctggtgccaaaatcactgcatttactacatg

SEQ ID NO: 3422 - DNA, 71 bp, chicken (Gallus Gallus)
  misc_feature (36): n=c or t
agcacgtagcctctgtttcttctatttcagtttttncagctctttcagtgtcgatatagcatgatgctggt

SEQ ID NO: 3423 - DNA, 71 bp, chicken (Gallus Gallus)
  misc_feature (36): n=c or t
tgaatcatcaaattgctcctttaggaatgtaatcangtgtaataagctaagcaatcacatcatcgatggac

SEQ ID NO: 3424 - DNA, 71 bp, chicken (Gallus Gallus)
  misc_feature (36): n=c or t
cacatgcagatacaagtttctgatcttggagtcacnccacacaggtgatgcagctcagacccattaccata

SEQ ID NO: 3425 - DNA, 71 bp, chicken (Gallus Gallus)
  misc_feature (36): n=g or t
aacatcactctgcagtttcaacctgcagctcatctnaggggggttttctcgacctctgcgtttctcaactt

SEQ ID NO: 3426 - DNA, 71 bp, chicken (Gallus Gallus)
  misc_feature (36): n=c or t
gctgaaagtgtggacgtaccagtagagaaatctgangtggcataatgatctctacctcgcctttgacctgt

SEQ ID NO: 3427 - DNA, 71 bp, chicken (Gallus Gallus)
  misc_feature (36): n=c or t
ctccagcgtggcaggatctggtttgtttcttgatgntagtctcatctccgtcctctgaatgggtgagtacg

SEQ ID NO: 3428 - DNA, 71 bp, chicken (Gallus Gallus)
  misc_feature (36): n=a or g
gctatttacccagagatggaacctgcataattcagncagaaataccagcattagagcgttctgttaagcac

SEQ ID NO: 3429 - DNA, 71 bp, chicken (Gallus Gallus)
  misc_feature (36): n=a or g
cctttgattccttcccagaatcttgtttctctgtcnctccccagctggctgcctgctctggccctccacaa

SEQ ID NO: 3430 - DNA, 71 bp, chicken (Gallus Gallus)
  misc_feature (36): n=c or t
tttgtgttctgctataagacacgtttatgttgcagngctatgcagcttttaattcattttcaaatgcatgc

SEQ ID NO: 3431 - DNA, 71 bp, chicken (Gallus Gallus)
  misc_feature (36): n=a or g
tagttctgttattgaagccatgcagtagaagattcnttgcttgtaatgtttggagaggatcttcctcagta

SEQ ID NO: 3432 - DNA, 71 bp, chicken (Gallus Gallus)
  misc_feature (36): n=c or t
attccgggcaggattttttgaacagcagcttttccncctgcagcctattctgctgggcttcattctaagca

SEQ ID NO: 3433 - DNA, 71 bp, chicken (Gallus Gallus)
  misc_feature (36): n=a or g
catatactttcaatagctacagtgtggttaaagtcngggaaatgaatgtacaaaaatagcatctgagcgcc

SEQ ID NO: 3434 - DNA, 71 bp, chicken (Gallus Gallus)
  misc_feature (36): n=c or t
acgggggctctcagggagccatttattgccatgcanagagcagtttggggttctggtgccattcttgttga

SEQ ID NO: 3435 - DNA, 71 bp, chicken (Gallus Gallus)
  misc_feature (36): n=c or t
aaggactgcctgtcttctgtgcatccctgatcaggnctgcaagaaggcaactataactgatacaacacata

SEQ ID NO: 3436 - DNA, 71 bp, chicken (Gallus Gallus)
  misc_feature (36): n=a or c
gaagaaggctattatcttgttgccttgcaatatagntaataaaaaaaatgtgaagcattttaccctatctt

SEQ ID NO: 3437 - DNA, 71 bp, chicken (Gallus Gallus)
  misc_feature (36): n=a or g
gaggtagttaagcatttaaagtatggaactttttcngctgttttttgagcaggagttttatggaaaacagc

SEQ ID NO: 3438 - DNA, 71 bp, chicken (Gallus Gallus)
  misc_feature (36): n=c or t
ctactgtaagcaggcagagtttggctatgatattgngtgatattcagtgtcagaatcaagtgggggctgag

SEQ ID NO: 3439 - DNA, 71 bp, chicken (Gallus Gallus)
  misc_feature (36): n=a or g
gcagttgtaggctgtgctgctgtgtctgggactgcntgttggttggtatcaagcaccagctctgtccctgc

SEQ ID NO: 3440 - DNA, 71 bp, chicken (Gallus Gallus)
  misc_feature (36): n=a or g
cagtaacatctgcacacagaaagcagctggtgaagncatctgtttgcaaattaaagggctgctcctgtcca

SEQ ID NO: 3441 - DNA, 71 bp, chicken (Gallus Gallus)
  misc_feature (36): n=a or g
gcaaggtatcagctatccaacaacaacaaatgcccngcaggacaaagtgttctctgagcactgcaaacact

SEQ ID NO: 3442 - DNA, 71 bp, chicken (Gallus Gallus)
  misc_feature (36): n=a or g
ttgggatggtggatggggtaatgcgatggatattcnggttgaagattaggacaagctttttctcaggagtg

SEQ ID NO: 3443 - DNA, 71 bp, chicken (Gallus Gallus)
  misc_feature (36): n=c or t
tcagttgtacactcaaaccatttattcagacactcnaggaataagaaacaatttctcttcctgattctaga

SEQ ID NO: 3444 - DNA, 71 bp, chicken (Gallus Gallus)
  misc_feature (36): n=c or t
ttattaaaccataacacacttcaggacaacttagtnattgtggaataacactgccttacgaacaccacgta

SEQ ID NO: 3445 - DNA, 71 bp, chicken (Gallus Gallus)
  misc_feature (36): n=c or t
gttctcagcctttgaaagaaagcacaggtgacccanggttatcccaccctcctgtgctaaagttgttctga

SEQ ID NO: 3446 - DNA, 71 bp, chicken (Gallus Gallus)
  misc_feature (36): n=a or g
ttgaagcatcgcttggtagtgctcgaatttattttnccctcatatctgggatctgaaatgactgcctgcaa

SEQ ID NO: 3447 - DNA, 71 bp, chicken (Gallus Gallus)
  misc_feature (36): n=a or t
ttctcctaagctctctgcaattatctgataatctgntcaatgacctggtttggatttggataagtgagtct

SEQ ID NO: 3448 - DNA, 71 bp, chicken (Gallus Gallus)
  misc_feature (36): n=a or t
agcctcttctcctaagctctctgcaattatctgatnatctgttcaatgacctggtttggatttggataagt

SEQ ID NO: 3449 - DNA, 71 bp, chicken (Gallus Gallus)
  misc_feature (36): n=c or t
gcagccttaagtattatcaggaatgctcaagccttngtatgttgtagaaatatgcatcagtaaacaaaagc

SEQ ID NO: 3450 - DNA, 71 bp, chicken (Gallus Gallus)
  misc_feature (36): n=c or t
cagttggtataaatgaagttacttgctaccattaantactgtgattgtttcctctccctagatacactctt

SEQ ID NO: 3451 - DNA, 71 bp, chicken (Gallus Gallus)
  misc_feature (36): n=a or g
attcagtggattaaaaaattagcttttcaaatattntccacatatttatataaagcaaaggctcataattc

SEQ ID NO: 3452 - DNA, 71 bp, chicken (Gallus Gallus)
  misc_feature (36): n=c or t
tggctttagtgaccacaaagcaatgatgttcaaaanacttgaggagtgtgagggtggtaagtagctgcata

SEQ ID NO: 3453 - DNA, 71 bp, chicken (Gallus Gallus)
  misc_feature (36): n=c or t
gctcagaagggaaggaaaagtttaagaataatgggngtctggacccttccacacagaatctgttataaagc

SEQ ID NO: 3454 - DNA, 71 bp, chicken (Gallus Gallus)
  misc_feature (36): n=a or g
agcgacattactcagctcctgcaagaaacttgaacntattccttgaagtggggaagtggttgcattccact

SEQ ID NO: 3455 - DNA, 71 bp, chicken (Gallus Gallus)
  misc_feature (36): n=a or g
atgaggtcatgttttctctcctctgttgtcatatgnaatgcttatgagaagagttttttcccttgattcta

SEQ ID NO: 3456 - DNA, 71 bp, chicken (Gallus Gallus)
  misc_feature (36): n=a or t
actgttcagggtgctgcagctgatacatccagaacnaaagcatcttgaatcaagaatctgacagttattca

SEQ ID NO: 3457 - DNA, 71 bp, chicken (Gallus Gallus)
  misc_feature (36): n=a or g
acagattttctgtaactttttaaattgaaaaagtgntgagctactgaatattgccattataaggaaacagt

SEQ ID NO: 3458 - DNA, 71 bp, chicken (Gallus Gallus)
  misc_feature (36): n=c or t
gctccataacttcagcatgtccagaatccacctcangtgaggacactcaggtggccttatcagatctcatt

SEQ ID NO: 3459 - DNA, 71 bp, chicken (Gallus Gallus)
  misc_feature (36): n=a or g
tccaggtacagctcagcaggaactgctgaaccagcngttctgtatcccatcaggaattacattggacccat

SEQ ID NO: 3460 - DNA, 71 bp, chicken (Gallus Gallus)
  misc_feature (36): n=c or t
taacatacacaagcctctgaagggtagtgtaataanatggcagtcaacaaactgttgatggattattttgg

SEQ ID NO: 3461 - DNA, 71 bp, chicken (Gallus Gallus)
  misc_feature (36): n=a or g
ccaggcaacctgttccagtacatgatcaccctcacngtaattctttctccccccatcaaatccgaatttct

SEQ ID NO: 3462 - DNA, 71 bp, chicken (Gallus Gallus)
  misc_feature (36): n=a or g
gcagacaacctacacaatgcaaggaaacatacggcnggatgcacaaagtgattcatgagtgagagagcgat

SEQ ID NO: 3463 - DNA, 71 bp, chicken (Gallus Gallus)
  misc_feature (36): n=c or t
cctctcagtgcatataaatagtacttataaaattangtattgtttcttcacactgtgattagtgttactgt

SEQ ID NO: 3464 - DNA, 71 bp, chicken (Gallus Gallus)
  misc_feature (36): n=g or t
gaattttctgtgctgcagaagaacttgtgaggactntaagtaattcagaatatttcacatgcctcatttgc

SEQ ID NO: 3465 - DNA, 71 bp, chicken (Gallus Gallus)
  misc_feature (36): n=a or g
ctatgtgtgatatgctagtcatagttctatgatgantgttgcttagtttaagactgaactgagtgtaacac

SEQ ID NO: 3466 - DNA, 71 bp, chicken (Gallus Gallus)
  misc_feature (36): n=c or t
gaacagtgcaccccatcctctctccaatggcaatanctaatttcagtacccactagacgttgtttcctgag

SEQ ID NO: 3467 - DNA, 71 bp, chicken (Gallus Gallus)
  misc_feature (36): n=a or g
gcagtaaagtagtgtctttaactgttttataccctntaccagaattgaatagcccaacttaaatacattca

SEQ ID NO: 3468 - DNA, 71 bp, chicken (Gallus Gallus)
  misc_feature (36): n=a or g
cagtgttttactttcaggctttacttataggctgtncttttctaatggaaggctattccaggtagcagtga

SEQ ID NO: 3469 - DNA, 71 bp, chicken (Gallus Gallus)
  misc_feature (36): n=c or t
agatgtcctagttttggtctgacaactaatgctganaaaaaaaggaagccgtgaaacttcacatacattaa

SEQ ID NO: 3470 - DNA, 71 bp, chicken (Gallus Gallus)
  misc_feature (36): n=a or c
caacaacaaactgttttgctttaatctttattcacnttctattttaatgttatatgaagatttcaaaagtg

SEQ ID NO: 3471 - DNA, 71 bp, chicken (Gallus Gallus)
  misc_feature (36): n=a or g
tacatatagaacatgaaagagtcactgagttcgtgnatgactcagctgacaggcaatcctgagcatttgca

SEQ ID NO: 3472 - DNA, 71 bp, chicken (Gallus Gallus)
  misc_feature (36): n=c or t
ggaaaaagaaataaaaccaaaacaagcagaaaacangaatacttattatcaagtaagtctgcacttctttg

SEQ ID NO: 3473 - DNA, 71 bp, chicken (Gallus Gallus)
  misc_feature (36): n=c or t
ctggaatgctgtaaagagaatgacttgaattgttgnttctgcctcttgtatgattgattttttacgagtga

SEQ ID NO: 3474 - DNA, 71 bp, chicken (Gallus Gallus)
  misc_feature (36): n=a or g
tgtttcttagtaagtgatgaaaaaatcctttatggntgtaagcttacttaaatcaatagtaacttctccat

SEQ ID NO: 3475 - DNA, 71 bp, chicken (Gallus Gallus)
  misc_feature (36): n=c or t
tacacttccagagaagacctgtgactttcaaaattnatctagttagcagaaaaaatgtattaaatttcatt

SEQ ID NO: 3476 - DNA, 71 bp, chicken (Gallus Gallus)
  misc_feature (36): n=c or t
tagctatgttacacacctgctggtcagctacatcanctctttccgatccactagaggtgatgaagcagtat

SEQ ID NO: 3477 - DNA, 71 bp, chicken (Gallus Gallus)
  misc_feature (36): n=a or g
gtacacagtgaaagaaaacttggtgagcccactagnagagatacttcattgtcagaagtaagaaaagtgta

SEQ ID NO: 3478 - DNA, 71 bp, chicken (Gallus Gallus)
  misc_feature (36): n=c or t
taccatttatggagagaacaaggtatcttcataatngatctgtccttgggtattagcttagaattaaatta

SEQ ID NO: 3479 - DNA, 71 bp, chicken (Gallus Gallus)
  misc_feature (36): n=a or t
cttcactgttgaatcttatttagaagatacagtccntgttttaatttggttgatgttgcctacagaattac

SEQ ID NO: 3480 - DNA, 71 bp, chicken (Gallus Gallus)
  misc_feature (36): n=a or g
gcaacggaagagtccagtggaggctcaaccggtctnatcacagaccttcaaacatttctgatactgattag

SEQ ID NO: 3481 - DNA, 71 bp, chicken (Gallus Gallus)
  misc_feature (36): n=c or t
tatgcaccaaggccattcataatgaattatatggtntaaactaataagttaccctcttagctgtttgcttc

SEQ ID NO: 3482 - DNA, 71 bp, chicken (Gallus Gallus)
  misc_feature (36): n=a or g
gtgttctgggacaaaacaaacagcaaagcagcattntggctttttcttaaacactaccattgcaccaagct

SEQ ID NO: 3483 - DNA, 71 bp, chicken (Gallus Gallus)
  misc_feature (36): n=c or t
atgttcttaattatacatctcgcagaaccggggggntcccactcagcagttacgtatggcatattgctggc

SEQ ID NO: 3484 - DNA, 71 bp, chicken (Gallus Gallus)
  misc_feature (36): n=c or t
gtcagctggctcaaggatcaccagccaggaatccanggcaaatccacattcctccatagatcaaacttcct

SEQ ID NO: 3485 - DNA, 71 bp, chicken (Gallus Gallus)
  misc_feature (36): n=a or c
agttctgtgtgaactgagaagcaatactgactgtgntatctgcagaggctgtagcacagccccaggagcac

SEQ ID NO: 3486 - DNA, 71 bp, chicken (Gallus Gallus)
  misc_feature (36): n=a or g
ctctattattgagctgtgtgcacgcatgcaactccngataattgtcatttacattagaactgtttgccttg

SEQ ID NO: 3487 - DNA, 71 bp, chicken (Gallus Gallus)
  misc_feature (36): n=c or t
ttttgttccttgcagttcagctactgttcagtatgntctcctgagcccagcacagtgggtctagtccagta

SEQ ID NO: 3488 - DNA, 71 bp, chicken (Gallus Gallus)
  misc_feature (36): n=a or g
tatatgttcaggaacataactgtcacgtggcagtanctgagctgcttgtctcactcatgcttactgatggc

SEQ ID NO: 3489 - DNA, 71 bp, chicken (Gallus Gallus)
  misc_feature (36): n=c or t
gctgccttctattccataccatcatgagcaacctangaaccccatgcaagctagctgacacggccctacct

SEQ ID NO: 3490 - DNA, 71 bp, chicken (Gallus Gallus)
  misc_feature (36): n=c or t
aaatccagctataagccagggcttgaagatgaaggnctggctttgtttgtacaggatacccccaaaaattt

SEQ ID NO: 3491 - DNA, 71 bp, chicken (Gallus Gallus)
  misc_feature (36): n=a or g
agaatgtgattttgccttggcagggaatgacttcanagctttctcatacattgtctaaaggaataaacttt

SEQ ID NO: 3492 - DNA, 71 bp, chicken (Gallus Gallus)
  misc_feature (36): n=c or t
gttgaagtggttcacatttggatttcctcttggcangcaggtgggaggcagccaggatagacagctggatc

SEQ ID NO: 3493 - DNA, 71 bp, chicken (Gallus Gallus)
  misc_feature (36): n=c or t
aggggctttatgtgatggtacccttacacaccttcnctgcacacagactgggaaagtgacagcttgcagga

SEQ ID NO: 3494 - DNA, 71 bp, chicken (Gallus Gallus)
  misc_feature (36): n=c or t
tactcctccgacagctttcacaaccaccagctgcanattagaagcacaaagtgactggaagaagagatgtg

SEQ ID NO: 3495 - DNA, 71 bp, chicken (Gallus Gallus)
  misc_feature (36): n=c or g
aggattcagaaaatacacagtgaaagcactggcaantgtgtgaaccaggcactacagcacacacgaaattt

SEQ ID NO: 3496 - DNA, 71 bp, chicken (Gallus Gallus)
  misc_feature (36): n=c or t
atccctatctccgatctgatgctttgtttcagaccnatctctaagatcaactgtagcagcaagaatcggag

SEQ ID NO: 3497 - DNA, 71 bp, chicken (Gallus Gallus)
  misc_feature (36): n=c or t
tatcaaatcaaacaggcctccatcgatgtctccttntgtgatgttgctgtgagtcttttccatcatacaca

SEQ ID NO: 3498 - DNA, 71 bp, chicken (Gallus Gallus)
  misc_feature (36): n=a or g
ccctgcagcctgctcccagccctgtggtgcctttcncgttttgctgcacgccaaactcaggatggttgcac

SEQ ID NO: 3499 - DNA, 71 bp, chicken (Gallus Gallus)
  misc_feature (36): n=c or t
atcctgcacacttggaatgctgattggtctgagttnacagaggtggacatggatgtgcagatccttaatgc

SEQ ID NO: 3500 - DNA, 71 bp, chicken (Gallus Gallus)
  misc_feature (36): n=a or g
cctgctttctttccatgtaaatgggaagacacaccnagtaatgcattactatagttccgacatctctcatg

SEQ ID NO: 3501 - DNA, 71 bp, chicken (Gallus Gallus)
  misc_feature (36): n=c or t
tggaggtgattatgatccaagagatcaaacccagcngttactggagtcctggccagcacagtgaaggtctg

SEQ ID NO: 3502 - DNA, 71 bp, chicken (Gallus Gallus)
  misc_feature (36): n=c or t
attgctgccaacattgatcgaatgactctggtgaanagtgcttggtgtgtaacacactgtgagtgcttcat

SEQ ID NO: 3503 - DNA, 71 bp, chicken (Gallus Gallus)
  misc_feature (36): n=a or c
attgattcaatcaagaaagagtgcttgggttctggngctggcagtactgcagggtcttccaaagatcactg

SEQ ID NO: 3504 - DNA, 71 bp, chicken (Gallus Gallus)
  misc_feature (36): n=a or c
catcatactccaagcaccaagcagcacatattcctncaagcaaagcccactcaccagataagtctccagtg

SEQ ID NO: 3505 - DNA, 71 bp, chicken (Gallus Gallus)
  misc_feature (36): n=c or t
ctagttaagcaggataactctggctctgctgtgtcnaggcaatttaaatgatttataaagcatagctgttt

SEQ ID NO: 3506 - DNA, 71 bp, chicken (Gallus Gallus)
  misc_feature (36): n=a or g
aacaaagccacccaaatgccactcttctgatcagcnaagccgcaccacaaaacaccgcagggcaggagtaa

SEQ ID NO: 3507 - DNA, 71 bp, chicken (Gallus Gallus)
  misc_feature (36): n=c or t
agggcagaacatctgaagaactcatcctaaatgcanaacagcctcagatgcccgcccttccttccaggggc

SEQ ID NO: 3508 - DNA, 71 bp, chicken (Gallus Gallus)
  misc_feature (36): n=c or t
gagaagtcatttcgcatctttgagctgtgactcctnatgtcctacttataggttatcttcctcactgccag

SEQ ID NO: 3509 - DNA, 71 bp, chicken (Gallus Gallus)
  misc_feature (36): n=c or t
catcttgagaggaaacactccaatttcaacagcacngcattttccaacaacaacagaaatgttcctttaat

SEQ ID NO: 3510 - DNA, 71 bp, chicken (Gallus Gallus)
  misc_feature (36): n=c or t
ttggagttgatgctgcctgttccagtcacagtctcnattctttcactgcagagcggattttgttgacacgt

SEQ ID NO: 3511 - DNA, 71 bp, chicken (Gallus Gallus)
  misc_feature (36): n=a or g
tgaagatagatgttaaaatgttactaagattttccngggagagctgaaacttcaaacaacccagaaatgcc

SEQ ID NO: 3512 - DNA, 71 bp, chicken (Gallus Gallus)
  misc_feature (36): n=a or g
tttcatagcaaagatactaatttctcacacatctcntgtctgccagagagaaaagatccttcagtgacatg

SEQ ID NO: 3513 - DNA, 71 bp, chicken (Gallus Gallus)
  misc_feature (36): n=c or t
attttctccccagcacagctcttcttctagcagcantgcactcaccatgaagttagcactttctctttgtt

SEQ ID NO: 3514 - DNA, 71 bp, chicken (Gallus Gallus)
  misc_feature (36): n=a or g
agcataagaagtacctggcatttgtcttgttgatanagccaaattccttactaaggagaaaatcccattca

SEQ ID NO: 3515 - DNA, 71 bp, chicken (Gallus Gallus)
  misc_feature (36): n=c or t
tgtaagcagataacaaagcctcaggttctcacagangaaataaaagctggaggagacaagagagaaggttg

SEQ ID NO: 3516 - DNA, 71 bp, chicken (Gallus Gallus)
  misc_feature (36): n=c or t
aagctctccatgcattcaagcagctcctaatgcacnacctaataacctatcacccagaggatccatgcacg

SEQ ID NO: 3517 - DNA, 71 bp, chicken (Gallus Gallus)
  misc_feature (36): n=c or t
cacttggggctgttcacagacagagcttctctgcanaacatgattgatgtggaaggtaagtggaataacaa

SEQ ID NO: 3518 - DNA, 71 bp, chicken (Gallus Gallus)
  misc_feature (36): n=a or g
gctatatatctaaagaagagctgtaagaaaacaggngactgactctttagcaaggtctgttgtgatgggac

SEQ ID NO: 3519 - DNA, 71 bp, chicken (Gallus Gallus)
  misc_feature (36): n=c or t
gggtgcacgtgggttttgttggaggtgcctgtgtanctgaggccttctgaaggtaagtagctttatttatt

SEQ ID NO: 3520 - DNA, 71 bp, chicken (Gallus Gallus)
  misc_feature (36): n=g or t
ccaaattattgggtgtcttggaagatgtgaaaaacnacaaaactaaggttacaacaggagctacgcaagtt

SEQ ID NO: 3521 - DNA, 71 bp, chicken (Gallus Gallus)
  misc_feature (36): n=a or g
gataaaataaagaagatttaagccaaattcttactntttcctgccctgggcaaaacgggggcagcaagtgg

SEQ ID NO: 3522 - DNA, 71 bp, chicken (Gallus Gallus)
  misc_feature (36): n=a or t
atcctggactaaatgctgtagtataactgtaatccnacagcttcccatataatatgtatgaattcaagtgt

SEQ ID NO: 3523 - DNA, 71 bp, chicken (Gallus Gallus)
  misc_feature (36): n=g or t
agcagcagcagaggtttctcgttggtttccagtttnggggaaggttttggtttttttctaaagcgttaact

SEQ ID NO: 3524 - DNA, 71 bp, chicken (Gallus Gallus)
  misc_feature (36): n=c or t
cttggtgacgtgcagccacagaacccccattctctngtttccagcacttcataaacagctctctgcctgga

SEQ ID NO: 3525 - DNA, 71 bp, chicken (Gallus Gallus)
  misc_feature (36): n=c or t
gagattgctttgcatgctcctgttattaagtaattngtgttttttccttattcctgatgtgttccttgagg

SEQ ID NO: 3526 - DNA, 71 bp, chicken (Gallus Gallus)
  misc_feature (36): n=c or t
gattcgtcctctttaatgaaaccaagacccggagcnttgaattgacccactgtcctgcagaaaatccacta

SEQ ID NO: 3527 - DNA, 71 bp, chicken (Gallus Gallus)
  misc_feature (36): n=c or t
cgcagtaagtctgtgactcccatgtgcttacctaangtgaagtgagaatggtgagaacccttgcagaatta

SEQ ID NO: 3528 - DNA, 71 bp, chicken (Gallus Gallus)
  misc_feature (36): n=c or t
gggaatgcacagtttaattaagactacctggcaganattcagacaagggaggtcatgctgaagtaatttgc

SEQ ID NO: 3529 - DNA, 71 bp, chicken (Gallus Gallus)
  misc_feature (36): n=c or t
aatacaaaatggataaagccctgcagtgactcagtnggggaactttatgcgtgaagcttttgtatgcaaca

SEQ ID NO: 3530 - DNA, 71 bp, chicken (Gallus Gallus)
  misc_feature (36): n=c or t
ggaaacccaaaccatccttttcccctgaaacagtanttgaggaaatgctgcgctgtctcctgctatagcat

SEQ ID NO: 3531 - DNA, 71 bp, chicken (Gallus Gallus)
  misc_feature (36): n=c or g
acaacattttaatatactgtcaggagtttaagctanattatatttgaataacctgggctggtgttaaatat

SEQ ID NO: 3532 - DNA, 71 bp, chicken (Gallus Gallus)
  misc_feature (36): n=a or g
gaaaagggttttgaggcttgcaagatttgctggatnacagaagcaaaacagctctaatggcccttctttgt

SEQ ID NO: 3533 - DNA, 71 bp, chicken (Gallus Gallus)
  misc_feature (36): n=c or t
tggagcaagtctaccacagctatggacacatgtgcnagatgttaaggacaatcaacacagcaccaaacaca

SEQ ID NO: 3534 - DNA, 71 bp, chicken (Gallus Gallus)
  misc_feature (36): n=a or g
tcagtttgtgttaatgagagatgtgggcaaatcctntagaaagacactggaatatatacctaaagggcaaa

SEQ ID NO: 3535 - DNA, 71 bp, chicken (Gallus Gallus)
  misc_feature (36): n=a or g
agcttcaagctttcagctaaatcatccccagcacanactccaagcagtcacacttctcagaaattgcatcc

SEQ ID NO: 3536 - DNA, 71 bp, chicken (Gallus Gallus)
  misc_feature (36): n=c or t
gcatggtatccagttgccctcaaacttcatggttcntatttctgtaacagggcagctcagtctgaagggct

SEQ ID NO: 3537 - DNA, 71 bp, chicken (Gallus Gallus)
  misc_feature (36): n=c or t
cttttagatgttaacagaaatttcaaaggtcatttnccttttcatgagggcacacagatgccagaactgag

SEQ ID NO: 3538 - DNA, 71 bp, chicken (Gallus Gallus)
  misc_feature (36): n=a or g
tataatcctcaattaatgccatgaaagattactccntttcactgataaacgtaaattaaaattgtttgctt

SEQ ID NO: 3539 - DNA, 71 bp, chicken (Gallus Gallus)
  misc_feature (36): n=a or g
tctttccttagattaaagcagccagtgaaggacagngagctgcgtgtcatctttcgaagacaagtgaaaca

SEQ ID NO: 3540 - DNA, 71 bp, chicken (Gallus Gallus)
  misc_feature (36): n=a or g
tctgctatttgtgtcttgttcatacaatcctttccnagagctcttgtaccctctgtacgatgcaaacccta

SEQ ID NO: 3541 - DNA, 71 bp, chicken (Gallus Gallus)
  misc_feature (36): n=c or t
gtaaaacagtaggacaaaataagaatcttctccagngagaaagcaacagcaatatatgtctggctctgagc

SEQ ID NO: 3542 - DNA, 71 bp, chicken (Gallus Gallus)
  misc_feature (36): n=a or g
acctggttgcaaaaagaaccaggaaagcacggtagntaaccagggtcagctttcaggtagtaacacatgag

SEQ ID NO: 3543 - DNA, 71 bp, chicken (Gallus Gallus)
  misc_feature (36): n=c or t
caaagcagtgttagagagcgagcagccctagacttngtttaacgaacaggcaactcttacctaattttttt

SEQ ID NO: 3544 - DNA, 71 bp, chicken (Gallus Gallus)
  misc_feature (36): n=a or g
tgtttgtcatttccccccatacaacaatctttgacnatctttcagacattagtctaaagccataaacgtca

SEQ ID NO: 3545 - DNA, 71 bp, chicken (Gallus Gallus)
  misc_feature (36): n=a or c
acaatataagtctagtataaataattttcctcttcnattatagcaaaattcaacagctattttctccaaga

SEQ ID NO: 3546 - DNA, 71 bp, chicken (Gallus Gallus)
  misc_feature (36): n=a or g
gacgtcactccctacttccttgctgtgatgatcctncacaaaagttgttctcacttataagataaagcaga

SEQ ID NO: 3547 - DNA, 71 bp, chicken (Gallus Gallus)
  misc_feature (36): n=g or t
attactgcatacatccactctttgctacttcccatntggaaaaatccattcattctctaagcagctcctcc

SEQ ID NO: 3548 - DNA, 71 bp, chicken (Gallus Gallus)
  misc_feature (36): n=c or t
ctaggaaatattatactgaaaaaagaggaataaaangatttctttgtaaacaactacgtattcaatatgag

SEQ ID NO: 3549 - DNA, 71 bp, chicken (Gallus Gallus)
  misc_feature (36): n=a or g
gccgtgatcacagagcaggacgagggaagatgggcncattttgttagcaggaggaggaagcttggtgtagc

SEQ ID NO: 3550 - DNA, 71 bp, chicken (Gallus Gallus)
  misc_feature (36): n=a or g
tacctgaggccctatacttttcccatgagtttaacntgacaggagtcaagtaatccagaaggaacctgagc

SEQ ID NO: 3551 - DNA, 71 bp, chicken (Gallus Gallus)
  misc_feature (36): n=a or g
aaagccctcatagcctgggcactgctctaaaactgnaagcgtctccaccatgcatatggctttcttgttat

SEQ ID NO: 3552 - DNA, 71 bp, chicken (Gallus Gallus)
  misc_feature (36): n=a or g
ttcttccattattgtctgttcgcatggacactccangctactgatgctctcaggtatgaagaagcattttt

SEQ ID NO: 3553 - DNA, 71 bp, chicken (Gallus Gallus)
  misc_feature (36): n=c or t
tgggactttgatgtctccatctattctggaagccanttggcctcctggagcaccagaggtacagctgaagc

SEQ ID NO: 3554 - DNA, 71 bp, chicken (Gallus Gallus)
  misc_feature (36): n=c or t
tacgctggaggaggatgcagggtgacgcggggcgangcagtgtgatgcaatacagggcgatgtgacgtgat

SEQ ID NO: 3555 - DNA, 71 bp, chicken (Gallus Gallus)
  misc_feature (36): n=c or t
cacataggggaatccaaatcactgcttaatgactgngaatccaagggttcaagaatccaattgcctttaat

SEQ ID NO: 3556 - DNA, 71 bp, chicken (Gallus Gallus)
  misc_feature (36): n=a or g
agcacacctgggagggggcgggggaggtcactgccntcccatccgcaaccaaagaaaaccttcaaatccac

SEQ ID NO: 3557 - DNA, 71 bp, chicken (Gallus Gallus)
  misc_feature (36): n=a or g
ggctagactaggatatttagagtggagaagctcacngatggcctacctgtgtggcactggtggggtaggag

SEQ ID NO: 3558 - DNA, 71 bp, chicken (Gallus Gallus)
  misc_feature (36): n=a or c
ttggaaagctgagggacagggtagctgctgcccctngtctgatttaccagttgctaataacggagtatgtg

SEQ ID NO: 3559 - DNA, 71 bp, chicken (Gallus Gallus)
  misc_feature (36): n=c or t
gggctgagctctgttgttctgatagcagttaaacanggtggttgcttaaaaagagagggatcaacggcttt

SEQ ID NO: 3560 - DNA, 71 bp, chicken (Gallus Gallus)
  misc_feature (36): n=c or t
gacatcattttataaataatcaaactcatagattcncagttcaaagcaagaagcttcttctccaggaaatc

SEQ ID NO: 3561 - DNA, 71 bp, chicken (Gallus Gallus)
  misc_feature (36): n=c or t
tgtggctgcacagggtccactattgcagcctccttngtttcctcatcaatgaggaggtacatgtagttgtc

SEQ ID NO: 3562 - DNA, 71 bp, chicken (Gallus Gallus)
  misc_feature (36): n=a or g
accttaccaatctgctctgcgtcaaagtcaggtgcntagaaccacacaacgggtgagacatgctttgctat

SEQ ID NO: 3563 - DNA, 71 bp, chicken (Gallus Gallus)
  misc_feature (36): n=c or t
tcatcagtgccagagagaagggtccaacacaaaccnatcttgaaacgatcgctgagagaataaatgggagc

SEQ ID NO: 3564 - DNA, 71 bp, chicken (Gallus Gallus)
  misc_feature (36): n=c or t
cggtgcttctgcagggctgcatcaaactgagctggnaggaaaaagaggaggtgtgtgcaccttcacgctga

SEQ ID NO: 3565 - DNA, 71 bp, chicken (Gallus Gallus)
  misc_feature (36): n=a or g
tagcattgcctttatttacagccagtgctgtgtgcnctgtttcatgtattgcaagaaacacagctgacagc

SEQ ID NO: 3566 - DNA, 71 bp, chicken (Gallus Gallus)
  misc_feature (36): n=c or t
ttctgaaatggattataaattatgaaatgtaacccntgggatgcttcgggatgacttgaaatgactaaggc

SEQ ID NO: 3567 - DNA, 71 bp, chicken (Gallus Gallus)
  misc_feature (36): n=g or t
tgcaagagtttttcctcccagccttccagggtttcnagtccatgtgcaggctggaatcagtatatatggag

SEQ ID NO: 3568 - DNA, 71 bp, chicken (Gallus Gallus)
  misc_feature (36): n=a or g
cttctcatcagtaccattttcagcttcctttatacnaaggaaatacgccattagtataaatacttttcatt

SEQ ID NO: 3569 - DNA, 71 bp, chicken (Gallus Gallus)
  misc_feature (36): n=a or g
atcattcgttctgtctgctggaattacattgttgcntggataaagatgttgaagagagctggctactcttc

SEQ ID NO: 3570 - DNA, 71 bp, chicken (Gallus Gallus)
  misc_feature (36): n=a or g
gatgttctataaagccagatgttgaagtcacttccntaactgtccttttgggttttaggtgtggaacgtta

SEQ ID NO: 3571 - DNA, 71 bp, chicken (Gallus Gallus)
  misc_feature (36): n=c or t
ccagacaatctctagagctcatcgagaatcaaccancctgtggttctgcttgcagtcattgctgcactgca

SEQ ID NO: 3572 - DNA, 71 bp, chicken (Gallus Gallus)
  misc_feature (36): n=g or t
accaactggtatttctctctcctgttcattccttgnttatataagctatcaaatcaacctctgcaggaagg

SEQ ID NO: 3573 - DNA, 71 bp, chicken (Gallus Gallus)
  misc_feature (36): n=c or t
ggtattgtggtggccttgtgaggaggtgctatatcnggggtaatccaaatatttgaaagcattgctgaggt

SEQ ID NO: 3574 - DNA, 71 bp, chicken (Gallus Gallus)
  misc_feature (36): n=c or t
tatttagtgggaacaggaggaaacaaacacctttangattagagattatttatgctttctggatctcacag

SEQ ID NO: 3575 - DNA, 71 bp, chicken (Gallus Gallus)
  misc_feature (36): n=c or t
gttctactgttcttctgggaaattaagtggggcatngaagcccagaacccttcagaaaacagaacacaagt

SEQ ID NO: 3576 - DNA, 71 bp, chicken (Gallus Gallus)
  misc_feature (36): n=c or t
agagaattttgtggtgaaattgtcttgtaagcccangtttttcagctccagaataaagtgctgaagaattt

SEQ ID NO: 3577 - DNA, 71 bp, chicken (Gallus Gallus)
  misc_feature (36): n=a or g
agaaagcgttttctggcatcatgtaagcttctttcntgataaagcacattacaaaaattacagaagcagtc

SEQ ID NO: 3578 - DNA, 71 bp, chicken (Gallus Gallus)
  misc_feature (36): n=a or g
atggaagccagccacttgtccttgcagcaaagaacncatccagcatcccaggctgtgttaggaagaatccc

SEQ ID NO: 3579 - DNA, 71 bp, chicken (Gallus Gallus)
  misc_feature (36): n=c or t
aactacttcaaagctcctttacatgtacacctgagngacttgctggcccagccctcctcttcaccttgaga

SEQ ID NO: 3580 - DNA, 71 bp, chicken (Gallus Gallus)
  misc_feature (36): n=c or t
acacttactgtagcttactatctcctttttagtagncagataataaagtattaattgtgaaagtgggaaat

SEQ ID NO: 3581 - DNA, 71 bp, chicken (Gallus Gallus)
  misc_feature (36): n=a or g
ttttatttcaataaaacatattctctgtgctagagncttaaagcctcagctgtatcctataagtttattcc

SEQ ID NO: 3582 - DNA, 71 bp, chicken (Gallus Gallus)
  misc_feature (36): n=c or t
caggaaccaccacaaatgcattagtatatatttcanagcaaacatctagtatgttcacgtgcccactggta

SEQ ID NO: 3583 - DNA, 71 bp, chicken (Gallus Gallus)
  misc_feature (36): n=g or t
tatggcatatgttatttaagctccttccttgcctantccactcacaatgactacaaaccacaggcatctcc

SEQ ID NO: 3584 - DNA, 71 bp, chicken (Gallus Gallus)
  misc_feature (36): n=c or t
aactcaaagcaatgcctctcaacagctgcagcactngagacccaaggatggccacgcaggagccccagtgt

SEQ ID NO: 3585 - DNA, 71 bp, chicken (Gallus Gallus)
  misc_feature (36): n=c or t
agctcattccaactcatcccggtggcttccgcaganctcacaccagtaggtgatcaagccctgcatgcaag

SEQ ID NO: 3586 - DNA, 71 bp, chicken (Gallus Gallus)
  misc_feature (36): n=c or t
tttatggccaaatacttctccataactgaatgccangtagggcacagacaagcagcaaagcagtggtaagc

SEQ ID NO: 3587 - DNA, 71 bp, chicken (Gallus Gallus)
  misc_feature (36): n=a or g
acagcccacctctgccatcacatccccatggcacantgcctaagtgatgtggttcagctgtgaaccagttc

SEQ ID NO: 3588 - DNA, 71 bp, chicken (Gallus Gallus)
  misc_feature (36): n=c or t
cacacacagcactgccagtctttctcaaaaacatanccttcaattttaacaggtattcacaaccctatata

SEQ ID NO: 3589 - DNA, 71 bp, chicken (Gallus Gallus)
  misc_feature (36): n=c or t
ggaagtttgatgtgtgggtgagggcttgcaaaatgngcagcagctctttcatatggcatttctgtaacaca

SEQ ID NO: 3590 - DNA, 71 bp, chicken (Gallus Gallus)
  misc_feature (36): n=c or t
gggacagcttgaggccatcctaagtgatgatgggcntgtgcttctcaccaaggggaaacgagccacccaac

SEQ ID NO: 3591 - DNA, 71 bp, chicken (Gallus Gallus)
  misc_feature (36): n=c or t
gcacagttctcagccgtgctttgcagaacagaaagntcactttgtagttaggcttcgtgcaggccctcctg

SEQ ID NO: 3592 - DNA, 71 bp, chicken (Gallus Gallus)
  misc_feature (36): n=c or t
agcaaggagtctttgtagtgcgcgagagagatgatnaccactgcgggtccgatgaggttcatagtgcgccc

SEQ ID NO: 3593 - DNA, 71 bp, chicken (Gallus Gallus)
  misc_feature (36): n=a or g
agaagcggatttacctgtttaggtgatattatcttngctttaattccttttatcttggattaaaaaaaaaa

SEQ ID NO: 3594 - DNA, 71 bp, chicken (Gallus Gallus)
  misc_feature (36): n=a or g
tatggctctgtcttatagaaaacctgacagcacccnctgctgtctcacagaagctgcattgcttgagtaaa

SEQ ID NO: 3595 - DNA, 71 bp, chicken (Gallus Gallus)
  misc_feature (36): n=a or g
ctgaagcccttagcagtgcttgactaccacaccgcnactgtccattctgtgtccttctcagaccacaaaag

SEQ ID NO: 3596 - DNA, 71 bp, chicken (Gallus Gallus)
  misc_feature (36): n=g or t
aggaatggcccagacctccctttcttagcactgctncttggccccataaaaagggatcattaacaaaaatc

SEQ ID NO: 3597 - DNA, 71 bp, chicken (Gallus Gallus)
  misc_feature (36): n=c or t
cacaaaccagcagtacagctctgtgccttatgactngtattttcagggtctgataccttgaacccaaaatc

SEQ ID NO: 3598 - DNA, 71 bp, chicken (Gallus Gallus)
  misc_feature (36): n=a or g
tgaaacttctcagctgttccctcacgaacggtcagnagtggcgctgcctggtcctacagttaatgtcaaac

SEQ ID NO: 3599 - DNA, 71 bp, chicken (Gallus Gallus)
  misc_feature (36): n=c or t
ggcagcatgttgaaagagaaacagaagtagcattcntgtatcttatcttgaggaaaagaaccactgaaaaa

SEQ ID NO: 3600 - DNA, 71 bp, chicken (Gallus Gallus)
  misc_feature (36): n=g or t
cagcttgctaattattgaagccatcttgtcctgagnctagaaataaaaaatggaatagtcccagtatgaga

SEQ ID NO: 3601 - DNA, 71 bp, chicken (Gallus Gallus)
  misc_feature (36): n=c or t
cccatctgttaacacctcttttattatcctgtgcanttctcaagtcaatgactgccatccacattcccttc

SEQ ID NO: 3602 - DNA, 71 bp, chicken (Gallus Gallus)
  misc_feature (36): n=c or t
acagaaaagctttgccaaaatctctgttacatgaangcaatgaagtaactcaactctcagttgtggatccc

SEQ ID NO: 3603 - DNA, 71 bp, chicken (Gallus Gallus)
  misc_feature (36): n=g or t
cattcttcagtagttatgagttcagattgatcactnatatgataaatatgaatatctagcttgtgcatcat

SEQ ID NO: 3604 - DNA, 71 bp, chicken (Gallus Gallus)
  misc_feature (36): n=a or g
ctgttcagactacgagctgtgtgaacacgcatgganaacaactagatatctaacatgtatacaagaagaac

SEQ ID NO: 3605 - DNA, 71 bp, chicken (Gallus Gallus)
  misc_feature (36): n=c or t
tctcttccacacattccattttttgtcctacctctngtttgtgtgcttgtttatttgttttctactgatag

SEQ ID NO: 3606 - DNA, 71 bp, chicken (Gallus Gallus)
  misc_feature (36): n=a or g
ttacaaaggaagtgaggtatctttgtaagggtatcnaaaggcgatgaaacacgtttcccatctgaattcca

SEQ ID NO: 3607 - DNA, 71 bp, chicken (Gallus Gallus)
  misc_feature (36): n=a or g
ttttctcagtctccattctctgaacttacctgagtnatgattgatatactttctgaaacagggaaacatat

SEQ ID NO: 3608 - DNA, 71 bp, chicken (Gallus Gallus)
  misc_feature (36): n=g or t
ataaggtgaacttcccctgtatgcaatagagagaangaaacttctagggggtgatttatcatcctgtggag

SEQ ID NO: 3609 - DNA, 71 bp, chicken (Gallus Gallus)
  misc_feature (36): n=c or t
catctcaccacagcctggagcacatcaccctgcatnggaggcaactgcagctcatacatccatgctttgtt

SEQ ID NO: 3610 - DNA, 71 bp, chicken (Gallus Gallus)
  misc_feature (36): n=a or g
gatgctagcagtattcacagcaaagttactcatgtntgtaaattaatactgcattgagcctttaaacaata

SEQ ID NO: 3611 - DNA, 71 bp, chicken (Gallus Gallus)
  misc_feature (36): n=a or g
ctccagcatatgttgtcatcacagcttgcagaactngatcctcatagcaaggcttaaatctctttgcataa

SEQ ID NO: 3612 - DNA, 71 bp, chicken (Gallus Gallus)
  misc_feature (36): n=c or t
gaacctgcagaaatgtgcttggtatgtatgggtatnggctcccagcagcgagatccaggagctgctgctga

SEQ ID NO: 3613 - DNA, 71 bp, chicken (Gallus Gallus)
  misc_feature (36): n=a or g
ccatgtgttggagtgctgcagctgtggggctggggnaaaggactcacttccccacgagttcctcagaagtg

SEQ ID NO: 3614 - DNA, 71 bp, chicken (Gallus Gallus)
  misc_feature (36): n=a or g
ctcagatccaactgacagttcatgcacactaaagcngagctgacttcccagacaggtggtggtcctgcttc

SEQ ID NO: 3615 - DNA, 71 bp, chicken (Gallus Gallus)
  misc_feature (36): n=a or g
gtggcttttttttttttctagatatgcatcacactnaactaaaacaaggaccaactggtgcagtctggggg

SEQ ID NO: 3616 - DNA, 71 bp, chicken (Gallus Gallus)
  misc_feature (36): n=a or g
aaccttctcacgacttttcatttttacacaacaccnagaaggttcacaaaggactaaatgaggccgagcaa

SEQ ID NO: 3617 - DNA, 71 bp, chicken (Gallus Gallus)
  misc_feature (36): n=a or g
cccaagacagattgcctcaaagtcttccttaaaacnttaactaaactagtcaatatagcaggtttagtgct

SEQ ID NO: 3618 - DNA, 71 bp, chicken (Gallus Gallus)
  misc_feature (36): n=g or t
gacagccttccctccctcctactgtccacctgcatnaaagtatttgctcagtgcattgccagtattacaag

SEQ ID NO: 3619 - DNA, 71 bp, chicken (Gallus Gallus)
  misc_feature (36): n=a or g
agcactgtcctcatggacatttgtgaggccatgggntgaccattgggtaaccatcgtgggaacagggaggg

SEQ ID NO: 3620 - DNA, 71 bp, chicken (Gallus Gallus)
  misc_feature (36): n=c or t
cacacagatttgcacaaacaacgtggctctttcatngtgcatccttgttgtctttgatttgggtggtggcg

SEQ ID NO: 3621 - DNA, 71 bp, chicken (Gallus Gallus)
  misc_feature (36): n=a or g
acctgaaggttgggaacctcactcttcctcattganagagttttgcttttggtttgctttgaggcttggtc

SEQ ID NO: 3622 - DNA, 71 bp, chicken (Gallus Gallus)
  misc_feature (36): n=c or t
aaatgaaacgatgacagacaattaactttccactcnatgctagcagctgtgtaggctctgctttagagcag

SEQ ID NO: 3623 - DNA, 71 bp, chicken (Gallus Gallus)
  misc_feature (36): n=a or g
aaagcaatacccttataaggagagccaccctacacnccagagccctagagatggtctgggtggagacttcc

SEQ ID NO: 3624 - DNA, 71 bp, chicken (Gallus Gallus)
  misc_feature (36): n=a or g
agaaaaaaaataatttcttttgttcaagtcagggcngccacaaaagtcccaaatctgttggagatgtccga

SEQ ID NO: 3625 - DNA, 71 bp, chicken (Gallus Gallus)
  misc_feature (36): n=a or g
gtggcagttactagaatgacttcttgtgtccaccanaaaagacagtgcaggtgctcagggtaacagctggc

SEQ ID NO: 3626 - DNA, 71 bp, chicken (Gallus Gallus)
  misc_feature (36): n=c or t
gccctcagcgtgaaggattcctccttacttccaacncaaatctcccctctttgagtctgaaaccacttccc

SEQ ID NO: 3627 - DNA, 71 bp, chicken (Gallus Gallus)
  misc_feature (36): n=a or g
tggtgctatgtagctaacacgtgcaaatgaaatganagacacagtctcgtgtttgtggagatgtccttaat

SEQ ID NO: 3628 - DNA, 71 bp, chicken (Gallus Gallus)
  misc_feature (36): n=a or g
gcgcttagcctggcacagagacagacattcataacntacaaaggaggaaaccactttctccatactccgaa

SEQ ID NO: 3629 - DNA, 71 bp, chicken (Gallus Gallus)
  misc_feature (36): n=a or g
taaaaaccaacagtgctacacactgctgttctaacntcttgtctgctgcctaagtggaagtagaaatccag

SEQ ID NO: 3630 - DNA, 71 bp, chicken (Gallus Gallus)
  misc_feature (36): n=c or t
gaggagttcaggaaacggaacttcagagctcagagncatgaagctttctataaaggccctgaggagatcag

SEQ ID NO: 3631 - DNA, 71 bp, chicken (Gallus Gallus)
  misc_feature (36): n=a or g
aaatgctgaactgtgcatccgcagctgctcttttcnaatagcatggcagaggtgcctcagaaactgagatc

SEQ ID NO: 3632 - DNA, 71 bp, chicken (Gallus Gallus)
  misc_feature (36): n=c or t
tatatatatgaggctgaattaaagctccatttaacntcatcctcttgtcttccctcactagttgcagtctt

SEQ ID NO: 3633 - DNA, 71 bp, chicken (Gallus Gallus)
  misc_feature (36): n=a or g
agaagcagcagaatctctcaaagggaatctgcttcntggcttcctctctcaaggcattatttcacgatggt

SEQ ID NO: 3634 - DNA, 71 bp, chicken (Gallus Gallus)
  misc_feature (36): n=a or g
gacagcacttcatgtctagtcaggctggagcccgcngagctttaagagtgaaacagcctgatcaaaccaga

SEQ ID NO: 3635 - DNA, 71 bp, chicken (Gallus Gallus)
  misc_feature (36): n=a or g
gtgacatctgtaccactgagtcagcctaccctctanggctaccacttcccatccttcttcatcagctaacc

SEQ ID NO: 3636 - DNA, 71 bp, chicken (Gallus Gallus)
  misc_feature (36): n=a or g
ggcagcaagacttcccgcacaacaaccatggagtcnagttatgtgaagagatcagacagtaagagcttttg

SEQ ID NO: 3637 - DNA, 71 bp, chicken (Gallus Gallus)
  misc_feature (36): n=a or g
taaggataactgcagctggagatgcaatacctaccngagggattcacttcaatgaagcagcactggtttga

SEQ ID NO: 3638 - DNA, 71 bp, chicken (Gallus Gallus)
  misc_feature (36): n=c or t
tgctacttttatcagaagtttttcttatctgctccnagcaaggaatcccacacacatcatctcatagctcc

SEQ ID NO: 3639 - DNA, 71 bp, chicken (Gallus Gallus)
  misc_feature (36): n=a or g
tccacctggcatctccacttcctacaggagagggcntctcacctgctatggctcacaaactcattactgca

SEQ ID NO: 3640 - DNA, 71 bp, chicken (Gallus Gallus)
  misc_feature (36): n=g or t
cagctgggtgttgagctttcatacaggactgatctncacagtgggaggaagactggagaaaacctttgggg

SEQ ID NO: 3641 - DNA, 71 bp, chicken (Gallus Gallus)
  misc_feature (36): n=a or t
tgtcttgctagttggcattggctcagggtggaagangatgatgactgctccttcgtggaggaggaagtgct

SEQ ID NO: 3642 - DNA, 71 bp, chicken (Gallus Gallus)
  misc_feature (36): n=c or t
tgtaagaaaatccagcattctctaagaagagtgtgntttctaaagttaatgaggccaacaaattctggccc

SEQ ID NO: 3643 - DNA, 71 bp, chicken (Gallus Gallus)
  misc_feature (36): n=c or g
caaaaatcagatatgttttcatctgttcattcttantctgttgttattacctggaaatgactgttttttca

SEQ ID NO: 3644 - DNA, 71 bp, chicken (Gallus Gallus)
  misc_feature (36): n=a or g
acatctgaggggtgaaagagagcaactgaatgttancaagaaatttctgtttcctgctgatagctctttcc

SEQ ID NO: 3645 - DNA, 71 bp, chicken (Gallus Gallus)
  misc_feature (36): n=c or t
ttgtccctatgcaagaacatgagtaactaatactanaaaatacagtatataaataaatgacacaaatagga

SEQ ID NO: 3646 - DNA, 71 bp, chicken (Gallus Gallus)
  misc_feature (36): n=a or c
caaaagtggagggcgacgtctgtagtggtgaacacnagtgggtctgccagaaagaacctttacgtctctat

SEQ ID NO: 3647 - DNA, 71 bp, chicken (Gallus Gallus)
  misc_feature (36): n=a or g
agtgaaaggcacatgggaaatcacagcaacaaatgnacagggctgcccatgcgctccctcagagctcagct

SEQ ID NO: 3648 - DNA, 71 bp, chicken (Gallus Gallus)
  misc_feature (36): n=c or t
cacagagctgctttccaggcaggctattatcactgngcaggcagctcatttatttgccgagaattctaatt

SEQ ID NO: 3649 - DNA, 71 bp, chicken (Gallus Gallus)
  misc_feature (36): n=a or g
ttatgaagaatcactgagttgcaaaaataggaaacngtgctcattccttgggctcccaccattcattcacc

SEQ ID NO: 3650 - DNA, 71 bp, chicken (Gallus Gallus)
  misc_feature (36): n=c or t
gcctgggcaccacaaaagcttcccttgtcctgccangaagtgccattattcaaaaaacttctgggtgaaac

SEQ ID NO: 3651 - DNA, 71 bp, chicken (Gallus Gallus)
  misc_feature (36): n=a or g
acgcagctttggagagagatgagggcaccaatggcngaagatggctctcctagcaaacagagcatcacctg

SEQ ID NO: 3652 - DNA, 71 bp, chicken (Gallus Gallus)
  misc_feature (36): n=c or t
gcctcttacatgcagctgccagaaggttccttccancatttcttcttggctgggcaaggcaggaccaaggg

SEQ ID NO: 3653 - DNA, 71 bp, chicken (Gallus Gallus)
  misc_feature (36): n=a or g
gctgtatggaaggccaaaataccaaagggcgcagangtctttgcgtagaggcgatgtcagtcttgatgtga

SEQ ID NO: 3654 - DNA, 71 bp, chicken (Gallus Gallus)
  misc_feature (36): n=c or t
gaaggcacagccgcaccttgccagggcaagcatcantgcaaaaatatttgctaagaaaagtgcagctccac

SEQ ID NO: 3655 - DNA, 71 bp, chicken (Gallus Gallus)
  misc_feature (36): n=a or g
gactaaagtactatttattatttacttcaaagcaancttcacaaaagacgtgtctattacatgaagaaact

SEQ ID NO: 3656 - DNA, 71 bp, chicken (Gallus Gallus)
  misc_feature (36): n=c or t
cagggcttggtcttgcaacttagccaaaggaaactncttacaggatgaaaagagcttctgctcagctgata

SEQ ID NO: 3657 - DNA, 71 bp, chicken (Gallus Gallus)
  misc_feature (36): n=a or c
tgggaaggtcaatttcctgccatgggaaagcctggnagcttgggctgagaaaccatagaatcatagaatgg

SEQ ID NO: 3658 - DNA, 71 bp, chicken (Gallus Gallus)
  misc_feature (36): n=c or t
tctttggtgttagcagtccggttgtgttcactgtantgagctgtcacagctatggatgtacgtgtatgcca

SEQ ID NO: 3659 - DNA, 71 bp, chicken (Gallus Gallus)
  misc_feature (36): n=c or t
ttctgtgattctatgaagttagcagctgaatcttgngacttgaggaccaagatcccatagagagccggagg

SEQ ID NO: 3660 - DNA, 71 bp, chicken (Gallus Gallus)
  misc_feature (36): n=a or g
acaaagaaatagcttggactgaggaccacttctagngagaaattgacttgaatattttgtttttcccttag

SEQ ID NO: 3661 - DNA, 71 bp, chicken (Gallus Gallus)
  misc_feature (36): n=a or c
tcattgcaacccaaaataataaataaaatatcaganacatttattctaacctgactgatgttcccctcaga

SEQ ID NO: 3662 - DNA, 71 bp, chicken (Gallus Gallus)
  misc_feature (36): n=c or t
agaaagcgtaactccaaagcacagcgttggacatcnctgctctgctcttcattatttcacactgtaacatc

SEQ ID NO: 3663 - DNA, 71 bp, chicken (Gallus Gallus)
  misc_feature (36): n=g or t
aggactcagtgcccttcctgcttcattatcagctcngaaagggctcttagcaatttctgctctcctcgttg

SEQ ID NO: 3664 - DNA, 71 bp, chicken (Gallus Gallus)
  misc_feature (36): n=c or t
cccacaactgtcagtggagaagagaggaaaacacancagagagagagaaaaggtcagtaatttgttcacca

SEQ ID NO: 3665 - DNA, 71 bp, chicken (Gallus Gallus)
  misc_feature (36): n=g or t
catttgctcacattcattcttcaagctctaacaagncaagggcaccatttgagtccatctcgattttcaca

SEQ ID NO: 3666 - DNA, 71 bp, chicken (Gallus Gallus)
  misc_feature (36): n=a or g
acaagtgggaaagctgctgtcaacgagcaactgccngagttttctcctttttgtcagggctgtccaccaga

SEQ ID NO: 3667 - DNA, 71 bp, chicken (Gallus Gallus)
  misc_feature (36): n=a or c
aaagctgcccagctggtgagagctcccctataagtntgtaacagacgaaagataggagagtttggggctcc

SEQ ID NO: 3668 - DNA, 71 bp, chicken (Gallus Gallus)
  misc_feature (36): n=c or t
tttacatgcctaattcccttatgcttttttgaggangccaaacattaacaaattatgtgagatgacagcag

SEQ ID NO: 3669 - DNA, 71 bp, chicken (Gallus Gallus)
  misc_feature (36): n=c or t
tcttgtgcagctatgattgcaagaatctgaatttangcatttcaagcaagtttgatgtctgcagctgcact

SEQ ID NO: 3670 - DNA, 71 bp, chicken (Gallus Gallus)
  misc_feature (36): n=c or t
tctgcccttccaggctgaggtgtgtgttcagccagngctatccaaaccagcacagagattaattcctcccc

SEQ ID NO: 3671 - DNA, 71 bp, chicken (Gallus Gallus)
  misc_feature (36): n=c or t
atgaaggtttcttccaattttgggtgcagagttttncatttcttccctgtacagctaaaaacgcaagccaa

SEQ ID NO: 3672 - DNA, 71 bp, chicken (Gallus Gallus)
  misc_feature (36): n=a or c
ggtgtggatgcctgtccaactggatggccttgcagnatctaccactgtaaggaccttgattgcctggtaga

SEQ ID NO: 3673 - DNA, 71 bp, chicken (Gallus Gallus)
  misc_feature (36): n=c or t
acaagcttacaagggcagcatcatctccttggtgcncaacctgtatggaagtcagagccctaaagactatt

SEQ ID NO: 3674 - DNA, 71 bp, chicken (Gallus Gallus)
  misc_feature (36): n=c or g
atctggcggctccgtgcaggtatcagggtagctaanatgctgcaataagttggatctcaagtgacgaggga

SEQ ID NO: 3675 - DNA, 71 bp, chicken (Gallus Gallus)
  misc_feature (36): n=a or c
gctgtgcaaggtaactctaagtgtcttgccaaaggntggaacgcaattcccattcactgggagggaccagc

SEQ ID NO: 3676 - DNA, 71 bp, chicken (Gallus Gallus)
  misc_feature (36): n=c or t
ggagctgtcctctcaccaacctctctgcacacccanctcctttactctgagctcggtgatgtgcacgagca

SEQ ID NO: 3677 - DNA, 71 bp, chicken (Gallus Gallus)
  misc_feature (36): n=c or t
gaagtatctggttatgtgcttaccccgtagtatatnggaagcggtactctagacagaccttgtacacacta

SEQ ID NO: 3678 - DNA, 71 bp, chicken (Gallus Gallus)
  misc_feature (36): n=a or g
aatgctaggaaagtagaaaatggaaaacttcaaatnacctaacaactgccttcagttatgacaacaacttc

SEQ ID NO: 3679 - DNA, 71 bp, chicken (Gallus Gallus)
  misc_feature (36): n=a or g
ctggatgcaaagaaatgggctggaacgagcactctncaaagctaagtagccagccctgtccattcacctgc

SEQ ID NO: 3680 - DNA, 71 bp, chicken (Gallus Gallus)
  misc_feature (36): n=a or g
tgctttttgggcacaggctgtgtcacagcctgggcngcagttagtccactgacagcttgatctcagttgga

SEQ ID NO: 3681 - DNA, 71 bp, chicken (Gallus Gallus)
  misc_feature (36): n=a or g
aaagtaatccaaagattatatttgccctcctcacanttaacatttgagactggatattaaagattctcctt

SEQ ID NO: 3682 - DNA, 71 bp, chicken (Gallus Gallus)
  misc_feature (36): n=c or t
caactcatctcagcttatcctctcagctgtgttgcnctatatttgcagtgggctaccaggttgcatgaagt

SEQ ID NO: 3683 - DNA, 71 bp, chicken (Gallus Gallus)
  misc_feature (36): n=c or t
aagcacttaggtgagtgcagcaaaggtgaactcaangcactgattttaatttggaagagaaatgaactgta

SEQ ID NO: 3684 - DNA, 71 bp, chicken (Gallus Gallus)
  misc_feature (36): n=c or t
agggggattaattagcgttcttctgcagccaccaantcttaacaaatgcagcgcaaagagtatcattttcc

SEQ ID NO: 3685 - DNA, 71 bp, chicken (Gallus Gallus)
  misc_feature (36): n=a or g
atcccatcccataccattccattccatcccaaaatncacattcccacccaacctccaggacaaatcacata

SEQ ID NO: 3686 - DNA, 71 bp, chicken (Gallus Gallus)
  misc_feature (36): n=a or g
ccttgccaaaggtttcagctttctattcaggcaccntcaccccaccccgtttcttttggtttaaaaacaaa

SEQ ID NO: 3687 - DNA, 71 bp, chicken (Gallus Gallus)
  misc_feature (36): n=c or t
actcctcacacaaaaccaatctagatacctgatgtntttgaagtgttttctcacttcatataatttttcct

SEQ ID NO: 3688 - DNA, 71 bp, chicken (Gallus Gallus)
  misc_feature (36): n=a or g
tcctaagaaaagttagcagggatgctccatgacacntctgcatcagcagcatgatcaggtaacagaaatcc

SEQ ID NO: 3689 - DNA, 71 bp, chicken (Gallus Gallus)
  misc_feature (36): n=c or t
attccccagcacagaaactaccagagcagtttcgangagtttccagagtagctgtaaaaactttttgctgt

SEQ ID NO: 3690 - DNA, 71 bp, chicken (Gallus Gallus)
  misc_feature (36): n=a or g
aagccatgacaatatgatgcctatgtttgtcaaggncttttcttgcacacttaagtcttgactctttttct

SEQ ID NO: 3691 - DNA, 71 bp, chicken (Gallus Gallus)
  misc_feature (36): n=c or g
gtggggctgattttaggctgctgtgccacgtgactnttgttcccagggcctcccttgctgcagcaggtaga

SEQ ID NO: 3692 - DNA, 71 bp, chicken (Gallus Gallus)
  misc_feature (36): n=a or g
acaataaattcacatgtactctgcctatctaatacngaagaaacacctactacctaatattcaaaaaggat

SEQ ID NO: 3693 - DNA, 71 bp, chicken (Gallus Gallus)
  misc_feature (36): n=a or g
gcttctttgaagacctgagtggaaaactgggaacantgcttcatctttgtatatcagcattttcagttttc

SEQ ID NO: 3694 - DNA, 71 bp, chicken (Gallus Gallus)
  misc_feature (36): n=a or g
gtaccttgtgtgacctggtgatcagtgatggttctngatgttggtattaaagaaagaataaaatgctacag

SEQ ID NO: 3695 - DNA, 71 bp, chicken (Gallus Gallus)
  misc_feature (36): n=a or c
ttctttctcttcaacattctccagcaggtcagtccnaccaaggaacttgtgtgctcgtttcagcctcccag

SEQ ID NO: 3696 - DNA, 71 bp, chicken (Gallus Gallus)
  misc_feature (36): n=a or c
cacgctgctcagcagtgcctctggccaatacaaagngcaaccactttgccccacatcaaagcatgagttca

SEQ ID NO: 3697 - DNA, 71 bp, chicken (Gallus Gallus)
  misc_feature (36): n=a or g
tgcctagcttctgccttgtaattgctgtcacagtancactgtggcttggatattgtttgtatccctgcagt

SEQ ID NO: 3698 - DNA, 71 bp, chicken (Gallus Gallus)
  misc_feature (36): n=a or g
gctttaggaatacaagctttccagtttagttccagnctcagtactgctactgacatgttagtcatgtttac

SEQ ID NO: 3699 - DNA, 71 bp, chicken (Gallus Gallus)
  misc_feature (36): n=a or g
tcctttgagctccctttcaccttagacctttccatntctccagatgctgtcaaatccctggatgcgggcag

SEQ ID NO: 3700 - DNA, 71 bp, chicken (Gallus Gallus)
  misc_feature (36): n=c or t
taatttccgtaggttagtttatcagctattgactgnactcagcaatacctcatgtataccgccttaaacat

SEQ ID NO: 3701 - DNA, 71 bp, chicken (Gallus Gallus)
  misc_feature (36): n=a or g
acaagaaatctggaagtcagcacatgctgagaagantctgccatttctgatgagtaaatattcagagatct

SEQ ID NO: 3702 - DNA, 71 bp, chicken (Gallus Gallus)
  misc_feature (36): n=a or g
ttagatagccttaaacttccagatgaaccaaggagnaagctcatctggaaggactggagtatggacgaaca

SEQ ID NO: 3703 - DNA, 71 bp, chicken (Gallus Gallus)
  misc_feature (36): n=a or g
tatgttcttagctgttattactagctttaataaaangcaaaaagctagctgtaatcacgagtgttcttcca

SEQ ID NO: 3704 - DNA, 71 bp, chicken (Gallus Gallus)
  misc_feature (36): n=c or t
ttaagcaccactgctggggcatctaactagatcacnagccaggaagttattggaaagccacagttaagaaa

SEQ ID NO: 3705 - DNA, 71 bp, chicken (Gallus Gallus)
  misc_feature (36): n=c or t
attcctctttttccattcaagttaaggcaggtggantcttcatctactgtagagccccacaggagtagctg

SEQ ID NO: 3706 - DNA, 71 bp, chicken (Gallus Gallus)
  misc_feature (36): n=a or g
gtttgttattgagctgagagtcccttgggacccacncagtaagtaagcagtaaaatcatccaacaatgcct

SEQ ID NO: 3707 - DNA, 71 bp, chicken (Gallus Gallus)
  misc_feature (36): n=a or c
gtgactattacagaattttgtttttctagtagtacnttcgtattacaaggaaatttataccctaggtacag

SEQ ID NO: 3708 - DNA, 71 bp, chicken (Gallus Gallus)
  misc_feature (36): n=c or t
actaatcctatgtgtggattttctgtgcagccaacnggagccgctctgttactgggccatctgcacatttg

SEQ ID NO: 3709 - DNA, 71 bp, chicken (Gallus Gallus)
  misc_feature (36): n=c or t
ttttaaaaactagaagccctgaaaattcatctaaangtacagcacagagagacaaaattctgtttgtgttg

SEQ ID NO: 3710 - DNA, 71 bp, chicken (Gallus Gallus)
  misc_feature (36): n=a or g
ctaatatctgactgaattaaacatcaggttgcaggncatattcaaagaggacctgcattccagtcttcgct

SEQ ID NO: 3711 - DNA, 71 bp, chicken (Gallus Gallus)
  misc_feature (36): n=a or g
acatgggtgaagcctaagactcaaataccaaacttnatgaaaaaagggagcagtgacgcttggaggctgga

SEQ ID NO: 3712 - DNA, 71 bp, chicken (Gallus Gallus)
  misc_feature (36): n=c or t
ttaaagtacattcaatttgaaaattaagttatacanagctaacaaatctactgtatctagtctataatttg

SEQ ID NO: 3713 - DNA, 71 bp, chicken (Gallus Gallus)
  misc_feature (36): n=c or t
tgttgtgggtaactataccctgtatttggctcagangaaggtgctggacttccatcagttcactctcgcca

SEQ ID NO: 3714 - DNA, 71 bp, chicken (Gallus Gallus)
  misc_feature (36): n=c or t
cagatacactaatgaaaaaaatgttcccttcccagngacaaagcttccagctctccctgggcacgctgctt

SEQ ID NO: 3715 - DNA, 71 bp, chicken (Gallus Gallus)
  misc_feature (36): n=c or t
tcaagtaatgtgcaaggtttgactgaaccagcgagncctgcactgctgcactggtgtgagcttgctcctgt

SEQ ID NO: 3716 - DNA, 71 bp, chicken (Gallus Gallus)
  misc_feature (36): n=c or t
gttctgcacaaaacagggtctcacacttccaagcanagctcacagcacgaggggaacccacagttgatggc

SEQ ID NO: 3717 - DNA, 71 bp, chicken (Gallus Gallus)
  misc_feature (36): n=a or g
aaacttgagaatttttggaggagctattcaggctgngtaacttagcaagtcgtgtcattttgctccttggt

SEQ ID NO: 3718 - DNA, 71 bp, chicken (Gallus Gallus)
  misc_feature (36): n=c or t
ccgaacccaaaaaggtagattacccgacaagtaatnagaagttccctaaccacttcttatggcaaaggaat

SEQ ID NO: 3719 - DNA, 71 bp, chicken (Gallus Gallus)
  misc_feature (36): n=a or g
aggcacacacaagctgtacctccaaatctactcatntccaaccaagaggctgagtgaacgagaggccattt

SEQ ID NO: 3720 - DNA, 71 bp, chicken (Gallus Gallus)
  misc_feature (36): n=c or t
cagccctggcacaggagaggaaatgctcttgggaanagcaagaagattggccaaaaagctgaccctgggga

SEQ ID NO: 3721 - DNA, 71 bp, chicken (Gallus Gallus)
  misc_feature (36): n=c or t
atgatcgagagggaatttcctctactccattccacnccaccccactcatttgctttcatgcttgatctatc

SEQ ID NO: 3722 - DNA, 71 bp, chicken (Gallus Gallus)
  misc_feature (36): n=a or g
ctggggagcccacagagctgcccatagtgcaggctntaggcattgatccttcagccagaagtcatttcctc

SEQ ID NO: 3723 - DNA, 71 bp, chicken (Gallus Gallus)
  misc_feature (36): n=c or t
tttctgggagcagcgctgtagctaaatagaagctcntgggttcaggatgtagcaagcaaactcaatgacct

SEQ ID NO: 3724 - DNA, 71 bp, chicken (Gallus Gallus)
  misc_feature (36): n=c or t
agcaaacatcagagcattcccttccattcagaccanggcagaaaaacaaagcatcagctcagggtcataga

SEQ ID NO: 3725 - DNA, 71 bp, chicken (Gallus Gallus)
  misc_feature (36): n=a or g
ctggatgtgctctgaattattagattttaatggtcntttttgctgtttccattgcatgactaagctgtgct

SEQ ID NO: 3726 - DNA, 71 bp, chicken (Gallus Gallus)
  misc_feature (36): n=c or g
ttcacatattttaataaaaggtctttccttacgatnggaccggggcagacgtgctgccccatggcacagac

SEQ ID NO: 3727 - DNA, 71 bp, chicken (Gallus Gallus)
  misc_feature (36): n=a or c
ccagaatccctacagcctccaccaggagtttcctgnaagtcaagaattgccatttcagtcaagaggaaatt

SEQ ID NO: 3728 - DNA, 71 bp, chicken (Gallus Gallus)
  misc_feature (36): n=a or g
tgattttttgctctgagacactgtagctgcatcttnaatgtaggaaagaaacaatggagggcatttagcaa

SEQ ID NO: 3729 - DNA, 71 bp, chicken (Gallus Gallus)
  misc_feature (36): n=a or g
atgaaaaaggaattgtatgattagggcttatgactntttctatcctgattgtctacagagtctcctattca

SEQ ID NO: 3730 - DNA, 71 bp, chicken (Gallus Gallus)
  misc_feature (36): n=c or t
aaaaaaaaaaacctgtgcttttctgcttgtatagtntgctttctattgcaggcaggaggtatcacagttaa

SEQ ID NO: 3731 - DNA, 71 bp, chicken (Gallus Gallus)
  misc_feature (36): n=a or g
tggaatgcttaaactgaatctgccatccgctcctcngcccatgaagccgccttggaagcaaggaggtggtt

SEQ ID NO: 3732 - DNA, 71 bp, chicken (Gallus Gallus)
  misc_feature (36): n=a or g
ttggttgcatacccgtgcccttcaaaccaaaggctngtgctgctttgcgcagagctgatgctaagcatgtt

SEQ ID NO: 3733 - DNA, 71 bp, chicken (Gallus Gallus)
  misc_feature (36): n=c or t
cttcatttcagctcacaacaggttgcagttgaatgnttcagtctgccatgatctgctttgaaatttccagt

SEQ ID NO: 3734 - DNA, 71 bp, chicken (Gallus Gallus)
  misc_feature (36): n=a or c
gcgctcttttttgatcttaactataataaaaaaaancaagttattattcagctccgaaaaggattcaaaga

SEQ ID NO: 3735 - DNA, 71 bp, chicken (Gallus Gallus)
  misc_feature (36): n=a or g
ctctacaaaataactgaaattacaaaatcacctccngtaactgagcaatgttaaacttctgtacctgagtg

SEQ ID NO: 3736 - DNA, 71 bp, chicken (Gallus Gallus)
  misc_feature (36): n=a or c
ttgtgactggggagagaaaacacttcaatggatgtnatttaaatttagaaggcacttaaagagggggctta

SEQ ID NO: 3737 - DNA, 71 bp, chicken (Gallus Gallus)
  misc_feature (36): n=c or t
ttcctacctgccctacccaagtattgtgttggatanttatcttactgctgtctctaaaactgtgcaagcaa

SEQ ID NO: 3738 - DNA, 71 bp, chicken (Gallus Gallus)
  misc_feature (36): n=a or g
aggtattcagaagggggaaatgggaatcctcttatnttcaaacagcttattgcttaggttttttaatcagt

SEQ ID NO: 3739 - DNA, 71 bp, chicken (Gallus Gallus)
  misc_feature (36): n=c or t
agtcatttgcattctgtgtctgcataactcacctgnatcatctgcacctgcctcatccatgccccttgtac

SEQ ID NO: 3740 - DNA, 71 bp, chicken (Gallus Gallus)
  misc_feature (36): n=a or g
agcttaggtatatatagccagtcaaaactggctacnctccactaggaacttttcaaatagggcaatgatct

SEQ ID NO: 3741 - DNA, 71 bp, chicken (Gallus Gallus)
  misc_feature (36): n=a or g
cgttcctatttttaccaacatgccttggtgagcccngtgtaggaccgactatcgtagcacacttctacagc

SEQ ID NO: 3742 - DNA, 71 bp, chicken (Gallus Gallus)
  misc_feature (36): n=c or t
gtgccgtctttctcagtctcctctcagatttacaanttttgcccacgacaggctggcaacaaagcgaggct

SEQ ID NO: 3743 - DNA, 71 bp, chicken (Gallus Gallus)
  misc_feature (36): n=a or t
attacatgctctgattttttatgtttattttttgangctccgtgtatataaattcacacttagtcatggcc

SEQ ID NO: 3744 - DNA, 71 bp, chicken (Gallus Gallus)
  misc_feature (36): n=c or t
aacaaaatgtcaccatctctgagggctgatggaaangagcctgcatttccaaagggggaatggaagcgatg

SEQ ID NO: 3745 - DNA, 71 bp, chicken (Gallus Gallus)
  misc_feature (36): n=c or t
cactgcagcgcactgcacagagccttgcacacagangtttacgcacatagcacatggagtgctgcacagct

SEQ ID NO: 3746 - DNA, 71 bp, chicken (Gallus Gallus)
  misc_feature (36): n=a or g
cctattctgctgattcagctcattctgccacctcancgtgccactctccaggatgctgtcgtaccaaatca

SEQ ID NO: 3747 - DNA, 71 bp, chicken (Gallus Gallus)
  misc_feature (36): n=c or t
ctgtttccacggtgatggccataacagagatgtttngttgagcttggcacagccaacaagttgaggagctg

SEQ ID NO: 3748 - DNA, 71 bp, chicken (Gallus Gallus)
  misc_feature (36): n=c or t
caaaccagctgtttcagagagtttcccaaatacttngtgtttcctaatactggggggacttcaggtggtaa

SEQ ID NO: 3749 - DNA, 71 bp, chicken (Gallus Gallus)
  misc_feature (36): n=a or g
ttgccagggatggaggagagttaagctggaaacccnttctgagcaatgtttcttccaggaacctgccacgg

SEQ ID NO: 3750 - DNA, 71 bp, chicken (Gallus Gallus)
  misc_feature (36): n=c or t
tggatgtgctgggagcatgttatctatcttatgtanaaaacacataagagttcagcaagctccattagttt

SEQ ID NO: 3751 - DNA, 71 bp, chicken (Gallus Gallus)
  misc_feature (36): n=a or c
aggggcaaaaatcagataaatagatgctgtttctcntgttcccttcctagggtggatgtctgtagtcagct

SEQ ID NO: 3752 - DNA, 71 bp, chicken (Gallus Gallus)
  misc_feature (36): n=c or t
gagctctttcctccctctgagcttccaccaggcccnttggtaacatgaaagaccagtctgagtgggcatgt

SEQ ID NO: 3753 - DNA, 71 bp, chicken (Gallus Gallus)
  misc_feature (36): n=c or t
tccttagtccctgcagtaactgcttaacttcaccangtgaagagaagcagtaatgctgaagcctgctttct

SEQ ID NO: 3754 - DNA, 71 bp, chicken (Gallus Gallus)
  misc_feature (36): n=c or t
cagcagcgtgtgaagcaggatcgtctcctgtgcttnttggctcaagattgggatttttaagaagaatttct

SEQ ID NO: 3755 - DNA, 71 bp, chicken (Gallus Gallus)
  misc_feature (36): n=c or t
tttcttcttgtccaggaatgtgctaaatctccatcngaaatgacactgccattcattagagagatttcggc

SEQ ID NO: 3756 - DNA, 71 bp, chicken (Gallus Gallus)
  misc_feature (36): n=a or g
caatgcctgtttcagacaagatggataggatataangagagagaaagctgcaggacacatccttagtcaga

SEQ ID NO: 3757 - DNA, 71 bp, chicken (Gallus Gallus)
  misc_feature (36): n=c or t
agctgcctggtgtcttgcagcttctgctgacaagtntggatttgcagtattaaccctgcatgagaggtaac

SEQ ID NO: 3758 - DNA, 71 bp, chicken (Gallus Gallus)
  misc_feature (36): n=a or g
cagtgtcaaggtagtgaatagagctgggaaaattgntctgggatccttaccccagccactgaacagtaccc

SEQ ID NO: 3759 - DNA, 71 bp, chicken (Gallus Gallus)
  misc_feature (36): n=g or t
gagcatttgttgcagaatttggggaagaaggttatngactgagcatgctcggttctgctgtgcctctcatc

SEQ ID NO: 3760 - DNA, 71 bp, chicken (Gallus Gallus)
  misc_feature (36): n=a or g
ccagtggtgttggaggtgcccaccgtgaaaatcaancgtctgttccaggccaccttcaggagctccaggac

SEQ ID NO: 3761 - DNA, 71 bp, chicken (Gallus Gallus)
  misc_feature (36): n=a or g
tgctgatggaggagctctgggtttcatatgtgctcnttcaggtgactccttttagtttgtcttgtgctgaa

SEQ ID NO: 3762 - DNA, 71 bp, chicken (Gallus Gallus)
  misc_feature (36): n=c or t
agtggaatctgcctcagtagggattggagctcatgnaggctccacaagaacccatgaccagaaacaggaac

SEQ ID NO: 3763 - DNA, 71 bp, chicken (Gallus Gallus)
  misc_feature (36): n=a or g
caacccttctgaacttcagctcttgagctgctatgnaaggtccaattccaaccgtttaggctgatggccaa

SEQ ID NO: 3764 - DNA, 71 bp, chicken (Gallus Gallus)
  misc_feature (36): n=c or t
tcgaccacggggtggactcagctctcctacccaaantgaagacagtgtgccctctgtgccgcaaagtccga

SEQ ID NO: 3765 - DNA, 71 bp, chicken (Gallus Gallus)
  misc_feature (36): n=c or t
tccagtcttttttgtcggggctgatgtgacattccnattcagagatccccattggtctgaaccttaagcag

SEQ ID NO: 3766 - DNA, 71 bp, chicken (Gallus Gallus)
  misc_feature (36): n=c or t
ctgtcggagcccatctggcaccacttcttaccaaanacagaaggcacatgttatgcaattaccatataatg

SEQ ID NO: 3767 - DNA, 71 bp, chicken (Gallus Gallus)
  misc_feature (36): n=c or t
aaggaatgcgtatggggagggaggaggggactctcnatgtgaaagatgtgagctctcccaggagagagaaa

SEQ ID NO: 3768 - DNA, 71 bp, chicken (Gallus Gallus)
  misc_feature (36): n=a or g
ccttgttgcgttaacctcagtgtgttttatctccantatccacgctgacagggaactgacaccgactgcag

SEQ ID NO: 3769 - DNA, 71 bp, chicken (Gallus Gallus)
  misc_feature (36): n=c or t
ctttccatacgtttaaaattcagcattattcaaaangggggaaaactttttaacatcaactttgaactaaa

SEQ ID NO: 3770 - DNA, 71 bp, chicken (Gallus Gallus)
  misc_feature (36): n=a or g
acaaagctggttcagtcctaaagctcagagttcccnaagcaagcagactgcccctgaaaatgtgctctttc

SEQ ID NO: 3771 - DNA, 71 bp, chicken (Gallus Gallus)
  misc_feature (36): n=g or t
cctaaagtgcttaactattttagatcaatgataccnggctctaaaatcttctatgtgttttaccatgcaaa

SEQ ID NO: 3772 - DNA, 71 bp, chicken (Gallus Gallus)
  misc_feature (36): n=c or t
aaattggttagcttaacgcaatacttgagcgacctnggcagacctttggtgaggctgttgtgtgcgctgtg

SEQ ID NO: 3773 - DNA, 71 bp, chicken (Gallus Gallus)
  misc_feature (36): n=c or t
tgcagagcaagcccagcttgttgcatgcaaatggcnggataagtcactgcctgcaagcaggaaccacttta

SEQ ID NO: 3774 - DNA, 71 bp, chicken (Gallus Gallus)
  misc_feature (36): n=g or t
ctgtctgtccatgctaaagaagatagagaagaacanatgagggtcttggaacacggtcaaaagcaacaaag

SEQ ID NO: 3775 - DNA, 71 bp, chicken (Gallus Gallus)
  misc_feature (36): n=a or c
gattagggggtagaagagcacaggtaagactatganaggaaggttaccctctagctttccaggctgtagga

SEQ ID NO: 3776 - DNA, 71 bp, chicken (Gallus Gallus)
  misc_feature (36): n=a or c
gaaatgcagtgccctccctcctcgtactccttcctnaaagtgtcagctttcaaaggagatagcacatgccc

SEQ ID NO: 3777 - DNA, 71 bp, chicken (Gallus Gallus)
  misc_feature (36): n=g or t
gatttctgctctatgtaggtcaggtacaccaaactnaatttttgttgttacagagcctgtagcaatgaggt

SEQ ID NO: 3778 - DNA, 71 bp, chicken (Gallus Gallus)
  misc_feature (36): n=c or t
tatcctagaaagcagggtcttaacaatcccagcccnacagcctttcttgaagcaaggaaaggggccctgtg

SEQ ID NO: 3779 - DNA, 71 bp, chicken (Gallus Gallus)
  misc_feature (36): n=a or g
agccatgtgtggcagccctgggcagaggcggctgcnatgccaggatccagcagaacaagtttgggagccac

SEQ ID NO: 3780 - DNA, 71 bp, chicken (Gallus Gallus)
  misc_feature (36): n=g or t
tgtgaggggttccccacgaggggttccccaggaggngcacggtgtgcttctagaaacactgccttcttgtg

SEQ ID NO: 3781 - DNA, 71 bp, chicken (Gallus Gallus)
  misc_feature (36): n=a or g
aaaccatttcctctgcttcctactggctaaagcacntgggtacacgaggctgcacggcaagagtttagcaa

SEQ ID NO: 3782 - DNA, 71 bp, chicken (Gallus Gallus)
  misc_feature (36): n=c or t
cagcagcatataactgcataaggttttgctggttgnactacatctattgggtgcagaatttggatttctat

SEQ ID NO: 3783 - DNA, 71 bp, chicken (Gallus Gallus)
  misc_feature (36): n=a or c
aaagatggaaaatcagtgctgaaaaacgtaccagtncatcctccaagcagaagttctcagagtgtttctct

SEQ ID NO: 3784 - DNA, 71 bp, chicken (Gallus Gallus)
  misc_feature (36): n=a or g
tcagagttcacaaaaaaatgttttctttttatcccntgattctttccattccctttctctttgttcatcac

SEQ ID NO: 3785 - DNA, 71 bp, chicken (Gallus Gallus)
  misc_feature (36): n=a or g
atgaaggaaattgggctgcaggtggggataagctgncatacaccagtagccttcctttgggaaggcagcag

SEQ ID NO: 3786 - DNA, 71 bp, chicken (Gallus Gallus)
  misc_feature (36): n=a or g
gaaaaattaacataaaagctattgctcccagcaaantagtggcctcattttggatcttgtgtctacccgat

SEQ ID NO: 3787 - DNA, 71 bp, chicken (Gallus Gallus)
  misc_feature (36): n=c or t
gtaaagatggtattggtgagctgtgacctgtccgancctttgaacaacattcttgagactgaatctatgtc

SEQ ID NO: 3788 - DNA, 71 bp, chicken (Gallus Gallus)
  misc_feature (36): n=c or t
taatttcacccaaaggtgttcaaatgctgggccctnggttcagacagcttgtgggatattcatcactggag

SEQ ID NO: 3789 - DNA, 71 bp, chicken (Gallus Gallus)
  misc_feature (36): n=c or t
tgaaaaatgtcagaggacttggctgtttgtcccacnatgtttgcatcaagatatccagagggccttgctta

SEQ ID NO: 3790 - DNA, 71 bp, chicken (Gallus Gallus)
  misc_feature (36): n=a or g
taagctaagctgtcgaggaagaaggaaggagtaatncaatcattttattctagtgtggggtcagtgcttct

SEQ ID NO: 3791 - DNA, 71 bp, chicken (Gallus Gallus)
  misc_feature (36): n=a or g
attgcattttatcttaagtcccaaatctgtgatctntttgcccattattcatctgatcacgatggcctgct

SEQ ID NO: 3792 - DNA, 71 bp, chicken (Gallus Gallus)
  misc_feature (36): n=a or g
tcctgaaaaatctgttttctggaatgaagttcaagntaacagactttccagctccatgtcagatctgtgca

SEQ ID NO: 3793 - DNA, 71 bp, chicken (Gallus Gallus)
  misc_feature (36): n=c or t
gaatcaacctttgtacagcttcttctttactctgangttgctttgctgattgttttgtctctctcagagcc

SEQ ID NO: 3794 - DNA, 71 bp, chicken (Gallus Gallus)
  misc_feature (36): n=g or t
tgtcctgtccaacagctacaaaccaggtaaagacanaaacacttctatatactctgggtatacacatgcac

SEQ ID NO: 3795 - DNA, 71 bp, chicken (Gallus Gallus)
  misc_feature (36): n=a or c
tggggggcttgacgctgcattttagctcagtgcctnaatccacctgaatgtctgtgcccttccagcagaac

SEQ ID NO: 3796 - DNA, 71 bp, chicken (Gallus Gallus)
  misc_feature (36): n=c or t
cttgaggcagctgttgtatgtctgtaccaaaaatanattttaaatattgaaatgctggaataaataatata

SEQ ID NO: 3797 - DNA, 71 bp, chicken (Gallus Gallus)
  misc_feature (36): n=a or g
aggtgcagctaaacggctgtgtagccacacaatgancacattagacaacgctgcacgttttaagtttgggg

SEQ ID NO: 3798 - DNA, 71 bp, chicken (Gallus Gallus)
  misc_feature (36): n=a or g
ggacaaatccctgcagctgacttcctagacagcacntgactccaagcatttgttttcattaggaaacaact

SEQ ID NO: 3799 - DNA, 71 bp, chicken (Gallus Gallus)
  misc_feature (36): n=a or g
gaggccttccagtacctgaagggagcttatacacangtggcagagtgactttttgcgtggatagacagcaa

SEQ ID NO: 3800 - DNA, 71 bp, chicken (Gallus Gallus)
  misc_feature (36): n=a or g
gaaagctgtttgggatacctgatggctcacaaagcnttaggaatggcccttgtttcagccgaggttggctc

SEQ ID NO: 3801 - DNA, 71 bp, chicken (Gallus Gallus)
  misc_feature (36): n=c or t
aaggagaggcatggcaatatcgtaaaaattatccanagtacaatatgactaatgttgtgtgaaatgcattc

SEQ ID NO: 3802 - DNA, 71 bp, chicken (Gallus Gallus)
  misc_feature (36): n=c or t
gtatttgttaatttgccacaggaaattaaacattanggtggtattaaagactcctcagctctaggtgctta

SEQ ID NO: 3803 - DNA, 71 bp, chicken (Gallus Gallus)
  misc_feature (36): n=a or c
atgactgctcttctgtttgggtgagctgaatgaacnatctctcttaccctgtgtatacaaaggggaggtgg

SEQ ID NO: 3804 - DNA, 71 bp, chicken (Gallus Gallus)
  misc_feature (36): n=a or g
agtgaacaaaagctgaagcagtatagacaaggacangcatatgtgctattctccttcaagcatatacactg

SEQ ID NO: 3805 - DNA, 71 bp, chicken (Gallus Gallus)
  misc_feature (36): n=a or g
aagaagccaattgtaggtgctgagcaggagaagagntctgcagacaagcttttgagtgcgctatgttggac

SEQ ID NO: 3806 - DNA, 71 bp, chicken (Gallus Gallus)
  misc_feature (36): n=c or t
ttcaggaagctgttggagtccatggctgcattgtangtgggaatgctgctcaggggaatcatcaccttggg

SEQ ID NO: 3807 - DNA, 71 bp, chicken (Gallus Gallus)
  misc_feature (36): n=a or g
tttattgaggagcaaagcttgggatcaccttcagcnccgcacagatgagcagggcaaagctcccagcacgc

SEQ ID NO: 3808 - DNA, 71 bp, chicken (Gallus Gallus)
  misc_feature (36): n=a or g
aggagcggtgctgagagcttctgttatttactctgngtgctgtggtgtcctgtgattagaaaccagtaaat

SEQ ID NO: 3809 - DNA, 71 bp, chicken (Gallus Gallus)
  misc_feature (36): n=c or t
tacatacaagctgatggggaagctgccaactgctangtgcctcgtagaatgggaactaaccttctcaggga

SEQ ID NO: 3810 - DNA, 71 bp, chicken (Gallus Gallus)
  misc_feature (36): n=c or t
aaaatatttttgatcacagtgtacaaaactagaccnagtttctttctttggcaagaagttgatttactgct

SEQ ID NO: 3811 - DNA, 71 bp, chicken (Gallus Gallus)
  misc_feature (36): n=c or t
gtcactttccggccattccaagaaagaaatcaagantcacaggacatgcactgggtcactgcatgttccca

SEQ ID NO: 3812 - DNA, 71 bp, chicken (Gallus Gallus)
  misc_feature (36): n=c or t
aggcagcttctctccaatcacctacagagaaacacnggaataggttgcacatctgtgagcagatattgatg

SEQ ID NO: 3813 - DNA, 71 bp, chicken (Gallus Gallus)
  misc_feature (36): n=a or g
ggactgtggtgatcctgagttgagtggtgtgtgacntggtaggaagaagactgctcttcactgaagcagtg

SEQ ID NO: 3814 - DNA, 71 bp, chicken (Gallus Gallus)
  misc_feature (36): n=a or c
ccagtctcaggcagttacagtgagtcagacccatanacttgcataagggatgacccagaaatgtttaagat

SEQ ID NO: 3815 - DNA, 71 bp, chicken (Gallus Gallus)
  misc_feature (36): n=a or g
gacagtgtctccttcctcctttgcctgttaagtgangaaaaaaagtctgtttcagcctttaatatttcctc

SEQ ID NO: 3816 - DNA, 71 bp, chicken (Gallus Gallus)
  misc_feature (36): n=c or t
cttggtatataatttgttttatttttttcagagagngtaaaccattgtaattctataagcagagaatgagt

SEQ ID NO: 3817 - DNA, 71 bp, chicken (Gallus Gallus)
  misc_feature (36): n=c or t
actttacttcattttccattttgtaacttgctcacntcctgatgaatgccaggagaaatgtcataattctt

SEQ ID NO: 3818 - DNA, 71 bp, chicken (Gallus Gallus)
  misc_feature (36): n=a or c
tgatctgaaaatgagaataactcagtttttctaagnctttccaagggagttggtgtgtctgggaattctac

SEQ ID NO: 3819 - DNA, 71 bp, chicken (Gallus Gallus)
  misc_feature (36): n=a or g
gtgctgtaaatcatattttcagctgaggtcaccgcntgtaagccttcatggtcaaataatcatacagttta

SEQ ID NO: 3820 - DNA, 71 bp, chicken (Gallus Gallus)
  misc_feature (36): n=a or g
tattagtgtgttatgttctataaatatcttatgatnttgctacattatgacatggataagctcactgtttt

SEQ ID NO: 3821 - DNA, 71 bp, chicken (Gallus Gallus)
  misc_feature (36): n=c or t
ttacatcatgcacactttaggagtcatgcttcaagncctggagttcaaactatgcctcttgcgtagatgac

SEQ ID NO: 3822 - DNA, 71 bp, chicken (Gallus Gallus)
  misc_feature (36): n=c or t
ctcttgagggaagatctgtcttgagagcaaatccantttcttataggtgtgggtcaggcccttcacaacaa

SEQ ID NO: 3823 - DNA, 71 bp, chicken (Gallus Gallus)
  misc_feature (36): n=c or t
agatctgtcagagagtaaggaagtatctgtgacagnggcagcagcagctcccctgctcttgagagtgtctg

SEQ ID NO: 3824 - DNA, 71 bp, chicken (Gallus Gallus)
  misc_feature (36): n=a or g
ttctaacctggttatgaaggtaacccttgatggttnttttggctgcaggtactgcgtggagttccagctcg

SEQ ID NO: 3825 - DNA, 71 bp, chicken (Gallus Gallus)
  misc_feature (36): n=c or t
ccccagatcaaatcaaacctcagcataaaatgctcngagctagctcttgcattcccagaggataatttcta

SEQ ID NO: 3826 - DNA, 71 bp, chicken (Gallus Gallus)
  misc_feature (36): n=a or g
gcttcaggtcaaggtgaacaatgtgcacctccacanacatgactttcctgatatgttgtaataccacttta

SEQ ID NO: 3827 - DNA, 71 bp, chicken (Gallus Gallus)
  misc_feature (36): n=a or g
ctgccccaagttggaatagcagcattcctgcagacncatcggttgggtcatggatggcatggagctctcct

SEQ ID NO: 3828 - DNA, 71 bp, chicken (Gallus Gallus)
  misc_feature (36): n=c or t
aaagtgcaatttaattgttaagtattactacagaanatagaagcttccaagtgcctgcagcacaatatgct

SEQ ID NO: 3829 - DNA, 71 bp, chicken (Gallus Gallus)
  misc_feature (36): n=a or c
ggggaactctcctgttgcaggacttgcagggtaatncaaggaggaaggcagtcaatgctggattgtttgcc

SEQ ID NO: 3830 - DNA, 71 bp, chicken (Gallus Gallus)
  misc_feature (36): n=a or g
agtagatgcttagggctaaatgttgataacttatantcaagaacataataatagaattatttcctttaaat

SEQ ID NO: 3831 - DNA, 71 bp, chicken (Gallus Gallus)
  misc_feature (36): n=c or t
tagtttgcaaagacagaatagaatcccattcactangaattaaaggatatgggccaatacacctgtactgc

SEQ ID NO: 3832 - DNA, 71 bp, chicken (Gallus Gallus)
  misc_feature (36): n=a or g
gaaagggaaaggcaaagcttctcattcctagggctngtaactgtaaaaggggaatcaaaatcccaggtact

SEQ ID NO: 3833 - DNA, 71 bp, chicken (Gallus Gallus)
  misc_feature (36): n=a or c
tctttaggataaatctttttcaaaacagtgcaatgnaaggaatgaattaagatttttctgcacatcttact

SEQ ID NO: 3834 - DNA, 71 bp, chicken (Gallus Gallus)
  misc_feature (36): n=c or t
agatgttacaggacagttattcactttgagataaanaacaagaatttctggtgtaaccaagggaactcatt

SEQ ID NO: 3835 - DNA, 71 bp, chicken (Gallus Gallus)
  misc_feature (36): n=a or g
tacttgcaaacacaaaggtgttgataaatatgaaancagataatgttatgtgcatgatgcagctctgtgga

SEQ ID NO: 3836 - DNA, 71 bp, chicken (Gallus Gallus)
  misc_feature (36): n=a or g
tgagaggaggcttaacaactataatgacttccatcnaaatgacccagattgagagagaacctttaaagtgg

SEQ ID NO: 3837 - DNA, 71 bp, chicken (Gallus Gallus)
  misc_feature (36): n=c or t
ttgcttttgcggttgattaaaaaaagttgtattagngctaagatccctcggttaacaggtgatacgtggat

SEQ ID NO: 3838 - DNA, 71 bp, chicken (Gallus Gallus)
  misc_feature (36): n=a or g
ctcctgaactgaagcacttgtgcgtgaggaatgtgncagagtgagccatgccatcaaaccttgtccttttc

SEQ ID NO: 3839 - DNA, 71 bp, chicken (Gallus Gallus)
  misc_feature (36): n=a or g
acagtgagaggcatcatttcagagtcctttggtccnactaggtaggcccagccacagatgtggggccgtgc

SEQ ID NO: 3840 - DNA, 71 bp, chicken (Gallus Gallus)
  misc_feature (36): n=c or t
ctctgcatcatctgctccctcatggaactgccctgnaatcaatatcaatgtggtttttgtaccagtaaatt

SEQ ID NO: 3841 - DNA, 71 bp, chicken (Gallus Gallus)
  misc_feature (36): n=c or t
agagggagattctggacagaccctgcagcccacggngggcatagatctgagctgaattaaatatggatttg

SEQ ID NO: 3842 - DNA, 71 bp, chicken (Gallus Gallus)
  misc_feature (36): n=a or g
cagcaagacagaagctaaagagaagatttcatagcnctgtgacatgccaggtgctgtgctctcattcagca

SEQ ID NO: 3843 - DNA, 71 bp, chicken (Gallus Gallus)
  misc_feature (36): n=a or g
agcatcggtcactgctggcacttccacctcctcccnttctctggtaaataattacttccctccctcctata

SEQ ID NO: 3844 - DNA, 71 bp, chicken (Gallus Gallus)
  misc_feature (36): n=c or t
cattgcggttgcagtggacaaaatggaaagaagacngtaagaagaaatacaactcagaacccagatcctgc

SEQ ID NO: 3845 - DNA, 71 bp, chicken (Gallus Gallus)
  misc_feature (36): n=a or g
agttaattccaagaagtccaagaagggttaggatgntactgctgaatatagttgctgtaagtgcattaaag

SEQ ID NO: 3846 - DNA, 71 bp, chicken (Gallus Gallus)
  misc_feature (36): n=c or t
agaagagttgttcaccttgttctaattgcactgccntggatgggagctgcgcagttgtgagtgctgctgta

SEQ ID NO: 3847 - DNA, 71 bp, chicken (Gallus Gallus)
  misc_feature (36): n=a or g
cctttagtcattagcatcgtccaccagtttgcgccnttcttactcttagctccagctccttctctcttttc

SEQ ID NO: 3848 - DNA, 71 bp, chicken (Gallus Gallus)
  misc_feature (36): n=a or g
tgcgcaggggacctgcagaatcagagaagcattcanagaagttgctcaaggatcctgccctccatctgccc

SEQ ID NO: 3849 - DNA, 71 bp, chicken (Gallus Gallus)
  misc_feature (36): n=a or c
cttctcttttcccagaatttcctgccacgcctcagngtaggagcttagggttaataacaatgcaaaatgca

SEQ ID NO: 3850 - DNA, 71 bp, chicken (Gallus Gallus)
  misc_feature (36): n=c or t
gaggccccacagagtgctggaagtgtgggtctgttnattgaatgcgtgggagggcacctcagtcatcactc

SEQ ID NO: 3851 - DNA, 71 bp, chicken (Gallus Gallus)
  misc_feature (36): n=a or g
tgggggctttctgggagctccatgcttatccctgangggcaattctattgatttctgccaagatttaccct

SEQ ID NO: 3852 - DNA, 71 bp, chicken (Gallus Gallus)
  misc_feature (36): n=c or t
tctgtcaatatgaacactgtgttttggtgggctaangatccctgttgttcctagaaggactgagctgccct

SEQ ID NO: 3853 - DNA, 71 bp, chicken (Gallus Gallus)
  misc_feature (36): n=c or t
atcttagctgcaatagtgggctgagtgcataggatngctcccagaaataggtgctaatgtggtctgtgcag

SEQ ID NO: 3854 - DNA, 71 bp, chicken (Gallus Gallus)
  misc_feature (36): n=c or t
gaaacctgtgtgaaaattcatgttttaggacttaangggctttgaagagaaaaggctcttaacataagtgg

SEQ ID NO: 3855 - DNA, 71 bp, chicken (Gallus Gallus)
  misc_feature (36): n=c or t
aagaggaaaagccatttactcctcacttctctggangaagccagcccataatttttaataaagtctttgct

SEQ ID NO: 3856 - DNA, 71 bp, chicken (Gallus Gallus)
  misc_feature (36): n=a or g
atttggcacacaaaagctttcaggataccaaagacnaacaggaaaaggctctctgctttacttctgctcaa

SEQ ID NO: 3857 - DNA, 71 bp, chicken (Gallus Gallus)
  misc_feature (36): n=a or c
ctgcaagggtactgggcattgagatatggggtacanagctgtggggctggagacacaggggtacagggctg

SEQ ID NO: 3858 - DNA, 71 bp, chicken (Gallus Gallus)
  misc_feature (36): n=c or t
aactcaatcccttacacagctcctggttgttgtatnggcagcaaggggatgagtgagtgctcatcatggct

SEQ ID NO: 3859 - DNA, 71 bp, chicken (Gallus Gallus)
  misc_feature (36): n=a or c
tttgggcagcggtgctcctaagaacaatgctcttcnctgttgcagggcttgcgtgcaatcaaatccctctg

SEQ ID NO: 3860 - DNA, 71 bp, chicken (Gallus Gallus)
  misc_feature (36): n=c or t
gtgcctcagttttctatgttgtcagctgatcaggcntataaacttgactaaaaattggtcaaatgtgttta

SEQ ID NO: 3861 - DNA, 71 bp, chicken (Gallus Gallus)
  misc_feature (36): n=c or t
ccacagcctgagaacatcctctgcgtcgctgccacngggcacatggtgaagatcattgactttgggctggc

SEQ ID NO: 3862 - DNA, 71 bp, chicken (Gallus Gallus)
  misc_feature (36): n=a or g
gctgctggcagcttccacgtgatcaacaaaatcccnacaggtattttataagcaccattctttctagaagt

SEQ ID NO: 3863 - DNA, 71 bp, chicken (Gallus Gallus)
  misc_feature (36): n=c or t
cctaaaaatggctgaccaagagcaatctaaaatgantgctgatagtgttcttacatattattcagctatag

SEQ ID NO: 3864 - DNA, 71 bp, chicken (Gallus Gallus)
  misc_feature (36): n=c or t
gacatcatgatcatgttcggcagccaaggtgatgtnccggggctgtgtggggggtgggagcaggcacagcc

SEQ ID NO: 3865 - DNA, 71 bp, chicken (Gallus Gallus)
  misc_feature (36): n=a or g
aaagggcaacagtaagtgaacttggaactgcctgancactgcactaagtgctaagagcacttcagtcttta

SEQ ID NO: 3866 - DNA, 71 bp, chicken (Gallus Gallus)
  misc_feature (36): n=a or g
tcccagtgctgataaagcctgggatgcaggcaatcngagcacaggctcactgcagggagaaaaacaaaagg

SEQ ID NO: 3867 - DNA, 71 bp, chicken (Gallus Gallus)
  misc_feature (36): n=a or g
gaagggcaatgtggatctttaaaaagtggataaagntggagaagaacggagtgacggctctttaaaaatac

SEQ ID NO: 3868 - DNA, 71 bp, chicken (Gallus Gallus)
  misc_feature (36): n=c or t
aggtgaccagcaaggagagcttacacatgtactgcnttaaaacatgcattggaatggctgctgctgctgtt

SEQ ID NO: 3869 - DNA, 71 bp, chicken (Gallus Gallus)
  misc_feature (36): n=g or t
tgcttttgtggacctgtgtagaaattagtgtgtgtncttttgcattgttctccctgtataaaaaaaacaag

SEQ ID NO: 3870 - DNA, 71 bp, chicken (Gallus Gallus)
  misc_feature (36): n=c or t
tgatagctttgaaaaatatcctcatctgtcacaacngtgtattaaattctcatcagtgtgtgtacacagag

SEQ ID NO: 3871 - DNA, 71 bp, chicken (Gallus Gallus)
  misc_feature (36): n=c or g
gatccctatcaattcctagtgaaagggatctggatngtgtgagtaagaatcaaccagtctggcacaaaaga

SEQ ID NO: 3872 - DNA, 71 bp, chicken (Gallus Gallus)
  misc_feature (36): n=c or t
agttcaagcatttcctttcatccttcagtgtctttngccttttccttccacatttctctgtgccagacact

SEQ ID NO: 3873 - DNA, 71 bp, chicken (Gallus Gallus)
  misc_feature (36): n=a or g
tcacacacacaaaagacgactaaccttacaaagtanaacgtggaatcagacagcagaagataggaatcatt

SEQ ID NO: 3874 - DNA, 71 bp, chicken (Gallus Gallus)
  misc_feature (36): n=a or g
tgaagtagattagagaaccaaagtgacttaaatagncttagcaataaggggaagtgaggtcactgatctac

SEQ ID NO: 3875 - DNA, 71 bp, chicken (Gallus Gallus)
  misc_feature (36): n=a or g
aaaagtgttttccctcaggtcctagaagcactaatntgtacttagctaatttaaatgaataataaaactgc

SEQ ID NO: 3876 - DNA, 71 bp, chicken (Gallus Gallus)
  misc_feature (36): n=c or t
gctgctcctcagctgcaaggaggcagagttgccaangaaaagatttaagaaacctgggaagcagctctcca

SEQ ID NO: 3877 - DNA, 71 bp, chicken (Gallus Gallus)
  misc_feature (36): n=a or g
tcggatgaggtggctgggtaccacttcagataaatnttaagtagaacaataaacttaatagctcttctgaa

SEQ ID NO: 3878 - DNA, 71 bp, chicken (Gallus Gallus)
  misc_feature (36): n=g or t
aactttatatagttactgacaggtaggagaggcacngcctgtcctatgtgtcactcagtctccatggatgc

SEQ ID NO: 3879 - DNA, 71 bp, chicken (Gallus Gallus)
  misc_feature (36): n=a or g
atcatgttccaaggttgcttagattatgaaaatgangtaatatgggtagacgatgagatgagcatgaattt

SEQ ID NO: 3880 - DNA, 71 bp, chicken (Gallus Gallus)
  misc_feature (36): n=c or t
ctgctttgttcctccttccaccacagaccctgtgcngtgtttaattctgacccagcctttgcctctcgagg

SEQ ID NO: 3881 - DNA, 71 bp, chicken (Gallus Gallus)
  misc_feature (36): n=a or c
atacgtgctatgtttctgtttcctagctgtgactcngatttgattgctgctttctgttaatttcagtgggg

SEQ ID NO: 3882 - DNA, 71 bp, chicken (Gallus Gallus)
  misc_feature (36): n=a or g
tgtcagtcaagtcagagactcgatgtcacttgtgangacaatgggtcactcttgttcctctattctgaata

SEQ ID NO: 3883 - DNA, 71 bp, chicken (Gallus Gallus)
  misc_feature (36): n=a or g
agaacttcctatttaacagggaaacgtcggcacacnctttcatcttgtgtatgatgtttgatactgtagtg

SEQ ID NO: 3884 - DNA, 71 bp, chicken (Gallus Gallus)
  misc_feature (36): n=c or t
ttggaggtgacgacataaagaaacctaagggtacanaataaatatgtagctgttctttattaaaagcatta

SEQ ID NO: 3885 - DNA, 71 bp, chicken (Gallus Gallus)
  misc_feature (36): n=a or g
aatcatggctgaaactgtatctactacccatgttcntgtgttcctaatactgtagcaataccaaaacccag

SEQ ID NO: 3886 - DNA, 71 bp, chicken (Gallus Gallus)
  misc_feature (36): n=a or g
gggctgccccagccacacctggcctggggggtgggngggtttcctcctataaatgtgcctgctttccaggg

SEQ ID NO: 3887 - DNA, 71 bp, chicken (Gallus Gallus)
  misc_feature (36): n=c or t
atgggacctacgtgtaccaccgtgagtgattcctangggacagtcccctccttagcccaagtaaataaacc

SEQ ID NO: 3888 - DNA, 71 bp, chicken (Gallus Gallus)
  misc_feature (36): n=c or t
aacatatggatcctcggccaatcttgttttgttctngctaacatgtttgcaagcagtaatcattcttcaga

SEQ ID NO: 3889 - DNA, 71 bp, chicken (Gallus Gallus)
  misc_feature (36): n=c or g
gtaagttctcctggatttggaacaggtgacagaaanaagaaaaatacagaggcagaaaagagggtcttcag

SEQ ID NO: 3890 - DNA, 71 bp, chicken (Gallus Gallus)
  misc_feature (36): n=a or c
tgtttggaaaccacttaaagaactccacctactttnccaagctattttttttttccctcttagcaaaggcc

SEQ ID NO: 3891 - DNA, 71 bp, chicken (Gallus Gallus)
  misc_feature (36): n=c or t
gtgagtaagctccaagaaaacgttgaactgtagcanagcagaggacaccctctgtctcagcagaggtagga

SEQ ID NO: 3892 - DNA, 71 bp, chicken (Gallus Gallus)
  misc_feature (36): n=c or t
cataaaccatctgggaagctttaattctctgctttnaggaggagattgcatttcaccagccggagctgatt

SEQ ID NO: 3893 - DNA, 71 bp, chicken (Gallus Gallus)
  misc_feature (36): n=a or g
gatcagggccacggagaggctctgacaaattgcagnacacaaattgtcagcagcttgcaagccattggcaa

SEQ ID NO: 3894 - DNA, 71 bp, chicken (Gallus Gallus)
  misc_feature (36): n=c or t
aggtgctttgcttataatggaattgagctctgctgngtgagttttccctgtgcgttgctgtgtttgtcatg

SEQ ID NO: 3895 - DNA, 71 bp, chicken (Gallus Gallus)
  misc_feature (36): n=a or g
acacctctggggtcggtgactccaccacctccctgngcagccatttccattagttccttcccatcccagga

SEQ ID NO: 3896 - DNA, 71 bp, chicken (Gallus Gallus)
  misc_feature (36): n=c or t
tctgctctgttggtgctgtgctcagaaccacctgtncatccatcaccatccctgtgctgtgctcacatagc

SEQ ID NO: 3897 - DNA, 71 bp, chicken (Gallus Gallus)
  misc_feature (36): n=c or t
cataaatttcttactagtttatagctccttacattnaaatttaaagaatgtgtgtaaataattccaaggaa

SEQ ID NO: 3898 - DNA, 71 bp, chicken (Gallus Gallus)
  misc_feature (36): n=g or t
tgtggttacggcgcttgtgtcttgcagcttcgcttnttattggtatacgtggaactgaaaagcaaacagat

SEQ ID NO: 3899 - DNA, 71 bp, chicken (Gallus Gallus)
  misc_feature (36): n=c or t
cagccttcctgagagtctgtgggtctgtagcttggnggagtttcccacactctatggccaatcagagagat

SEQ ID NO: 3900 - DNA, 71 bp, chicken (Gallus Gallus)
  misc_feature (36): n=g or t
caaaaatgagtgccaggtcattgagttattgcaggnagaatttaagtcacgtgcaccctctgtcaaaataa

SEQ ID NO: 3901 - DNA, 71 bp, chicken (Gallus Gallus)
  misc_feature (36): n=a or g
attctgagctaattgatgcttcaataagagataccntgttaaataaactgcatccccgaaataaaacacat

SEQ ID NO: 3902 - DNA, 71 bp, chicken (Gallus Gallus)
  misc_feature (36): n=c or t
gaacaccttctgagtataacaaaaccagcatgctgnatttgcagagcagaataagccctaccaaacatagc

SEQ ID NO: 3903 - DNA, 71 bp, chicken (Gallus Gallus)
  misc_feature (36): n=g or t
gggtcttcaaaactgttattggataattcttaatanaattcttaaacattaggcaagtgaacaaatgactt

SEQ ID NO: 3904 - DNA, 71 bp, chicken (Gallus Gallus)
  misc_feature (36): n=c or t
gtaatctgtcactgttttgatgcagtggttttgaangtgtatactcaggtgtccattggcatcactcatag

SEQ ID NO: 3905 - DNA, 71 bp, chicken (Gallus Gallus)
  misc_feature (36): n=a or g
tagcccaaagctgaaagtcagtagctggggaggatnaaattctgacagatgttgctgccaggaaggattgc

SEQ ID NO: 3906 - DNA, 71 bp, chicken (Gallus Gallus)
  misc_feature (36): n=a or g
gatggagagccaggaaaacactaggcagagaaaagnctgaggatctgagctagggagagggcaatgattgt

SEQ ID NO: 3907 - DNA, 71 bp, chicken (Gallus Gallus)
  misc_feature (36): n=a or g
taagaaacagccacaggttaacagcaccaaagagcntgtgtagatatttgtattgctggcacagtgcagct

SEQ ID NO: 3908 - DNA, 71 bp, chicken (Gallus Gallus)
  misc_feature (36): n=g or t
tggtgtaacttagggagcagtttctaacaggagcancattgcttcgaggtgctcaaagtggtgtgttcatg

SEQ ID NO: 3909 - DNA, 71 bp, chicken (Gallus Gallus)
  misc_feature (36): n=a or g
ttacttctcccatgcctcacttgccttcccttgcanttttcctgccttatctacttaagctcgctggagct

SEQ ID NO: 3910 - DNA, 71 bp, chicken (Gallus Gallus)
  misc_feature (36): n=a or c
tgtttggggtgtgcttattcataaagaaagcgctgnctgagatggtaagccctgagatttgcctttaatca

SEQ ID NO: 3911 - DNA, 71 bp, chicken (Gallus Gallus)
  misc_feature (36): n=c or t
tcagtagctcttcctaggagctttgcctgctatttncatcatctctggaggaacatgagattcatgagatg

SEQ ID NO: 3912 - DNA, 71 bp, chicken (Gallus Gallus)
  misc_feature (36): n=c or t
tgatgctttgcacacctccagctcctggctctgaangttttggcactgctatgtaatgaatcctccaaaca

SEQ ID NO: 3913 - DNA, 71 bp, chicken (Gallus Gallus)
  misc_feature (36): n=c or t
ttactgcttcatctatcagaaaggaatacatatccngccatcagtccagcacagctgttacaacaattgga

SEQ ID NO: 3914 - DNA, 71 bp, chicken (Gallus Gallus)
  misc_feature (36): n=a or g
taccaggtaagtgatgggcagaaggaaggcatttgntactaaaagataatttgaagctcgtggtggatttc

SEQ ID NO: 3915 - DNA, 71 bp, chicken (Gallus Gallus)
  misc_feature (36): n=a or g
cacttacaccacgaagtgtaaacgctaacaagtcantgtagggctaactaatctctttgtcctcggggatt

SEQ ID NO: 3916 - DNA, 71 bp, chicken (Gallus Gallus)
  misc_feature (36): n=a or g
ctgccctaaaaatcatcgaggttctcatgggaaacnctctcagctcctgttgcacaggctgtggtgatggc

SEQ ID NO: 3917 - DNA, 71 bp, chicken (Gallus Gallus)
  misc_feature (36): n=c or t
tgagacagcatctagactggctcatgtctagacttngttttaaggactaaactacttcttcccgtgttgtt

SEQ ID NO: 3918 - DNA, 71 bp, chicken (Gallus Gallus)
  misc_feature (36): n=a or g
cattttgttccttaagaacagagtactttctgctcntcacatgtaagcttttcaaatgaggtaagctttgc

SEQ ID NO: 3919 - DNA, 71 bp, chicken (Gallus Gallus)
  misc_feature (36): n=a or c
tctaagtgagtgtcactgccaccagctgtcagagtnatctcttatctggccgctgttaatcttgaaattac

SEQ ID NO: 3920 - DNA, 71 bp, chicken (Gallus Gallus)
  misc_feature (36): n=a or g
cagctgtgccaggcagggctgtaattatgcagaacntactgtgaaacttatgcacacactcgcaattacat

SEQ ID NO: 3921 - DNA, 71 bp, chicken (Gallus Gallus)
  misc_feature (36): n=c or t
gagtaatgaagtcaaataaaagtgtgttaatgactnagcatctggggtttgtgaaatagtttgaggaaaag

SEQ ID NO: 3922 - DNA, 71 bp, chicken (Gallus Gallus)
  misc_feature (36): n=c or t
gattctttgcattgtgattaatgatttgttgctgcnctcacaaaaaggaatctgagcccagcccagctttg

SEQ ID NO: 3923 - DNA, 71 bp, chicken (Gallus Gallus)
  misc_feature (36): n=a or t
tgccgctccttctaaaatggattgaggtcaacgggngccttcgatagtcccaaatccgccatcaatgggtg

SEQ ID NO: 3924 - DNA, 71 bp, chicken (Gallus Gallus)
  misc_feature (36): n=c or t
acaatctattcccagctctgttttctatttaaagtnggcatgatggatgcttggagagatgctgtacgctc

SEQ ID NO: 3925 - DNA, 71 bp, chicken (Gallus Gallus)
  misc_feature (36): n=c or t
ttcttcacacagctgagaacatggttcatggtgtcnggaagatactgatcagctgcccacaagagagaaca

SEQ ID NO: 3926 - DNA, 71 bp, chicken (Gallus Gallus)
  misc_feature (36): n=c or t
atcactgatgggaaaggtccttaatgagaaactggntgttatttaggctggcactgaggacatgtgggtag

SEQ ID NO: 3927 - DNA, 71 bp, chicken (Gallus Gallus)
  misc_feature (36): n=g or t
gtaaactaaaggtgtgtttctttctaggtgaggaanctgtaggttctggcagcagagaatgtagacaggac

SEQ ID NO: 3928 - DNA, 71 bp, chicken (Gallus Gallus)
  misc_feature (36): n=a or g
tgcttgaggctgcacaatttaaaagctaaaccttanaactgggaaaaatgactgggaaaaaatgggaaata

SEQ ID NO: 3929 - DNA, 71 bp, chicken (Gallus Gallus)
  misc_feature (36): n=c or t
cccgctgtgacttcttggctagaggggagaaaagantggtgctgcccttctcctcctgccgacactccttg

SEQ ID NO: 3930 - DNA, 71 bp, chicken (Gallus Gallus)
  misc_feature (36): n=a or t
tttgtgccactttgacactgcactgagttccacctntcccagaaacttacactgagtacattttttttcca

SEQ ID NO: 3931 - DNA, 71 bp, chicken (Gallus Gallus)
  misc_feature (36): n=a or g
cacgatgttgatccatcttcatgtttgtatttgccnctgctagcttgcatgagatacaggagaagtccctt

SEQ ID NO: 3932 - DNA, 71 bp, chicken (Gallus Gallus)
  misc_feature (36): n=c or t
ctgcaggagagcctggaagagctgaaagcaaaacangagcaagacctacagataaaaatcaatcagattat

SEQ ID NO: 3933 - DNA, 71 bp, chicken (Gallus Gallus)
  misc_feature (36): n=a or g
ctgctgaatttaataaagaactgatctcagctacantgaatgcttcatctagtagaaatagcagactggta

SEQ ID NO: 3934 - DNA, 71 bp, chicken (Gallus Gallus)
  misc_feature (36): n=a or g
aacaccctctgtcatggcagagcaaaaggctttaancagaaggaagttatgcaagtcttaattaaagctta

SEQ ID NO: 3935 - DNA, 71 bp, chicken (Gallus Gallus)
  misc_feature (36): n=a or g
aaacaaagcttggagcaatgtccttgttaaggaccnggcaaagtgctggaatggggcttccatggtgacgc

SEQ ID NO: 3936 - DNA, 71 bp, chicken (Gallus Gallus)
  misc_feature (36): n=a or c
caccccatgtccccaagcttttgccataagctatgngtgctatcatctcagatccctatcatcttgacgct

SEQ ID NO: 3937 - DNA, 71 bp, chicken (Gallus Gallus)
  misc_feature (36): n=a or g
taggattttatgatctgatcggctctttcaataagnggaaagcactgtagaagcccaacacttcccactta

SEQ ID NO: 3938 - DNA, 71 bp, chicken (Gallus Gallus)
  misc_feature (36): n=a or g
agagtgtaaagcactgaagtcatcccagtttgagancagtaagtatactgagacacataattaggagcctt

SEQ ID NO: 3939 - DNA, 71 bp, chicken (Gallus Gallus)
  misc_feature (36): n=a or g
tcagatgctgctatcgctaatcagcactgaacagcngcagaggatggcttaggaaggtcacactgcatgcc

SEQ ID NO: 3940 - DNA, 71 bp, chicken (Gallus Gallus)
  misc_feature (36): n=c or t
gggatggacgggttatgtatagggagagaaaccaangccccaaagtccagcccacagtaatgccttccctc

SEQ ID NO: 3941 - DNA, 71 bp, chicken (Gallus Gallus)
  misc_feature (36): n=c or t
gttacttagacaaaagctcaaataaagaacagaaanttgaagaagcccagtcaaaatagcacaggagcccg

SEQ ID NO: 3942 - DNA, 71 bp, chicken (Gallus Gallus)
  misc_feature (36): n=a or c
ccctcttaacatctgtggcttccctatttgtcctgncacatgcctgattcaccccacaagcatatctgtat

SEQ ID NO: 3943 - DNA, 71 bp, chicken (Gallus Gallus)
  misc_feature (36): n=c or t
actgtctaagtgatctctccatcgggaaattactanagacatactgagcagcaccgatggctggggagctc

SEQ ID NO: 3944 - DNA, 71 bp, chicken (Gallus Gallus)
  misc_feature (36): n=c or t
ttacgtccgtgtatcttgtacagcatatacatacanttaactaagtatgaaagatacggtttcagctgagc

SEQ ID NO: 3945 - DNA, 71 bp, chicken (Gallus Gallus)
  misc_feature (36): n=c or t
aaaaagcttaagatgaatttcggggaaagtttttantttcagggagagcattggttgggagcgtggtgtga

SEQ ID NO: 3946 - DNA, 71 bp, chicken (Gallus Gallus)
  misc_feature (36): n=a or g
ctgcagaaggagctgctgttgtcgctttaaatcctncctcccgcttcgcttttctttgttaagtactgcgt

SEQ ID NO: 3947 - DNA, 71 bp, chicken (Gallus Gallus)
  misc_feature (36): n=c or t
ccccaaccaaacactcagctttgtcagacaggagangcagatgctgctgtcgagcgtggtgggtgatggca

SEQ ID NO: 3948 - DNA, 71 bp, chicken (Gallus Gallus)
  misc_feature (36): n=a or t
aaccacgcctgcagcacggctctggccacagtggangaaatcagtgctggagaaatcttcagggattcaga

SEQ ID NO: 3949 - DNA, 71 bp, chicken (Gallus Gallus)
  misc_feature (36): n=c or t
gtgcttcataattccttctacttttcatttttgtgnttgaaactgcttctctttttcaacttcagctctgg

SEQ ID NO: 3950 - DNA, 71 bp, chicken (Gallus Gallus)
  misc_feature (36): n=c or t
actagctctgaggatgaatgcgagctgaaggagtantgcaatggcacctctggggcatgcgcacccaacct

SEQ ID NO: 3951 - DNA, 71 bp, chicken (Gallus Gallus)
  misc_feature (36): n=a or g
aacagcttaagtgacttctgtgcagtgtcagagagnacctctggtagagcagaatgttctgttaagttcag

SEQ ID NO: 3952 - DNA, 71 bp, chicken (Gallus Gallus)
  misc_feature (36): n=c or t
ctctaaaaatatgtcttaatatatattaacctcttntaggacttttggctctcaaacaaataatggaggat

SEQ ID NO: 3953 - DNA, 71 bp, chicken (Gallus Gallus)
  misc_feature (36): n=a or g
atcctgcactgccatccgtgcagatgggagcgtggngtgctgcaaactgtctgattctgacccaaaggagg

SEQ ID NO: 3954 - DNA, 71 bp, chicken (Gallus Gallus)
  misc_feature (36): n=a or c
cccatctcattttcctcatccttgtctctctgcaanccttctgtccccccaggttccgtgtgggcttcaag

SEQ ID NO: 3955 - DNA, 71 bp, chicken (Gallus Gallus)
  misc_feature (36): n=a or g
ttaagagcacctgtaacatctcactgatctgtaatnggtgcattttacttttacaagatcagtttataggt

SEQ ID NO: 3956 - DNA, 71 bp, chicken (Gallus Gallus)
  misc_feature (36): n=a or g
ctatgtccaaagcatttatagacatctatgaccaantaccctccgtgtgcttcactgataaggaaccacaa

SEQ ID NO: 3957 - DNA, 71 bp, chicken (Gallus Gallus)
  misc_feature (36): n=c or t
ctcctggaatatgtaggaaatgcatataatgaaccnggaattacatggcaatgatgtccagcttggtactg

SEQ ID NO: 3958 - DNA, 71 bp, chicken (Gallus Gallus)
  misc_feature (36): n=g or t
gagacacgcgtggacattgcaacgttggtgaacaangttccacgctgatgtggaatcgcatcttatctcag

SEQ ID NO: 3959 - DNA, 71 bp, chicken (Gallus Gallus)
  misc_feature (36): n=c or t
tgccattaacaaaatgaacagttcctttgttaggcngtaggataagaattatccatagatctttagctaga

SEQ ID NO: 3960 - DNA, 71 bp, chicken (Gallus Gallus)
  misc_feature (36): n=c or t
aaatctgtggttcctccaggctgtctgggggtgganttactggtatatctcttcttcaccaggctgcagat

SEQ ID NO: 3961 - DNA, 71 bp, chicken (Gallus Gallus)
  misc_feature (36): n=a or g
ctagagcaagttccctgtcactgtttttgagaaacnctatttttcaatgtaatcagcatgagctgtgtgtt

SEQ ID NO: 3962 - DNA, 71 bp, chicken (Gallus Gallus)
  misc_feature (36): n=g or t
tgactgagtttcagtcctcctaatgctgcttaatancctcacttccagggatggtttgagatggaagatcc

SEQ ID NO: 3963 - DNA, 71 bp, chicken (Gallus Gallus)
  misc_feature (36): n=a or g
gctttgtccccacagctctgtgtgccagggtgagcncttggagtggtatttctcatggtggatttattttc

SEQ ID NO: 3964 - DNA, 71 bp, chicken (Gallus Gallus)
  misc_feature (36): n=a or g
cttttttaattccagtgctcaataaaaaaggatgtnttgatctctgtgtatgagagctgtgggtatccgtg

SEQ ID NO: 3965 - DNA, 71 bp, chicken (Gallus Gallus)
  misc_feature (36): n=a or g
tgtctggaggaaggtgcttcgttgtggttgtacacngatgacttaaatctcgcttccacagatgctgctat

SEQ ID NO: 3966 - DNA, 71 bp, chicken (Gallus Gallus)
  misc_feature (36): n=a or g
agagagcaaagccacagctgaaacaactgttgcacncatacgtacaattactgcactaatgatgtttgaca

SEQ ID NO: 3967 - DNA, 71 bp, chicken (Gallus Gallus)
  misc_feature (36): n=a or g
taggtattataatgcaaacaacacccgttcaacgcngcacatgaaaagcagaactccttccaaattctcag

SEQ ID NO: 3968 - DNA, 71 bp, chicken (Gallus Gallus)
  misc_feature (36): n=a or g
aaagcgtttgtctccctctgatttctccacgtatcntcgcttctttttgtccctcctgtgttcctccgctg

SEQ ID NO: 3969 - DNA, 71 bp, chicken (Gallus Gallus)
  misc_feature (36): n=c or t
ttctctctcctgtttttcatatccaagtagtgtttngcgttctcgtcgttgttttgatgttcagctttcag

SEQ ID NO: 3970 - DNA, 71 bp, chicken (Gallus Gallus)
  misc_feature (36): n=c or t
atagcccatatcccggggagtgggtgaaagagcttntctctgcaaagggattttaattggttttaaaatgt

SEQ ID NO: 3971 - DNA, 71 bp, chicken (Gallus Gallus)
  misc_feature (36): n=a or g
agctgtcatggcaaacgtagctgtgtcattgcagcntcaggacagttacagagtggatatgactcagtgtc

SEQ ID NO: 3972 - DNA, 71 bp, chicken (Gallus Gallus)
  misc_feature (36): n=a or g
gaccacactactccttcttgaagggtgctggcagtnttctgcaggtgggacagcctcactagcttcactct

SEQ ID NO: 3973 - DNA, 71 bp, chicken (Gallus Gallus)
  misc_feature (36): n=a or g
catgaagagttttagcttgagggttcaggagaggcnagcctgctccagagaggagaaattagggcagggaa

SEQ ID NO: 3974 - DNA, 71 bp, chicken (Gallus Gallus)
  misc_feature (36): n=a or g
tcattaaagagtcaccatgagccttcagttgcctcnctggcagctctgattgtggctgtgttatcaccgtg

SEQ ID NO: 3975 - DNA, 71 bp, chicken (Gallus Gallus)
  misc_feature (36): n=a or g
tcaaggagaaaactacattgttcgtagaacagtganaaaggagagcttaactgggaatgctgggaagatct

SEQ ID NO: 3976 - DNA, 71 bp, chicken (Gallus Gallus)
  misc_feature (36): n=c or t
agatgggcatagactcacttgtacatgatatgaaancaaatctcaactgctcagatgttccagagcttcct

SEQ ID NO: 3977 - DNA, 71 bp, chicken (Gallus Gallus)
  misc_feature (36): n=c or t
cctccatgccatagaacttgccctctggtgtgtaanaaaagaagaatcacaggctagatcagatactttgg

SEQ ID NO: 3978 - DNA, 71 bp, chicken (Gallus Gallus)
  misc_feature (36): n=a or g
tgctggtaagtggaaaccagaggggagaagacagtnagtagaagtctgtcatggtttcaaagctgtacact

SEQ ID NO: 3979 - DNA, 71 bp, chicken (Gallus Gallus)
  misc_feature (36): n=a or c
acccgctaggattggcttgaaatattcaaccacgtntgaggagtttctactaagcctagaagtctgaaaat

SEQ ID NO: 3980 - DNA, 71 bp, chicken (Gallus Gallus)
  misc_feature (36): n=a or g
ccagcctgaggagatgtggatgagctgccaaatccngatagtagatcaggacagacagattccgttccctg

SEQ ID NO: 3981 - DNA, 71 bp, chicken (Gallus Gallus)
  misc_feature (36): n=a or g
aatgagaagtgagatggcaagatctgtttaaactcncagccatggagaaaagtgtttgagtaactccagac

SEQ ID NO: 3982 - DNA, 71 bp, chicken (Gallus Gallus)
  misc_feature (36): n=c or t
catttctcaggttacccttgctggatccatccatanaccaagtgtagagctataatatgatggaagcaaca

SEQ ID NO: 3983 - DNA, 71 bp, chicken (Gallus Gallus)
  misc_feature (36): n=c or t
ctccagcagaagcacaatgccagacaccaaattcangctgcagctgggagttgtcttcactgttctctgct

SEQ ID NO: 3984 - DNA, 71 bp, chicken (Gallus Gallus)
  misc_feature (36): n=a or g
tgttcacggtgcaattggaaatctgtatgcataggnttcagatcttctgcagttaacctgcactgaggggg

SEQ ID NO: 3985 - DNA, 71 bp, chicken (Gallus Gallus)
  misc_feature (36): n=c or t
tgtaacttacgcttggaaacttgcatgtgtaaactnttgcatttattgcagcttggtttttgttgcgcctt

SEQ ID NO: 3986 - DNA, 71 bp, chicken (Gallus Gallus)
  misc_feature (36): n=a or g
aggaggaagggagggagggagcaactttctcagcanagcctatttggaatagatttcccccccagtgactg

SEQ ID NO: 3987 - DNA, 71 bp, chicken (Gallus Gallus)
  misc_feature (36): n=a or g
acgatgaggccctttcacgagggatttcccttccgntatgaagggattcatccggaaacaaaagaaaaaca

SEQ ID NO: 3988 - DNA, 71 bp, chicken (Gallus Gallus)
  misc_feature (36): n=c or t
ggttttgcttgtttcatctttgtggttttgtcattnattgggaatttccagctcacggctgccctacgtac

SEQ ID NO: 3989 - DNA, 71 bp, chicken (Gallus Gallus)
  misc_feature (36): n=c or t
caattctaaaagaaggcaaaaggagcacccttcttncctttggaaacaacatctggtcctctcctatggat

SEQ ID NO: 3990 - DNA, 71 bp, chicken (Gallus Gallus)
  misc_feature (36): n=c or t
cttgttattattaagagtttccagcttttgtctgcngcaaaagaatactccggttttcatttgctacgtct

SEQ ID NO: 3991 - DNA, 71 bp, chicken (Gallus Gallus)
  misc_feature (36): n=c or t
tctgcattacgattccttctcatagagccaaacaancactgaggttggagaagagctctcagatccccacc

SEQ ID NO: 3992 - DNA, 71 bp, chicken (Gallus Gallus)
  misc_feature (36): n=c or t
gttcatcctgtatggatgtgagcaagctttctgccntcaggctctgctctctaccccagcagcatctcccc

SEQ ID NO: 3993 - DNA, 71 bp, chicken (Gallus Gallus)
  misc_feature (36): n=a or g
tgatgcagatgggtaggttataggtgtaaaggatgntattttgtgccctctaacagaagtagaacatacag

SEQ ID NO: 3994 - DNA, 71 bp, chicken (Gallus Gallus)
  misc_feature (36): n=a or g
gcatgatttcctcctggcaggtcacatctgacatgngtagtgttctgcttttgtgtttcaaatctcacctc

SEQ ID NO: 3995 - DNA, 71 bp, chicken (Gallus Gallus)
  misc_feature (36): n=c or t
cttactgcagttgtgtcctgggtttttgagtttctnagcagtgagagctgctgacctctgacttcagctcc

SEQ ID NO: 3996 - DNA, 71 bp, chicken (Gallus Gallus)
  misc_feature (36): n=c or t
atttctccttctctgacgccttaataatttgtgcanggttgctgtgtgatgcacaggatcattgtgagaaa

SEQ ID NO: 3997 - DNA, 71 bp, chicken (Gallus Gallus)
  misc_feature (36): n=a or g
aagctgtgaattgttggtgataaaggtgcattcccngagggaggaaaccagtccgaactccgggctgatgg

SEQ ID NO: 3998 - DNA, 71 bp, chicken (Gallus Gallus)
  misc_feature (36): n=a or g
attgaggcacagaccccaggtgagctcagggtccangtgtaacaggcgttgcacatattttatttcaatta

SEQ ID NO: 3999 - DNA, 71 bp, chicken (Gallus Gallus)
  misc_feature (36): n=a or g
gttttcccagggctttaatttttaagcatgcacacntttctgaaggtggtcttctggcagctgaatgcttg

SEQ ID NO: 4000 - DNA, 71 bp, chicken (Gallus Gallus)
  misc_feature (36): n=a or g
ggcaagaaggtaaccttctgctgcacctctgacacngccttaaaaaatcagcactgaaatgaggcatgctt

SEQ ID NO: 4001 - DNA, 71 bp, chicken (Gallus Gallus)
  misc_feature (36): n=a or g
tcaacactgatttcttcacaagcaagcagggcttcnccattcagttttcaggtaagctttgcattctctcc

SEQ ID NO: 4002 - DNA, 71 bp, chicken (Gallus Gallus)
  misc_feature (36): n=c or t
gtgcagggatatcacaaacagagcatgcagagtgantgtgcatgaaatatatggagagagcatgcagacag

SEQ ID NO: 4003 - DNA, 71 bp, chicken (Gallus Gallus)
  misc_feature (36): n=c or t
agagccatgctgcaggagcagtgatggagacgatgnctttgcttggagcatctttgtgtgccctgtcccga

SEQ ID NO: 4004 - DNA, 71 bp, chicken (Gallus Gallus)
  misc_feature (36): n=a or c
gggctctgtgccacacttcagtgaccgattgaaatngcctggttgagaggggacgaaggtcaggcaaggtg

SEQ ID NO: 4005 - DNA, 71 bp, chicken (Gallus Gallus)
  misc_feature (36): n=c or t
tggccgtgcaggatttctgctccctgtgatcaattnaggatcagctgcagcagcgcaatgaattcagggcc

SEQ ID NO: 4006 - DNA, 71 bp, chicken (Gallus Gallus)
  misc_feature (36): n=c or t
ttccctctggttcctttccatgtaaggaagtgttangttaccttgtatttcccactcaaggtgtggtatgc

SEQ ID NO: 4007 - DNA, 71 bp, chicken (Gallus Gallus)
  misc_feature (36): n=c or t
aagcacagaaacaagtcaggatggaaagaaacaaantacttcacagcatccacaaacagagcagcactgat

SEQ ID NO: 4008 - DNA, 71 bp, chicken (Gallus Gallus)
  misc_feature (36): n=a or g
acaacctcaagacccacttagatatgaactcggggnaagaatgagctagaggagatggcagaagaaaccag

SEQ ID NO: 4009 - DNA, 71 bp, chicken (Gallus Gallus)
  misc_feature (36): n=a or g
agaagcgtggcctgaagggtgactttttcctccccncaagcatttcatgaagccagcagacccactgggac

SEQ ID NO: 4010 - DNA, 71 bp, chicken (Gallus Gallus)
  misc_feature (36): n=a or g
tgacccagcaaacatacaaacagacacgtcaatgtnatgcaaaataaaaacatgcaagctaagcaatgtgc

SEQ ID NO: 4011 - DNA, 71 bp, chicken (Gallus Gallus)
  misc_feature (36): n=c or t
cttaccaggctgaagtgtgccgggagctccggcagngagcaaacagcatttgtcaccaacagcagtgggac

SEQ ID NO: 4012 - DNA, 71 bp, chicken (Gallus Gallus)
  misc_feature (36): n=a or g
gtgtctgtgaatgcatttacatgagcacctgcagcnagattcagagggatggacgcgtacagaatatggca

SEQ ID NO: 4013 - DNA, 71 bp, chicken (Gallus Gallus)
  misc_feature (36): n=a or c
agaggacagcagagctggagaaaagcattggggtgngcagcatgttttacccccagccatttgcgccccca

SEQ ID NO: 4014 - DNA, 71 bp, chicken (Gallus Gallus)
  misc_feature (36): n=a or g
gtgtgctgaagataattgtgttatgagaccagagancaggagctcatgcccctatattttaccaagcggca

SEQ ID NO: 4015 - DNA, 71 bp, chicken (Gallus Gallus)
  misc_feature (36): n=g or t
agagtggtcaacagtgactgtcctggtgtggtaccntactgcaccattaactgagatactgtgccatatcc

SEQ ID NO: 4016 - DNA, 71 bp, chicken (Gallus Gallus)
  misc_feature (36): n=c or t
taggacagaggttcccaagcaccacctctgtgtttncccagtgtctgccattacaatctaaacccagcagc

SEQ ID NO: 4017 - DNA, 71 bp, chicken (Gallus Gallus)
  misc_feature (36): n=c or t
agggattgaacccagggccctgctagctgcagctcngtgttcctgtagatagattgcccaaaatacatcgc

SEQ ID NO: 4018 - DNA, 71 bp, chicken (Gallus Gallus)
  misc_feature (36): n=a or g
gtgtactccaccgtgctgttccgcgttttcactttntagattttatctgtttttcttactaaatccttaac

SEQ ID NO: 4019 - DNA, 71 bp, chicken (Gallus Gallus)
  misc_feature (36): n=c or g
ttcccactgttcagtgtagctcttaccttggctttnccaaagccgccctttgggaggacaatcttgtgcga

SEQ ID NO: 4020 - DNA, 71 bp, chicken (Gallus Gallus)
  misc_feature (36): n=c or t
ggcactgcagcaggaagacagcccagcttttccatnggctctcctgttatctttcgacctcattttgcagc

SEQ ID NO: 4021 - DNA, 71 bp, chicken (Gallus Gallus)
  misc_feature (36): n=a or g
ttgttaaagccagaaggaatccattacgatcagccncagctgaccttcttcggtcaatagttttggcatct

SEQ ID NO: 4022 - DNA, 71 bp, chicken (Gallus Gallus)
  misc_feature (36): n=c or t
cggtaagcctcaggcctcagttgaggctttgctgcnatgccttctacccttcccatttctcaaggaataca

SEQ ID NO: 4023 - DNA, 71 bp, chicken (Gallus Gallus)
  misc_feature (36): n=a or g
tatgatatgagaaggaggtatgaacgcattgtcccntgcaagacagctgttttctgggcagatcggccttt

SEQ ID NO: 4024 - DNA, 71 bp, chicken (Gallus Gallus)
  misc_feature (36): n=c or t
tctttaacacgatcaactcaatcatctggaacggantgagctcagggttccatgcagacctgctgcaaacc

SEQ ID NO: 4025 - DNA, 71 bp, chicken (Gallus Gallus)
  misc_feature (36): n=a or g
aagacagctgcatttaaagcagctgcaagagatgantgaacacagtaaaagtgcaagtcagtgctcctaac

SEQ ID NO: 4026 - DNA, 71 bp, chicken (Gallus Gallus)
  misc_feature (36): n=a or g
aacattttctaaggttctcatttcccttgtatctcnaaagcccaggattgatattgcaatattacacaagg

SEQ ID NO: 4027 - DNA, 71 bp, chicken (Gallus Gallus)
  misc_feature (36): n=c or t
ctgtggcctgctgactgcagaatggatgtgaaatangtaaataaaactgtctagaaagtctgcagtaacac

SEQ ID NO: 4028 - DNA, 71 bp, chicken (Gallus Gallus)
  misc_feature (36): n=a or g
ggtaatggcatggagaaccctggctttgtcccaagntacatttgtgaaaggtcagcctttcactggaaggt

SEQ ID NO: 4029 - DNA, 71 bp, chicken (Gallus Gallus)
  misc_feature (36): n=c or t
aaaagggctttagctattggtactaatggcagacanagtttttgagcattacttggatgctgactgtaatt

SEQ ID NO: 4030 - DNA, 71 bp, chicken (Gallus Gallus)
  misc_feature (36): n=a or g
ctctgttctttaaaagggggcaacaagatacaaggngagagattctttagcggggtctgtgtgataggaac

SEQ ID NO: 4031 - DNA, 71 bp, chicken (Gallus Gallus)
  misc_feature (36): n=c or t
cctgggagaagagctgcggtattcatttgcagaagnattccttcctacagacagggaacagattgggcagt

SEQ ID NO: 4032 - DNA, 71 bp, chicken (Gallus Gallus)
  misc_feature (36): n=c or t
ctaaatgatgagctgtctgggttcttgctgagatgnatcttcctctcttgatggagaacactatgtcttgc

SEQ ID NO: 4033 - DNA, 71 bp, chicken (Gallus Gallus)
  misc_feature (36): n=c or t
gctctccactctgctttgtatttgaggatgggcacnccaccagtagcttcaggctcatcgaactccacacg

SEQ ID NO: 4034 - DNA, 71 bp, chicken (Gallus Gallus)
  misc_feature (36): n=a or g
ttcagcaaacactttgatttaactgcaagcatctcnagatgcacttggtaggactgagaactacagtaccc

SEQ ID NO: 4035 - DNA, 71 bp, chicken (Gallus Gallus)
  misc_feature (36): n=c or t
tgaagtcctctgaaatcctcagatgaaagactcttnagaagtgcaaagagctattatttatctggcacctg

SEQ ID NO: 4036 - DNA, 71 bp, chicken (Gallus Gallus)
  misc_feature (36): n=c or t
ttcctcaccaccttgagtaaatttcatcctaacatntaacctgaatctccctttttagtttaaagctgttc

SEQ ID NO: 4037 - DNA, 71 bp, chicken (Gallus Gallus)
  misc_feature (36): n=c or t
agagtgggggctgcgtgacagcacggcagtgtgcangtgtgtgagtgcacttatctactgggactgcacag

SEQ ID NO: 4038 - DNA, 71 bp, chicken (Gallus Gallus)
  misc_feature (36): n=a or g
tccagcccaagctgctcacactgccagctgtggccnttgtgcctttgtgcatctctggcactagcaagaag

SEQ ID NO: 4039 - DNA, 71 bp, chicken (Gallus Gallus)
  misc_feature (36): n=c or t
agtttggttcagagtcatagctatagatgtctcagnaacttatggacttcatgaagtgaaaggaggggatt

SEQ ID NO: 4040 - DNA, 71 bp, chicken (Gallus Gallus)
  misc_feature (36): n=c or t
ctaaagacctcattaagtgcaaacttccagcctgcncctttcaccactcctggctctggctcagctctttg

SEQ ID NO: 4041 - DNA, 71 bp, chicken (Gallus Gallus)
  misc_feature (36): n=c or g
atgatgatcttctggcctgatcccccactgccatanctggaagagccatagcctgaagtgccatagccaga

SEQ ID NO: 4042 - DNA, 71 bp, chicken (Gallus Gallus)
  misc_feature (36): n=c or t
gctgtaagatcacgggtttaacagaaatcaaacttngaactgatttctaaagcagcacaaatagactttcc

SEQ ID NO: 4043 - DNA, 71 bp, chicken (Gallus Gallus)
  misc_feature (36): n=a or g
ctcttttcctgtttactcaggaaggtgagttctccntgaagaatgataagtgagcagctgaatgccattag

SEQ ID NO: 4044 - DNA, 71 bp, chicken (Gallus Gallus)
  misc_feature (36): n=c or t
aagagttgaagcgagcccttatattggagcaagagntgaagcttagtggatggagggaataaattctcctg

SEQ ID NO: 4045 - DNA, 71 bp, chicken (Gallus Gallus)
  misc_feature (36): n=c or t
gtgcagcagcagaggaaggccgggctggtggggttntaatgggatgcctctaagagttgtgaagccttgaa

SEQ ID NO: 4046 - DNA, 71 bp, chicken (Gallus Gallus)
  misc_feature (36): n=c or g
cctttgtgctttgtaaagcatgtgtgaagccctgancagcataaacctgttattgcctatggttatctgca

SEQ ID NO: 4047 - DNA, 71 bp, chicken (Gallus Gallus)
  misc_feature (36): n=c or t
gtttgcttttccctcgtaggttttcagtgcactccncctgtttgtttgcatgcactcttaaaggtgcagcc

SEQ ID NO: 4048 - DNA, 71 bp, chicken (Gallus Gallus)
  misc_feature (36): n=c or t
ctgctccttgtcaggaaatgcaaacccagtgatcangacaatctcttctacttgcatctctcttaggttca

SEQ ID NO: 4049 - DNA, 71 bp, chicken (Gallus Gallus)
  misc_feature (36): n=a or c
cattgcaatatttgacctaatgaaatgtgctgtctncctcaacacagctgctctgtcctctccaggccaaa

SEQ ID NO: 4050 - DNA, 71 bp, chicken (Gallus Gallus)
  misc_feature (36): n=c or t
ttcttttagtgctttttgagtcgcagctctcagccnccacacatcaccctgggcctgcaccttgcactttg

SEQ ID NO: 4051 - DNA, 71 bp, chicken (Gallus Gallus)
  misc_feature (36): n=a or g
gcttttttttaacctgctgtcccagaaaaggaaacntacagcgcagtgaagcttgcagagaagagagagca

SEQ ID NO: 4052 - DNA, 71 bp, chicken (Gallus Gallus)
  misc_feature (36): n=a or g
ccctgtgctaatttcgtttctacagtaaccagcccnagaggtgtgcatgcgcccggtcccatggcacaaag

SEQ ID NO: 4053 - DNA, 71 bp, chicken (Gallus Gallus)
  misc_feature (36): n=g or t
gtatcgatttgggatggaagaacagttcagtatctnattgtgctctgtggtgatgaggaaggagtggggat

SEQ ID NO: 4054 - DNA, 71 bp, chicken (Gallus Gallus)
  misc_feature (36): n=c or t
ccaaggttctcccaaatccaaatgcaaagccaaagngttctactgagggcatcaattagttgctcattttt

SEQ ID NO: 4055 - DNA, 71 bp, chicken (Gallus Gallus)
  misc_feature (36): n=c or g
tcttcctaatggcaatccttaggaacaagcagctgncactgctggaatccttcaacctccaacaggagagc

SEQ ID NO: 4056 - DNA, 71 bp, chicken (Gallus Gallus)
  misc_feature (36): n=c or t
gagcttggaatctctcagagcagcgtgaagtcaaanagcccagaaggcaacgtgtgagatgaattagcatc

SEQ ID NO: 4057 - DNA, 71 bp, chicken (Gallus Gallus)
  misc_feature (36): n=g or t
aagcagaactgttacatgttgggatctctgtcactnttgatggctacaggagcagaggcattaagtggtgg

SEQ ID NO: 4058 - DNA, 71 bp, chicken (Gallus Gallus)
  misc_feature (36): n=c or t
agcttcacacaaatgaataatgggattgatttaagnattacttcactattgacttcatccaaactattttc

SEQ ID NO: 4059 - DNA, 71 bp, chicken (Gallus Gallus)
  misc_feature (36): n=c or t
tgcactgtatctccttgcagcgaaaccttttccttngtcctgacaaacgtggatggcagcaggaagattgg

SEQ ID NO: 4060 - DNA, 71 bp, chicken (Gallus Gallus)
  misc_feature (36): n=c or t
aatagctttaaagtcaaaggttttaaatttgtgttngaaaaggctgtggctttgatgctttatatatgatt

SEQ ID NO: 4061 - DNA, 71 bp, chicken (Gallus Gallus)
  misc_feature (36): n=c or t
ggctctccaagttctgacatcccattgtggttggangtgtcacgccttgcctaacactaatctgggcaggg

SEQ ID NO: 4062 - DNA, 71 bp, chicken (Gallus Gallus)
  misc_feature (36): n=a or g
cttaatatttcatagtaaggcagtgttggatacagnagcctctgagaatgcctggagctgtgcaacagaga

SEQ ID NO: 4063 - DNA, 71 bp, chicken (Gallus Gallus)
  misc_feature (36): n=a or g
gctgccacttctcctcggcagcacctcctgcaagcnggcaatgcagaaagagaagtgcagctactccgcaa

SEQ ID NO: 4064 - DNA, 71 bp, chicken (Gallus Gallus)
  misc_feature (36): n=a or g
tctgctctctaaccaactgcaagtcatgcagtaacnaggagtccttaacacagcaaacacaacagtccagg

SEQ ID NO: 4065 - DNA, 71 bp, chicken (Gallus Gallus)
  misc_feature (36): n=a or c
aaggtgttcggtatgcaccggtttaatcaggacaantgcacagcagagaagggatcagcaccgggggaggt

SEQ ID NO: 4066 - DNA, 71 bp, chicken (Gallus Gallus)
  misc_feature (36): n=c or t
ctgcccatgcccccaccagcactgcccctcctgtcnttatttccttcttccatccttctgcagagctgatc

SEQ ID NO: 4067 - DNA, 71 bp, chicken (Gallus Gallus)
  misc_feature (36): n=a or g
cggcatggcacagggaaagcccttctatcactgggngagttggttgggctttttgttggtttatctcctcc

SEQ ID NO: 4068 - DNA, 71 bp, chicken (Gallus Gallus)
  misc_feature (36): n=c or t
ggaaaaacacagcaaataatagcagctcaggtgtangagggctgaaatcagaccattactctttacctgga

SEQ ID NO: 4069 - DNA, 71 bp, chicken (Gallus Gallus)
  misc_feature (36): n=a or c
ccatcactttctgtgccagcttgaattatgcacatntgtactgatttgacacccagcctgcttggcagcag

SEQ ID NO: 4070 - DNA, 71 bp, chicken (Gallus Gallus)
  misc_feature (36): n=a or g
aagccagcaaagaacagaacctttgagagggaagcnttcttggcctatgcacgtttggtagcatggtttga

SEQ ID NO: 4071 - DNA, 71 bp, chicken (Gallus Gallus)
  misc_feature (36): n=a or c
cgcctcttcattaagcaatgctcagcacaaaaatanagcaatagatgccaaaaatactgcagtgcctgttg

SEQ ID NO: 4072 - DNA, 71 bp, chicken (Gallus Gallus)
  misc_feature (36): n=a or g
gctgatgttactgtgtacaaatgcaaacagtctctntgtcattaagtttatagaggtaatgccatctgcag

SEQ ID NO: 4073 - DNA, 71 bp, chicken (Gallus Gallus)
  misc_feature (36): n=c or t
gttttcccctcctgttattaaaagaaatcttcccangaaataattcatgaatggaagagatggtagagaaa

SEQ ID NO: 4074 - DNA, 71 bp, chicken (Gallus Gallus)
  misc_feature (36): n=a or g
taatttctcgtaacgactgtattgtatctctcaatncacttcactggatcgctgctgtccctgataaacaa

SEQ ID NO: 4075 - DNA, 71 bp, chicken (Gallus Gallus)
  misc_feature (36): n=a or g
aaaaccttaatttcatctggtttcgtggagctatcntcaagtatctccaatttgaactttccccatacatc

SEQ ID NO: 4076 - DNA, 71 bp, chicken (Gallus Gallus)
  misc_feature (36): n=c or t
agaaagcaaaaaaaaaaagatgttttaaaaggctangtttctaaatgtgaaactggaaaactatgggaaga

SEQ ID NO: 4077 - DNA, 71 bp, chicken (Gallus Gallus)
  misc_feature (36): n=a or g
ctttgatagccaactgtcctcgtttcagagctgctncacagctttcgcaaacgaatgctctctggatcgaa

SEQ ID NO: 4078 - DNA, 71 bp, chicken (Gallus Gallus)
  misc_feature (36): n=a or c
caatcagcctgaggggcagcaccagctcacactgtnaatgtacagattattttgctgaagggaattgcaga

SEQ ID NO: 4079 - DNA, 71 bp, chicken (Gallus Gallus)
  misc_feature (36): n=a or g
ccatggccaaattcacaggagaatgaagcacccaancaactgttgtgccattaggcagcttgcctcacttc

SEQ ID NO: 4080 - DNA, 71 bp, chicken (Gallus Gallus)
  misc_feature (36): n=c or t
tcaggagaccctcagaaggttctgctcatctcacantgctcctattcatccctgcacagattcctccagga

SEQ ID NO: 4081 - DNA, 71 bp, chicken (Gallus Gallus)
  misc_feature (36): n=c or t
aatgagaatggagatgcgccaggacgttacgacatntaccaataccagatcaggaactccactcctgagta

SEQ ID NO: 4082 - DNA, 71 bp, chicken (Gallus Gallus)
  misc_feature (36): n=a or c
agtgcagcaggactcaaggaacaaacactatcgtgntgcaaaggaaaacagaactgagaatgctgcagctc

SEQ ID NO: 4083 - DNA, 71 bp, chicken (Gallus Gallus)
  misc_feature (36): n=c or t
tcacgttgctgctgctgtcagctttcctgatctcanagagagaggtctgagatattcgggcgtcgtggggg

SEQ ID NO: 4084 - DNA, 71 bp, chicken (Gallus Gallus)
  misc_feature (36): n=c or t
tcattcagggcccaaaataacccttcagagaagcanaggacaagaaacgaggagttcccttcatacttttt

SEQ ID NO: 4085 - DNA, 71 bp, chicken (Gallus Gallus)
  misc_feature (36): n=c or t
gtgcctctcgtttgcagggacaggaacacacggagngttattcagctcagagccatgaagttctctgcagc

SEQ ID NO: 4086 - DNA, 71 bp, chicken (Gallus Gallus)
  misc_feature (36): n=c or t
atcacatgcatgtctgaaaaagaaccacaaaatcantcagacttgactccctggaagatggaaaggtagct

SEQ ID NO: 4087 - DNA, 71 bp, chicken (Gallus Gallus)
  misc_feature (36): n=a or g
ctgtatgaagaagttcagaggtgttgacataacctnctgggagctcgaaatagcattgaatttcttctgag

SEQ ID NO: 4088 - DNA, 71 bp, chicken (Gallus Gallus)
  misc_feature (36): n=a or t
atttgtgatgtgggggataattagcatttaggagcngcgatacgtggtttgcagcatcctagaacatgaag

SEQ ID NO: 4089 - DNA, 71 bp, chicken (Gallus Gallus)
  misc_feature (36): n=c or t
ccaaaattatgctgcaaggccacgaacagcctcacngagagcctgctgggctgcattggagtggccggatg

SEQ ID NO: 4090 - DNA, 71 bp, chicken (Gallus Gallus)
  misc_feature (36): n=c or t
tccccattagcatagccttatccaattttatgctgnggacacatgcactaaatacagctggattcagtcct

SEQ ID NO: 4091 - DNA, 71 bp, chicken (Gallus Gallus)
  misc_feature (36): n=a or g
ctctggatagtctggagggagaacatgctggtatcnccatcgtcagcgatggacacaccagggaggtccat

SEQ ID NO: 4092 - DNA, 71 bp, chicken (Gallus Gallus)
  misc_feature (36): n=c or t
agtggaagtaataactacaacaaaaatattaaatcngataaaacaaaacacagtcgcagccctttctctca

SEQ ID NO: 4093 - DNA, 71 bp, chicken (Gallus Gallus)
  misc_feature (36): n=c or t
gagcccagagcagggctcctctcaccccacaagtgnttctgtaagctccgttagccagcaggattaaatgc

SEQ ID NO: 4094 - DNA, 71 bp, chicken (Gallus Gallus)
  misc_feature (36): n=c or t
ctgaaaacgaaaccaaataaaattagctgataacanaatgggaagcgggaaagttcaggttttctattgct

SEQ ID NO: 4095 - DNA, 71 bp, chicken (Gallus Gallus)
  misc_feature (36): n=c or t
gttaacaataagataagacacagcttcctgacagangaatctgggagagtctcctttgagttggacacctc

SEQ ID NO: 4096 - DNA, 71 bp, chicken (Gallus Gallus)
  misc_feature (36): n=c or t
tttcttttattccaaaatgctcaacgccgtgggctngtgaactgctgcaaagggtgcccttggatggcaag

SEQ ID NO: 4097 - DNA, 71 bp, chicken (Gallus Gallus)
  misc_feature (36): n=g or t
catcagcctcacaaatagtccagattagtttctgtnctgaccctttgtatcaccacatctgagccaacgtg

SEQ ID NO: 4098 - DNA, 71 bp, chicken (Gallus Gallus)
  misc_feature (36): n=c or t
cagcccccagtgaagcaggctggaatggagatctcntccctctgtttctggctcattgaaatttcaccctg

SEQ ID NO: 4099 - DNA, 71 bp, chicken (Gallus Gallus)
  misc_feature (36): n=c or t
gatggataagtcagtccttttgtcttctttattagngcttgaaatgcaccaccgccctttgcgtgcgcaaa

SEQ ID NO: 4100 - DNA, 71 bp, chicken (Gallus Gallus)
  misc_feature (36): n=c or t
gggattggagcctaaattatgcttactgtgactggngagaagcttaaatttggttattgactggattaaac

SEQ ID NO: 4101 - DNA, 71 bp, chicken (Gallus Gallus)
  misc_feature (36): n=c or t
ggcatatgtgaaaacagttcaaggcagataagcaangcactgcgacggcgggttttgttccagacgctgaa

SEQ ID NO: 4102 - DNA, 71 bp, chicken (Gallus Gallus)
  misc_feature (36): n=c or t
tgaagtcaaagagacggattcccacaggcagtgcangaaacccctccatttagaggaagaaaacactgagt

SEQ ID NO: 4103 - DNA, 71 bp, chicken (Gallus Gallus)
  misc_feature (36): n=c or t
caggtgaaaggaagttaggagctgctgagtgccctnagtttggattgttttctgtgatgcccagagtgttc

SEQ ID NO: 4104 - DNA, 71 bp, chicken (Gallus Gallus)
  misc_feature (36): n=a or c
aactgcactctacaaaacaaaagtggcattgcattngattaacctgcagtcccacatccgctcctctgcta

SEQ ID NO: 4105 - DNA, 71 bp, chicken (Gallus Gallus)
  misc_feature (36): n=a or g
tgctccatgtcagccgcgctgctccggaaatccccnttgttgtacagcttcaccgagcgcacaaagattgg

SEQ ID NO: 4106 - DNA, 71 bp, chicken (Gallus Gallus)
  misc_feature (36): n=c or t
cacaaaaacatatagaggaaaggtggaacagtcaanggttcatgtgctcagtgggtgaagccccatcctaa

SEQ ID NO: 4107 - DNA, 71 bp, chicken (Gallus Gallus)
  misc_feature (36): n=a or g
ctggagttcactctagatcaggagctaatactgggntacatttccaggaggcatctgcatttatagatgca

SEQ ID NO: 4108 - DNA, 71 bp, chicken (Gallus Gallus)
  misc_feature (36): n=c or t
aattttagctcagcagtctagagagaaaaacagggngatggaaagaatgtgtttatgtgtaaaaaataaaa

SEQ ID NO: 4109 - DNA, 71 bp, chicken (Gallus Gallus)
  misc_feature (36): n=g or t
tttgtgtccaccaggtgctttgtgcgcggatttctntgccttggaagttgctcagtatggcctaacaaaca

SEQ ID NO: 4110 - DNA, 71 bp, chicken (Gallus Gallus)
  misc_feature (36): n=c or t
aactattttttggtctgactgttttccaatcctttnagattattttgtgcaaccactatactgtaaggtgc

SEQ ID NO: 4111 - DNA, 71 bp, chicken (Gallus Gallus)
  misc_feature (36): n=a or g
ggttcctattgcattggaagaagcaacaagaaaacntggactacattaaagcatgactgccaagcagccac

SEQ ID NO: 4112 - DNA, 71 bp, chicken (Gallus Gallus)
  misc_feature (36): n=c or t
acgtactctctgctgagggctgaaggcagcagcacngttctgctgtttgagaaagcacgtgtttctgtgtt

SEQ ID NO: 4113 - DNA, 71 bp, chicken (Gallus Gallus)
  misc_feature (36): n=c or t
cccaatgtccgccctctgcctctcctggcacaattnagtgctgttttctctcatcctacagaaccccacaa

SEQ ID NO: 4114 - DNA, 71 bp, chicken (Gallus Gallus)
  misc_feature (36): n=c or t
agagcactcacagcctttcctcccccagcagaaganatgtgggtatgctgccattcttgttctgcttaccc

SEQ ID NO: 4115 - DNA, 71 bp, chicken (Gallus Gallus)
  misc_feature (36): n=a or g
gggtctaagcagacaggtgcaatctaaggcaggagntggtcagccttccctggtgccagctggtatggcat

SEQ ID NO: 4116 - DNA, 71 bp, chicken (Gallus Gallus)
  misc_feature (36): n=c or t
taacgggctgggattttagtgaagcctggtcatctntgtgattaaaaagctctcttctggagttgtgttaa

SEQ ID NO: 4117 - DNA, 71 bp, chicken (Gallus Gallus)
  misc_feature (36): n=c or t
tgtgtgctctttgaaacctttggcaagtgtccttanggcgtcacgtgccgctttgccaaggcccacctcgg

SEQ ID NO: 4118 - DNA, 71 bp, chicken (Gallus Gallus)
  misc_feature (36): n=a or g
ggagcccccatggcttgagctcggctctggttggangaaaggttgatgtgagcagcgtggtacttttccac

SEQ ID NO: 4119 - DNA, 71 bp, chicken (Gallus Gallus)
  misc_feature (36): n=a or g
atgatgtcctgctggctggaggccgtggcccgagcncgcagcttgattaattccccatcaaacagcaatta

SEQ ID NO: 4120 - DNA, 71 bp, chicken (Gallus Gallus)
  misc_feature (36): n=c or t
agcggtgaggaaggcagaaccttctactcaagagantgctcagcaccactgtgaatttccagcagacttaa

SEQ ID NO: 4121 - DNA, 71 bp, chicken (Gallus Gallus)
  misc_feature (36): n=c or t
aaaatatgacaggattctgcttcccatttatcaaanaaaatgtcttcaaccaaagttcctgtgggtgtcta

SEQ ID NO: 4122 - DNA, 71 bp, chicken (Gallus Gallus)
  misc_feature (36): n=g or t
atatatatataccatgtttctggatacgtttgtgtnttgtgaaaagaagagagaatgcagagcacagaggg

SEQ ID NO: 4123 - DNA, 71 bp, chicken (Gallus Gallus)
  misc_feature (36): n=c or t
ttgagtagctagcactgagatgttcgtagctctctnctgccactgtgaaagtcacatttaaagaaacagca

SEQ ID NO: 4124 - DNA, 71 bp, chicken (Gallus Gallus)
  misc_feature (36): n=g or t
agcactgagctgatgtctgtaggtatatatatgganacccacatcctgcatacctcctctgaccttccatt

SEQ ID NO: 4125 - DNA, 71 bp, chicken (Gallus Gallus)
  misc_feature (36): n=c or t
ctgcctacagtcacctcactccattctgctgcttcntccccagaaggatgagagcagcaaaagatctttgc

SEQ ID NO: 4126 - DNA, 71 bp, chicken (Gallus Gallus)
  misc_feature (36): n=a or g
ttaacctgcatgaattgattaactgaagtgggcccncagtgacttgcagcgtgttacaagaggtcagacac

SEQ ID NO: 4127 - DNA, 71 bp, chicken (Gallus Gallus)
  misc_feature (36): n=c or t
ttttgcaaccagtgccctgatacgcaggtctgtccnatctggctcacccatggtgggcaacaacacagctt

SEQ ID NO: 4128 - DNA, 71 bp, chicken (Gallus Gallus)
  misc_feature (36): n=c or t
cgcagcagctggatacacagcccagcagttctgaangcacaagtaacccttaatcacagggatccagcatg

SEQ ID NO: 4129 - DNA, 71 bp, chicken (Gallus Gallus)
  misc_feature (36): n=c or t
tccaggcagggaaccgaagtgctgggagaaaggggnacatccagaactgttcacccattccacaaagcatc

SEQ ID NO: 4130 - DNA, 71 bp, chicken (Gallus Gallus)
  misc_feature (36): n=c or t
ataatgctcatataatctctttttcagaaattgggntcacataactagttggtatgcaaaatatgtaaggc

SEQ ID NO: 4131 - DNA, 71 bp, chicken (Gallus Gallus)
  misc_feature (36): n=a or c
catcaaaccctcacagctgtgtaaataccaaacacncaaatcaaagcctcccctccaaccataaaacagcc

SEQ ID NO: 4132 - DNA, 71 bp, chicken (Gallus Gallus)
  misc_feature (36): n=a or c
acagggactgaaaccctcctcgaagctgcactgaanccaggatgtgcaacagacatcatctgagaattccc

SEQ ID NO: 4133 - DNA, 71 bp, chicken (Gallus Gallus)
  misc_feature (36): n=c or t
gcctcatctgcatttgacccagaacaagctggatcntcctctgcttcaggatttcctgtcacctcttgctc

SEQ ID NO: 4134 - DNA, 71 bp, chicken (Gallus Gallus)
  misc_feature (36): n=c or t
tcctttgaaatttttgtgatggttttcttaagctcngggagcgacttttccttcctggaagcacaacatgg

SEQ ID NO: 4135 - DNA, 71 bp, chicken (Gallus Gallus)
  misc_feature (36): n=g or t
atatctatgtgtaattctctgcagattgctttgctnttaattatagagttcttggtgaagcacactgggaa

SEQ ID NO: 4136 - DNA, 71 bp, chicken (Gallus Gallus)
  misc_feature (36): n=a or g
attgaaccgttctttgcaggtacattgcttatatantgtcttccatactgtactacctttctgaaaccctt

SEQ ID NO: 4137 - DNA, 71 bp, chicken (Gallus Gallus)
  misc_feature (36): n=c or t
caggatccataagaaataaccgtagccataactctncctccatgtgcttccctctgctcatgcagatctta

SEQ ID NO: 4138 - DNA, 71 bp, chicken (Gallus Gallus)
  misc_feature (36): n=c or t
cgatttgatattttcactcatttttctttaacgttncccctttctttcctaaaaagaatcaacaaagacat

SEQ ID NO: 4139 - DNA, 71 bp, chicken (Gallus Gallus)
  misc_feature (36): n=a or c
gatgaaggtggtagtgatacggggatggggtatagnctgggcgtggggatggaggaagtgggattgggtca

SEQ ID NO: 4140 - DNA, 71 bp, chicken (Gallus Gallus)
  misc_feature (36): n=a or g
ttagagaaggcagagaataaaggaaagttgagcacngtgccttagcttaaagctgctaaagatgtcagaag

SEQ ID NO: 4141 - DNA, 71 bp, chicken (Gallus Gallus)
  misc_feature (36): n=a or g
gtatgagccatactgagatctgaagaagcagccaancagtgctgctgagtaggggatgaagtgtctgagag

SEQ ID NO: 4142 - DNA, 71 bp, chicken (Gallus Gallus)
  misc_feature (36): n=a or t
aagctgctctcaggactgctaagctgaaatgaaagnagcacatgaaaacctaagagtcagtttatcaagag

SEQ ID NO: 4143 - DNA, 71 bp, chicken (Gallus Gallus)
  misc_feature (36): n=c or t
caatgttttgaaaatgttttgaacttcccaaaagangtggaacctggtagctcccacagctcttacagccc

SEQ ID NO: 4144 - DNA, 71 bp, chicken (Gallus Gallus)
  misc_feature (36): n=a or g
tgatatgagcaagcttggatgtgtgagcacactggngtagcattcttcctccccatccttcctgaagacac

SEQ ID NO: 4145 - DNA, 71 bp, chicken (Gallus Gallus)
  misc_feature (36): n=c or t
cccacaaccagtgggacttcttgtctgtttgcagangttatcctgtacatcaaactttttttgctagtatt

SEQ ID NO: 4146 - DNA, 71 bp, chicken (Gallus Gallus)
  misc_feature (36): n=g or t
ctgtagagaaggggcatgcagctcaggactagagcngacagtgggtctaactgtgttgctggaggagattc

SEQ ID NO: 4147 - DNA, 71 bp, chicken (Gallus Gallus)
  misc_feature (36): n=a or g
ctgcacagctgtgtgggaagggccatgacagtgggntatttgcaagacctgattgtctcgtcctgtctcca

SEQ ID NO: 4148 - DNA, 71 bp, chicken (Gallus Gallus)
  misc_feature (36): n=c or t
gccccactgtcttttgcagacagacctgttgtcacnccatgtcaagcaggaaccaaatagcagatcccttg

SEQ ID NO: 4149 - DNA, 71 bp, chicken (Gallus Gallus)
  misc_feature (36): n=a or g
gagctaagtgctcaggagagctttagctggaaagcntactgaacttatgcaataaggcgtgaagtgaaagg

SEQ ID NO: 4150 - DNA, 71 bp, chicken (Gallus Gallus)
  misc_feature (36): n=g or t
ggttgttcttttatttcctttcttgcatccagctgnattcagacctgggcaacctggactagatgacctgc

SEQ ID NO: 4151 - DNA, 71 bp, chicken (Gallus Gallus)
  misc_feature (36): n=c or t
atgtatgtactactccctccccacaggtcaaagagnggatttacgaattgcaggactgagggcaaaattcc

SEQ ID NO: 4152 - DNA, 71 bp, chicken (Gallus Gallus)
  misc_feature (36): n=g or t
aaaccttgattagagtccttgggtccagctgggacntatggttgttactgctttgtcaccaattgcagagg

SEQ ID NO: 4153 - DNA, 71 bp, chicken (Gallus Gallus)
  misc_feature (36): n=g or t
tctgctgaaggagataaccgagggcgtggaggaaanccacccctccccaatggcacaaaaagatggaagag

SEQ ID NO: 4154 - DNA, 71 bp, chicken (Gallus Gallus)
  misc_feature (36): n=a or g
acgtgcacggacttggtgcatttgggctgatgcatnttcagcagcatgagtcgttcactaaggctttcttg

SEQ ID NO: 4155 - DNA, 71 bp, chicken (Gallus Gallus)
  misc_feature (36): n=c or t
gtcaacggcagcctctgcggcatcatgtccttcatntccatcacgccctgtgtgcggctcagtgagtacca

SEQ ID NO: 4156 - DNA, 71 bp, chicken (Gallus Gallus)
  misc_feature (36): n=c or t
gttgagccaaaaagcctgcttaacccactgcatgtnctcctggagcagcacttcgttaccttgtgagatca

SEQ ID NO: 4157 - DNA, 71 bp, chicken (Gallus Gallus)
  misc_feature (36): n=a or g
aatggactctgggaagttatgtcattctggacatangaatgttcttgcacagatgacttcttgacatggag

SEQ ID NO: 4158 - DNA, 71 bp, chicken (Gallus Gallus)
  misc_feature (36): n=c or t
ccgcagcagaaaatctgagaagcaggaaagcatcanctgtgccagctgcaggaggattaggagacctgccc

SEQ ID NO: 4159 - DNA, 71 bp, chicken (Gallus Gallus)
  misc_feature (36): n=g or t
attgatttgtaatagaaactgatgggacaagctggnatatagaagcccaaggatatataactctgcttggc

SEQ ID NO: 4160 - DNA, 71 bp, chicken (Gallus Gallus)
  misc_feature (36): n=a or g
gtaaaatcacagccagatatggctttgacgggagcnctattaaaatgaaggatgcagggggttgttaaggg

SEQ ID NO: 4161 - DNA, 71 bp, chicken (Gallus Gallus)
  misc_feature (36): n=c or t
tgaatagtagcagacaataaactgtcttcccaaagnacacgaggaaaccagtaaggaagcaatcgtggggg

SEQ ID NO: 4162 - DNA, 71 bp, chicken (Gallus Gallus)
  misc_feature (36): n=c or t
gccaaacttttttgggagaagtccaaggatcgtttngttcagagctgccacatggttttatttacaaccca

SEQ ID NO: 4163 - DNA, 71 bp, chicken (Gallus Gallus)
  misc_feature (36): n=c or t
aagagatacaatacccaactgctgaacacaacatangaaatatttcacatgctgtttatgtctaggaagtc

SEQ ID NO: 4164 - DNA, 71 bp, chicken (Gallus Gallus)
  misc_feature (36): n=a or g
ccagaactaagaagagggagtgagcgtgtgttttgnagacagctagtgctaaatctgaattcagagggttt

SEQ ID NO: 4165 - DNA, 71 bp, chicken (Gallus Gallus)
  misc_feature (36): n=a or g
cttgcaatgtctaagccagctttcatgaccacatcntatcgcagagactgcactactttttcaaggtcttt

SEQ ID NO: 4166 - DNA, 71 bp, chicken (Gallus Gallus)
  misc_feature (36): n=c or t
agcaatagctgcaatattttatctgtaaaccagccnggtccaatttcaactggccaatattaaatcttgtt

SEQ ID NO: 4167 - DNA, 71 bp, chicken (Gallus Gallus)
  misc_feature (36): n=a or g
aaagaaatacttagaagtttaggctgatccgcaacntactcatattcacagagttctctgagggctgcctt

SEQ ID NO: 4168 - DNA, 71 bp, chicken (Gallus Gallus)
  misc_feature (36): n=a or g
tccgtgatcctggtatgactaagccagacgcccatntgtgaggttacttagagaaaaaatgaagtacactt

SEQ ID NO: 4169 - DNA, 71 bp, chicken (Gallus Gallus)
  misc_feature (36): n=a or g
tagcaaaattgccccaggcagtctatctctagtaanggagctgttatcattcgcaatggagaaatctcatt

SEQ ID NO: 4170 - DNA, 71 bp, chicken (Gallus Gallus)
  misc_feature (36): n=a or g
gtagtcactataaatttctctgtgtcttagaccccntaaattctcaggagtttgcaagatagatcataagt

SEQ ID NO: 4171 - DNA, 71 bp, chicken (Gallus Gallus)
  misc_feature (36): n=a or g
ctgagaaccctatgacagtccctgcagcagctttgntgttctttgccacgttgtcactgctaaactcttct

SEQ ID NO: 4172 - DNA, 71 bp, chicken (Gallus Gallus)
  misc_feature (36): n=c or t
ctgtctcaaatgccactggtggctgtgattttctcncatgaaaaacgcagactcttcaccaattgcaagct

SEQ ID NO: 4173 - DNA, 71 bp, chicken (Gallus Gallus)
  misc_feature (36): n=a or g
caggttatcttagaaaaaaaatatcagacaacaaantggagatactaaatttcaagatgattaatgtgact

SEQ ID NO: 4174 - DNA, 71 bp, chicken (Gallus Gallus)
  misc_feature (36): n=a or g
ttaatgagtgaggttgtagaaacaagaacttgcagnttgagaatgtaatttacttacagaaattagaaact

SEQ ID NO: 4175 - DNA, 71 bp, chicken (Gallus Gallus)
  misc_feature (36): n=a or g
gaagaatttctatttctttcttcaatttatagcagnttcattaccttcaataatactatggtttctaccat

SEQ ID NO: 4176 - DNA, 71 bp, chicken (Gallus Gallus)
  misc_feature (36): n=a or g
gctcagtgcactcgttcagtgttgcttcagtagaangtcagaactgtttaagagctttggtccaagttaat

SEQ ID NO: 4177 - DNA, 71 bp, chicken (Gallus Gallus)
  misc_feature (36): n=a or g
cctgactggtttggattaatttgtttctttgattcntcatggtcagcagaaataaatgcaactcattaaat

SEQ ID NO: 4178 - DNA, 71 bp, chicken (Gallus Gallus)
  misc_feature (36): n=a or g
ttgaactccctgtgcagtaagccagaaatgtatacnggcaagaagagaatagcctagctcctcaaatgatg

SEQ ID NO: 4179 - DNA, 71 bp, chicken (Gallus Gallus)
  misc_feature (36): n=a or c
tttctgcttactcaagtgcctctccatctcttattntgagagcagcaatggtgcttcactgatcaggaatg

SEQ ID NO: 4180 - DNA, 71 bp, chicken (Gallus Gallus)
  misc_feature (36): n=a or g
tttctgcataaagcactgactgaggttctggggctnaggttcgaagggcatcagaccatctataaaaatgg

SEQ ID NO: 4181 - DNA, 71 bp, chicken (Gallus Gallus)
  misc_feature (36): n=a or g
cacagacatgccacatttgttgttcactcaagacanattctttccccattgtgattgtttctagaagacgg

SEQ ID NO: 4182 - DNA, 71 bp, chicken (Gallus Gallus)
  misc_feature (36): n=c or t
aatctgataaaagaaggacttcttaaaaatagcttnttctccagtaatgataataatctggcaatattcag

SEQ ID NO: 4183 - DNA, 71 bp, chicken (Gallus Gallus)
  misc_feature (36): n=a or g
gtggttggagttgggatttccctctcgcagacacanctgaaagtttgtagctgtggatgagatacagaaag

SEQ ID NO: 4184 - DNA, 71 bp, chicken (Gallus Gallus)
  misc_feature (36): n=c or t
gctgccctttgaagacagagttgcaggtgtctgtanttgaagagggatagggaaatgccaggaagtatttc

SEQ ID NO: 4185 - DNA, 71 bp, chicken (Gallus Gallus)
  misc_feature (36): n=c or t
tacaacgtaagccaggcgctgccgtaaggcccacangactctattttccaactcacgttctggaaaatttc

SEQ ID NO: 4186 - DNA, 71 bp, chicken (Gallus Gallus)
  misc_feature (36): n=a or g
gtagacaggccattagcactgagctgacagatttgngagtattcaaatctctcacactgtactgatacttc

SEQ ID NO: 4187 - DNA, 71 bp, chicken (Gallus Gallus)
  misc_feature (36): n=a or g
actaaatatatacaaaatattcaggaatcatgagcntacttgtaccagaccatctgcagtattattaactc

SEQ ID NO: 4188 - DNA, 71 bp, chicken (Gallus Gallus)
  misc_feature (36): n=a or g
agtcctggtttacctgtgacagcacagctccatacnaggctgttacacagaatggtgcgttcaaaaaaatc

SEQ ID NO: 4189 - DNA, 71 bp, chicken (Gallus Gallus)
  misc_feature (36): n=a or c
aaccaagtcttgtgttatcctgtttgggtacagacntatctatagctctcatagcatgccttttgctgtgc

SEQ ID NO: 4190 - DNA, 71 bp, chicken (Gallus Gallus)
  misc_feature (36): n=c or t
caaaaggacaaggtgcacaaataagcaagatatgcntagataggttcagatatatttttagaagtggctgc

SEQ ID NO: 4191 - DNA, 71 bp, chicken (Gallus Gallus)
  misc_feature (36): n=a or g
gagctttatagatagatgccgtgggaatgggtgctncaccatgccctgtatctaaaccttttctgagcagg

SEQ ID NO: 4192 - DNA, 71 bp, chicken (Gallus Gallus)
  misc_feature (36): n=c or t
aattgttctcttccatcccaggactgcagggatgangttggtggggcccagaatgcaggcatgcgtgggat

SEQ ID NO: 4193 - DNA, 71 bp, chicken (Gallus Gallus)
  misc_feature (36): n=c or t
aattaatttttttaatcgagttctcaatgaaataanattcatgtgtgtgagcagctccccatatcactcac

SEQ ID NO: 4194 - DNA, 71 bp, chicken (Gallus Gallus)
  misc_feature (36): n=c or t
ctgctccctattaaaaggggaaaataacatttcacnttgtaacaaagtcacacctacgtggttttctcttc

SEQ ID NO: 4195 - DNA, 71 bp, chicken (Gallus Gallus)
  misc_feature (36): n=a or g
tcagggcttgattctagtgcccccagctcttttccnccattgaccccacagcaacaaatgccagaacccca

SEQ ID NO: 4196 - DNA, 71 bp, chicken (Gallus Gallus)
  misc_feature (36): n=a or g
aaatagtttggagcatattttaatgaccaatgaccnatgattaaaatagtgatgaaaaaacaaaaatatcc

SEQ ID NO: 4197 - DNA, 71 bp, chicken (Gallus Gallus)
  misc_feature (36): n=a or g
tcttatcaaaacatctttgtgcccttttaagtatcnatcctatcttcatctgaacatttactctggatgca

SEQ ID NO: 4198 - DNA, 71 bp, chicken (Gallus Gallus)
  misc_feature (36): n=c or t
ctccgctcctgggtaaatacaacatctacgagggangctccaaaagtagtgcctcctactttgttatgttg

SEQ ID NO: 4199 - DNA, 71 bp, chicken (Gallus Gallus)
  misc_feature (36): n=a or c
aaacataaaaaagcaattgaaatatgttggtaaagnaatggccaaacagagaggtcatcaggaggtcagca

SEQ ID NO: 4200 - DNA, 71 bp, chicken (Gallus Gallus)
  misc_feature (36): n=a or g
tttgttttgaagttaaagtgcttggagggcaaattnacatttgaagctctggattttgcaagacatgcaca

SEQ ID NO: 4201 - DNA, 71 bp, chicken (Gallus Gallus)
  misc_feature (36): n=g or t
atactctgctattatggctataaaagccactaatgnttttgtactcacactgttgggccaggctaagggcc

SEQ ID NO: 4202 - DNA, 71 bp, chicken (Gallus Gallus)
  misc_feature (36): n=c or t
gcgtgtggtgtgtaaggaacatgattgcagctcttntctcttctgctgggcaaagcaattacttcagaagt

SEQ ID NO: 4203 - DNA, 71 bp, chicken (Gallus Gallus)
  misc_feature (36): n=a or g
attgcagtaagactaatgtagatcaaaaattggaanaaggagaaaacaggaaggctatcatatcagaggtg

SEQ ID NO: 4204 - DNA, 71 bp, chicken (Gallus Gallus)
  misc_feature (36): n=c or g
agcacaaatttggttcacgcttcatattataagctncctacaagaattcactgaagatgaattcacttatg

SEQ ID NO: 4205 - DNA, 71 bp, chicken (Gallus Gallus)
  misc_feature (36): n=a or g
caacaacagtaactagccaacaaagtaactgggtcnttatttccacgatatcttaaaagtttaacaagatt

SEQ ID NO: 4206 - DNA, 71 bp, chicken (Gallus Gallus)
  misc_feature (36): n=c or t
catggttatgtcatgtcaaagagttgtactactatnggagtgtcctttctaacttcagaataaacttcact

SEQ ID NO: 4207 - DNA, 71 bp, chicken (Gallus Gallus)
  misc_feature (36): n=a or g
tatctgtgttctttaaaacaagatcagactggattntggtatgaaatgggagacttggaaggagttttttc

SEQ ID NO: 4208 - DNA, 71 bp, chicken (Gallus Gallus)
  misc_feature (36): n=a or g
tatgtaatagagtacaaatataattaaaataggccntaaattctgaagtatactggcagttcaggggatgt

SEQ ID NO: 4209 - DNA, 71 bp, chicken (Gallus Gallus)
  misc_feature (36): n=a or g
gggttcaatctgcagtgcatacaactgtcttgtctnttgcgatatgagctcagcagagctgatcagatcgt

SEQ ID NO: 4210 - DNA, 71 bp, chicken (Gallus Gallus)
  misc_feature (36): n=a or g
ctttggaaaaaaaaaaaagcagattttaatcattcngttgagcttagatatgatggcacaaaacaaacaca

SEQ ID NO: 4211 - DNA, 71 bp, chicken (Gallus Gallus)
  misc_feature (36): n=c or t
atgttttagaagcaagcacacaagatggaagcctgncagaagtggcattacaacctacacaagcgattcct

SEQ ID NO: 4212 - DNA, 71 bp, chicken (Gallus Gallus)
  misc_feature (36): n=c or t
agcagcttggtgacagtgcatcaggagtgagaatcnacatgcgttaacttcttagtcaacacaggggtgtt

SEQ ID NO: 4213 - DNA, 71 bp, chicken (Gallus Gallus)
  misc_feature (36): n=g or t
tggccaggagagctgcaattaaacatgtaccacctncctcgcattcttttgtaattaaattttattcattc

SEQ ID NO: 4214 - DNA, 71 bp, chicken (Gallus Gallus)
  misc_feature (36): n=a or g
ccttttttatagctgagagtggcactatatgatacnggatatctctgcttagttcaggccatctgccttgt

SEQ ID NO: 4215 - DNA, 71 bp, chicken (Gallus Gallus)
  misc_feature (36): n=a or g
aacagagctaacctcatgggtagcatggataacacnttctcctggaccacagagtccaaagatgtttgctg

SEQ ID NO: 4216 - DNA, 71 bp, chicken (Gallus Gallus)
  misc_feature (36): n=c or t
ctacatattgagtttttactcttcatgtagttcttngcagacactcagatctttgctgcttattttggtca

SEQ ID NO: 4217 - DNA, 71 bp, chicken (Gallus Gallus)
  misc_feature (36): n=a or g
aaatgcattgcttataaggttctagtagtttggctntggagccctctgtgctgttgttggaaaacgagagc

SEQ ID NO: 4218 - DNA, 71 bp, chicken (Gallus Gallus)
  misc_feature (36): n=a or g
gtagaagaagtgctggcatagtatttggtgacctcnaaagctgtgtgactaaataccaagatttttttcct

SEQ ID NO: 4219 - DNA, 71 bp, chicken (Gallus Gallus)
  misc_feature (36): n=a or g
aagaaaaccaggactgatggcatttttcttagagancagataatccacatgctaacaggtgactaggcttc

SEQ ID NO: 4220 - DNA, 71 bp, chicken (Gallus Gallus)
  misc_feature (36): n=g or t
aaggtgagtctcataaaagagctctgcttcatcttncaccatgtgcaatacattgggattcctctctgctt

SEQ ID NO: 4221 - DNA, 71 bp, chicken (Gallus Gallus)
  misc_feature (36): n=a or g
ggacaagaccctctttgaatatctgacagtaagaangagaagatcgaaagaaccttcaatggatgtttaat

SEQ ID NO: 4222 - DNA, 71 bp, chicken (Gallus Gallus)
  misc_feature (36): n=g or t
tcatttctaagtcttcctgagtgagggacaacatcngagtgcataagtttgtatgggggagtgtttaagca

SEQ ID NO: 4223 - DNA, 71 bp, chicken (Gallus Gallus)
  misc_feature (36): n=a or g
ttggctctccaaatgcatttgtattcatcactgccncaagccttgtgatgtccttagggaacatcctgctc

SEQ ID NO: 4224 - DNA, 71 bp, chicken (Gallus Gallus)
  misc_feature (36): n=a or t
tttttttaacatccctatgggacaccttaggacttngcagaatttgtaaagtaaatgtgaagtagtcactg

SEQ ID NO: 4225 - DNA, 71 bp, chicken (Gallus Gallus)
  misc_feature (36): n=g or t
atcttatctatacaaactgtctaattatttcctagntacaatcatgacaagccaggatgtagctgatggtg

SEQ ID NO: 4226 - DNA, 71 bp, chicken (Gallus Gallus)
  misc_feature (36): n=a or g
aaattggagtctgtactgtctagccaggcatcagcntccagccagcatcagacagcaaaatagttgaaagt

SEQ ID NO: 4227 - DNA, 71 bp, chicken (Gallus Gallus)
  misc_feature (36): n=g or t
ttgcaaggagcagcattttattattattggtgattngtatgatttagtccaatgattgctgtagatttttt

SEQ ID NO: 4228 - DNA, 71 bp, chicken (Gallus Gallus)
  misc_feature (36): n=c or t
gttggtgcctgtattgtaaattcagaaaacaagatngttggaattgggtacaatgggatgcctaacggctg

SEQ ID NO: 4229 - DNA, 71 bp, chicken (Gallus Gallus)
  misc_feature (36): n=g or t
ataggaaagacaggtacagcttctgagcaatatacnctctaagcaatctctctccatgcagactcccaaag

SEQ ID NO: 4230 - DNA, 71 bp, chicken (Gallus Gallus)
  misc_feature (36): n=c or t
gcatgtaggggttcaagcagcttcaatgattgttcntatttgaatccctacttcagtgttccttaacgctg

SEQ ID NO: 4231 - DNA, 71 bp, chicken (Gallus Gallus)
  misc_feature (36): n=a or g
caacagaaaacaaaaaccatcaagaaatgtcatagngacagaacttgtttcctccacatcttagaggcatg

SEQ ID NO: 4232 - DNA, 71 bp, chicken (Gallus Gallus)
  misc_feature (36): n=c or t
gcagagagtagatttcttactaagatgcagatattntagaaagggggagggaatggagacccatttgctag

SEQ ID NO: 4233 - DNA, 71 bp, chicken (Gallus Gallus)
  misc_feature (36): n=a or g
atgaaaatgtgaatacagtataactttgggaagttncgtttttcagtctggaggcaaaatcagggctggcc

SEQ ID NO: 4234 - DNA, 71 bp, chicken (Gallus Gallus)
  misc_feature (36): n=c or t
acagtgaacagaaagattgcactctgtcttatattnctctgccatagacaggtgtgtccagcgcacaaaac

SEQ ID NO: 4235 - DNA, 71 bp, chicken (Gallus Gallus)
  misc_feature (36): n=a or g
ctaaatggagaggaggtagaagaaacagagctcacngggtttgtggatgatcagcagactttcttctgtgg

SEQ ID NO: 4236 - DNA, 71 bp, chicken (Gallus Gallus)
  misc_feature (36): n=a or g
cagaagctggggtaatattaggctccagcaatgccntgcagggaaggcatacacacaaagtccttatctgg

SEQ ID NO: 4237 - DNA, 71 bp, chicken (Gallus Gallus)
  misc_feature (36): n=a or g
agccgtattgtctaaatgattagcacaaacttacgnctggacaaatgacttgagctactccaaaaggggct

SEQ ID NO: 4238 - DNA, 71 bp, chicken (Gallus Gallus)
  misc_feature (36): n=a or c
ccagctggcctttaagcatgaaactactggtcaatnatcaccctatgcctatctaactggtgcttcttggt

SEQ ID NO: 4239 - DNA, 71 bp, chicken (Gallus Gallus)
  misc_feature (36): n=g or t
acaaaggagagcaatttttaaaggcataagccaacngtagggaggtgtttaaaaataggattctttaatgt

SEQ ID NO: 4240 - DNA, 71 bp, chicken (Gallus Gallus)
  misc_feature (36): n=c or t
tttaagatccaaatgactcattacagaacagcatantgaattgtgggtattgttctaacctaaaaataagc

SEQ ID NO: 4241 - DNA, 71 bp, chicken (Gallus Gallus)
  misc_feature (36): n=c or t
cagcaatttggaaatcactgttgagagttataatgnttagctaaggaaacacttctctgaagtaagatgtt

SEQ ID NO: 4242 - DNA, 71 bp, chicken (Gallus Gallus)
  misc_feature (36): n=c or t
aaacattttttaattgtgtacacctgcgaagtaatnttaaaaaacaccaggaactggacctgactatcctt

SEQ ID NO: 4243 - DNA, 71 bp, chicken (Gallus Gallus)
  misc_feature (36): n=a or c
aattatcctcctgccacccagttgatcaagtagcanagaatcacagaatggcttggattacaagggacctc

SEQ ID NO: 4244 - DNA, 71 bp, chicken (Gallus Gallus)
  misc_feature (36): n=a or t
ttttgtgtaagtcgttgaattctggagtaaaaaaantgtggaaaaaaagaattgtgacaatcatgggatca

SEQ ID NO: 4245 - DNA, 71 bp, chicken (Gallus Gallus)
  misc_feature (36): n=g or t
gcctgactgtttgctagcaagtatatcttcctgttnagcaggagacaccagtctgagtctaccctctggtt

SEQ ID NO: 4246 - DNA, 71 bp, chicken (Gallus Gallus)
  misc_feature (36): n=a or c
actagaaatacgatttagctttaaattctttctacntctggtgagctccagtgcacgtttcatgtaaacat

SEQ ID NO: 4247 - DNA, 71 bp, chicken (Gallus Gallus)
  misc_feature (36): n=c or t
ggctgtcatttttcctggattaacagccaagtcctngagtcctttgttgtagctgaggaattaagggacgt

SEQ ID NO: 4248 - DNA, 71 bp, chicken (Gallus Gallus)
  misc_feature (36): n=a or g
aaatatgaaatgtgtttgtcatggttttaattatanaagctgttgcattggtttaaaattaattaaaaaac

SEQ ID NO: 4249 - DNA, 71 bp, chicken (Gallus Gallus)
  misc_feature (36): n=a or g
ttctcctgcatctttttggaagtggagtctctgacnataaaggttttgggtagacacagtgtataccacac

SEQ ID NO: 4250 - DNA, 71 bp, chicken (Gallus Gallus)
  misc_feature (36): n=a or g
aggtcacaactctcgatgcagctctaccacattttnaccctgaagttcccaaaggaggcaatgcagcacca

SEQ ID NO: 4251 - DNA, 71 bp, chicken (Gallus Gallus)
  misc_feature (36): n=c or t
aacagaagaaagcaaacagataatttgcaaagcagnttgcaaagggcataaacatatatatgcatatttaa

SEQ ID NO: 4252 - DNA, 71 bp, chicken (Gallus Gallus)
  misc_feature (36): n=g or t
ttctgaagtaaatgcttggcattagcatttttgttnttgatgctctgctgtgtgagtacatctgttcaaaa

SEQ ID NO: 4253 - DNA, 71 bp, chicken (Gallus Gallus)
  misc_feature (36): n=c or t
gtagcaccagcttctttggaccgtactgggatctgntccttcaagggtgctgttatggaggacacctcaag

SEQ ID NO: 4254 - DNA, 71 bp, chicken (Gallus Gallus)
  misc_feature (36): n=c or t
cacttcctgggaacaagagaactttgatcagaagantgtaataaactgcaaaagaggtcgacctcccagct

SEQ ID NO: 4255 - DNA, 71 bp, chicken (Gallus Gallus)
  misc_feature (36): n=a or g
atagtgttcgctccattacaaattcccaagaactanaagggtttggagcattgtccagatgatatgatgtg

SEQ ID NO: 4256 - DNA, 71 bp, chicken (Gallus Gallus)
  misc_feature (36): n=c or t
gcacactgaactgcttaatcatatgtgtcttccttngtatgtttgtcctgaattttttctgttcttgattt

SEQ ID NO: 4257 - DNA, 71 bp, chicken (Gallus Gallus)
  misc_feature (36): n=c or g
ttttggaatttgctggattctcaggtgaggaataanagttgttttcagataactagaaataaaataataaa

SEQ ID NO: 4258 - DNA, 71 bp, chicken (Gallus Gallus)
  misc_feature (36): n=c or t
cacctggctccctagattccttgcctcctttggttngaaactgctactcaggtaaaacaagctggcaatga

SEQ ID NO: 4259 - DNA, 71 bp, chicken (Gallus Gallus)
  misc_feature (36): n=c or t
ggtgagggattgaatttcccttttctgagttggctngttcagctacagcctccttggtagtacagtggtca

SEQ ID NO: 4260 - DNA, 71 bp, chicken (Gallus Gallus)
  misc_feature (36): n=c or t
tgtagcagattggtgcatccagagcaatcgctcaanaagagagcttttctgacagtaagagtatggtcttt

SEQ ID NO: 4261 - DNA, 71 bp, chicken (Gallus Gallus)
  misc_feature (36): n=c or g
ccagagctgactgtaatacccactttaattaaagangaacaagttcttcacatgacatctgctagacttcc

SEQ ID NO: 4262 - DNA, 71 bp, chicken (Gallus Gallus)
  misc_feature (36): n=a or c
atggaaagtcccaggtacagatacaccttttgtatntgaggactcaatagctgagcaattccaggtggcca

SEQ ID NO: 4263 - DNA, 71 bp, chicken (Gallus Gallus)
  misc_feature (36): n=c or t
ggtcaagaaaccacagtgcaactgtagtaccccaangtaacaaagcccagcgggcatctcttgctttcttg

SEQ ID NO: 4264 - DNA, 71 bp, chicken (Gallus Gallus)
  misc_feature (36): n=a or g
ctgctctagaggaatgccacacataccactaacacnccgatggaggtttctgtcccagccatggcgtagat

SEQ ID NO: 4265 - DNA, 71 bp, chicken (Gallus Gallus)
  misc_feature (36): n=a or g
gcaacagcatgcccatcgagatggttatgtatgtgnggcaagtttacccacctatcttcatcgatgaaata

SEQ ID NO: 4266 - DNA, 71 bp, chicken (Gallus Gallus)
  misc_feature (36): n=a or g
tctcaaacccaaatgtctgtgtttttatggaaatcncagctaataccatattctcccttcctctcttgccg

SEQ ID NO: 4267 - DNA, 71 bp, chicken (Gallus Gallus)
  misc_feature (36): n=c or t
gtccatggctgcatttgggcaccagtctggacctcnatcagcttccatcattcagtgatttttctttgaaa

SEQ ID NO: 4268 - DNA, 71 bp, chicken (Gallus Gallus)
  misc_feature (36): n=a or g
tgtgaactgatgctgtgaagaacctgactcttctgntctcttccatttcatatttctagtacatgtaaatg

SEQ ID NO: 4269 - DNA, 71 bp, chicken (Gallus Gallus)
  misc_feature (36): n=c or t
tacaatttgtttttccatttacttcaatagctttangatctattgagaaaaggtacaaaaagttccttcac

SEQ ID NO: 4270 - DNA, 71 bp, chicken (Gallus Gallus)
  misc_feature (36): n=a or g
caggtctctctcatagagcagctgactggaaaacancaccacagaaacgcacaggactgctctgcaaagca

SEQ ID NO: 4271 - DNA, 71 bp, chicken (Gallus Gallus)
  misc_feature (36): n=a or g
ggatttagtgggtgtgggtttgtggtttgttacagncagcattagacctcagatgaccagaatgatccttg

SEQ ID NO: 4272 - DNA, 71 bp, chicken (Gallus Gallus)
  misc_feature (36): n=c or t
cactgggggagtaaatccaatgactacacaaggtgnatatgaaacttctatcagctccttagcatttcaga

SEQ ID NO: 4273 - DNA, 71 bp, chicken (Gallus Gallus)
  misc_feature (36): n=a or g
tggaggccataatggtttctctgttcattttgagcngtcaacaagttccatgtctctgtagaaccactaac

SEQ ID NO: 4274 - DNA, 71 bp, chicken (Gallus Gallus)
  misc_feature (36): n=a or g
tgagcagcaccagacaagggtgcaacagtgccagcntacagctaccagcctgagcagtgtgtttgcttttc

SEQ ID NO: 4275 - DNA, 71 bp, chicken (Gallus Gallus)
  misc_feature (36): n=a or g
cctggctgtggattttgctgaagagaatcaagaatnttgttggtgcttatgcaagaacatgaatttatttc

SEQ ID NO: 4276 - DNA, 71 bp, chicken (Gallus Gallus)
  misc_feature (36): n=a or g
tcccacattacatcttctccaaagataaccaccacngtgaccatagagaagtacctattaaatggagaaag

SEQ ID NO: 4277 - DNA, 71 bp, chicken (Gallus Gallus)
  misc_feature (36): n=a or g
ggagaagaaaatggaagatgaggaaactgatgcacnttcttggcttattttgaaattgtgggtggtgagtt

SEQ ID NO: 4278 - DNA, 71 bp, chicken (Gallus Gallus)
  misc_feature (36): n=a or g
aaacaaaacccagctttagacactgcagtgaacgtngcaggacactgtagaaacttctactagtgctggat

SEQ ID NO: 4279 - DNA, 71 bp, chicken (Gallus Gallus)
  misc_feature (36): n=c or t
taccaccatttgtcccactaacttaaagctgactcngggcagagcacacagccctacctaccaaaaagccc

SEQ ID NO: 4280 - DNA, 71 bp, chicken (Gallus Gallus)
  misc_feature (36): n=a or g
atgcatagttatgcatagtttctgcagtactaaaancaaatgtcacaaagcactatggaaaactgagaaag

SEQ ID NO: 4281 - DNA, 71 bp, chicken (Gallus Gallus)
  misc_feature (36): n=a or g
gagagaagccagttacacctgcttgcctcagccccnactaagaatcccattgggaataaacagcagcagcc

SEQ ID NO: 4282 - DNA, 71 bp, chicken (Gallus Gallus)
  misc_feature (36): n=a or g
attcagggtcattgaatgcgctgatctgttcggtcngccctgtcatagctttcatgtgtattctacttcac

SEQ ID NO: 4283 - DNA, 71 bp, chicken (Gallus Gallus)
  misc_feature (36): n=g or t
cctttccagtgtttggtgctgggtgtagcttttgangtacagtagagaaatattaagacttctctaaacac

SEQ ID NO: 4284 - DNA, 71 bp, chicken (Gallus Gallus)
  misc_feature (36): n=c or t
caggtcagtgccaatacttctgtgctgaattccttntgctttttagtttaccaaaccccgttgcacccaac

SEQ ID NO: 4285 - DNA, 71 bp, chicken (Gallus Gallus)
  misc_feature (36): n=c or t
ctttgaaagccacatgcacttccctgcttttacaancctatttccaaccttttccatggaatttttccgta

SEQ ID NO: 4286 - DNA, 71 bp, chicken (Gallus Gallus)
  misc_feature (36): n=c or t
tcttcataccctcctctggacccgctccagaagctncatgtccttattgtgccccagaactggtctcagta

SEQ ID NO: 4287 - DNA, 71 bp, chicken (Gallus Gallus)
  misc_feature (36): n=a or c
aatgccttctgaattacatacagtatttcttccaanatctctatttcatagttactgtggtgtaggcatga

SEQ ID NO: 4288 - DNA, 71 bp, chicken (Gallus Gallus)
  misc_feature (36): n=a or g
tacctattgtgtttttgtaaattttcaattaaggancagttgctatctgtaatcaaggaggcctttcagga

SEQ ID NO: 4289 - DNA, 71 bp, chicken (Gallus Gallus)
  misc_feature (36): n=a or g
tcaagccttcatccagggatgtgtgacattgacgtngtcagtagaatatgcttaaatttatgttttaacca

SEQ ID NO: 4290 - DNA, 71 bp, chicken (Gallus Gallus)
  misc_feature (36): n=c or t
tggtggtgtttttttacaagaatggctggcagtctngctgtagtcattgcaagttgtcgccacaattaaca

SEQ ID NO: 4291 - DNA, 71 bp, chicken (Gallus Gallus)
  misc_feature (36): n=a or g
tgttactttgttctgccggggatctcagaaagctcngcacccacataaggaggagatggcattaagaaaca

SEQ ID NO: 4292 - DNA, 71 bp, chicken (Gallus Gallus)
  misc_feature (36): n=g or t
cagaaactttagctgaggtgaaatcagttgggtggngcttgactttcttgttctcttatatagcagtgtaa

SEQ ID NO: 4293 - DNA, 71 bp, chicken (Gallus Gallus)
  misc_feature (36): n=a or g
aggggaagatcttgatgttgctttggtgatctgtgntgagaccaccacagctattctctgaaccttctcaa

SEQ ID NO: 4294 - DNA, 71 bp, chicken (Gallus Gallus)
  misc_feature (36): n=a or g
caaactcatctggagtccaccatcttacagaaaacntttttagagctgactagtctacatgtcatactaaa

SEQ ID NO: 4295 - DNA, 71 bp, chicken (Gallus Gallus)
  misc_feature (36): n=a or g
aattcagtgacccgtgtaatcagaaggcacagctcntaggagacacatctactccgcactgcatccataaa

SEQ ID NO: 4296 - DNA, 71 bp, chicken (Gallus Gallus)
  misc_feature (36): n=a or g
gcttgaaacagccttccaagcagcttctcaccagcncagacttttaactccctgcaacctttggaaccaaa

SEQ ID NO: 4297 - DNA, 71 bp, chicken (Gallus Gallus)
  misc_feature (36): n=a or g
agggaaagaaacaatgtgcacaggccctcttcagtnagatttaacaaatttctttcaataaaatgataaaa

SEQ ID NO: 4298 - DNA, 71 bp, chicken (Gallus Gallus)
  misc_feature (36): n=a or c
ttcctatatgttacaatgcaaatttctagatgtgcntttcttttattccaatttaaatgaagaaaaagttt

SEQ ID NO: 4299 - DNA, 71 bp, chicken (Gallus Gallus)
  misc_feature (36): n=c or t
cgcagcgttgtcagaaatgttaatcctggtctccantaacaccttgtacctggctgctgcctctgctgctt

SEQ ID NO: 4300 - DNA, 71 bp, chicken (Gallus Gallus)
  misc_feature (36): n=a or g
cttactcttcatattctgcatacttgtcaataggancactatttcctgccccagaaaacagttccaaatgt

SEQ ID NO: 4301 - DNA, 71 bp, chicken (Gallus Gallus)
  misc_feature (36): n=c or t
cttccttgactgctctctccttctatttgcaagagnccaggaaaatcagattagatgctgctacgagtggt

SEQ ID NO: 4302 - DNA, 71 bp, chicken (Gallus Gallus)
  misc_feature (36): n=c or t
gcaacacgatacagaaactttttgtcatgaataacngtatacaaaacataacagtattaaaatacatatct

SEQ ID NO: 4303 - DNA, 71 bp, chicken (Gallus Gallus)
  misc_feature (36): n=c or t
gttctcttggttcttttgacaaccttttatcagctnggatgacacgagatctgtcagaacttgatcatcct

SEQ ID NO: 4304 - DNA, 71 bp, chicken (Gallus Gallus)
  misc_feature (36): n=a or g
ctttgtagtaagccttattaagcaagcttgatacangatgtcagtcggcctgcgggaggcaggaagccact

SEQ ID NO: 4305 - DNA, 71 bp, chicken (Gallus Gallus)
  misc_feature (36): n=a or g
tctcagtaagaaaatcagcaatatacatcagaggtncatctctcagccacacctcaatgtcaatgacctat

SEQ ID NO: 4306 - DNA, 71 bp, chicken (Gallus Gallus)
  misc_feature (36): n=a or g
gcacaagagaaatcagggatgatgcgaacagaaagntaatgaaaaagaaaactccttcaaacaaaatccat

SEQ ID NO: 4307 - DNA, 71 bp, chicken (Gallus Gallus)
  misc_feature (36): n=c or t
tgtgcaactactgttcagcaacagtcaaagcacagnatcatgcaagctgctgtgaagaagtggatcctaat

SEQ ID NO: 4308 - DNA, 71 bp, chicken (Gallus Gallus)
  misc_feature (36): n=a or g
atagcagtaggcaaaaatcacactctgtgtccgtanctgtgagctttcctgactacatgagaggcttcaat

SEQ ID NO: 4309 - DNA, 71 bp, chicken (Gallus Gallus)
  misc_feature (36): n=a or g
aaaatacagttcttcacttaacctgaaagcacagcntgtcctgtcttttaagacatggcacggtgcccaat

SEQ ID NO: 4310 - DNA, 71 bp, chicken (Gallus Gallus)
  misc_feature (36): n=a or g
aaatgcactgagaacagcaaattcactgcagaatcngaacatagagcaaacaaattcttgttcaaattgtg

SEQ ID NO: 4311 - DNA, 71 bp, chicken (Gallus Gallus)
  misc_feature (36): n=c or t
tcacagagagctgcaggaggctatgccaagcttttnatacctttaaactgcagaaagttactctgcaggtg

SEQ ID NO: 4312 - DNA, 71 bp, chicken (Gallus Gallus)
  misc_feature (36): n=a or g
tcagcctgaagtataaagaacagctatggttaactncaacaaagggttcttcagcctgttttgatcaagtg

SEQ ID NO: 4313 - DNA, 71 bp, chicken (Gallus Gallus)
  misc_feature (36): n=a or g
gagcaatgatgtggtgtgggggcagaggggtaaatnccgtgggatctgggagctgttctgtggaggggctg

SEQ ID NO: 4314 - DNA, 71 bp, chicken (Gallus Gallus)
  misc_feature (36): n=c or t
cttaagtagcaaatgcaaggtagctctgaaatatcnagagtgcaagtaccacagcgcagctgaattccccg

SEQ ID NO: 4315 - DNA, 71 bp, chicken (Gallus Gallus)
  misc_feature (36): n=a or g
actcctctgatccctcttaatgctgctgggaagctnaggtggaggcttacacagcaaaatgagtgacaacg

SEQ ID NO: 4316 - DNA, 71 bp, chicken (Gallus Gallus)
  misc_feature (36): n=c or t
ttggtttatcacacagcacatcctgtgaggcaaaangcagagcctcaccatctttttggtggtacttggag

SEQ ID NO: 4317 - DNA, 71 bp, chicken (Gallus Gallus)
  misc_feature (36): n=a or g
atacaatttaagccagcaatatgtgcttgtggcccnaaaggccaactgtatcctgggcttcatcaaaagag

SEQ ID NO: 4318 - DNA, 71 bp, chicken (Gallus Gallus)
  misc_feature (36): n=g or t
agaacaccttatggtttacacctgctgtgctgactnacaaatcttctctcttttaacttgatgcaggtaag

SEQ ID NO: 4319 - DNA, 71 bp, chicken (Gallus Gallus)
  misc_feature (36): n=c or t
ttcagtataaaaagagcaccaagctgtgccagaacngtagaagcaaatacagctagaacttcaaacctctc

SEQ ID NO: 4320 - DNA, 71 bp, chicken (Gallus Gallus)
  misc_feature (36): n=a or g
cttcatctaggaaaccagaaatgacctactcggcanccacatttcagcactattgaaagcaaaggggcatc

SEQ ID NO: 4321 - DNA, 71 bp, chicken (Gallus Gallus)
  misc_feature (36): n=a or g
agccgatgctctttcagaagcagcttttggatcacnccctgcatccccccgtggtattggctggacagcgc

SEQ ID NO: 4322 - DNA, 71 bp, chicken (Gallus Gallus)
  misc_feature (36): n=g or t
aatcggacaaccagtgcttaagccaatgcatggccntgagccagcacgctcagcactgagtggaagcaagc

SEQ ID NO: 4323 - DNA, 71 bp, chicken (Gallus Gallus)
  misc_feature (36): n=a or g
catgtctaaagtgtaagtgagggagtcctctgaggncactccgctgggtgggctccactgcagggccagcc

SEQ ID NO: 4324 - DNA, 71 bp, chicken (Gallus Gallus)
  misc_feature (36): n=c or t
gatttcacaagtttgtgtgtgatggcagacagcacngagcagagctctgcattatctatgcaataaaaccc

SEQ ID NO: 4325 - DNA, 71 bp, chicken (Gallus Gallus)
  misc_feature (36): n=c or t
aaattcacaagcatgagtcttcttggaaagaaaaantgtaaactgagccttgattattgctaaggcagacc

SEQ ID NO: 4326 - DNA, 71 bp, chicken (Gallus Gallus)
  misc_feature (36): n=a or g
ttacagaattcactgaatacagttgatctcatccanagtgactcctgagagcaaaatagttttagcattac

SEQ ID NO: 4327 - DNA, 71 bp, chicken (Gallus Gallus)
  misc_feature (36): n=c or t
tgctcgtatgaaatatacgatgtacattcagttatnggcatcttaggtaggctaaggacggtctggaaaac

SEQ ID NO: 4328 - DNA, 71 bp, chicken (Gallus Gallus)
  misc_feature (36): n=a or c
agaaggacctagaaatatctgcaactcaagaaatanaagatttaaaaagggtttgctgttgttgttgttta

SEQ ID NO: 4329 - DNA, 71 bp, chicken (Gallus Gallus)
  misc_feature (36): n=c or t
aacaaccggttttaccagtataatagaagtatgtcngaactaaggggaagaaacatgcttcctcaaggtta

SEQ ID NO: 4330 - DNA, 71 bp, chicken (Gallus Gallus)
  misc_feature (36): n=c or t
tgaaggagctgccagaaaactcgtcttgctcaaatngccacctttttctaaccaattatacgagagcgtta

SEQ ID NO: 4331 - DNA, 71 bp, chicken (Gallus Gallus)
  misc_feature (36): n=a or g
aattgataatgaactatgatcccaaagctggttatntaagcattgttaaggaaattggttttatttctgta

SEQ ID NO: 4332 - DNA, 71 bp, chicken (Gallus Gallus)
  misc_feature (36): n=a or g
ttgtttttcatcaacacaaatcacagcaattacacnaccaatagaagggagaaggttgatcaccagtgata

SEQ ID NO: 4333 - DNA, 71 bp, chicken (Gallus Gallus)
  misc_feature (36): n=a or g
ccatgagagtcactttacttgggtccacaattcccntctgccaaaacaaataaacaaaaagactcaaaata

SEQ ID NO: 4334 - DNA, 71 bp, chicken (Gallus Gallus)
  misc_feature (36): n=a or g
caccaaaatttgctttttaaatatagaacattgcangctgctggtaagtctcaggtccttcactacggtga

SEQ ID NO: 4335 - DNA, 71 bp, chicken (Gallus Gallus)
  misc_feature (36): n=a or g
tagctcagtcaccactaaggatgtgctacaagtganacagattctaacatttttatattatattatcctga

SEQ ID NO: 4336 - DNA, 71 bp, chicken (Gallus Gallus)
  misc_feature (36): n=a or g
atatttggtctttaaataaaagaagtgctagggaanactagttttaagcacacagagatgaacaagtacga

SEQ ID NO: 4337 - DNA, 71 bp, chicken (Gallus Gallus)
  misc_feature (36): n=a or g
cacggctgggcttggtgaacagtatggaaacagaantccacacagacacatgttttcctctaataaataga

SEQ ID NO: 4338 - DNA, 71 bp, chicken (Gallus Gallus)
  misc_feature (36): n=a or g
ggcacccagggcaacaggcttgaaaatattgtgtcnttaggagcagcagtagctaagtagactgttacaga

SEQ ID NO: 4339 - DNA, 71 bp, chicken (Gallus Gallus)
  misc_feature (36): n=a or g
aaccttcagtattattcaggaagcagaatatagganaagaccaacagggaaatcccatcaatattgtttca

SEQ ID NO: 4340 - DNA, 71 bp, chicken (Gallus Gallus)
  misc_feature (36): n=c or t
ccccttctgctctgtgccacttgtaggagggcttanaatgaagcacagcccctgcctgctgctcccattca

SEQ ID NO: 4341 - DNA, 71 bp, chicken (Gallus Gallus)
  misc_feature (36): n=c or t
gaggtatcttcttccctaacagcaactactgctctngcagcagcagaggaaacttacaggtacttttccca

SEQ ID NO: 4342 - DNA, 71 bp, chicken (Gallus Gallus)
  misc_feature (36): n=a or g
ctacatttatgatcagttgctgactccatatatacnccagacatgcaagcctggctccaggcacagctgaa

SEQ ID NO: 4343 - DNA, 71 bp, chicken (Gallus Gallus)
  misc_feature (36): n=c or t
taaccaagaagctatgtactagtgtattcccacaangtacattagtgtttgttagtatgttccttgaacaa

SEQ ID NO: 4344 - DNA, 71 bp, chicken (Gallus Gallus)
  misc_feature (36): n=a or g
cctgaacgatactgggatctccctccaatgagtgtnaaacccccaagaatattaggtgccagatgcacaaa

SEQ ID NO: 4345 - DNA, 71 bp, chicken (Gallus Gallus)
  misc_feature (36): n=c or t
gccctcatgtagaaggtacagcttgaaagtcattcnctgctctgttgtaggaaagctttgtacagtatctt

SEQ ID NO: 4346 - DNA, 71 bp, chicken (Gallus Gallus)
  misc_feature (36): n=a or g
agatgaggatcacaaggcaaagcttgacagctgttncattcattaattgatgggaggtgtatatttatcag

SEQ ID NO: 4347 - DNA, 71 bp, chicken (Gallus Gallus)
  misc_feature (36): n=a or g
tccttcatagtggtagggatagaaaaatagggctcntggtattctttctcctgcttttcaggagagaacaa

SEQ ID NO: 4348 - DNA, 71 bp, chicken (Gallus Gallus)
  misc_feature (36): n=c or t
atatgaaaatggaagcataaatttctaatttcatcnggatagcttttgtgcttgaggacaaaaactcggtg

SEQ ID NO: 4349 - DNA, 71 bp, chicken (Gallus Gallus)
  misc_feature (36): n=a or g
attatagttccatcagggacacctaatgatgctggntacttaatagaagtctgtaggtgatcttaaaatgt

SEQ ID NO: 4350 - DNA, 71 bp, chicken (Gallus Gallus)
  misc_feature (36): n=c or t
gggacagggcagttgttgagtgagctgaaaatattngtggccttaaaggagcagcgttctgtgtttcaggt

SEQ ID NO: 4351 - DNA, 71 bp, chicken (Gallus Gallus)
  misc_feature (36): n=g or t
tttacttcactcaagtgttagtgaggtgtgggtagnctgatatgtttgtatgatgaagttaaagaatagct

SEQ ID NO: 4352 - DNA, 71 bp, chicken (Gallus Gallus)
  misc_feature (36): n=a or g
catttaataccttccctgctgaagagtgcactaccnatgatttttatttctttttcccctaaaaaatttgc

SEQ ID NO: 4353 - DNA, 71 bp, chicken (Gallus Gallus)
  misc_feature (36): n=c or t
cagagaaactgttccttcatagttcctgtaataaangttggcagccattcattcagctgtccaaaataact

SEQ ID NO: 4354 - DNA, 71 bp, chicken (Gallus Gallus)
  misc_feature (36): n=a or g
gatggaataacacgacaaaaggattactcatcctcncccattactgaaaataggattttcacagtggatcc

SEQ ID NO: 4355 - DNA, 71 bp, chicken (Gallus Gallus)
  misc_feature (36): n=a or g
tacagtgtagcagatgatggcagaaatatcatacanctggctgctatttcctagaaacaatgtctttatta

SEQ ID NO: 4356 - DNA, 71 bp, chicken (Gallus Gallus)
  misc_feature (36): n=a or g
tttctccagcgacaagccctccttgtgctgtgcacntcttggcatagattgccctattcaaatttgccgtc

SEQ ID NO: 4357 - DNA, 71 bp, chicken (Gallus Gallus)
  misc_feature (36): n=c or t
gtcctgtgctgatctctggacctacctgcaagcctngccccagtgactttccctcgattcccatgatgctt

SEQ ID NO: 4358 - DNA, 71 bp, chicken (Gallus Gallus)
  misc_feature (36): n=a or g
ttgagactgttgtgaacaagtgaatgcaggaggcangagatgtctcatttgtgaccacgactgtacagggg

SEQ ID NO: 4359 - DNA, 71 bp, chicken (Gallus Gallus)
  misc_feature (36): n=c or t
aattgctggcatctatttttccagtctcaaaatttnccttttgcattgctagtgtttcagaaaaattcaca

SEQ ID NO: 4360 - DNA, 71 bp, chicken (Gallus Gallus)
  misc_feature (36): n=c or t
tagaagggaatgaaatagtcttaaccaaacaagtangtgcaacactgaagactaacacaattaacacaaca

SEQ ID NO: 4361 - DNA, 71 bp, chicken (Gallus Gallus)
  misc_feature (36): n=a or g
ttcattattctgaaaggaaaacctgggggaacaacngatgaacctctgaccagaaaatcagtatgaggatc

SEQ ID NO: 4362 - DNA, 71 bp, chicken (Gallus Gallus)
  misc_feature (36): n=g or t
atgtgtatagcatggaatcacagatgcttctttcancccaccttttgtcagacaagcccatagggatggtt

SEQ ID NO: 4363 - DNA, 71 bp, chicken (Gallus Gallus)
  misc_feature (36): n=c or t
aatctctgactctgtctagtggatgttttacattantttgcctctgcatttcagagtttttcagagctgtg

SEQ ID NO: 4364 - DNA, 71 bp, chicken (Gallus Gallus)
  misc_feature (36): n=c or t
tatttggaaagcatcaattgtctgcattcaatgtantaaatgtaaggcatatacttgccacagacttggag

SEQ ID NO: 4365 - DNA, 71 bp, chicken (Gallus Gallus)
  misc_feature (36): n=c or t
agctgcctgctagggtctatgtgccaaatggaccangattgtatcctgtccatgagaccaaatacttctct

SEQ ID NO: 4366 - DNA, 71 bp, chicken (Gallus Gallus)
  misc_feature (36): n=c or t
tgctgatgttcctaatgggcttatactatcctgtgnattctcagctcagtttgctcactctgggaattctg

SEQ ID NO: 4367 - DNA, 71 bp, chicken (Gallus Gallus)
  misc_feature (36): n=g or t
gtaagctgttggtaaataagacatcaaacatttatncagtccatcaatatagacagctactttctacatta

SEQ ID NO: 4368 - DNA, 71 bp, chicken (Gallus Gallus)
  misc_feature (36): n=a or c
gctcataaaaaatatatatttttaaggaatttgcanatttcatagaaagacatggacttttggaatggttc

SEQ ID NO: 4369 - DNA, 71 bp, chicken (Gallus Gallus)
  misc_feature (36): n=a or c
cagggacagagaggtgataatctacctctattctgncctcagctggaatccaagtccaagaccctcagctc

SEQ ID NO: 4370 - DNA, 71 bp, chicken (Gallus Gallus)
  misc_feature (36): n=c or t
tgttctacttagctgataattcagtgattacaccanaggtgctgtggtactgagcttgttgctaggacttc

SEQ ID NO: 4371 - DNA, 71 bp, chicken (Gallus Gallus)
  misc_feature (36): n=a or g
aacttttatgtactgatcacaaccctcaattctctnttctgtcatgctgctcaaagcagtgagaggagaca

SEQ ID NO: 4372 - DNA, 71 bp, chicken (Gallus Gallus)
  misc_feature (36): n=a or g
accatgttcataaaactggagagggttacagtaccngcagtggcaccacaacagctaaccttccttgcagg

SEQ ID NO: 4373 - DNA, 71 bp, chicken (Gallus Gallus)
  misc_feature (36): n=a or g
gaatttcagctcccagattgttcattagtctgacanaagtctttggtgtcaagtggccctatgcgataacc

SEQ ID NO: 4374 - DNA, 71 bp, chicken (Gallus Gallus)
  misc_feature (36): n=c or t
ggaaaacaaatagttcagaagaactttctaaactcncgtgcttcttcttcagggctacagaatacaaaaga

SEQ ID NO: 4375 - DNA, 71 bp, chicken (Gallus Gallus)
  misc_feature (36): n=c or t
tatccagggccttctcaaggcaagtattgaaagttnctagtaacatcctctttggacaatcctttccagtg

SEQ ID NO: 4376 - DNA, 71 bp, chicken (Gallus Gallus)
  misc_feature (36): n=a or g
tgagaactgggatgaagtttcacttcttctttgggntagcttctacctggaaatgcatttaagcatgcatt

SEQ ID NO: 4377 - DNA, 71 bp, chicken (Gallus Gallus)
  misc_feature (36): n=c or t
ttgtcactgataggtctttaacacatcaaacacacnaaggagcttactgaaggtctgaatcacaacgtgga

SEQ ID NO: 4378 - DNA, 71 bp, chicken (Gallus Gallus)
  misc_feature (36): n=a or g
agtcactgctgttctgaagactgctataatatgggntctgcatgaaatagccttggaagcaagtgttcaga

SEQ ID NO: 4379 - DNA, 71 bp, chicken (Gallus Gallus)
  misc_feature (36): n=c or t
aatctaattggcttttgatttttttctacaaactgntccaagtcttaggcacagatttcatttcctgaact

SEQ ID NO: 4380 - DNA, 71 bp, chicken (Gallus Gallus)
  misc_feature (36): n=c or t
tgcatgtcctttctctgagggttcctccttctgtcntgctcctctccttgccagctgtagccttttgctgc

SEQ ID NO: 4381 - DNA, 71 bp, chicken (Gallus Gallus)
  misc_feature (36): n=a or c
tactaaaagtttatgacagctccctgattctgggtntgatttttgacccccagttgagcatgtacaacaat

SEQ ID NO: 4382 - DNA, 71 bp, chicken (Gallus Gallus)
  misc_feature (36): n=c or t
caaagctggggcatttaattacatctaaccaatgtngcccgttgggtagacatgctatggaattggattgc

SEQ ID NO: 4383 - DNA, 71 bp, chicken (Gallus Gallus)
  misc_feature (36): n=c or t
gctgcatgtggctgcgtcctcaactggaagagaggngttgcttgtaggagggccctacttcctgtaattat

SEQ ID NO: 4384 - DNA, 71 bp, chicken (Gallus Gallus)
  misc_feature (36): n=a or g
gatatattgtctttccagcagatactgaaatggttnaagccctccactaggaccagggcttctgaatataa

SEQ ID NO: 4385 - DNA, 71 bp, chicken (Gallus Gallus)
  misc_feature (36): n=c or t
gggataggcctgatgggtagctagacacccacatcnggagagcatctaagcaaaactgcttgcatcctact

SEQ ID NO: 4386 - DNA, 71 bp, chicken (Gallus Gallus)
  misc_feature (36): n=c or t
actaactggagtgttgtctttttctagaaagaaatnccataaaggatggctctacaatttactaaggtagc

SEQ ID NO: 4387 - DNA, 71 bp, chicken (Gallus Gallus)
  misc_feature (36): n=g or t
ccttaggaaacaatgagacatgaatgtctgctctgnatatgcattttttcttaatttttattaacaaatag

SEQ ID NO: 4388 - DNA, 71 bp, chicken (Gallus Gallus)
  misc_feature (36): n=g or t
tcaacctgctaggttaatttctccatacagaacggngtgtttttctcccttcagccagccattcatttgtc

SEQ ID NO: 4389 - DNA, 71 bp, chicken (Gallus Gallus)
  misc_feature (36): n=a or g
ttgtttttctaatgagtagttgagcttctgcagcantatcgtgaggctgaagtttgtttctgttactgatt

SEQ ID NO: 4390 - DNA, 71 bp, chicken (Gallus Gallus)
  misc_feature (36): n=a or g
acttaaggaagttaacatttcattacatcatttccnatgtcaagcaagctggctgaactagatatatttta

SEQ ID NO: 4391 - DNA, 71 bp, chicken (Gallus Gallus)
  misc_feature (36): n=a or g
taaggtcaccatctgcaacacacacagctaatcccnacaagagctccacaagcacatttcagtgggaactg

SEQ ID NO: 4392 - DNA, 71 bp, chicken (Gallus Gallus)
  misc_feature (36): n=a or g
cttaaaataaaactaagcatttcaagcaatcaatcngtgaggtaagtcattactcagatattctgttttaa

SEQ ID NO: 4393 - DNA, 71 bp, chicken (Gallus Gallus)
  misc_feature (36): n=c or t
tctgcccaaaccaccctatgaaccctcagaagaaangtgctcttatgtttgcttaaagccagctaagaagg

SEQ ID NO: 4394 - DNA, 71 bp, chicken (Gallus Gallus)
  misc_feature (36): n=c or t
atagagaaactccatgtgacaaaactctgctgttgncttaaataactattcaggtgacaggaacatgataa

SEQ ID NO: 4395 - DNA, 71 bp, chicken (Gallus Gallus)
  misc_feature (36): n=a or g
tacttgtatttgaagacaaaacttatttgaaaagcntatcatacaattagcttgcaaaagactgcaagtca

SEQ ID NO: 4396 - DNA, 71 bp, chicken (Gallus Gallus)
  misc_feature (36): n=a or g
tgtcaaggtataatgaaaatatcatccatttcaccntgctgcaaatccattttaatgtattttttttcatt

SEQ ID NO: 4397 - DNA, 71 bp, chicken (Gallus Gallus)
  misc_feature (36): n=c or t
ttgtgttagcaatgtggggtttgaaagaacagcaanagatcctgccaataaatggtgtcacctgtgctggt

SEQ ID NO: 4398 - DNA, 71 bp, chicken (Gallus Gallus)
  misc_feature (36): n=a or g
tccatgccatgtttgcttgctccacacactgacatncagtgggcactgcggctgccgtcacatatgctgtt

SEQ ID NO: 4399 - DNA, 71 bp, chicken (Gallus Gallus)
  misc_feature (36): n=c or t
ctggccttgggtgagaatgatggggtttgcatcagnccctttttgctgctgcattggatgttctccatgca

SEQ ID NO: 4400 - DNA, 71 bp, chicken (Gallus Gallus)
  misc_feature (36): n=c or t
aagccaaaggaaggtgcattatagctgcctgtttgnaagtatgtagcattagtacttaactgaacgttaag

SEQ ID NO: 4401 - DNA, 71 bp, chicken (Gallus Gallus)
  misc_feature (36): n=g or t
gcacatctttatttttagagctatttataaagactnttaagtagcacatttagacagatcatatttttacc

SEQ ID NO: 4402 - DNA, 71 bp, chicken (Gallus Gallus)
  misc_feature (36): n=a or g
acatcccaaattttgagctgtgtttcttgctggacnattgctctttctcaccatcttctgtggttttcata

SEQ ID NO: 4403 - DNA, 71 bp, chicken (Gallus Gallus)
  misc_feature (36): n=g or t
gtaggaaaacaaagcagaattcaaaacttgcagctncttctgttgggtgagccatgttttctgcacgttgt

SEQ ID NO: 4404 - DNA, 71 bp, chicken (Gallus Gallus)
  misc_feature (36): n=g or t
attatgctgaagaatccaggatttaagagagctatnttagagattcacagcctcagcagtagcactatgtg

SEQ ID NO: 4405 - DNA, 71 bp, chicken (Gallus Gallus)
  misc_feature (36): n=c or t
ctgtccctggacacattcaagacctgagcaaatcanctagctgtagaaatctctgttcattgcaggggaga

SEQ ID NO: 4406 - DNA, 71 bp, chicken (Gallus Gallus)
  misc_feature (36): n=c or t
ataagtcagatctgaatacatcatagttactatttnccactggctttttccaaagcatggcattgtcactg

SEQ ID NO: 4407 - DNA, 71 bp, chicken (Gallus Gallus)
  misc_feature (36): n=c or g
accccgtagcacccatgaaccagccaaaggttaggncacgatgttcagtctctctcctttgcaaagcccag

SEQ ID NO: 4408 - DNA, 71 bp, chicken (Gallus Gallus)
  misc_feature (36): n=c or t
gagaacaaaacctcatgaaagagcttggtactcacnacgcccatgctaattctaactgagatttactgcat

SEQ ID NO: 4409 - DNA, 71 bp, chicken (Gallus Gallus)
  misc_feature (36): n=a or g
tacactgtatcacccaagagttcattttacctgctncctgctcacttgggagtgatctctagagatatgca

SEQ ID NO: 4410 - DNA, 71 bp, chicken (Gallus Gallus)
  misc_feature (36): n=c or t
cgagaaaaacaaccaaatctgctttgcagttgtctnaaattagagctagtcctggaaaatggatgaggaaa

SEQ ID NO: 4411 - DNA, 71 bp, chicken (Gallus Gallus)
  misc_feature (36): n=a or g
cacacactttcagcctattccttaatgtacacactnttcttaatcaatcctgaatacagtgagtgactgct

SEQ ID NO: 4412 - DNA, 71 bp, chicken (Gallus Gallus)
  misc_feature (36): n=a or g
atagggtttctctcaagcatgaaatattaaaggaancgaggccaggtgcttaccaagcgtgctttgttact

SEQ ID NO: 4413 - DNA, 71 bp, chicken (Gallus Gallus)
  misc_feature (36): n=c or t
aggccatgaaattgtgtatattttttaatgcaaaanagttgaagaggtgaaactttaaaatgtagctatta

SEQ ID NO: 4414 - DNA, 71 bp, chicken (Gallus Gallus)
  misc_feature (36): n=c or g
cttcccccaaaatagacttcatgattcatgctctanccagcataaactggcattgctcagaggactcatta

SEQ ID NO: 4415 - DNA, 71 bp, chicken (Gallus Gallus)
  misc_feature (36): n=c or t
ggaactttcactgttgtgaagaggaattgtgctggntcatgctaattttcttcatagtagtgcatgtggtg

SEQ ID NO: 4416 - DNA, 71 bp, chicken (Gallus Gallus)
  misc_feature (36): n=a or g
cacaatgatcttatcttcagttgcccagaacttcangaattatagttctatgaggtctctcatgactgcca

SEQ ID NO: 4417 - DNA, 71 bp, chicken (Gallus Gallus)
  misc_feature (36): n=a or c
tctcaaatggaaggaaaccaggccatcgtgaacccnctctgccttctgatgttaatgcagaagagggcttt

SEQ ID NO: 4418 - DNA, 71 bp, chicken (Gallus Gallus)
  misc_feature (36): n=a or g
aattggagacatagtagctagataaggcaccttaanttgtgcattatgagtactcacctgcatcactgccc

SEQ ID NO: 4419 - DNA, 71 bp, chicken (Gallus Gallus)
  misc_feature (36): n=c or t
gatcctcctgcaggaagcttgtacagctttccttangtattgcttgaatcctggtgagttaaactgcttgt

SEQ ID NO: 4420 - DNA, 71 bp, chicken (Gallus Gallus)
  misc_feature (36): n=c or t
gtaagttttgtctttcctcctatgatttaagtgaangtaataataatgattttttgtaatagataccttga

SEQ ID NO: 4421 - DNA, 71 bp, chicken (Gallus Gallus)
  misc_feature (36): n=a or t
tgagttatcagtaagaccaggatcttgtttctgtgnggaaaaaaaaatgttcttgtgcagtcggttattgc

SEQ ID NO: 4422 - DNA, 71 bp, chicken (Gallus Gallus)
  misc_feature (36): n=a or g
agcttgtcaaggattgttctctatctctgtaaatgnaaagacttgacattcatttgcaacctgtttttctt

SEQ ID NO: 4423 - DNA, 71 bp, chicken (Gallus Gallus)
  misc_feature (36): n=a or g
aaaggcaaaaagaagacctgagagccaccaatttcnaggcttctgccatccgctcagtctcacagaagaag

SEQ ID NO: 4424 - DNA, 71 bp, chicken (Gallus Gallus)
  misc_feature (36): n=c or t
tccaaaaggaaaagcactgcagctgaggagcttgtncagtcagtttttttgagaatctcaaaagatttcac

SEQ ID NO: 4425 - DNA, 71 bp, chicken (Gallus Gallus)
  misc_feature (36): n=a or g
ctggcatgaatttaaggacattttctaggtaagatnttattaaatatgcatgttcatttgtttcacaacat

SEQ ID NO: 4426 - DNA, 71 bp, chicken (Gallus Gallus)
  misc_feature (36): n=a or g
tcagcagtcgatgacatggacttaatctgctctagnagcacagctagtgttttttttcccccaccattttg

SEQ ID NO: 4427 - DNA, 71 bp, chicken (Gallus Gallus)
  misc_feature (36): n=c or t
atatttaaaaaatcttttttctttatgaactactcnggggagtaaaatatttggggcacttaaggagtatg

SEQ ID NO: 4428 - DNA, 71 bp, chicken (Gallus Gallus)
  misc_feature (36): n=c or t
tgcatcactttggtcctgtggctcccaagacattgncatacttcttggtcagctgtacctttccaaaatgc

SEQ ID NO: 4429 - DNA, 71 bp, chicken (Gallus Gallus)
  misc_feature (36): n=g or t
gtgaggggctgccatctcctcagagagaaaagacancaagtgttcaaaccttttgaaatatggagctcagg

SEQ ID NO: 4430 - DNA, 71 bp, chicken (Gallus Gallus)
  misc_feature (36): n=c or t
tctctaaagaaaactcccgatcctgcaaaggactgngtataatatagaagctgaaaagtgtccaaggttat

SEQ ID NO: 4431 - DNA, 71 bp, chicken (Gallus Gallus)
  misc_feature (36): n=a or g
tctggtattctgcctcaatgctggaaaactaccttntgagagcattcttaaatcacaagtcttagaaactt

SEQ ID NO: 4432 - DNA, 71 bp, chicken (Gallus Gallus)
  misc_feature (36): n=a or g
ataagaatgcgctcagagctctaaacaagccacagnagcaccatgattacacagactgtcattagcagcac

SEQ ID NO: 4433 - DNA, 71 bp, chicken (Gallus Gallus)
  misc_feature (36): n=c or t
tatgaaaacgagtcctgaagttatcacaagttttgnatactccacaagccacagaacactgtggtgtaacg

SEQ ID NO: 4434 - DNA, 71 bp, chicken (Gallus Gallus)
  misc_feature (36): n=a or g
ttttgaagctctcagtttagcttaaaagagggatanatgaaaaacaagcatgctatatacaacacacttaa

SEQ ID NO: 4435 - DNA, 71 bp, chicken (Gallus Gallus)
  misc_feature (36): n=a or g
tggtgttagcagagtataaagtttaaatgctttctnttgcagtgtgagtttgtctccagtatgttactgac

SEQ ID NO: 4436 - DNA, 71 bp, chicken (Gallus Gallus)
  misc_feature (36): n=c or t
caacagaatgtcagttgaatgtttgctatttgtttncatgtttgccaccgagcataagaaatctgaacaag

SEQ ID NO: 4437 - DNA, 71 bp, chicken (Gallus Gallus)
  misc_feature (36): n=a or g
gccagcacaacataggagaaaccttcaataacacgnaatagagcagaccactgaggatgtgtatacatcaa

SEQ ID NO: 4438 - DNA, 71 bp, chicken (Gallus Gallus)
  misc_feature (36): n=a or t
ggattttagcaaagggagatgccacagacaggaagncagactgacacagagctacaaggaagactgataaa

SEQ ID NO: 4439 - DNA, 71 bp, chicken (Gallus Gallus)
  misc_feature (36): n=c or t
caaaacaggcagtcagtagtaaaagaagcatttaanaataatcctaacttcctaagatcactaaaacaaag

SEQ ID NO: 4440 - DNA, 71 bp, chicken (Gallus Gallus)
  misc_feature (36): n=a or g
caccatcagggagcaatgcttgttttcaaagctcangaaaagaaatgatttatcaacagtcccaaattgaa

SEQ ID NO: 4441 - DNA, 71 bp, chicken (Gallus Gallus)
  misc_feature (36): n=a or t
agatgtaggaagttctgaactctggtcaaaaaaatnagaaccgtccttctaatttttacagaaattatttc

SEQ ID NO: 4442 - DNA, 71 bp, chicken (Gallus Gallus)
  misc_feature (36): n=c or t
aagaggactgttaaattctatacctgttaatagatnatatcctcatttgttggttcctgttgatacctact

SEQ ID NO: 4443 - DNA, 71 bp, chicken (Gallus Gallus)
  misc_feature (36): n=a or c
ccaggcacacacctgtcagatgagcttactgtctcnttacctctaacagtctctggaatcattcaccctat

SEQ ID NO: 4444 - DNA, 71 bp, chicken (Gallus Gallus)
  misc_feature (36): n=a or g
tgactggagcttttaagtactatgataataagagcngggacatgcatacatggtgcatgcattgccgctgt

SEQ ID NO: 4445 - DNA, 71 bp, chicken (Gallus Gallus)
  misc_feature (36): n=a or g
taattaatatatttgaaaaacttatgatcaaatatnagaaatctctgcttgcagctgtttccattcatgcg

SEQ ID NO: 4446 - DNA, 71 bp, chicken (Gallus Gallus)
  misc_feature (36): n=c or t
caccatccatccagcctacttctttgctcctgctgnggagtcagctccactttagatacaaatcagcactt

SEQ ID NO: 4447 - DNA, 71 bp, chicken (Gallus Gallus)
  misc_feature (36): n=a or g
aagaggcataaccccgcagagaatctgctgtgtgantactcagaggtagctgttttcctttctacttccat

SEQ ID NO: 4448 - DNA, 71 bp, chicken (Gallus Gallus)
  misc_feature (36): n=a or g
agtttacgatgctagcagatttgcttgataggatcnggcctttgcaggttcaagttacatgttttgctatg

SEQ ID NO: 4449 - DNA, 71 bp, chicken (Gallus Gallus)
  misc_feature (36): n=c or t
ccaacaagccaactaaactatatccctcagtgccanatctcctattttcttgaaaatctctggggatgatg

SEQ ID NO: 4450 - DNA, 71 bp, chicken (Gallus Gallus)
  misc_feature (36): n=g or t
aaaaaaatgcaaggaaggaagaagctacagagcagncagaccttccatttcatctgtattggactcctact

SEQ ID NO: 4451 - DNA, 71 bp, chicken (Gallus Gallus)
  misc_feature (36): n=a or g
tacatttttgttaagaataaaaaggctctgttcctngctgcattaattgtccatggttttgtaagagactg

SEQ ID NO: 4452 - DNA, 71 bp, chicken (Gallus Gallus)
  misc_feature (36): n=g or t
aaggaaggagcaaattagcttcctgccctgatggancagaaattaccagatcatccttacaccactgatac

SEQ ID NO: 4453 - DNA, 71 bp, chicken (Gallus Gallus)
  misc_feature (36): n=a or g
ggtggtagaaatccctttttgttctgaaaatgcacntcccagggcaatatgtcaatggttggtgctgcaag

SEQ ID NO: 4454 - DNA, 71 bp, chicken (Gallus Gallus)
  misc_feature (36): n=c or t
caccttaattgatactacttaactgaacctacaggnctatccacataacaatgctcacaaaattaatctga

SEQ ID NO: 4455 - DNA, 71 bp, chicken (Gallus Gallus)
  misc_feature (36): n=a or g
tcatcaggctgaacttggatagctttaaaatatacnttctacctgtgaatgtggtggggatggcgtgggat

SEQ ID NO: 4456 - DNA, 71 bp, chicken (Gallus Gallus)
  misc_feature (36): n=a or g
caagcagttctttgcccttgtaaaattaatcaagtntgtttgcccaggcatttccctaatgccgctcttag

SEQ ID NO: 4457 - DNA, 71 bp, chicken (Gallus Gallus)
  misc_feature (36): n=c or t
gtcccctcattaagctgaatgcatacccctgatcangtccatcttcaccaactacagttttccctcagaaa

SEQ ID NO: 4458 - DNA, 71 bp, chicken (Gallus Gallus)
  misc_feature (36): n=a or c
cagtgctgtgtcggtggtacctcaaagccagagggncttcatgctgaatacttctcctgggattttgtttt

SEQ ID NO: 4459 - DNA, 71 bp, chicken (Gallus Gallus)
  misc_feature (36): n=a or g
aatacccacttagatggattcaacagataaacaacnttcaagtaaagcttctgaaacaaaggtacgagagg

SEQ ID NO: 4460 - DNA, 71 bp, chicken (Gallus Gallus)
  misc_feature (36): n=c or t
tacagctggaagggcagaaatgggcatcctgtttcncaaagacagcaaagcaaatggattttaggaaaaca

SEQ ID NO: 4461 - DNA, 71 bp, chicken (Gallus Gallus)
  misc_feature (36): n=a or c
gcctgcctcagctattagcttgaatttattactgcncaacaaagcactgtttatggctgacttcagctgta

SEQ ID NO: 4462 - DNA, 71 bp, chicken (Gallus Gallus)
  misc_feature (36): n=a or c
tcataggtagaactgggtgttgttaggaaaaaaaancaactgaaatatgcttaaagtaatatgtcatttgg

SEQ ID NO: 4463 - DNA, 71 bp, chicken (Gallus Gallus)
  misc_feature (36): n=c or t
cattgactcttaggatcaggtgcattgattgaccangaatgagaatgaggagacatggtttagaagattat

SEQ ID NO: 4464 - DNA, 71 bp, chicken (Gallus Gallus)
  misc_feature (36): n=g or t
attaaaatgggaatttatgtccctcacgtccatagnggaaactctgtgttctatgttattgatttcctggt

SEQ ID NO: 4465 - DNA, 71 bp, chicken (Gallus Gallus)
  misc_feature (36): n=a or t
cctgtattgagatgacctcgaagtttctgcagagangtgagcctccatccctgaagaattagagcataaac

SEQ ID NO: 4466 - DNA, 71 bp, chicken (Gallus Gallus)
  misc_feature (36): n=c or t
gaacaacgtatctgctccttcctggtgctggcttangagcaatctcttacttcatggtaaagcaaagccct

SEQ ID NO: 4467 - DNA, 71 bp, chicken (Gallus Gallus)
  misc_feature (36): n=c or t
cattggatattagaaagctgccttacaattcattgntcaatgcataacaaacattaaattcattggcaatg

SEQ ID NO: 4468 - DNA, 71 bp, chicken (Gallus Gallus)
  misc_feature (36): n=c or t
tcttaagatatcaccagtatgtgggtgctaatagantgattttacctaatttccaagcagaggaaacaacc

SEQ ID NO: 4469 - DNA, 71 bp, chicken (Gallus Gallus)
  misc_feature (36): n=a or g
tctggaagcagagctcttgcactcctccaatcatantgtgagatagttatttcactgtgtgtttaggcatc

SEQ ID NO: 4470 - DNA, 71 bp, chicken (Gallus Gallus)
  misc_feature (36): n=c or t
aaaaaatagttttactgaaatttaaagcaatattgncagtgaccttaataaagtcagtgggtgtctaacat

SEQ ID NO: 4471 - DNA, 71 bp, chicken (Gallus Gallus)
  misc_feature (36): n=c or t
aacaatttgtgagctgcagggagcctgcagtatgtngataccagtagtccctatgtcccagaggacttcca

SEQ ID NO: 4472 - DNA, 71 bp, chicken (Gallus Gallus)
  misc_feature (36): n=a or g
caagaattccttgataagtaataccaattggagttngaaaaagtaattatttgagaaagagacattcagat

SEQ ID NO: 4473 - DNA, 71 bp, chicken (Gallus Gallus)
  misc_feature (36): n=a or g
ttatttacttactataataatttcatactttaaacngttcttaaatttgctctattaagagtaaaaaagat

SEQ ID NO: 4474 - DNA, 71 bp, chicken (Gallus Gallus)
  misc_feature (36): n=a or g
cacacaacaacagggccaccttccaagctgaactcntctccaaatgcagatcactctattcagagttgaga

SEQ ID NO: 4475 - DNA, 71 bp, chicken (Gallus Gallus)
  misc_feature (36): n=c or t
taacaactttggtgcaaatagagcaccaggaagggnagggataagaggaacctatggaatttggcaacgta

SEQ ID NO: 4476 - DNA, 71 bp, chicken (Gallus Gallus)
  misc_feature (36): n=a or g
gacttgcatcagtagcatgatgtcctgagatgatgncccgaaggatgttaactggcagcaagacaaaacca

SEQ ID NO: 4477 - DNA, 71 bp, chicken (Gallus Gallus)
  misc_feature (36): n=a or g
gtgtctgtgaaattaatttctgaggttatgatggangagctttgatggagatttagttgttatatcgatag

SEQ ID NO: 4478 - DNA, 71 bp, chicken (Gallus Gallus)
  misc_feature (36): n=c or t
agctgttgacagcacagaagtgccactgaaaccaanagccatacagtttttccaattcggtataaaagaat

SEQ ID NO: 4479 - DNA, 71 bp, chicken (Gallus Gallus)
  misc_feature (36): n=c or t
tttggattgctcagtttaatgtgtatatccaacccnaccaacaaagcaacttctaattcctatagtggagt

SEQ ID NO: 4480 - DNA, 71 bp, chicken (Gallus Gallus)
  misc_feature (36): n=c or g
acccttcttgctaaagcatttgttttctgtcactgnacttctgtgatctgccctagtcgtcccacctcaac

SEQ ID NO: 4481 - DNA, 71 bp, chicken (Gallus Gallus)
  misc_feature (36): n=a or t
attttactcactatatggactgctttaggcatagtngactttgaataactcaaatcagtacgcaggacaat

SEQ ID NO: 4482 - DNA, 71 bp, chicken (Gallus Gallus)
  misc_feature (36): n=c or g
cccagggaggctgggcagccaagcagacacccatgntacattatatgagctgctttggttgttcagggtta

SEQ ID NO: 4483 - DNA, 71 bp, chicken (Gallus Gallus)
  misc_feature (36): n=c or t
ctgcagttatttcgttatgcaattttggtgcccatntcctgataacttattgtctcttccttctttccagt

SEQ ID NO: 4484 - DNA, 71 bp, chicken (Gallus Gallus)
  misc_feature (36): n=c or t
cccagaaaaccatatgtactaaagctagtgttaccngatggaattttgaagaactgtatgatacatgtggt

SEQ ID NO: 4485 - DNA, 71 bp, chicken (Gallus Gallus)
  misc_feature (36): n=a or g
taggggtgtagacaaatacactagcattctacagtntcaggctgagagagctcaggctcttcagtctggag

SEQ ID NO: 4486 - DNA, 71 bp, chicken (Gallus Gallus)
  misc_feature (36): n=a or g
ttgcttttacttgagattactcctaatttacaatcntatagctattagagctattagcggaattagaggag

SEQ ID NO: 4487 - DNA, 71 bp, chicken (Gallus Gallus)
  misc_feature (36): n=c or t
agtagaaaactgaacacttacttggagaagcaaaanagacatactaagcaaaatttttattcaggagcagc

SEQ ID NO: 4488 - DNA, 71 bp, chicken (Gallus Gallus)
  misc_feature (36): n=c or t
ataaagctgtaaagtatacctgcccttgagggctgngctgatttaatttctcaaccactatgattattgca

SEQ ID NO: 4489 - DNA, 71 bp, chicken (Gallus Gallus)
  misc_feature (36): n=g or t
tatctctatataactatcctgtccttcttttagctncaggtttgcccattttttacttcattttatttagc

SEQ ID NO: 4490 - DNA, 71 bp, chicken (Gallus Gallus)
  misc_feature (36): n=a or g
gaaggagctttaacagggcgagacattagaagaacncggtcctacagtagggatgtgcaaggatacagata

SEQ ID NO: 4491 - DNA, 71 bp, chicken (Gallus Gallus)
  misc_feature (36): n=c or t
tgctgctgtgtttgtcaaagaaccaccactttaagnagctgctatctcagagcactggtacagtgtgttga

SEQ ID NO: 4492 - DNA, 71 bp, chicken (Gallus Gallus)
  misc_feature (36): n=c or t
aatgatggaggaacagacttctagcccaccagcttncatactacagagaactgatgttcagaactgaacca

SEQ ID NO: 4493 - DNA, 71 bp, chicken (Gallus Gallus)
  misc_feature (36): n=a or g
cctctgtctctgtgccacatctcagagtctaaaagncacgtgtgcaatcctaccagacttcagaagggacc

SEQ ID NO: 4494 - DNA, 71 bp, chicken (Gallus Gallus)
  misc_feature (36): n=a or g
ttgttgtccctgtctccagtcatattccaatcaccntataacaggaagaaaaattgcaactgagtcatttg

SEQ ID NO: 4495 - DNA, 71 bp, chicken (Gallus Gallus)
  misc_feature (36): n=a or c
acagccagggggtgagaggacagccaaaggtctganagcagtcagaagttcccactgaactccgaactagt

SEQ ID NO: 4496 - DNA, 71 bp, chicken (Gallus Gallus)
  misc_feature (36): n=a or c
tccacatagaattcatgcaaccatacacagatgttntagattgaattacaaagagatgggagatgatgtct

SEQ ID NO: 4497 - DNA, 71 bp, chicken (Gallus Gallus)
  misc_feature (36): n=c or t
tggcgaatggcagtgcctatgctggacaagcagagnggtgtggcacagggatggcatcacagcttgctgtg

SEQ ID NO: 4498 - DNA, 71 bp, chicken (Gallus Gallus)
  misc_feature (36): n=a or g
cctttgttacctttttaagaacatcatcccaagctngggtgttctcttttgtgctttgtgcagtcagttac

SEQ ID NO: 4499 - DNA, 71 bp, chicken (Gallus Gallus)
  misc_feature (36): n=c or t
acatctttttgctcctctctttcgcccttttcttgnctcatctgttccagctatatgagcttggacactag

SEQ ID NO: 4500 - DNA, 71 bp, chicken (Gallus Gallus)
  misc_feature (36): n=a or g
tgcgtgtgacacagtgttcctaagctgtgacagaancccaggtcacgcagttgggttttcctgagctggaa

SEQ ID NO: 4501 - DNA, 71 bp, chicken (Gallus Gallus)
  misc_feature (36): n=c or t
tcggtgctgggtctggtattgtccaatatcttcaangacaaccttgacaatgggatagtgcccaccctcag

SEQ ID NO: 4502 - DNA, 71 bp, chicken (Gallus Gallus)
  misc_feature (36): n=g or t
tataaaagtgtcttatatgcagttagaatgagcttnctttctttaaacgttagtttcccttctccgaccaa

SEQ ID NO: 4503 - DNA, 71 bp, chicken (Gallus Gallus)
  misc_feature (36): n=a or g
tgtgtgggatagctgatgctgatctctggagagatncacaaacgtgttccttgtgtgtatcagaagagtct

SEQ ID NO: 4504 - DNA, 71 bp, chicken (Gallus Gallus)
  misc_feature (36): n=a or t
tcagattgtcacaaacctggctgggagccactcatnggacatgcttcagattgctacctcagaatccaggt

SEQ ID NO: 4505 - DNA, 71 bp, chicken (Gallus Gallus)
  misc_feature (36): n=c or t
tttcttgaaggcagctggatttaaactcctttctgntcctgtgagctagatttgcagagactggcagtctt

SEQ ID NO: 4506 - DNA, 71 bp, chicken (Gallus Gallus)
  misc_feature (36): n=a or g
tcaattacaccttccttagtcttaatacatgtaatncatctttaatctaggaaggctgcattaagaagtga

SEQ ID NO: 4507 - DNA, 71 bp, chicken (Gallus Gallus)
  misc_feature (36): n=g or t
tccaatggggaaaaaaaagaaagagaaaaaaaaagntgctagtatgaagcttactttggctgggaaagcat

SEQ ID NO: 4508 - DNA, 71 bp, chicken (Gallus Gallus)
  misc_feature (36): n=a or t
tgagccactgcgctctcgcgtgacgggttctcctcncttttcaaagtaattattacaatccactttagatg

SEQ ID NO: 4509 - DNA, 71 bp, chicken (Gallus Gallus)
  misc_feature (36): n=c or t
gtagccagttgctgcctagttgttccagaatcatcntcctgtaagcagtctccaactgatgaagaagataa

SEQ ID NO: 4510 - DNA, 71 bp, chicken (Gallus Gallus)
  misc_feature (36): n=c or t
gcataactaagtatttaaacccacggcactgaaacngaaggatagatcccagaacagaaagcatttacaaa

SEQ ID NO: 4511 - DNA, 71 bp, chicken (Gallus Gallus)
  misc_feature (36): n=a or g
cacattaatatgcctgcaaaggtcagagcagcacancgcacagaataagcctgcttaacgaggagaacttc

SEQ ID NO: 4512 - DNA, 71 bp, chicken (Gallus Gallus)
  misc_feature (36): n=c or t
tcataacaaagtctacttgtgaaatgcttggaaaangtcagtaagaaagtttaatggctttcagctaccac

SEQ ID NO: 4513 - DNA, 71 bp, chicken (Gallus Gallus)
  misc_feature (36): n=c or t
tgcatatgtatgtgtaaatcatctgcttaagtgttngcatagtctacaattgtttcaatacccgtagcttg

SEQ ID NO: 4514 - DNA, 71 bp, chicken (Gallus Gallus)
  misc_feature (36): n=c or t
atgcgttccaaccacacagtctgacccctgtgctcntcagtttcccagcttcaggtactatcaccacaaaa

SEQ ID NO: 4515 - DNA, 71 bp, chicken (Gallus Gallus)
  misc_feature (36): n=a or g
tggagggggaatctctcatttgaactcaaagctgangcgtaaaatgccagttcccacagtgatacagtacc

SEQ ID NO: 4516 - DNA, 71 bp, chicken (Gallus Gallus)
  misc_feature (36): n=a or g
gatggagcaaggtccaaaagacaccagaagttcacncatttcctgcccagacctgtggatcctgaaagagt

SEQ ID NO: 4517 - DNA, 71 bp, chicken (Gallus Gallus)
  misc_feature (36): n=a or g
gggaagctccagcattcagcctgctgctggatgttncctctgccttggattaatttgtagagcaaagttac

SEQ ID NO: 4518 - DNA, 71 bp, chicken (Gallus Gallus)
  misc_feature (36): n=a or g
atgttgccacaggcattttacatagagggagctacntttgttttgaaaagtgtatttccagttaggaggaa

SEQ ID NO: 4519 - DNA, 71 bp, chicken (Gallus Gallus)
  misc_feature (36): n=a or c
ctgtactgttgtacctggatgacaggaggctggtanggaggttttaaagccagcctgctgcttcctgacct

SEQ ID NO: 4520 - DNA, 71 bp, chicken (Gallus Gallus)
  misc_feature (36): n=a or g
gtagttcagaaggagaattttgattctcactgtgantatcactctcatcattttgtgactagcttcacact

SEQ ID NO: 4521 - DNA, 71 bp, chicken (Gallus Gallus)
  misc_feature (36): n=a or g
ccatgtgctgcaggtaatggtacctaccctcacttnataatacattttaaaatatacatctaagataggcg

SEQ ID NO: 4522 - DNA, 71 bp, chicken (Gallus Gallus)
  misc_feature (36): n=c or t
gtgtggatcctgtaccaaggaactgagtccacaaangtgtgcagcagggcttcattacttggcttctttga

SEQ ID NO: 4523 - DNA, 71 bp, chicken (Gallus Gallus)
  misc_feature (36): n=c or t
taccctccaatctgactcttagcaacgaattcccanagtagcagaaagattcactgtgcaaagctaagtcc

SEQ ID NO: 4524 - DNA, 71 bp, chicken (Gallus Gallus)
  misc_feature (36): n=a or g
ctggatctgtggtttaggtgcaaagtctcaggagcncattaagcacattgcaaccacttgagctggtcatg

SEQ ID NO: 4525 - DNA, 71 bp, chicken (Gallus Gallus)
  misc_feature (36): n=a or g
gatgaagaatcagaataaagcagctatggcactagntattgctttaaggaaagagcatcttgaagatctgt

SEQ ID NO: 4526 - DNA, 71 bp, chicken (Gallus Gallus)
  misc_feature (36): n=c or t
agaaaggggaaaaacagcacataatatagttgcttntctttgtacaaactacaatcaagcttctgcatgca

SEQ ID NO: 4527 - DNA, 71 bp, chicken (Gallus Gallus)
  misc_feature (36): n=g or t
aaattgtagaagagcgacagactcctgtgcaaaagnagtcgagtcccagtagactcacttattaactgtca

SEQ ID NO: 4528 - DNA, 71 bp, chicken (Gallus Gallus)
  misc_feature (36): n=a or g
acaggttttacagcacctattgacatttttacacantcacttttttggatatatggagcttcattccctcc

SEQ ID NO: 4529 - DNA, 71 bp, chicken (Gallus Gallus)
  misc_feature (36): n=g or t
tcagattagtttgttttggctcaaattatgttctcngttattgtttgggagctttttctccattttgaatt

SEQ ID NO: 4530 - DNA, 71 bp, chicken (Gallus Gallus)
  misc_feature (36): n=a or g
tctctctttaccctgaagaaaaaacagcgttccatntccagcaattcagcctcccactcccatcacagctg

SEQ ID NO: 4531 - DNA, 71 bp, chicken (Gallus Gallus)
  misc_feature (36): n=c or t
tgtctccttggagattttttgaagccatctgaatangatcctgggcaaccagctccaggagcccctatttc

SEQ ID NO: 4532 - DNA, 71 bp, chicken (Gallus Gallus)
  misc_feature (36): n=a or g
tgaaaagtgttggatgccaatttcgcagaaactganaacagctttccctttacttataactcttccacaat

SEQ ID NO: 4533 - DNA, 71 bp, chicken (Gallus Gallus)
  misc_feature (36): n=a or g
cttctgttgaaataataaaatgtaagcagcagagtntgtggatgcacatactcaaatccagctcacacaca

SEQ ID NO: 4534 - DNA, 71 bp, chicken (Gallus Gallus)
  misc_feature (36): n=g or t
agtatatattagcaattggcctaaaaacatatgcanttaattataatgtttctggtatggtttgctttttt

SEQ ID NO: 4535 - DNA, 71 bp, chicken (Gallus Gallus)
  misc_feature (36): n=c or t
cctccggtgtggtctttggagagaaaagactgctgngattttagtcctcagcacctgacacgaacaacgcc

SEQ ID NO: 4536 - DNA, 71 bp, chicken (Gallus Gallus)
  misc_feature (36): n=c or t
cacagttcattttttctggaacatgagcacattgcnagcttgtacatgcacactgaaagtattcagcttat

SEQ ID NO: 4537 - DNA, 71 bp, chicken (Gallus Gallus)
  misc_feature (36): n=c or t
gttagacctttgaaacatgtgacagttactgctctntgatatcatgtacctctggtaactgtttgaagttt

SEQ ID NO: 4538 - DNA, 71 bp, chicken (Gallus Gallus)
  misc_feature (36): n=c or t
aacagccaggctctgactgaagctacctcctcttanagcaagcattcaagacaggaacagcagcaatatcc

SEQ ID NO: 4539 - DNA, 71 bp, chicken (Gallus Gallus)
  misc_feature (36): n=c or t
agacaccgtgaccttgccagttccaccagtcttctngctgaagaaggctgactattggtctagtattaaac

SEQ ID NO: 4540 - DNA, 71 bp, chicken (Gallus Gallus)
  misc_feature (36): n=c or t
ctatcccagtctgggtagggctatgacttggaaacngttccagatctggaagcaggttcctcccctctttg

SEQ ID NO: 4541 - DNA, 71 bp, chicken (Gallus Gallus)
  misc_feature (36): n=c or t
gtgcagatatattgacagatgaattttcctttcaanagtagtaaattctgcccatccttactttcctcttt

SEQ ID NO: 4542 - DNA, 71 bp, chicken (Gallus Gallus)
  misc_feature (36): n=a or g
agcagaaacattaattggcttcttcccagagtaagngacctttaagctatttatgacatgtagagtacaca

SEQ ID NO: 4543 - DNA, 71 bp, chicken (Gallus Gallus)
  misc_feature (36): n=g or t
ctcagtcatcatatgttcttcatagagatgctgacnttttggccagcaatatacctggtgtggttggggcc

SEQ ID NO: 4544 - DNA, 71 bp, chicken (Gallus Gallus)
  misc_feature (36): n=a or g
gcagggttttcaggttacattagaattgcatttgtnctgttctttactgaggaggagatttgaatgtagat

SEQ ID NO: 4545 - DNA, 71 bp, chicken (Gallus Gallus)
  misc_feature (36): n=a or g
tgagcagagcatttcttagtttcctataattagacnaggggatccagagcctcaattttgatctaaaggat

SEQ ID NO: 4546 - DNA, 71 bp, chicken (Gallus Gallus)
  misc_feature (36): n=a or g
aagcagggcttccccaccagcagctctgcactcacntgaagctgtaaactcctagaggcacatctaggagg

SEQ ID NO: 4547 - DNA, 71 bp, chicken (Gallus Gallus)
  misc_feature (36): n=c or g
agcacggcaatgtttaccttggctgtcagcattggnctgcacaaccgaacctgctgcttagaatcctgcct

SEQ ID NO: 4548 - DNA, 71 bp, chicken (Gallus Gallus)
  misc_feature (36): n=c or g
caaagaaggacagaaaagaaagatggattatctgangcattttagattaagaggacctattctagctgtga

SEQ ID NO: 4549 - DNA, 71 bp, chicken (Gallus Gallus)
  misc_feature (36): n=c or t
atgtaaagtgcatttgttttttcttccttactcctncttttatctcttatttacgcactcaaggtcaggct

SEQ ID NO: 4550 - DNA, 71 bp, chicken (Gallus Gallus)
  misc_feature (36): n=a or g
tgctgtgctcagagctgtcataagtaggggtgattngtttatgaatgtcaaacagatttacacttgagata

SEQ ID NO: 4551 - DNA, 71 bp, chicken (Gallus Gallus)
  misc_feature (36): n=a or g
tgaagagatggatgatgatagcttcgtctacacacntacctacatctacattagacagaaaccagaattct

SEQ ID NO: 4552 - DNA, 71 bp, chicken (Gallus Gallus)
  misc_feature (36): n=a or g
aaatactgcatatgtatatgcaaatatatacacacntagacagaaaaaattctgaatcaggagtacttcaa

SEQ ID NO: 4553 - DNA, 71 bp, chicken (Gallus Gallus)
  misc_feature (36): n=a or g
agctgtgaaagtccaaatataacgtacacgtatgcntggtgtattatgagaccgaactaaagcaagtgggc

SEQ ID NO: 4554 - DNA, 71 bp, chicken (Gallus Gallus)
  misc_feature (36): n=c or t
actttcaacaggacacaatgagagacgcttaaacgnggtgaatcatagaatcatagaatggcctgggttga

SEQ ID NO: 4555 - DNA, 71 bp, chicken (Gallus Gallus)
  misc_feature (36): n=a or g
ttcttacagaggtgaagtgccctgtaggtatgttangaacccttgtcttccacgttaggacctgtttcaga

SEQ ID NO: 4556 - DNA, 71 bp, chicken (Gallus Gallus)
  misc_feature (36): n=a or g
caggacctgcacacgagtgaacaaggaatgttatanctcaataactaacaagggccgagttaagcaaaaca

SEQ ID NO: 4557 - DNA, 71 bp, chicken (Gallus Gallus)
  misc_feature (36): n=a or g
aacagactgttcaaatcattctttgcagccatggtnggagacctgacagacataagccaccctaccccagt

SEQ ID NO: 4558 - DNA, 71 bp, chicken (Gallus Gallus)
  misc_feature (36): n=a or g
aaaatgacatggtaaaaggataattgaaaattccantatacaaatacaggagagaaaaaaagccattatta

SEQ ID NO: 4559 - DNA, 71 bp, chicken (Gallus Gallus)
  misc_feature (36): n=a or g
aaaaggggacacgttggggctgcagcattcggtggnactgacacgagtgggtatcaatatggaaaatcagt

SEQ ID NO: 4560 - DNA, 71 bp, chicken (Gallus Gallus)
  misc_feature (36): n=c or t
ttaaaacttatttgtcaaagggtagagctaacatcntaatacgcatggtctgctcacagctcgctagctgt

SEQ ID NO: 4561 - DNA, 71 bp, chicken (Gallus Gallus)
  misc_feature (36): n=c or t
tcctgaagggaaggatggagggatgctgcttccccnactgaagtatataccattatggatgttgctgcttt

SEQ ID NO: 4562 - DNA, 71 bp, chicken (Gallus Gallus)
  misc_feature (36): n=g or t
ttcagatgtatgttttgaagctctaatttgtacctnttactaagatgcataattttccaaacgaggtattt

SEQ ID NO: 4563 - DNA, 71 bp, chicken (Gallus Gallus)
  misc_feature (36): n=a or g
gtaagtaggagaacagcacttccttcatcactactnccatacgttgtataatattctgaagtggattttac

SEQ ID NO: 4564 - DNA, 71 bp, chicken (Gallus Gallus)
  misc_feature (36): n=c or g
ccttggtgtcagcatgttaacaagtagcctgtagtnagagaccaggcatgaaggacccatatccacataat

SEQ ID NO: 4565 - DNA, 71 bp, chicken (Gallus Gallus)
  misc_feature (36): n=a or g
acctagcagtaagcccacttgatattgccctttacntaatgacattacaattatataaatatatactgaca

SEQ ID NO: 4566 - DNA, 71 bp, chicken (Gallus Gallus)
  misc_feature (36): n=a or g
aaacagcatctttacgtttagctctgatcccaaagnacttgaaataggtcatccctgcatagatcataact

SEQ ID NO: 4567 - DNA, 71 bp, chicken (Gallus Gallus)
  misc_feature (36): n=c or t
gagctgtgctggcactttcgtttgtttggtcatcanagagttggatacacaggaagagtatcacggcatgc

SEQ ID NO: 4568 - DNA, 71 bp, chicken (Gallus Gallus)
  misc_feature (36): n=a or g
tggcatgagccacctgtggataaatggcaggtgtcnacacgtttataagatttctctaggttactgtttca

SEQ ID NO: 4569 - DNA, 71 bp, chicken (Gallus Gallus)
  misc_feature (36): n=c or t
tcacctggattattaattgtgtggcaaacatctggnatttaaagtaacatataaagaaacattttaagtca

SEQ ID NO: 4570 - DNA, 71 bp, chicken (Gallus Gallus)
  misc_feature (36): n=a or g
cactttggaaagcctctggtgttcacatctcagagntgctgcctacatccagagctccgaaagctgctgat

SEQ ID NO: 4571 - DNA, 71 bp, chicken (Gallus Gallus)
  misc_feature (36): n=c or g
cccgtagttctgtaactaaaggtcccaatactatgnggtttggagaagggaagaggaggacacagtggcat

SEQ ID NO: 4572 - DNA, 71 bp, chicken (Gallus Gallus)
  misc_feature (36): n=c or t
gatgaggagcaggaaagcttgagcacatatgggtcntctaactggtgactcttggtggtgatgttaaaagt

SEQ ID NO: 4573 - DNA, 71 bp, chicken (Gallus Gallus)
  misc_feature (36): n=c or t
aggctgctgagctcctccttttgtacagtccttttncagaagcacatctctgatttatgcagcttgacaaa

SEQ ID NO: 4574 - DNA, 71 bp, chicken (Gallus Gallus)
  misc_feature (36): n=g or t
gctccagagaggttgggtcaaaataaggtattcctnctctgactattgagcttttgatcttaacctcaact

SEQ ID NO: 4575 - DNA, 71 bp, chicken (Gallus Gallus)
  misc_feature (36): n=a or g
aacctttttctgaaaatgtgccacatgttgcattgnggagaagaggaacagatgaaatagacatatatgtg

SEQ ID NO: 4576 - DNA, 71 bp, chicken (Gallus Gallus)
  misc_feature (36): n=c or t
agattgcctgtttaacattacttctttcatttagcngatttgcagttcgcattgatgcaaagcctcgtgtg

SEQ ID NO: 4577 - DNA, 71 bp, chicken (Gallus Gallus)
  misc_feature (36): n=c or t
accctgcagcaccgacagcttcatgcaaatcctctntctgcccggctcccccacggcaacgatcccactcg

SEQ ID NO: 4578 - DNA, 71 bp, chicken (Gallus Gallus)
  misc_feature (36): n=a or c
atgagcaaacccttctgcgtatttagattatccagnactttgggtgcaattgctgtcccatctgatgggag

SEQ ID NO: 4579 - DNA, 71 bp, chicken (Gallus Gallus)
  misc_feature (36): n=a or g
atagcacatttacgaaatctgaaataaatttaatcnttgtagttgaattttttctttgaaaccagaatcta

SEQ ID NO: 4580 - DNA, 71 bp, chicken (Gallus Gallus)
  misc_feature (36): n=a or g
gtagaacaggcttttctgggctacagctgtggtcanacttatgtgttcacttccagctttggctgtatgtt

SEQ ID NO: 4581 - DNA, 71 bp, chicken (Gallus Gallus)
  misc_feature (36): n=c or t
taaacacaaagtgacagagaagatctggaacagatnctttgcaacactttcaattaagctgtgttccaaaa

SEQ ID NO: 4582 - DNA, 71 bp, chicken (Gallus Gallus)
  misc_feature (36): n=c or t
acccatttcagataatataatgtatggcaaagttgntatttgcttttagagtgttaccattttattcacga

SEQ ID NO: 4583 - DNA, 71 bp, chicken (Gallus Gallus)
  misc_feature (36): n=a or g
agggaagtaatccgctcagtgctagaagctcagagngggaacaagaatgcagctatcaactccttgcttca

SEQ ID NO: 4584 - DNA, 71 bp, chicken (Gallus Gallus)
  misc_feature (36): n=c or t
tgtgttttcttaagctaaattcagttattgttacanagtaaaggtgcagagaatcctctctctctctctga

SEQ ID NO: 4585 - DNA, 71 bp, chicken (Gallus Gallus)
  misc_feature (36): n=a or c
cttccacttccaagggatacagtaagcctgacaaanagatgtgaacataggggtggaccaacaacttatcc

SEQ ID NO: 4586 - DNA, 71 bp, chicken (Gallus Gallus)
  misc_feature (36): n=a or c
gtttgggcagtaaggagagataagtaccaaataacngaaaatgaaagacagaagtaagttcttcctagaag

SEQ ID NO: 4587 - DNA, 71 bp, chicken (Gallus Gallus)
  misc_feature (36): n=c or t
ttcaatctgactcaaaatttcttagtagttgcttcntaatgaaataatctttttcactctgtatcagctat

SEQ ID NO: 4588 - DNA, 71 bp, chicken (Gallus Gallus)
  misc_feature (36): n=c or t
cagctcacgcccttgtttcataaataaataatttancaagtaaatgcatgactggtaagatactgccaagt

SEQ ID NO: 4589 - DNA, 71 bp, chicken (Gallus Gallus)
  misc_feature (36): n=a or c
tgtggggttgttgtctttagagaaggagtgtgtcanccacaaaaaagagaagaaatctacataaaggtaaa

SEQ ID NO: 4590 - DNA, 71 bp, chicken (Gallus Gallus)
  misc_feature (36): n=c or t
tgagtaataacagataatatggctgttggatacacnaacgcattcctaaaagagccagccgtatttacgat

SEQ ID NO: 4591 - DNA, 71 bp, chicken (Gallus Gallus)
  misc_feature (36): n=a or g
ggtatcaaacttgattagtgaacaaaacaacagacncagctatagctttccttaatctttcctggaaaaaa

SEQ ID NO: 4592 - DNA, 71 bp, chicken (Gallus Gallus)
  misc_feature (36): n=a or g
tccctggagatgttcaggaccacttcaaatggagtnctgagcaatatgacatggtggaaacagtgtccctg

SEQ ID NO: 4593 - DNA, 71 bp, chicken (Gallus Gallus)
  misc_feature (36): n=a or g
agctgggccagaataacctgtggtagtatctgaacntgaagactgcagccacctccaagcttccaggtcta

SEQ ID NO: 4594 - DNA, 71 bp, chicken (Gallus Gallus)
  misc_feature (36): n=a or g
ttccaacaccttatctaaacctaggcaggctgagcncacgctttcacaggagtaatactctagccagagat

SEQ ID NO: 4595 - DNA, 71 bp, chicken (Gallus Gallus)
  misc_feature (36): n=c or t
aagaaagtgttgcaaactcatttgtcccattccacnttacctttctactgtaaattcagctgctttctgaa

SEQ ID NO: 4596 - DNA, 71 bp, chicken (Gallus Gallus)
  misc_feature (36): n=g or t
tctactctaagatttttgatgtttggggaaggaagnagcaactacaaaccactgttcctcttacagtaaag

SEQ ID NO: 4597 - DNA, 71 bp, chicken (Gallus Gallus)
  misc_feature (36): n=c or t
acctcacagttataatgtaagagatcacagaatcanagaactgtaggggctgggaaagacctctgggggtc

SEQ ID NO: 4598 - DNA, 71 bp, chicken (Gallus Gallus)
  misc_feature (36): n=c or t
gcattaacatttctaaatacgcctctctgaggagancactgaggtattttgcataatgtttcactgattac

SEQ ID NO: 4599 - DNA, 71 bp, chicken (Gallus Gallus)
  misc_feature (36): n=c or t
agtgacgaaaagcacggcttctttagcagcaaagtnctttgtttcagcatagaaaacatgatttccatcca

SEQ ID NO: 4600 - DNA, 71 bp, chicken (Gallus Gallus)
  misc_feature (36): n=a or g
cagcaagaagagaggtccaggtgctctgtattctcngaggaccaaatatcacgccactacgggattagtga

SEQ ID NO: 4601 - DNA, 71 bp, chicken (Gallus Gallus)
  misc_feature (36): n=a or g
gtgatgcagaaggggaacaaaaaggctgatgcactncgttctggtgcacatatcagctacagattcagtag

SEQ ID NO: 4602 - DNA, 71 bp, chicken (Gallus Gallus)
  misc_feature (36): n=a or g
gagtttagatcctgagtatctgaggacagctggaantgatttagacagtgtttcaattgctatacaagcga

SEQ ID NO: 4603 - DNA, 71 bp, chicken (Gallus Gallus)
  misc_feature (36): n=c or t
aaagagtccagcttgattaatcaagatcaccatcangtccagatagtggtctggatgagaaagggacttat

SEQ ID NO: 4604 - DNA, 71 bp, chicken (Gallus Gallus)
  misc_feature (36): n=a or g
ttctactttgaatgcttgtaaaaaggcacttaatancagctacttgtttccagatctaagtaataatgtgt

SEQ ID NO: 4605 - DNA, 71 bp, chicken (Gallus Gallus)
  misc_feature (36): n=a or g
ctcttcttcctgttgttaggatcttttcccccaccnttttgctagttgctgatgtagaaagctgagtgatt

SEQ ID NO: 4606 - DNA, 71 bp, chicken (Gallus Gallus)
  misc_feature (36): n=a or g
ttttgaggagatatattatctggcttatggtagcanctaaaatgagaaaccctactggtacttaacttctt

SEQ ID NO: 4607 - DNA, 71 bp, chicken (Gallus Gallus)
  misc_feature (36): n=a or g
caaaacagctctctgggattgctgacagctaaaatnatgtaaatcaatctttatggctctgaacacattcc

SEQ ID NO: 4608 - DNA, 71 bp, chicken (Gallus Gallus)
  misc_feature (36): n=a or g
tattaaaacctggcctgctttcctacgtagaagctnattattcttcctcaccctcctgacctaaaggagta

SEQ ID NO: 4609 - DNA, 71 bp, chicken (Gallus Gallus)
  misc_feature (36): n=g or t
cagtgtaaatgacaaactgttgcctggtatatccanttgcaggagaagtgccagagatgggccttgttctg

SEQ ID NO: 4610 - DNA, 71 bp, chicken (Gallus Gallus)
  misc_feature (36): n=a or g
gatatccattgcagcatttccttctctgaagaggcnatactggatctgaccttacggctctgatttttggc

SEQ ID NO: 4611 - DNA, 71 bp, chicken (Gallus Gallus)
  misc_feature (36): n=c or t
taaaaccagctggagggagccaaccctgctctgtantgtgatcaagaccaagagtgctcaggtctaacagg

SEQ ID NO: 4612 - DNA, 71 bp, chicken (Gallus Gallus)
  misc_feature (36): n=c or t
ggccggagggcagaaagccgtgcttgggagcagccnggtaacttcagttctttcccagatgggaggggatg

SEQ ID NO: 4613 - DNA, 71 bp, chicken (Gallus Gallus)
  misc_feature (36): n=c or t
atccaagttaaaatggtcaagcatagtcaacactgntgtctcacttttccatcagtataactatacttgct

SEQ ID NO: 4614 - DNA, 71 bp, chicken (Gallus Gallus)
  misc_feature (36): n=c or t
agatctcagtcggcacgagttagagtattaaggatngattcaagtctgagatatgtatgaaatgaattctg

SEQ ID NO: 4615 - DNA, 71 bp, chicken (Gallus Gallus)
  misc_feature (36): n=a or g
tttcaaaatagctgctgtgacaccttccagcacccngtatattgccacaaacagcttaaatccttgtcaac

SEQ ID NO: 4616 - DNA, 71 bp, chicken (Gallus Gallus)
  misc_feature (36): n=a or g
gctcatttttctttctcaaccactttgtcaaaaatnattgctactctctgtcccaaactccaatatctcaa

SEQ ID NO: 4617 - DNA, 71 bp, chicken (Gallus Gallus)
  misc_feature (36): n=a or g
cttaaaacttattccacatgaaagcactctgaaaanctactaaaaatcattaaaacataacatagcttaaa

SEQ ID NO: 4618 - DNA, 71 bp, chicken (Gallus Gallus)
  misc_feature (36): n=a or g
taatttccccctcccgactgctctgttttgcagacntacagcaaggaggacaggctgatcatcacccaact

SEQ ID NO: 4619 - DNA, 71 bp, chicken (Gallus Gallus)
  misc_feature (36): n=a or g
ggggtttctttatgaataaaagacacagctgccacntgaactcaccaaacattttggagagggtgagttga

SEQ ID NO: 4620 - DNA, 71 bp, chicken (Gallus Gallus)
  misc_feature (36): n=a or g
aagaggggttgacattttgctcactgtcaggtcacngttcttacaagcagctcccataacaggcccaacct

SEQ ID NO: 4621 - DNA, 71 bp, chicken (Gallus Gallus)
  misc_feature (36): n=a or g
atttgcagctacgatacaaatctcatcacagaggcnctgctggtactcatggagaccaaagatctgattgt

SEQ ID NO: 4622 - DNA, 71 bp, chicken (Gallus Gallus)
  misc_feature (36): n=a or g
ggacaattccgaccatatgcacaggctgtaggacangaggtgggagtgcagcctatggaaagggatctggg

SEQ ID NO: 4623 - DNA, 71 bp, chicken (Gallus Gallus)
  misc_feature (36): n=a or g
gtttccaactgggcacagcaataaaaccagataacnaaagtaaccatcatcccaagagaaagcttgcagat

SEQ ID NO: 4624 - DNA, 71 bp, chicken (Gallus Gallus)
  misc_feature (36): n=a or g
agtgcaatgatacctaggaaatgagaacacaatccngccagttatggttatgtgactgagcttttactgct

SEQ ID NO: 4625 - DNA, 71 bp, chicken (Gallus Gallus)
  misc_feature (36): n=c or t
cataacctgttcagaagcatgttttctggtaataanggtgatgctccaactacgtccttaatcacaaatgc

SEQ ID NO: 4626 - DNA, 71 bp, chicken (Gallus Gallus)
  misc_feature (36): n=c or g
actagaattagggagtttacattggcaatggattcntcagtccaccttggctcttggtctgtcacggtttg

SEQ ID NO: 4627 - DNA, 71 bp, chicken (Gallus Gallus)
  misc_feature (36): n=c or t
ctcaatatcccggggcaggatttcaaaacagtcggntacctgggggattcctcagccttcagctgtgggag

SEQ ID NO: 4628 - DNA, 71 bp, chicken (Gallus Gallus)
  misc_feature (36): n=a or g
gtagaggatctctgagattccttctaacccaagccntactgtaattctatctaaatcatgactataccgat

SEQ ID NO: 4629 - DNA, 71 bp, chicken (Gallus Gallus)
  misc_feature (36): n=c or t
cactgcctccttcaggcttccctaacccatgtcatnagcaaaaaattaaatttcgctaaaactgaaaatga

SEQ ID NO: 4630 - DNA, 71 bp, chicken (Gallus Gallus)
  misc_feature (36): n=g or t
ggtgctggctgggtttgctttggctgacgttgagcntttatgttaggtgggagagatactgatccttccaa

SEQ ID NO: 4631 - DNA, 71 bp, chicken (Gallus Gallus)
  misc_feature (36): n=c or t
atagtactctgggcagccagagaagtatgttgagcnaatcatatgtacactctgaaataggaacaagaaaa

SEQ ID NO: 4632 - DNA, 71 bp, chicken (Gallus Gallus)
  misc_feature (36): n=a or g
cccaagttccatggagggtttcatccaagacaaggnctctcatgagctggagcatgccctgtgccccgtgt

SEQ ID NO: 4633 - DNA, 71 bp, chicken (Gallus Gallus)
  misc_feature (36): n=a or c
tcaagtttgccacatacaggatagaaaaacgctttncacaatcaggttgtataaatgtttaagctctaaat

SEQ ID NO: 4634 - DNA, 71 bp, chicken (Gallus Gallus)
  misc_feature (36): n=c or t
agtcattgctaatgttggtcttgcatgcaatccttncagtagtgtaaggtatcctgggggaagcttagatt

SEQ ID NO: 4635 - DNA, 71 bp, chicken (Gallus Gallus)
  misc_feature (36): n=c or t
ctacaacagtgaaaacagctcctactctccctccantggcacgactatagatctgatgtctgtgtcactaa

SEQ ID NO: 4636 - DNA, 71 bp, chicken (Gallus Gallus)
  misc_feature (36): n=a or t
gcaatggcatggtagggttacaggagatatgactcngagtcttgcttaaagcaaacctggtatatatgaat

SEQ ID NO: 4637 - DNA, 71 bp, chicken (Gallus Gallus)
  misc_feature (36): n=a or g
aacctcacaggtatctttaccatcagtagctccaanaccagcagaagaggagagtagtggagagaaactca

SEQ ID NO: 4638 - DNA, 71 bp, chicken (Gallus Gallus)
  misc_feature (36): n=g or t
ccattattttctttaaacatagttaatacagacttnatataagctccaggaaataatcttgcagaatagaa

SEQ ID NO: 4639 - DNA, 71 bp, chicken (Gallus Gallus)
  misc_feature (36): n=c or t
aacagagtcatcagccatccgactcttccaattagnatcactgctcatgaagacagacacatcaaatttta

SEQ ID NO: 4640 - DNA, 71 bp, chicken (Gallus Gallus)
  misc_feature (36): n=c or t
atcaatcacttttttaatgtaggtgggaaaaggaangttcaggctggataatttgtacctgtaaatagcaa

SEQ ID NO: 4641 - DNA, 71 bp, chicken (Gallus Gallus)
  misc_feature (36): n=c or t
ataaaacttggatctgagaaatactaaatttcattntagcagagacagcaaatatttctgaaaaataaaca

SEQ ID NO: 4642 - DNA, 71 bp, chicken (Gallus Gallus)
  misc_feature (36): n=a or g
taattactgttttgattcccatgagaggcctttganaacccatcttgtcatggaagttaagggcataatgt

SEQ ID NO: 4643 - DNA, 71 bp, chicken (Gallus Gallus)
  misc_feature (36): n=c or t
tgctaagaccatgctttccaaagcagtgaattgttnttctatatcttttcgtttcttgatttcctgtagag

SEQ ID NO: 4644 - DNA, 71 bp, chicken (Gallus Gallus)
  misc_feature (36): n=a or g
aaaaagcatgtactgcaatttcaagtcacagtctgnaccttggtacaagtgcttggtaatgttgatacaga

SEQ ID NO: 4645 - DNA, 71 bp, chicken (Gallus Gallus)
  misc_feature (36): n=a or t
tttttaaacgtgttttcaatgattgttggtatgctnctaatatttgcaagaagctgcaagagtcacaagat

SEQ ID NO: 4646 - DNA, 71 bp, chicken (Gallus Gallus)
  misc_feature (36): n=c or t
atgggaggggggcatggggggggaagagtgctaccntctgagcggctcatagacgattagttcagcttagc

SEQ ID NO: 4647 - DNA, 71 bp, chicken (Gallus Gallus)
  misc_feature (36): n=c or t
acagcctcgcttgcagcggagtggtcaaatgtcttngggcgctttgcacgtcgagcctttcctctctccat

SEQ ID NO: 4648 - DNA, 71 bp, chicken (Gallus Gallus)
  misc_feature (36): n=a or g
ctcaaccaacttcccatgaagtggaggaagggaagnttttttgctgacttttccacagggcatgatataac

SEQ ID NO: 4649 - DNA, 71 bp, chicken (Gallus Gallus)
  misc_feature (36): n=c or t
agtagatgtatgccaggttggaaccggtaggattcntgcctgagtaatacttctttgcctgcacacacaca

SEQ ID NO: 4650 - DNA, 71 bp, chicken (Gallus Gallus)
  misc_feature (36): n=c or t
ttcctgggactggtgctgctaaatgtcttcagtaangacctagatgacaggaggcatctttcctgacaacg

SEQ ID NO: 4651 - DNA, 71 bp, chicken (Gallus Gallus)
  misc_feature (36): n=c or t
actgaagttttatatctacccagaatatctctgctncatagatatataaaactagcacaacacacacacac

SEQ ID NO: 4652 - DNA, 71 bp, chicken (Gallus Gallus)
  misc_feature (36): n=c or t
aaggggttgttcatttttatcttaaagagatgacangttaaccacttcaagtttatgtcaagtataatttt

SEQ ID NO: 4653 - DNA, 71 bp, chicken (Gallus Gallus)
  misc_feature (36): n=a or g
aaagcagcttccctgcagttcttctattttgcagcngagagctagcaggatggctaagtaaaaccactgta

SEQ ID NO: 4654 - DNA, 71 bp, chicken (Gallus Gallus)
  misc_feature (36): n=c or t
ggagaagagaactggggaagaaacctaatgggctantacaaaaactattttctagaatagaaaaggaaaat

SEQ ID NO: 4655 - DNA, 71 bp, chicken (Gallus Gallus)
  misc_feature (36): n=c or g
gtgttgatcaaaatatgacatatcgatgttttactnaagattattaagatctgtttaagctgccaaaaaac

SEQ ID NO: 4656 - DNA, 71 bp, chicken (Gallus Gallus)
  misc_feature (36): n=a or g
cacatacttatatttgtatatggatttacatatatntgtattgttggtgtgtgatacgatattccatatcg

SEQ ID NO: 4657 - DNA, 71 bp, chicken (Gallus Gallus)
  misc_feature (36): n=a or g
tgagcattagaagctggagcacgatagccatccacnttacaagtgctaaggaccgagaggccattgtcatc

SEQ ID NO: 4658 - DNA, 71 bp, chicken (Gallus Gallus)
  misc_feature (36): n=a or g
ttttccagtcaaaaaataacagtgtgtttggatagnaattcaggaggcagactagctttgtgattaatagt

SEQ ID NO: 4659 - DNA, 71 bp, chicken (Gallus Gallus)
  misc_feature (36): n=c or t
ggttaaataactcagaaagaccactggaaactgcangtgtacatttcggcaccttcagaaacagtgccaca

SEQ ID NO: 4660 - DNA, 71 bp, chicken (Gallus Gallus)
  misc_feature (36): n=c or t
atatgaactgccttcaaaaactttacagcattcagntgcaagcaggaccaaacaatacttatacacatgaa

SEQ ID NO: 4661 - DNA, 71 bp, chicken (Gallus Gallus)
  misc_feature (36): n=a or g
ttgaaggagaatgttgaatgtgtgtcattggctgantttgtaaaggagagtcagattccagttttgacttg

SEQ ID NO: 4662 - DNA, 71 bp, chicken (Gallus Gallus)
  misc_feature (36): n=a or g
taaacagcccagatttttcatccacagtccaacaancagataatagaccacaggctctgaaatctggacta

SEQ ID NO: 4663 - DNA, 71 bp, chicken (Gallus Gallus)
  misc_feature (36): n=g or t
tcttcagtaaggtgtgctgtgggagctcagaaaggnctgcaaaggagtaactgtggctttggatcctttct

SEQ ID NO: 4664 - DNA, 71 bp, chicken (Gallus Gallus)
  misc_feature (36): n=a or g
atggatctaaggtgtgcatggcaaacctctctggtntaattacctccagcttactgcatacaggcctgaaa

SEQ ID NO: 4665 - DNA, 71 bp, chicken (Gallus Gallus)
  misc_feature (36): n=c or t
agcagaggatcttctatcttctgagtctcacagttncactcttccacaatcatgacttttttgaccactgg

SEQ ID NO: 4666 - DNA, 71 bp, chicken (Gallus Gallus)
  misc_feature (36): n=a or g
gttttatcccaaagttgagattgttccaacatgcanaagtcttctggaaaagcaaatgttgcttctttcta

SEQ ID NO: 4667 - DNA, 71 bp, chicken (Gallus Gallus)
  misc_feature (36): n=a or g
gaggtggcagctggaggccaagccccagcatgcccnactgcttccatacaagcactgccttttacagacaa

SEQ ID NO: 4668 - DNA, 71 bp, chicken (Gallus Gallus)
  misc_feature (36): n=a or g
caggcagctggttattgactctaactagctaattcnggctctgagtgacaggatggcaaaatgttaggcta

SEQ ID NO: 4669 - DNA, 71 bp, chicken (Gallus Gallus)
  misc_feature (36): n=c or t
atagtttttgataaaaaaatcagtgaaattggaaancaaagccacaaagtatatgttttcatatggaattg

SEQ ID NO: 4670 - DNA, 71 bp, chicken (Gallus Gallus)
  misc_feature (36): n=a or g
cacagctcacatttccttttcacagcctggaactcnggtgcctgtcccagtttcagatttgagaatcctaa

SEQ ID NO: 4671 - DNA, 71 bp, chicken (Gallus Gallus)
  misc_feature (36): n=a or g
tcaccgacaaacagtcttcctgtaactgggaagtcntgatgtgaatgaagccagttactgcatttcatatg

SEQ ID NO: 4672 - DNA, 71 bp, chicken (Gallus Gallus)
  misc_feature (36): n=a or g
cggaagggaagcataactgcctaccaagaaaaatgngaacacgcactccattttaagcccatgacagaaag

SEQ ID NO: 4673 - DNA, 71 bp, chicken (Gallus Gallus)
  misc_feature (36): n=c or t
gtctgtgcgcccttctggctggacacagactaacanaagtgatatttgggagagaaaagggggttgagtgc

SEQ ID NO: 4674 - DNA, 71 bp, chicken (Gallus Gallus)
  misc_feature (36): n=c or t
gagatgatctttattatatctctttttggctacctngtcttcatgattattttcaaatggtgtcattttga

SEQ ID NO: 4675 - DNA, 71 bp, chicken (Gallus Gallus)
  misc_feature (36): n=a or g
catcttctaggttctgaacctgggcaaaaaaagctntttagtttgagaattttcctgatttttttttttaa

SEQ ID NO: 4676 - DNA, 71 bp, chicken (Gallus Gallus)
  misc_feature (36): n=c or g
gcagtgtcacttagcatatgatgctcgtgttggtgntgagcggttgcctctgagcgggagcactgtgcagt

SEQ ID NO: 4677 - DNA, 71 bp, chicken (Gallus Gallus)
  misc_feature (36): n=c or t
gatatttaatttctttagcatttcctttattgcttncctcaggtgtatattatgcaccacaaaattaaaac

SEQ ID NO: 4678 - DNA, 71 bp, chicken (Gallus Gallus)
  misc_feature (36): n=c or t
tgatagttgttccagtagttcataaaacatcacatnagtgtaaacttattttcattgtgattttaagcaga

SEQ ID NO: 4679 - DNA, 71 bp, chicken (Gallus Gallus)
  misc_feature (36): n=a or c
tctgcagtgtgaatgagagtaatctgcataaatagnatttttctcagtagctcattacaaaagtgcgctgt

SEQ ID NO: 4680 - DNA, 71 bp, chicken (Gallus Gallus)
  misc_feature (36): n=a or g
cgcaaccctaactcaaagttattttcactctgaccncagagtacttcccatcagaagcaggaatatcccgg

SEQ ID NO: 4681 - DNA, 71 bp, chicken (Gallus Gallus)
  misc_feature (36): n=a or g
cttgtaggctgctgagccttgcataaatgggaagtncgtagtataaaaattgtgccaggtgtctgaccacg

SEQ ID NO: 4682 - DNA, 71 bp, chicken (Gallus Gallus)
  misc_feature (36): n=a or c
attggcagctgctaggctaccctacatcatctgtgngagcaccgattcctttccagaggtgtggtaagcac

SEQ ID NO: 4683 - DNA, 71 bp, chicken (Gallus Gallus)
  misc_feature (36): n=a or g
aagcatatcaaaatctaattcccttgttgtcactgnatgctgcataatgcatcagtcactcttgcttctga

SEQ ID NO: 4684 - DNA, 71 bp, chicken (Gallus Gallus)
  misc_feature (36): n=a or t
attctttgtatgagaatacttatagattcacagacngtctaaatgcacttttaaaacaatggctttattta

SEQ ID NO: 4685 - DNA, 71 bp, chicken (Gallus Gallus)
  misc_feature (36): n=c or t
aggaagctatggccaattcactggtccctatggacngacaatgaaataatgcacttctgtttgtgcttttt

SEQ ID NO: 4686 - DNA, 71 bp, chicken (Gallus Gallus)
  misc_feature (36): n=c or t
ctggttccttattgtacttgatgattttgattgcantgcttgatgtttccatgtatgattacaggaatgac

SEQ ID NO: 4687 - DNA, 71 bp, chicken (Gallus Gallus)
  misc_feature (36): n=a or g
tacctgcagtttttactttcactgttatgtaccccnagctgcttattatgcagtgcattccaagaaacatc

SEQ ID NO: 4688 - DNA, 71 bp, chicken (Gallus Gallus)
  misc_feature (36): n=a or g
tttctgactctgtgaatttttggagatgtgtgtccntttagaattcaacaaaatgtaggtcagccttcaat

SEQ ID NO: 4689 - DNA, 71 bp, chicken (Gallus Gallus)
  misc_feature (36): n=a or g
gatatgtatctgagtatctgaatatttcctcatagncataaatatatatttttaaaatttcacatgcaatc

SEQ ID NO: 4690 - DNA, 71 bp, chicken (Gallus Gallus)
  misc_feature (36): n=a or g
catagtgggtaggtgccttaagatgacagcctgctnctgttcagctttgtcactcttcttggagactggag

SEQ ID NO: 4691 - DNA, 71 bp, chicken (Gallus Gallus)
  misc_feature (36): n=c or t
ctcctgtccatacagcagcatcttaattagtattangctgctaggttacagctaatagcaagcaaactttt

SEQ ID NO: 4692 - DNA, 71 bp, chicken (Gallus Gallus)
  misc_feature (36): n=a or g
ggcttctcttagcctagagtctacctgacagagatntgaacctctcaaccagctgctagtacctgcaacat

SEQ ID NO: 4693 - DNA, 71 bp, chicken (Gallus Gallus)
  misc_feature (36): n=c or t
tagcagattctaatagagtggcagacagtttatatnttacttctgtgaaccttcagaatcagttatgtcag

SEQ ID NO: 4694 - DNA, 71 bp, chicken (Gallus Gallus)
  misc_feature (36): n=a or g
tgtggtatgattctgtccatttcttataaacttggntagtctttgttcctattgatcacttttctatcaaa

SEQ ID NO: 4695 - DNA, 71 bp, chicken (Gallus Gallus)
  misc_feature (36): n=a or c
ttttacacctgttgggactttgagatagtagttttntccccaaagctatcactgatgtattttcttccatt

SEQ ID NO: 4696 - DNA, 71 bp, chicken (Gallus Gallus)
  misc_feature (36): n=a or g
agaatgcatttgttattacaaacatagtgatactgntaccatgtaggtattaaagcttgcttcatagaaac

SEQ ID NO: 4697 - DNA, 71 bp, chicken (Gallus Gallus)
  misc_feature (36): n=a or g
agtctgagtctccatgtccctttcagcagcagctcnccaccgtggttgcacattggtatatccagagagca

SEQ ID NO: 4698 - DNA, 71 bp, chicken (Gallus Gallus)
  misc_feature (36): n=a or g
gaagctatggacatctcctccctggactcattcaangccaggctagatggggccctgagcaacatggtatg

SEQ ID NO: 4699 - DNA, 71 bp, chicken (Gallus Gallus)
  misc_feature (36): n=c or t
tatattagtgagtagaaaatggcacccaggaaatgnttaaaaatgggaatccaaaatcaatcctctctcaa

SEQ ID NO: 4700 - DNA, 71 bp, chicken (Gallus Gallus)
  misc_feature (36): n=a or g
taaaggagcagggaaggagatttatcctcacatacntacaaaaacaatgctatcatttgggtttgatttca

SEQ ID NO: 4701 - DNA, 71 bp, chicken (Gallus Gallus)
  misc_feature (36): n=c or t
gtacagtgtttttataataaatacttacttggaacncttggttatttttgactgttctgtcaaagttggat

SEQ ID NO: 4702 - DNA, 71 bp, chicken (Gallus Gallus)
  misc_feature (36): n=c or t
tggagtctaatgttgcttatttcttactgcataaangtctcaaatttcttctcaggcaataaggaacacac

SEQ ID NO: 4703 - DNA, 71 bp, chicken (Gallus Gallus)
  misc_feature (36): n=c or t
tttgctaactctagaggtgtgacaactttctgaganaaacaaacaggtttgttttaggcaatgaacaccac

SEQ ID NO: 4704 - DNA, 71 bp, chicken (Gallus Gallus)
  misc_feature (36): n=c or t
atagtgagacgactgtctgacatagtgaaagagtangatctgattgttcatcagcttgctacatacccaga

SEQ ID NO: 4705 - DNA, 71 bp, chicken (Gallus Gallus)
  misc_feature (36): n=c or t
atttcattccctaaagttactgatataggaatttanaaacaatactaaatgacacctgaaatttttttcat

SEQ ID NO: 4706 - DNA, 71 bp, chicken (Gallus Gallus)
  misc_feature (36): n=c or t
ttgtgtagagaaggtctgtcataatttagaaaccanacagagaatagtaccatttgattacagagcagaag

SEQ ID NO: 4707 - DNA, 71 bp, chicken (Gallus Gallus)
  misc_feature (36): n=a or g
acagagaagagtatggatattccgtagcataaatcnagtgggatcttgagcactttttccatgaagctgct

SEQ ID NO: 4708 - DNA, 71 bp, chicken (Gallus Gallus)
  misc_feature (36): n=a or g
tccttccattcctttttacttagcagcagatatcancacttcagaatttaaatcacgtcttcaaacttgaa

SEQ ID NO: 4709 - DNA, 71 bp, chicken (Gallus Gallus)
  misc_feature (36): n=a or g
ccaccaagcgtttgatcacttaggaaaatgactgtngtgcccgtctttaacatacccgatgagatttttca

SEQ ID NO: 4710 - DNA, 71 bp, chicken (Gallus Gallus)
  misc_feature (36): n=c or t
aaatgataccacagcagttgaaacagcaagatacanaggcaactgcacgtaaaaagacgcacatgagaggg

SEQ ID NO: 4711 - DNA, 71 bp, chicken (Gallus Gallus)
  misc_feature (36): n=a or g
tgacaaggtgatgaatttatggagcctgataacacnctatgcaaatgttagcttatttgattaacattaag

SEQ ID NO: 4712 - DNA, 71 bp, chicken (Gallus Gallus)
  misc_feature (36): n=c or t
cagcgatggtggttccagtgaggaggatgaaggttnggctgaatgtggaggctgcgaagtgcaggacttga

SEQ ID NO: 4713 - DNA, 71 bp, chicken (Gallus Gallus)
  misc_feature (36): n=c or t
taagaacggaataccgacaaaggcagctctgaaacngaaaccattacaggttggcaagtctctgccccaag

SEQ ID NO: 4714 - DNA, 71 bp, chicken (Gallus Gallus)
  misc_feature (36): n=c or t
tgagtcttgtatttacagttcagcattttattctanagtcatatccccattgggaataatgaatattcaga

SEQ ID NO: 4715 - DNA, 71 bp, chicken (Gallus Gallus)
  misc_feature (36): n=c or t
tcaaactattatttacactatgtaattgctctcacnggtgctaaatgcaaaatctgagatgtacatttcct

SEQ ID NO: 4716 - DNA, 71 bp, chicken (Gallus Gallus)
  misc_feature (36): n=c or t
gcaattggatattttccctactgttcagcaactgtntggtcaggtttaacagctgctttagatcacagaat

SEQ ID NO: 4717 - DNA, 71 bp, chicken (Gallus Gallus)
  misc_feature (36): n=c or t
tatcctggcttctaggattcaaattccactgtctangatagaaaaatgtaggtactgtattttctgactat

SEQ ID NO: 4718 - DNA, 71 bp, chicken (Gallus Gallus)
  misc_feature (36): n=c or t
cagtataaatgtctatgacaatccatgtgggaggcntagcttttaattaaaggcactacatgaagctgaag

SEQ ID NO: 4719 - DNA, 71 bp, chicken (Gallus Gallus)
  misc_feature (36): n=c or t
gctagaagaaggatgcgacttccctgccccactgcnagctgccttttggcacccatctccacaaaacagag

SEQ ID NO: 4720 - DNA, 71 bp, chicken (Gallus Gallus)
  misc_feature (36): n=a or g
aaaatgtactaacaagccataaatgtaaaagctgcnctactccaaacatttcacaccatgagaaccaaccc

SEQ ID NO: 4721 - DNA, 71 bp, chicken (Gallus Gallus)
  misc_feature (36): n=a or g
accctgtgaaggatttgccccataaagcaccgtgtnaactttgtgatgttctcaagggtaagctgatggct

SEQ ID NO: 4722 - DNA, 71 bp, chicken (Gallus Gallus)
  misc_feature (36): n=a or g
tctgtgcctgggaagatcatggaggagatcctcctngaagggatgtcaaagcacatgcaaaatcaggaggt

SEQ ID NO: 4723 - DNA, 71 bp, chicken (Gallus Gallus)
  misc_feature (36): n=c or t
taatctgtagtcccaagcttgatgatttgctctctntctgctgtgtgagcaatggctggtttaggctgata

SEQ ID NO: 4724 - DNA, 71 bp, chicken (Gallus Gallus)
  misc_feature (36): n=c or t
tgctgagggtttattaaatcacatcatctatgtcantgataaaaatgtcatagagtgttggtcccaggatg

SEQ ID NO: 4725 - DNA, 71 bp, chicken (Gallus Gallus)
  misc_feature (36): n=c or t
ttgcatagcatagctgacataaccagctagagacanaatcatagaggagttataaaatcatagattcatag

SEQ ID NO: 4726 - DNA, 71 bp, chicken (Gallus Gallus)
  misc_feature (36): n=c or t
gtccttaaggagatctcttcaaagagctttccatangatatgactgtaaataaggtctgggaacaagcaat

SEQ ID NO: 4727 - DNA, 71 bp, chicken (Gallus Gallus)
  misc_feature (36): n=c or t
ggggatgttctctggactcctttgaactagcttganccagggaattcctaacagcaacccaagcccagggg

SEQ ID NO: 4728 - DNA, 71 bp, chicken (Gallus Gallus)
  misc_feature (36): n=c or t
tatgctgtgtactttctctcagttgtttacatcttngtggatgcattttcccaacagctgtgggttgtaca

SEQ ID NO: 4729 - DNA, 71 bp, chicken (Gallus Gallus)
  misc_feature (36): n=a or g
agttctgtgcttgcaaacttctaagcagaggtttcncttgaattaccctgatgtttagacatgttggccaa

SEQ ID NO: 4730 - DNA, 71 bp, chicken (Gallus Gallus)
  misc_feature (36): n=c or t
ggaaggcacccaaactgctcccaccacactctccanacacataaaggaggtcagcacaaaacatctcctac

SEQ ID NO: 4731 - DNA, 71 bp, chicken (Gallus Gallus)
  misc_feature (36): n=a or g
gatctaattctagctctctagcaccataaaagcacngacacatctctacatgtgtgtatacattccagcac

SEQ ID NO: 4732 - DNA, 71 bp, chicken (Gallus Gallus)
  misc_feature (36): n=a or g
tatgaatgggacaagtgattcctttggtggtttcanaacaggtatcaccctttgtatatgggggctgagct

SEQ ID NO: 4733 - DNA, 71 bp, chicken (Gallus Gallus)
  misc_feature (36): n=c or t
tgcagaatatcatgtttttctttgtattttgctggntgggatttagcatatattgaagtcgagtcgatgga

SEQ ID NO: 4734 - DNA, 71 bp, chicken (Gallus Gallus)
  misc_feature (36): n=a or g
tactggtcttgtctgtggtgagactgggagatgtgngaaggagctctttcagattttccatcttgcattat

SEQ ID NO: 4735 - DNA, 71 bp, chicken (Gallus Gallus)
  misc_feature (36): n=c or t
gcccacttcacaagccagtctctatagttagatctnattctgcaccccttattcctccatgttacctgcta

SEQ ID NO: 4736 - DNA, 71 bp, chicken (Gallus Gallus)
  misc_feature (36): n=a or g
aagtggagaattctttcacaatccctggcctcttcnttgctatgaatcatcacagctgtcactggtgttct

SEQ ID NO: 4737 - DNA, 71 bp, chicken (Gallus Gallus)
  misc_feature (36): n=g or t
atcagatcttttagatttgaaatctgggacaactcntcagttggatcttctaattagtatacttgagcaag

SEQ ID NO: 4738 - DNA, 71 bp, chicken (Gallus Gallus)
  misc_feature (36): n=c or t
tttaagcatgaacttaaactggaaataatttggctntcagaatcatccatgggccagactgcaattgttaa

SEQ ID NO: 4739 - DNA, 71 bp, chicken (Gallus Gallus)
  misc_feature (36): n=c or t
attgcttgtacgtgtattttatgaaaaaaaagaatncccagcaattattaaaatattaaagacaactaatt

SEQ ID NO: 4740 - DNA, 71 bp, chicken (Gallus Gallus)
  misc_feature (36): n=c or t
ggccagcttccagaccagaatttctcatcttttacnaaagccacggtgggcccaagggaggaactcctcct

SEQ ID NO: 4741 - DNA, 71 bp, chicken (Gallus Gallus)
  misc_feature (36): n=c or t
tggccctgcctgaaagctgcctgacaaaatcctctnctgaactcgactctgtgtccatccattcttcacaa

SEQ ID NO: 4742 - DNA, 71 bp, chicken (Gallus Gallus)
  misc_feature (36): n=c or t
gggtttccttttcacaatgcagcaaactctgtgggngttgatcgtgctgtgttttgagacctgagtcttta

SEQ ID NO: 4743 - DNA, 71 bp, chicken (Gallus Gallus)
  misc_feature (36): n=a or g
gtttcaatattaaatttcattaacaagggaggagangcactatcacttcttgcttaaaagtagttaagttt

SEQ ID NO: 4744 - DNA, 71 bp, chicken (Gallus Gallus)
  misc_feature (36): n=a or g
aacctgagtgagactgtctctatcactaagacaagngagctgaagctttccagagagagaatcacagaatc

SEQ ID NO: 4745 - DNA, 71 bp, chicken (Gallus Gallus)
  misc_feature (36): n=a or g
caaatggaaatatgtacactcattaaaactggctcnaagtagagactttccactgcagtaaggatatatct

SEQ ID NO: 4746 - DNA, 71 bp, chicken (Gallus Gallus)
  misc_feature (36): n=g or t
ggtttgggttggatattaggagaaagttctctgaangagtaatcaggctgattgagtgactgtccctggag

SEQ ID NO: 4747 - DNA, 71 bp, chicken (Gallus Gallus)
  misc_feature (36): n=a or g
ctatactataacacaacatctctaaattttttaccnggtattcgcttagcctttgtaaacagatcggaatt

SEQ ID NO: 4748 - DNA, 71 bp, chicken (Gallus Gallus)
  misc_feature (36): n=a or g
tgctcgtgggctttctccttacttgtgagtccaccngtactggtggcagctacgagatgtgtgcgcagcca

SEQ ID NO: 4749 - DNA, 71 bp, chicken (Gallus Gallus)
  misc_feature (36): n=c or t
aatcaggataagctccatggaaagccagtgcatcanacctagtccacctctcctggtagctaactgtgttt

SEQ ID NO: 4750 - DNA, 71 bp, chicken (Gallus Gallus)
  misc_feature (36): n=a or t
tgcaccactacagttatttaagtaccagaaggaaantttttatctgaaaagagtagtaacagtagcaaatg

SEQ ID NO: 4751 - DNA, 71 bp, chicken (Gallus Gallus)
  misc_feature (36): n=c or t
ggacttaaatatgaagcagtgtacagagcagcctcncccttcaattcccttcctcattttgctcagcatat

SEQ ID NO: 4752 - DNA, 71 bp, chicken (Gallus Gallus)
  misc_feature (36): n=c or t
tcagaggtgcccagcagatcagcttgtactcatcanatcctcacagtgggtgggaggaggtggatccacat

SEQ ID NO: 4753 - DNA, 71 bp, chicken (Gallus Gallus)
  misc_feature (36): n=c or t
tggatggctaagagtgtgttgatgtaaaaatgctcngtttccttaccagaagcatgttgaagtttgggggt

SEQ ID NO: 4754 - DNA, 71 bp, chicken (Gallus Gallus)
  misc_feature (36): n=a or g
gcaaatcactcgaagtggtgcatggttctctgtatnaagtcttcacagagaatgtctacttctgcatgcat

SEQ ID NO: 4755 - DNA, 71 bp, chicken (Gallus Gallus)
  misc_feature (36): n=c or t
tcattttcaaccccattagaaaaatggaagtgcagngtgtcatgaagatttctttcatctataacttggtc

SEQ ID NO: 4756 - DNA, 71 bp, chicken (Gallus Gallus)
  misc_feature (36): n=c or g
tctgagttttgatttcagtcccattgtttcttgtcntcccatgatgtgcagcaacaaagagccaagctcca

SEQ ID NO: 4757 - DNA, 71 bp, chicken (Gallus Gallus)
  misc_feature (36): n=c or t
ctaattctagggacttccatcatttcccttactgangctgtgaaagaattaagaagctttagttacagcaa

SEQ ID NO: 4758 - DNA, 71 bp, chicken (Gallus Gallus)
  misc_feature (36): n=g or t
tagttagcagtatcagctccagctaaaacattcatnatttatctattttattttatatgcctgatggatgg

SEQ ID NO: 4759 - DNA, 71 bp, chicken (Gallus Gallus)
  misc_feature (36): n=c or t
gagccctttgtttctgtaaaagtacgtttttcacantagggtgtaaactactgacatccttcggactgctg

SEQ ID NO: 4760 - DNA, 71 bp, chicken (Gallus Gallus)
  misc_feature (36): n=a or g
tgggaacatctgatggaccatgcatgtgaccatgcntgggtaagtcggagaggacaaaaagaccagtgttt

SEQ ID NO: 4761 - DNA, 71 bp, chicken (Gallus Gallus)
  misc_feature (36): n=a or g
atttaatatgtcagggaaggatggaacaaggtcacntgcccaagtgttggtcatataaccaattagataat

SEQ ID NO: 4762 - DNA, 71 bp, chicken (Gallus Gallus)
  misc_feature (36): n=a or g
ttgccccctcttggcttttgtttgcccacagaccangatctctgtgtgggtattgctgccaccaagagcaa

SEQ ID NO: 4763 - DNA, 71 bp, chicken (Gallus Gallus)
  misc_feature (36): n=a or g
gtatcctatgatattccagatactgcctacttgctngtagaagctaattctgtcaactggtccagttcaac

SEQ ID NO: 4764 - DNA, 71 bp, chicken (Gallus Gallus)
  misc_feature (36): n=a or g
acttcctcttcccgtttagacagagagatggagatnaacatagccatgccttctctttgccccacatgatt

SEQ ID NO: 4765 - DNA, 71 bp, chicken (Gallus Gallus)
  misc_feature (36): n=a or g
tgcctactttggagaagaggagccttactacacaanaacagtgaaatactcctaaatgttttcaccagtag

SEQ ID NO: 4766 - DNA, 71 bp, chicken (Gallus Gallus)
  misc_feature (36): n=a or g
attgttttgtacctccagtccaaaatgctcaaaatnttcctaagtacagaatagctcccttctccctctgt

SEQ ID NO: 4767 - DNA, 71 bp, chicken (Gallus Gallus)
  misc_feature (36): n=c or t
gtttgagatggggaagtggcaagaaaagctcatcangctggtggatggttgagctgttggctgtttgcttc

SEQ ID NO: 4768 - DNA, 71 bp, chicken (Gallus Gallus)
  misc_feature (36): n=c or t
aagcaatgcaaaaagtagtatttatactaaaagtcnatacatattagtatttatcattttataaggaaatg

SEQ ID NO: 4769 - DNA, 71 bp, chicken (Gallus Gallus)
  misc_feature (36): n=g or t
ataattttgaatggaataaagctgaagaaaaggatntatcggtccttaattatcctcaaccatttgcagag

SEQ ID NO: 4770 - DNA, 71 bp, chicken (Gallus Gallus)
  misc_feature (36): n=c or t
tctagtagtgattcaaggctgctcttctccatttcngtagctgacttttcaaagaaagaggggaaaacatc

SEQ ID NO: 4771 - DNA, 71 bp, chicken (Gallus Gallus)
  misc_feature (36): n=a or c
gctgaaagagctagattttatgtagatttagggaangggctgtctgagaagtatatttccaacaaaaagta

SEQ ID NO: 4772 - DNA, 71 bp, chicken (Gallus Gallus)
  misc_feature (36): n=c or t
aattcttgtctttaccattttaccaataaaaattangaaggtcgtgttttgtttatgagtgtctaggcatc

SEQ ID NO: 4773 - DNA, 71 bp, chicken (Gallus Gallus)
  misc_feature (36): n=a or g
tgctgttaactttatggactctcctgtctaatccanaatagctcaatattaggtatatatttaaatatatt

SEQ ID NO: 4774 - DNA, 71 bp, chicken (Gallus Gallus)
  misc_feature (36): n=g or t
tgggggagttctggctgtgatgggacaacaaccaanagagggagaaggaccaggcggataattgcatcaga

SEQ ID NO: 4775 - DNA, 71 bp, chicken (Gallus Gallus)
  misc_feature (36): n=c or t
gggcagatgcacaattgcaccatgccacaatgccanaaaagcaggacagtgatggggagcacacccaagcc

SEQ ID NO: 4776 - DNA, 71 bp, chicken (Gallus Gallus)
  misc_feature (36): n=c or g
gattctgataccccacaggaagattcctaccacctngattttgagaatggcctgaagtgaagtgcagctcc

SEQ ID NO: 4777 - DNA, 71 bp, chicken (Gallus Gallus)
  misc_feature (36): n=a or c
ttttaagctaaactctgaaaacatcatttactgatnttttgctgtttggtgcagcagaaatcccatcagtc

SEQ ID NO: 4778 - DNA, 71 bp, chicken (Gallus Gallus)
  misc_feature (36): n=a or g
tactctgtcactccttttccataatagaagtatggncagatataccagggcatgatacagccctgcttgta

SEQ ID NO: 4779 - DNA, 71 bp, chicken (Gallus Gallus)
  misc_feature (36): n=c or t
acaactacagcaggaggctgtcttcatgcctgtagngcatgcttgcaaatgcacactgaacttaaatatct

SEQ ID NO: 4780 - DNA, 71 bp, chicken (Gallus Gallus)
  misc_feature (36): n=c or t
aagccagggctgcagcctctcttgtgcaagtaaagntcattctatacatggagaacacactgaatttgtat

SEQ ID NO: 4781 - DNA, 71 bp, chicken (Gallus Gallus)
  misc_feature (36): n=a or g
gactaaaacctaggaaccatgtgtgtgtctgcagcntctgtgactgagagctcagcattaccacctcagga

SEQ ID NO: 4782 - DNA, 71 bp, chicken (Gallus Gallus)
  misc_feature (36): n=a or g
agtaccctttcctgagcaggatgcccacaaatcatnttctctgtaatattttcctcaaacttaatgtgtaa

SEQ ID NO: 4783 - DNA, 71 bp, chicken (Gallus Gallus)
  misc_feature (36): n=c or t
tggaatccacaaattttctgtattggtagttccccnatagagggaaaatcttccctttaccatttttactt

SEQ ID NO: 4784 - DNA, 71 bp, chicken (Gallus Gallus)
  misc_feature (36): n=a or g
tgagaggtgtcactgtaaagctgaacaaattatganaaaggatttggttagcattcctctaaacctcttgt

SEQ ID NO: 4785 - DNA, 71 bp, chicken (Gallus Gallus)
  misc_feature (36): n=a or g
cagctctattccatctccttttgcattgaaagagtnctgagctctgaaggtgcagaggatggaatggtttg

SEQ ID NO: 4786 - DNA, 71 bp, chicken (Gallus Gallus)
  misc_feature (36): n=a or g
aatgtctggcaggcagcagctaaaccttgcagaggnaggtcaaggagacttgcttcggcttagaatgacag

SEQ ID NO: 4787 - DNA, 71 bp, chicken (Gallus Gallus)
  misc_feature (36): n=a or g
gaaatcacagaagctgctttacaacttctctgtcantgcagatcagttctgacttgcgagcaccccctcca

SEQ ID NO: 4788 - DNA, 71 bp, chicken (Gallus Gallus)
  misc_feature (36): n=a or g
ccaatggagaaggaaagaaattagttttccctaccnaaaatgagctcaaataaacgcatgggtaggaacca

SEQ ID NO: 4789 - DNA, 71 bp, chicken (Gallus Gallus)
  misc_feature (36): n=a or g
taatacaaagcaggcaactgctctgaaccatggagntcaacaatgatttcatactgcagctcaaacactcc

SEQ ID NO: 4790 - DNA, 71 bp, chicken (Gallus Gallus)
  misc_feature (36): n=g or t
tgggtccaggttggctgaaaaactctttaggttggngtcaagaacttttttttgcttgctttgaaatatat

SEQ ID NO: 4791 - DNA, 71 bp, chicken (Gallus Gallus)
  misc_feature (36): n=a or g
ggcttctgcttgagaaatacttagtagcaatagcanttttggcaaagatgacattgtgttggctatagtgt

SEQ ID NO: 4792 - DNA, 71 bp, chicken (Gallus Gallus)
  misc_feature (36): n=a or g
cttttggtggattgacctagcagatctccagccttntaaaggtccagcgacaacaacagccagctgggacc

SEQ ID NO: 4793 - DNA, 71 bp, chicken (Gallus Gallus)
  misc_feature (36): n=a or c
tgagattgaagtaatactaatatcagcattttcagnctgtggcctacaaattgtcagtaaacagcttctaa

SEQ ID NO: 4794 - DNA, 71 bp, chicken (Gallus Gallus)
  misc_feature (36): n=a or g
tacttttttacagtatgcttaccatctaaaatatcnttggctttctcacccgactgctactctgttagact

SEQ ID NO: 4795 - DNA, 71 bp, chicken (Gallus Gallus)
  misc_feature (36): n=c or t
taattcacacaaaagcttttaagtgccaacacaatnaaagcaatcttctcacaacttccccctacaaaaaa

SEQ ID NO: 4796 - DNA, 71 bp, chicken (Gallus Gallus)
  misc_feature (36): n=a or g
gctgtgtcttgctcacagctatgaagattttcctcntgtttgaaatgaaacatcctgtgttccagtttgtg

SEQ ID NO: 4797 - DNA, 71 bp, chicken (Gallus Gallus)
  misc_feature (36): n=c or t
tagaggaagggagaaaatctttgcttatgggatatntgcacatgtaagtgacaagagtacaaaaggtggca

SEQ ID NO: 4798 - DNA, 71 bp, chicken (Gallus Gallus)
  misc_feature (36): n=a or g
taacgtccacacaaactttgtttaacccaagcatgnccagccatcgggcctcatgcagcccagcacagctg

SEQ ID NO: 4799 - DNA, 71 bp, chicken (Gallus Gallus)
  misc_feature (36): n=a or g
atagtacaaacttattttataaagctacatgcggtntaagttcctgaatgctgcatttctcccactttata

SEQ ID NO: 4800 - DNA, 71 bp, chicken (Gallus Gallus)
  misc_feature (36): n=a or g
ggaggccgtgtaagcagaggtaagctgaattttagntttcattccaaaggggagtgcctgtataactcagt

SEQ ID NO: 4801 - DNA, 71 bp, chicken (Gallus Gallus)
  misc_feature (36): n=c or t
tatggcaactcagctgctgagtggtggtgtattaangcactcttaagtatcattgtacatgttgatgtact

SEQ ID NO: 4802 - DNA, 71 bp, chicken (Gallus Gallus)
  misc_feature (36): n=c or g
gttgtgagtgtgtatgtatgtatatgtctgtatctntgttttcctgcaactatacttagccagctggagca

SEQ ID NO: 4803 - DNA, 71 bp, chicken (Gallus Gallus)
  misc_feature (36): n=c or t
cctgaatgtcactgcagttgcttactgatgctgcancatttcagtttgctgtgagaaagctggtttctgtt

SEQ ID NO: 4804 - DNA, 71 bp, chicken (Gallus Gallus)
  misc_feature (36): n=a or g
ctgccagtcttgttatacacagatgcatgatagaanttctttgaaaggtcacagaataccacaagttggtg

SEQ ID NO: 4805 - DNA, 71 bp, chicken (Gallus Gallus)
  misc_feature (36): n=c or t
tgtcaccattgaattaacaggatgtcagtggcatgncaaaatgcagcaaggttgagaatgtttatttctat

SEQ ID NO: 4806 - DNA, 71 bp, chicken (Gallus Gallus)
  misc_feature (36): n=a or g
ttaaaagtctgctgaacctaatgaggaagtgatatnattttcttcatcttttgcacctcatttgaaatagc

SEQ ID NO: 4807 - DNA, 71 bp, chicken (Gallus Gallus)
  misc_feature (36): n=a or g
catagaaggcatccagaagctaacagttgattctgnctttgttggtaatattgagtaaaacaatgtgtagt

SEQ ID NO: 4808 - DNA, 71 bp, chicken (Gallus Gallus)
  misc_feature (36): n=a or c
ctttactctgacaggtaagggagaaacatggcatgngacacaccgtgcagaaaaggcgggtatttgttttt

SEQ ID NO: 4809 - DNA, 71 bp, chicken (Gallus Gallus)
  misc_feature (36): n=a or g
aagcatttccttaaatacatactgttggagcttgtngcattgtagggaaacatttgctacgtcattgcact

SEQ ID NO: 4810 - DNA, 71 bp, chicken (Gallus Gallus)
  misc_feature (36): n=a or g
attgcatggagggaccaggtgggagattttctttcntgatttagttcaggacttgcatttagtgatgggtc

SEQ ID NO: 4811 - DNA, 71 bp, chicken (Gallus Gallus)
  misc_feature (36): n=c or t
ctgatgagtttaaaaagaccactgcaaaaaaccttncagttgctttttcgtttgaaagagcaataagtggt

SEQ ID NO: 4812 - DNA, 71 bp, chicken (Gallus Gallus)
  misc_feature (36): n=a or g
agcttggagattcttcatccataataacatctccanaatatttccacacgaggctgtatgttctgtgctat

SEQ ID NO: 4813 - DNA, 71 bp, chicken (Gallus Gallus)
  misc_feature (36): n=a or g
tcaccataaaatttctatcctttgtgggaaagtatntttgtttctcagaatcctgtgaggatggcaaacat

SEQ ID NO: 4814 - DNA, 71 bp, chicken (Gallus Gallus)
  misc_feature (36): n=c or t
tgacttgaaagattcacagcttaggtaaaactaatnatggtatcttgtcttctgtgcaaaatcacaaagtc

SEQ ID NO: 4815 - DNA, 71 bp, chicken (Gallus Gallus)
  misc_feature (36): n=c or t
agcctgttctaaggcagttcaaatgaaggggaagancatctctcttttgaatagctcatgcctcagatctt

SEQ ID NO: 4816 - DNA, 71 bp, chicken (Gallus Gallus)
  misc_feature (36): n=g or t
catttgaaacagaatgagaacgagaccctaagctgngtaaggaataccttctcctacttttgaggtacaaa

SEQ ID NO: 4817 - DNA, 71 bp, chicken (Gallus Gallus)
  misc_feature (36): n=c or t
ttctaacagaaagcattgcttcttggagaacacagnccttgtgtaagtgtggatgactaagcttgctgatg

SEQ ID NO: 4818 - DNA, 71 bp, chicken (Gallus Gallus)
  misc_feature (36): n=c or t
acttctgcagctcttcacagatttatatgctggtgngtgttcaactttttgttgtcattttttaaagagtt

SEQ ID NO: 4819 - DNA, 71 bp, chicken (Gallus Gallus)
  misc_feature (36): n=g or t
aaaatgtttagacatcaaaacttcaattgccaatanttccagacaaactaaatgctggccacaatgacatc

SEQ ID NO: 4820 - DNA, 71 bp, chicken (Gallus Gallus)
  misc_feature (36): n=c or t
gaagcgagagcagggatatctttcttatgtaaaagntgtcattgtcaacaacaaaatattttcaccctttg

SEQ ID NO: 4821 - DNA, 71 bp, chicken (Gallus Gallus)
  misc_feature (36): n=c or t
gtagatgaaagagaaggaaatccctgtaagattcanatacattgtctaaccctcttactgacattgagtaa

SEQ ID NO: 4822 - DNA, 71 bp, chicken (Gallus Gallus)
  misc_feature (36): n=c or t
acacagatatttaagagctcttggtgaaaagcttcngggctttctgagatgtggaactcccgcccggtccc

SEQ ID NO: 4823 - DNA, 71 bp, chicken (Gallus Gallus)
  misc_feature (36): n=c or t
ctcaaagctagagaaacctagttttctatatgtagngcctacttccaacatctgacaatgatttacaatct

SEQ ID NO: 4824 - DNA, 71 bp, chicken (Gallus Gallus)
  misc_feature (36): n=a or g
gttctgtgagtttttttgcactttcttaaacatgcngaaaatgtaaggcaggcctaagctaagtcctaaaa

SEQ ID NO: 4825 - DNA, 71 bp, chicken (Gallus Gallus)
  misc_feature (36): n=c or t
attacacacctgctccttgtcctacttgggctttanaaagcaaagaagtagctgaatgttatcaacaacat

SEQ ID NO: 4826 - DNA, 71 bp, chicken (Gallus Gallus)
  misc_feature (36): n=g or t
ttggtagtctacagcaattccttgtgaggaaagatnagttcagtgatacctacaatttttagctgatcttt

SEQ ID NO: 4827 - DNA, 71 bp, chicken (Gallus Gallus)
  misc_feature (36): n=a or c
taatttccttacgatcacttcctgctatcaaaagcntgagaagagatcatagttctttctttcacagaaga

SEQ ID NO: 4828 - DNA, 71 bp, chicken (Gallus Gallus)
  misc_feature (36): n=c or g
tatgatagaagtgactgagaagaggattcatacccnagatatacacacagttggcattctcacatgcactc

SEQ ID NO: 4829 - DNA, 71 bp, chicken (Gallus Gallus)
  misc_feature (36): n=a or g
attaattttgataacgaatctcaatctaaatcccantttcacaaaggtatatccaagaaaatccttaggct

SEQ ID NO: 4830 - DNA, 71 bp, chicken (Gallus Gallus)
  misc_feature (36): n=c or t
gtgtcaggagttggaatcagtgactcttatgggccnctttcaggtacaggtattatatgatcctacaattc

SEQ ID NO: 4831 - DNA, 71 bp, chicken (Gallus Gallus)
  misc_feature (36): n=a or g
gcatgggcacagctggcttgtataatttgccacagnttattctgacaggcaccctcattatctttatgtat

SEQ ID NO: 4832 - DNA, 71 bp, chicken (Gallus Gallus)
  misc_feature (36): n=a or c
ttgacagtaatctgtctggaaataatcattgctcantacccattgccaaccaaaaatcttttttttttttt

SEQ ID NO: 4833 - DNA, 71 bp, chicken (Gallus Gallus)
  misc_feature (36): n=a or g
ttgcagacaagcaagaagattttgttaaatgtacantgaggttttcctgcagcttcctctggaaagtgtca

SEQ ID NO: 4834 - DNA, 71 bp, chicken (Gallus Gallus)
  misc_feature (36): n=a or c
aacacatttgtacatgaaagaaacgtatgtattttntgcctgactccttcatgaagtatgccactgctttg

SEQ ID NO: 4835 - DNA, 71 bp, chicken (Gallus Gallus)
  misc_feature (36): n=a or c
cagtgggaggtttttctgtctgtatagctcaatganatagcaagggaaataccagaagtgtttctgtcatc

SEQ ID NO: 4836 - DNA, 71 bp, chicken (Gallus Gallus)
  misc_feature (36): n=a or g
gtgccagcagtgcagaggtgcagtaggcagtctggnaatccctttcagtcgttctgcagcattccaacact

SEQ ID NO: 4837 - DNA, 71 bp, chicken (Gallus Gallus)
  misc_feature (36): n=c or t
acagttgacaaaaacatgaaaactgcatacatctgntgctgagttcctttctacgtattatgaaattgtgt

SEQ ID NO: 4838 - DNA, 71 bp, chicken (Gallus Gallus)
  misc_feature (36): n=a or g
aaactaatactaaataaattaaactaatactaacantaattttcttatctgttgagcagtcttctttttaa

SEQ ID NO: 4839 - DNA, 71 bp, chicken (Gallus Gallus)
  misc_feature (36): n=a or g
gaccatatttatcttcctagaacccatacagagtcntactcataaatgaacatttcttgaaagttgaattg

SEQ ID NO: 4840 - DNA, 71 bp, chicken (Gallus Gallus)
  misc_feature (36): n=c or t
acatcagatttagaaacagcagtggcaagtcattgnaagaaaaaagcaaaaaggaaaaatgtggcatttcc

SEQ ID NO: 4841 - DNA, 71 bp, chicken (Gallus Gallus)
  misc_feature (36): n=a or c
caagcatcttagttaactttagaagactttccaggntcactactcactttagaaggaaaagaaaagaaagt

SEQ ID NO: 4842 - DNA, 71 bp, chicken (Gallus Gallus)
  misc_feature (36): n=c or t
gttaaaatcctaatttgtactatgtggaaagtgagnaattttacttagctctagccttcattttgaaatag

SEQ ID NO: 4843 - DNA, 71 bp, chicken (Gallus Gallus)
  misc_feature (36): n=c or g
gggtgacgtggagagacctgacaacaagccattttncaatagagcaggcagcagcgttgtggttggggtca

SEQ ID NO: 4844 - DNA, 71 bp, chicken (Gallus Gallus)
  misc_feature (36): n=c or t
gaatagagaagatctggatttaatttctcactctgncatacttcccaggtggttttggacaggtgtctgat

SEQ ID NO: 4845 - DNA, 71 bp, chicken (Gallus Gallus)
  misc_feature (36): n=c or t
gagctttttgttgattaaacagctcttttatcctgngctgagggaaggagcaggggtgaagggatccatac

SEQ ID NO: 4846 - DNA, 71 bp, chicken (Gallus Gallus)
  misc_feature (36): n=a or g
aacttgctgatggtgcacgtgaccccactttccatntcacctacaaggatgttaaataaccctggtcccag

SEQ ID NO: 4847 - DNA, 71 bp, chicken (Gallus Gallus)
  misc_feature (36): n=a or g
caataaatactgggacttaaaatagctgcttatttngaacacatcactttctttctttgtttcaagactat

SEQ ID NO: 4848 - DNA, 71 bp, chicken (Gallus Gallus)
  misc_feature (36): n=a or c
ttataatcagggaatcactgtatgtattcctcccanaaccaaggtttgacatttcattatgagaatttcaa

SEQ ID NO: 4849 - DNA, 71 bp, chicken (Gallus Gallus)
  misc_feature (36): n=a or g
tacttttcatgcaggcagcaatgatgttattttacncaaccttcccagcaggataacagctctgtttgttc

SEQ ID NO: 4850 - DNA, 71 bp, chicken (Gallus Gallus)
  misc_feature (36): n=g or t
tgccctgagctggatcccagagatgtgccttcatgngactgctgcaggttcctgtgttgagcacctcatcc

SEQ ID NO: 4851 - DNA, 71 bp, chicken (Gallus Gallus)
  misc_feature (36): n=c or t
cccacccatgctttggcagtactgtgaagctgatanaggaaggagcatttttacaagcataagtgaaactg

SEQ ID NO: 4852 - DNA, 71 bp, chicken (Gallus Gallus)
  misc_feature (36): n=a or g
cagaaatccaaagatctccaaaatgaaatggtgtcngtagctggaaaactgaaacaagagaagacctagaa

SEQ ID NO: 4853 - DNA, 71 bp, chicken (Gallus Gallus)
  misc_feature (36): n=c or t
atcagacaagtcccttgatttcttgtgattaaaggnacattgcacaaagcaatatcataagtaacttacct

SEQ ID NO: 4854 - DNA, 71 bp, chicken (Gallus Gallus)
  misc_feature (36): n=c or t
caacaacaagcaagaaaaagaaacaccctaccaggntgagaagctggtttgcaaagaagcaaacagcacga

SEQ ID NO: 4855 - DNA, 71 bp, chicken (Gallus Gallus)
  misc_feature (36): n=c or t
aaatccagctttgaattcctaggggaagcagaccancagataggttttggcaagaaacagcagtggatatc

SEQ ID NO: 4856 - DNA, 71 bp, chicken (Gallus Gallus)
  misc_feature (36): n=a or g
taggtcagtgatatttttattggtcccacacatctngaaaccagaaattctcacagctaattttgtcgttt

SEQ ID NO: 4857 - DNA, 71 bp, chicken (Gallus Gallus)
  misc_feature (36): n=c or t
gcttttctttctctttgatgtcatatttttcatagntgaaataaattattaccagtgaaagctttagaggc

SEQ ID NO: 4858 - DNA, 71 bp, chicken (Gallus Gallus)
  misc_feature (36): n=a or g
cttgctgatataatatgatctgggctgactgccccntccccatattttatctgataaccagcctgtcctgc

SEQ ID NO: 4859 - DNA, 71 bp, chicken (Gallus Gallus)
  misc_feature (36): n=g or t
gagctgagctcagcttcatccatcagcagcaatccnctctggagacctgtctgtacctctgggcctgggga

SEQ ID NO: 4860 - DNA, 71 bp, chicken (Gallus Gallus)
  misc_feature (36): n=c or t
tagcttttggtaaaaaggggttatctatacaaatangttcaagtttgcttaatgaatactatagcaccaga

SEQ ID NO: 4861 - DNA, 71 bp, chicken (Gallus Gallus)
  misc_feature (36): n=c or t
gtttatttgtttatttatttttttatccaagaagangtgtttcagtgagtgaagcctagttacagtatcct

SEQ ID NO: 4862 - DNA, 71 bp, chicken (Gallus Gallus)
  misc_feature (36): n=c or t
gaatctcatctcatctgttcttgctctccatttatncacaactggcatttaaaacaattccgttctattat

SEQ ID NO: 4863 - DNA, 71 bp, chicken (Gallus Gallus)
  misc_feature (36): n=c or t
catttctgcagcaaaaaaaaaaaacccagaagccancaacaaaatcaaacgtgctttctggtgcactgcaa

SEQ ID NO: 4864 - DNA, 71 bp, chicken (Gallus Gallus)
  misc_feature (36): n=a or g
ctttaattgtttctcacctccaaagcttccatcagntgttcccctgttgcaatgttgggtacatggatcgt

SEQ ID NO: 4865 - DNA, 71 bp, chicken (Gallus Gallus)
  misc_feature (36): n=g or t
cctttgaactcacaataaaacaagaaactctctctntcaatccagttttaccagggaaggtatagtgaaag

SEQ ID NO: 4866 - DNA, 71 bp, chicken (Gallus Gallus)
  misc_feature (36): n=c or t
tcttgagttccgagatctagagatcttggcaaaacngagcatttgaatttcttgaagatcgatcaattaaa

SEQ ID NO: 4867 - DNA, 71 bp, chicken (Gallus Gallus)
  misc_feature (36): n=c or t
gaaaatgtaaaaatgctcagaaatcaagtggtatanagcaggacaagggactcaatgttaatctgttgtgc

SEQ ID NO: 4868 - DNA, 71 bp, chicken (Gallus Gallus)
  misc_feature (36): n=c or t
cgcctgcaaaattgaaaggggtaagtgttgggttgntggatgagggtcgtaatggtcctggtcctgcagca

SEQ ID NO: 4869 - DNA, 71 bp, chicken (Gallus Gallus)
  misc_feature (36): n=c or t
ttctggctttcatgtgctgtctttaaacttctattngtttattgtgctccttcccagaaaagtgaatctta

SEQ ID NO: 4870 - DNA, 71 bp, chicken (Gallus Gallus)
  misc_feature (36): n=c or t
tgaacaagagcctgcacctgcaccagcagcactgtnccaaccgttgctttcaccactcctgaaatgcacca

SEQ ID NO: 4871 - DNA, 71 bp, chicken (Gallus Gallus)
  misc_feature (36): n=a or t
ttaggaatgaaatgaccagaagaaaatttgaggagngatggaaattttttaagtgtctttgaggttcgtgt

SEQ ID NO: 4872 - DNA, 71 bp, chicken (Gallus Gallus)
  misc_feature (36): n=g or t
accactgtgtcttgctatgtgtcataaatctatctncagcgtgcatcatggaatcatagaagagctcagtg

SEQ ID NO: 4873 - DNA, 71 bp, chicken (Gallus Gallus)
  misc_feature (36): n=a or g
gaggcccagtttcagaacaatctccataggcagatnctggcacatgcccaccagctgtgcaggactgcacg

SEQ ID NO: 4874 - DNA, 71 bp, chicken (Gallus Gallus)
  misc_feature (36): n=a or g
atttaaaaaactcctaaatgcttgtattattcaganctgttattacaactgttatggtactcgttacccta

SEQ ID NO: 4875 - DNA, 71 bp, chicken (Gallus Gallus)
  misc_feature (36): n=c or t
ccttcaattgagacaaatattcttaaaacactgaancactttgaatcacttcagacattttcagcatacaa

SEQ ID NO: 4876 - DNA, 71 bp, chicken (Gallus Gallus)
  misc_feature (36): n=c or t
gaatctctgcataataacaatgcaacatcctcaaangctttaaaggactcttttctcatgaactacatcaa

SEQ ID NO: 4877 - DNA, 71 bp, chicken (Gallus Gallus)
  misc_feature (36): n=a or g
tagatgtacccccagcaagttggttaattgtaaagncaatgattggtaaattggagtttatggctgccttt

SEQ ID NO: 4878 - DNA, 71 bp, chicken (Gallus Gallus)
  misc_feature (36): n=c or t
ctggagtgaagataaaacggagatctgcctgtctcnagtgctttgccaaaatacgggtgtacctgagtgta

SEQ ID NO: 4879 - DNA, 71 bp, chicken (Gallus Gallus)
  misc_feature (36): n=a or g
cttctccaaagtgtttcacagccttggaaaactggnagagaagcacagaattgtaagggttggaagaaacc

SEQ ID NO: 4880 - DNA, 71 bp, chicken (Gallus Gallus)
  misc_feature (36): n=c or t
gtgtacagtgagaaagtaggaaaacagccccggtgntttttgttgccagtgggtagttgtttttgacctgt

SEQ ID NO: 4881 - DNA, 71 bp, chicken (Gallus Gallus)
  misc_feature (36): n=a or g
actgtgcaaggaatttggttctctgtcccagctgcnttctctcatgcctcgctattctagtcaggaactca

SEQ ID NO: 4882 - DNA, 71 bp, chicken (Gallus Gallus)
  misc_feature (36): n=a or g
gcaaaaagcttcagctgctgaagctacagttttccngggctggaggtgaagcactggagctgggcataggg

SEQ ID NO: 4883 - DNA, 71 bp, chicken (Gallus Gallus)
  misc_feature (36): n=a or g
gaacattgggaacatgatcagaaatgaaactgcacnctgagcaaaggaaagctctgcaaaacaaatctcct

SEQ ID NO: 4884 - DNA, 71 bp, chicken (Gallus Gallus)
  misc_feature (36): n=a or g
cttttttggaatccttggtgtgaatatctcggctcntgcttcagagctaaacttttcaacaagaacattca

SEQ ID NO: 4885 - DNA, 71 bp, chicken (Gallus Gallus)
  misc_feature (36): n=c or t
atcacggtggaggactcgtgcaacttcatcatctcnaacggcggggcgcagacctaccacctgaaggccag

SEQ ID NO: 4886 - DNA, 71 bp, chicken (Gallus Gallus)
  misc_feature (36): n=c or g
agaaagggcaaaaagcttgggtgaaagagtggttanaatatattagtttctctttctgacttaatgtttac

SEQ ID NO: 4887 - DNA, 71 bp, chicken (Gallus Gallus)
  misc_feature (36): n=c or t
agaactccctcctaacatctaacctaaatctccccnctttttgcccccctcctgacttgttctatcactat

SEQ ID NO: 4888 - DNA, 71 bp, chicken (Gallus Gallus)
  misc_feature (36): n=a or g
aggtcagggaactgaaaagcaacttctgagtttccntgccaggctgtttctttgttcagtgaagggaagga

SEQ ID NO: 4889 - DNA, 71 bp, chicken (Gallus Gallus)
  misc_feature (36): n=a or g
aacaataagacgttttcaaaaagacttagcaagcanagctaagctaagctaagcaaagccgagctcctaaa

SEQ ID NO: 4890 - DNA, 71 bp, chicken (Gallus Gallus)
  misc_feature (36): n=c or t
tctgtgtgtgcatgtgtatgcaaacgaattcaaggngcagatctctgcatgcacacaataacacaggctgt

SEQ ID NO: 4891 - DNA, 71 bp, chicken (Gallus Gallus)
  misc_feature (36): n=a or c
taagaaaagagggacctgcactgctggcagtcctgngggccttgcataggcttctattgaatagattgatc

SEQ ID NO: 4892 - DNA, 71 bp, chicken (Gallus Gallus)
  misc_feature (36): n=a or g
atataattttaatacaacttagcttcaatttcactnattgtaactctggtagaatgcagtgggacagcaga

SEQ ID NO: 4893 - DNA, 71 bp, chicken (Gallus Gallus)
  misc_feature (36): n=c or t
gaaaaaaagcccgcacctcaacacagttccacaacnatttgcagactcacattaagttcctccagcttatt

SEQ ID NO: 4894 - DNA, 71 bp, chicken (Gallus Gallus)
  misc_feature (36): n=c or t
ttaattattctgtggaggcttggatgcatttatatncactctcttgggcaagaacttagctaaagcatcga

SEQ ID NO: 4895 - DNA, 71 bp, chicken (Gallus Gallus)
  misc_feature (36): n=c or t
ttgctgagtatagttgaaggaaatacatcaacttgngtttctcttcaaatacaaggggtaaaaaggtgagg

SEQ ID NO: 4896 - DNA, 71 bp, chicken (Gallus Gallus)
  misc_feature (36): n=c or t
actagtgtgtaagctctctgggagcagggactgtanctctgtggtgcctacctgaaggcctaatagcatta

SEQ ID NO: 4897 - DNA, 71 bp, chicken (Gallus Gallus)
  misc_feature (36): n=c or t
tttgcatttcattttcggttcccacattcacatcanacagctacttgcctttttgtcttcagggcttagtt

SEQ ID NO: 4898 - DNA, 71 bp, chicken (Gallus Gallus)
  misc_feature (36): n=a or g
tggactgatggaaagtcaaagcagctcattctaaanagagtttaaaacaaatttgtgtaccagagaacttc

SEQ ID NO: 4899 - DNA, 71 bp, chicken (Gallus Gallus)
  misc_feature (36): n=a or g
ttcccttcattgaactttctccatattatttgcatngtcacttctggagccagtattaattgctagatatt

SEQ ID NO: 4900 - DNA, 71 bp, chicken (Gallus Gallus)
  misc_feature (36): n=a or g
cctgcgtatatccccagtcttgggaagaataaagcnaggatgattttttaaaatattacatattgcagcac

SEQ ID NO: 4901 - DNA, 71 bp, chicken (Gallus Gallus)
  misc_feature (36): n=a or g
gggactggactggattgaatttagggctgggacacngcatcagcagctcagctaccaactgggaacctctc

SEQ ID NO: 4902 - DNA, 71 bp, chicken (Gallus Gallus)
  misc_feature (36): n=a or g
ttgaagtgagtggattgaaagtgggcacaactgctngtattcatgcgtatattagctgtctctctgcagag

SEQ ID NO: 4903 - DNA, 71 bp, chicken (Gallus Gallus)
  misc_feature (36): n=g or t
ctcccattgttttttttttaactttgcaagagctgnatcttgtgtgaaatgataaaagagggtagttttcc

SEQ ID NO: 4904 - DNA, 71 bp, chicken (Gallus Gallus)
  misc_feature (36): n=c or t
aacctgttcagtagtctgtttacacatgcattagcngttgtggagccacttagcagcaccaaaaagattac

SEQ ID NO: 4905 - DNA, 71 bp, chicken (Gallus Gallus)
  misc_feature (36): n=a or g
ctttgcagcccatgagttgtcggcatggtccaagangagctcccaagtcctaactcctgacaactttaagt

SEQ ID NO: 4906 - DNA, 71 bp, chicken (Gallus Gallus)
  misc_feature (36): n=c or t
tagcagcagccacttcataacaaggacaagaagcantgagatgctatatgcatattcaaaggacaggaggc

SEQ ID NO: 4907 - DNA, 71 bp, chicken (Gallus Gallus)
  misc_feature (36): n=a or g
ggaactgtgatcagcttcaatactttgttgagatcnttgcccaagtggggtgcccttatcctaccaacagg

SEQ ID NO: 4908 - DNA, 71 bp, chicken (Gallus Gallus)
  misc_feature (36): n=a or g
attatagctgtagatctcacctaaaatgtaataacnctagagaataagagatgaactttgtgaaaggttta

SEQ ID NO: 4909 - DNA, 71 bp, chicken (Gallus Gallus)
  misc_feature (36): n=c or t
cagctctacaagattctcttctagcgtaacaccagngtaatatggagccaggggggctgagaaatcagaga

SEQ ID NO: 4910 - DNA, 71 bp, chicken (Gallus Gallus)
  misc_feature (36): n=a or g
agaaaagccaaagattatctggatttaaaactagtnatgtgaaaggtatgaggtttctgtaactaggtcaa

SEQ ID NO: 4911 - DNA, 71 bp, chicken (Gallus Gallus)
  misc_feature (36): n=c or t
gccagctgcacaaagattgctcctggagcagggtcntgctctcaagatctaagccttcgcctttcagcatg

SEQ ID NO: 4912 - DNA, 71 bp, chicken (Gallus Gallus)
  misc_feature (36): n=c or t
agctgctagaaactaatatggagtttgcaatagagngatctctttccgttgcctaaatcctacagtcctga

SEQ ID NO: 4913 - DNA, 71 bp, chicken (Gallus Gallus)
  misc_feature (36): n=c or t
ctagagcttcactcctctagcaactgagagtcttgnaattccatactgaaattgtttgtgatgacagcttt

SEQ ID NO: 4914 - DNA, 71 bp, chicken (Gallus Gallus)
  misc_feature (36): n=c or g
tgtatttttgttaaatttctatgtgtagatagctgnatatgtatactttgctcttgaacttctggtctttt

SEQ ID NO: 4915 - DNA, 71 bp, chicken (Gallus Gallus)
  misc_feature (36): n=c or t
acagtcctcagcattacctgactcacaatctcatanttatcacaagttttaatgccttcttttcatcctgt

SEQ ID NO: 4916 - DNA, 71 bp, chicken (Gallus Gallus)
  misc_feature (36): n=a or g
aggtttcacactcaactaaaagctttaatcatatcntccacctgaaactgatttaccattcgctagagagt

SEQ ID NO: 4917 - DNA, 71 bp, chicken (Gallus Gallus)
  misc_feature (36): n=a or g
gtggagagctggaaatcattgattgccatgagtttnatccctgccaatgaacacagtccttccgcccattg

SEQ ID NO: 4918 - DNA, 71 bp, chicken (Gallus Gallus)
  misc_feature (36): n=c or t
gcatgatattttcttaaaatcataagctttcttaangttcttacggtttatgaatgttttcttatgcttca

SEQ ID NO: 4919 - DNA, 71 bp, chicken (Gallus Gallus)
  misc_feature (36): n=a or g
tacctgtgttattggcagtcaaaattattgtgttcnaatattcatttttggcatatcattttctagaggta

SEQ ID NO: 4920 - DNA, 71 bp, chicken (Gallus Gallus)
  misc_feature (36): n=g or t
gcaaaacataaccctagtttcaagatggagcatgtnaaatttctgagaagtattgcatgttgcaaccatgt

SEQ ID NO: 4921 - DNA, 71 bp, chicken (Gallus Gallus)
  misc_feature (36): n=c or t
tctgaaatcttcacaacattctactcatacctgttnccagcttcttaatgtgctttaatttggtcaaatct

SEQ ID NO: 4922 - DNA, 71 bp, chicken (Gallus Gallus)
  misc_feature (36): n=c or t
attatcaatctcatgggttagctagatggcttcagntttaaaaagacttttaattgctacatatatttttt

SEQ ID NO: 4923 - DNA, 71 bp, chicken (Gallus Gallus)
  misc_feature (36): n=c or t
agtttcaagctgcagtacctacaaaagatgaacgtngtgtgtctctgggagacacctgaggacaaaaaaac

SEQ ID NO: 4924 - DNA, 71 bp, chicken (Gallus Gallus)
  misc_feature (36): n=a or t
tgaaaagcaacagattatcaaaagaacatcaagaanttatttttcctctgcactgggaaagttgtgcatat

SEQ ID NO: 4925 - DNA, 71 bp, chicken (Gallus Gallus)
  misc_feature (36): n=g or t
gtttaaagccatccccccttgtcctatcactgtaanactgtgtaaaaatagagttccatttaagtagcaaa

SEQ ID NO: 4926 - DNA, 71 bp, chicken (Gallus Gallus)
  misc_feature (36): n=a or g
gtcaaaatactgaacaatcatcttacattcattagntctagcctagacacagagatttttatccaaacctg

SEQ ID NO: 4927 - DNA, 71 bp, chicken (Gallus Gallus)
  misc_feature (36): n=a or g
aaggatgcattgggctttctcagccttcacattgtntaccaatcatgacacagattctgaatatgccctct

SEQ ID NO: 4928 - DNA, 71 bp, chicken (Gallus Gallus)
  misc_feature (36): n=c or t
tgcatgagaccattctatgcatgtttcatgtgtctngagacaaaatattccaaatttgctgtgaatttgcg

SEQ ID NO: 4929 - DNA, 71 bp, chicken (Gallus Gallus)
  misc_feature (36): n=c or t
tgatgtttgcccatcattgctcttgtaatgacttangttttccttaaatgttagataccttcagttcaaag

SEQ ID NO: 4930 - DNA, 71 bp, chicken (Gallus Gallus)
  misc_feature (36): n=c or t
aaatgagagaaaatatcatttgacttactctgacangtgaaaacagaaagaaaaacctgggcatcattttt

SEQ ID NO: 4931 - DNA, 71 bp, chicken (Gallus Gallus)
  misc_feature (36): n=a or c
caaatagttctgaaaccccagcctagactcctttgnccagcttgtgtattgcagctcctagaagtgaatga

SEQ ID NO: 4932 - DNA, 71 bp, chicken (Gallus Gallus)
  misc_feature (36): n=a or c
gcatgctgtacttgtaagtatccgcatggccatctngaatgggccttgtcttccatacaccacccacatct

SEQ ID NO: 4933 - DNA, 71 bp, chicken (Gallus Gallus)
  misc_feature (36): n=a or g
aaaggtcatgcacagtaatgccctttgcatcctctntagctgtagaaaagctagactgctctgaaaccatt

SEQ ID NO: 4934 - DNA, 71 bp, chicken (Gallus Gallus)
  misc_feature (36): n=a or g
agtacgtgctgcttactcataataacagtacttcantgaacatttgttctttgggtggaaaataagctcca

SEQ ID NO: 4935 - DNA, 71 bp, chicken (Gallus Gallus)
  misc_feature (36): n=c or t
gcagaaggagcatctgaaaggtcagctgaggagaanggcatgattacccagaggctgttataccttgcatg

SEQ ID NO: 4936 - DNA, 71 bp, chicken (Gallus Gallus)
  misc_feature (36): n=g or t
ctcacatcagtacagtccgtctccctctttgagagntgagcaggctactgagcagactgtcagttcactga

SEQ ID NO: 4937 - DNA, 71 bp, chicken (Gallus Gallus)
  misc_feature (36): n=c or t
ctgtcacttgtgtttaagtcatagcagtgacctgcnctaccacaaggccctagaacttcacaagaggatct

SEQ ID NO: 4938 - DNA, 71 bp, chicken (Gallus Gallus)
  misc_feature (36): n=a or c
ctgagctcagctacctgttttcctccttaaccattncagtgaaagctagcttggccagatcttccatattg

SEQ ID NO: 4939 - DNA, 71 bp, chicken (Gallus Gallus)
  misc_feature (36): n=c or g
tcccagatctcctgtaacagcagacccaaagtgatnaagctaatagagttaaatagatccaccattttgga

SEQ ID NO: 4940 - DNA, 71 bp, chicken (Gallus Gallus)
  misc_feature (36): n=c or t
ttgtaacctatgtgaaacattggaagagaaagctanagatgtgggtgaaatggggttctaacacatcagca

SEQ ID NO: 4941 - DNA, 71 bp, chicken (Gallus Gallus)
  misc_feature (36): n=a or g
aatagtctgcttagcttgccttagagttatagaacngcacatgtggcaatcacagcctttacctctacacc

SEQ ID NO: 4942 - DNA, 71 bp, chicken (Gallus Gallus)
  misc_feature (36): n=c or g
tgttattcctcaagactatgattcacagttattaanactgactagtgaaagaccactatcacatgaactgg

SEQ ID NO: 4943 - DNA, 71 bp, chicken (Gallus Gallus)
  misc_feature (36): n=a or g
gagactataaagaacacagcctgggtcctggaagcngcaggcacatcgcagcagatctaagataatggttt

SEQ ID NO: 4944 - DNA, 71 bp, chicken (Gallus Gallus)
  misc_feature (36): n=c or t
aagctagggatggtgcaggatgaactatgacttacnttcttttcccttggcagtgagcagtcccttgcgtg

SEQ ID NO: 4945 - DNA, 71 bp, chicken (Gallus Gallus)
  misc_feature (36): n=c or g
cattatcatgaccactgaggagtccagtgtgacctntgatggctgagatactgcattcttgctttaggaga

SEQ ID NO: 4946 - DNA, 71 bp, chicken (Gallus Gallus)
  misc_feature (36): n=a or t
aaaaagaaactgagaaatgtaagcatacagcagcantgcaggatgcgttgggttctgaatgtccctgcaac

SEQ ID NO: 4947 - DNA, 71 bp, chicken (Gallus Gallus)
  misc_feature (36): n=a or g
aatatgcaggaggtctagtttgaaggaagaatgaantactatatacaaatcaaattctgtaacattttcag

SEQ ID NO: 4948 - DNA, 71 bp, chicken (Gallus Gallus)
  misc_feature (36): n=a or g
gtttagggtgaaggaaactctcttgcttcccatctnataggtagcagttacagttggctttcactccaagg

SEQ ID NO: 4949 - DNA, 71 bp, chicken (Gallus Gallus)
  misc_feature (36): n=c or t
ttttaacttgaaagtaatgattaacaaagcagatangaacccttagaggcctatttcggtagaaactgaag

SEQ ID NO: 4950 - DNA, 71 bp, chicken (Gallus Gallus)
  misc_feature (36): n=c or t
taaaataaagctgtgggaagaggtggcagattttcngctatcacttggggaatatgctcaaatatctaaaa

SEQ ID NO: 4951 - DNA, 71 bp, chicken (Gallus Gallus)
  misc_feature (36): n=c or t
cttttgactttcccagtttttagatgcatgactagnaaagaggccaagcagtcctcaaatggaaataacca

SEQ ID NO: 4952 - DNA, 71 bp, chicken (Gallus Gallus)
  misc_feature (36): n=c or t
ctgaacgttgcttgttagtcaatgaaaatcaagtantgaagccaatcagatgcttcagtaaatcccactag

SEQ ID NO: 4953 - DNA, 71 bp, chicken (Gallus Gallus)
  misc_feature (36): n=c or t
tttcaaatacagtagcattcatctgctcagaagtgntatcattgtagcactttgcaagaaagaagatcagc

SEQ ID NO: 4954 - DNA, 71 bp, chicken (Gallus Gallus)
  misc_feature (36): n=c or t
gtgtattcattttggcagcttaagtgcaaaaacttncagactaaagatgtatttttatacaaataaggaat

SEQ ID NO: 4955 - DNA, 71 bp, chicken (Gallus Gallus)
  misc_feature (36): n=c or t
tagtatttgtaagttcaatacatgtagcgtaggatntgtacctatttgatcaacaaataattttattttat

SEQ ID NO: 4956 - DNA, 71 bp, chicken (Gallus Gallus)
  misc_feature (36): n=a or c
attgctaataactataagaaccaacttattttcttngtgtctccaaaacattaaaaataatcttttcttta

SEQ ID NO: 4957 - DNA, 71 bp, chicken (Gallus Gallus)
  misc_feature (36): n=c or t
gtgtcagatccctccagcactgcagcgtcagcaganggcctgatgtcctgggcaaacaaaatgaggtctga

SEQ ID NO: 4958 - DNA, 71 bp, chicken (Gallus Gallus)
  misc_feature (36): n=a or c
ggagatgtagctgtggggagttggctagaggaggcnactgttcaggaattgtctgggtgtaggtctgtggc

SEQ ID NO: 4959 - DNA, 71 bp, chicken (Gallus Gallus)
  misc_feature (36): n=a or g
tatcagcttgtgtcctccagtttcccttctgtaaancacagctgtataacagtgcttccctaactgaacgt

SEQ ID NO: 4960 - DNA, 71 bp, chicken (Gallus Gallus)
  misc_feature (36): n=a or g
ctctttgaaccccttttggaatcagaggggcccctngggttttttgttctatctgccttcagaagctttcc

SEQ ID NO: 4961 - DNA, 71 bp, chicken (Gallus Gallus)
  misc_feature (36): n=a or c
tgctacaccgttgtcagtgagaaaaagccatttccnagccaggttggttaacccagatttgcatgttctgt

SEQ ID NO: 4962 - DNA, 71 bp, chicken (Gallus Gallus)
  misc_feature (36): n=a or g
ctggtagatgatggtagcattttctcataaacaagnaaaaggaataagccctaatgtgggtttattcataa

SEQ ID NO: 4963 - DNA, 71 bp, chicken (Gallus Gallus)
  misc_feature (36): n=c or t
agtacatttttgttacctagcattccccttatattncaattcatattaatttcaaagcagaagatcccaag

SEQ ID NO: 4964 - DNA, 71 bp, chicken (Gallus Gallus)
  misc_feature (36): n=a or c
tcccccagactaagggtaattcctgcttgcacccgnggccagctgaaaaatgagtttgcctttcctttcgg

SEQ ID NO: 4965 - DNA, 71 bp, chicken (Gallus Gallus)
  misc_feature (36): n=c or g
cgtggtagtgtatgagctcaggaactgttacagcanttaagactttcttcctcttttagaagaagccaata

SEQ ID NO: 4966 - DNA, 71 bp, chicken (Gallus Gallus)
  misc_feature (36): n=c or t
gcctcaatccaaggtggttttgattatattaaatangcaaaataaacactaccatcaaattgagcttcctt

SEQ ID NO: 4967 - DNA, 71 bp, chicken (Gallus Gallus)
  misc_feature (36): n=a or g
ttgatacagcaacgtggccacatcgacagctctacnaccagggcaacaatggcctgagtccatttacaaga

SEQ ID NO: 4968 - DNA, 71 bp, chicken (Gallus Gallus)
  misc_feature (36): n=c or t
gttgctttcccaaatctagagagaaggagactaaanctcagtcataccctattcaccatcactacaatacg

SEQ ID NO: 4969 - DNA, 71 bp, chicken (Gallus Gallus)
  misc_feature (36): n=c or t
ctggcattgtccccaaatacgataacaggttgagtngttaccaagaatttcaaaagtcaggagagaagtag

SEQ ID NO: 4970 - DNA, 71 bp, chicken (Gallus Gallus)
  misc_feature (36): n=c or t
aatgtcctcaacagtgctgcatttcagtgacaaaancaacaaaaatacagacacccaggccaatcccactc

SEQ ID NO: 4971 - DNA, 71 bp, chicken (Gallus Gallus)
  misc_feature (36): n=a or g
tcatgagggatcatctgctccagctctttattctcntggaaccgcaatcctctgtgacagcataataactt

SEQ ID NO: 4972 - DNA, 71 bp, chicken (Gallus Gallus)
  misc_feature (36): n=c or t
ttcaagctggaactgagaaacagccctaaaagtagntcaaaaagcaatggaatgaatttcatgggaaggat

SEQ ID NO: 4973 - DNA, 71 bp, chicken (Gallus Gallus)
  misc_feature (36): n=a or g
gagcacaactttgcatttgctatgacaaaaactgtnacatagattgcacagtgtagattgaacgatctgga

SEQ ID NO: 4974 - DNA, 71 bp, chicken (Gallus Gallus)
  misc_feature (36): n=a or g
gctttctttcctgaggccaaagaggaaactgaaatntgaatagcagcaataggaagtcatggaaaggtaag

SEQ ID NO: 4975 - DNA, 71 bp, chicken (Gallus Gallus)
  misc_feature (36): n=c or t
acaacatcgtggtgcaaagtattccataacttaagnacatggtacttatccattctggttgctgccaatct

SEQ ID NO: 4976 - DNA, 71 bp, chicken (Gallus Gallus)
  misc_feature (36): n=a or g
aggtaacaactccatcatggcagaggggagacaaangaggtcagccaagcagcaaatacgaaaagctttac

SEQ ID NO: 4977 - DNA, 71 bp, chicken (Gallus Gallus)
  misc_feature (36): n=c or t
tcagtgctcagaggatgttcttggcacccaatcttngcttctagctgcatttactttttcttgttgtccta

SEQ ID NO: 4978 - DNA, 71 bp, chicken (Gallus Gallus)
  misc_feature (36): n=a or g
gaaaacacaggacagaagaggtgaatggcatttcantcttcagtcctgattcagcagaaagaaatctatga

SEQ ID NO: 4979 - DNA, 71 bp, chicken (Gallus Gallus)
  misc_feature (36): n=a or g
tttttattgatagctgagtctgattgccatgccagntagttaatgagtcttccagtattccagatattatc

SEQ ID NO: 4980 - DNA, 71 bp, chicken (Gallus Gallus)
  misc_feature (36): n=a or c
gacaagtggcagagagaaactactctgtatgggtcncaaccactccttcgttcctcttgcaccactgtgca

SEQ ID NO: 4981 - DNA, 71 bp, chicken (Gallus Gallus)
  misc_feature (36): n=c or t
agtctatcaagtatccacagctgcgtggctgtttcntaaagatcccctttgctagcggggcgtggagcagt

SEQ ID NO: 4982 - DNA, 71 bp, chicken (Gallus Gallus)
  misc_feature (36): n=a or g
caggaaataatcgcctgtcactttgagtgtttccantcttgtggcagagattaaatacagcagaagccaac

SEQ ID NO: 4983 - DNA, 71 bp, chicken (Gallus Gallus)
  misc_feature (36): n=c or t
atacatttaaacttcaaaaccagaaatctatagaanaaactttttaaaggaagtggtttagatctggattt

SEQ ID NO: 4984 - DNA, 71 bp, chicken (Gallus Gallus)
  misc_feature (36): n=g or t
catgtttctcacagtgataggtttctcaaagatccnccagcttcccaagctgctcatttcagaaagacgac

SEQ ID NO: 4985 - DNA, 71 bp, chicken (Gallus Gallus)
  misc_feature (36): n=c or t
cctcctgaaccatccaggaaccacccagcagagtcnaaggagcagaacattataggtaatacagcactgaa

SEQ ID NO: 4986 - DNA, 71 bp, chicken (Gallus Gallus)
  misc_feature (36): n=a or g
taaggacagttcccaaaccaatgttgcaggtaatanatttagtttaagctgaaagactttaaagtaatggc

SEQ ID NO: 4987 - DNA, 71 bp, chicken (Gallus Gallus)
  misc_feature (36): n=a or g
tggatggccaacattccaggaagactggcagcaaanatatgactgtggttcactacactgataacaattag

SEQ ID NO: 4988 - DNA, 71 bp, chicken (Gallus Gallus)
  misc_feature (36): n=a or g
tgtccttgactttctgacacctgagctgcaggtacnatcagtggcagcgacggcgacctgctgtcaacctg

SEQ ID NO: 4989 - DNA, 71 bp, chicken (Gallus Gallus)
  misc_feature (36): n=c or t
tggccagaagctgaggttatgatgaccagatcattnggtatggcactgacatttcaagttcagagagattg

SEQ ID NO: 4990 - DNA, 71 bp, chicken (Gallus Gallus)
  misc_feature (36): n=a or g
tactgaggctgtggatacctggcacagtgcagaaanctgagaccaaaccccaaactgctgctccctccact

SEQ ID NO: 4991 - DNA, 71 bp, chicken (Gallus Gallus)
  misc_feature (36): n=a or g
tttggtactcattgcttttacagtacattttctctnactttgcctggtacaagcttgtcttggccatatct

SEQ ID NO: 4992 - DNA, 71 bp, chicken (Gallus Gallus)
  misc_feature (36): n=c or t
ttcacaaacctatctctgcactcatcttcttctatncaaactgcaggtttagtcatcctgtcacagatgca

SEQ ID NO: 4993 - DNA, 71 bp, chicken (Gallus Gallus)
  misc_feature (36): n=c or t
gcccatccttcatctctgaggatgttttacagcctnaggatgtgtaggttgtgctgctgctctcccctctg

SEQ ID NO: 4994 - DNA, 71 bp, chicken (Gallus Gallus)
  misc_feature (36): n=a or g
aatgaaagggtacctgaggacaacttgctaccacangtgaccctcctgggctgggatctctttctttccaa

SEQ ID NO: 4995 - DNA, 71 bp, chicken (Gallus Gallus)
  misc_feature (36): n=c or t
tggttttggctttgttgtagtattgaggttgtgctngctttgttgttgtggggatttttttgctgctgttt

SEQ ID NO: 4996 - DNA, 71 bp, chicken (Gallus Gallus)
  misc_feature (36): n=g or t
gttaatatcttttaaaagcttgcatatactctttantgctgcaccttctccattttatacgaggaaaatta

SEQ ID NO: 4997 - DNA, 71 bp, chicken (Gallus Gallus)
  misc_feature (36): n=g or t
catcccccggcccgcgctgcagctcaccagggcacngaggaggaacttccatcacaccgatggcttttgga

SEQ ID NO: 4998 - DNA, 71 bp, chicken (Gallus Gallus)
  misc_feature (36): n=c or t
tcactatatgtgaggctgctacagagccatgtcccngggtccagctagtaatgagtctgagtatgtattcc

SEQ ID NO: 4999 - DNA, 71 bp, chicken (Gallus Gallus)
  misc_feature (36): n=a or g
ggtgtcatatagggaaagaaaactggtgaaccaaangggcaacagtcactagaacatactgtgttggttta

SEQ ID NO: 5000 - DNA, 71 bp, chicken (Gallus Gallus)
  misc_feature (36): n=a or c
ctaactggtacacattaatgccctgaaaaagtgagnaatattctacttagttattgaagtaatttactaaa

SEQ ID NO: 5001 - DNA, 71 bp, chicken (Gallus Gallus)
  misc_feature (36): n=c or t
tggttatggacattacaatagcaaccagaatacgtnctcagaaacactttcaatacagatcacacagcaaa

SEQ ID NO: 5002 - DNA, 71 bp, chicken (Gallus Gallus)
  misc_feature (36): n=c or t
cttctttttttcccactgaattctgtgtagtttcantgtaagacaaagacttattaaacaaccatggaaaa

SEQ ID NO: 5003 - DNA, 71 bp, chicken (Gallus Gallus)
  misc_feature (36): n=a or t
atcaatggacaacccatttcttgctgactgagattnacctgaatgcagagaaaccagctgacattccaagt

SEQ ID NO: 5004 - DNA, 71 bp, chicken (Gallus Gallus)
  misc_feature (36): n=a or g
attaggagcttgcctagaatgaaaattttagggagngaaaccagcagacagggcaaatcacccgtagagaa

SEQ ID NO: 5005 - DNA, 71 bp, chicken (Gallus Gallus)
  misc_feature (36): n=c or t
tttggctacctttgttctaaaatcttgatctcaaancagatggcaaaatcaccttttcaagaataccatct

SEQ ID NO: 5006 - DNA, 71 bp, chicken (Gallus Gallus)
  misc_feature (36): n=g or t
ttcagttttctaattcagagactttgagtacctagnagaagctaaatgcaatatgaaatgttgccctaaga

SEQ ID NO: 5007 - DNA, 71 bp, chicken (Gallus Gallus)
  misc_feature (36): n=c or t
aggaacttggcctgatgttcaggaagtggacctttntgaatagctcctttttatgctggaaaactatttcc

SEQ ID NO: 5008 - DNA, 71 bp, chicken (Gallus Gallus)
  misc_feature (36): n=c or t
tgagatctgtgatccttctactgactatggaggaanagattaaatctccacttgatgatgagctatcttaa

SEQ ID NO: 5009 - DNA, 71 bp, chicken (Gallus Gallus)
  misc_feature (36): n=a or g
tcaatgctcacacgtaatccctgctggagttaaagnactgaaaaagagcttattattgaatactctacatg

SEQ ID NO: 5010 - DNA, 71 bp, chicken (Gallus Gallus)
  misc_feature (36): n=c or t
tcctctccatgtcacgcaattcacttttgaactccngagtgcattttactcatcctcctggagcatttcac

SEQ ID NO: 5011 - DNA, 71 bp, chicken (Gallus Gallus)
  misc_feature (36): n=c or t
ctcctataatgctttcagtaggaagcaaagagcaangcttttcatattcaatttcacagcatcatattcat

SEQ ID NO: 5012 - DNA, 71 bp, chicken (Gallus Gallus)
  misc_feature (36): n=c or t
ctcagttactaaagctgtaagtaccctatttatagnctttctgagttttgtggcaagatggtgggatttgg

SEQ ID NO: 5013 - DNA, 71 bp, chicken (Gallus Gallus)
  misc_feature (36): n=a or g
acttttttctcttttttaagactgccatactcagcntgcttgtcattagagaagaaaggagtttcccgttg

SEQ ID NO: 5014 - DNA, 71 bp, chicken (Gallus Gallus)
  misc_feature (36): n=c or t
tgttcaaattgtgtcgttctgcttttgtctaacttntttacagtgataggccagcagaaatgcagtagaat

SEQ ID NO: 5015 - DNA, 71 bp, chicken (Gallus Gallus)
  misc_feature (36): n=a or g
aatggacatatgttgggacatgaatatctctggacntctgctgtttccaagcatagcttatttttaacgat

SEQ ID NO: 5016 - DNA, 71 bp, chicken (Gallus Gallus)
  misc_feature (36): n=a or g
ctctcttgggtgcacctactgttaatgtatacctantgagcactgctgaatgtcagctgctctttttggag

SEQ ID NO: 5017 - DNA, 71 bp, chicken (Gallus Gallus)
  misc_feature (36): n=c or t
tcagtgattctatgactctataaagtacgaggacangcagtcaataacactaagatgaccaatatatcatt

SEQ ID NO: 5018 - DNA, 71 bp, chicken (Gallus Gallus)
  misc_feature (36): n=g or t
gtcaatttggttacgaggcaggggtaaaacaaaggnagtgcccacgtgtgtactgcaggcttctgggactc

SEQ ID NO: 5019 - DNA, 71 bp, chicken (Gallus Gallus)
  misc_feature (36): n=a or g
cagtctctttgagaagtgtttgctgccatttggcanatgtttcatgctttgaagacacaaatattttttaa

SEQ ID NO: 5020 - DNA, 71 bp, chicken (Gallus Gallus)
  misc_feature (36): n=c or g
aaaaatgtgaatgatgaatgctatgcatccaacagnatggttaaataacaaagtgtagatactgggatata

SEQ ID NO: 5021 - DNA, 71 bp, chicken (Gallus Gallus)
  misc_feature (36): n=c or t
ggcagtggcttcaaagagcaaaatcagctcatgcanctcccatccacatcccatcccatcccatcctgttg

SEQ ID NO: 5022 - DNA, 71 bp, chicken (Gallus Gallus)
  misc_feature (36): n=c or t
cctccattcaacacattttggaattgccatgtttgntcttctctgtgctggagatgattactgtgttcccc

SEQ ID NO: 5023 - DNA, 71 bp, chicken (Gallus Gallus)
  misc_feature (36): n=g or t
gactgactctagcatggtaccttaagatgccatctngggagctacttgtattgtgacactaaggtaaggca

SEQ ID NO: 5024 - DNA, 71 bp, chicken (Gallus Gallus)
  misc_feature (36): n=a or g
catcctgacaggaaagtgttttctctgctcatctgncactgctaattctgaagcaaaatgccttttgcagc

SEQ ID NO: 5025 - DNA, 71 bp, chicken (Gallus Gallus)
  misc_feature (36): n=c or t
gcagaagaaacgagcaattcttcccattgtatcacngcgatgtaggaaagcactcaagtccggagcacgct

SEQ ID NO: 5026 - DNA, 71 bp, chicken (Gallus Gallus)
  misc_feature (36): n=a or g
agagaataacaggaaaacagaccaaagcctggaatncaacctgctggcacctggggggagaaccacgcagg

SEQ ID NO: 5027 - DNA, 71 bp, chicken (Gallus Gallus)
  misc_feature (36): n=a or g
ccttacagtcaggatatagcgggctatccacttacnagacagcataatagcaaaacggtgattgatctgcc

SEQ ID NO: 5028 - DNA, 71 bp, chicken (Gallus Gallus)
  misc_feature (36): n=a or g
ttgtcacagatgagtttgtgaataaatagcaatcantgctcagaagtaacattggatcttttggtattact

SEQ ID NO: 5029 - DNA, 71 bp, chicken (Gallus Gallus)
  misc_feature (36): n=a or g
aaatcactactgtaagaaggagctattgataatctntaataataaaaagcaactttaaacactgcttttta

SEQ ID NO: 5030 - DNA, 71 bp, chicken (Gallus Gallus)
  misc_feature (36): n=g or t
aaaagttttctacttggttctgatcagtatccaggntgaactgaattggttgagattggtccaaagccttt

SEQ ID NO: 5031 - DNA, 71 bp, chicken (Gallus Gallus)
  misc_feature (36): n=a or g
actcagtagagctgtgagcatctgacatatttaacnttaagtaaatctgtttgttatccagatgaagttgg

SEQ ID NO: 5032 - DNA, 71 bp, chicken (Gallus Gallus)
  misc_feature (36): n=a or g
aacctgctctcactggtcactgcagtcacttcagtnggatttctcaggagcaaatgaaaaaagcagtttga

SEQ ID NO: 5033 - DNA, 71 bp, chicken (Gallus Gallus)
  misc_feature (36): n=a or g
attcaatttgcgatgatgtcaagaagaaagtgttanacttgaagtactattcctgaatataaatagaacaa

SEQ ID NO: 5034 - DNA, 71 bp, chicken (Gallus Gallus)
  misc_feature (36): n=c or t
aagaaatggttaatgatctggatgtgccaacaggtntcatttaaggaagcagatgtaaacccaaggtttaa

SEQ ID NO: 5035 - DNA, 71 bp, chicken (Gallus Gallus)
  misc_feature (36): n=c or t
taaagctgagttgaacttaattgtcctcatccccangttagccagaaaaatacacagcctggaaagcaagt

SEQ ID NO: 5036 - DNA, 71 bp, chicken (Gallus Gallus)
  misc_feature (36): n=a or c
tctctttgcagagaacaaagacctgtatgctcaganttctgtccctttctcttcctcctgatgaagatttt

SEQ ID NO: 5037 - DNA, 71 bp, chicken (Gallus Gallus)
  misc_feature (36): n=c or t
aggggaaggcacattgtaatgtatttacttccattntctgcttctatgaaacttgcaacaagctcctcagc

SEQ ID NO: 5038 - DNA, 71 bp, chicken (Gallus Gallus)
  misc_feature (36): n=c or t
ttttcttttctgaatgaaataagggttcaaaatggnaaaaaaaaaaaaaaaaaaaagtgctcatacaactt

SEQ ID NO: 5039 - DNA, 71 bp, chicken (Gallus Gallus)
  misc_feature (36): n=c or t
attgtatgtccatctccaacaaagatgatacttcgnagattttaaaaacaggcaccacaatactttgatga

SEQ ID NO: 5040 - DNA, 71 bp, chicken (Gallus Gallus)
  misc_feature (36): n=c or t
tattgtaccttctgctgaaagtcaggttctgcaaangaatctcagctcttatggctagcttttctgcacag

SEQ ID NO: 5041 - DNA, 71 bp, chicken (Gallus Gallus)
  misc_feature (36): n=a or g
atcaagaaagagtcagctctagagcactcgtactcnttacctactatctaactgcagagactaagtttcca

SEQ ID NO: 5042 - DNA, 71 bp, chicken (Gallus Gallus)
  misc_feature (36): n=c or t
gtttatgcatattcttcctgtccctgcagatgttcncagcttctctttatagatcccaaacactgaccctt

SEQ ID NO: 5043 - DNA, 71 bp, chicken (Gallus Gallus)
  misc_feature (36): n=a or g
ctggtgcaaacacctttacatttcttcaaagtcacngtaaccattttgtcttttactggtctccagctgtc

SEQ ID NO: 5044 - DNA, 71 bp, chicken (Gallus Gallus)
  misc_feature (36): n=c or t
gcacagccagctcatacctaaaccactcccatgcanagtgcccgaatttccccaagatgctcaactcgcag

SEQ ID NO: 5045 - DNA, 71 bp, chicken (Gallus Gallus)
  misc_feature (36): n=a or c
gctagcgcttatttcacaaataaacccaatcatttntttacagagaatgatctggttggtcaggcttgatt

SEQ ID NO: 5046 - DNA, 71 bp, chicken (Gallus Gallus)
  misc_feature (36): n=a or g
ttttcagaagagataggcaaggcaggaaaagcgacngtgtggcgccctatgctaagacattttgtctgcta

SEQ ID NO: 5047 - DNA, 71 bp, chicken (Gallus Gallus)
  misc_feature (36): n=c or t
tggcgcagcagaaccaggcctgcaatgatgtcagangggacgatgtcaaggtctcggaagaactcagcgaa

SEQ ID NO: 5048 - DNA, 71 bp, chicken (Gallus Gallus)
  misc_feature (36): n=a or g
gccgctcatgggttcagtgcccctgtgaagctgagncttctccttagcaccacgacacatgcaaagcagca

SEQ ID NO: 5049 - DNA, 71 bp, chicken (Gallus Gallus)
  misc_feature (36): n=c or t
tagttttggtaggaaagtttattatatgtgatcagntgcaaggacgttcatgagaagaatgacaataaagc

SEQ ID NO: 5050 - DNA, 71 bp, chicken (Gallus Gallus)
  misc_feature (36): n=a or g
tgaggaagccagttctccccttttgtttgtcatagngagtacattctccacttctgcccaatatatccaaa

SEQ ID NO: 5051 - DNA, 71 bp, chicken (Gallus Gallus)
  misc_feature (36): n=c or t
cgtgagccctggggcagaaggcatacaaattagagngggttcaagccttacaagtgtttttcacgtaatca

SEQ ID NO: 5052 - DNA, 71 bp, chicken (Gallus Gallus)
  misc_feature (36): n=c or t
ggaggaaacatgaggctgtgtgaggcgtaggtctcngtcagtggaagaagacaagtctcagtttggggact

SEQ ID NO: 5053 - DNA, 71 bp, chicken (Gallus Gallus)
  misc_feature (36): n=a or g
ttgcgttgtggtctttcggagctattgattaaagcnaccaacaatctatattcgattcagagcaaaatgcc

SEQ ID NO: 5054 - DNA, 71 bp, chicken (Gallus Gallus)
  misc_feature (36): n=a or g
atgccgtttataataagaaaaagctcagtagtttgntcacaagaagttgtatttagtgaagtcaacaggtg

SEQ ID NO: 5055 - DNA, 71 bp, chicken (Gallus Gallus)
  misc_feature (36): n=c or g
ccatatctgaaatttgatgggtatattactttctanaatcaacattgtgttatcaaaatgtagattcttac

SEQ ID NO: 5056 - DNA, 71 bp, chicken (Gallus Gallus)
  misc_feature (36): n=c or g
ctagatcaagcttattcccattgatgatggaatttntgttattcactctgaaggaactggcagttctgcaa

SEQ ID NO: 5057 - DNA, 71 bp, chicken (Gallus Gallus)
  misc_feature (36): n=a or g
cacactaccatagtcacccttaaatagtaacacacncagcaggttatttttcttagcagacatttcttttg

SEQ ID NO: 5058 - DNA, 71 bp, chicken (Gallus Gallus)
  misc_feature (36): n=a or g
acaacttgtaaagaggaaaagctaatcttaaaaacntttatatggttgaacagtattcttgattttgtata

SEQ ID NO: 5059 - DNA, 71 bp, chicken (Gallus Gallus)
  misc_feature (36): n=c or t
gagaggtttcagctaaaggtcataggagagccactntatattttttcttcaaacaaaatcaattgaaggac

SEQ ID NO: 5060 - DNA, 71 bp, chicken (Gallus Gallus)
  misc_feature (36): n=a or g
cacagagggcaacataaaagaggtgatgattggggnaaaaaaaaagaaaaagaaaaaaaaagacgtcatac

SEQ ID NO: 5061 - DNA, 71 bp, chicken (Gallus Gallus)
  misc_feature (36): n=c or t
tattggcattggagaaatgaaaattccagtttcttnatcagcatacaaaatgcagaaccatctttcctacc

SEQ ID NO: 5062 - DNA, 71 bp, chicken (Gallus Gallus)
  misc_feature (36): n=c or t
ctgtttaaaatatgtattaatttctctgtctctctntatttcacttgtatttcatgatttaaccctatatt

SEQ ID NO: 5063 - DNA, 71 bp, chicken (Gallus Gallus)
  misc_feature (36): n=c or t
gaaagataatgaaacatattaagtgcactgacattntatccgtgtcataccaccccacagaatgtaacttc

SEQ ID NO: 5064 - DNA, 71 bp, chicken (Gallus Gallus)
  misc_feature (36): n=c or t
aattatatgtatgtataactatatttatataattanacatataactattattcatatgaatgtatttatca

SEQ ID NO: 5065 - DNA, 71 bp, chicken (Gallus Gallus)
  misc_feature (36): n=c or t
gtgcatcacaaaaataactcctggatcaacagttantcctgagccacagattacagctcctttcattccat

SEQ ID NO: 5066 - DNA, 71 bp, chicken (Gallus Gallus)
  misc_feature (36): n=a or g
caactgcgatagcactttcagtggttaactgaagcngaccccaagcactgttactgttttagcgcagtaga

SEQ ID NO: 5067 - DNA, 71 bp, chicken (Gallus Gallus)
  misc_feature (36): n=a or g
gcctatgtaaattgctgaagactaacataatttacncttattttccctgagtgatgtttcagagcagtgct

SEQ ID NO: 5068 - DNA, 71 bp, chicken (Gallus Gallus)
  misc_feature (36): n=g or t
gtagttttcccactgccttgttgaagaggaataggnttgcaaatcacagctcttaaagaacagtggctaga

SEQ ID NO: 5069 - DNA, 71 bp, chicken (Gallus Gallus)
  misc_feature (36): n=c or t
tagagggagcaaaaaatattactgtctagcatttgntttcctctcctctcatgttggataagttgtttatt

SEQ ID NO: 5070 - DNA, 71 bp, chicken (Gallus Gallus)
  misc_feature (36): n=c or g
ctgacagctgggacagagcatgccaagcccaaccanaactgcctcataggaacagatgaattgaagccatc

SEQ ID NO: 5071 - DNA, 71 bp, chicken (Gallus Gallus)
  misc_feature (36): n=g or t
cacatgttcctgcaagtgaagaatctgaacaagctnctttctagaaatgcaaattcatcctctgggatggt

SEQ ID NO: 5072 - DNA, 71 bp, chicken (Gallus Gallus)
  misc_feature (36): n=a or t
ttttggagtagtgttttagaaataatgcttataagnaaatgtctcatcttatgtgccatgtggatagttat

SEQ ID NO: 5073 - DNA, 71 bp, chicken (Gallus Gallus)
  misc_feature (36): n=c or t
tctgaatgggtgatcatctgtggtatatttgtgaanatatttgtgaatacagtgtctttgcttgtccagag

SEQ ID NO: 5074 - DNA, 71 bp, chicken (Gallus Gallus)
  misc_feature (36): n=c or g
tcatgtttcagtaggggcgtcaggatcggtttcatnttgcataatttcaaaatattttgttctctaccaaa

SEQ ID NO: 5075 - DNA, 71 bp, chicken (Gallus Gallus)
  misc_feature (36): n=a or g
aaagagggcataagtttgctttggccagttgcatantgtttgtgctaggagaggtatgcagcaagatgttc

SEQ ID NO: 5076 - DNA, 71 bp, chicken (Gallus Gallus)
  misc_feature (36): n=a or g
aggtggattattgtcaatgtgagctcacaccaaatncactggaaaggctttacattactactgatttgatt

SEQ ID NO: 5077 - DNA, 71 bp, chicken (Gallus Gallus)
  misc_feature (36): n=g or t
tgaaggttagaatgattggtacaagtagttgagganaaataggaagtagtttggttttgcagtgcagttta

SEQ ID NO: 5078 - DNA, 71 bp, chicken (Gallus Gallus)
  misc_feature (36): n=g or t
cccatgtggatcacaattctggggtgctttccagtnagggtgaccctcacctgggtctaacctgtggatgt

SEQ ID NO: 5079 - DNA, 71 bp, chicken (Gallus Gallus)
  misc_feature (36): n=a or g
tacaaaatattaaaagtatactttgtttcatattcnctgaatgcagaaagaaacggaaaatgaaggatggc

SEQ ID NO: 5080 - DNA, 71 bp, chicken (Gallus Gallus)
  misc_feature (36): n=c or t
ttcatctgatgaacctgaaagttatgaagactctgngtttagtttttgtgcacattagtgagagatcattt

SEQ ID NO: 5081 - DNA, 71 bp, chicken (Gallus Gallus)
  misc_feature (36): n=g or t
tcactaaattgaattatgacagctaaaaataaacanctttcatgcaaacggttgctgtagttgctgaactg

SEQ ID NO: 5082 - DNA, 71 bp, chicken (Gallus Gallus)
  misc_feature (36): n=a or g
cactccactttcacatcatctcctttgtctttcacntagaggtgaagctgcggataggaaaacagttattg

SEQ ID NO: 5083 - DNA, 71 bp, chicken (Gallus Gallus)
  misc_feature (36): n=c or g
ggtgttctttttttaagggtttttatacatgtaagntaatttctgaatcttagcatgtttttggttggaag

SEQ ID NO: 5084 - DNA, 71 bp, chicken (Gallus Gallus)
  misc_feature (36): n=a or g
tcagaaacaagcacgtggaaactttcgtccctttcnctgctactatctggtgcacaccaggttccctgcaa

SEQ ID NO: 5085 - DNA, 71 bp, chicken (Gallus Gallus)
  misc_feature (36): n=g or t
aagtttctctcaagttgatttttcccaggtgtcagnaggcaaaacctatgatttctccccattcacatttt

SEQ ID NO: 5086 - DNA, 71 bp, chicken (Gallus Gallus)
  misc_feature (36): n=a or g
cgaggctacggagaggagtaaatgatgtgcattatngttgtgtggagagacagcagaggagcaggctctca

SEQ ID NO: 5087 - DNA, 71 bp, chicken (Gallus Gallus)
  misc_feature (36): n=a or g
aacaaaattgtaatttaattacagcagaacaaattnacatgttagaaagccattcttatggcagaaacaca

SEQ ID NO: 5088 - DNA, 71 bp, chicken (Gallus Gallus)
  misc_feature (36): n=g or t
aggacagcactctgttcaccacctctctcaggtccnggccatcagctggtttgttatccagcaaagagcgt

SEQ ID NO: 5089 - DNA, 71 bp, chicken (Gallus Gallus)
  misc_feature (36): n=c or t
tcttttccagttggtatccagattactctttgtaanggttatctcaattgttcttaatagaaaaacaaaca

SEQ ID NO: 5090 - DNA, 71 bp, chicken (Gallus Gallus)
  misc_feature (36): n=c or t
taatcaaaatcttcaaagctaaccatgccagtatgnaaaattcagttacatgtggctataacccaaattaa

SEQ ID NO: 5091 - DNA, 71 bp, chicken (Gallus Gallus)
  misc_feature (36): n=a or g
ttcaatccaaacttcaaagcagctcaaagacaggcntgatgacctgccccccactgcatccctcccagcag

SEQ ID NO: 5092 - DNA, 71 bp, chicken (Gallus Gallus)
  misc_feature (36): n=a or g
gggtgaacacacgtgaatcaagacttggacctgcantgtgttactttaggcagcatctttaatgttttagt

SEQ ID NO: 5093 - DNA, 71 bp, chicken (Gallus Gallus)
  misc_feature (36): n=c or t
tacgcagacagactacatcttgcacctcttaactcnttgatcatgtctgtgaattattactgacattttca

SEQ ID NO: 5094 - DNA, 71 bp, chicken (Gallus Gallus)
  misc_feature (36): n=a or g
cctcagtctttcagcccggtttagctgctcaaagcncaggttatgaggggcagcagtactcacacatgatc

SEQ ID NO: 5095 - DNA, 71 bp, chicken (Gallus Gallus)
  misc_feature (36): n=a or g
cgttcggtggtggaaatggtatagctacaacggcantccgtggtgatgaataattgaagccatcgtcagga

SEQ ID NO: 5096 - DNA, 71 bp, chicken (Gallus Gallus)
  misc_feature (36): n=a or g
agttccttggaactcagctttgccattatgggagantttcctgtgtgtaggaccattgtttaagggtctca

SEQ ID NO: 5097 - DNA, 71 bp, chicken (Gallus Gallus)
  misc_feature (36): n=c or t
tcagaaaaaaaatatatttatctagcctagagaganagtgctgttgaagggtggagattaacacctcttga

SEQ ID NO: 5098 - DNA, 71 bp, chicken (Gallus Gallus)
  misc_feature (36): n=c or t
tggatgctctgtgatgggggaaatcatcaccgtgcnatgttgaaatgctttgtgcttgaagaaaagaggta

SEQ ID NO: 5099 - DNA, 71 bp, chicken (Gallus Gallus)
  misc_feature (36): n=a or g
ggtaatcctttctttgctcctcagaactttgcacanccagcaaacacaatgacaaacagcagctcagctag

SEQ ID NO: 5100 - DNA, 71 bp, chicken (Gallus Gallus)
  misc_feature (36): n=c or t
gccaaaaatccatagaggtaacaaaaagcaatcacngaggttatagcttagcactgtctccaagatggttt

SEQ ID NO: 5101 - DNA, 71 bp, chicken (Gallus Gallus)
  misc_feature (36): n=a or g
cagcagagctgcagaaatgactccagtagttctttnaaatggcacgttctttcttagtctcgattatgtat

SEQ ID NO: 5102 - DNA, 71 bp, chicken (Gallus Gallus)
  misc_feature (36): n=a or g
aaagctgtttggagagaggtttgtcaggcctcagcntacctcctaatttactctgtatttccttctggaca

SEQ ID NO: 5103 - DNA, 71 bp, chicken (Gallus Gallus)
  misc_feature (36): n=g or t
tcgttgtgataagaaccatccagtacaacatgacanggacacgggtaagagttactttgagtgcttctgta

SEQ ID NO: 5104 - DNA, 71 bp, chicken (Gallus Gallus)
  misc_feature (36): n=a or c
attgtagaattaggggactgagttttgtaaacgctnacattttcctgaagtagacgagcagtcgtttgttc

SEQ ID NO: 5105 - DNA, 71 bp, chicken (Gallus Gallus)
  misc_feature (36): n=a or g
atcaagaaatcaccaattgctttgagatggggtcanacagctttcagcaatggtcccttgcaggcacttct

SEQ ID NO: 5106 - DNA, 71 bp, chicken (Gallus Gallus)
  misc_feature (36): n=a or g
gcaatcttctactttgattaaagaaactgaaatacngtatatactcaagaaagcagtgttgctttctggac

SEQ ID NO: 5107 - DNA, 71 bp, chicken (Gallus Gallus)
  misc_feature (36): n=a or c
tcactattagcaagctcatataactaaagaaacttntgctgtgatacaacaaatggtgttatgcaatttcc

SEQ ID NO: 5108 - DNA, 71 bp, chicken (Gallus Gallus)
  misc_feature (36): n=a or g
tggagttccacataaacaaaccacgcgtatcaaatncatgcatgatcatacagttcaagctgaaagcaatt

SEQ ID NO: 5109 - DNA, 71 bp, chicken (Gallus Gallus)
  misc_feature (36): n=a or g
acaaagcttggataaaatgtagtgatgacagaacanttttattttctgacttgagaatggtaagatggaaa

SEQ ID NO: 5110 - DNA, 71 bp, chicken (Gallus Gallus)
  misc_feature (36): n=a or g
ctaatttctcctgctatacaagacgacgtgcctacntatgaccttttatagctcagctgttaggtacagtc

SEQ ID NO: 5111 - DNA, 71 bp, chicken (Gallus Gallus)
  misc_feature (36): n=a or g
acatcttccacagaagcttttaaactgaaaacaacncacatattttgagacttctcatatcagatcaactg

SEQ ID NO: 5112 - DNA, 71 bp, chicken (Gallus Gallus)
  misc_feature (36): n=c or t
caacaccttttcccctgcctgtcttccctaaagagnttatacctgtccattcctatattccagtcatgaga

SEQ ID NO: 5113 - DNA, 71 bp, chicken (Gallus Gallus)
  misc_feature (36): n=a or g
catggcttcctttcacctgtatgagcatgcactccntgtccagatgtgttcccaaggttgcagaaacaaga

SEQ ID NO: 5114 - DNA, 71 bp, chicken (Gallus Gallus)
  misc_feature (36): n=c or t
tagactctacccataaataccatttatatacaaatnttttatataaaaagcttttcataacatggtcaagt

SEQ ID NO: 5115 - DNA, 71 bp, chicken (Gallus Gallus)
  misc_feature (36): n=c or t
cgactttatgtatgtttgattgttgggcacatatangtgcctatgtacctcgttacaaactacttgaattt

SEQ ID NO: 5116 - DNA, 71 bp, chicken (Gallus Gallus)
  misc_feature (36): n=c or t
ttaacagacaccaaaatgcacctggtgtaactgagnacttagttttgccagcttcggtgtgatctgaaaaa

SEQ ID NO: 5117 - DNA, 71 bp, chicken (Gallus Gallus)
  misc_feature (36): n=a or g
aactgttgaccacatcgtaaatccagcgacacagcnacaactgggtttagctggctcatgcaggaaacgta

SEQ ID NO: 5118 - DNA, 71 bp, chicken (Gallus Gallus)
  misc_feature (36): n=a or g
acagatctttttgatcactgtagagtagtaattcantacaacaggatctgatccaaataatttcggtggat

SEQ ID NO: 5119 - DNA, 71 bp, chicken (Gallus Gallus)
  misc_feature (36): n=a or g
ggagcttaagggttaatggagtttcattagagcccnagctataatgatttgctgctggcatatctggcctg

SEQ ID NO: 5120 - DNA, 71 bp, chicken (Gallus Gallus)
  misc_feature (36): n=c or t
attccagaacgtagttgcactggcttctgtaagcangcagttaccttgaactttcgaagcaactgttctat

SEQ ID NO: 5121 - DNA, 71 bp, chicken (Gallus Gallus)
  misc_feature (36): n=a or g
tgttgaccttaacttgattttcctgggcttcttgcncctgagcaacaacgggagatagaccttgccttcag

SEQ ID NO: 5122 - DNA, 71 bp, chicken (Gallus Gallus)
  misc_feature (36): n=c or t
tgcctgttatcacatcagctgtaataggtgaccagntcagaggaaattccatctgtatttagtttactgaa

SEQ ID NO: 5123 - DNA, 71 bp, chicken (Gallus Gallus)
  misc_feature (36): n=a or c
accgtcttaacaatgtccagcaatgccaactgccanaggtcagagatggtaaaaaagaagggagaaagaaa

SEQ ID NO: 5124 - DNA, 71 bp, chicken (Gallus Gallus)
  misc_feature (36): n=a or g
cactgatagttagtgcaaatgtaaaaattgcaagcntatgcacaccttaaagcttgtctaagttgtttact

SEQ ID NO: 5125 - DNA, 71 bp, chicken (Gallus Gallus)
  misc_feature (36): n=a or g
tttctgctgcccaggtagtagacatgttcaacagcngtctcaacatcaggagagatcggctcatctcacca

SEQ ID NO: 5126 - DNA, 71 bp, chicken (Gallus Gallus)
  misc_feature (36): n=a or g
attgcttctccaaaattatgcaagatgagtagcaanttgaactataaatatgaaagtgccaactctgaagc

SEQ ID NO: 5127 - DNA, 71 bp, chicken (Gallus Gallus)
  misc_feature (36): n=a or g
ttcccactggcagctccactgggagaggtagacccntccattttcacatatgaaatgtgacctctgcgaag

SEQ ID NO: 5128 - DNA, 71 bp, chicken (Gallus Gallus)
  misc_feature (36): n=a or g
aaattccttactgtcactgtctatctgacagaaatntatgaaagggaggtcaatcagctgttctgtaaaat

SEQ ID NO: 5129 - DNA, 71 bp, chicken (Gallus Gallus)
  misc_feature (36): n=c or t
gtaatccattatttgcagaaccacataaaacagttnaaattcacttttagaagttttagatgactctagat

SEQ ID NO: 5130 - DNA, 71 bp, chicken (Gallus Gallus)
  misc_feature (36): n=a or c
tagaatcagaaacaagacaaaccaaatcaacaacancagaaacacctagaactgtgcaaatgacttgttta

SEQ ID NO: 5131 - DNA, 71 bp, chicken (Gallus Gallus)
  misc_feature (36): n=c or g
cttctgtcactggtctgtaaagtcactttccatccncagtctatatatgtgtggaagcagggtgaaggacg

SEQ ID NO: 5132 - DNA, 71 bp, chicken (Gallus Gallus)
  misc_feature (36): n=a or g
taaggctctagtccagttagtctagtatcctctccntggtagttgttgtggcgctcagacgttcattttta

SEQ ID NO: 5133 - DNA, 71 bp, chicken (Gallus Gallus)
  misc_feature (36): n=c or t
cattgactttttgtccttttatgctgccagagtggntgctcagcggaacaccacatggaagctgaagtagg

SEQ ID NO: 5134 - DNA, 71 bp, chicken (Gallus Gallus)
  misc_feature (36): n=a or g
ctctgttagatataaccgtattgagctccacttgantttaatgtactagtaaagatgaaagtcaacaaatc

SEQ ID NO: 5135 - DNA, 71 bp, chicken (Gallus Gallus)
  misc_feature (36): n=c or t
gtgtgactgctctcccaacatgctttatcaacctgngataacaagcagctattacaagaaaggggatgaaa

SEQ ID NO: 5136 - DNA, 71 bp, chicken (Gallus Gallus)
  misc_feature (36): n=c or t
agtatccgaagcactccaaaccccagcactcagtanccaaagaatccccagcaccagcatgcatatggggc

SEQ ID NO: 5137 - DNA, 71 bp, chicken (Gallus Gallus)
  misc_feature (36): n=c or t
atcaaaaattaagaaagttgaatgtaatctaggttntatgcatacggccttaacctgaaaacatggatgta

SEQ ID NO: 5138 - DNA, 71 bp, chicken (Gallus Gallus)
  misc_feature (36): n=a or g
tctttttcaaccttaatgattctgtgactccatgantctatgactgcttacacaggtatcatcagatggca

SEQ ID NO: 5139 - DNA, 71 bp, chicken (Gallus Gallus)
  misc_feature (36): n=a or g
gtctgaaagctaaaaggagtccttagttattgaatngtgtgctgtttttcataaagagaaggaagagccag

SEQ ID NO: 5140 - DNA, 71 bp, chicken (Gallus Gallus)
  misc_feature (36): n=c or t
tcagattgtggttactagactgtcacaaaggtgaangtagcttgctttattctttcccctcagggattgcg

SEQ ID NO: 5141 - DNA, 71 bp, chicken (Gallus Gallus)
  misc_feature (36): n=c or t
tcagatgaatcccaggtgctctctctgtaagccatntttgaatgtagtttgctggaaatgtttgttctccc

SEQ ID NO: 5142 - DNA, 71 bp, chicken (Gallus Gallus)
  misc_feature (36): n=a or g
cagagatgaaggaactgcctgtcacggggatttcancgtgcatctcccacatctcaggtgaaagtgaataa

SEQ ID NO: 5143 - DNA, 71 bp, chicken (Gallus Gallus)
  misc_feature (36): n=a or g
gaaaaacattttaatgaacactgtgcccatgctctnagcgatcacatagccatcctctgagctattggaag

SEQ ID NO: 5144 - DNA, 71 bp, chicken (Gallus Gallus)
  misc_feature (36): n=a or g
tggacagatgtgtaggtgaaatgctcaccaaaacantgcatcttacagcaggagatgggctatagctgggt

SEQ ID NO: 5145 - DNA, 71 bp, chicken (Gallus Gallus)
  misc_feature (36): n=c or t
tgactttttaagcacgcctaaaaaagcaacagcagngtactggtacagccaaggctctatgcccttacttg

SEQ ID NO: 5146 - DNA, 71 bp, chicken (Gallus Gallus)
  misc_feature (36): n=a or g
actgaccgttaagaagtggaacctcatgcagcaggnaaactgaaatgcaatttcccataagctgaaaagtc

SEQ ID NO: 5147 - DNA, 71 bp, chicken (Gallus Gallus)
  misc_feature (36): n=a or g
tatcccccagaagatgctgtgtagctgaattaaatntaagcaatggctctgtgcctgggtgctgtggtatt

SEQ ID NO: 5148 - DNA, 71 bp, chicken (Gallus Gallus)
  misc_feature (36): n=a or g
agtatctaactgtggcagcacccagcagcatagctncaagtaacaagaactacctggcacaatcttactgt

SEQ ID NO: 5149 - DNA, 71 bp, chicken (Gallus Gallus)
  misc_feature (36): n=a or c
cagctgtaaatcttgggcccttgtaacttcctctanttctagtcttgttggcagaattttcataaatccat

SEQ ID NO: 5150 - DNA, 71 bp, chicken (Gallus Gallus)
  misc_feature (36): n=c or t
ggttagtagtgcaactagaagtttttcaggtagggnttttggcacaaaaacgatgagctgctgaattaagt

SEQ ID NO: 5151 - DNA, 71 bp, chicken (Gallus Gallus)
  misc_feature (36): n=c or t
tttccatccagtatttctttttcttaacatatgtantttacatcaataatggttgtcattagtcagcacaa

SEQ ID NO: 5152 - DNA, 71 bp, chicken (Gallus Gallus)
  misc_feature (36): n=a or g
tctggtttagatctctggaagttgtagagatcagancaaactagtactcaagcagtgatatcttgttcttt

SEQ ID NO: 5153 - DNA, 71 bp, chicken (Gallus Gallus)
  misc_feature (36): n=c or t
cattaccagagtgtgtcaaaactcttttgtgcccangggcagcacagcagctttacccagtgctgctctga

SEQ ID NO: 5154 - DNA, 71 bp, chicken (Gallus Gallus)
  misc_feature (36): n=c or t
catcactatcttccttaccagcctcaaggctttcantaggctggcactgaacactcatggtgcagaatata

SEQ ID NO: 5155 - DNA, 71 bp, chicken (Gallus Gallus)
  misc_feature (36): n=c or t
ctttctgtaaatattatttgacatttcttcacctgngttgaagtaggagtgacagcttgatcgatagatgg

SEQ ID NO: 5156 - DNA, 71 bp, chicken (Gallus Gallus)
  misc_feature (36): n=a or g
gtgggagatttcactgttacaaagttatactaaacnggattgttccattactgtcaaactatgtggatgta

SEQ ID NO: 5157 - DNA, 71 bp, chicken (Gallus Gallus)
  misc_feature (36): n=a or t
actcagtgctattgagttcacaaaaaccagcaggangaactgttcctaattctggaattatgtttttaatt

SEQ ID NO: 5158 - DNA, 71 bp, chicken (Gallus Gallus)
  misc_feature (36): n=a or g
ctcttttattagaatgacggtcctcatgtacgtcancaagagatttacatggcagaccagcatggggctga

SEQ ID NO: 5159 - DNA, 71 bp, chicken (Gallus Gallus)
  misc_feature (36): n=c or t
aggaaaacctcaaagttataccatcctcaatctctncaaagcatagtggggaaaggagatagcgatagtaa

SEQ ID NO: 5160 - DNA, 71 bp, chicken (Gallus Gallus)
  misc_feature (36): n=a or g
gggattgtgatcagtttgtattagtcacagaagagnaggttatttctttctttaagagtttgcagtcttac

SEQ ID NO: 5161 - DNA, 71 bp, chicken (Gallus Gallus)
  misc_feature (36): n=a or g
tgcccgtgcctctctgaaacaaggttcttgcactcnaatgcccacagcaggacaagctgctgcccaagtag

SEQ ID NO: 5162 - DNA, 71 bp, chicken (Gallus Gallus)
  misc_feature (36): n=a or g
agcacttcccagctaaagttgccctatttttaatantctgggggttcccttgtctcatcaagacctttatc

SEQ ID NO: 5163 - DNA, 71 bp, chicken (Gallus Gallus)
  misc_feature (36): n=c or t
aataaatcaaatattctggatcttttgtccagctangaaaaataaatgtttctactagcacttcagatttg

SEQ ID NO: 5164 - DNA, 71 bp, chicken (Gallus Gallus)
  misc_feature (36): n=c or t
accaagggctttacgaccttattgaaagcttttacntatcatgaaacccacaccatacaatggcacctacc

SEQ ID NO: 5165 - DNA, 71 bp, chicken (Gallus Gallus)
  misc_feature (36): n=a or g
acttgtccaaccaaatctgtggtcaggaagctaatncagatttgtgtgctgtctttgccatcttttctttg

SEQ ID NO: 5166 - DNA, 71 bp, chicken (Gallus Gallus)
  misc_feature (36): n=g or t
gagtcacggatttacacagcttgctctgagatttcntgcataaaacagagccaaaccggtgccattctccc

SEQ ID NO: 5167 - DNA, 71 bp, chicken (Gallus Gallus)
  misc_feature (36): n=c or t
ttactggtgtttcccacaagctcacccctacctagntacctgtcaagctgtgctaaatggccatatgagag

SEQ ID NO: 5168 - DNA, 71 bp, chicken (Gallus Gallus)
  misc_feature (36): n=c or t
agctatagaggagactaagtactgtctagattgctnttcatcttagaaataagaggttttccgttcatgaa

SEQ ID NO: 5169 - DNA, 71 bp, chicken (Gallus Gallus)
  misc_feature (36): n=a or c
taggagaggctgtcttctcacacactcgggtgcagnaagctgtgtgaagcaccactgtggaacattcgttt

SEQ ID NO: 5170 - DNA, 71 bp, chicken (Gallus Gallus)
  misc_feature (36): n=c or t
atattgaatggcaataagcttaccttgcaaacgagnattttgagactggatgaaaatctgacctctagcca

SEQ ID NO: 5171 - DNA, 71 bp, chicken (Gallus Gallus)
  misc_feature (36): n=a or g
ccccaaatttttccacaggggaaatgatcaatagtnctctccattcctacagcaagcactgaacattgccc

SEQ ID NO: 5172 - DNA, 71 bp, chicken (Gallus Gallus)
  misc_feature (36): n=a or c
gtgggaatctgctggaaaacaccagcaaggtggacnacagcttctctcctatttgatacacaatcccagtc

SEQ ID NO: 5173 - DNA, 71 bp, chicken (Gallus Gallus)
  misc_feature (36): n=c or t
tggtttgagcttatggtttccgaggcagattaacantgctctgaatcatagtgccacatgatcacgttgtt

SEQ ID NO: 5174 - DNA, 71 bp, chicken (Gallus Gallus)
  misc_feature (36): n=a or g
acatctggcatgcttccatgatcacggtggctgcanccatagcctgagcaagagcagaattaaatccctta

SEQ ID NO: 5175 - DNA, 71 bp, chicken (Gallus Gallus)
  misc_feature (36): n=c or t
gcagttctgtttcatctggtagctgtattaataaancttccactttatcttattgctaaaaagaagacttg

SEQ ID NO: 5176 - DNA, 71 bp, chicken (Gallus Gallus)
  misc_feature (36): n=a or g
aaaaataagaagagaaggagatttggaacaggtaancaggctgctgaacgtttctgtgaggtcctgatcat

SEQ ID NO: 5177 - DNA, 71 bp, chicken (Gallus Gallus)
  misc_feature (36): n=g or t
tcctgaaatttgaatcattcaattttggttttgctnctgctcatctctttacacttgggaaaactttacat

SEQ ID NO: 5178 - DNA, 71 bp, chicken (Gallus Gallus)
  misc_feature (36): n=c or t
aagaaagtagatcaaatgcagggttggaaaaggggntctcaactgatatggtgcacatcctcctgatgcaa

SEQ ID NO: 5179 - DNA, 71 bp, chicken (Gallus Gallus)
  misc_feature (36): n=c or t
tagagtgcccttgaacattattctccatttagaagngtgatggaaccctccatggatgacagtggtaccat

SEQ ID NO: 5180 - DNA, 71 bp, chicken (Gallus Gallus)
  misc_feature (36): n=a or c
ataacaaacaacactgggatacatcaggccgagaanagaatgcatagccaaagtctccattctgttcacac

SEQ ID NO: 5181 - DNA, 71 bp, chicken (Gallus Gallus)
  misc_feature (36): n=a or g
agaaaggtgatgtttatgctgtaaagacataattgnctctggagcattgttcctcttgtaaaatatcaatg

SEQ ID NO: 5182 - DNA, 71 bp, chicken (Gallus Gallus)
  misc_feature (36): n=c or t
ggatttcaggggaacccaaattgccttccaaatctnagataacaaagctacaatcgtcaaacacatgaaag

SEQ ID NO: 5183 - DNA, 71 bp, chicken (Gallus Gallus)
  misc_feature (36): n=a or g
ttccaaagctgcagacctcaataatttctagtgccnaagatgccaaaaatctcctttgcaattttccatac

SEQ ID NO: 5184 - DNA, 71 bp, chicken (Gallus Gallus)
  misc_feature (36): n=c or t
cagaacactgctttttcttaaagcaagagtgactancactgctatgtattatgtagatacttgtgagaaag

SEQ ID NO: 5185 - DNA, 71 bp, chicken (Gallus Gallus)
  misc_feature (36): n=c or t
aaatactgtcacagtatttcatgcaaaagcacatcnaagaatcacaatgtgagtaatgtatagacatagta

SEQ ID NO: 5186 - DNA, 71 bp, chicken (Gallus Gallus)
  misc_feature (36): n=g or t
cctctggagattgagctaaaagcagcttctctacantaggttgagcagaaaagccctagacttgaacaggg

SEQ ID NO: 5187 - DNA, 71 bp, chicken (Gallus Gallus)
  misc_feature (36): n=c or t
cacctgatggaatcttgaaccttgcaacctctgtangctacccagggcagcctagagtcaggtcctgcagc

SEQ ID NO: 5188 - DNA, 71 bp, chicken (Gallus Gallus)
  misc_feature (36): n=c or t
cggtgttggagggtttccctgtatgccaaaagccanagctgttgtagaactctttggggttctcacagaac

SEQ ID NO: 5189 - DNA, 71 bp, chicken (Gallus Gallus)
  misc_feature (36): n=a or g
gaacttgctgaaaaatgaactaaaacattggcaacnatgaagtcttgaactttccactctgaatctgactt

SEQ ID NO: 5190 - DNA, 71 bp, chicken (Gallus Gallus)
  misc_feature (36): n=c or t
tataagccagctgattcctccatgtagtctattcanaaatggcatctgttttcatcctgaactacacatat

SEQ ID NO: 5191 - DNA, 71 bp, chicken (Gallus Gallus)
  misc_feature (36): n=c or t
tttgatttaatctgttaagaactaatagtaattgtncattccaaatgtttttccataggaaaattaaaacc

SEQ ID NO: 5192 - DNA, 71 bp, chicken (Gallus Gallus)
  misc_feature (36): n=c or t
cagcttgcaagaggagggacctgatgagcaataganaatgagccaaactaacaaacaattaattgctacta

SEQ ID NO: 5193 - DNA, 71 bp, chicken (Gallus Gallus)
  misc_feature (36): n=a or g
aacatcttcattaatgaactggatcacaggacagantgcatatacagaactgggaggagtggcttataaac

SEQ ID NO: 5194 - DNA, 71 bp, chicken (Gallus Gallus)
  misc_feature (36): n=a or t
acccattggagctatgtgaatttccaagacaagggnaaattaatactgttctgggcaaggtgtgtctgctc

SEQ ID NO: 5195 - DNA, 71 bp, chicken (Gallus Gallus)
  misc_feature (36): n=c or t
gaatattgttgatgtagcttcggttaagatttgatnggtctcttatttctctccccatcattcacatgtac

SEQ ID NO: 5196 - DNA, 71 bp, chicken (Gallus Gallus)
  misc_feature (36): n=c or t
gggttactctttctttagcccatctgtctgcagcgnacttttcctattgcacagaaaataagtcagctgtc

SEQ ID NO: 5197 - DNA, 71 bp, chicken (Gallus Gallus)
  misc_feature (36): n=g or t
tgcaccattgacactcaatgtttgcagtgggtggtncatttcagcagtggcaacagcaggtcaactccgtt

SEQ ID NO: 5198 - DNA, 71 bp, chicken (Gallus Gallus)
  misc_feature (36): n=a or g
cagtgagattagcttgagatggaaaatagttgaatncaggaggaacatggtggaacaggaaacagagagtg

SEQ ID NO: 5199 - DNA, 71 bp, chicken (Gallus Gallus)
  misc_feature (36): n=g or t
gaatggcacagtttcaccccttgactaaaccaaacncatttaaatgaaactacatgtattacaatggagag

SEQ ID NO: 5200 - DNA, 71 bp, chicken (Gallus Gallus)
  misc_feature (36): n=c or t
tccatctgatggtcagaaaaatcccacctgtattgnagagaaggaaggtcctaattatccaggctcactgc

SEQ ID NO: 5201 - DNA, 71 bp, chicken (Gallus Gallus)
  misc_feature (36): n=a or g
taattaggaggcacaggctacgaccagcctgaaaantaggcatgctttttgacaccccaaaatgggggcat

SEQ ID NO: 5202 - DNA, 71 bp, chicken (Gallus Gallus)
  misc_feature (36): n=a or g
cacacagcctccccacgtgccccccttgggacaagnaggacatttctgctttgattcgtggagtattttaa

SEQ ID NO: 5203 - DNA, 71 bp, chicken (Gallus Gallus)
  misc_feature (36): n=g or t
gatgcggcccctgcaggtgtgagggaccagaggagngagagtagggaggtgttaaaacatattaatttatg

SEQ ID NO: 5204 - DNA, 71 bp, chicken (Gallus Gallus)
  misc_feature (36): n=a or c
tacagaatctttttccagagacaaaaacctcatgangtccataattgccaatactaaacttttaagacttg

SEQ ID NO: 5205 - DNA, 71 bp, chicken (Gallus Gallus)
  misc_feature (36): n=a or g
tggaactaatatgctctctatgaaagctaacacctntttcagagtaaacggaaattatttggaagacattg

SEQ ID NO: 5206 - DNA, 71 bp, chicken (Gallus Gallus)
  misc_feature (36): n=c or t
ctttcaggcttctctagataaggaattattttgttnactttcatcacaccagatgtcaccaaagtaatttt

SEQ ID NO: 5207 - DNA, 71 bp, chicken (Gallus Gallus)
  misc_feature (36): n=c or t
ccaccaatccatatagaagcagctatgctggctgcntctggcaaagaaatgccactaagcaaaacagtagt

SEQ ID NO: 5208 - DNA, 71 bp, chicken (Gallus Gallus)
  misc_feature (36): n=a or t
tgagcaaggaatataaaactcctgcctgaaatgttnttctcttctccgtaagggtataatgtacttagttg

SEQ ID NO: 5209 - DNA, 71 bp, chicken (Gallus Gallus)
  misc_feature (36): n=c or t
acaactgagcagagaaacacatcctctgttattgancaataaacaaagaaactctggggaaaaacctacac

SEQ ID NO: 5210 - DNA, 71 bp, chicken (Gallus Gallus)
  misc_feature (36): n=c or t
gcaatattagagctattctgtactccagcattgtgngctatagtaaatctagagatattttgttctccttg

SEQ ID NO: 5211 - DNA, 71 bp, chicken (Gallus Gallus)
  misc_feature (36): n=c or t
caaacttccgctggtacaaaagggatgacagaacanacagctctgctcaggcagcggtgcccatcagaacc

SEQ ID NO: 5212 - DNA, 71 bp, chicken (Gallus Gallus)
  misc_feature (36): n=a or g
tgaaaattaaactcagttggagcagcaaacaggtcnaaacaaaaatgtagtgaatttgcgttggatgaact

SEQ ID NO: 5213 - DNA, 71 bp, chicken (Gallus Gallus)
  misc_feature (36): n=a or g
ctggggacacggtaactgtcaggtatcacctaaatncagcttggatgaaccaggaaccataacgtttcagg

SEQ ID NO: 5214 - DNA, 71 bp, chicken (Gallus Gallus)
  misc_feature (36): n=a or g
agtacaagcactgagggaatagagactaaaacaganggatgacaaggaagggaacaccagctttttcaata

SEQ ID NO: 5215 - DNA, 71 bp, chicken (Gallus Gallus)
  misc_feature (36): n=c or g
aaaaaaaaagaaagaaaaagaaaaagactccttcgntatagtgatttgtattgaaaacaggtacaagtcag

SEQ ID NO: 5216 - DNA, 71 bp, chicken (Gallus Gallus)
  misc_feature (36): n=a or g
tcaacaatgctctggttgctttgtacctatgtatgnctcttggaagccttgagaagcagatgagctaagtt

SEQ ID NO: 5217 - DNA, 71 bp, chicken (Gallus Gallus)
  misc_feature (36): n=c or t
tgagcttattacttttattctcttgggtattacttntagtggtttgggtttttctttctgtgctgtacaca

SEQ ID NO: 5218 - DNA, 71 bp, chicken (Gallus Gallus)
  misc_feature (36): n=c or t
aaaatagcaatttttgtctgtacacatttaatttgnatctgaatacacacatgcaaaaaatgagatggaac

SEQ ID NO: 5219 - DNA, 71 bp, chicken (Gallus Gallus)
  misc_feature (36): n=c or t
tctgatgttgtaaagcatagggctgcgctctcatgncaaggagatagttgctacgttgtctatgggaaaga

SEQ ID NO: 5220 - DNA, 71 bp, chicken (Gallus Gallus)
  misc_feature (36): n=c or t
gctctgaggccaactaagctgagctgagggctgagnagtgaccatctctgtccatctctattcacagatca

SEQ ID NO: 5221 - DNA, 71 bp, chicken (Gallus Gallus)
  misc_feature (36): n=a or g
gaatccattgctataggaagatgggaaaatatttcncctcaaaagaggggaaaatttagattgaatgtaag

SEQ ID NO: 5222 - DNA, 71 bp, chicken (Gallus Gallus)
  misc_feature (36): n=a or g
tcctcagtgagatctctgctttgttgatggcacacngtaactgggaggttggtgagagtatttaccaggca

SEQ ID NO: 5223 - DNA, 71 bp, chicken (Gallus Gallus)
  misc_feature (36): n=a or g
ggttgctgtgccgctgtctttcctgagtcacacagngagtaaggaccatgggaacttcttcctaatgggca

SEQ ID NO: 5224 - DNA, 71 bp, chicken (Gallus Gallus)
  misc_feature (36): n=a or t
agtaattcaacaaacaggaacagatgacttcccatnaaagtaaaatgcagaacagagatctctgaaacaca

SEQ ID NO: 5225 - DNA, 71 bp, chicken (Gallus Gallus)
  misc_feature (36): n=a or g
actgatgacgtaaactgtatacaaactttttgaaanagctcatctttggaggtggtcagcattgtcctaaa

SEQ ID NO: 5226 - DNA, 71 bp, chicken (Gallus Gallus)
  misc_feature (36): n=c or t
gacactcaagtcttcttgttctttcagaaatttgtntaacaaccatgctatctgaagcatcacacacagca

SEQ ID NO: 5227 - DNA, 71 bp, chicken (Gallus Gallus)
  misc_feature (36): n=c or t
tgaacacataaaaagtgagtgcagtttgactaactngtaatctcagagaataatgatgcacacattatcaa

SEQ ID NO: 5228 - DNA, 71 bp, chicken (Gallus Gallus)
  misc_feature (36): n=a or g
ttaatttatttatttttgctctggagtcaaatgggnggaattttgtaaaactgtaatgaaggaaagcatcc

SEQ ID NO: 5229 - DNA, 71 bp, chicken (Gallus Gallus)
  misc_feature (36): n=a or g
agcagcactggatgttgtgtatgaccatcccgagcntatgtacacggtgatatactgtacgtatcatcatc

SEQ ID NO: 5230 - DNA, 71 bp, chicken (Gallus Gallus)
  misc_feature (36): n=c or t
gcaccctgcacctgagcctatagtacctgttacacnttgacctgacatctgatgatgtacgtaagctctgt

SEQ ID NO: 5231 - DNA, 71 bp, chicken (Gallus Gallus)
  misc_feature (36): n=a or g
gtttgggagcagagttttcccatcctctctagctanaatcgttcctctctgcatatgcaaactgtcactgt

SEQ ID NO: 5232 - DNA, 71 bp, chicken (Gallus Gallus)
  misc_feature (36): n=a or t
cttataacttttcaagatttttcctaatcctaattntcctgcctttttcctaatattgaagttagtttact

SEQ ID NO: 5233 - DNA, 71 bp, chicken (Gallus Gallus)
  misc_feature (36): n=a or g
ctgaatatttgctcagacttctcacacattctgcanatagtggaaacaaaccctattaaattgaccttgag

SEQ ID NO: 5234 - DNA, 71 bp, chicken (Gallus Gallus)
  misc_feature (36): n=c or t
tcccagtaagctaaaggatatcctccagtgccttcnagttgtctgagctatctgaccgtaaacattcccag

SEQ ID NO: 5235 - DNA, 71 bp, chicken (Gallus Gallus)
  misc_feature (36): n=a or c
taacaagatgagaccatagccataacaataggctgnaagctgaagacatggttggagaagggaaccctgtg

SEQ ID NO: 5236 - DNA, 71 bp, chicken (Gallus Gallus)
  misc_feature (36): n=a or g
caaagacaagtgcaaggttctgcacctgggatggcntaaccaaagagcccagtacaggctaggatgtgtgc

SEQ ID NO: 5237 - DNA, 71 bp, chicken (Gallus Gallus)
  misc_feature (36): n=a or g
tcctcttaccccactgtattcctctacagctctagnagaaaaccttcggccttctctcccactatagcagt

SEQ ID NO: 5238 - DNA, 71 bp, chicken (Gallus Gallus)
  misc_feature (36): n=c or t
ttcagttgcaatggaattgcagaactttgagtgcantggactgagaaaagaaaccttggatggcagctgaa

SEQ ID NO: 5239 - DNA, 71 bp, chicken (Gallus Gallus)
  misc_feature (36): n=a or g
ctctttctcctctgagccaggctggcagtttttatngtgcataagctcaaaaagtgacagcctattagaga

SEQ ID NO: 5240 - DNA, 71 bp, chicken (Gallus Gallus)
  misc_feature (36): n=a or g
gttctgtataacctaatgagggcaggtggaacaccntggaaatgagttattgttgatttgatacaattata

SEQ ID NO: 5241 - DNA, 71 bp, chicken (Gallus Gallus)
  misc_feature (36): n=g or t
tctgcatattgtctagtcaagtaaaactgcatattngatctgtttggtcagcctgtcctgtacttttttcc

SEQ ID NO: 5242 - DNA, 71 bp, chicken (Gallus Gallus)
  misc_feature (36): n=c or t
aacacaccatctgaacataacattgttaaggcttcntctaaatccaaatagcattgatgagttcctggagc

SEQ ID NO: 5243 - DNA, 71 bp, chicken (Gallus Gallus)
  misc_feature (36): n=c or t
tgatcaagagggctgtgcctaggaagactaagaatncccctccaattaatttttactgaatggatgcatga

SEQ ID NO: 5244 - DNA, 71 bp, chicken (Gallus Gallus)
  misc_feature (36): n=c or t
ggaatgcctttgtcactctctcaccaaatatcatcntagacaagctgacagaatataagtcaagttgacaa

SEQ ID NO: 5245 - DNA, 71 bp, chicken (Gallus Gallus)
  misc_feature (36): n=c or t
tctgtgtatgtctaccaggccctggattactgtcanagcatggggatcatgcacagggatgtcaaacccca

SEQ ID NO: 5246 - DNA, 71 bp, chicken (Gallus Gallus)
  misc_feature (36): n=g or t
agggtttgtttaaaaaaaaaaatgaagctccatacncataactcatttattagaagtgtttgtttggaacc

SEQ ID NO: 5247 - DNA, 71 bp, chicken (Gallus Gallus)
  misc_feature (36): n=a or g
tacttcacatcatacccatcctggtatctgcatagnctggaaccataccaaagagagcatctctttgccat

SEQ ID NO: 5248 - DNA, 71 bp, chicken (Gallus Gallus)
  misc_feature (36): n=a or g
gaagcaattagctggaaaagtcatatatggattttntttttccactagataatatcttgctttataactat

SEQ ID NO: 5249 - DNA, 71 bp, chicken (Gallus Gallus)
  misc_feature (36): n=a or g
aagtactgacccttttgaacaataaatgaatgcccngtgtttaaaacttgctcagcagcagtcagaattcc

SEQ ID NO: 5250 - DNA, 71 bp, chicken (Gallus Gallus)
  misc_feature (36): n=g or t
gccatttgaagccttctacagctcttcagcgttcanatgtgaccttatctggcttggacacagagtccttc

SEQ ID NO: 5251 - DNA, 71 bp, chicken (Gallus Gallus)
  misc_feature (36): n=c or t
agagatgaggtttggggtgcaatcactaacacaccnagctgtgaaagtggcaaatattgaagcaggcagtt

SEQ ID NO: 5252 - DNA, 71 bp, chicken (Gallus Gallus)
  misc_feature (36): n=a or g
ctgcagcaacaaataagattccagcaacaactgaanagctagaaacaccaagatcacctcctcctccatgg

SEQ ID NO: 5253 - DNA, 71 bp, chicken (Gallus Gallus)
  misc_feature (36): n=c or t
tgtaccactagagggtggtgcacgttactagattcnggctggccttcctgtaatgctggctggccatgtgg

SEQ ID NO: 5254 - DNA, 71 bp, chicken (Gallus Gallus)
  misc_feature (36): n=c or t
ataagtgtacctttttacactcaagtcagaagaaangagatccctaaaaatctcactattagcattagtgt

SEQ ID NO: 5255 - DNA, 71 bp, chicken (Gallus Gallus)
  misc_feature (36): n=a or g
agcagaggaaacaagcagaacgtttctccccccaancctcaatgcaccacatttatttacagcactgccac

SEQ ID NO: 5256 - DNA, 71 bp, chicken (Gallus Gallus)
  misc_feature (36): n=c or t
ctgtataaaccagctcataccacatcattccattanatctaacctcttactccagtttaaagtcaagatgc

SEQ ID NO: 5257 - DNA, 71 bp, chicken (Gallus Gallus)
  misc_feature (36): n=a or c
gtccacctaaggtgaaagtgtggatagcttcagtantgaaacttttggctgaggctgaaaaaaactggaca

SEQ ID NO: 5258 - DNA, 71 bp, chicken (Gallus Gallus)
  misc_feature (36): n=c or t
gctgtgttagatatgcctggaatctagtaacctggnatttgcattagagacaggttcagaatataggagtg

SEQ ID NO: 5259 - DNA, 71 bp, chicken (Gallus Gallus)
  misc_feature (36): n=c or t
gtggtgggagaaaatgaggccttgcagcagttcttngaaggtaagagcttagcttagttttaagagtctca

SEQ ID NO: 5260 - DNA, 71 bp, chicken (Gallus Gallus)
  misc_feature (36): n=c or t
tttttttttccctcagaggaacttcactacctgcanatgtaagcactgaggaagtgagcactgagctgtgc

SEQ ID NO: 5261 - DNA, 71 bp, chicken (Gallus Gallus)
  misc_feature (36): n=a or c
tcagatataaaagtattaatctgaattaggcaaaanccatccaaaatttagcacagatttacattcacttt

SEQ ID NO: 5262 - DNA, 71 bp, chicken (Gallus Gallus)
  misc_feature (36): n=a or g
ttcctctcttactaataagttgataactttaaagcnggcatatatatgttgaaagcctttcatttaattga

SEQ ID NO: 5263 - DNA, 71 bp, chicken (Gallus Gallus)
  misc_feature (36): n=a or c
ttcactaaggatagatcttaacttcaccaatggtantcatgggagaatcaggaaaattattccttcttgtt

SEQ ID NO: 5264 - DNA, 71 bp, chicken (Gallus Gallus)
  misc_feature (36): n=c or t
tagtacatgcaggggcagcaggccaccaaggacagngctggctgatgagtgacgctaacttgacctccctt

SEQ ID NO: 5265 - DNA, 71 bp, chicken (Gallus Gallus)
  misc_feature (36): n=c or t
atgctattaggcctgctgatttgtggttgagctaantgtgttgttccagtttgtaaaatctcttgagttcc

SEQ ID NO: 5266 - DNA, 71 bp, chicken (Gallus Gallus)
  misc_feature (36): n=a or g
taatacattctaatgttttcttcagaacaagaatgnagactcccaagttcctttaacggttagcagaatca

SEQ ID NO: 5267 - DNA, 71 bp, chicken (Gallus Gallus)
  misc_feature (36): n=a or g
catgtttttaaagtaacttcatgggtaattgtcatnaaaaacagtaaaaatgagcaagtccagtgcaaaac

SEQ ID NO: 5268 - DNA, 71 bp, chicken (Gallus Gallus)
  misc_feature (36): n=c or t
atttcagctgctgctacttctcatccagtaccaatnatcttccaaggaaggaaataggattgatttgacaa

SEQ ID NO: 5269 - DNA, 71 bp, chicken (Gallus Gallus)
  misc_feature (36): n=a or g
tttcctcacagattctaaggaattacagaaaaatanaggaagctgcaaagttgcaagactaagttcttaca

SEQ ID NO: 5270 - DNA, 71 bp, chicken (Gallus Gallus)
  misc_feature (36): n=a or t
aaaattaaatccccaccattcatgtttaaatctgantcagttttaaagttatgcagtaaatgactaatgat

SEQ ID NO: 5271 - DNA, 71 bp, chicken (Gallus Gallus)
  misc_feature (36): n=a or g
aggtgactgatgacgagccaagtggattgtacagcnagttcagtttaagtactccaagaggggcaaatttg

SEQ ID NO: 5272 - DNA, 71 bp, chicken (Gallus Gallus)
  misc_feature (36): n=c or t
tgcttatataaaaattctgcttatcttactcagagncttacaacctcctcctttctctctatagtttattt

SEQ ID NO: 5273 - DNA, 71 bp, chicken (Gallus Gallus)
  misc_feature (36): n=a or g
gctgatgatggagcaggatatagaggcaagcactcntgagtttctgctcggcacccactgtttttcctcaa

SEQ ID NO: 5274 - DNA, 71 bp, chicken (Gallus Gallus)
  misc_feature (36): n=c or t
ccacacagggtaatgcagctgttgatgacttagcangcttattcaaatacctgaactatttcagctgattt

SEQ ID NO: 5275 - DNA, 71 bp, chicken (Gallus Gallus)
  misc_feature (36): n=a or g
tcctgcatctaaaataatgttaccagcatgactggngaaatgatttctcctttgattatggcactagtatg

SEQ ID NO: 5276 - DNA, 71 bp, chicken (Gallus Gallus)
  misc_feature (36): n=c or t
gagcagcagcctcctggtggatctcattgtgtttcnaactggagcagaaaacacattttatgaccttttct

SEQ ID NO: 5277 - DNA, 71 bp, chicken (Gallus Gallus)
  misc_feature (36): n=a or g
catcacacagtgacatccacaagatatggctttggnaagttctcatttatagaatcagtgctaacttacat

SEQ ID NO: 5278 - DNA, 71 bp, chicken (Gallus Gallus)
  misc_feature (36): n=c or t
catctgatcttgattatatagctcaggtaccagctngcaaccaaccgagttctttgtccccaggccagatg

SEQ ID NO: 5279 - DNA, 71 bp, chicken (Gallus Gallus)
  misc_feature (36): n=c or t
actgtccgctgtgccacaggacacagggtagccaangtgtttccaaaagctgttaagagggctgccctgca

SEQ ID NO: 5280 - DNA, 71 bp, chicken (Gallus Gallus)
  misc_feature (36): n=a or g
ttggtattttttgagctgctccatttcttttctttnctgctccccgcagtgtccttaggtgatgattagtg

SEQ ID NO: 5281 - DNA, 71 bp, chicken (Gallus Gallus)
  misc_feature (36): n=a or g
gtgtatgtgaaaataaatcattgacagctgctgtantcagattggaatgggagtactgtggcctgtgatgc

SEQ ID NO: 5282 - DNA, 71 bp, chicken (Gallus Gallus)
  misc_feature (36): n=a or g
gtcccttccaacctatgacagttgtgttccaaaagnaactcctacagtcccatggtctaagacaaagtcac

SEQ ID NO: 5283 - DNA, 71 bp, chicken (Gallus Gallus)
  misc_feature (36): n=a or g
ctcgaacttctgcagagatgtggtagccctttgcanagcagtgctgctgccagctgggatggctctgcgcg

SEQ ID NO: 5284 - DNA, 71 bp, chicken (Gallus Gallus)
  misc_feature (36): n=a or g
tctctcaaagaaagtctttaacctttaggtagtacntggtaacggtcctatgcctgacaaggactgcaaat

SEQ ID NO: 5285 - DNA, 71 bp, chicken (Gallus Gallus)
  misc_feature (36): n=c or t
gtacaaaaactggcattttaagtcttgaaaatgcangtggattcattcaaattttcaaaagaaattcctgc

SEQ ID NO: 5286 - DNA, 71 bp, chicken (Gallus Gallus)
  misc_feature (36): n=c or g
ttgaaggccttgatctccatcagtataggttgttgntagagctagttacctcttgtgctccaggatgggtg

SEQ ID NO: 5287 - DNA, 71 bp, chicken (Gallus Gallus)
  misc_feature (36): n=a or c
gctctgtgggtgggtgggtgctggagccgggtgctncttgctgaccagcttgtttatctcgtgggagctga

SEQ ID NO: 5288 - DNA, 71 bp, chicken (Gallus Gallus)
  misc_feature (36): n=c or t
tggaaagaggagactgtaaaacagctgacttttgantgtgctcatcaaactcttgtttttaacttttcccc

SEQ ID NO: 5289 - DNA, 71 bp, chicken (Gallus Gallus)
  misc_feature (36): n=c or t
agctgtaactaaatcccaaaccacacttctgggaangcatcgctcacctttctcaagttgtaggctgactt

SEQ ID NO: 5290 - DNA, 71 bp, chicken (Gallus Gallus)
  misc_feature (36): n=a or g
atttgttcatttattatgcatagcacatcagactcnggaagattatatcatttgaaaattaaatttcacac

SEQ ID NO: 5291 - DNA, 71 bp, chicken (Gallus Gallus)
  misc_feature (36): n=c or t
taatgattctcctctggtcagtttgtctagcagtancctctaggagtctcctggattgcttgcagcctgct

SEQ ID NO: 5292 - DNA, 71 bp, chicken (Gallus Gallus)
  misc_feature (36): n=c or t
agagcaaaaagcaaagctcagtgcttacagggacanagatcgtcctaaggacaagaaatgagatggcttat

SEQ ID NO: 5293 - DNA, 71 bp, chicken (Gallus Gallus)
  misc_feature (36): n=c or t
ctgaagaagctgattaaggtaagcatgcagaagganggtgacactgatacttcagcatcaggaagcaagag

SEQ ID NO: 5294 - DNA, 71 bp, chicken (Gallus Gallus)
  misc_feature (36): n=a or g
tcagattgaatacatctgggatagatttatatcaantttgtttccagtagagctgtccaactgttcaacac

SEQ ID NO: 5295 - DNA, 71 bp, chicken (Gallus Gallus)
  misc_feature (36): n=c or t
agcgagaaggaagggacagaaaaaaagagggcaagngaaacgataaagagctcttctggactatttaattg

SEQ ID NO: 5296 - DNA, 71 bp, chicken (Gallus Gallus)
  misc_feature (36): n=c or t
aataaacctgcagagagattaattggaagaaagganggtgcttgtgagaaatgcgtgttttaaatcgtgtc

SEQ ID NO: 5297 - DNA, 71 bp, chicken (Gallus Gallus)
  misc_feature (36): n=c or t
gccccggccaagcaggagccatgatatccttgctangactggaagcagcaatgggcatgacttagcaccca

SEQ ID NO: 5298 - DNA, 71 bp, chicken (Gallus Gallus)
  misc_feature (36): n=c or t
tgagaagaagtggaaatggttggtgctgtacagcantgagataaatgcgtggaagaaatcaatatgtggat

SEQ ID NO: 5299 - DNA, 71 bp, chicken (Gallus Gallus)
  misc_feature (36): n=c or t
aatgcaaaatacccctgctagaatgacttttaagcngggctctaaaaaactgagctgcttatcagcctgcc

SEQ ID NO: 5300 - DNA, 71 bp, chicken (Gallus Gallus)
  misc_feature (36): n=a or g
gtattggcactgcttttctgatggctgtcacactcnggtttccagtgatgcacggcagctttactgcatgg

SEQ ID NO: 5301 - DNA, 71 bp, chicken (Gallus Gallus)
  misc_feature (36): n=a or g
accatcagggatttccagctatgtgtgtacataccngaaagagtaaacggatctgagaagtaaagccatgt

SEQ ID NO: 5302 - DNA, 71 bp, chicken (Gallus Gallus)
  misc_feature (36): n=g or t
caggtacttcattggtggctctggtctagctgacanagaccacacatctgcaactaatgagcatgaaatag

SEQ ID NO: 5303 - DNA, 71 bp, chicken (Gallus Gallus)
  misc_feature (36): n=c or t
ttcattgaggaccagtctaaactctctgggcttaantaccttcaaggtctattgctcagctgagggagtgg

SEQ ID NO: 5304 - DNA, 71 bp, chicken (Gallus Gallus)
  misc_feature (36): n=c or t
atagcataagttaaaaacaattggggagatttcctngcagtaagattactgacccctcttaataatatgta

SEQ ID NO: 5305 - DNA, 71 bp, chicken (Gallus Gallus)
  misc_feature (36): n=c or t
ttaattaacttcaagtttaagacttctaagacttanttaacaaatagaaattctgtccttacccacatatg

SEQ ID NO: 5306 - DNA, 71 bp, chicken (Gallus Gallus)
  misc_feature (36): n=g or t
atgtgactgatagaggtcacaatgatttgtgcaagnggcaatatcctacaacaaaaacatgtctactactg

SEQ ID NO: 5307 - DNA, 71 bp, chicken (Gallus Gallus)
  misc_feature (36): n=c or t
attttttttcttttgatttcttccgcagcctctggnctgcctttgtgtcagtcctaatatccttgtccagg

SEQ ID NO: 5308 - DNA, 71 bp, chicken (Gallus Gallus)
  misc_feature (36): n=a or g
tatttggtagaagattaaacaatcttcaagccctantactgtaagacctatatggcaactaggaagataat

SEQ ID NO: 5309 - DNA, 71 bp, chicken (Gallus Gallus)
  misc_feature (36): n=a or g
gccatttgcaggatgctttgtcatgaagtctccagnaatctctgggtggctctagtagctcacagccaaaa

SEQ ID NO: 5310 - DNA, 71 bp, chicken (Gallus Gallus)
  misc_feature (36): n=c or g
aaactagcaattaagaaatttaaaaaataagtgtangagcagcaagcctatatcaactgatgtaaataact

SEQ ID NO: 5311 - DNA, 71 bp, chicken (Gallus Gallus)
  misc_feature (36): n=c or t
gccactacattaattatggcagcttaaatgtggtgntgtttctatacttagtcacgacttaaaggtaaaaa

SEQ ID NO: 5312 - DNA, 71 bp, chicken (Gallus Gallus)
  misc_feature (36): n=a or c
gaactcacaatctcgactctagcttgaatgaaagangatgaaaatgcagaaacttccactccttccagtgt

SEQ ID NO: 5313 - DNA, 71 bp, chicken (Gallus Gallus)
  misc_feature (36): n=a or g
tgttttggagtatacttatttactgacttttacagncttaaggctgtgtttgtttctactgtgtccctcca

SEQ ID NO: 5314 - DNA, 71 bp, chicken (Gallus Gallus)
  misc_feature (36): n=c or t
acataacaggcataatgagacagtatttagcagcangatctctgcattttggctgcttagaactacttcat

SEQ ID NO: 5315 - DNA, 71 bp, chicken (Gallus Gallus)
  misc_feature (36): n=c or t
cataaaatatatagtaaataataagtaacaaaactnactttattctttagtatttcttgttaaaacctaaa

SEQ ID NO: 5316 - DNA, 71 bp, chicken (Gallus Gallus)
  misc_feature (36): n=a or g
atgacatatgtttacaccctatgcacaatagcttcncttacaaagagtctggtcaagttgtcagcaacaac

SEQ ID NO: 5317 - DNA, 71 bp, chicken (Gallus Gallus)
  misc_feature (36): n=c or t
atcactatggctcaaaaaacagtgctaagaaaatangactacatatagaaacaggaaaagatatggtaatg

SEQ ID NO: 5318 - DNA, 71 bp, chicken (Gallus Gallus)
  misc_feature (36): n=a or g
agaccttccttggagtcaacacagacataatagcanttggcacaaatattacgtggcaataaatctaaaat

SEQ ID NO: 5319 - DNA, 71 bp, chicken (Gallus Gallus)
  misc_feature (36): n=a or g
caactgtacacttctgatgtgaaagagggttattcntgtgcttttataagaacagtttagccaggttaagg

SEQ ID NO: 5320 - DNA, 71 bp, chicken (Gallus Gallus)
  misc_feature (36): n=a or g
ctctggtgtctttcttgacacatctttgcttgcacnttcctaccaagcattaagctactccatgctgcctt

SEQ ID NO: 5321 - DNA, 71 bp, chicken (Gallus Gallus)
  misc_feature (36): n=a or g
atcttttgtggtccactgacatgacatcaagctcantgaaatcagtggcagtcttcttatcagcttcaaaa

SEQ ID NO: 5322 - DNA, 71 bp, chicken (Gallus Gallus)
  misc_feature (36): n=c or t
atgaactaatactttcctacttttttttttttcttntcgtttatgagctcatctgcttttactagtcagct

SEQ ID NO: 5323 - DNA, 71 bp, chicken (Gallus Gallus)
  misc_feature (36): n=a or g
cgctactgactccgcttgtttggacctgtgctgaantaccccattacagcaccttactgtggctgcaccgg

SEQ ID NO: 5324 - DNA, 71 bp, chicken (Gallus Gallus)
  misc_feature (36): n=c or t
accaggcctacttctctagctgcctcctaaagccangggaactcaaggaacccttaagcaaactgatgaaa

SEQ ID NO: 5325 - DNA, 71 bp, chicken (Gallus Gallus)
  misc_feature (36): n=a or t
ggaaagtgcaagatgaacaatgttctgaaatgaaangtcaaactctcacagccatggaatcagatatttga

SEQ ID NO: 5326 - DNA, 71 bp, chicken (Gallus Gallus)
  misc_feature (36): n=a or g
agcttgcaggattgaacctgtggggaaaaagtattnatgagggccaggaatgaatgtcctggaaattttgt

SEQ ID NO: 5327 - DNA, 71 bp, chicken (Gallus Gallus)
  misc_feature (36): n=c or t
tttgtagtgctgtgaaataggctggaactcacctgntgatctggtaaagctgaacttctgtttgaaatgtg

SEQ ID NO: 5328 - DNA, 71 bp, chicken (Gallus Gallus)
  misc_feature (36): n=c or t
actctcctgcagatgtacgttgtgtcactgaacagngttgtacatcaacccccactgacatttagctgcaa

SEQ ID NO: 5329 - DNA, 71 bp, chicken (Gallus Gallus)
  misc_feature (36): n=a or g
tttccaagggagtgggaagagttaaattggtaactnttttcctttatccaaactcttatctttcccttcgt

SEQ ID NO: 5330 - DNA, 71 bp, chicken (Gallus Gallus)
  misc_feature (36): n=c or t
gctaacagtaggttgtcttggtgaagattttacttngaggaaagcccagtttcatgatgtactgctacaac

SEQ ID NO: 5331 - DNA, 71 bp, chicken (Gallus Gallus)
  misc_feature (36): n=c or t
ggacttgtgagctttgcatgttaaaggctaaactcntgttatagtgaacgtgatattttttaaggcttgag

SEQ ID NO: 5332 - DNA, 71 bp, chicken (Gallus Gallus)
  misc_feature (36): n=c or t
ggcttaagcaagcatgtagcctattagcaaagcagngcactgtgataagcaaattcttcaaaaccacttca

SEQ ID NO: 5333 - DNA, 71 bp, chicken (Gallus Gallus)
  misc_feature (36): n=a or g
cagcagggtaacgcacgcttgataagataccaacanatctctgagacagcttttaaaaaaggccttgtctg

SEQ ID NO: 5334 - DNA, 71 bp, chicken (Gallus Gallus)
  misc_feature (36): n=g or t
ttcatgttctggtgataatgctgatttttgcctaanctaatcagctttgagatagtaacataagaacaacc

SEQ ID NO: 5335 - DNA, 71 bp, chicken (Gallus Gallus)
  misc_feature (36): n=a or t
tgggatctacccacagggttcagctagcttatcctnctaagataaaggctgagaggttacgaataatccct

SEQ ID NO: 5336 - DNA, 71 bp, chicken (Gallus Gallus)
  misc_feature (36): n=a or g
cctgagcttacagctacttaaactttcagctctggncattgtgatgaccacagggatgatggatgggtgaa

SEQ ID NO: 5337 - DNA, 71 bp, chicken (Gallus Gallus)
  misc_feature (36): n=a or g
ttccattaaaaattagttgaagcattatttcagtcntccatgatttaccacttctaagccaatatattaac

SEQ ID NO: 5338 - DNA, 71 bp, chicken (Gallus Gallus)
  misc_feature (36): n=c or t
tcttttttaacttaacaagggtgaacagtatcacangaaaagctagatgcaacggtgcagtttttacaagt

SEQ ID NO: 5339 - DNA, 71 bp, chicken (Gallus Gallus)
  misc_feature (36): n=g or t
ccactttcctatctaaaaatggctcaatagacaatnggctaacagttgcctaccctctgtgtaagggtgga

SEQ ID NO: 5340 - DNA, 71 bp, chicken (Gallus Gallus)
  misc_feature (36): n=a or g
gcttagttttatttctggcatacaacgtttcttcanatgcacacatcttcagaagctctgttacaagcaat

SEQ ID NO: 5341 - DNA, 71 bp, chicken (Gallus Gallus)
  misc_feature (36): n=a or g
aagcaacctgcatttatgtgacttctgataacttcntatgtattaagtatatttttcctgtttaatcattc

SEQ ID NO: 5342 - DNA, 71 bp, chicken (Gallus Gallus)
  misc_feature (36): n=c or t
agtgtggcattttgatcctaaaaacctttctccctntcccctacagttttgcatttgtctgaagctccaga

SEQ ID NO: 5343 - DNA, 71 bp, chicken (Gallus Gallus)
  misc_feature (36): n=a or g
aaagattgcgtcccacagcaaatggtaactcggtcngtgcatgtgctgttactcctatttttgttacgttt

SEQ ID NO: 5344 - DNA, 71 bp, chicken (Gallus Gallus)
  misc_feature (36): n=a or g
accagatacaacaaaaaggtagcttatgcccaaagnactgaaaaatgccagtaaggacagaaaagagaatg

SEQ ID NO: 5345 - DNA, 71 bp, chicken (Gallus Gallus)
  misc_feature (36): n=g or t
ccctaaaaacttctttctttcacttaggcttttttntttttggacaactacacactgagctcttgtttccc

SEQ ID NO: 5346 - DNA, 71 bp, chicken (Gallus Gallus)
  misc_feature (36): n=c or t
tttttgttgtgtccttttctccctgtatagttctantacttcaacatgcagctcacatggatgcaggtttt

SEQ ID NO: 5347 - DNA, 71 bp, chicken (Gallus Gallus)
  misc_feature (36): n=a or g
gggaccattctgttaccatgagttcaggtttactgnagaacaaattgcaattcatttttacatctcttgtc

SEQ ID NO: 5348 - DNA, 71 bp, chicken (Gallus Gallus)
  misc_feature (36): n=c or g
ggagcactggagataggcagtgctttggctctcaanacttgttacaactgctgctagtaggagattgcaag

SEQ ID NO: 5349 - DNA, 71 bp, chicken (Gallus Gallus)
  misc_feature (36): n=a or g
ctttgatgcagttcctggcttttgaaatgcatgctntactgagcagaagtgatgtcttgtgcctggtctgc

SEQ ID NO: 5350 - DNA, 71 bp, chicken (Gallus Gallus)
  misc_feature (36): n=c or t
cttgagacttgtactgaaaatcccaaatcccatcgngtcgtgcttgttggggtgttgttttctcacgcctg

SEQ ID NO: 5351 - DNA, 71 bp, chicken (Gallus Gallus)
  misc_feature (36): n=a or g
gctgactgtgtttgaaaacgcttgtattcattagtntaatgctctgtacaattgccttcttgcccagtgca

SEQ ID NO: 5352 - DNA, 71 bp, chicken (Gallus Gallus)
  misc_feature (36): n=g or t
gctcactgttctcacatgtatggtttgttctccatnaatttttagcaagctttgatgaacatcaaaaactt

SEQ ID NO: 5353 - DNA, 71 bp, chicken (Gallus Gallus)
  misc_feature (36): n=a or g
tgagcattgtggtccttttcaacccaggccattctntgattcaatgacagtgcctccaaaatataatttta

SEQ ID NO: 5354 - DNA, 71 bp, chicken (Gallus Gallus)
  misc_feature (36): n=a or g
ttaccagatcagtcaccaagctgaagcttctttacntgatttacacttaagaaactgctgaaaacatgatg

SEQ ID NO: 5355 - DNA, 71 bp, chicken (Gallus Gallus)
  misc_feature (36): n=a or c
tgggcatcaaagatgcaacagcctcatcaagagccnggcacacatctgtggtgctctgcattctattctgt

SEQ ID NO: 5356 - DNA, 71 bp, chicken (Gallus Gallus)
  misc_feature (36): n=c or t
ttttggaccggttcctgatgcctcacggaagattancccgcctcaaactgctggcgtttatagccaagatg

SEQ ID NO: 5357 - DNA, 71 bp, chicken (Gallus Gallus)
  misc_feature (36): n=c or t
ggtgctaccgaagtatttaattagtagacagcttantcttgatgcttgcttactcttatgtgaccatattc

SEQ ID NO: 5358 - DNA, 71 bp, chicken (Gallus Gallus)
  misc_feature (36): n=c or t
taggacattttctgttctttgccctaaaaaatcccntaggttccttgacaaaccaaatagaaaataaaagc

SEQ ID NO: 5359 - DNA, 71 bp, chicken (Gallus Gallus)
  misc_feature (36): n=a or c
aaggcactgtcgagctacattacaccagcaggaacnctgaacaagtttacctgaaattcccagttctctga

SEQ ID NO: 5360 - DNA, 71 bp, chicken (Gallus Gallus)
  misc_feature (36): n=c or t
atgctctctcatctgaaaccagaacaaggacggggnacagtgccatgctaaccattgcttgcacccaccat

SEQ ID NO: 5361 - DNA, 71 bp, chicken (Gallus Gallus)
  misc_feature (36): n=c or t
aaagcaggctttcctgaacgtttggttttaatacantttctcagtttgaaactgctgtagctgctgtcctg

SEQ ID NO: 5362 - DNA, 71 bp, chicken (Gallus Gallus)
  misc_feature (36): n=c or t
ctggttacctcaagtgttcaggctactgatgagagntatttagtatttcaggctgctgtcttgagtaatac

SEQ ID NO: 5363 - DNA, 71 bp, chicken (Gallus Gallus)
  misc_feature (36): n=c or t
tatcaagcccagtgtcagctcaccagtgctataacnagaatgagcaagatcttgttgcactttcacagact

SEQ ID NO: 5364 - DNA, 71 bp, chicken (Gallus Gallus)
  misc_feature (36): n=a or t
actacaacatcatacgtgactgctctacatgggatntgccacaccaaatgcttaagcagaaagcagttgca

SEQ ID NO: 5365 - DNA, 71 bp, chicken (Gallus Gallus)
  misc_feature (36): n=c or t
aggtgattctgccactctactgtgctctcgtgagancccacctggagtactgcatccagttctggggactc

SEQ ID NO: 5366 - DNA, 71 bp, chicken (Gallus Gallus)
  misc_feature (36): n=c or t
gaatatttgtagtaggtaaattcaacgttaaaatangtacccttctttttgtgactaaatccagtttactt

SEQ ID NO: 5367 - DNA, 71 bp, chicken (Gallus Gallus)
  misc_feature (36): n=a or g
gcagcagcagtgagcacagcacgggaggcagcagcngaaaaactttcacactttgtgttaaatcgccaatt

SEQ ID NO: 5368 - DNA, 71 bp, chicken (Gallus Gallus)
  misc_feature (36): n=c or t
acaacagcagcagctctggtgactacttagaaacanaaacaggaacagtttacagttgactttatttaaaa

SEQ ID NO: 5369 - DNA, 71 bp, chicken (Gallus Gallus)
  misc_feature (36): n=a or g
ccttattcagtgtcttccttcagtgcattccaattnttattcaagcatgtcagaaataatgaagttcatta

SEQ ID NO: 5370 - DNA, 71 bp, chicken (Gallus Gallus)
  misc_feature (36): n=c or g
agagaccaaagaatttagtcctgatagagatggatntcaaattagaataaagaaaagcatgtgctttgtgt

SEQ ID NO: 5371 - DNA, 71 bp, chicken (Gallus Gallus)
  misc_feature (36): n=c or t
cagaacattatacttgcataacttgccaatatatgntaagcatgtagaatgaagtctctccttctgattaa

SEQ ID NO: 5372 - DNA, 71 bp, chicken (Gallus Gallus)
  misc_feature (36): n=c or t
cgtagctgtctgttgcttaatactgcctaaaataangatctacttctttagttcttcagatccatcttcat

SEQ ID NO: 5373 - DNA, 71 bp, chicken (Gallus Gallus)
  misc_feature (36): n=g or t
cagtacttcacatagtcaaatgccagaggctaccanagaacaaacaatgcccaactgttcattaaatttaa

SEQ ID NO: 5374 - DNA, 71 bp, chicken (Gallus Gallus)
  misc_feature (36): n=a or g
cagggaggaagaaaaggcagaggagtaagaaaaganaggacaaaccaagaaccgatagattaatttttaaa

SEQ ID NO: 5375 - DNA, 71 bp, chicken (Gallus Gallus)
  misc_feature (36): n=c or t
ggctatcttcgtaatcttacttagatttgggaaaantcaagaagtgtaaggctaaatttgcctaggagtcc

SEQ ID NO: 5376 - DNA, 71 bp, chicken (Gallus Gallus)
  misc_feature (36): n=a or c
tcatcccgctgattaattcattggaaaaatggttcngttgacaagaaaacagggctggcatcaatgaacac

SEQ ID NO: 5377 - DNA, 71 bp, chicken (Gallus Gallus)
  misc_feature (36): n=a or g
gcttcgtacacccctataaccatgagcacctcttanttttctcagtctctctcttactgactgctgtcact

SEQ ID NO: 5378 - DNA, 71 bp, chicken (Gallus Gallus)
  misc_feature (36): n=a or g
attacgcttttgtaaacctcagcttcatgccccttngtcctcctttactctgtggaaatgaattactttca

SEQ ID NO: 5379 - DNA, 71 bp, chicken (Gallus Gallus)
  misc_feature (36): n=a or g
ctgtgtccttacagatgagtagctaggctgctggtntctgtgagtgggcttggagtctagtccccaggtaa

SEQ ID NO: 5380 - DNA, 71 bp, chicken (Gallus Gallus)
  misc_feature (36): n=a or g
aaaggaagaaaaggggcttggaacgggcactaagangtaaaaggaagctgggcagatatcttgtatcaacc

SEQ ID NO: 5381 - DNA, 71 bp, chicken (Gallus Gallus)
  misc_feature (36): n=c or t
atgtttgcattgtcagaaaatcctactaatttctcnagcttagccacaaggaatgagataatttgtcttct

SEQ ID NO: 5382 - DNA, 71 bp, chicken (Gallus Gallus)
  misc_feature (36): n=a or g
attactagaaattctggttttgcagctcttgccaantttcagcatagaagtaggttgatattacctaaatc

SEQ ID NO: 5383 - DNA, 71 bp, chicken (Gallus Gallus)
  misc_feature (36): n=a or g
tgagccacatgcagttcatgagaacagcttgctggncaaagctatcaatattttagggctgctcctttgtg

SEQ ID NO: 5384 - DNA, 71 bp, chicken (Gallus Gallus)
  misc_feature (36): n=a or g
gctggaccaagctcgtgcaatttgtgggcctgactnccaaccatgggacttaggtccagaaaatctctaac

SEQ ID NO: 5385 - DNA, 71 bp, chicken (Gallus Gallus)
  misc_feature (36): n=a or g
aagcacctcaacaatgttctgcaaagaaatagcgcnatgctgtgtaatctaccacagtaggcaatgcaggt

SEQ ID NO: 5386 - DNA, 71 bp, chicken (Gallus Gallus)
  misc_feature (36): n=c or g
ctcttaatctcccccagaaggttttgctgtcctcanatgcaagctcacccacgctttattttggtgctctg

SEQ ID NO: 5387 - DNA, 71 bp, chicken (Gallus Gallus)
  misc_feature (36): n=a or g
ataataaggagggagtagtcccatttctcctgtatntatgcccaccagatgctctagaacgtggtgtcagt

SEQ ID NO: 5388 - DNA, 71 bp, chicken (Gallus Gallus)
  misc_feature (36): n=a or g
tttctaatgctacctaagggatgaatctacaaactncaagagctactgtaagggggtctttttctgagctg

SEQ ID NO: 5389 - DNA, 71 bp, chicken (Gallus Gallus)
  misc_feature (36): n=a or c
tcatagtaacacagcaatcaagaaaacactcctctnatgcttaactccaaagattttgatgttaaaataaa

SEQ ID NO: 5390 - DNA, 71 bp, chicken (Gallus Gallus)
  misc_feature (36): n=a or g
catatgcagccaacctaaattccacttttgtctctntgcctatctaatgagctggctctagaaagcttcct

SEQ ID NO: 5391 - DNA, 71 bp, chicken (Gallus Gallus)
  misc_feature (36): n=a or g
tagatttttattattcctagttttctcttcccttcnttctttgaccttgctaagaagcacttctgtacaga

SEQ ID NO: 5392 - DNA, 71 bp, chicken (Gallus Gallus)
  misc_feature (36): n=c or t
tatagcaaaaacttccaaagagaatatcataacacnaagttctatttattatctgtccacctccttgccca

SEQ ID NO: 5393 - DNA, 71 bp, chicken (Gallus Gallus)
  misc_feature (36): n=a or g
gcattgaaatcactaatgttgctacaccttccagcntcagttgattgtctagcttccctgtatttttgaca

SEQ ID NO: 5394 - DNA, 71 bp, chicken (Gallus Gallus)
  misc_feature (36): n=a or g
tttgtactgtgcatcattgctaattgctactaaacnctccatcttaaccctggcatgctcttctcctgctg

SEQ ID NO: 5395 - DNA, 71 bp, chicken (Gallus Gallus)
  misc_feature (36): n=a or t
gtttactagcaaatgaaaacttagagggcagttctntgtttatactgacatagttccattgtgttaccaat

SEQ ID NO: 5396 - DNA, 71 bp, chicken (Gallus Gallus)
  misc_feature (36): n=c or t
gacctcctgtgtgtgtctgtgaatctttctaccttnacccaccatttcaacgaacaaagtgagttgcagag

SEQ ID NO: 5397 - DNA, 71 bp, chicken (Gallus Gallus)
  misc_feature (36): n=a or g
cattgatggcccctgaaattagtgaaaaagcactcnggatggtaagatgaaactattattaatctccagtc

SEQ ID NO: 5398 - DNA, 71 bp, chicken (Gallus Gallus)
  misc_feature (36): n=c or t
tatgtgacagtaacaagaaaagctgacacgtgagtncagtcctttatctgagtcttttatattgtggttgg

SEQ ID NO: 5399 - DNA, 71 bp, chicken (Gallus Gallus)
  misc_feature (36): n=a or g
ataacatcccaatacaaacatcccaaggtgacacanactgttacatttcaaattcatatgacaaatttcag

SEQ ID NO: 5400 - DNA, 71 bp, chicken (Gallus Gallus)
  misc_feature (36): n=c or t
gaaaagacagtgtaggagagagaccaagagggcaanagtgttgaacagaaaagtgttaaggttatagctga

SEQ ID NO: 5401 - DNA, 71 bp, chicken (Gallus Gallus)
  misc_feature (36): n=c or t
ttcagagagtacaaaccctggagtgaggtattgacncagagctgattgagtagctgtttaaactgcaataa

SEQ ID NO: 5402 - DNA, 71 bp, chicken (Gallus Gallus)
  misc_feature (36): n=a or g
caggaaggacattaagttactcgagcagcaaagctngtgaagggactagaaaacgagttatgaggagcaag

SEQ ID NO: 5403 - DNA, 71 bp, chicken (Gallus Gallus)
  misc_feature (36): n=a or g
ttgtagaacacacacgagtacatccagactgcaaanttcccaaactaagccagcacagtactgtgctgtac

SEQ ID NO: 5404 - DNA, 71 bp, chicken (Gallus Gallus)
  misc_feature (36): n=a or g
gaatcaatccgtgttgtcacgactgcaatgcctgtntaaattaacgattacctaaagacaataatttgtcc

SEQ ID NO: 5405 - DNA, 71 bp, chicken (Gallus Gallus)
  misc_feature (36): n=c or t
gagcagctgctgcatatggccccttggtgctggtgngagtcacaggatggtctccagtttgcagaatgagg

SEQ ID NO: 5406 - DNA, 71 bp, chicken (Gallus Gallus)
  misc_feature (36): n=c or t
tttttgctgtgttttctaggagtcactgcagtctcnctcccttttcctgctgttacatatctaaaagtggc

SEQ ID NO: 5407 - DNA, 71 bp, chicken (Gallus Gallus)
  misc_feature (36): n=a or g
acctaggataagatacagaggatttaaaatactcangcttcctggcataactaactgcttgagattaggag

SEQ ID NO: 5408 - DNA, 71 bp, chicken (Gallus Gallus)
  misc_feature (36): n=a or g
gagttcccaaaaatatctcaaaatatatgagttccnaaaactgtatctaacataattaaatgttggaataa

SEQ ID NO: 5409 - DNA, 71 bp, chicken (Gallus Gallus)
  misc_feature (36): n=a or g
cacagaaactccagtaagcacacaaatgagagacantaaaaatctcacccatcagctagaagtgtacaaat

SEQ ID NO: 5410 - DNA, 71 bp, chicken (Gallus Gallus)
  misc_feature (36): n=a or c
cactctcctacctacctagctaactctcctttaacnttagcagtccttcagtatctgcttaagggaatata

SEQ ID NO: 5411 - DNA, 71 bp, chicken (Gallus Gallus)
  misc_feature (36): n=a or g
gtaatggatcttcgttatttcaggttgtttgaagantttcactatgtgaagtacgttgcagcttatatttt

SEQ ID NO: 5412 - DNA, 71 bp, chicken (Gallus Gallus)
  misc_feature (36): n=a or g
agatggaaatgaaaacagaaacaacaaactgaaatncagcagccattggcaaattctatgattctgtgatt

SEQ ID NO: 5413 - DNA, 71 bp, chicken (Gallus Gallus)
  misc_feature (36): n=a or g
caacactgaaggtcataaaatgtaagtcaataaatntaaaatgtggcttttactatgagactgtataggct

SEQ ID NO: 5414 - DNA, 71 bp, chicken (Gallus Gallus)
  misc_feature (36): n=a or g
ggggccccagccaagcgggagctcattagactaagntgggtgattatagagaggaagtcagactagaaatg

SEQ ID NO: 5415 - DNA, 71 bp, chicken (Gallus Gallus)
  misc_feature (36): n=c or t
atgcaggcacgtccctagggacccgtttcccttctnctaacccaagccccgttcgaagcagagatgttgac

SEQ ID NO: 5416 - DNA, 71 bp, chicken (Gallus Gallus)
  misc_feature (36): n=c or t
cacaaaacgcattgagctctccgctcttgtcgtggntgttgaattgttgaaagtaatgcaaagagggtctc

SEQ ID NO: 5417 - DNA, 71 bp, chicken (Gallus Gallus)
  misc_feature (36): n=c or t
ctgcaaagtagcatttctaggtgatgcaacctctgnaaccctctgattcttaatcttctaagactattgtt

SEQ ID NO: 5418 - DNA, 71 bp, chicken (Gallus Gallus)
  misc_feature (36): n=c or t
cacatctttcctaaggatttactgtgtatttacatncttgtcataaatgaccttttctttcattgcatgaa

SEQ ID NO: 5419 - DNA, 71 bp, chicken (Gallus Gallus)
  misc_feature (36): n=a or g
acggtaaagcagagaaatcactgtcctggaaaaatncttttaactcctacagctcttatgtacgtaacaaa

SEQ ID NO: 5420 - DNA, 71 bp, chicken (Gallus Gallus)
  misc_feature (36): n=a or g
acgtggaggtcagggctgcttctactatactgtgcnctgtcatcctcggttgccttccatggacagaaaaa

SEQ ID NO: 5421 - DNA, 71 bp, chicken (Gallus Gallus)
  misc_feature (36): n=c or t
tccacagaaaattttttaactaaagttcttactagntaaatagcaaaataaaatcaccttcacaaacaaga

SEQ ID NO: 5422 - DNA, 71 bp, chicken (Gallus Gallus)
  misc_feature (36): n=c or t
aaatagaagtcagaaagggtaacgtaaaatgagtanggatgaggagacacactggaaaatagttcatttgc

SEQ ID NO: 5423 - DNA, 71 bp, chicken (Gallus Gallus)
  misc_feature (36): n=c or g
ataaattgagcattttcactgtaaatttttctcttntacgcaattagtataaaagattattaaatgatagt

SEQ ID NO: 5424 - DNA, 71 bp, chicken (Gallus Gallus)
  misc_feature (36): n=a or c
aatgatttggatgcttgatcccagggcttactgctnaaaaccatcaagcacccataattctaacatcagga

SEQ ID NO: 5425 - DNA, 71 bp, chicken (Gallus Gallus)
  misc_feature (36): n=c or t
acctgattttagaaaaatcatctgatagagccttgnattcccatgttgcagtggaacagctggcaaccact

SEQ ID NO: 5426 - DNA, 71 bp, chicken (Gallus Gallus)
  misc_feature (36): n=a or t
catccgggttcatcttaggcagtggaaattagtacngagaattctgcttgtgtgggtccagacctcttctg

SEQ ID NO: 5427 - DNA, 71 bp, chicken (Gallus Gallus)
  misc_feature (36): n=c or t
gaacatgaacaggacgtggaagcagggacaggtacnctggaaaaagtatagggatgctgctaagctgtgtg

SEQ ID NO: 5428 - DNA, 71 bp, chicken (Gallus Gallus)
  misc_feature (36): n=c or t
tgtatcaataaaaagtcagtgattcctgaagatccngttcagaaatgtctgtcctttaatgaccatcaact

SEQ ID NO: 5429 - DNA, 71 bp, chicken (Gallus Gallus)
  misc_feature (36): n=a or g
tccttccaggcactaagagtagcaaacatgaactantaaaaggtgatggggcagctgtactctttgtgaga

SEQ ID NO: 5430 - DNA, 71 bp, chicken (Gallus Gallus)
  misc_feature (36): n=g or t
tctgcgtgcctgcatgtggcactaagctgtattttntgttaaattggaagcttggggtttttcctgccctc

SEQ ID NO: 5431 - DNA, 71 bp, chicken (Gallus Gallus)
  misc_feature (36): n=a or g
ttgcagacttccctggagcagcagtgagagctcagntcaaattgtttttccgttttggagcatttcagctc

SEQ ID NO: 5432 - DNA, 71 bp, chicken (Gallus Gallus)
  misc_feature (36): n=a or g
agtcccaggcacaagaaactgtccataaagcacagntatttgccgaagcactttgtaaggggagtgaagaa

SEQ ID NO: 5433 - DNA, 71 bp, chicken (Gallus Gallus)
  misc_feature (36): n=c or t
ggtgtaatctatgctcacagcactgatgtgtaaccntggcatggagtgaataacagcagcaacacccgtgc

SEQ ID NO: 5434 - DNA, 71 bp, chicken (Gallus Gallus)
  misc_feature (36): n=a or c
aattaagtgacaggaaacatagttgcaagattatcncagagaccaagaaaagatcctgggaaatctgtgtt

SEQ ID NO: 5435 - DNA, 71 bp, chicken (Gallus Gallus)
  misc_feature (36): n=a or g
agctaccagagagctttctcttctagagatgagctntgtttagtcagcagagctaatcttgatttccactt

SEQ ID NO: 5436 - DNA, 71 bp, chicken (Gallus Gallus)
  misc_feature (36): n=a or t
cctcaccacctctgggaaagaattccctcctcacanctaagctaaatttcccttctttccgtttaaagcca

SEQ ID NO: 5437 - DNA, 71 bp, chicken (Gallus Gallus)
  misc_feature (36): n=a or g
caaatatcactgcaatatgtcagagttgcacattcntcctatttgctacacagagatacacttcactgttt

SEQ ID NO: 5438 - DNA, 71 bp, chicken (Gallus Gallus)
  misc_feature (36): n=c or t
ccttctcagactaaatctaatgcctctgaaaggggntgagtcaacaggtctttggactgaaagcctctgat

SEQ ID NO: 5439 - DNA, 71 bp, chicken (Gallus Gallus)
  misc_feature (36): n=a or g
aatgaggtttgtttttattagtttgttacttttacntgattgctatttttcactagcaattcatggtacta

SEQ ID NO: 5440 - DNA, 71 bp, chicken (Gallus Gallus)
  misc_feature (36): n=c or t
gactcaggatgggagctgatagggaatgttgtggtncaacattttgtcatcacagtctgaagaagatgcag

SEQ ID NO: 5441 - DNA, 71 bp, chicken (Gallus Gallus)
  misc_feature (36): n=c or t
tttctttgctaaatcatgtaagtcaccttacagtgnttttagaagggtagcaattatttacataagtagta

SEQ ID NO: 5442 - DNA, 71 bp, chicken (Gallus Gallus)
  misc_feature (36): n=a or g
ataagttgtcttcctcagcactgctgtttaagttcntttctagtatttcccttctgtctctgagatggatc

SEQ ID NO: 5443 - DNA, 71 bp, chicken (Gallus Gallus)
  misc_feature (36): n=c or t
gctgcaaagcaaagcaaaaccaactcttatctgccnacttcatgctgaggaagagaagtaaagcataaggc

SEQ ID NO: 5444 - DNA, 71 bp, chicken (Gallus Gallus)
  misc_feature (36): n=c or t
ccgtgcataacgatgtgggagttaccagcaagggcngtattacacagctataacacctgcaaatctcaagg

SEQ ID NO: 5445 - DNA, 71 bp, chicken (Gallus Gallus)
  misc_feature (36): n=a or g
ttggattttctaaacgtcattagctgcaaccaacgngatatggccagaaaacattttaacattatttactg

SEQ ID NO: 5446 - DNA, 71 bp, chicken (Gallus Gallus)
  misc_feature (36): n=a or g
tggttccagatattctttcaagcccttcttgcttcntcttcagcccttgttttagattagctgatctgcac

SEQ ID NO: 5447 - DNA, 71 bp, chicken (Gallus Gallus)
  misc_feature (36): n=c or t
tccatacagctgtacaaagcagtttgaaaaaatcangttagtgcactggtaactttcttctgctatgtgga

SEQ ID NO: 5448 - DNA, 71 bp, chicken (Gallus Gallus)
  misc_feature (36): n=c or t
tttgtgaatgccaaaacagctgcagaattgtcagtncaatttcattctattttttaactgtttatttttca

SEQ ID NO: 5449 - DNA, 71 bp, chicken (Gallus Gallus)
  misc_feature (36): n=c or t
tgggactttttttttcatatgttgtgcaagaaatcnactttagttgttgttgtttcttttaacttacatta

SEQ ID NO: 5450 - DNA, 71 bp, chicken (Gallus Gallus)
  misc_feature (36): n=a or g
gaaacaaaaatcaaagctgctgctgttgccgctacntgactgtatttgtaaaggcaagacacatacctggc

SEQ ID NO: 5451 - DNA, 71 bp, chicken (Gallus Gallus)
  misc_feature (36): n=c or t
aaaactcagttgcacgagcttgaacccttcatctcnctatggaatttaaataaggattatgcatttgaaat

SEQ ID NO: 5452 - DNA, 71 bp, chicken (Gallus Gallus)
  misc_feature (36): n=a or g
ccatggaagctcccagtttagtcacccatcagagangaagggaagggcagaatcaccacagggaagcaccc

SEQ ID NO: 5453 - DNA, 71 bp, chicken (Gallus Gallus)
  misc_feature (36): n=c or t
aacccatagtgaagcattgccgtttgaattcacatncaagctggcagcattttcctgctgtgagagacacc

SEQ ID NO: 5454 - DNA, 71 bp, chicken (Gallus Gallus)
  misc_feature (36): n=a or g
ttccaaggcaataagtatatgagctaataatcttcnaatgtggacaaacaaaataaaaatactacatgttt

SEQ ID NO: 5455 - DNA, 71 bp, chicken (Gallus Gallus)
  misc_feature (36): n=c or t
gagtttgagcagcacactaatgcccttgggagagtntgagacccccggtagcactgaaatctcagcaactg

SEQ ID NO: 5456 - DNA, 71 bp, chicken (Gallus Gallus)
  misc_feature (36): n=a or g
ttgtctagcaatggattgagaaacttcagtgctacnggaatttcccctttccttctcccttagataattta

SEQ ID NO: 5457 - DNA, 71 bp, chicken (Gallus Gallus)
  misc_feature (36): n=c or g
atttcagcggaactgaaaatcacaagtgttccctgngggctgggttctgtagttggattattatctcccat

SEQ ID NO: 5458 - DNA, 71 bp, chicken (Gallus Gallus)
  misc_feature (36): n=c or t
cctactgctctctgtgctacttttccagcatatgcncaagaggttgaagaaccccagtcaggagaagtgcc

SEQ ID NO: 5459 - DNA, 71 bp, chicken (Gallus Gallus)
  misc_feature (36): n=c or t
ctgcagttgagtcattctcaaagaataaaataggtncttgctttcaaactgcatttatactctaatagtaa

SEQ ID NO: 5460 - DNA, 71 bp, chicken (Gallus Gallus)
  misc_feature (36): n=c or t
gaagtacaccagtgcagctcagagaacagcttattngtcactgacaagacttttttacttttgatgaaact

SEQ ID NO: 5461 - DNA, 71 bp, chicken (Gallus Gallus)
  misc_feature (36): n=c or t
atacagttctatagttgcttggtaagtgaaatgaangtgtaaaacctgaaaaggtatataaatacgtagct

SEQ ID NO: 5462 - DNA, 71 bp, chicken (Gallus Gallus)
  misc_feature (36): n=a or g
attttttctgctcagtaacaaagccagagaataacnggagtgtggaaggagaggcaatggggcagaattga

SEQ ID NO: 5463 - DNA, 71 bp, chicken (Gallus Gallus)
  misc_feature (36): n=a or t
ttatatttcttttaatatcaggaattacaatcaacnctttggagtatgctgcttaaaaaataaaacagctt

SEQ ID NO: 5464 - DNA, 71 bp, chicken (Gallus Gallus)
  misc_feature (36): n=c or g
ctgagttccttggcccaaaaaactgctgtctgcatntctgtaactttttctacacatgaacataaaggctt

SEQ ID NO: 5465 - DNA, 71 bp, chicken (Gallus Gallus)
  misc_feature (36): n=c or t
aaaaaatgcttccttctgtctcatagaggataaaanagtaagtgtgctccattctgacctatttgcaaata

SEQ ID NO: 5466 - DNA, 71 bp, chicken (Gallus Gallus)
  misc_feature (36): n=g or t
ctcttccttgcaacacacactaatgctttgtcaggnaatatttagatccccatcatgaagtgtcttcctaa

SEQ ID NO: 5467 - DNA, 71 bp, chicken (Gallus Gallus)
  misc_feature (36): n=a or g
gcacatgactgaacagctttctgtgcagtgcttggntggctcaaagtttatggtcagaaggtactccaggg

SEQ ID NO: 5468 - DNA, 71 bp, chicken (Gallus Gallus)
  misc_feature (36): n=a or g
aatatgcaaacaaacaaccatcttaagatgcttgcnaacactaacacttactgattgttattgattctcct

SEQ ID NO: 5469 - DNA, 71 bp, chicken (Gallus Gallus)
  misc_feature (36): n=a or g
tgcttttaggctgagtaaaggttatgtctcctaacntaagctgttttcaccacactactagagattaacca

SEQ ID NO: 5470 - DNA, 71 bp, chicken (Gallus Gallus)
  misc_feature (36): n=c or t
tattcatgtttcatctcatatcaaaaggccagaganaaatctacttattttttcctaactgctctctgtaa

SEQ ID NO: 5471 - DNA, 71 bp, chicken (Gallus Gallus)
  misc_feature (36): n=a or g
aaacaaaactgcactgattctgagctcaagaaatgncacaccctctaggcagtaaaattttaaatttgccc

SEQ ID NO: 5472 - DNA, 71 bp, chicken (Gallus Gallus)
  misc_feature (36): n=a or g
catgcaaaacatgagtaccaggcagtaagcactgtntacggagtttccagctcaagacttgaagatgcact

SEQ ID NO: 5473 - DNA, 71 bp, chicken (Gallus Gallus)
  misc_feature (36): n=a or g
taattacagctttcgtgttttcagtgtaggctcacnaattgctttctgtgactatttctgtggtgaaacac

SEQ ID NO: 5474 - DNA, 71 bp, chicken (Gallus Gallus)
  misc_feature (36): n=c or t
ctgttattaatgccacaattgggcttaatattacanaatatttcaaaatgtaacaagttgcatcatcatct

SEQ ID NO: 5475 - DNA, 71 bp, chicken (Gallus Gallus)
  misc_feature (36): n=c or t
aaaaaacaacaaaaaacactgatatgccagaaaaanaaataaaaatcatccatgacagtgcaccaaaagcc

SEQ ID NO: 5476 - DNA, 71 bp, chicken (Gallus Gallus)
  misc_feature (36): n=c or t
atgcagctgagaccttgttatgccctttcgacatangaaggcaacaagaaagatggagaaagacttttgaa

SEQ ID NO: 5477 - DNA, 71 bp, chicken (Gallus Gallus)
  misc_feature (36): n=g or t
tgattaacatcactaagccccagagcagctgagtcngtgctcaaaagttatctcctctctcagctacacca

SEQ ID NO: 5478 - DNA, 71 bp, chicken (Gallus Gallus)
  misc_feature (36): n=a or g
ccatgaacgggaccttcaggaaagaaaaagtttcangtttcatatttcaatcagcagaaccagaagagcca

SEQ ID NO: 5479 - DNA, 71 bp, chicken (Gallus Gallus)
  misc_feature (36): n=a or c
caaaggttatctgggcaattaaggtctattagcacntgcagcacctggcagggatgctgttccatgcaact

SEQ ID NO: 5480 - DNA, 71 bp, chicken (Gallus Gallus)
  misc_feature (36): n=c or t
tgaggacaaatccttctttcacctgcttgctttacncgcctttttccagcacttcattgggatatgtcagt

SEQ ID NO: 5481 - DNA, 71 bp, chicken (Gallus Gallus)
  misc_feature (36): n=c or t
gggtgcattccatgtctagaagataacgagcttcancctatagctacatcctatcagctctataaaacacg

SEQ ID NO: 5482 - DNA, 71 bp, chicken (Gallus Gallus)
  misc_feature (36): n=g or t
aacttctgaaataaccctctgtttgtgtatttaatngcacagttgtctggaccaactgattacagctactt

SEQ ID NO: 5483 - DNA, 71 bp, chicken (Gallus Gallus)
  misc_feature (36): n=a or g
aaagcattgaagctttttcctatctggtgagggaancaaacccactgaagtgaataatgcttagcagactt

SEQ ID NO: 5484 - DNA, 71 bp, chicken (Gallus Gallus)
  misc_feature (36): n=a or g
tggagtgttaaaatgcattttttatttaagaaatcntgaaaacataactccattagttgttgtataagcta

SEQ ID NO: 5485 - DNA, 71 bp, chicken (Gallus Gallus)
  misc_feature (36): n=a or g
caggtccaaagactatccacagtggagttcaggatngatctatggaaacttgcccacgcttaggtaagctg

SEQ ID NO: 5486 - DNA, 71 bp, chicken (Gallus Gallus)
  misc_feature (36): n=g or t
tattctttgcttgttgttaaaattgtgcagaagaanttgttattggtggttgttttgatatccagatcatt

SEQ ID NO: 5487 - DNA, 71 bp, chicken (Gallus Gallus)
  misc_feature (36): n=a or g
tcacccttccgtagcatgtatgacgaagttattatnggaagctttaaaataggagcctgtctgtgtaaaat

SEQ ID NO: 5488 - DNA, 71 bp, chicken (Gallus Gallus)
  misc_feature (36): n=a or t
aagatttagtccttattgctgccttttatcatatantcatagaatacccccagttggaaggattccacagg

SEQ ID NO: 5489 - DNA, 71 bp, chicken (Gallus Gallus)
  misc_feature (36): n=c or t
aatttgaggaggtagatgttgatactgtaaagcaangtggagcagctggagctggtgtaagcagtgccaag

SEQ ID NO: 5490 - DNA, 71 bp, chicken (Gallus Gallus)
  misc_feature (36): n=a or c
gctgtgttggctcgggaagcggcagtgtgtgctgcnagcttgaactttctctgcttgctgatacagctctg

SEQ ID NO: 5491 - DNA, 71 bp, chicken (Gallus Gallus)
  misc_feature (36): n=c or t
ttatggcaatggccaactctgcttttctgtgttctntgtccaagcttgacagttatttgtgtaaattaata

SEQ ID NO: 5492 - DNA, 71 bp, chicken (Gallus Gallus)
  misc_feature (36): n=c or t
accttggaaaagctcctcttttagtctccattgtcncacttcaagcctctcatctcattgcttttttctaa

SEQ ID NO: 5493 - DNA, 71 bp, chicken (Gallus Gallus)
  misc_feature (36): n=a or g
atacataagaatgaaactgttcagaaaggaactggngaaaattctcactatggtcaatacataacttacca

SEQ ID NO: 5494 - DNA, 71 bp, chicken (Gallus Gallus)
  misc_feature (36): n=a or c
agacactatcttaactggatgcttgataatgaaatnaaactctctagttttatttgacaatagaattattc

SEQ ID NO: 5495 - DNA, 71 bp, chicken (Gallus Gallus)
  misc_feature (36): n=g or t
tctagatgtgactcttgcagctcatttcagttatanaaaatttggcttttattatcatttagccaatggca

SEQ ID NO: 5496 - DNA, 71 bp, chicken (Gallus Gallus)
  misc_feature (36): n=g or t
tgcctcaccctgagcacagcacgactgaaagcattncagagaactaaaaatctccagggcaaggtttaagt

SEQ ID NO: 5497 - DNA, 71 bp, chicken (Gallus Gallus)
  misc_feature (36): n=a or g
ctgagtttaaagaagccaaataacgtgatgtcttgntagaatcctgtgagtatatattcatggaaaataaa

SEQ ID NO: 5498 - DNA, 71 bp, chicken (Gallus Gallus)
  misc_feature (36): n=a or g
ttcaaaaagtctaattattttaagggccaaaggatnaaacttctgtgagaacaaatagtctaatcttttac

SEQ ID NO: 5499 - DNA, 71 bp, chicken (Gallus Gallus)
  misc_feature (36): n=a or g
tgcacagcattcctggtgcagcaatgagtgcttacngggtaagctgatattggggcaacatttgtggaata

SEQ ID NO: 5500 - DNA, 71 bp, chicken (Gallus Gallus)
  misc_feature (36): n=c or t
ggttgctttattgctgaatatcctatatattccatnaggaaactttgaatagtttagctgagtttgtgttg

SEQ ID NO: 5501 - DNA, 71 bp, chicken (Gallus Gallus)
  misc_feature (36): n=c or t
tcagaatagtgattctagaaaaaagttttcttaaanttcagtctttacttttcaaagagatttccatttca

SEQ ID NO: 5502 - DNA, 71 bp, chicken (Gallus Gallus)
  misc_feature (36): n=a or g
cagacaaaagagtgctttgtagcacacatagttacntatgtcagatagtttcattagcataaagggtttgg

SEQ ID NO: 5503 - DNA, 71 bp, chicken (Gallus Gallus)
  misc_feature (36): n=a or c
caaagggcagctgattgcagctggcacataatcttnggatcactaataaagcagcagtattagactcaatt

SEQ ID NO: 5504 - DNA, 71 bp, chicken (Gallus Gallus)
  misc_feature (36): n=c or t
caggagggttatatttctgaagcagaactggaaacnaaatgaataattcagttgaagttgctctagaacag

SEQ ID NO: 5505 - DNA, 71 bp, chicken (Gallus Gallus)
  misc_feature (36): n=a or g
tgtgatggaagggaagaggaagccatctctatgctngtcttgatttaatagaactttcttctcaagcaatc

SEQ ID NO: 5506 - DNA, 71 bp, chicken (Gallus Gallus)
  misc_feature (36): n=a or g
agtgaatgggagccatgaacataagagtatatatcnagacattgtctagagctaataaagagtcttagaat

SEQ ID NO: 5507 - DNA, 71 bp, chicken (Gallus Gallus)
  misc_feature (36): n=a or g
gatcagttcacaagaaacaatgggctgaaattggcntggaaaaacatattggtagaagaaagcatttagtt

SEQ ID NO: 5508 - DNA, 71 bp, chicken (Gallus Gallus)
  misc_feature (36): n=a or g
tactttaactcagcagcctccctgtagacatcaggnttaatgctgaaccctgctgtctgcctctatcattt

SEQ ID NO: 5509 - DNA, 71 bp, chicken (Gallus Gallus)
  misc_feature (36): n=a or g
aattaaacatggcaattcttcctccagctatgctcngccctttcttttaaccacatcttccttttctgtcc

SEQ ID NO: 5510 - DNA, 71 bp, chicken (Gallus Gallus)
  misc_feature (36): n=a or t
ttcaattgagagaaatgttttacttacagtttatgngttggctgttcattcggagtcagaattcctacttc

SEQ ID NO: 5511 - DNA, 71 bp, chicken (Gallus Gallus)
  misc_feature (36): n=c or t
ttttactcagagctactcagtatccctgctgtgaanatttttcaagagactgagatctcctccacggtgag

SEQ ID NO: 5512 - DNA, 71 bp, chicken (Gallus Gallus)
  misc_feature (36): n=c or t
aaacatttctatttttgaaggtcaggcctcagtggntgggatggtatgattaaaacaaatccagtttcatt

SEQ ID NO: 5513 - DNA, 71 bp, chicken (Gallus Gallus)
  misc_feature (36): n=c or t
tccaagctcagctgagcgtttcccattagcacactngaaattttcagtgtcaccaagtcaacgggaattct

SEQ ID NO: 5514 - DNA, 71 bp, chicken (Gallus Gallus)
  misc_feature (36): n=a or g
gagaaactaaacaccttgcaaaatgataatgctgcnacactgaagcttatcttttagaacatttgggtgtc

SEQ ID NO: 5515 - DNA, 71 bp, chicken (Gallus Gallus)
  misc_feature (36): n=c or t
aaacagaaagaaaaactctggctgcaccctttagangttattcatgcccagagaaattaaaataggcaaca

SEQ ID NO: 5516 - DNA, 71 bp, chicken (Gallus Gallus)
  misc_feature (36): n=c or t
tagctcttgaggtggtaagagacagtgagctcatanagtgagtttatggtaaagactatagctttaaggag

SEQ ID NO: 5517 - DNA, 71 bp, chicken (Gallus Gallus)
  misc_feature (36): n=a or c
taaggtgaagaagtgtttgaaaagccttgcaatccngtactaagagaaggaatcagctggttacctgagtg

SEQ ID NO: 5518 - DNA, 71 bp, chicken (Gallus Gallus)
  misc_feature (36): n=c or t
ataacaagtgagactgtcttctgaatccgtgttatntatcaagtttggactgaagggcactgattttaaat

SEQ ID NO: 5519 - DNA, 71 bp, chicken (Gallus Gallus)
  misc_feature (36): n=a or g
ggcaaggcaccacttcttccttgctaaatttctctntctcacaaacaaaacctacaaactacatcacttac

SEQ ID NO: 5520 - DNA, 71 bp, chicken (Gallus Gallus)
  misc_feature (36): n=c or t
ttccctgatctttcagtcctggcgaagaaaaggacntggaaatgttatctaaggggcctgtcagagtgggg

SEQ ID NO: 5521 - DNA, 71 bp, chicken (Gallus Gallus)
  misc_feature (36): n=c or t
gaggaaataaaatgacagctattttgtcttcatctnactttgtctcatttatttatttatttgtatgtgtt

SEQ ID NO: 5522 - DNA, 71 bp, chicken (Gallus Gallus)
  misc_feature (36): n=a or g
gtaaactcagactctggtctgctcatcactttgggntttagaaatggtctttagtaacatccattgtagtt

SEQ ID NO: 5523 - DNA, 71 bp, chicken (Gallus Gallus)
  misc_feature (36): n=c or g
tctgccccttaaatttaaggcaagaactgtacccangaatagcactatctggcaggacttgtcctcaaaca

SEQ ID NO: 5524 - DNA, 71 bp, chicken (Gallus Gallus)
  misc_feature (36): n=c or t
agacacttccacatttattagtgacctatagctttntgaatttcaaaagtaatggcattaactacatacac

SEQ ID NO: 5525 - DNA, 71 bp, chicken (Gallus Gallus)
  misc_feature (36): n=a or g
atctaaaatccaatttgagcattaatccctaagcantgaaatgcagtgacagcacacttcagttgcagtga

SEQ ID NO: 5526 - DNA, 71 bp, chicken (Gallus Gallus)
  misc_feature (36): n=a or t
cagaacaagccatttgagagactctggaaattctcncagcatacccatggggtggcagcatctcctttcag

SEQ ID NO: 5527 - DNA, 71 bp, chicken (Gallus Gallus)
  misc_feature (36): n=g or t
gagattttagatagttttggagtagagtttaaggantttttcactcaggtgcatgtggattgaatttaagg

SEQ ID NO: 5528 - DNA, 71 bp, chicken (Gallus Gallus)
  misc_feature (36): n=a or g
cagctcgaggcttacaggatcttcagtctcattcanaagaaccaataagtactttcatttgaaaataggtc

SEQ ID NO: 5529 - DNA, 71 bp, chicken (Gallus Gallus)
  misc_feature (36): n=c or t
ttgtggaatgtggattttatttaaaaatgagccacnactgaattaccatcattgttcctaaagaaatgtca

SEQ ID NO: 5530 - DNA, 71 bp, chicken (Gallus Gallus)
  misc_feature (36): n=g or t
gttaatccttactcagagggtgttgggatctttttnccaaatcaaaataacatctcttaattgctgtttac

SEQ ID NO: 5531 - DNA, 71 bp, chicken (Gallus Gallus)
  misc_feature (36): n=a or g
gggggaactaagctggataaggaggagatgttttcntgcagagacagcaggaaatggggagggttgggttt

SEQ ID NO: 5532 - DNA, 71 bp, chicken (Gallus Gallus)
  misc_feature (36): n=c or g
gccattcttcacccacttatacccttttaatatcantggagttcttgagtatcaatcacttcaaacacaaa

SEQ ID NO: 5533 - DNA, 71 bp, chicken (Gallus Gallus)
  misc_feature (36): n=c or t
agaataagtaacatgtctgaaatgtctcctctacantgacaatggtcctgattaataattaatagtaactc

SEQ ID NO: 5534 - DNA, 71 bp, chicken (Gallus Gallus)
  misc_feature (36): n=c or t
tctgctgtgtaagcttttaagcacgtacagaagttnggttgcagcacaggagccaatagtaatcaattgtc

SEQ ID NO: 5535 - DNA, 71 bp, chicken (Gallus Gallus)
  misc_feature (36): n=c or t
tggtttctcagtgcacctcctttccttccccgactnctgaggtagctcatgattcatgtctgttaacactg

SEQ ID NO: 5536 - DNA, 71 bp, chicken (Gallus Gallus)
  misc_feature (36): n=g or t
gacaaagagggaagcttaacacagcttatttggggncagaataggaatgtcattttgtcttgaattctcag

SEQ ID NO: 5537 - DNA, 71 bp, chicken (Gallus Gallus)
  misc_feature (36): n=a or g
caacatagtctttgtttatcattttgaagatcctgntctctggcatacatggaattttcaggaggatttga

SEQ ID NO: 5538 - DNA, 71 bp, chicken (Gallus Gallus)
  misc_feature (36): n=a or c
aaaaataatttgaacttcacttgcctgtgctcgtantgggctcttagatatacctattagtaggtttactg

SEQ ID NO: 5539 - DNA, 71 bp, chicken (Gallus Gallus)
  misc_feature (36): n=c or t
ctccttagctggatgtgcagtcagaggtcattgaangggttaattgcctgcacttaccttttaaagcagag

SEQ ID NO: 5540 - DNA, 71 bp, chicken (Gallus Gallus)
  misc_feature (36): n=c or t
aggaaacctggttctattcagagcgtaacttttccnagctcaggtttaggatacttgcaaggatttagcat

SEQ ID NO: 5541 - DNA, 71 bp, chicken (Gallus Gallus)
  misc_feature (36): n=c or t
tttttcctttttcttggcgtgagccctgaatgcagngttcttcccggagctgcccatgtagctgctgtgct

SEQ ID NO: 5542 - DNA, 71 bp, chicken (Gallus Gallus)
  misc_feature (36): n=a or g
cagcatagacttggacatctccctgttagttcctgnttagaagtacaaattagaagttagagacctgaatc

SEQ ID NO: 5543 - DNA, 71 bp, chicken (Gallus Gallus)
  misc_feature (36): n=c or t
tacaaggttatgtacatgtaagttgtgcacaagggntgcagttattaatatagctagtgataactgataat

SEQ ID NO: 5544 - DNA, 71 bp, chicken (Gallus Gallus)
  misc_feature (36): n=c or t
agactttggggaaaagaaagtcattcttcatttttnagtatatgtccaccttgacattcacttggcttctt

SEQ ID NO: 5545 - DNA, 71 bp, chicken (Gallus Gallus)
  misc_feature (36): n=c or t
ctgatttacctgtgatcttttgagatgagcagttantatcacacattacttttcaaacagaatactttgtg

SEQ ID NO: 5546 - DNA, 71 bp, chicken (Gallus Gallus)
  misc_feature (36): n=c or t
tgtaacacttccaaaaaaaaaaaaagaaaaaggaanctgggtcattgccaaagaacacatttcaggcagtt

SEQ ID NO: 5547 - DNA, 71 bp, chicken (Gallus Gallus)
  misc_feature (36): n=a or g
gtcctaggactacaacttccacattcaacactgttnagactgctactggcttccaatttttccttttcagt

SEQ ID NO: 5548 - DNA, 71 bp, chicken (Gallus Gallus)
  misc_feature (36): n=c or t
tatacatgtattctgattcatctgtcctactgaagngttccagtaggttttcccttgtaaatgtgctcttg

SEQ ID NO: 5549 - DNA, 71 bp, chicken (Gallus Gallus)
  misc_feature (36): n=a or g
ttaatatattctattaccaagtgtaactaccatgtncacgaatatatctataaaacagaagtcctatttgc

SEQ ID NO: 5550 - DNA, 71 bp, chicken (Gallus Gallus)
  misc_feature (36): n=a or g
acttctgatggtaaatctggcaattctgggcatgtnagagaaaggcacttccttcttgctctgttaataat

SEQ ID NO: 5551 - DNA, 71 bp, chicken (Gallus Gallus)
  misc_feature (36): n=a or g
tcttcttactgtgcttttcattaattcagacaaccngtctgtcatgtagctgttatatatgcatgaagatt

SEQ ID NO: 5552 - DNA, 71 bp, chicken (Gallus Gallus)
  misc_feature (36): n=a or c
ttggtgtctatgctttaaccatacgtgaacactttnttttggatttactttagtatttcaatattttttcc

SEQ ID NO: 5553 - DNA, 71 bp, chicken (Gallus Gallus)
  misc_feature (36): n=c or t
aatcctcaaaaaaaaatggccttcaaagtcattaangtagatgcatcaaagctttgcaactaagaacaaaa

SEQ ID NO: 5554 - DNA, 71 bp, chicken (Gallus Gallus)
  misc_feature (36): n=c or t
accagcaccacaaggacagaattaagtttactcccntggttagaagtcagcaacacatatacgcgcagaat

SEQ ID NO: 5555 - DNA, 71 bp, chicken (Gallus Gallus)
  misc_feature (36): n=c or t
atccagctggacatcaccaccaagcattcagttccngttctctaaatatgaggctgtgcatacaagaaact

SEQ ID NO: 5556 - DNA, 71 bp, chicken (Gallus Gallus)
  misc_feature (36): n=g or t
agggcagggagaaaaggttttgacgggaccctgccngggatagaaggtccacgtccatgaacttataggca

SEQ ID NO: 5557 - DNA, 71 bp, chicken (Gallus Gallus)
  misc_feature (36): n=g or t
taagaaatactgttttctctatttcagtagatctgnctgcaatgaacaaaaccatcaaagtgttggtaatg

SEQ ID NO: 5558 - DNA, 71 bp, chicken (Gallus Gallus)
  misc_feature (36): n=c or t
gaagaagaaattaaatttcgccatgactggaaaatnactttagtttgaattccattaggatttttacatgt

SEQ ID NO: 5559 - DNA, 71 bp, chicken (Gallus Gallus)
  misc_feature (36): n=a or g
actgaatttacacatctgctttcagaacctgtcatnggctacagaggttacagagcatcaggtaaactcat

SEQ ID NO: 5560 - DNA, 71 bp, chicken (Gallus Gallus)
  misc_feature (36): n=g or t
catcatttctccacaggtgtcagaaaagttgtcccnagtgggacactgtggcaaaaattgaaactgtttca

SEQ ID NO: 5561 - DNA, 71 bp, chicken (Gallus Gallus)
  misc_feature (36): n=c or t
actccttcattttcttaatctagtaatagcaaaaantccaacagctgctatacaaagacgtattcctcaac

SEQ ID NO: 5562 - DNA, 71 bp, chicken (Gallus Gallus)
  misc_feature (36): n=a or g
caggtagttcagatgtacccgtttgtcatcctcacncgtcctcttgcagttcaaaagctacctagttatgc

SEQ ID NO: 5563 - DNA, 71 bp, chicken (Gallus Gallus)
  misc_feature (36): n=a or g
tgggtctcacgctgtgtcctttgccttgcagagaancctggcacctgcccgtccgtgaagccagggatccc

SEQ ID NO: 5564 - DNA, 71 bp, chicken (Gallus Gallus)
  misc_feature (36): n=a or c
aaggtcagctgtcatcactttcctggaaagcatcancatacagaggagaaaaacagcacgggaatcgtggc

SEQ ID NO: 5565 - DNA, 71 bp, chicken (Gallus Gallus)
  misc_feature (36): n=g or t
ttgtgacccaaagcaaattttattgcaggagggaangagtttatataatatatgcatcttttcattgtata

SEQ ID NO: 5566 - DNA, 71 bp, chicken (Gallus Gallus)
  misc_feature (36): n=a or c
ctttagggtaatatctataaatactaatgcaatgcnttaaaatttatctgaatggttccacagcaagactg

SEQ ID NO: 5567 - DNA, 71 bp, chicken (Gallus Gallus)
  misc_feature (36): n=c or t
tttacccaagctaccagctgagatctggagttgtancagttataagaagttagaagcaacagattatgcat

SEQ ID NO: 5568 - DNA, 71 bp, chicken (Gallus Gallus)
  misc_feature (36): n=c or t
ttttgcctggttttctgcaaacagcagatcagtgcnctgtgacagccaaaagataagtaggacattaaaaa

SEQ ID NO: 5569 - DNA, 71 bp, chicken (Gallus Gallus)
  misc_feature (36): n=a or g
agtaggagactaattagtctcagaggggaaaactcnccatactagatggtagttagtcttggtgaatagtt

SEQ ID NO: 5570 - DNA, 71 bp, chicken (Gallus Gallus)
  misc_feature (36): n=c or t
attccttgcttcctgaagggaagaaagtgatctgcnacaggaaaatcaagttagcaaggtgacctatctgt

SEQ ID NO: 5571 - DNA, 71 bp, chicken (Gallus Gallus)
  misc_feature (36): n=a or g
ggtcccacatgaaaacaggtgagtgactaagctgtnctgccagtggaaaggtgcagacctcagcctcctga

SEQ ID NO: 5572 - DNA, 71 bp, chicken (Gallus Gallus)
  misc_feature (36): n=c or t
atgcaaacgtgtttcaaatcttgattttaagaaaanagcttcctcccaagaagcagctatagttagcttcc

SEQ ID NO: 5573 - DNA, 71 bp, chicken (Gallus Gallus)
  misc_feature (36): n=a or c
cttcagagtcataacgtgcctctcaggtaaacatgntaactgtcatctttgggaattgaattgtgaggttt

SEQ ID NO: 5574 - DNA, 71 bp, chicken (Gallus Gallus)
  misc_feature (36): n=a or g
ggctgattgaaccaagagaaacatttctcaggcacnattctccagcagcaagggccatttgagcattatct

SEQ ID NO: 5575 - DNA, 71 bp, chicken (Gallus Gallus)
  misc_feature (36): n=g or t
agataactttccatctctgccctctttttcctattnctgtgctaatcaatctttattccacaactgatgtg

SEQ ID NO: 5576 - DNA, 71 bp, chicken (Gallus Gallus)
  misc_feature (36): n=a or g
atcacagacgttctgctcaccccttcaggtcaatgnctggcagtgctactctcttcatgaacagctgtgga

SEQ ID NO: 5577 - DNA, 71 bp, chicken (Gallus Gallus)
  misc_feature (36): n=a or c
cccgttgctatgtctccacatgcatgtaggtgctcnggtttttgaatttaggtcttactggctcagcctac

SEQ ID NO: 5578 - DNA, 71 bp, chicken (Gallus Gallus)
  misc_feature (36): n=c or t
acatttcctcatgtttttcagcagacaatccagagnggttcatacattcagcagactcagagaacagcttc

SEQ ID NO: 5579 - DNA, 71 bp, chicken (Gallus Gallus)
  misc_feature (36): n=a or g
atgtatacgtacatccctgtgccctgatgagatgcntccacaactgaaggagttggcaggtgtgattgcaa

SEQ ID NO: 5580 - DNA, 71 bp, chicken (Gallus Gallus)
  misc_feature (36): n=a or c
tcacctgcctcacagccactgcttcaagctgtttgnaagatcagatcaatctgctgagcacaattcacaac

SEQ ID NO: 5581 - DNA, 71 bp, chicken (Gallus Gallus)
  misc_feature (36): n=c or t
ggctgatttcttggcagttgaggtctcttggaaatnagactgtgagactgtatgcaccaattttttcagta

SEQ ID NO: 5582 - DNA, 71 bp, chicken (Gallus Gallus)
  misc_feature (36): n=c or t
aagtgtatcagctcagtttaatagtaaaacctgaanctggtacttatggtattacaataccactttgaagg

SEQ ID NO: 5583 - DNA, 71 bp, chicken (Gallus Gallus)
  misc_feature (36): n=a or g
tctcattgaaagactttgggacaaacttaaggatanataagttctggcctggaggacctgcagcattttta

SEQ ID NO: 5584 - DNA, 71 bp, chicken (Gallus Gallus)
  misc_feature (36): n=g or t
ttgtgatgtctcagagaaaaacactgggcatgacanaaaggcaaggtctcctgtaaataaccaacaaccac

SEQ ID NO: 5585 - DNA, 71 bp, chicken (Gallus Gallus)
  misc_feature (36): n=g or t
ctctaatagggtactataccactgagaagcccagangttccagtattaaaaagggaaatgaaccatcctaa

SEQ ID NO: 5586 - DNA, 71 bp, chicken (Gallus Gallus)
  misc_feature (36): n=a or c
tggagaaaaagaagttctgacatagcccttggaaangggagctgtttcagaggagacaagcttctctggat

SEQ ID NO: 5587 - DNA, 71 bp, chicken (Gallus Gallus)
  misc_feature (36): n=c or t
catctttcagctataagtgctctgccacaacacgangagagttcctccaagcagagatggggttggagttc

SEQ ID NO: 5588 - DNA, 71 bp, chicken (Gallus Gallus)
  misc_feature (36): n=g or t
tagttttaggacaaggggggttggtcttaaactganacaggggaggtttaggttagatattaggaagaagt

SEQ ID NO: 5589 - DNA, 71 bp, chicken (Gallus Gallus)
  misc_feature (36): n=a or c
tcagcaaaaacttattttagaatctgaaaagagagnaagttaaagcatttggcggtacaatctgttactta

SEQ ID NO: 5590 - DNA, 71 bp, chicken (Gallus Gallus)
  misc_feature (36): n=a or g
aagtatactaaaaaagaaataaatctcaaacttacnaggtttttgtaatttctgtgaagttactttattaa

SEQ ID NO: 5591 - DNA, 71 bp, chicken (Gallus Gallus)
  misc_feature (36): n=c or t
ttgcagctcggagtatgtgataaggcagatgatacntatctgtcatgtgactgttgcaagtcagaccacag

SEQ ID NO: 5592 - DNA, 71 bp, chicken (Gallus Gallus)
  misc_feature (36): n=a or g
cctgctgcaaggaagcttttgcagtcagtccttccntgtactttacccaacaatccatagcagactgctcc

SEQ ID NO: 5593 - DNA, 71 bp, chicken (Gallus Gallus)
  misc_feature (36): n=a or c
tattgctctttcttttgtggagaacttgtagttctntctcttctcctcagggctttgcaatggactatctg

SEQ ID NO: 5594 - DNA, 71 bp, chicken (Gallus Gallus)
  misc_feature (36): n=a or g
gtcacctgcctgataagtattgcaaaactgaactgncaaagctgcccgagattagcataacccttgtgcac

SEQ ID NO: 5595 - DNA, 71 bp, chicken (Gallus Gallus)
  misc_feature (36): n=c or t
cagctctgcccggaggtttccaaaagctggaatganattgacaaaaaaagacaaaaagttgtactatcgag

SEQ ID NO: 5596 - DNA, 71 bp, chicken (Gallus Gallus)
  misc_feature (36): n=c or t
ttgctgctctgggccaggcaatgcttttcaccaccnagcctgcatctaagaaatgcctcaacttctttgag

SEQ ID NO: 5597 - DNA, 71 bp, chicken (Gallus Gallus)
  misc_feature (36): n=c or t
ttaatgcagacacaaacaaagctcttcatagggaanacaggaggaattggcaggcagttgcagccacaagg

SEQ ID NO: 5598 - DNA, 71 bp, chicken (Gallus Gallus)
  misc_feature (36): n=g or t
gcaccttgtgtggcatattctggggacaaaaccaangctcttctaaggtggaatcaggaagtgtcactggc

SEQ ID NO: 5599 - DNA, 71 bp, chicken (Gallus Gallus)
  misc_feature (36): n=a or g
ttggaagcagtattttgtcctgtttggaaaaggtcntgtgggctaaggcaaaattagatttgatttgtttt

SEQ ID NO: 5600 - DNA, 71 bp, chicken (Gallus Gallus)
  misc_feature (36): n=a or g
acagagcacgtacagatctatagatggctcagtgcnatacggagaatctctgctgagaaccctttgtgtat

SEQ ID NO: 5601 - DNA, 71 bp, chicken (Gallus Gallus)
  misc_feature (36): n=c or t
ttgcatgaagcaccaggagctcaggtacttaatggngtcgaagatggtttttagtgtgtgaggttacgctg

SEQ ID NO: 5602 - DNA, 71 bp, chicken (Gallus Gallus)
  misc_feature (36): n=c or t
caccacgtgcacttagatcagtaagttcagaaatantggctaagtttatcatgtgaggctctcatccatcg

SEQ ID NO: 5603 - DNA, 71 bp, chicken (Gallus Gallus)
  misc_feature (36): n=a or c
agaaaacataagtaaaactcttaacaaaggaggcanataacccataacagctgcttactgatttaagtcat

SEQ ID NO: 5604 - DNA, 71 bp, chicken (Gallus Gallus)
  misc_feature (36): n=c or t
ctgcagccaccctggcataatccctgatcagagagnagcagggacatactgggagctctttcatcccagcc

SEQ ID NO: 5605 - DNA, 71 bp, chicken (Gallus Gallus)
  misc_feature (36): n=a or t
agaagccatccacgcaccttcccttgtgctgcatanacccaatataatatgtcgtgtttcctcctacaggg

SEQ ID NO: 5606 - DNA, 71 bp, chicken (Gallus Gallus)
  misc_feature (36): n=a or g
cttataacccacccaggcatcatcaccatggctacngctgcacttgacagacactacttcggttcatgtct

SEQ ID NO: 5607 - DNA, 71 bp, chicken (Gallus Gallus)
  misc_feature (36): n=a or c
gtgttgaggcccatcttgacaggtagctagaagtcncaggaatttgcttggtttgcattaattacaaatca

SEQ ID NO: 5608 - DNA, 71 bp, chicken (Gallus Gallus)
  misc_feature (36): n=c or t
tcaagattctcaagtccaactccaaagtccaactgncaagctcaaccattcattagaagctgacagatgaa

SEQ ID NO: 5609 - DNA, 71 bp, chicken (Gallus Gallus)
  misc_feature (36): n=a or g
cagactcagcagcaggcatttctcttgcagcaacancacgtaacagagtgctttattttgccaaatgcaaa

SEQ ID NO: 5610 - DNA, 71 bp, chicken (Gallus Gallus)
  misc_feature (36): n=c or t
aaccattctgtgattcaagcaagcaagcagtattcntacactgaggacaatgtttggaacaagtggaatgc

SEQ ID NO: 5611 - DNA, 71 bp, chicken (Gallus Gallus)
  misc_feature (36): n=g or t
gttcctgaaaacgcacagaattgtttcctaaagatncagaggagctatgatgaaccttaatgacaagaata

SEQ ID NO: 5612 - DNA, 71 bp, chicken (Gallus Gallus)
  misc_feature (36): n=a or g
caacaaaaaaaggaacaactccatgaaagatgtctntgtgcactttcatcatttcagcttgttagttctaa

SEQ ID NO: 5613 - DNA, 71 bp, chicken (Gallus Gallus)
  misc_feature (36): n=a or g
cccgcttagctttctcttctccaggctgaacagccncatgtctctcagtctttgttcataagggagatggc

SEQ ID NO: 5614 - DNA, 71 bp, chicken (Gallus Gallus)
  misc_feature (36): n=a or g
gaagcccaacacatcaaaatatgtaagtagttaatncaatttcatcagaatcgtctgaggcttggtggaag

SEQ ID NO: 5615 - DNA, 71 bp, chicken (Gallus Gallus)
  misc_feature (36): n=a or g
gaacagagcctagattatatacttgcttgtgcagcnaaaagaatatttttcacctggggtttttttggttt

SEQ ID NO: 5616 - DNA, 71 bp, chicken (Gallus Gallus)
  misc_feature (36): n=a or g
aactgaatctcattttcattgcctcatttatctttnaaagtcctaccagcgtccttcccataactaagcag

SEQ ID NO: 5617 - DNA, 71 bp, chicken (Gallus Gallus)
  misc_feature (36): n=c or t
tagatcccagagcccaaacatagcagtgttagcatncatttcactctttcataaaaagaggaattctgaac

SEQ ID NO: 5618 - DNA, 71 bp, chicken (Gallus Gallus)
  misc_feature (36): n=a or c
tgatgttcctgcagtattggaatactaaggactagngaaatgttgtcatactttttaatcagggtgaaagt

SEQ ID NO: 5619 - DNA, 71 bp, chicken (Gallus Gallus)
  misc_feature (36): n=a or g
acaatcagtctttcaagcactgaaaacttctgtggntgaaaaaagaggctttttaaaaacctgtaacatca

SEQ ID NO: 5620 - DNA, 71 bp, chicken (Gallus Gallus)
  misc_feature (36): n=a or g
gatgagcaagctctttagaaatgagaatgagaaacnaactataaaaagaacaaaaacatgaatgctaagaa

SEQ ID NO: 5621 - DNA, 71 bp, chicken (Gallus Gallus)
  misc_feature (36): n=g or t
cacaaagctattcatttgaccacttacagtatgaangatcatccttctgcagttattgggtggggaaagaa

SEQ ID NO: 5622 - DNA, 71 bp, chicken (Gallus Gallus)
  misc_feature (36): n=a or g
aggcatgtgctcctcagcacacagctgaacaccacnctttctcctgttacgtgatcccaacgtacttggca

SEQ ID NO: 5623 - DNA, 71 bp, chicken (Gallus Gallus)
  misc_feature (36): n=a or g
acagagagattaataataaagaaatgctcaccgatngcccccattccttatgtattaccaaataaaaagag

SEQ ID NO: 5624 - DNA, 71 bp, chicken (Gallus Gallus)
  misc_feature (36): n=c or t
agctcgaaggttgctttgcatttctgagatcctgtngttgtgaagagaggtgtgtatcgtgcaaagttttt

SEQ ID NO: 5625 - DNA, 71 bp, chicken (Gallus Gallus)
  misc_feature (36): n=a or g
actactgcagcactgaagctatgattttagcatccnagagttttgtcctatgcttatggtagcggagtttt

SEQ ID NO: 5626 - DNA, 71 bp, chicken (Gallus Gallus)
  misc_feature (36): n=c or t
ccccatgttaatctacaagataccttgtgggtctgnaagtacaaccacagctccctaaccacctgttagaa

SEQ ID NO: 5627 - DNA, 71 bp, chicken (Gallus Gallus)
  misc_feature (36): n=c or t
ctagaatgactcaatgaaggaagatcagcaagatcntcatgccctgactgaagtacagtgggtgttctgta

SEQ ID NO: 5628 - DNA, 71 bp, chicken (Gallus Gallus)
  misc_feature (36): n=c or t
caatgttgatgctatcacaaaactggttttcagaangctgtgacaagaaagctgttggaattaatttcgga

SEQ ID NO: 5629 - DNA, 71 bp, chicken (Gallus Gallus)
  misc_feature (36): n=a or g
tttccccttttgctacagctggttgggacatgttcntaccttgcagtgagagccttgagagaaaaaaaaat

SEQ ID NO: 5630 - DNA, 71 bp, chicken (Gallus Gallus)
  misc_feature (36): n=a or g
ttacccttagtctccctgttgcttccaccatcatanttctgctgtcctacaacatgtggaccagcaggctt

SEQ ID NO: 5631 - DNA, 71 bp, chicken (Gallus Gallus)
  misc_feature (36): n=a or g
aagcgtaacatacaaatgtacagataggtcattaanggatcccttctttctcctcatacaaattgcctttt

SEQ ID NO: 5632 - DNA, 71 bp, chicken (Gallus Gallus)
  misc_feature (36): n=a or g
catctttctctctgtctttcatcttttatgaatcanttcaaagcccaggaaagcacttaaagaggtttcca

SEQ ID NO: 5633 - DNA, 71 bp, chicken (Gallus Gallus)
  misc_feature (36): n=a or g
atgtctaacacttcacctggacataagatagttctncacaatgttatttcacatgcagttctgtggaagac

SEQ ID NO: 5634 - DNA, 71 bp, chicken (Gallus Gallus)
  misc_feature (36): n=a or c
ccctaccacttcactgatgatatgtggttgggttantgtgatcacaggtagcaaaaaaaagtaataagaat

SEQ ID NO: 5635 - DNA, 71 bp, chicken (Gallus Gallus)
  misc_feature (36): n=a or g
agttcctttccaccagtgagttttgccttgaattcntgtggaaatgtgtaatgggaaaggaaagaaatgga

SEQ ID NO: 5636 - DNA, 71 bp, chicken (Gallus Gallus)
  misc_feature (36): n=a or t
atgaaaaacagcttttgggtagattgtttgtttgtntataaagcaactttcattgctttcctagcccttaa

SEQ ID NO: 5637 - DNA, 71 bp, chicken (Gallus Gallus)
  misc_feature (36): n=c or g
tcaaaatgaagatacagtagatctccggttcacctngtgtaacattagcggtcactgcagactccaccatc

SEQ ID NO: 5638 - DNA, 71 bp, chicken (Gallus Gallus)
  misc_feature (36): n=g or t
ctgctacctagtctgtgctactgaactattcagacngctccttcaataggcacgaaatacttaagtgaaca

SEQ ID NO: 5639 - DNA, 71 bp, chicken (Gallus Gallus)
  misc_feature (36): n=a or g
tatagtctcaaaggtgacttacagtgctgaccattnctaagatccccaatattctagtaaaagatagaatt

SEQ ID NO: 5640 - DNA, 71 bp, chicken (Gallus Gallus)
  misc_feature (36): n=c or t
aggctactgagcagactgtcagttcactgactttanaggttgtgttgccaaacccagagttggaagtcctt

SEQ ID NO: 5641 - DNA, 71 bp, chicken (Gallus Gallus)
  misc_feature (36): n=c or t
tttcattactgatattgaacccttggttttggttgnaacctttgcttttttggttttaacacgcatctctt

SEQ ID NO: 5642 - DNA, 71 bp, chicken (Gallus Gallus)
  misc_feature (36): n=a or g
tggttacgttaaaagaacaagctgtcagactgccanggagaagggcactatgggtgctgtgtagtaaaggc

SEQ ID NO: 5643 - DNA, 71 bp, chicken (Gallus Gallus)
  misc_feature (36): n=g or t
tggaataataaaaatggtaggccacattacctcagnggtctaactaaacacagagcacacatgggcagcta

SEQ ID NO: 5644 - DNA, 71 bp, chicken (Gallus Gallus)
  misc_feature (36): n=a or g
actgaatagaaagtgttccattgctccacaaaatangagtctggcaccaggttagcatgttctcatctcca

SEQ ID NO: 5645 - DNA, 71 bp, chicken (Gallus Gallus)
  misc_feature (36): n=a or g
ccctaaaaacaggatgtaagctcagaaacagccacnaggtaccaaaaaggcaaaagatgatgagggcacaa

SEQ ID NO: 5646 - DNA, 71 bp, chicken (Gallus Gallus)
  misc_feature (36): n=a or g
ctgagaatgtgagattgaactctctctctccttaanagaatgagggggagaatgaactttctgatataatc

SEQ ID NO: 5647 - DNA, 71 bp, chicken (Gallus Gallus)
  misc_feature (36): n=a or g
ctttgataaccagcagatgaataacttacatccccnttttgtcaggctaatacttaacgggaatgaacaga

SEQ ID NO: 5648 - DNA, 71 bp, chicken (Gallus Gallus)
  misc_feature (36): n=c or t
aatatgaagtctaagtcttgctaccaacttgtcccnaacctccactcaaagctaaagtaataaagcaaact

SEQ ID NO: 5649 - DNA, 71 bp, chicken (Gallus Gallus)
  misc_feature (36): n=c or t
attatgatcggtcattttagagttactacttgtaanggaagcgaatttgtctgtgcctgctaatcttgcat

SEQ ID NO: 5650 - DNA, 71 bp, chicken (Gallus Gallus)
  misc_feature (36): n=c or t
ttttcaacaggaggaatcaagagaacctcatcccancagatgttgttaaaaaagtgactagtttgcaatga

SEQ ID NO: 5651 - DNA, 71 bp, chicken (Gallus Gallus)
  misc_feature (36): n=a or g
ttccagtcagttaaaacagaagactattgcatcatnaagccacagtcaaataaatatcaaacttgctatta

SEQ ID NO: 5652 - DNA, 71 bp, chicken (Gallus Gallus)
  misc_feature (36): n=c or t
taacttctatgttctgcagaagtagggagctggcangacttgctcagtgcccttgagacacgccgtgtctg

SEQ ID NO: 5653 - DNA, 71 bp, chicken (Gallus Gallus)
  misc_feature (36): n=a or g
agctagtaatagtttgcatttcaagaacagcattantcacacagcttgacataatatcgtcagttttgaga

SEQ ID NO: 5654 - DNA, 71 bp, chicken (Gallus Gallus)
  misc_feature (36): n=c or t
aaggactcaaacgaatctacttttactccacagganggatttggaattccaataccaacagaaaaactgct

SEQ ID NO: 5655 - DNA, 71 bp, chicken (Gallus Gallus)
  misc_feature (36): n=a or g
gtatttttatttgtagatatgggttattatttcacngcctatttatatacagtatttattctgtatatgta

SEQ ID NO: 5656 - DNA, 71 bp, chicken (Gallus Gallus)
  misc_feature (36): n=a or g
gcctggctccacactgcaccacccaaaccctatgtntgaaagtggtgtccacatgctctctgaactctggc

SEQ ID NO: 5657 - DNA, 71 bp, chicken (Gallus Gallus)
  misc_feature (36): n=a or c
aaaattactcatgttgctgcgtgagctatatatgtnatccatacagctttctccagatcatgatttatttt

SEQ ID NO: 5658 - DNA, 71 bp, chicken (Gallus Gallus)
  misc_feature (36): n=a or g
tcttatgtaagaattgtgtaggatagtacattctgngggcaagcttttatgggtattgcttctttggtgtg

SEQ ID NO: 5659 - DNA, 71 bp, chicken (Gallus Gallus)
  misc_feature (36): n=a or g
ggcataaggtcaagctcagcaacaggctacagtganctgaaggctttcaagggcccactgaacaaagtaca

SEQ ID NO: 5660 - DNA, 71 bp, chicken (Gallus Gallus)
  misc_feature (36): n=c or t
aggcaaggagaatgaagataaagtaaaacacagagntgaccagaacagcatgtgctatcatttgtggtttt

SEQ ID NO: 5661 - DNA, 71 bp, chicken (Gallus Gallus)
  misc_feature (36): n=c or t
ttttaaaacatgacagtgttgtactttattatgccngtgatggtaaaattagggtttatcatagagtcata

SEQ ID NO: 5662 - DNA, 71 bp, chicken (Gallus Gallus)
  misc_feature (36): n=c or t
ctgagagctttatgcatgttatggtaactgtaatantcaggaacttctacactgtgcttatacatgcaacg

SEQ ID NO: 5663 - DNA, 71 bp, chicken (Gallus Gallus)
  misc_feature (36): n=c or t
ttgggatcactgatccttacgagtctcttccaactngggatattctgtgatgctacaactctaacttcatg

SEQ ID NO: 5664 - DNA, 71 bp, chicken (Gallus Gallus)
  misc_feature (36): n=a or g
tcgacaaacaggttatgacatattcatatgcatgtncatatataatgattataaaacttaatttaattata

SEQ ID NO: 5665 - DNA, 71 bp, chicken (Gallus Gallus)
  misc_feature (36): n=a or g
gaagttgagcagtgtattcatttctacctctttccntgggtgtggaacaaaccaaacttgcttctgagtca

SEQ ID NO: 5666 - DNA, 71 bp, chicken (Gallus Gallus)
  misc_feature (36): n=c or t
agggttaggtggaagctcagctacctgcttttgctntgtaggagaggtttaagtagggtcaactagcggca

SEQ ID NO: 5667 - DNA, 71 bp, chicken (Gallus Gallus)
  misc_feature (36): n=c or t
tgcttgtgaaaaatcccttctggatgcttgtcactnctctgcttagcatttacctttggcacgtccttgac

SEQ ID NO: 5668 - DNA, 71 bp, chicken (Gallus Gallus)
  misc_feature (36): n=a or g
attctgttaagaaaatcagatgtactgaaatagaantaccaagaaaataaaaatgctactaccttaaaaaa

SEQ ID NO: 5669 - DNA, 71 bp, chicken (Gallus Gallus)
  misc_feature (36): n=a or g
gtcaatgagacaaaagctgtctcagttagcactggngtgtgcattcgatcgcttaacaaaaaagaaaggag

SEQ ID NO: 5670 - DNA, 71 bp, chicken (Gallus Gallus)
  misc_feature (36): n=g or t
gttgcttttccctgtctgtgatggatttcttctacnttagggtagaatgcatatgatgatacttgaattta

SEQ ID NO: 5671 - DNA, 71 bp, chicken (Gallus Gallus)
  misc_feature (36): n=c or t
gtatgaagcaacacacatcatttaagcagtgattantcactaagatgctactagggagcctgacctaggct

SEQ ID NO: 5672 - DNA, 71 bp, chicken (Gallus Gallus)
  misc_feature (36): n=a or g
tcttaatgattctatgattttatgaagctgagacgntatgagaggtgactgtaaaatgccatgcctcatgg

SEQ ID NO: 5673 - DNA, 71 bp, chicken (Gallus Gallus)
  misc_feature (36): n=c or t
cttgcccactcttcaaagttcatcttgaatactgcntttttgctgctgagtactgtgtgctgctcaaggat

SEQ ID NO: 5674 - DNA, 71 bp, chicken (Gallus Gallus)
  misc_feature (36): n=a or g
ggttcattacgatgcacccactaaactgagggagantattctgttatttttcactttgattacctgaatat

SEQ ID NO: 5675 - DNA, 71 bp, chicken (Gallus Gallus)
  misc_feature (36): n=c or t
atcagcagcaattaatctaagacctgaattacttcnacatcacttgttgtgtttggatgaaaggcagtaga

SEQ ID NO: 5676 - DNA, 71 bp, chicken (Gallus Gallus)
  misc_feature (36): n=g or t
caaacatactcatacaagacccaccaataaaggcantgagctgggtccagctgggatggaattagctttct

SEQ ID NO: 5677 - DNA, 71 bp, chicken (Gallus Gallus)
  misc_feature (36): n=c or t
gttgttctgctttgtttaaattgatttgtgtgctgntggcttccagtagtgcatagaaattgttttgtttt

SEQ ID NO: 5678 - DNA, 71 bp, chicken (Gallus Gallus)
  misc_feature (36): n=a or g
catcgcaatatgtacaaggcagcaggctagtagganccttctgtctaacccaggtactaacaagctatacg

SEQ ID NO: 5679 - DNA, 71 bp, chicken (Gallus Gallus)
  misc_feature (36): n=a or c
cttggtgctggaatcctgtattctcaccctgagtgnggtggatttgcactgccatgcagctggtggcacag

SEQ ID NO: 5680 - DNA, 71 bp, chicken (Gallus Gallus)
  misc_feature (36): n=c or t
tatgagcacatacatttaagagtaagactgctgcanagagcttgtatgtgactggaaaactgtgatacagg

SEQ ID NO: 5681 - DNA, 71 bp, chicken (Gallus Gallus)
  misc_feature (36): n=a or g
agagaatgcaggtttgattgttcctatgtgtatatnctgtaaatctccctctggcctattaaataacttcc

SEQ ID NO: 5682 - DNA, 71 bp, chicken (Gallus Gallus)
  misc_feature (36): n=c or t
aagatcatccctcaaggtcagtggtgggaagacacngatgcagggatgacacagatgaactcgtagtctgc

SEQ ID NO: 5683 - DNA, 71 bp, chicken (Gallus Gallus)
  misc_feature (36): n=c or t
gatcaaaaggtattcaaattctaaattccaggtttnccagtgattcatttagcaagccaagtaaattttaa

SEQ ID NO: 5684 - DNA, 71 bp, chicken (Gallus Gallus)
  misc_feature (36): n=c or t
aaaaactgggaaaaggcagtctctttgtagaagcanatgctgttctctcctaaatgcctttcctgaacatc

SEQ ID NO: 5685 - DNA, 71 bp, chicken (Gallus Gallus)
  misc_feature (36): n=a or g
agtgcagcatcccagacttggttttggtgttagaanaattcagagggtgaacttgaaagtatagcagtttc

SEQ ID NO: 5686 - DNA, 71 bp, chicken (Gallus Gallus)
  misc_feature (36): n=a or g
tggcagtctctcaactgctgagcaacagtgtaaaancaggggaaacataatgatacttctgtcctgtagaa

SEQ ID NO: 5687 - DNA, 71 bp, chicken (Gallus Gallus)
  misc_feature (36): n=c or t
taatatttccaatcaggaagaaaggctgtggataantggaattcaccttgatataaaactagggaatagca

SEQ ID NO: 5688 - DNA, 71 bp, chicken (Gallus Gallus)
  misc_feature (36): n=c or t
ttgcctttctttactattttagactgttatgaatgncgtttcatgctgagctactatgttttactagattt

SEQ ID NO: 5689 - DNA, 71 bp, chicken (Gallus Gallus)
  misc_feature (36): n=c or t
aaaaagcccaaggtttgcttcttctaagcacttgtngcattacttatacaggtaacctcatctacgaatga

SEQ ID NO: 5690 - DNA, 71 bp, chicken (Gallus Gallus)
  misc_feature (36): n=a or g
cccaggaatgtccaccatccacataaccattcaganaagacactgtttgcctgtttttccagccaagccct

SEQ ID NO: 5691 - DNA, 71 bp, chicken (Gallus Gallus)
  misc_feature (36): n=c or t
ttggaggtaaagctgggttctttggagcgtatgtcnattttgctgaatgtattaatcagcacattaagggc

SEQ ID NO: 5692 - DNA, 71 bp, chicken (Gallus Gallus)
  misc_feature (36): n=c or g
ggcaagacctccttggcttttccttattaattagantccatcctccaagcagcagggccctgagggctttg

SEQ ID NO: 5693 - DNA, 71 bp, chicken (Gallus Gallus)
  misc_feature (36): n=c or t
actcttgtaaaaaagatcagtaagatccagagctgngtggtcagatgtgagacagtatcctcaagaataca

SEQ ID NO: 5694 - DNA, 71 bp, chicken (Gallus Gallus)
  misc_feature (36): n=a or g
actctgtttgaggtgtcctgcaggtcaccaggatcnaacagctgagattccttaagtcccagctccttgca

SEQ ID NO: 5695 - DNA, 71 bp, chicken (Gallus Gallus)
  misc_feature (36): n=a or g
agtccccgtaatgaaaaatagcttcatacaaaaccnctcactgaacgtcagccacacgtgcagccgtgctc

SEQ ID NO: 5696 - DNA, 71 bp, chicken (Gallus Gallus)
  misc_feature (36): n=a or g
gctacctgcaaacagctcctgaccctcacggggtgnaaaaaactatttagacaagaacattaaaacccgtg

SEQ ID NO: 5697 - DNA, 71 bp, chicken (Gallus Gallus)
  misc_feature (36): n=c or t
atcagcatttccaaagcagggaaatacaacaacaanctttagtgctttggaaattagaacctttgagtata

SEQ ID NO: 5698 - DNA, 71 bp, chicken (Gallus Gallus)
  misc_feature (36): n=c or t
cctctgatcccatctcaacgccttgctttaaagtancatcacttcaataccagcttgggttgtatccccaa

SEQ ID NO: 5699 - DNA, 71 bp, chicken (Gallus Gallus)
  misc_feature (36): n=a or g
tgtgtttccacatatcaacagcaagtgaaaaaagantcaagaatatggcttgtgtggaagttcccactagg

SEQ ID NO: 5700 - DNA, 71 bp, chicken (Gallus Gallus)
  misc_feature (36): n=a or g
cttcaaccatgacccctatgatcttgttttgtttgnaaatgactaaatagccagacatgtctcattcaacc

SEQ ID NO: 5701 - DNA, 71 bp, chicken (Gallus Gallus)
  misc_feature (36): n=a or g
ggcatagacaataaggacaagactcagaatacaaangaagagtcactgcctcctcttccaattcacctagc

SEQ ID NO: 5702 - DNA, 71 bp, chicken (Gallus Gallus)
  misc_feature (36): n=c or t
tttggcaaagcacagaggacaactgctcacaactgngtgaagctgtccaaacctatctgttgctggaatct

SEQ ID NO: 5703 - DNA, 71 bp, chicken (Gallus Gallus)
  misc_feature (36): n=a or g
gtctggtctcttctggtaactaatgacagggaaccncacaaagctgaaaatcctcctccacgggtagagat

SEQ ID NO: 5704 - DNA, 71 bp, chicken (Gallus Gallus)
  misc_feature (36): n=a or g
gcagtaagagatgaagctaccgttacggcagccacnaagcctgttagggattggacagcaaggtttgtgcc

SEQ ID NO: 5705 - DNA, 71 bp, chicken (Gallus Gallus)
  misc_feature (36): n=a or g
cttatcctttcctttttccctctacccttatcttcncttttacatacaccagaaaatggaaaaaagcagat

SEQ ID NO: 5706 - DNA, 71 bp, chicken (Gallus Gallus)
  misc_feature (36): n=c or t
catttcaaagggcagctccacgttagacaatctcanctcctactgatctgcggtccatttcttagattatg

SEQ ID NO: 5707 - DNA, 71 bp, chicken (Gallus Gallus)
  misc_feature (36): n=a or g
tgaaaaatctgtgttgtagtgggaaatgctgagcancccagactgattctactgaacccatgacaacgggg

SEQ ID NO: 5708 - DNA, 71 bp, chicken (Gallus Gallus)
  misc_feature (36): n=a or g
ttttccttgaagataagcaacttctcccagtggatnttcatggaatttttgttatattattatcatgttag

SEQ ID NO: 5709 - DNA, 71 bp, chicken (Gallus Gallus)
  misc_feature (36): n=c or t
tctgacccattagtgcataaacacacttcataatcntacaaacatcctacagttagttgtgtctgaaagct

SEQ ID NO: 5710 - DNA, 71 bp, chicken (Gallus Gallus)
  misc_feature (36): n=a or c
gtgaataaggtatggacttgagcttgaaaggtttanctccaaccaaaattttagaaaatgttcaataagca

SEQ ID NO: 5711 - DNA, 71 bp, chicken (Gallus Gallus)
  misc_feature (36): n=a or g
ctgctgctctaacagaagacaaacaaatcaacttcngaagatacccaggaagatggaacattttctgaaac

SEQ ID NO: 5712 - DNA, 71 bp, chicken (Gallus Gallus)
  misc_feature (36): n=c or t
ttatcatagctatctggagtttgctctttctgcatnctgaaggaattacacctgagctttccagatgtttg

SEQ ID NO: 5713 - DNA, 71 bp, chicken (Gallus Gallus)
  misc_feature (36): n=a or g
tcttctctctgaagtagaatggctgcagagatgcantaaagaacgagaaggaggtctacaaggtctgaggg

SEQ ID NO: 5714 - DNA, 71 bp, chicken (Gallus Gallus)
  misc_feature (36): n=c or t
gcattgcaataagcataaaagagtacaaatacatanactaccaagcactggtgactagttgggtggaggga

SEQ ID NO: 5715 - DNA, 71 bp, chicken (Gallus Gallus)
  misc_feature (36): n=c or t
ttacatttaacacttatacccatctgccttccatgnatcagctattttaggctttgtgaaattgctgtaag

SEQ ID NO: 5716 - DNA, 71 bp, chicken (Gallus Gallus)
  misc_feature (36): n=c or t
cctcaaagaagcactgaaaagaattttgttaatgantgcaacacctcctcggtattcacccatttagcttg

SEQ ID NO: 5717 - DNA, 71 bp, chicken (Gallus Gallus)
  misc_feature (36): n=c or t
aggttcagatacttgttccctgatacccactcacgntggatgagaaacagcactgccatggggagaagggg

SEQ ID NO: 5718 - DNA, 71 bp, chicken (Gallus Gallus)
  misc_feature (36): n=a or g
tgttgggcacaggagctggagagagaagagaccaanatgtaagtccctaggctgcctgcaaacacaagatg

SEQ ID NO: 5719 - DNA, 71 bp, chicken (Gallus Gallus)
  misc_feature (36): n=c or t
tgtagcaaacaagcttctctgcacagaaagagcccngtggtaatttgagtagatgtttgtgatggatttgc

SEQ ID NO: 5720 - DNA, 71 bp, chicken (Gallus Gallus)
  misc_feature (36): n=a or c
actactcaaattctccatgtaggactcagtgggacnagggcagtactgaattttatgccagctccatgggc

SEQ ID NO: 5721 - DNA, 71 bp, chicken (Gallus Gallus)
  misc_feature (36): n=a or g
caacagccttctgtggaaaaagcccttaaggacatngaaattagttcatggggtgagcacagcagtgtttt

SEQ ID NO: 5722 - DNA, 71 bp, chicken (Gallus Gallus)
  misc_feature (36): n=a or g
ctgggaatagctctcacgggctatagtgaaagaacntattcacagtcagtagccagatttgtgactgaaat

SEQ ID NO: 5723 - DNA, 71 bp, chicken (Gallus Gallus)
  misc_feature (36): n=c or t
ttttcttgccttctgcagctaaaacaaggaagtccnaatgtgcagccaatcatgccacacgttaggtaaaa

SEQ ID NO: 5724 - DNA, 71 bp, chicken (Gallus Gallus)
  misc_feature (36): n=c or t
tgactgttctccctgatgaaagagctcctctccagnttacttgtaggcccctcttagatactggaaaacag

SEQ ID NO: 5725 - DNA, 71 bp, chicken (Gallus Gallus)
  misc_feature (36): n=c or t
ttacgatgtccacagatgatattatattctacccgnaagagctaaaattactgtagaaagataaatgccca

SEQ ID NO: 5726 - DNA, 71 bp, chicken (Gallus Gallus)
  misc_feature (36): n=a or c
gaggatagtgttaatcatggtaaatagcataaaaancattgcctgttgacaattacaaactaggagcataa

SEQ ID NO: 5727 - DNA, 71 bp, chicken (Gallus Gallus)
  misc_feature (36): n=a or g
taggaaaaattcttatctggaagagtagtgacatantaaaacacgcttcttgggaaagtggtagtcacagt

SEQ ID NO: 5728 - DNA, 71 bp, chicken (Gallus Gallus)
  misc_feature (36): n=c or t
acagctagatagcttacatctaatctgggtaattcngaaacagtggcaagaatcacagtttcttgtgacct

SEQ ID NO: 5729 - DNA, 71 bp, chicken (Gallus Gallus)
  misc_feature (36): n=a or g
gatgagagctgccttgtccaagaacaggagttttgnctcaaacacatagatacactacccccactacaatg

SEQ ID NO: 5730 - DNA, 71 bp, chicken (Gallus Gallus)
  misc_feature (36): n=a or g
aaactttttggtatgtctctgtttcttatgactttnagaagaacctttgaaagtttgaagtgatagttgtg

SEQ ID NO: 5731 - DNA, 71 bp, chicken (Gallus Gallus)
  misc_feature (36): n=c or t
gcagcctggctgatctgccacactgaagtgatcacnttttcaaagtgaagtcttgagtgctggaagattta

SEQ ID NO: 5732 - DNA, 71 bp, chicken (Gallus Gallus)
  misc_feature (36): n=a or g
agagctggtcggctgttaagagagctaatcaaagcngacacaagcctaagtataataccagttattagaaa

SEQ ID NO: 5733 - DNA, 71 bp, chicken (Gallus Gallus)
  misc_feature (36): n=a or g
gagaaatgggagtgattgatcatgcttagcaaaggncaatgaaggagctgcgccgaagctcattactgtaa

SEQ ID NO: 5734 - DNA, 71 bp, chicken (Gallus Gallus)
  misc_feature (36): n=a or t
ttcacgtgctcttaaaatacattcaagaatcaaacnttatatagcaagagatctcagaatgtcatgtgttg

SEQ ID NO: 5735 - DNA, 71 bp, chicken (Gallus Gallus)
  misc_feature (36): n=a or g
gattcaccaaggcttattagttccagttcaacactntactaacgtcactacactttttctgcacagacctg

SEQ ID NO: 5736 - DNA, 71 bp, chicken (Gallus Gallus)
  misc_feature (36): n=c or t
gccgtctcagagaacaccgagtcctccagcggcagngtctgcaagtagtgaagtcctgagctcgtcagtgg

SEQ ID NO: 5737 - DNA, 71 bp, chicken (Gallus Gallus)
  misc_feature (36): n=a or g
ccaagggcaacgtctcctccagatcacgcagagacngtgagcaggatcagctcattgatctacctgaaccc

SEQ ID NO: 5738 - DNA, 71 bp, chicken (Gallus Gallus)
  misc_feature (36): n=c or g
gtatgtcttaactgtttaaatgtagaatgtgaattntaagagtatgcatttgattttccacgtcacctggt

SEQ ID NO: 5739 - DNA, 71 bp, chicken (Gallus Gallus)
  misc_feature (36): n=a or g
gcttttttccctgtaggactgaaagggagcgctacntgtttgttagcagattttggaaataaaatataatg

SEQ ID NO: 5740 - DNA, 71 bp, chicken (Gallus Gallus)
  misc_feature (36): n=c or t
cctaactaacagtttacatgaatgcaagagcattcnaaatgtacaaaaacacgcttgcttttcatgcattt

SEQ ID NO: 5741 - DNA, 71 bp, chicken (Gallus Gallus)
  misc_feature (36): n=a or g
agttgtctcaccttcatgcagtggctgaactgtagnagctgctactgctgtttgtagtcccaaacaggaga

SEQ ID NO: 5742 - DNA, 71 bp, chicken (Gallus Gallus)
  misc_feature (36): n=a or g
tagtagtgctgacaagtcgttagtggtattaaaaanttagcattcactttccagaagcttatcttctggaa

SEQ ID NO: 5743 - DNA, 71 bp, chicken (Gallus Gallus)
  misc_feature (36): n=a or g
aaaaggctatactaaatgacagatagctttcaaatnaaagaaataaggagcgctggcactgcaggctgcag

SEQ ID NO: 5744 - DNA, 71 bp, chicken (Gallus Gallus)
  misc_feature (36): n=c or t
gctttctccagtaattcccctcgtgtgtccctacanacactgagttctcgaaagagaaggcatccagaccg

SEQ ID NO: 5745 - DNA, 71 bp, chicken (Gallus Gallus)
  misc_feature (36): n=a or g
aaatccctcctcaaagcagtacaaccctttcccttnctcctttattcaggaactttcttcaagctcctcat

SEQ ID NO: 5746 - DNA, 71 bp, chicken (Gallus Gallus)
  misc_feature (36): n=c or t
tttgtgctcttccaaaataatgctttaagccctcanctagctgtggcccctcatctcaaaggtgcatatga

SEQ ID NO: 5747 - DNA, 71 bp, chicken (Gallus Gallus)
  misc_feature (36): n=a or c
caggcagtccttgtaggtgagaaaagggagggggcnatccttgcctgtaaacacaacagctaacaacaaag

SEQ ID NO: 5748 - DNA, 71 bp, chicken (Gallus Gallus)
  misc_feature (36): n=c or t
cagcagggccgccctccagcatttctctttgtttantttaatggaggaatggatgggaaactttcaaagca

SEQ ID NO: 5749 - DNA, 71 bp, chicken (Gallus Gallus)
  misc_feature (36): n=a or g
actctgtttatatttttacctaagagtgaaaacacntcccacctatccttcttagtattttctcaccaata

SEQ ID NO: 5750 - DNA, 71 bp, chicken (Gallus Gallus)
  misc_feature (36): n=c or t
agaaggaaagaactccagtttggctgcaagcacttngtgacgaataaagacattagagattgtcaagaatc

SEQ ID NO: 5751 - DNA, 71 bp, chicken (Gallus Gallus)
  misc_feature (36): n=a or g
gcagaagtctgagctttaacctgctctgaacgtctntgcactgctgagattccaggacaaaaatctgaacc

SEQ ID NO: 5752 - DNA, 71 bp, chicken (Gallus Gallus)
  misc_feature (36): n=a or g
ctgggctgccttaaagctaatttccaccgcagtacngcaggctgatggggattgcttggagcagcctcaga

SEQ ID NO: 5753 - DNA, 71 bp, chicken (Gallus Gallus)
  misc_feature (36): n=c or t
atgaagctccaacccctcctccaacagttctatctngggctgataagaaattggaaaagttaggttgatgc

SEQ ID NO: 5754 - DNA, 71 bp, chicken (Gallus Gallus)
  misc_feature (36): n=c or t
tgtttttgtcattatccaacacatgaattggattcnctactttgctatagctatttaactgtgactaccag

SEQ ID NO: 5755 - DNA, 71 bp, chicken (Gallus Gallus)
  misc_feature (36): n=a or g
gtcttggtaggatgcactgaagccagctttgagatntgaaccctcattctgcgctgaggttctcttaaaca

SEQ ID NO: 5756 - DNA, 71 bp, chicken (Gallus Gallus)
  misc_feature (36): n=a or g
tctttgtaatttgttgttgcatttccttcccatctntcaagcactgcatagccaggccacgcgtgtttcac

SEQ ID NO: 5757 - DNA, 71 bp, chicken (Gallus Gallus)
  misc_feature (36): n=a or g
tgtccttgtcatactgtgctggatgagtccttcttnttaatattcaagtgtatgaaacgtactgaagaaat

SEQ ID NO: 5758 - DNA, 71 bp, chicken (Gallus Gallus)
  misc_feature (36): n=c or t
gggagaatgtagtctgctttttaactgtgtttcttntgctttgtctcacaggagctgagataaaccaaccc

SEQ ID NO: 5759 - DNA, 71 bp, chicken (Gallus Gallus)
  misc_feature (36): n=c or t
aacatagactcagtgatgtggagtccactttgcagntctaaacgggccgttagctgctaaacacatggcat

SEQ ID NO: 5760 - DNA, 71 bp, chicken (Gallus Gallus)
  misc_feature (36): n=a or g
aaaaggtatcctcccagctggacatacagatacaanagggcacacacttgcctccatgaacatcaacccta

SEQ ID NO: 5761 - DNA, 71 bp, chicken (Gallus Gallus)
  misc_feature (36): n=a or g
gctggagttcaaggagcgtttggacacctctctcanacagtgctagggtttgaattctgagaactttacag

SEQ ID NO: 5762 - DNA, 71 bp, chicken (Gallus Gallus)
  misc_feature (36): n=a or g
ccagacatgagaaagatgcacaaaaggagtatggancatgagtgaaagagcttatgtccagcaaagaatac

SEQ ID NO: 5763 - DNA, 71 bp, chicken (Gallus Gallus)
  misc_feature (36): n=a or g
tttttgttccctttttgctccaaatattgtagcctnctagccagacagagtctcagaagacagacaggtac

SEQ ID NO: 5764 - DNA, 71 bp, chicken (Gallus Gallus)
  misc_feature (36): n=c or t
gatatcagcagggctgcaggaatattttctacatanatgtcatggtataatgttccacagacatatatgtc

SEQ ID NO: 5765 - DNA, 71 bp, chicken (Gallus Gallus)
  misc_feature (36): n=c or t
ggaaacgactgtaagaatggacataaaaagtagatnggaaaacatggctcctttttccagtgcttctgtgg

SEQ ID NO: 5766 - DNA, 71 bp, chicken (Gallus Gallus)
  misc_feature (36): n=g or t
catcacggggatgaaaaagataatgaacttcctcangctacacggtcacaccaaataagaggaactcacta

SEQ ID NO: 5767 - DNA, 71 bp, chicken (Gallus Gallus)
  misc_feature (36): n=a or c
atcaccaacagcctggaataggcagcagtgttaccncttttccatgttaacaaagctggaaaaactcttct

SEQ ID NO: 5768 - DNA, 71 bp, chicken (Gallus Gallus)
  misc_feature (36): n=c or t
tacacaaacaaggtttttctatgcagtagcctgttncatgtggtcagctgatattaatgcatagatccaac

SEQ ID NO: 5769 - DNA, 71 bp, chicken (Gallus Gallus)
  misc_feature (36): n=a or g
tgctgtgctgtatgtgaacgatgtctgactgaaatnggatgtgtatggggctgtgaggacagcacttctcc

SEQ ID NO: 5770 - DNA, 71 bp, chicken (Gallus Gallus)
  misc_feature (36): n=c or t
cagctctgcactttgctttgcaggaggacgtggcangatgacggcgaagaagaatcagcctttgcagaatg

SEQ ID NO: 5771 - DNA, 71 bp, chicken (Gallus Gallus)
  misc_feature (36): n=a or c
ttagccaatgttaatactagaagcctagagtcaaanaataatcaggaatgatcaactggaaggaagctgat

SEQ ID NO: 5772 - DNA, 71 bp, chicken (Gallus Gallus)
  misc_feature (36): n=a or g
gtttctcaactagatctacattccttcctatctctnactacctcatccctttccttacagatccttttccc

SEQ ID NO: 5773 - DNA, 71 bp, chicken (Gallus Gallus)
  misc_feature (36): n=c or t
tataaatattttctgcctgacaatgcaaatgatcangaagtaaaaccatataagaaatcagctcctgcttc

SEQ ID NO: 5774 - DNA, 71 bp, chicken (Gallus Gallus)
  misc_feature (36): n=a or c
ccttataaatctgtatgtatgaaccaaatgcagtcntagtgaaatgaaccggtagaaataaggtgttatga

SEQ ID NO: 5775 - DNA, 71 bp, chicken (Gallus Gallus)
  misc_feature (36): n=a or g
gaaacttgaactcatggtgaacaaataaagacattncagattcctttgctgccagtgtgacccctttaatc

SEQ ID NO: 5776 - DNA, 71 bp, chicken (Gallus Gallus)
  misc_feature (36): n=a or g
tctaagattgtatcttggattgactgtgccatacantccatcagatataaaccactgaccatgtttgggac

SEQ ID NO: 5777 - DNA, 71 bp, chicken (Gallus Gallus)
  misc_feature (36): n=a or c
ctatgtccatcagtccaatcttatgtctcatgtatnacatgtgaaagcttttttttttccagcaccttggt

SEQ ID NO: 5778 - DNA, 71 bp, chicken (Gallus Gallus)
  misc_feature (36): n=g or t
attccaaactaatcttaatgagggggaaggctgatnatattaaaagctctgagaaacagagacattaaacg

SEQ ID NO: 5779 - DNA, 71 bp, chicken (Gallus Gallus)
  misc_feature (36): n=g or t
gtttttccagatcttttcatagaaaaaaaccaacanaatttccccccgttgtttatgctcagtggctcgct

SEQ ID NO: 5780 - DNA, 71 bp, chicken (Gallus Gallus)
  misc_feature (36): n=a or g
agtattctaattcagtattctatacgaaaggagggnacacactatttagcagggtctgtagtgagagaaca

SEQ ID NO: 5781 - DNA, 71 bp, chicken (Gallus Gallus)
  misc_feature (36): n=c or t
aagtttaaggcactttcaaccttagctttacgcttnagcctaggagatcaaaaccggtcccaagttagtta

SEQ ID NO: 5782 - DNA, 71 bp, chicken (Gallus Gallus)
  misc_feature (36): n=a or c
attcattaattcatttgtttaacagtgaaatctganattgaactcgtatttcatctctcaaaagaaagtag

SEQ ID NO: 5783 - DNA, 71 bp, chicken (Gallus Gallus)
  misc_feature (36): n=c or g
gagaaagaaaaccaggactgatggcatttttcttanagaacagataatccacatgctaacaggtgactagg

SEQ ID NO: 5784 - DNA, 71 bp, chicken (Gallus Gallus)
  misc_feature (36): n=a or g
aagctggtctggttagaagcaagactgaggtgaagngcagaagggttgacagccagggcacaggaggatgg

SEQ ID NO: 5785 - DNA, 71 bp, chicken (Gallus Gallus)
  misc_feature (36): n=c or t
aaggttgtgggcatggaacaggctccttagggcagnggtcactgcaccaaatctgctagtgtacaaggaga

SEQ ID NO: 5786 - DNA, 71 bp, chicken (Gallus Gallus)
  misc_feature (36): n=c or t
aaacccatggtccttggcagccagctgtagagtggncttgcttgagtgagcagtgacatcaaaccaaatga

SEQ ID NO: 5787 - DNA, 71 bp, chicken (Gallus Gallus)
  misc_feature (36): n=a or g
tgtcccatctcctcaattattattgctggcagacantaagtagaaggttgctctttgctgctttcttcaag

SEQ ID NO: 5788 - DNA, 71 bp, chicken (Gallus Gallus)
  misc_feature (36): n=c or t
cattggtctggatttatggagactggcttcccagcnagacgtcaggcaattcctgcttcaaacagcaggcc

SEQ ID NO: 5789 - DNA, 71 bp, chicken (Gallus Gallus)
  misc_feature (36): n=a or g
catttatttcttctcaacactggagaactcttttgngcaaagcagaatggtaaacgcccccaaaacacctg

SEQ ID NO: 5790 - DNA, 71 bp, chicken (Gallus Gallus)
  misc_feature (36): n=c or t
acggtccttagctgcccaggcaattggtgatttacncccagccttcacattgtaactcaataatagtatgg

SEQ ID NO: 5791 - DNA, 71 bp, chicken (Gallus Gallus)
  misc_feature (36): n=g or t
atgtagctgaaaaacagatcagggtgacctgtaggnggtccctcatttcagtctcctcaaaccagaactca

SEQ ID NO: 5792 - DNA, 71 bp, chicken (Gallus Gallus)
  misc_feature (36): n=a or g
gaggacacatttccagctcagctccagcacagagcnggtctgcgtttaagatcccatctccttggttgata

SEQ ID NO: 5793 - DNA, 71 bp, chicken (Gallus Gallus)
  misc_feature (36): n=c or t
ttaaatgagtcaagctttttaaccagcagtcacacnagcactccttttatcaatatcattaactattagac

SEQ ID NO: 5794 - DNA, 71 bp, chicken (Gallus Gallus)
  misc_feature (36): n=a or g
atatgccatatccatcatatatccgattatgtactntaggctaattataacaggtacgtgatacaaacaag

SEQ ID NO: 5795 - DNA, 71 bp, chicken (Gallus Gallus)
  misc_feature (36): n=g or t
agatagcaggactccaccgcacaatttgtctgcaanccatgacaaagacacagacagctgcctctgcctgt

SEQ ID NO: 5796 - DNA, 71 bp, chicken (Gallus Gallus)
  misc_feature (36): n=c or t
tttcccaccttctcctgaatctactacagtcttgtnccgtttcaaattcctgtataaacagtcggtaacta

SEQ ID NO: 5797 - DNA, 71 bp, chicken (Gallus Gallus)
  misc_feature (36): n=a or g
tttcacccataaaacacaacaaaaaacctagataanacttccaccagaaaggtattattcaagatttctga

SEQ ID NO: 5798 - DNA, 71 bp, chicken (Gallus Gallus)
  misc_feature (36): n=a or g
atactgttgttatcattaaagatattgaaacaatcnttaaatatcagtttggactctaagctaaatatttt

SEQ ID NO: 5799 - DNA, 71 bp, chicken (Gallus Gallus)
  misc_feature (36): n=a or g
tcttatttaattattaatttgcattcggatttggantagacagtgacgtactggattttctaagactgcaa

SEQ ID NO: 5800 - DNA, 71 bp, chicken (Gallus Gallus)
  misc_feature (36): n=a or g
tcttcaaaattagagaacattgcctctgacaggcanctcatacatcaaatctagtagtacttcttggcatt

SEQ ID NO: 5801 - DNA, 71 bp, chicken (Gallus Gallus)
  misc_feature (36): n=a or g
tgcgagcttccttgcttcagacgtcaactacttacnaaacatatagcacctcaaaaataaccgaagtaaga

SEQ ID NO: 5802 - DNA, 71 bp, chicken (Gallus Gallus)
  misc_feature (36): n=c or t
aaccggggatgatatagaggaaattatttttaaacntcttacatgcgtaggggagagagtagatggagaaa

SEQ ID NO: 5803 - DNA, 71 bp, chicken (Gallus Gallus)
  misc_feature (36): n=c or t
aagaacccgctgttatcaaggagaaataataataanagtcataataaaaaatcaaagcgtcactctgtatt

SEQ ID NO: 5804 - DNA, 71 bp, chicken (Gallus Gallus)
  misc_feature (36): n=c or t
ttcagtgaagaaatgatgtatagcttttctatatangctgtaagcactgaaagctttgcctgagtagaaga

SEQ ID NO: 5805 - DNA, 71 bp, chicken (Gallus Gallus)
  misc_feature (36): n=a or g
cacagacaacaagctttgctctgctcactactgatnctattctaagccatttccagaagcagtcaacagat

SEQ ID NO: 5806 - DNA, 71 bp, chicken (Gallus Gallus)
  misc_feature (36): n=a or g
gttgaaaagcacctacaaattctttgaatttagtcnatcactgacagctctctcaatacaaacttaaacac

SEQ ID NO: 5807 - DNA, 71 bp, chicken (Gallus Gallus)
  misc_feature (36): n=a or g
atttcctttcacaccaaagtatctactccctaaatnctgtatgtaatagaaacagaatccacgggacaaag

SEQ ID NO: 5808 - DNA, 71 bp, chicken (Gallus Gallus)
  misc_feature (36): n=a or g
ggcacagagagtgagtgcatccttaaaaattctctnttttaatcccctttagctattgtttgtttgttcca

SEQ ID NO: 5809 - DNA, 71 bp, chicken (Gallus Gallus)
  misc_feature (36): n=c or t
ggaaaaatactgaccatgatgcaaggtatgccagtntgagaaaatacctgaaaacaccttatctggataaa

SEQ ID NO: 5810 - DNA, 71 bp, chicken (Gallus Gallus)
  misc_feature (36): n=c or t
aatacagagggaaaacaggcagaggcctctaaacantgtattcacatattcttggtcactatggaaatttc

SEQ ID NO: 5811 - DNA, 71 bp, chicken (Gallus Gallus)
  misc_feature (36): n=a or g
tgactctaatcagagcagaactacagtaaaaagcanttggcaaattaagaaatgccagctgtgatgtaaaa

SEQ ID NO: 5812 - DNA, 71 bp, chicken (Gallus Gallus)
  misc_feature (36): n=c or t
ccaaaaattcagtcctagctgttctcctttttcttnctatgcactcacgttgacagccttctgtgtgatga

SEQ ID NO: 5813 - DNA, 71 bp, chicken (Gallus Gallus)
  misc_feature (36): n=c or t
gttgcatttcatgcatttccccaagtttgcagcagngcttgaactagcttaacaccacagagtttagtgac

SEQ ID NO: 5814 - DNA, 71 bp, chicken (Gallus Gallus)
  misc_feature (36): n=a or g
acatgagcttctgaacaggtgcaaatctggtcaacnttggtttcaattgataaaaggttactgtaatgtat

SEQ ID NO: 5815 - DNA, 71 bp, chicken (Gallus Gallus)
  misc_feature (36): n=c or t
ctgctgagggtatgtatacccaaagtgttagatganttgtagtcatgtctttaacactgggttttgcaata

SEQ ID NO: 5816 - DNA, 71 bp, chicken (Gallus Gallus)
  misc_feature (36): n=a or t
agagggaagggctggaattactttgctgaaagaaanacagaccttcagtggatactccttaaaaaaagtct

SEQ ID NO: 5817 - DNA, 71 bp, chicken (Gallus Gallus)
  misc_feature (36): n=a or c
catgggctgcacctcctgcaaggccgggggagaganatggcattgaaggtgactgcgtttcctcactgtgg

SEQ ID NO: 5818 - DNA, 71 bp, chicken (Gallus Gallus)
  misc_feature (36): n=a or g
cctttacaagggcactacaaaagggagtgggttcancagagaagctgtgactccatctctgagccacagat

SEQ ID NO: 5819 - DNA, 71 bp, chicken (Gallus Gallus)
  misc_feature (36): n=g or t
cattaacatttcatatcttcattgataaaggaaatnaatagctccctgggatagtaattgcctgttgagtt

SEQ ID NO: 5820 - DNA, 71 bp, chicken (Gallus Gallus)
  misc_feature (36): n=a or g
acaccctcaatctgaatttcatgttctcccgaaatngcatcctcctctgaccttgaactctctcccgtgcg

SEQ ID NO: 5821 - DNA, 71 bp, chicken (Gallus Gallus)
  misc_feature (36): n=c or t
ttaagagatgggacctacctgttttgcggtagatangggctgcctagtagaaccagacacagtcttctgga

SEQ ID NO: 5822 - DNA, 71 bp, chicken (Gallus Gallus)
  misc_feature (36): n=c or t
cactgggcacttcaaagatgcattccaacacttctnaaaatttgaagaaaaaaaaaatttagtatagtaac

SEQ ID NO: 5823 - DNA, 71 bp, chicken (Gallus Gallus)
  misc_feature (36): n=a or c
catacataactgttcattcaccagcagactttttanatacaagccattttattttatgctagacaaggcaa

SEQ ID NO: 5824 - DNA, 71 bp, chicken (Gallus Gallus)
  misc_feature (36): n=c or t
tccgtgttggcttctgatgaatagaatttgggccanaaaaatgcaaatctacagtgaacatcagcctttgc

SEQ ID NO: 5825 - DNA, 71 bp, chicken (Gallus Gallus)
  misc_feature (36): n=a or t
tataccagaaattaattgcacccaagcccagaaatncagtttgttgtacaatgtacaagttttagaatgtt

SEQ ID NO: 5826 - DNA, 71 bp, chicken (Gallus Gallus)
  misc_feature (36): n=a or g
cttctagtgaaaccatgttatagcttcttaaaatanttagacgtcttcccttccttttgctcactgaagag

SEQ ID NO: 5827 - DNA, 71 bp, chicken (Gallus Gallus)
  misc_feature (36): n=c or t
gaaagaaatgggatatgtgagtggaaaaaagcctgntagcaaacaagtgggtacctacatatacaattaac

SEQ ID NO: 5828 - DNA, 71 bp, chicken (Gallus Gallus)
  misc_feature (36): n=c or t
tcctatgtgttcctacctgctttacctagcagcatnaaatagcctgtctgcattctcccccattctcctgc

SEQ ID NO: 5829 - DNA, 71 bp, chicken (Gallus Gallus)
  misc_feature (36): n=a or g
agggcagatgtaagatggttgtaatgcttgggtgcntgccggtgtgacactgccctgagctggtgtttgtt

SEQ ID NO: 5830 - DNA, 71 bp, chicken (Gallus Gallus)
  misc_feature (36): n=a or g
caaatgtcttacaagtgccttaccatgtgatcaatncattttatcagaagaaaatattgagttgtggcact

SEQ ID NO: 5831 - DNA, 71 bp, chicken (Gallus Gallus)
  misc_feature (36): n=c or t
ctacctggaagcattctgctatagtctaaacatttngctgttacattgtgatagaacacaaaagagtgtta

SEQ ID NO: 5832 - DNA, 71 bp, chicken (Gallus Gallus)
  misc_feature (36): n=a or g
ccatgtgtgaagatttccatctttgcatggaaagcnagagcttcagtttctttctgaaagctcagctccct

SEQ ID NO: 5833 - DNA, 71 bp, chicken (Gallus Gallus)
  misc_feature (36): n=c or t
gcttaatacgagagctgttccatttcattacctttnccctgtttttttcttgaggtggaactaatgcaatg

SEQ ID NO: 5834 - DNA, 71 bp, chicken (Gallus Gallus)
  misc_feature (36): n=a or g
gaatcccttcttacttcagctaacacagaagggctncagtattagtccttcccgatgcttctgtatcatac

SEQ ID NO: 5835 - DNA, 71 bp, chicken (Gallus Gallus)
  misc_feature (36): n=g or t
gtgaatcaaattatatctatagtagaaatctctgtncctaactttgtctccttcgaattccttagcaggca

SEQ ID NO: 5836 - DNA, 71 bp, chicken (Gallus Gallus)
  misc_feature (36): n=c or t
caaaagccacacctgggtttcatgcccaaaggaagngagtatcatgcctatgtcccaggaacttctccaaa

SEQ ID NO: 5837 - DNA, 71 bp, chicken (Gallus Gallus)
  misc_feature (36): n=a or g
agaacacgttagtcaagacggctggtccatacctcnaatatcccacgtaacttcccaaagcttctcatttg

SEQ ID NO: 5838 - DNA, 71 bp, chicken (Gallus Gallus)
  misc_feature (36): n=g or t
cataaccatttatccttcattaaagatcttttaaanacttaaacttcatggttcaacccttaatgtaatgt

SEQ ID NO: 5839 - DNA, 71 bp, chicken (Gallus Gallus)
  misc_feature (36): n=a or c
gaaagcaggaagatatggcacacgattcccctccantaccctagaataacagcaatccaacatgtcaactt

SEQ ID NO: 5840 - DNA, 71 bp, chicken (Gallus Gallus)
  misc_feature (36): n=a or t
aatgtttgttttctgcacgttgatgacatgttatanccaaaagtggtctctgttcatttcttgttaccaca

SEQ ID NO: 5841 - DNA, 71 bp, chicken (Gallus Gallus)
  misc_feature (36): n=a or g
atgacttacagggttgtatagcagtcagaattccantactctactaatctatttgtcttcagtctgagctc

SEQ ID NO: 5842 - DNA, 71 bp, chicken (Gallus Gallus)
  misc_feature (36): n=g or t
atgttaagtgtatgttatgtattataaaagctgctngctgaaaattaattgagtattcccgtgctagataa

SEQ ID NO: 5843 - DNA, 71 bp, chicken (Gallus Gallus)
  misc_feature (36): n=c or t
aagagctggattttcttcttgttgctaatatatctnctgtcatatctgcatctatttgtctcttatcacag

SEQ ID NO: 5844 - DNA, 71 bp, chicken (Gallus Gallus)
  misc_feature (36): n=a or g
ggacaaaatgcatgttgtggcacagttaaacatggntttgtatgttggggaaaattgagaaaattttacaa

SEQ ID NO: 5845 - DNA, 71 bp, chicken (Gallus Gallus)
  misc_feature (36): n=a or g
acagccaacattaggagatgttttgataggcaaganagacatttactctttgaaagaatatgcaattctta

SEQ ID NO: 5846 - DNA, 71 bp, chicken (Gallus Gallus)
  misc_feature (36): n=a or g
taagaagaccagtgagtcaggatctttctcccccanacgaggtgatcacaatatcgtgatgctccaaacct

SEQ ID NO: 5847 - DNA, 71 bp, chicken (Gallus Gallus)
  misc_feature (36): n=c or t
ctcatttctttagcttgcaagtgaagagcatgctcngcaaaggtgtgctgagagattttgtcctttccata

SEQ ID NO: 5848 - DNA, 71 bp, chicken (Gallus Gallus)
  misc_feature (36): n=a or c
gaaatggtttcaaactagaacaggggagactaaggntataaggaatagcttttaatgacaagagtagcgaa

SEQ ID NO: 5849 - DNA, 71 bp, chicken (Gallus Gallus)
  misc_feature (36): n=a or g
atgggttctagagcctctatttattcatttggtgtncttcatactgacagcaatcaagtgcatagaatttg

SEQ ID NO: 5850 - DNA, 71 bp, chicken (Gallus Gallus)
  misc_feature (36): n=c or t
atgttctagtaggggcaggttctgctgtagaaatgntctctcatttctaaatagtcttggataaaacagga

SEQ ID NO: 5851 - DNA, 71 bp, chicken (Gallus Gallus)
  misc_feature (36): n=a or c
gtatacaaactgagtgcgattataatctagtatatnttttcgtgaggctatttgggcctcccttgatgtca

SEQ ID NO: 5852 - DNA, 71 bp, chicken (Gallus Gallus)
  misc_feature (36): n=c or g
gtataaacaatccaaatgtctcctaacatacttctnctaaaaccaccaattagtaccatctacataaatta

SEQ ID NO: 5853 - DNA, 71 bp, chicken (Gallus Gallus)
  misc_feature (36): n=c or t
attagcaggctttttgtttcaagcacatgaccaggnaacactgtcttcgctctactaagagcaggagagcc

SEQ ID NO: 5854 - DNA, 71 bp, chicken (Gallus Gallus)
  misc_feature (36): n=c or t
actttccatttatctgcagccagtaatttaactttnctcagattttgttctgcaaggctatgagagccaag

SEQ ID NO: 5855 - DNA, 71 bp, chicken (Gallus Gallus)
  misc_feature (36): n=c or t
caatcttcacctgtggtttgtagcgttaacacttcnaaattcctcatgtctaaggtccagcagacatgaac

SEQ ID NO: 5856 - DNA, 71 bp, chicken (Gallus Gallus)
  misc_feature (36): n=c or t
tgtcttcagcctaaaaatagaagtcttaatgatttngactgctatcacattctgtgaattcagaagtgctg

SEQ ID NO: 5857 - DNA, 71 bp, chicken (Gallus Gallus)
  misc_feature (36): n=c or t
tatgcttttatgtggctgatgtagctatcccaacangttctctctccactagggagtattctggcgtagat

SEQ ID NO: 5858 - DNA, 71 bp, chicken (Gallus Gallus)
  misc_feature (36): n=c or t
ctgaaataaagagcacagaacaaacgtaatggtttnacccttcctcttcccaacttttggatggtaagtgg

SEQ ID NO: 5859 - DNA, 71 bp, chicken (Gallus Gallus)
  misc_feature (36): n=a or g
tcacagcaagtggagatgcttctagtccctttctanggagccaaggcaaggtcctcccatctcttagctcc

SEQ ID NO: 5860 - DNA, 71 bp, chicken (Gallus Gallus)
  misc_feature (36): n=c or t
aagacaatccagctattctacctcatgagtctccanggcaagtaggaaaaaaaaaaatcatttattttaac

SEQ ID NO: 5861 - DNA, 71 bp, chicken (Gallus Gallus)
  misc_feature (36): n=a or c
gatggaaggaagtgagatagacacgagagtgtcttngttgcacttggaaaaaacagaactgatctttggga

SEQ ID NO: 5862 - DNA, 71 bp, chicken (Gallus Gallus)
  misc_feature (36): n=c or t
ctcctgtcagtgtagtctctcacttgtagcctaacntgtcctcttccaaaggataaaactgaaacaaacca

SEQ ID NO: 5863 - DNA, 71 bp, chicken (Gallus Gallus)
  misc_feature (36): n=a or c
tgtcagtggatactgctgtgaagagtatgactcttnttgactctctcccatcagataagatccccctgcaa

SEQ ID NO: 5864 - DNA, 71 bp, chicken (Gallus Gallus)
  misc_feature (36): n=a or g
tttttttcccccttattgggcttatttaattatgtnattatttatccgtgttaaacttatgggggttgctg

SEQ ID NO: 5865 - DNA, 71 bp, chicken (Gallus Gallus)
  misc_feature (36): n=c or t
tctgcttttaaccctgttttatttagtgagcatgangtctaacttcattacatgtactcatcctttcacaa

SEQ ID NO: 5866 - DNA, 71 bp, chicken (Gallus Gallus)
  misc_feature (36): n=c or g
ggtatctttgtcagacctggtgagatttcacacctnttggagtttaacaaaaatggttccagttccactgg

SEQ ID NO: 5867 - DNA, 71 bp, chicken (Gallus Gallus)
  misc_feature (36): n=a or g
ggttgctgattcagactacttgtttccgaatctatntggagtgtagttagactggctacttcttgttcctc

SEQ ID NO: 5868 - DNA, 71 bp, chicken (Gallus Gallus)
  misc_feature (36): n=a or g
agatattattttaagtcaagtagatttacttgcacncatgaagtttctcagattgattttcacaattaaga

SEQ ID NO: 5869 - DNA, 71 bp, chicken (Gallus Gallus)
  misc_feature (36): n=c or t
aaatcaattctttaattatttattacaattcatcancatttaaggattttcttgttaatccagcttttacc

SEQ ID NO: 5870 - DNA, 71 bp, chicken (Gallus Gallus)
  misc_feature (36): n=a or g
aagaaggatcagtgagatttccagctaaggaaaacnagtttaaaaataagaaaaatagattaagggagagt

SEQ ID NO: 5871 - DNA, 71 bp, chicken (Gallus Gallus)
  misc_feature (36): n=a or g
aggtgctctttgtcccttgttttgcctgcatttggngaagaggggaagaaaggggagatctgaaacccgtg

SEQ ID NO: 5872 - DNA, 71 bp, chicken (Gallus Gallus)
  misc_feature (36): n=a or g
tcagatagaaaaataatcaagcaagcagttttttcntttgtttgttttactcctttgctttatggaaaaga

SEQ ID NO: 5873 - DNA, 71 bp, chicken (Gallus Gallus)
  misc_feature (36): n=a or g
atcatatgactggaacaaaaccctgcctgacggtcngctgcaagtttacagatttgagacaaaatgtacct

SEQ ID NO: 5874 - DNA, 71 bp, chicken (Gallus Gallus)
  misc_feature (36): n=a or c
gaaaacactgaggacatgtaaaaacacctggatggntgtgggaagagggaaagtccaagcacagactagta

SEQ ID NO: 5875 - DNA, 71 bp, chicken (Gallus Gallus)
  misc_feature (36): n=a or g
tgatgagaaaacatccttaaaagtgatcacagctanaattgcttttctagatacaaatgcaacacacttta

SEQ ID NO: 5876 - DNA, 71 bp, chicken (Gallus Gallus)
  misc_feature (36): n=c or t
tcatttagtgacttccagccctattcctttgtgtanggtgcagctgtagtggcggctggcgtgctctgcac

SEQ ID NO: 5877 - DNA, 71 bp, chicken (Gallus Gallus)
  misc_feature (36): n=c or t
aaaatcgtcctcagtagggttgaattactgaatttntgaaatatgtgtttaattttgcttcagtagctgct

SEQ ID NO: 5878 - DNA, 71 bp, chicken (Gallus Gallus)
  misc_feature (36): n=a or g
cattaacagctctgttatacaacagtgtaagtcagnatacatcctttttttttttaattactattattcaa

SEQ ID NO: 5879 - DNA, 71 bp, chicken (Gallus Gallus)
  misc_feature (36): n=a or g
tgaacaaaatcctatgcatttgagaactaggcactncacagtatctttcaatattaaattcatacaggatg

SEQ ID NO: 5880 - DNA, 71 bp, chicken (Gallus Gallus)
  misc_feature (36): n=c or t
tttcatgtcagtgtttcaagatatttgaactcattntaatagcagcagctctgacttaaaataaataaata

SEQ ID NO: 5881 - DNA, 71 bp, chicken (Gallus Gallus)
  misc_feature (36): n=c or t
acttgtagtagaagttcgagtttgttcattctgaanatagtgcagccattagcctcctatcttactctcct

SEQ ID NO: 5882 - DNA, 71 bp, chicken (Gallus Gallus)
  misc_feature (36): n=g or t
cagtgggtatttgttaaataaatgtaaccatatctntaacacttactgcaacatacacaaaataccattag

SEQ ID NO: 5883 - DNA, 71 bp, chicken (Gallus Gallus)
  misc_feature (36): n=a or c
acctaagtaagatttacatctctgaaaagagataantttgaaatctcatactttttacacattccagagag

SEQ ID NO: 5884 - DNA, 71 bp, chicken (Gallus Gallus)
  misc_feature (36): n=a or g
acatctgttacccagtctggatagaatgggaaaacnggcagcctgggatgaaaacaggaggtaccagaatg

SEQ ID NO: 5885 - DNA, 71 bp, chicken (Gallus Gallus)
  misc_feature (36): n=c or t
ccaacagatttaatttccagtgttgcttcctgaaangttcagcttttgtggatgttctacatgagacttct

SEQ ID NO: 5886 - DNA, 71 bp, chicken (Gallus Gallus)
  misc_feature (36): n=c or t
tcacatgcaaaggaaaaagggagaactaggggcaanctggagtgattgggaatttgctgtggccaccagtt

SEQ ID NO: 5887 - DNA, 71 bp, chicken (Gallus Gallus)
  misc_feature (36): n=a or g
gatcactctaagtattcctattaggagcatagatcntttaagcatataattgagatcaagctaggacaaac

SEQ ID NO: 5888 - DNA, 71 bp, chicken (Gallus Gallus)
  misc_feature (36): n=c or t
aaacggctcagggaaataaatatttacatttgatcnggtaggatgtatttcatttttggaaatgacacttt

SEQ ID NO: 5889 - DNA, 71 bp, chicken (Gallus Gallus)
  misc_feature (36): n=c or t
tccactgactaatacttatccttctcagtcattctngttttagcgctactagcatgcccaatagctgtcct

SEQ ID NO: 5890 - DNA, 71 bp, chicken (Gallus Gallus)
  misc_feature (36): n=a or g
tatacatcttccatctctagcagcttttggtacaanccaaacacaaagaaaaaaagactacagttttacta

SEQ ID NO: 5891 - DNA, 71 bp, chicken (Gallus Gallus)
  misc_feature (36): n=c or t
taaagtgaacagtaaaataaagaacactggcagggnttccccaatgagccagaggtaggtgagaaaatgat

SEQ ID NO: 5892 - DNA, 71 bp, chicken (Gallus Gallus)
  misc_feature (36): n=c or t
cagactaagttggctacagagagctcagtggaaaanggaaagcaatactcattcaaatgcccctttgggaa

SEQ ID NO: 5893 - DNA, 71 bp, chicken (Gallus Gallus)
  misc_feature (36): n=a or g
aaatgcattatagaactcccttaaagataaatgagntagcatcattcagaagtgttaaaaaaaaaaaaaaa

SEQ ID NO: 5894 - DNA, 71 bp, chicken (Gallus Gallus)
  misc_feature (36): n=a or g
aattaccttcaaacatcattgtctaaattcagatantgaaatatacaccagatgatcttgtaagctgctca

SEQ ID NO: 5895 - DNA, 71 bp, chicken (Gallus Gallus)
  misc_feature (36): n=c or t
ccagcagtgggaaactcagacacatcagaccttgcnttaggaagatgagagaccaaaaatccaccataagc

SEQ ID NO: 5896 - DNA, 71 bp, chicken (Gallus Gallus)
  misc_feature (36): n=a or g
cattaggaggtccagttttgccctatataaatgctngcttacataaatgagacacaagctttccagaggga

SEQ ID NO: 5897 - DNA, 71 bp, chicken (Gallus Gallus)
  misc_feature (36): n=a or g
tcctcagaaatctaaagctgctcctggagtagtccnaatgcagggattaaatccaaggagcagggacagca

SEQ ID NO: 5898 - DNA, 71 bp, chicken (Gallus Gallus)
  misc_feature (36): n=a or g
gtttagcatgttttatagtttgtgtttgaattcatnagtgcatgctcaaaatttgaaagttgatataattc

SEQ ID NO: 5899 - DNA, 71 bp, chicken (Gallus Gallus)
  misc_feature (36): n=g or t
atttgcgaagagaaggtgatagagtagttctttcantttaattggtagaaaaaaactgtatagcaacaaga

SEQ ID NO: 5900 - DNA, 71 bp, chicken (Gallus Gallus)
  misc_feature (36): n=a or g
agcaacctggaagtctctcttaatttaaagaaatancacctaataatttgcttacacaatcttcatgatat

SEQ ID NO: 5901 - DNA, 71 bp, chicken (Gallus Gallus)
  misc_feature (36): n=c or g
ttcacactgactacacccttgccctgaatcttttancaatttcacttcaaaacgaggttggatagcagacc

SEQ ID NO: 5902 - DNA, 71 bp, chicken (Gallus Gallus)
  misc_feature (36): n=a or g
taatagctaaggaagtcatttctcctccaggtactnttgaaaccagccactgatgggttaggcatatgttg

SEQ ID NO: 5903 - DNA, 71 bp, chicken (Gallus Gallus)
  misc_feature (36): n=c or t
taaaacattttatttctgtgtatatctccatatcanctacttttgtcagtgatgatgtgtggaaaatttcc

SEQ ID NO: 5904 - DNA, 71 bp, chicken (Gallus Gallus)
  misc_feature (36): n=a or c
gctcagcagacaaagcaagcacaaacaattaaagtnatcaagctagaaagacgcactccctacttaccaac

SEQ ID NO: 5905 - DNA, 71 bp, chicken (Gallus Gallus)
  misc_feature (36): n=c or t
agctctaaagaagggcaagagccaacacctaacagngctgaaagtgtgtggaaataaaaggttttgccagc

SEQ ID NO: 5906 - DNA, 71 bp, chicken (Gallus Gallus)
  misc_feature (36): n=a or g
tatactactgtcatgtccctgttgatattgtacganactacaaattttttttcactggagaaaaaattaag

SEQ ID NO: 5907 - DNA, 71 bp, chicken (Gallus Gallus)
  misc_feature (36): n=a or g
aaatctggcatttacctcatcattaattgcttgttntaggttttctccactaaccttcagcaagcagagat

SEQ ID NO: 5908 - DNA, 71 bp, chicken (Gallus Gallus)
  misc_feature (36): n=c or g
agatgaagaagctttttaatttgggatattgtggtnttatttataggtaagctctttcttttagtgagaaa

SEQ ID NO: 5909 - DNA, 71 bp, chicken (Gallus Gallus)
  misc_feature (36): n=c or t
atcgaccccttcacttatgaggaccccaacgaggcngtgcgtgagtttgccaaggagattgacgtctcctt

SEQ ID NO: 5910 - DNA, 71 bp, chicken (Gallus Gallus)
  misc_feature (36): n=a or g
gctatagaccagacatgttcaacctgcagctcacangctgtatgtggcccggcacagctggcactgtagcc

SEQ ID NO: 5911 - DNA, 71 bp, chicken (Gallus Gallus)
  misc_feature (36): n=a or g
aactggctgcaccttgttaatttagaaggaagaacnagggaggcttgcttaatctcaaagataacactgct

SEQ ID NO: 5912 - DNA, 71 bp, chicken (Gallus Gallus)
  misc_feature (36): n=a or g
taattgtaagattaagcatcgctatgtgtatttagnaagtaacatttatctcgtgtcaatttaatcttagt

SEQ ID NO: 5913 - DNA, 71 bp, chicken (Gallus Gallus)
  misc_feature (36): n=a or g
gtatgttttccacagcgtcatcaaacgtatcttctntgttattatgcaactggattgacttcttagttttt

SEQ ID NO: 5914 - DNA, 71 bp, chicken (Gallus Gallus)
  misc_feature (36): n=a or g
ctcctcgctaaaacacctcctatcattaatcttaanccacttgaagattatgatggaaagaatgggatcag

SEQ ID NO: 5915 - DNA, 71 bp, chicken (Gallus Gallus)
  misc_feature (36): n=g or t
gtgcttcagactcactgcctgccctactgttatttncacacagccctttgcatgcaaggcagttgctttct

SEQ ID NO: 5916 - DNA, 71 bp, chicken (Gallus Gallus)
  misc_feature (36): n=c or t
aaaggctaggaataagatgaaatctcaccctgtccntcccttgactctacagagattaacctgtgaattaa

SEQ ID NO: 5917 - DNA, 71 bp, chicken (Gallus Gallus)
  misc_feature (36): n=a or g
tcacctcttccaacaaaatggaagtcctgtttcatngtctggagacttctttctcccgttaatgcatggag

SEQ ID NO: 5918 - DNA, 71 bp, chicken (Gallus Gallus)
  misc_feature (36): n=a or g
ggcactcccaataacacgatgaagagcctggcaacnaggtacacagcaagctttagtgcacttaggacatc

SEQ ID NO: 5919 - DNA, 71 bp, chicken (Gallus Gallus)
  misc_feature (36): n=a or c
cggtttctttctttaaaggcttatggcatcacagcnaacatccccctgcttcctgatgaaatacctcatac

SEQ ID NO: 5920 - DNA, 71 bp, chicken (Gallus Gallus)
  misc_feature (36): n=a or g
ttttaagtgtcttgtctaggcatgtgtctgggactnctggacagcatctcttctttatttgtttttaaaac

SEQ ID NO: 5921 - DNA, 71 bp, chicken (Gallus Gallus)
  misc_feature (36): n=c or t
tctgaattatctgctttattgttgtagcttttccanacacaaggctcaggactagtgctgatgaacatttt

SEQ ID NO: 5922 - DNA, 71 bp, chicken (Gallus Gallus)
  misc_feature (36): n=c or t
ttctgcttaaataatgcctgaatagttcatcaggtnccaggacagccttttagaaggaagcagaaaactga

SEQ ID NO: 5923 - DNA, 71 bp, chicken (Gallus Gallus)
  misc_feature (36): n=a or g
caggaagtcctggagttgattgtcttgcaagttctntttcagctgtgtctgaattgttttccagctatatg

SEQ ID NO: 5924 - DNA, 71 bp, chicken (Gallus Gallus)
  misc_feature (36): n=a or g
atgccattgtgccaacctggacacattgctggctcntgtttagctgagtgtcgaccagcatccccaggtcc

SEQ ID NO: 5925 - DNA, 71 bp, chicken (Gallus Gallus)
  misc_feature (36): n=a or g
ataaaactttttttgaaatattcctgatcagctccnctgagcaggtgttgtgggaacatttgggataggct

SEQ ID NO: 5926 - DNA, 71 bp, chicken (Gallus Gallus)
  misc_feature (36): n=c or t
agaaaagaagaagtgaaataagtgttccctctgacnttcagttccccagagctaagtgaattcgagcaggc

SEQ ID NO: 5927 - DNA, 71 bp, chicken (Gallus Gallus)
  misc_feature (36): n=g or t
gctattggagtatatgttgaatatggttcttcattnctgtagacattgtttatcaaaggaacattaacaga

SEQ ID NO: 5928 - DNA, 71 bp, chicken (Gallus Gallus)
  misc_feature (36): n=c or t
gattcagacaacaagatctttgtacagaggcctttngtactcttgacactcaagtcttcttgttctttcag

SEQ ID NO: 5929 - DNA, 71 bp, chicken (Gallus Gallus)
  misc_feature (36): n=c or t
aaatgtgcagacgtaggaattgagagaacagtttanaaatactaacgctatttcataaagaagcctttcca

SEQ ID NO: 5930 - DNA, 71 bp, chicken (Gallus Gallus)
  misc_feature (36): n=a or g
cgttctccaatgaagtactgcagctctgtaatactncttttgttttctttcgaaactggatcataataagg

SEQ ID NO: 5931 - DNA, 71 bp, chicken (Gallus Gallus)
  misc_feature (36): n=a or c
tccttaaagaacatgtagtaaaactcaattagtgcngaacacgagcctacttttaacatgtatttattcag

SEQ ID NO: 5932 - DNA, 71 bp, chicken (Gallus Gallus)
  misc_feature (36): n=a or c
tatatatatatatatatatatatatatatatatatnttttatttttacctgctaattactttactagaaag

SEQ ID NO: 5933 - DNA, 71 bp, chicken (Gallus Gallus)
  misc_feature (36): n=a or g
tggaaatgttttccaggataattttgtccctccccnactctgggatttgaagcttcttgacttgtagtacc

SEQ ID NO: 5934 - DNA, 71 bp, chicken (Gallus Gallus)
  misc_feature (36): n=c or t
tctatttttttttttcactcccaaatatctgaatanatttcagggaagctcagaaatattttccaagccag

SEQ ID NO: 5935 - DNA, 71 bp, chicken (Gallus Gallus)
  misc_feature (36): n=g or t
gtgatacttgccaaaaactggtgttagttgttattntattggcccaaaagagcaatcatcattttagctaa

SEQ ID NO: 5936 - DNA, 71 bp, chicken (Gallus Gallus)
  misc_feature (36): n=a or g
cccaccctgtttgctctcccattcctgccttatcancacagctgtcactctaccaagggagacaccaccgg

SEQ ID NO: 5937 - DNA, 71 bp, chicken (Gallus Gallus)
  misc_feature (36): n=c or t
gttgctaaaagaaactttctgtcatctcgaagaagngagacagttttgggttgtgggcagggcttttccag

SEQ ID NO: 5938 - DNA, 71 bp, chicken (Gallus Gallus)
  misc_feature (36): n=a or g
gatcgctgctgctggatgagtggggcagcagtatgngagatcactaaaaagaaagataaagtagtgaggct

SEQ ID NO: 5939 - DNA, 71 bp, chicken (Gallus Gallus)
  misc_feature (36): n=c or t
ctgcactcctgttgcttgacattatttttgtcattngaacaagttccttcaggtactacacctaaacagag

SEQ ID NO: 5940 - DNA, 71 bp, chicken (Gallus Gallus)
  misc_feature (36): n=c or t
taatgctgcactcaattgtgatgcacaaggctgcantgcatagcacccatcagttaaaagcaccaagcaca

SEQ ID NO: 5941 - DNA, 71 bp, chicken (Gallus Gallus)
  misc_feature (36): n=a or g
gtaaattttaggaatttgcatcatatgattcaactncccatcatctttccaagagatctcagcctgcacaa

SEQ ID NO: 5942 - DNA, 71 bp, chicken (Gallus Gallus)
  misc_feature (36): n=a or g
acaatttattaaatctggccattgtattgctgcatngggagagaacaatgcaaagatgtcacacaaaacag

SEQ ID NO: 5943 - DNA, 71 bp, chicken (Gallus Gallus)
  misc_feature (36): n=c or g
ttccatctcctgacagcagaagaaacataacagtgntgaaaaagattccatttgatttgcttaaagatcat

SEQ ID NO: 5944 - DNA, 71 bp, chicken (Gallus Gallus)
  misc_feature (36): n=c or t
agagggagaagtgtttggagagacagaaagttctgnggatatggaagtgagcagggggactggggagaggg

SEQ ID NO: 5945 - DNA, 71 bp, chicken (Gallus Gallus)
  misc_feature (36): n=c or t
catttatatataaaacaatattagtaaaacacattnaaagctgcatatcaaatcatgagacttatagtgat

SEQ ID NO: 5946 - DNA, 71 bp, chicken (Gallus Gallus)
  misc_feature (36): n=a or g
agaagagattatttgttattgcaagtaaaacatacntaaaatgtaggttattttatctttagaggcttgga

SEQ ID NO: 5947 - DNA, 71 bp, chicken (Gallus Gallus)
  misc_feature (36): n=c or t
ctaaccctacatcccatatgacagttcagaaggaanggacacaagcagaatctagtcacaaaaccactaaa

SEQ ID NO: 5948 - DNA, 71 bp, chicken (Gallus Gallus)
  misc_feature (36): n=a or g
ggagccagacaggtagtaaggagtccaagctgatgnaagagaagtgtaaagctgatacctgtcacctaaat

SEQ ID NO: 5949 - DNA, 71 bp, chicken (Gallus Gallus)
  misc_feature (36): n=a or g
agggagatgcatagcttgccattgttgttaagggtntattttcatactgcattttgcctgaattgctgggg

SEQ ID NO: 5950 - DNA, 71 bp, chicken (Gallus Gallus)
  misc_feature (36): n=c or t
ctttgggttagagtttgtctcattatgatattagantattttgatgaagtattacagtaattacagttata

SEQ ID NO: 5951 - DNA, 71 bp, chicken (Gallus Gallus)
  misc_feature (36): n=a or g
gaactgaccatagcagatgggcctgggcaggatgtnacccaaccaaacttctggtattactcctttagctc

SEQ ID NO: 5952 - DNA, 71 bp, chicken (Gallus Gallus)
  misc_feature (36): n=a or g
ggttttctggcaggtgctttccagtgggagcgattngaagaagatataaaaaagaagttgaaagattctga

SEQ ID NO: 5953 - DNA, 71 bp, chicken (Gallus Gallus)
  misc_feature (36): n=c or t
gggcaattcatttcaccacaaatgtggcagtgctgnatatatgccactaaaaactatttgtgcaatacctt

SEQ ID NO: 5954 - DNA, 71 bp, chicken (Gallus Gallus)
  misc_feature (36): n=a or g
tggtgcttgactgtccgcgtacagagctgtggagtnaaatgaaagcagcttttaaagtgtctattcttctc

SEQ ID NO: 5955 - DNA, 71 bp, chicken (Gallus Gallus)
  misc_feature (36): n=c or t
gcccagagaaaggtttacagctatggcaaagcctcngaatcaggatgaaaatttgtacatcaaattcaggc

SEQ ID NO: 5956 - DNA, 71 bp, chicken (Gallus Gallus)
  misc_feature (36): n=a or g
ctggtgccagtgtgctaagagtgtctgttggactcnctgtattttcagatgaaaagtgacatattgaatct

SEQ ID NO: 5957 - DNA, 71 bp, chicken (Gallus Gallus)
  misc_feature (36): n=c or t
aagtggaggatgctagtgggagagactgggaatcanagatttgtggtcatgcaactgagaaggcaaggaga

SEQ ID NO: 5958 - DNA, 71 bp, chicken (Gallus Gallus)
  misc_feature (36): n=a or g
gtgtgacagacatcatctgaaagtgaatatgttcantgacttaatcatctttggcacatctgtaacagttt

SEQ ID NO: 5959 - DNA, 71 bp, chicken (Gallus Gallus)
  misc_feature (36): n=a or g
ttgttttagtcgtggtggtatttgctttcatactcngctggttgccttttcacgtaggacgatatttattt

SEQ ID NO: 5960 - DNA, 71 bp, chicken (Gallus Gallus)
  misc_feature (36): n=a or g
atgttcagtgcaagaggatggagaattaaggcctcnatcttactgtagtgaaaagaaacctagcttcacac

SEQ ID NO: 5961 - DNA, 71 bp, chicken (Gallus Gallus)
  misc_feature (36): n=a or g
cagaaaaccagaagaggggtagaaattgactttatnaagactgaaagtgcgatctctttgtcacattaaca

SEQ ID NO: 5962 - DNA, 71 bp, chicken (Gallus Gallus)
  misc_feature (36): n=c or t
agctcagtttaatagtaaaacctgaacctggtactnatggtattacaataccactttgaaggacagtattt

SEQ ID NO: 5963 - DNA, 71 bp, chicken (Gallus Gallus)
  misc_feature (36): n=c or t
caattaggtggtacaaaatcactgtggtatgttctncagtccataagggttgtgattgcgtgggatcttct

SEQ ID NO: 5964 - DNA, 71 bp, chicken (Gallus Gallus)
  misc_feature (36): n=c or t
cagtctgaaatgcaaatgcaaagcctgttttccctntttgctctgtgttttcctgacaactgcagccagga

SEQ ID NO: 5965 - DNA, 71 bp, chicken (Gallus Gallus)
  misc_feature (36): n=g or t
gttggcagacagctagatcaaattttcatttttatntagagaaaggagaaatctaagaatcaaggcagcta

SEQ ID NO: 5966 - DNA, 71 bp, chicken (Gallus Gallus)
  misc_feature (36): n=c or t
ctaatcctacacgctcttccaaaaattccagaaagnctttttgttgactacaatttataaaaattgtcatg

SEQ ID NO: 5967 - DNA, 71 bp, chicken (Gallus Gallus)
  misc_feature (36): n=c or t
tcagggagccgcgttccaaagaagtatttctcctcngctcagttcagaaactaagaaggcgctgtggcagg

SEQ ID NO: 5968 - DNA, 71 bp, chicken (Gallus Gallus)
  misc_feature (36): n=a or g
catactcatctgcgaattgactgaagctctctttgncacaatgaattccacaaagaaacggcatgctaggg

SEQ ID NO: 5969 - DNA, 71 bp, chicken (Gallus Gallus)
  misc_feature (36): n=c or t
cattgcattcccgcacctcttggtgtttttcagtcntcatatactcaaacctccatagaagaaatggggtc

SEQ ID NO: 5970 - DNA, 71 bp, chicken (Gallus Gallus)
  misc_feature (36): n=a or c
taacacgtgttgtggatacaacccctttaacacttntaggaattaattaattactttttactgagaacgag

SEQ ID NO: 5971 - DNA, 71 bp, chicken (Gallus Gallus)
  misc_feature (36): n=g or t
atttaaatgtcacttttaacagaatgtgaatgaaantgtgctgcttcctactctgacttatccctgtgttg

SEQ ID NO: 5972 - DNA, 71 bp, chicken (Gallus Gallus)
  misc_feature (36): n=a or g
ttcctgactagaatggagctcttgttacatttgtcngcaagtcatgcattaaaaaaagacaaaaacagaag

SEQ ID NO: 5973 - DNA, 71 bp, chicken (Gallus Gallus)
  misc_feature (36): n=c or t
caaggggtcacatgcacatatgaagcaaagtcagtnagatgtttcctgtttgtggtaatatccataaccat

SEQ ID NO: 5974 - DNA, 71 bp, chicken (Gallus Gallus)
  misc_feature (36): n=c or t
acagagatgcacacgtcttcctggctgcagagagcngcatcctttggcggatgggaaataatcttcacttt

SEQ ID NO: 5975 - DNA, 71 bp, chicken (Gallus Gallus)
  misc_feature (36): n=a or c
tgttctcacatgcagaagtacacagtatggcacagnagatcagagaggcatctggagatgtagcctgtcca

SEQ ID NO: 5976 - DNA, 71 bp, chicken (Gallus Gallus)
  misc_feature (36): n=c or t
caaatacctgtattattctctttgtcatctggattngctggatctggttcgggatcttctctgttttcccc

SEQ ID NO: 5977 - DNA, 71 bp, chicken (Gallus Gallus)
  misc_feature (36): n=c or t
agcaaccagatattaagaccacaaacagatggatgnacctattatagaaattatttttaagtacacatttg

SEQ ID NO: 5978 - DNA, 71 bp, chicken (Gallus Gallus)
  misc_feature (36): n=c or t
agagttaggcaaatgctttttgctgttgaacagctnagttaagatcatattcagactcaatggatttaaaa

SEQ ID NO: 5979 - DNA, 71 bp, chicken (Gallus Gallus)
  misc_feature (36): n=c or t
cctaacagagctaagcaggcaactccaactgcttcngatataacgtaaagcactccaaactgtcacagaga

SEQ ID NO: 5980 - DNA, 71 bp, chicken (Gallus Gallus)
  misc_feature (36): n=c or t
ctgacgacatggccagcaacaccaacagcaatggtntgaactggagagaaatggtgcatttaggacaatga

SEQ ID NO: 5981 - DNA, 71 bp, chicken (Gallus Gallus)
  misc_feature (36): n=a or g
ctaatggtagcacaaagctgaatgtacacgccttcntttctaagctttctgacagcccaggtggatccagg

SEQ ID NO: 5982 - DNA, 71 bp, chicken (Gallus Gallus)
  misc_feature (36): n=a or g
ctgccactcagtgtcattactattttttttccaccngcaacattagccttgtctctgtaaaaacacagact

SEQ ID NO: 5983 - DNA, 71 bp, chicken (Gallus Gallus)
  misc_feature (36): n=c or t
gttcctatttaaatctggttcttctaaagtgagttntaaatgagatggattcaccatgatctacatattta

SEQ ID NO: 5984 - DNA, 71 bp, chicken (Gallus Gallus)
  misc_feature (36): n=c or t
ttacctttcttaggtaatttatgactggtttaaagnagctatatctgctacagcctttccatatggatatg

SEQ ID NO: 5985 - DNA, 71 bp, chicken (Gallus Gallus)
  misc_feature (36): n=g or t
ttgagtttataccatagatggaagtcaagaatagcngatagcttcagtgcttgaagtgatacctatttgaa

SEQ ID NO: 5986 - DNA, 71 bp, chicken (Gallus Gallus)
  misc_feature (36): n=a or g
gccctgtgttagtggagataggataaaaaaaaatantcatcattttgatatcaggttccagtgttaaagtg

SEQ ID NO: 5987 - DNA, 71 bp, chicken (Gallus Gallus)
  misc_feature (36): n=c or t
gtatgtctgatattccttatgtgtgcaatccatcantgcatggtcactacagcccaggcagcctccaatcc

SEQ ID NO: 5988 - DNA, 71 bp, chicken (Gallus Gallus)
  misc_feature (36): n=a or g
tggacatagtaatcatcatcatcttcctcatcctgnaatcgactgtaggacctctgtgtgtagccatcctg

SEQ ID NO: 5989 - DNA, 71 bp, chicken (Gallus Gallus)
  misc_feature (36): n=c or t
caggttcttcttctttatcaatccaaaatgctaatnggtggctttggtcaggtatatgtgcaaaatgataa

SEQ ID NO: 5990 - DNA, 71 bp, chicken (Gallus Gallus)
  misc_feature (36): n=c or t
tttcctggccaactctgctcagcaagactgggcaanggttacataaagaagtatttttgtgatttgatgtg

SEQ ID NO: 5991 - DNA, 71 bp, chicken (Gallus Gallus)
  misc_feature (36): n=c or t
tccagacgcagctcaaatctacaatttcacctcagngtgagcaaggactgaagagtcaaaaggaagacggg

SEQ ID NO: 5992 - DNA, 71 bp, chicken (Gallus Gallus)
  misc_feature (36): n=c or t
tccacctacaccacctctatcttgtccatatccatnacaaccaggatgttgagagttgcagcagtgagaac

SEQ ID NO: 5993 - DNA, 71 bp, chicken (Gallus Gallus)
  misc_feature (36): n=c or t
tttaagcataggaattcattgcagacttggtgttgnaatgtgaatctgttaattaagctggatagatgcat

SEQ ID NO: 5994 - DNA, 71 bp, chicken (Gallus Gallus)
  misc_feature (36): n=c or t
tggtcataagggggagctcttacttaggactgaggncaactgctgctgtttccaatgcgtctcacgtaagt

SEQ ID NO: 5995 - DNA, 71 bp, chicken (Gallus Gallus)
  misc_feature (36): n=a or c
gaatattgctgaaatatacagaattatatcagtagntgtattaaaatatgtgtttatgttgcttcaagtct

SEQ ID NO: 5996 - DNA, 71 bp, chicken (Gallus Gallus)
  misc_feature (36): n=a or g
taataatagatttcaatgcattttataaaatgaganttagctggatcatgaattcttgtaggagacaatat

SEQ ID NO: 5997 - DNA, 71 bp, chicken (Gallus Gallus)
  misc_feature (36): n=g or t
attccctaaatatggatgaaggagagcaagtgaagnaacaacgtgagctgaaagacagcattgcataggaa

SEQ ID NO: 5998 - DNA, 71 bp, chicken (Gallus Gallus)
  misc_feature (36): n=a or g
tcatctcctgaaaagcatgcaagcaagaatgcaacnttatgtacaaaaaagccatttcacccttccttttg

SEQ ID NO: 5999 - DNA, 71 bp, chicken (Gallus Gallus)
  misc_feature (36): n=g or t
aatacataaaacttatttttaacctcttagttgttnctacaagcttcagcttcctgaagccattttctttc

SEQ ID NO: 6000 - DNA, 71 bp, chicken (Gallus Gallus)
  misc_feature (36): n=a or c
aagactggggatgaaggaagatgaagaaacagcttnatagaagagagaacgtttactttttcttaaaggtg

SEQ ID NO: 6001 - DNA, 71 bp, chicken (Gallus Gallus)
  misc_feature (36): n=a or g
aaatacacaacggtatattgtgattgtgcccaaagngatatccagagcatgacattgtgatagcatctatt

SEQ ID NO: 6002 - DNA, 71 bp, chicken (Gallus Gallus)
  misc_feature (36): n=a or g
catggatgaaagcacgcagcttgcatccttgcgtgnatggaggcatgcagccagaatccttgcatagatga

SEQ ID NO: 6003 - DNA, 71 bp, chicken (Gallus Gallus)
  misc_feature (36): n=a or g
ctgccaataaaccatcactgctcagcattgtgcctntgtcaatggaaggatgcaggaaccatcacttgttg

SEQ ID NO: 6004 - DNA, 71 bp, chicken (Gallus Gallus)
  misc_feature (36): n=c or t
catcatgctccaaaaaaatgatgttctcacaagctnagtggatagtctatagagtaggacaaatgcagcac

SEQ ID NO: 6005 - DNA, 71 bp, chicken (Gallus Gallus)
  misc_feature (36): n=c or t
ctgttagggctaatcagattacttatatatgcaagnatttaattataaagcttctctatcataaggatcag

SEQ ID NO: 6006 - DNA, 71 bp, chicken (Gallus Gallus)
  misc_feature (36): n=a or g
atcaacattaggttttacagctgttgttccattttntaatgtcaagtcttttatgtaatagaatacataca

SEQ ID NO: 6007 - DNA, 71 bp, chicken (Gallus Gallus)
  misc_feature (36): n=a or c
ctcagaaggaattatttgtagataggctctaagttntactagagctgtgcttaaaataaatgtatgccttt

SEQ ID NO: 6008 - DNA, 71 bp, chicken (Gallus Gallus)
  misc_feature (36): n=c or t
cctctgatctatcagcaatgaaagctgctatacttnggtaacgactcagtggaaaggtgtttcggtctctt

SEQ ID NO: 6009 - DNA, 71 bp, chicken (Gallus Gallus)
  misc_feature (36): n=a or g
aatataaagcactgctttcattttaatatgacttcntttcctattcactgcgggggatttttattaactcc

SEQ ID NO: 6010 - DNA, 71 bp, chicken (Gallus Gallus)
  misc_feature (36): n=c or t
atctcactcagataccgtttccctgcaaaaagcagngcttatcagatcagaaagcctgggttaatgctgca

SEQ ID NO: 6011 - DNA, 71 bp, chicken (Gallus Gallus)
  misc_feature (36): n=a or g
ctcaattggtttcctcattacacagcttgcgagcanatcatattcttgtcctgaatagtaagactgatgca

SEQ ID NO: 6012 - DNA, 71 bp, chicken (Gallus Gallus)
  misc_feature (36): n=c or t
aggtttcctgtattttaatctgcatgctaataaaantttactcatactacttaactctttaggacctaact

SEQ ID NO: 6013 - DNA, 71 bp, chicken (Gallus Gallus)
  misc_feature (36): n=a or g
cccttcacatcagagctctgaatgaaagaggaaaanacaaactgtaaacatcaaacaaatttctggtgaaa

SEQ ID NO: 6014 - DNA, 71 bp, chicken (Gallus Gallus)
  misc_feature (36): n=c or t
ggttgcattccatgtactgattctgaaaggtatagnctttgctttacaaggctaatggtatggtggggaaa

SEQ ID NO: 6015 - DNA, 71 bp, chicken (Gallus Gallus)
  misc_feature (36): n=a or g
gaagtaattagctgcgagtgacaatgagagcacacngcgttcatcctgccaagaggtttcctttgctctgg

SEQ ID NO: 6016 - DNA, 71 bp, chicken (Gallus Gallus)
  misc_feature (36): n=c or g
agcaataatggatttatgtgttgcaatgaaatactntataacttgctattcattgaatgatagcaaagtac

SEQ ID NO: 6017 - DNA, 71 bp, chicken (Gallus Gallus)
  misc_feature (36): n=a or t
gctggggaatcaatgagcatttgttcctagcaggcnccctcattcttggagctgcctgacaaggttttggg

SEQ ID NO: 6018 - DNA, 71 bp, chicken (Gallus Gallus)
  misc_feature (36): n=c or g
acaggctttaatactttgtgatttattttgcagtgnaagcatttcaggccacctgacacttcatctgaaat

SEQ ID NO: 6019 - DNA, 71 bp, chicken (Gallus Gallus)
  misc_feature (36): n=a or g
agggcttccagatgctgttgcaaccacagagaaatncctagcctgacaaagaattgaatttttattgcttc

SEQ ID NO: 6020 - DNA, 71 bp, chicken (Gallus Gallus)
  misc_feature (36): n=c or t
ctgacatcagccagagtaacaaaacttagaaccagngaatcataagatcatataatcattaaggttggaaa

SEQ ID NO: 6021 - DNA, 71 bp, chicken (Gallus Gallus)
  misc_feature (36): n=a or g
gtgagtgaaatacagaaaactgagactcgtcaatgnagcaaatttaagcttttctggttgtccaggggaag

SEQ ID NO: 6022 - DNA, 71 bp, chicken (Gallus Gallus)
  misc_feature (36): n=c or t
gcaatggaaggcagttagtcctggtgtgctgttaanggatagagacagcactttgttggatttctggtgtg

SEQ ID NO: 6023 - DNA, 71 bp, chicken (Gallus Gallus)
  misc_feature (36): n=c or t
cattaaagaccaatattaaaggtgagcaagcaacancatgccttggttctctgagtcaaatactgatcagc

SEQ ID NO: 6024 - DNA, 71 bp, chicken (Gallus Gallus)
  misc_feature (36): n=g or t
tgataatctgatagctgtcttaaaagtattgagctncatgccacagaaattgctgttaaatttcagagagc

SEQ ID NO: 6025 - DNA, 71 bp, chicken (Gallus Gallus)
  misc_feature (36): n=a or g
gattgtgagttgttagcggggccccatcacagtgtntttggtttcagggtgagattttcctctcagtggga

SEQ ID NO: 6026 - DNA, 71 bp, chicken (Gallus Gallus)
  misc_feature (36): n=c or t
tgtgaagctgttacataaaagctcattaaggaatanagccagccagtgcaatgaggtgatggtatctcagt

SEQ ID NO: 6027 - DNA, 71 bp, chicken (Gallus Gallus)
  misc_feature (36): n=c or t
catttcagctccaggcagtaaacccattccctttcntttaaagacagcccccactttactacaatatttcc

SEQ ID NO: 6028 - DNA, 71 bp, chicken (Gallus Gallus)
  misc_feature (36): n=g or t
caggcaggaaaagggtgggaaagcttgggaaggggntgttaagtgggaatgatgagacagctccaaaaaat

SEQ ID NO: 6029 - DNA, 71 bp, chicken (Gallus Gallus)
  misc_feature (36): n=a or c
tacagtctccttgaatgcagctgaatgtaagcacanacactacactgaatgtaagcacaagcacgtgtttg

SEQ ID NO: 6030 - DNA, 71 bp, chicken (Gallus Gallus)
  misc_feature (36): n=a or g
tgtatgcttctaagagcatatctaaaagtaagcatntttcttctgtctctgtttagtcattcgtgactctt

SEQ ID NO: 6031 - DNA, 71 bp, chicken (Gallus Gallus)
  misc_feature (36): n=c or t
cattcatcaaggcagatgatgccaaagcctcctagntcatcagttagcaataacaagagaatagtgactac

SEQ ID NO: 6032 - DNA, 71 bp, chicken (Gallus Gallus)
  misc_feature (36): n=a or g
aagactgtaggggtggtgtgaggctctacagctccngttaatatttgaattctttaactttaaaagtctaa

SEQ ID NO: 6033 - DNA, 71 bp, chicken (Gallus Gallus)
  misc_feature (36): n=a or g
ggagcaaaatgtaaatgtaagtaaaagagccgtacncattgctctttccatactccttgtgctatgaacta

SEQ ID NO: 6034 - DNA, 71 bp, chicken (Gallus Gallus)
  misc_feature (36): n=g or t
tgcagcagtttgcataacacccaatgccaagtggangccagtgttatgggcaaaatatattaatgacatga

SEQ ID NO: 6035 - DNA, 71 bp, chicken (Gallus Gallus)
  misc_feature (36): n=a or c
gaaatttaatgtgaaggaagctcttccatgctgcangttaaagctgcatctaattgtggcagttctgatat

SEQ ID NO: 6036 - DNA, 71 bp, chicken (Gallus Gallus)
  misc_feature (36): n=c or t
cagaccatgacaacgttaataaacaatcgctggcangaatgccactagctgtcttccaagttacgactact

SEQ ID NO: 6037 - DNA, 71 bp, chicken (Gallus Gallus)
  misc_feature (36): n=a or g
aaggaaagtttgcttttcagatgagggtcatcccangtaaataaacagaactaaccgttaagcaacaatca

SEQ ID NO: 6038 - DNA, 71 bp, chicken (Gallus Gallus)
  misc_feature (36): n=c or t
ttcaccaacagccagagcttttacgcctttctgtgntcattcactattcaaagtgaggccatcattcccat

SEQ ID NO: 6039 - DNA, 71 bp, chicken (Gallus Gallus)
  misc_feature (36): n=c or t
tcaggctgcccacggcagcagctcagcctgcctgcnttacctctgtgcccttgaacctcagaaactacaag

SEQ ID NO: 6040 - DNA, 71 bp, chicken (Gallus Gallus)
  misc_feature (36): n=a or g
ctccagtggtttgcctatgccttcactgcacacaangcaaattaccaattggaagtcaaagctttaaaaca

SEQ ID NO: 6041 - DNA, 71 bp, chicken (Gallus Gallus)
  misc_feature (36): n=g or t
agttgtctgtgctactggaaacaacactgtggtccnaactaacacaggtatctgatatgaagtgaagaaat

SEQ ID NO: 6042 - DNA, 71 bp, chicken (Gallus Gallus)
  misc_feature (36): n=c or t
ccaattgtgtgcatgtcagagaaagacagtgcatgnccaactccatcgttagcttctacactatctttcta

SEQ ID NO: 6043 - DNA, 71 bp, chicken (Gallus Gallus)
  misc_feature (36): n=c or t
tggagctttacgcctgacagtatcaccacagtgtanatataatgaaccacccaaaataacactggccttct

SEQ ID NO: 6044 - DNA, 71 bp, chicken (Gallus Gallus)
  misc_feature (36): n=c or t
atatattcgtttatgaagaagctattgaacagatanacatttaaaattcacaactgtatcatatgtaccaa

SEQ ID NO: 6045 - DNA, 71 bp, chicken (Gallus Gallus)
  misc_feature (36): n=a or g
atggcagagaggggactgatttaggagctctgtatntcagagtgtcagaaggagactgacccccattgtat

SEQ ID NO: 6046 - DNA, 71 bp, chicken (Gallus Gallus)
  misc_feature (36): n=c or t
ctgtctggatattgtgaaaatcacaaagaagcagtnacaaaaggaaagtgtttgaaagctgcgtgttaatg

SEQ ID NO: 6047 - DNA, 71 bp, chicken (Gallus Gallus)
  misc_feature (36): n=a or g
attgtacccccttacttgaagctgcataaagtcatnggctcaagtgttttcatttttcgtgtttttcatat

SEQ ID NO: 6048 - DNA, 71 bp, chicken (Gallus Gallus)
  misc_feature (36): n=a or c
ggaagaaagtctgagatttcactgccttcactattngagattttaacaaccaagcaccctcctgaccagca

SEQ ID NO: 6049 - DNA, 71 bp, chicken (Gallus Gallus)
  misc_feature (36): n=c or t
ctaaaaatagttgcttacagtgtcaaattatattantggcattaacattgccagactttgcaattaccaaa

SEQ ID NO: 6050 - DNA, 71 bp, chicken (Gallus Gallus)
  misc_feature (36): n=c or t
gttttacaagttttccttgtgatgtgaagtcatagngaaagtgctagaccagaagcattgctgcctatgtt

SEQ ID NO: 6051 - DNA, 71 bp, chicken (Gallus Gallus)
  misc_feature (36): n=c or t
cggtcttgaaatcttttggcagaaatgctgtaagangatctaagcatggagacttgaaagctgtgtgacat

SEQ ID NO: 6052 - DNA, 71 bp, chicken (Gallus Gallus)
  misc_feature (36): n=c or t
gtcagtcatggctatgaattatctgtactgcacaancagttgagctcagtacaccacattcacagggagag

SEQ ID NO: 6053 - DNA, 71 bp, chicken (Gallus Gallus)
  misc_feature (36): n=a or g
atttttaaagctgacttaaaacttttaagttaaagntagaaaatagatggtatcctctgtcttgtgccagt

SEQ ID NO: 6054 - DNA, 71 bp, chicken (Gallus Gallus)
  misc_feature (36): n=a or c
agtagcactttgggcccaggttgttcttccttttcntgttcgctgcctaggatttgtgaaacgaacagtcc

SEQ ID NO: 6055 - DNA, 71 bp, chicken (Gallus Gallus)
  misc_feature (36): n=a or c
agaaattaaaaaatgtggtctcaggtatgagtgaantttttagtgcgagatgtttactttacataaagatg

SEQ ID NO: 6056 - DNA, 71 bp, chicken (Gallus Gallus)
  misc_feature (36): n=a or g
cccaacctcctctgagctggactaaatagaaagtcngatcagttttgcattcagctgaggtagaattcaga

SEQ ID NO: 6057 - DNA, 71 bp, chicken (Gallus Gallus)
  misc_feature (36): n=c or t
tactctctgtatcaacgtataggaattcacaatganaatgctgatgtagaagtgttagctaggtttgctga

SEQ ID NO: 6058 - DNA, 71 bp, chicken (Gallus Gallus)
  misc_feature (36): n=c or t
ctcagaaaaagattctgttctcttccacaaaagccntctctgcaggaaatacactgtcccatgcaaagttt

SEQ ID NO: 6059 - DNA, 71 bp, chicken (Gallus Gallus)
  misc_feature (36): n=a or g
tttcgagttctggacactgaactcgaaacactgaantaaaagaacagtcagtttgccatgcttatagtgaa

SEQ ID NO: 6060 - DNA, 71 bp, chicken (Gallus Gallus)
  misc_feature (36): n=c or t
actttctcatgtcttgcatgagacatctaggacctncagtcttttctgaaagctacagaaagatatgaaaa

SEQ ID NO: 6061 - DNA, 71 bp, chicken (Gallus Gallus)
  misc_feature (36): n=a or g
aatctatcttctctatcttcagttgtgcactgaaangaatgaaacagtttttcaggtgtgtgtgtgtattg

SEQ ID NO: 6062 - DNA, 71 bp, chicken (Gallus Gallus)
  misc_feature (36): n=a or g
catgatgatggttgtctgtatgagtgaaacttgaancacaataattaactgttgcaatggccatttgattt

SEQ ID NO: 6063 - DNA, 71 bp, chicken (Gallus Gallus)
  misc_feature (36): n=a or g
ggtgtacagagtagctgggtagaagcgttgcattgngatgaaggatttggctagcaaaatcgctgccttcc

SEQ ID NO: 6064 - DNA, 71 bp, chicken (Gallus Gallus)
  misc_feature (36): n=a or g
cttcagtcctaatagctcttgtttcacagaaccacnccatgttttgccttcacccttctgctctcaggttg

SEQ ID NO: 6065 - DNA, 71 bp, chicken (Gallus Gallus)
  misc_feature (36): n=c or t
gtgatggagtgtttttaagcaataagaataaacctnttctgcaggcgtctgacaatgggatagtcagggaa

SEQ ID NO: 6066 - DNA, 71 bp, chicken (Gallus Gallus)
  misc_feature (36): n=a or c
aaatttgaaaatacaatgggaaaaactctttcatanataggtaaccatagactctaatggagcatgaatct

SEQ ID NO: 6067 - DNA, 71 bp, chicken (Gallus Gallus)
  misc_feature (36): n=a or c
atcattaattaaataacatctaattacaaccataantgtgtattttctttgcatttgttggtgatactcgg

SEQ ID NO: 6068 - DNA, 71 bp, chicken (Gallus Gallus)
  misc_feature (36): n=a or g
cttctctctgaggctatttttctttccaggacatcnaggaaattaaattcagaggcttgagaaaaatgtgt

SEQ ID NO: 6069 - DNA, 71 bp, chicken (Gallus Gallus)
  misc_feature (36): n=a or g
atagcttatttttaagcctcaggcagaaaacaatcntgcagacaaggaatctagatccagttcccatcctg

SEQ ID NO: 6070 - DNA, 71 bp, chicken (Gallus Gallus)
  misc_feature (36): n=a or g
cctggaactctgatcttaatgtttgcagtactatcnctccaactcaaaatatttagctcccttgtgtgata

SEQ ID NO: 6071 - DNA, 71 bp, chicken (Gallus Gallus)
  misc_feature (36): n=c or t
tcagaatattgaatgagatacaagctatgtgtgaantgaggataactccaatacttgcgtgcagattggaa

SEQ ID NO: 6072 - DNA, 71 bp, chicken (Gallus Gallus)
  misc_feature (36): n=c or t
tgcattagtaagagctgccagttatgataaatgatnaaatattcttttattattattattttgcaatcata

SEQ ID NO: 6073 - DNA, 71 bp, chicken (Gallus Gallus)
  misc_feature (36): n=c or t
aaggaatcctctgcactgctgttccaaatggacagngtgcggctccatggatggggaaggaatgttagctg

SEQ ID NO: 6074 - DNA, 71 bp, chicken (Gallus Gallus)
  misc_feature (36): n=a or g
ctggaattgttaacaaatttaaataaaaagcttcanaaccatgcttaagttcacaaaaaggtggaggaagt

SEQ ID NO: 6075 - DNA, 71 bp, chicken (Gallus Gallus)
  misc_feature (36): n=a or c
tatgcccaagtgttgtccttgtccttatggattttnattgttgcctggtatcttctaagttagtacttcct

SEQ ID NO: 6076 - DNA, 71 bp, chicken (Gallus Gallus)
  misc_feature (36): n=c or t
tttttgaggtatgtttaggtcaccttctagcagcangctattacagcttatgtgtaatgaactgcattgta

SEQ ID NO: 6077 - DNA, 71 bp, chicken (Gallus Gallus)
  misc_feature (36): n=c or t
acagcccatgagacgtggtcctgccattgccaaaancatgggctgtgttctagcactgcaaaacatagagg

SEQ ID NO: 6078 - DNA, 71 bp, chicken (Gallus Gallus)
  misc_feature (36): n=a or t
acctttcaaagagttcagacgtgggaatacctcgtnggtgctataggcacaagaatgcttggcgtattcag

SEQ ID NO: 6079 - DNA, 71 bp, chicken (Gallus Gallus)
  misc_feature (36): n=a or g
gcctcgtcttctaaacaagttctgttcaattaacanaatctccattcccaacttcattctagtttttacca

SEQ ID NO: 6080 - DNA, 71 bp, chicken (Gallus Gallus)
  misc_feature (36): n=c or t
gctttatttattttctttatgttttttcacagtaangtaactgctgtcaggtttcaggtgtgcactacaga

SEQ ID NO: 6081 - DNA, 71 bp, chicken (Gallus Gallus)
  misc_feature (36): n=c or t
ctgtgtgccaagattagagtaaatatagttgtgctnttacatcctttgacaatgtggttgcacctcattgc

SEQ ID NO: 6082 - DNA, 71 bp, chicken (Gallus Gallus)
  misc_feature (36): n=g or t
ctcagccagttcacaagcttcacagtgattaacagnctgctttatgtagttattcatctgccccataacta

SEQ ID NO: 6083 - DNA, 71 bp, chicken (Gallus Gallus)
  misc_feature (36): n=g or t
ccaaataaaacatagcagaattgcaaccgagtaaanaaagacttgacttcaaatggcaactttcagcaggc

SEQ ID NO: 6084 - DNA, 71 bp, chicken (Gallus Gallus)
  misc_feature (36): n=a or g
tccacagaaacttctttacttgtgctaggtgtgggntcactctcttactggaaggaatcaaaggaatggga

SEQ ID NO: 6085 - DNA, 71 bp, chicken (Gallus Gallus)
  misc_feature (36): n=a or g
gttataaaggttctccagaaatcctgtcttgatttncagtgatttgaaagctgtgttttttattcatcaga

SEQ ID NO: 6086 - DNA, 71 bp, chicken (Gallus Gallus)
  misc_feature (36): n=a or g
gaaggatgcttttatttagatggtcacaaagtacanagaagcttcagcaatacagtcattttagcagagca

SEQ ID NO: 6087 - DNA, 71 bp, chicken (Gallus Gallus)
  misc_feature (36): n=a or g
tcctagcaaagatagctgtttttgtaataagaggangatgggacctttaatgtccattgtttgtcactggc

SEQ ID NO: 6088 - DNA, 71 bp, chicken (Gallus Gallus)
  misc_feature (36): n=a or c
tcttctctgctctcactgcctgaatgtttcatttgnactttgaaatgtgcaaaactttttaatattttaat

SEQ ID NO: 6089 - DNA, 71 bp, chicken (Gallus Gallus)
  misc_feature (36): n=c or t
gtaagagataagtattttcctaatttatgaagcacnttataagccgttgtttgcagacctgcactgagttt

SEQ ID NO: 6090 - DNA, 71 bp, chicken (Gallus Gallus)
  misc_feature (36): n=g or t
ggccttgttcagctccaaggttgctccagaccttangagagacaagtgcatccaggactcctgctgagcat

SEQ ID NO: 6091 - DNA, 71 bp, chicken (Gallus Gallus)
  misc_feature (36): n=c or t
tattagaacaggtgtgatggcaatcaagggagctcngctaagtgaggaacttggagtgcaatacacaagca

SEQ ID NO: 6092 - DNA, 71 bp, chicken (Gallus Gallus)
  misc_feature (36): n=a or g
cttcccagcaaggaagcctgaagcgaaagactaacngctcataagatatgcctgcagaaaaatgttctttt

SEQ ID NO: 6093 - DNA, 71 bp, chicken (Gallus Gallus)
  misc_feature (36): n=c or t
tagtaagttcgtagctggatttcatgatcggatacntacatggttgcaatagagatacataatattgtcca

SEQ ID NO: 6094 - DNA, 71 bp, chicken (Gallus Gallus)
  misc_feature (36): n=a or g
aggcaggagataccttcacaaatttgtagaagtgtntaaagtgtgtagaagtaaaaccatactttgtgggt

SEQ ID NO: 6095 - DNA, 71 bp, chicken (Gallus Gallus)
  misc_feature (36): n=c or t
tttgcttaagtctatttcagatctctaactagtctntgtatctctgagctcctgaaatattgagtcaatca

SEQ ID NO: 6096 - DNA, 71 bp, chicken (Gallus Gallus)
  misc_feature (36): n=c or t
aggtatcattagttaggtatgtctttatgcctccanaaaattgtttttgtaaaaaagcaaaacaaaccatt

SEQ ID NO: 6097 - DNA, 71 bp, chicken (Gallus Gallus)
  misc_feature (36): n=c or g
tccacctgtgcagctaatgctcttatactggtgtgnaggtgtgcattaactccctgcctacaagtggttgg

SEQ ID NO: 6098 - DNA, 71 bp, chicken (Gallus Gallus)
  misc_feature (36): n=c or t
agaaatgttcttccctttctatggactacatctacncagatttagtagaaacaagccaaagaaccttccct

SEQ ID NO: 6099 - DNA, 71 bp, chicken (Gallus Gallus)
  misc_feature (36): n=a or g
actgggcatcaggagcattttaccctgccagcttcnctgtctctagagcaggaagaaaggttctcctttca

SEQ ID NO: 6100 - DNA, 71 bp, chicken (Gallus Gallus)
  misc_feature (36): n=a or g
agcatgacttgaattcacattttcggatgtgaaagnctagaacagtaatagctgatgccaaagagtacctt

SEQ ID NO: 6101 - DNA, 71 bp, chicken (Gallus Gallus)
  misc_feature (36): n=g or t
gagtcctgcacagccctgcttcgggttgtgcaaggntagggtcatgttgggtgttaggaaacatttctctg

SEQ ID NO: 6102 - DNA, 71 bp, chicken (Gallus Gallus)
  misc_feature (36): n=a or g
aagctagtcctgatttcattcagtatctgacatacnattatgcttttgacaactgcataccttaatggcca

SEQ ID NO: 6103 - DNA, 71 bp, chicken (Gallus Gallus)
  misc_feature (36): n=c or t
gtgagactacataaagaaatggtctcaagttgtgcntgtagagatttagattgaacattaagaatttcttt

SEQ ID NO: 6104 - DNA, 71 bp, chicken (Gallus Gallus)
  misc_feature (36): n=a or g
tactgcatcccgagagccctgggggcccaaaggagntatccatggattgaagctgtgtggcctgaaggaag

SEQ ID NO: 6105 - DNA, 71 bp, chicken (Gallus Gallus)
  misc_feature (36): n=c or t
acctggccggggatgggccatgcacacgaggatgcnttccaaaatggagctaaatcacatggcggcctcac

SEQ ID NO: 6106 - DNA, 71 bp, chicken (Gallus Gallus)
  misc_feature (36): n=c or t
caaatctcatttactgtgctctattaatatggcagntggagatgaaaggctacatgaagctggaacacttg

SEQ ID NO: 6107 - DNA, 71 bp, chicken (Gallus Gallus)
  misc_feature (36): n=c or t
ctgttcagcatggttgctgtggtttgatagtacttntcagtgttttagcttttaatttgcctgatacatcc

SEQ ID NO: 6108 - DNA, 71 bp, chicken (Gallus Gallus)
  misc_feature (36): n=a or g
actgcaaataattacatggactgtaaagatcttggnaaggatttgaagagaagaaggaaaccagaagcaga

SEQ ID NO: 6109 - DNA, 71 bp, chicken (Gallus Gallus)
  misc_feature (36): n=c or t
agtagatgggcatcagattagtcagactggatggantttcctgtcatgaaactatgttgatggtgcctgat

SEQ ID NO: 6110 - DNA, 71 bp, chicken (Gallus Gallus)
  misc_feature (36): n=c or t
cacagtggtgccaatttgttagcagcttggtgacangcacagataagccccagcaaggaactggcccattg

SEQ ID NO: 6111 - DNA, 71 bp, chicken (Gallus Gallus)
  misc_feature (36): n=c or t
aaataatttaggagaaagtaattcagacttgaatgnggtgtgaacgagaaaaacacaggaagaggagtcaa

SEQ ID NO: 6112 - DNA, 71 bp, chicken (Gallus Gallus)
  misc_feature (36): n=a or g
tgggtgtgttttctaacactgacctcacaagggccnatctggcagcgagtcattaaattattaggcctatc

SEQ ID NO: 6113 - DNA, 71 bp, chicken (Gallus Gallus)
  misc_feature (36): n=c or t
ttgaaggtggtagaagttcagtatggaacacctctngttttctgtgggtgccaactcaatagtgcaggttg

SEQ ID NO: 6114 - DNA, 71 bp, chicken (Gallus Gallus)
  misc_feature (36): n=a or g
tgaccattctaaagtgaaaaatccaggcacggctcntagtattaataatcacttaaaagtccttaaataat

SEQ ID NO: 6115 - DNA, 71 bp, chicken (Gallus Gallus)
  misc_feature (36): n=c or t
agatgagctcccacctctattctacttttcatgtangctcttggggaaatacttaattcccactttctgct

SEQ ID NO: 6116 - DNA, 71 bp, chicken (Gallus Gallus)
  misc_feature (36): n=a or g
cagtttgtggaaagtgatatagtacaatattcattnccattgtagctgcagctgaccaatgttagccaaaa

SEQ ID NO: 6117 - DNA, 71 bp, chicken (Gallus Gallus)
  misc_feature (36): n=a or g
caaaggtccttcctactagctctctaacaagaattnccattcgctccagagaaggtaccaaatggtaggat

SEQ ID NO: 6118 - DNA, 71 bp, chicken (Gallus Gallus)
  misc_feature (36): n=c or t
atggttgatcttccagggtcaagcttatctagctanggagagaaaatatttataactggaggatgcaaagg

SEQ ID NO: 6119 - DNA, 71 bp, chicken (Gallus Gallus)
  misc_feature (36): n=a or g
gttttggttccaggtcaagtaacatcagagaataangaggagatattaattatagagagtgggtaatttct

SEQ ID NO: 6120 - DNA, 71 bp, chicken (Gallus Gallus)
  misc_feature (36): n=c or t
ctaggaccaaacatacaatagtatctgatctgatcnctgctacgtttggcaaaaataatgggtcaattgcc

SEQ ID NO: 6121 - DNA, 71 bp, chicken (Gallus Gallus)
  misc_feature (36): n=g or t
cattgagatcatcttttgattaaggtactggattanaataccggaagctgaagttttatattacacttgtg

SEQ ID NO: 6122 - DNA, 71 bp, chicken (Gallus Gallus)
  misc_feature (36): n=a or g
tggcaggagcttgggcctattcctgactaactcggncacgttttgaaaagtgttaaatgccctttcggatt

SEQ ID NO: 6123 - DNA, 71 bp, chicken (Gallus Gallus)
  misc_feature (36): n=a or g
tctccaaaatctcaacaatatatttcatagagtgtngaatggtttgaacttatgacaatttggtttcttat

SEQ ID NO: 6124 - DNA, 71 bp, chicken (Gallus Gallus)
  misc_feature (36): n=a or g
caaggtgcccgcatctaagaacaactggaacagctngtggaaagatagcaatgtcagaatcatcgctgtat

SEQ ID NO: 6125 - DNA, 71 bp, chicken (Gallus Gallus)
  misc_feature (36): n=c or t
aaacaaaggctgccaactggctggcattgattcagnttatgtgagtagggggatatgttcagttaatattg

SEQ ID NO: 6126 - DNA, 71 bp, chicken (Gallus Gallus)
  misc_feature (36): n=c or t
agcgactctcataaccttcagaataaagaatgagangtatttatccacgctcagctcgcccgttcctccag

SEQ ID NO: 6127 - DNA, 71 bp, chicken (Gallus Gallus)
  misc_feature (36): n=c or t
tggccttttccagaagatgcgtaccgttccatgaanggtcacatggttacttccaggtttttgtttttccc

SEQ ID NO: 6128 - DNA, 71 bp, chicken (Gallus Gallus)
  misc_feature (36): n=c or g
catgcctttaaatgtaaagcaatagaacagtgctgncaaatgcatgtgctctgatctgatctgctttctgg

SEQ ID NO: 6129 - DNA, 71 bp, chicken (Gallus Gallus)
  misc_feature (36): n=a or g
ggtgcatgaggaatttgacactggagaacacagcanccatctcttcaatggtgctatagaacagcctgaca

SEQ ID NO: 6130 - DNA, 71 bp, chicken (Gallus Gallus)
  misc_feature (36): n=c or t
ctcagtcccagtcacttgccctgagatctgtggtgnttcacatttcagcgctctcttcccggatgtggtga

SEQ ID NO: 6131 - DNA, 71 bp, chicken (Gallus Gallus)
  misc_feature (36): n=a or g
aaatctcttctaccttgtgctttgtgaagagtgccntatggtagcgggagaaagataatgaccagctcatt

SEQ ID NO: 6132 - DNA, 71 bp, chicken (Gallus Gallus)
  misc_feature (36): n=a or c
tccttttaggacattgatgtcagtttatatactgcnaacacatacgaggatgtaagtatagttaaaatttg

SEQ ID NO: 6133 - DNA, 71 bp, chicken (Gallus Gallus)
  misc_feature (36): n=a or g
ttgctgggattagtacgacgaacatctttatgcacntggtcagcaagaccaaaaggtcactacggttttaa

SEQ ID NO: 6134 - DNA, 71 bp, chicken (Gallus Gallus)
  misc_feature (36): n=a or g
cttcaggattagggtaatcttcccgtatgaaaatanattcttttgtctaacagtccaaggtccactcagta

SEQ ID NO: 6135 - DNA, 71 bp, chicken (Gallus Gallus)
  misc_feature (36): n=a or g
aaaacgtagctgagaaagatacagtattctgttgtngaagcataatccccctcagggaagtctgtaatgga

SEQ ID NO: 6136 - DNA, 71 bp, chicken (Gallus Gallus)
  misc_feature (36): n=c or t
tatgtaaacaaatgcattttaggatcagaatgatgngatccttgatgtcaccagctcacgcggcagttaga

SEQ ID NO: 6137 - DNA, 71 bp, chicken (Gallus Gallus)
  misc_feature (36): n=c or t
tctgagcttttaacaaaggattgatactgactttcnctttggcctttgaagctccaggtctcttaaccaaa

SEQ ID NO: 6138 - DNA, 71 bp, chicken (Gallus Gallus)
  misc_feature (36): n=a or g
tacacagtcagagacagtcactacatgctgtctagngaaatctgaatcaacaatgcaagagataaaacatt

SEQ ID NO: 6139 - DNA, 71 bp, chicken (Gallus Gallus)
  misc_feature (36): n=a or g
gtggaattaaggatacttttggtcaaagtcctgcantaaggaagtaggcaactggaaatatcctgacatgg

SEQ ID NO: 6140 - DNA, 71 bp, chicken (Gallus Gallus)
  misc_feature (36): n=c or g
ctccgctgggactaaaattgagaaattcttattttntgaggtcaaagctaacctgtatccagcaccccatc

SEQ ID NO: 6141 - DNA, 71 bp, chicken (Gallus Gallus)
  misc_feature (36): n=a or g
agtacaaaacgtatatagtgctctgtgtttggttancttatttcatttactatcatctcctgactggggag

SEQ ID NO: 6142 - DNA, 71 bp, chicken (Gallus Gallus)
  misc_feature (36): n=a or c
tacatattataccacccccttgatcacgtaatctgnttcttgcaccttctctagcttccacaaataatcag

SEQ ID NO: 6143 - DNA, 71 bp, chicken (Gallus Gallus)
  misc_feature (36): n=c or t
aaaaattaaatatgtattgcaatggaagtgagagtnggtccattcactacaggaataaactcactgttagc

SEQ ID NO: 6144 - DNA, 71 bp, chicken (Gallus Gallus)
  misc_feature (36): n=c or t
ctttcaaaggaaagagataaataccgcagagttccnaaacactggaactgaaggacagaagcatggggtcg

SEQ ID NO: 6145 - DNA, 71 bp, chicken (Gallus Gallus)
  misc_feature (36): n=c or t
gggatatctgagggctgattaggtcagacaggagantccatgtaaagaaattaccattggtgaattattta

SEQ ID NO: 6146 - DNA, 71 bp, chicken (Gallus Gallus)
  misc_feature (36): n=c or t
ttttaggtactacagtagctaagtcatcaaacattngtctccgtagtttgtgaactgtgtgaactgttgtg

SEQ ID NO: 6147 - DNA, 71 bp, chicken (Gallus Gallus)
  misc_feature (36): n=c or t
gttttaaggtggcagtaaattagtggctaatgtaangttgcccagttgttcccttcccctagaagactgca

SEQ ID NO: 6148 - DNA, 71 bp, chicken (Gallus Gallus)
  misc_feature (36): n=c or t
tcccctaagaaagggcctcaaccagctttgaaaacngtctgccatgttgatctacccccatgccagcccat

SEQ ID NO: 6149 - DNA, 71 bp, chicken (Gallus Gallus)
  misc_feature (36): n=a or g
tcagactaaaaaggtaggtcacattcctatgacatnaaatgtctttatttaagtcatgtgtcaaagcaaga

SEQ ID NO: 6150 - DNA, 71 bp, chicken (Gallus Gallus)
  misc_feature (36): n=a or g
gcaagatgagctgcctctgttgtgtgggtctcttgnaagttacatgggtaagtaaatccagtgagtctgac

SEQ ID NO: 6151 - DNA, 71 bp, chicken (Gallus Gallus)
  misc_feature (36): n=a or g
ataactgttacgtaagagcaatcaagacttttctcntggtgttcagcacgtatcatctgtttaccatctaa

SEQ ID NO: 6152 - DNA, 71 bp, chicken (Gallus Gallus)
  misc_feature (36): n=a or g
ccattgggaactgtagtaaatgttgtccttcatctntgattttcaatagaatagtgtcagctatatgctga

SEQ ID NO: 6153 - DNA, 71 bp, chicken (Gallus Gallus)
  misc_feature (36): n=c or t
ttccattgaacgaataccaagagctctttacaggantgctgggttatgtggtaaaaatcagagatcacgta

SEQ ID NO: 6154 - DNA, 71 bp, chicken (Gallus Gallus)
  misc_feature (36): n=c or t
cctttcttttactcatccctacagaaactttcaggnctcaaataacagtggatgttggccatacttaaaaa

SEQ ID NO: 6155 - DNA, 71 bp, chicken (Gallus Gallus)
  misc_feature (36): n=c or t
ttgtcaagttttggggccaattcagactggttccangattaatggggagggaggactcatggacatacacc

SEQ ID NO: 6156 - DNA, 71 bp, chicken (Gallus Gallus)
  misc_feature (36): n=a or g
ccactggctttgatatgaattacagtggtgtgtganttgatgatagtgttattagctgatgcttattccca

SEQ ID NO: 6157 - DNA, 71 bp, chicken (Gallus Gallus)
  misc_feature (36): n=g or t
ccctatatccttctccacagagctgcactcaattanttcttctcccactaagtagacataatggaattgcc

SEQ ID NO: 6158 - DNA, 71 bp, chicken (Gallus Gallus)
  misc_feature (36): n=a or g
gcatgaaataacttcattagtccttctccgcttcancctctcttttcgtaataacctgctgctaaattaac

SEQ ID NO: 6159 - DNA, 71 bp, chicken (Gallus Gallus)
  misc_feature (36): n=a or c
attcaaattatcagttaatatatctttgccttttcnagactagaagtggtggtaactagctctttcccttt

SEQ ID NO: 6160 - DNA, 71 bp, chicken (Gallus Gallus)
  misc_feature (36): n=g or t
agcagcaaggatgtttctttgtgaaaggtaagctgnacagctaactagtgagagccagatggagttgattt

SEQ ID NO: 6161 - DNA, 71 bp, chicken (Gallus Gallus)
  misc_feature (36): n=a or c
tccacatttgtcgatcggtatgcaaagaagctgccnaacgtttttgccaggctgctgtgctgaccccactg

SEQ ID NO: 6162 - DNA, 71 bp, chicken (Gallus Gallus)
  misc_feature (36): n=c or t
acctgctatgattaacaattcttgcaagatgtaagnccatggtactagttctactttcccaaacagatttc

SEQ ID NO: 6163 - DNA, 71 bp, chicken (Gallus Gallus)
  misc_feature (36): n=a or g
ctaaacctcttttgcattgtggtctttgaattcgcngaactcatagaatttcacagtcctgtcatgcaaat

SEQ ID NO: 6164 - DNA, 71 bp, chicken (Gallus Gallus)
  misc_feature (36): n=c or t
tcctaacatccagcctgaaccttccctggtgcagcntgaggccataagtccatcacctatcccaggaatgt

SEQ ID NO: 6165 - DNA, 71 bp, chicken (Gallus Gallus)
  misc_feature (36): n=a or g
tgatgctcttaccaatggtcatactgtcagcacccntgctcagtgggcagcagtttgcaagactcagggaa

SEQ ID NO: 6166 - DNA, 71 bp, chicken (Gallus Gallus)
  misc_feature (36): n=a or g
ctctagctcacaagtgtggattaaactcttcctacnttgtgtattgcttataatatggaacttcattaact

SEQ ID NO: 6167 - DNA, 71 bp, chicken (Gallus Gallus)
  misc_feature (36): n=c or t
ggccctggcaaaggcacagccttcaaatcccttttntcccatattaacctacaaggatgggtcagtgctga

SEQ ID NO: 6168 - DNA, 71 bp, chicken (Gallus Gallus)
  misc_feature (36): n=c or t
agggacaagatggtcataacactattgaacacatcnggcaatcactatacatacagttctatatttgtgtc

SEQ ID NO: 6169 - DNA, 71 bp, chicken (Gallus Gallus)
  misc_feature (36): n=a or g
ttctcatggtccacagccacgtaaaaaggagtttcntaaacctagaagagatgcactgctgtaacactcag

SEQ ID NO: 6170 - DNA, 71 bp, chicken (Gallus Gallus)
  misc_feature (36): n=c or t
ttgacatgggttctcagcaaatggcttcctcttggnttcccagtagctggcacagaagaattgttaaacta

SEQ ID NO: 6171 - DNA, 71 bp, chicken (Gallus Gallus)
  misc_feature (36): n=c or t
aatcaagcctgactagaagctagggactacagaccntgtcataatgttaaatagaagtaattcaggatggt

SEQ ID NO: 6172 - DNA, 71 bp, chicken (Gallus Gallus)
  misc_feature (36): n=g or t
cttacagaaaaaaacgtctcagaagatctgggagancagcagattatggctaattaccactggcactctcc

SEQ ID NO: 6173 - DNA, 71 bp, chicken (Gallus Gallus)
  misc_feature (36): n=c or t
ggaaaaaaaatccgtattgtactataaacaagtatngttcccaactgatcacctgttactagtcaacatga

SEQ ID NO: 6174 - DNA, 71 bp, chicken (Gallus Gallus)
  misc_feature (36): n=a or g
aggccagcagattaaaatacaagagaaatataaccntaactagcactgctattttcaagtttcaatttatc

SEQ ID NO: 6175 - DNA, 71 bp, chicken (Gallus Gallus)
  misc_feature (36): n=c or t
agatccttgtggagcagggtcttgcttcccttcacntcttccatctcactcttgccatgggccaggcaaca

SEQ ID NO: 6176 - DNA, 71 bp, chicken (Gallus Gallus)
  misc_feature (36): n=a or g
ttgttcatcacagcagttttaaggtgctttaagatnttgatattttagctattgataaaccaagtttctgc

SEQ ID NO: 6177 - DNA, 71 bp, chicken (Gallus Gallus)
  misc_feature (36): n=c or t
atccactacagaataaccaaaatagaccatatgacnacatagtccttcagtactcctcatcccattattgt

SEQ ID NO: 6178 - DNA, 71 bp, chicken (Gallus Gallus)
  misc_feature (36): n=a or c
gtaatactctcctctgtgtgtccctccttgccacanagtgttctagcacttaccttacgttgtttgcccat

SEQ ID NO: 6179 - DNA, 71 bp, chicken (Gallus Gallus)
  misc_feature (36): n=a or g
agatagaacctcagatgtatgatcattttaacaatngaaacatggattttctttatgctttgttttggttt

SEQ ID NO: 6180 - DNA, 71 bp, chicken (Gallus Gallus)
  misc_feature (36): n=c or t
ccaggtgaacagtagaagggttggacagttcctaangcaatgtgttttgagccaaaacaggaccaaacgtc

SEQ ID NO: 6181 - DNA, 71 bp, chicken (Gallus Gallus)
  misc_feature (36): n=c or t
gtggcctcagagctggctgagataaggagatgcttnctgacagcacctgacgcaactgaggaagtctttct

SEQ ID NO: 6182 - DNA, 71 bp, chicken (Gallus Gallus)
  misc_feature (36): n=a or g
gtaattttggggtgtatgtgtgtttctctcccgcantccttcattgcagacaagctcaccgttattgctaa

SEQ ID NO: 6183 - DNA, 71 bp, chicken (Gallus Gallus)
  misc_feature (36): n=a or g
gggtgtataaccacacacgacttaccgatctcagcngcgagatccccttaaataaatacatcagaatatac

SEQ ID NO: 6184 - DNA, 71 bp, chicken (Gallus Gallus)
  misc_feature (36): n=c or t
aacacttagctgatggtggaggagagaaagttgtancctaaagatgctgcacaaaagaatttcaaaggtga

SEQ ID NO: 6185 - DNA, 71 bp, chicken (Gallus Gallus)
  misc_feature (36): n=c or t
atttttggcaaagatattcagtctcattattgaaanattctttcagtgtctctggttattttcctttaaag

SEQ ID NO: 6186 - DNA, 71 bp, chicken (Gallus Gallus)
  misc_feature (36): n=a or c
tgcatatggacaagtgcaatggagacactaccaganttacttcacagacagatcatgacttgtaccatggg

SEQ ID NO: 6187 - DNA, 71 bp, chicken (Gallus Gallus)
  misc_feature (36): n=a or g
cagttccaagacctatgctgtctgccttcaagagcntcatatgtctgagctcactgagcactgggtgcaga

SEQ ID NO: 6188 - DNA, 71 bp, chicken (Gallus Gallus)
  misc_feature (36): n=a or g
ttacaatcttgagaaatagcttctgcagtcactacnagtgcacgcacagatcaagttttagggtaacctga

SEQ ID NO: 6189 - DNA, 71 bp, chicken (Gallus Gallus)
  misc_feature (36): n=a or g
ttcttctaccttcacttaaatattggaagttgtggntgtatgtatgatctaattgcatacccacatattac

SEQ ID NO: 6190 - DNA, 71 bp, chicken (Gallus Gallus)
  misc_feature (36): n=a or g
agacactgcaaaggggtcttgaactgtgtaatgacntgctgttaggcagccaaagcatatctgtccatatc

SEQ ID NO: 6191 - DNA, 71 bp, chicken (Gallus Gallus)
  misc_feature (36): n=c or t
cttcattacctaatgaatttagcatcttggttcatntttaaacgtagccttaaacttcactgtaaagcagc

SEQ ID NO: 6192 - DNA, 71 bp, chicken (Gallus Gallus)
  misc_feature (36): n=c or t
aaattgacaaggactgaccaatcaagctgtacatanagagctgtgctactacataacggacattgggaaca

SEQ ID NO: 6193 - DNA, 71 bp, chicken (Gallus Gallus)
  misc_feature (36): n=c or t
tgaggcttccttccaacctgagatattcctaacagnctgaaataaaagtcaccagcttctctggaaatgca

SEQ ID NO: 6194 - DNA, 71 bp, chicken (Gallus Gallus)
  misc_feature (36): n=c or t
gctcccctgcacagcccactgctgctgtcagttccngcatgtgcatgaaggaaagcctccctaagggcttc

SEQ ID NO: 6195 - DNA, 71 bp, chicken (Gallus Gallus)
  misc_feature (36): n=c or t
acaagtttgctggcgatatttttgaattatcagaantgaacaacatttttcaacttcttctctttatagtc

SEQ ID NO: 6196 - DNA, 71 bp, chicken (Gallus Gallus)
  misc_feature (36): n=c or t
tgtcagtcagtaccacttggatgtaaacagacatanggtatatctaagctctaaggcaactgctctgtttt

SEQ ID NO: 6197 - DNA, 71 bp, chicken (Gallus Gallus)
  misc_feature (36): n=g or t
atgttcaggactgttctgttgccccctctttcagtnaatttcagagggaaacccaagagcagcctctacag

SEQ ID NO: 6198 - DNA, 71 bp, chicken (Gallus Gallus)
  misc_feature (36): n=a or g
ataatgaattattcaacaaaagccttaactgaaagncaacagttcacaaatatctgataaaactattagta

SEQ ID NO: 6199 - DNA, 71 bp, chicken (Gallus Gallus)
  misc_feature (36): n=c or t
tacatagtgctattattgttactacagctgattaangagtgaataattctcactaggaaaaaataaaataa

SEQ ID NO: 6200 - DNA, 71 bp, chicken (Gallus Gallus)
  misc_feature (36): n=a or c
aaagtcatttgctcaattagtttgaagtctagacanttagtttaggttagacatctatactccgatggtca

SEQ ID NO: 6201 - DNA, 71 bp, chicken (Gallus Gallus)
  misc_feature (36): n=c or t
tcagtttgttatgcaagctgtagttaaaatgccacngagagtcagaatacacgaagaagtgagtagctcag

SEQ ID NO: 6202 - DNA, 71 bp, chicken (Gallus Gallus)
  misc_feature (36): n=c or t
aagagagccagaatgctgggtaggtgcagtatgaangacatttttacaccgatctctctcatcttccttct

SEQ ID NO: 6203 - DNA, 71 bp, chicken (Gallus Gallus)
  misc_feature (36): n=a or g
cactcaaacctgcagcaattttttatggcgagagcnaaagaaccaacataaagctgcagagtgactttatt

SEQ ID NO: 6204 - DNA, 71 bp, chicken (Gallus Gallus)
  misc_feature (36): n=a or g
catttatacagttggcacaaaactgagcaaaacccnaaggatttaacaaagctaaacaaatgacagaatac

SEQ ID NO: 6205 - DNA, 71 bp, chicken (Gallus Gallus)
  misc_feature (36): n=a or g
aagagttatgcaattaaaatgtcctcccatgcctcngtctccagtggaacgggcaacacacttaagttaca

SEQ ID NO: 6206 - DNA, 71 bp, chicken (Gallus Gallus)
  misc_feature (36): n=c or t
aggagacctttgtaaggctgattaatccatccaagnagacccttctgccagttgccagctagctggtgcaa

SEQ ID NO: 6207 - DNA, 71 bp, chicken (Gallus Gallus)
  misc_feature (36): n=a or g
aaagttgtaaaactttcagggtaattataagcaacncaacattaatccatcgcagaaaacaaacgtatctc

SEQ ID NO: 6208 - DNA, 71 bp, chicken (Gallus Gallus)
  misc_feature (36): n=a or g
ttgaaatgagccatataccagctctttatactacantgcacacgtcataaaaatctaagtgcaacaccatt

SEQ ID NO: 6209 - DNA, 71 bp, chicken (Gallus Gallus)
  misc_feature (36): n=a or g
gtctcaccccagagcatggggagctcgtaaagcctnactggttgagcgaaaaaccaaacaggtctatcacc

SEQ ID NO: 6210 - DNA, 71 bp, chicken (Gallus Gallus)
  misc_feature (36): n=a or g
gggctgtgttttcagaaaagcaccctcaaattctgnaaaacttcatcctaagtgcagactattgtagacta

SEQ ID NO: 6211 - DNA, 71 bp, chicken (Gallus Gallus)
  misc_feature (36): n=c or t
gtgcttatacagtgacaccttttggatcggagcagngtgggttacaaacagctcagctccggcagccctgc

SEQ ID NO: 6212 - DNA, 71 bp, chicken (Gallus Gallus)
  misc_feature (36): n=c or t
tgaaatctaccactagggtaaagaacagaccagtcnccaggtgacaagatagcttgtgccaggaggccaaa

SEQ ID NO: 6213 - DNA, 71 bp, chicken (Gallus Gallus)
  misc_feature (36): n=a or g
ttcccacaatgggtgtgaaggccagaacacaaagcnatgggcctaagctgcacaaaaggaccttcagttag

SEQ ID NO: 6214 - DNA, 71 bp, chicken (Gallus Gallus)
  misc_feature (36): n=a or g
ctgttctatgtcttgttaccagctgttgtctatagncctcttgcagtaccttcttaatttctttcctgtgg

SEQ ID NO: 6215 - DNA, 71 bp, chicken (Gallus Gallus)
  misc_feature (36): n=c or t
gtgtctgcagtttcaccttccctctaattagagagntggtctttggatgtaggcagcattacacagcccat

SEQ ID NO: 6216 - DNA, 71 bp, chicken (Gallus Gallus)
  misc_feature (36): n=a or g
tttgagacttttgccttgcctaggatgaggggcagncataagccctgtagctgtctctgcaccagtctcaa

SEQ ID NO: 6217 - DNA, 71 bp, chicken (Gallus Gallus)
  misc_feature (36): n=g or t
ttgttttgtgagctcctaacatctccgtgaacaganaagcagctttatttatttcttatacgctgtaagtg

SEQ ID NO: 6218 - DNA, 71 bp, chicken (Gallus Gallus)
  misc_feature (36): n=c or t
gtagctgaggggtgacagagtattcaaaagctttgngtaattcctttctggaacatttctgaaataataca

SEQ ID NO: 6219 - DNA, 71 bp, chicken (Gallus Gallus)
  misc_feature (36): n=a or t
aagactcccttcacaacagcaagtatttctgcagtngtagttacagctgtgtactcctctctttagaagaa

SEQ ID NO: 6220 - DNA, 71 bp, chicken (Gallus Gallus)
  misc_feature (36): n=a or g
cctgcagccccgcagcaccagcgggtgctcagtgcnctccgtgctgctctgtatgcaaagcactgagattt

SEQ ID NO: 6221 - DNA, 71 bp, chicken (Gallus Gallus)
  misc_feature (36): n=a or c
cttgcagtggcaatcatcatctctagcttcaccatntctgaaatttgatgggtatattactttctagaatc

SEQ ID NO: 6222 - DNA, 71 bp, chicken (Gallus Gallus)
  misc_feature (36): n=c or t
agcagaattaaatctgtatacctacctgtgcaaccnattttgggataccctgcttagcagggtggtgggac

SEQ ID NO: 6223 - DNA, 71 bp, chicken (Gallus Gallus)
  misc_feature (36): n=a or g
caggcccatagggtttggagagtcagtgaagagganggcagaggaattttaatgagaaaataatcaaagga

SEQ ID NO: 6224 - DNA, 71 bp, chicken (Gallus Gallus)
  misc_feature (36): n=a or c
agcaggagacttaatggaagggaaaccaggggtganatccactgctatgtgctctggtgaaaagagactca

SEQ ID NO: 6225 - DNA, 71 bp, chicken (Gallus Gallus)
  misc_feature (36): n=a or g
cgtgtattaatattacacgataatctggtggagggnaaaaaaaaaaataaaaggctggatctcgagcttct

SEQ ID NO: 6226 - DNA, 71 bp, chicken (Gallus Gallus)
  misc_feature (36): n=g or t
cttacatctcacagtgagatctaatatttttaaagnggaagaaagattcaataaaaaaattcaagtcttta

SEQ ID NO: 6227 - DNA, 71 bp, chicken (Gallus Gallus)
  misc_feature (36): n=a or g
aattgaaattataacaattttctattttaaagtatnaagttctccttttctaattgcagcatgcggattga

SEQ ID NO: 6228 - DNA, 71 bp, chicken (Gallus Gallus)
  misc_feature (36): n=c or t
ggtgctgtctactcgtagcactttggattacatcantgtaagctgagttaaagaattcagtagtggtcttt

SEQ ID NO: 6229 - DNA, 71 bp, chicken (Gallus Gallus)
  misc_feature (36): n=a or g
tgatcttttctttctactagccctgttgagtaaganatacgggataggtagatagaaatgtacacttgaga

SEQ ID NO: 6230 - DNA, 71 bp, chicken (Gallus Gallus)
  misc_feature (36): n=a or c
tcccatatgagtgctgggcacagcctgggaactggnttgggctacaatagctgctcagcaaatacctggac

SEQ ID NO: 6231 - DNA, 71 bp, chicken (Gallus Gallus)
  misc_feature (36): n=a or t
gaggccatccctctagtcctattgctagttaatacngtattgtgcttatatagcttactcacaaaaagccc

SEQ ID NO: 6232 - DNA, 71 bp, chicken (Gallus Gallus)
  misc_feature (36): n=a or g
gctggtcagaagtttttacgttgtctttttcaaatncaaacacaattccacaaagtaggtcttgatatcta

SEQ ID NO: 6233 - DNA, 71 bp, chicken (Gallus Gallus)
  misc_feature (36): n=a or g
ggctgggagtgcatggggaggtgggaagggatggancaagaatagctgacccaaatgggtaaaagggatgt

SEQ ID NO: 6234 - DNA, 71 bp, chicken (Gallus Gallus)
  misc_feature (36): n=c or t
tctttctgccagttagtagcttcatgcatcagcccnttttccaggcatattcacatggatgaaataccaaa

SEQ ID NO: 6235 - DNA, 71 bp, chicken (Gallus Gallus)
  misc_feature (36): n=c or t
aagttaatgtttcatgttttcagctaggcatcagtncccggcttgttcatatcaatcggtacttctttatt

SEQ ID NO: 6236 - DNA, 71 bp, chicken (Gallus Gallus)
  misc_feature (36): n=a or g
tatgtgctcgtacctacactgatgagatggttgctntacagttctcattctgtggtgtggacagatgtcat

SEQ ID NO: 6237 - DNA, 71 bp, chicken (Gallus Gallus)
  misc_feature (36): n=c or t
atctattcctagattacttgtttctttgtttaatgnatcctctttcctactaaacccctcacctgatatcg

SEQ ID NO: 6238 - DNA, 71 bp, chicken (Gallus Gallus)
  misc_feature (36): n=a or g
attcggtccagaagagtttgcaaactttacatgccnttacttcagggaagagcggtgttcatcatagagta

SEQ ID NO: 6239 - DNA, 71 bp, chicken (Gallus Gallus)
  misc_feature (36): n=c or t
tgcagagccaaacatggtgcctgcttcttgccttgngcaaattgtgcaggactgtgttctagctcctgtgc

SEQ ID NO: 6240 - DNA, 71 bp, chicken (Gallus Gallus)
  misc_feature (36): n=c or t
atgaatataatgaataaggatgtaaatgctctaatnaaatacagtcaattacaatgcaaacagctgtgtgc

SEQ ID NO: 6241 - DNA, 71 bp, chicken (Gallus Gallus)
  misc_feature (36): n=a or t
tcagcacgctcttgcagctttggacaagcgcatctnatctcaggctgtgctctatggcctgctgctgctct

SEQ ID NO: 6242 - DNA, 71 bp, chicken (Gallus Gallus)
  misc_feature (36): n=g or t
aaggcagagtgcatgagatcattctcagttcctaantgacagatatactggattgcaactcaggaacaaaa

SEQ ID NO: 6243 - DNA, 71 bp, chicken (Gallus Gallus)
  misc_feature (36): n=a or g
tagggagtatcctgaggctagctgtgggtgcccccntggctctgcctgattgacctctaagttgccctgca

SEQ ID NO: 6244 - DNA, 71 bp, chicken (Gallus Gallus)
  misc_feature (36): n=c or t
agttttatgtcctcagtcaagccttcagcgaggcanagaggtctgtgaaatgctttcatcccagcctttct

SEQ ID NO: 6245 - DNA, 71 bp, chicken (Gallus Gallus)
  misc_feature (36): n=c or t
gagaaatcagccaagctgacattgtgtgcagtgccngagatctgccttttgttgaccaaagggttgggtcc

SEQ ID NO: 6246 - DNA, 71 bp, chicken (Gallus Gallus)
  misc_feature (36): n=a or g
aataatttaaaagctgttcttcctgagtagtgctantaagtcttaacacagtcatgaagtagcattcagaa

SEQ ID NO: 6247 - DNA, 71 bp, chicken (Gallus Gallus)
  misc_feature (36): n=a or g
actccaggaaagttgcctagtaatggttaagaaacntgtatacatatccagtacacaatgaaggttcagat

SEQ ID NO: 6248 - DNA, 71 bp, chicken (Gallus Gallus)
  misc_feature (36): n=c or t
cctttaagggtatcttcccactctaatgagtctaangattccatgaaattctggccttcagccatcagcag

SEQ ID NO: 6249 - DNA, 71 bp, chicken (Gallus Gallus)
  misc_feature (36): n=g or t
ctgaggacagtatccgaaggggacatctaatggctnccttggtcatgttagctgatgacagcatgtgccat

SEQ ID NO: 6250 - DNA, 71 bp, chicken (Gallus Gallus)
  misc_feature (36): n=g or t
tagctttaggttagcagtgctggtacagaaaggatnggaactgccttagttgggccaaattcaccatgggt

SEQ ID NO: 6251 - DNA, 71 bp, chicken (Gallus Gallus)
  misc_feature (36): n=c or t
ttgcaataggagcctctctacttccttcttctcccnctcttcagaaccgcctttttaagatcaaacacaga

SEQ ID NO: 6252 - DNA, 71 bp, chicken (Gallus Gallus)
  misc_feature (36): n=c or t
aaatcattagtgttctgtatggcacaggcacttttngaactgtgtacccactggaaaaatctgtatattgt

SEQ ID NO: 6253 - DNA, 71 bp, chicken (Gallus Gallus)
  misc_feature (36): n=a or g
aagtatgtttgtgtctccacagtaaagcaaggcctntactgtttccccatacaagcagtgaatggaagcat

SEQ ID NO: 6254 - DNA, 71 bp, chicken (Gallus Gallus)
  misc_feature (36): n=c or t
caaattggcgggaaaagacttggattcatctccatntcctttctcagttgtaatttcactgctggtcactg

SEQ ID NO: 6255 - DNA, 71 bp, chicken (Gallus Gallus)
  misc_feature (36): n=c or t
gtcttggttctgcaaatactcaaattgtattttcancacccagctcaactgttctaagccattattgctaa

SEQ ID NO: 6256 - DNA, 71 bp, chicken (Gallus Gallus)
  misc_feature (36): n=c or t
ttaagtctgtgaatagtttgggagcgaaaataaacngcagtttttggcaaacagcttatttgcttccaaga

SEQ ID NO: 6257 - DNA, 71 bp, chicken (Gallus Gallus)
  misc_feature (36): n=a or g
aggaagtgaactgttcaacagtttttgccttcatcngtaatattagctctaggatacctattctctgcagt

SEQ ID NO: 6258 - DNA, 71 bp, chicken (Gallus Gallus)
  misc_feature (36): n=c or t
tggagtgaaagctctctgtgtaatggaaatacggcngtactaaatgtgattgctactgccagtggggctca

SEQ ID NO: 6259 - DNA, 71 bp, chicken (Gallus Gallus)
  misc_feature (36): n=c or t
cagcaactgcaggttagacaccagtccattagtccngtgtgctctctctgctattcctctgcagtagtcat

SEQ ID NO: 6260 - DNA, 71 bp, chicken (Gallus Gallus)
  misc_feature (36): n=g or t
acctctttgctctctacagatacctggcaggaggtnatagcagggaggtgttggtctcttttctcaggtgc

SEQ ID NO: 6261 - DNA, 71 bp, chicken (Gallus Gallus)
  misc_feature (36): n=c or t
cagtaatcactgtaccgtacacaacactatgtttanggtaatgttccactgtaacccattttagtttttta

SEQ ID NO: 6262 - DNA, 71 bp, chicken (Gallus Gallus)
  misc_feature (36): n=c or t
cagccccagagagactcctccctctcactgctgcanatttcagcacccttgttaatgcttaagctccagtg

SEQ ID NO: 6263 - DNA, 71 bp, chicken (Gallus Gallus)
  misc_feature (36): n=c or t
ttggctgctaacacttaaatgagggtaaggaggacncagggtccactccttctggtcactcagatgcactg

SEQ ID NO: 6264 - DNA, 71 bp, chicken (Gallus Gallus)
  misc_feature (36): n=c or t
ctgggatgtgtcactaccaaggagtgtgattgctgnagtttgccctactggttgtcttgtacatgaacttt

SEQ ID NO: 6265 - DNA, 71 bp, chicken (Gallus Gallus)
  misc_feature (36): n=c or t
agtgctaaaaaggcagataacttaaatattcacttnctgtatgtagatgagtgaataggaacagatagtca

SEQ ID NO: 6266 - DNA, 71 bp, chicken (Gallus Gallus)
  misc_feature (36): n=a or c
agtagttgcataggattggtgtctgtgtgtttctangtgatttcttatctcagtgagcactaatgaaggac

SEQ ID NO: 6267 - DNA, 71 bp, chicken (Gallus Gallus)
  misc_feature (36): n=c or t
ctattgctgcaacagcaccggctgcaaacaaaatcncttaaagttcatgacaggacaggttgcacatgttg

SEQ ID NO: 6268 - DNA, 71 bp, chicken (Gallus Gallus)
  misc_feature (36): n=a or g
ccttgaacgcctccaaggatgggacatccacaactnctctgggcatactcttccagtacctcactactctc

SEQ ID NO: 6269 - DNA, 71 bp, chicken (Gallus Gallus)
  misc_feature (36): n=a or g
tcttaatctttgcaactatatcagagagcttattancagaacagatgtgtttattttagagcctccaccct

SEQ ID NO: 6270 - DNA, 71 bp, chicken (Gallus Gallus)
  misc_feature (36): n=a or g
gaaagatataaggatgttaaacaaaagaaaaagagntaaaaacagcagcagtgcactggatatgtgtctac

SEQ ID NO: 6271 - DNA, 71 bp, chicken (Gallus Gallus)
  misc_feature (36): n=g or t
aattcatagttagtagactggagatgtaaatgaaanttaatgtatacttattcagtccttaaaaatcacag

SEQ ID NO: 6272 - DNA, 71 bp, chicken (Gallus Gallus)
  misc_feature (36): n=c or t
ggaattcaactttcagagggattgcagagttgttancccatatcacaccgtatctcttttcaagctctaaa

SEQ ID NO: 6273 - DNA, 71 bp, chicken (Gallus Gallus)
  misc_feature (36): n=a or c
atcttcagaactaatgtctaatacttgtatcttcanaatctaaatcttgattttaaaatattttgcttaaa

SEQ ID NO: 6274 - DNA, 71 bp, chicken (Gallus Gallus)
  misc_feature (36): n=c or t
tgaaatgcagaattgttggacaaaatagcttaattngatttgtgagtagatagaatgtagagatgtcatca

SEQ ID NO: 6275 - DNA, 71 bp, chicken (Gallus Gallus)
  misc_feature (36): n=c or t
tgcagaggatacctcagtcaagctgtcaattggtcntcctcactgttataaattataagtattttcttgta

SEQ ID NO: 6276 - DNA, 71 bp, chicken (Gallus Gallus)
  misc_feature (36): n=c or t
gtaacacaccttcaatgcgctgaagcagctcgaggngcaggatgaataggatgaatacactttcacctccc

SEQ ID NO: 6277 - DNA, 71 bp, chicken (Gallus Gallus)
  misc_feature (36): n=a or g
ggcaacacacaaaatgaagtcacatgacaaatccantgaaaaatagctgaagtccagtgtccccgtcatgg

SEQ ID NO: 6278 - DNA, 71 bp, chicken (Gallus Gallus)
  misc_feature (36): n=c or t
agaagggttacttgtgaacagcatccatattgctangctccaggtcatggcaaaatgcttctgtaagtagc

SEQ ID NO: 6279 - DNA, 71 bp, chicken (Gallus Gallus)
  misc_feature (36): n=c or t
aagctaaatctttaaaatatctgatttagcttctangaaactaaaaaaatgagtgcctaataatcccataa

SEQ ID NO: 6280 - DNA, 71 bp, chicken (Gallus Gallus)
  misc_feature (36): n=c or t
actgataagccattaatttccaatgccttattatancagaaatgggataaagaaaaggcacattgcctgaa

SEQ ID NO: 6281 - DNA, 71 bp, chicken (Gallus Gallus)
  misc_feature (36): n=a or t
aaatatattgcttgcatcctgcgttcaatagtgaangtctgtttatcagtacatcttagatatcattatca

SEQ ID NO: 6282 - DNA, 71 bp, chicken (Gallus Gallus)
  misc_feature (36): n=c or t
gactgagctttgtaaagatcagcacattctagcagngaactcaagaaaaaaaaaaaaaaaaagaagaaaca

SEQ ID NO: 6283 - DNA, 71 bp, chicken (Gallus Gallus)
  misc_feature (36): n=a or t
gatttcagaagagagccaacagcaatgctagtagtnttctatgctgtattgttgtttaatatgtaagcagt

SEQ ID NO: 6284 - DNA, 71 bp, chicken (Gallus Gallus)
  misc_feature (36): n=c or t
gaaataaaaaggggttaatgttcagatcaaattaanggccatacataaatagtaagtagatgttgtgaatt

SEQ ID NO: 6285 - DNA, 71 bp, chicken (Gallus Gallus)
  misc_feature (36): n=a or g
aagtatcagggaaaactattgcagatacatgtcttnaatgtcacttctgttcagagaacttcacaatattt

SEQ ID NO: 6286 - DNA, 71 bp, chicken (Gallus Gallus)
  misc_feature (36): n=a or g
gggctgtgcgacgaggcttgctgagacccagcagcnacacaggatcacacaagagctgctgaagcatcgct

SEQ ID NO: 6287 - DNA, 71 bp, chicken (Gallus Gallus)
  misc_feature (36): n=c or t
atagcagctaaagcaaagagacttggggtgtctgcngagcagtgcaaattctcgctactctgaggtgttct

SEQ ID NO: 6288 - DNA, 71 bp, chicken (Gallus Gallus)
  misc_feature (36): n=c or t
aatcagctgccaaatagattggctaaggtaattttntttctatcttgtctactgaaatatattaattagag

SEQ ID NO: 6289 - DNA, 71 bp, chicken (Gallus Gallus)
  misc_feature (36): n=c or t
cagattttttgaggtactctgtgactcaggtcactngataagatcagtgtttagtctgctaccaaattagc

SEQ ID NO: 6290 - DNA, 71 bp, chicken (Gallus Gallus)
  misc_feature (36): n=a or g
tgtactgatgctctgaattgatagtatgttaacctnagagatgtgctttctacttttccctctaactttac

SEQ ID NO: 6291 - DNA, 71 bp, chicken (Gallus Gallus)
  misc_feature (36): n=a or g
aactcaaagtaaattcagtgtctgcaaagcaaaccnaagttaagtttatcatcaagagaaatctgatcttc

SEQ ID NO: 6292 - DNA, 71 bp, chicken (Gallus Gallus)
  misc_feature (36): n=a or g
gttcggttttgatctgtagacctgagagctccgagngtgctggtcttgtttatgtatcggagtgggagcaa

SEQ ID NO: 6293 - DNA, 71 bp, chicken (Gallus Gallus)
  misc_feature (36): n=c or t
agaccacatcgccttcagtgcaacagaggccatttngagcagcagttccccagagcccttgcattggcaca

SEQ ID NO: 6294 - DNA, 71 bp, chicken (Gallus Gallus)
  misc_feature (36): n=a or g
taggatcagcattagccagagtttctctgtaaggtnatgagtagctttggtaaaccctgaactaccttctg

SEQ ID NO: 6295 - DNA, 71 bp, chicken (Gallus Gallus)
  misc_feature (36): n=c or t
actaaagataaatgacatctgctactattaattcangcacttaggcattttatcttagaagataatcagac

SEQ ID NO: 6296 - DNA, 71 bp, chicken (Gallus Gallus)
  misc_feature (36): n=c or t
tcattattggaagaaatagctttatactgaaagganaaaatggactttttctgtctaacctggaaacgact

SEQ ID NO: 6297 - DNA, 71 bp, chicken (Gallus Gallus)
  misc_feature (36): n=c or t
tccaaattatgatcctaatatgtgtactattcctantagaataataatcaatcatctagtgtcaaacatct

SEQ ID NO: 6298 - DNA, 71 bp, chicken (Gallus Gallus)
  misc_feature (36): n=a or g
tttacagttactatagactttttaatttgaaatctnattgtctgatggctataactgagataccagaactt

SEQ ID NO: 6299 - DNA, 71 bp, chicken (Gallus Gallus)
  misc_feature (36): n=a or g
ccccttgacccagccagccaaattctgacatctaancagagcaggagagatctcaaacacgcagagttttt

SEQ ID NO: 6300 - DNA, 71 bp, chicken (Gallus Gallus)
  misc_feature (36): n=c or t
agacaaagagcctattttaaagaaacccagctctanacagtatgtacacactgcatatcaaccataacaaa

SEQ ID NO: 6301 - DNA, 71 bp, chicken (Gallus Gallus)
  misc_feature (36): n=a or g
agatctaccagaaagagcagtgtcctcttgggcacntggtgatgaaaggagccctaggacccccgggtggc

SEQ ID NO: 6302 - DNA, 71 bp, chicken (Gallus Gallus)
  misc_feature (36): n=a or c
tcacctttctagtggaatgaagaggccaaactgtancattcagtaaatcaaaagacacatcctcctaagga

SEQ ID NO: 6303 - DNA, 71 bp, chicken (Gallus Gallus)
  misc_feature (36): n=c or t
caggcatttgtctccgtttgttataaaaagtgcganggaatcaaacatttctgctagcagctcattagact

SEQ ID NO: 6304 - DNA, 71 bp, chicken (Gallus Gallus)
  misc_feature (36): n=a or t
cataaaatagcagaatattttctttgcatataaaancacattattactgtttgcatatttggaacaatctc

SEQ ID NO: 6305 - DNA, 71 bp, chicken (Gallus Gallus)
  misc_feature (36): n=c or t
cccttgatatgggcagcaaaatccatgtctcccaantcctatgtctcccaaagctcaccacggtccctctc

SEQ ID NO: 6306 - DNA, 71 bp, chicken (Gallus Gallus)
  misc_feature (36): n=c or t
ctttatctttccttcctgaagcagtgaaaaaaatgncagaaatttaaatcagacagaaagagaagaggaaa

SEQ ID NO: 6307 - DNA, 71 bp, chicken (Gallus Gallus)
  misc_feature (36): n=a or g
tggctatccatgggatagcatcagccttctctcccngaaatgggacattgcattgtttcatggctcgaaga

SEQ ID NO: 6308 - DNA, 71 bp, chicken (Gallus Gallus)
  misc_feature (36): n=a or g
attctttgtggaaaaatataaaatggagaaaaaccnccttttcccccttaaaattacgttttgatggggta

SEQ ID NO: 6309 - DNA, 71 bp, chicken (Gallus Gallus)
  misc_feature (36): n=c or t
ctacctcgagatttggtggcttccttgaaatgcagngttgtgtagggtggctggaggaaggaagcttgtaa

SEQ ID NO: 6310 - DNA, 71 bp, chicken (Gallus Gallus)
  misc_feature (36): n=c or t
ctacgcagtttaaaacacaaccatttgagtggccangtacagcttgggtactgtgcatgcccactatttac

SEQ ID NO: 6311 - DNA, 71 bp, chicken (Gallus Gallus)
  misc_feature (36): n=c or t
aattttgtatccttttacaaaagcatcttcagctgngtcagacacttctttaaagatgttactgagatggt

SEQ ID NO: 6312 - DNA, 71 bp, chicken (Gallus Gallus)
  misc_feature (36): n=a or g
tcctttaactggaagtgggtagtgtcagtaccttgntagtcagtacctaagaggcaggagcaaaaggaaag

SEQ ID NO: 6313 - DNA, 71 bp, chicken (Gallus Gallus)
  misc_feature (36): n=a or g
ggctgacttgtctcagggaggtaaacaagaagagtntcctaatgagcatcaagttaaggtacagagacaaa

SEQ ID NO: 6314 - DNA, 71 bp, chicken (Gallus Gallus)
  misc_feature (36): n=c or t
acattaagcctgtgagggtggatagatggaggcatncctaattggtgtatcactgctcaaaaggtaatcca

SEQ ID NO: 6315 - DNA, 71 bp, chicken (Gallus Gallus)
  misc_feature (36): n=a or g
cagcaaacttgaaacagctcttgttccgttcctganaaagttccaggtgacctgatttatagcatcccatt

SEQ ID NO: 6316 - DNA, 71 bp, chicken (Gallus Gallus)
  misc_feature (36): n=c or t
tccagcagattcaaattttgtgatcaagcattattncttggttagccttacatttcatccattttctcatt

SEQ ID NO: 6317 - DNA, 71 bp, chicken (Gallus Gallus)
  misc_feature (36): n=a or g
actggaactgtttcattgtgaaagcatcagctgcantttgacttttctcctcaccatcatctctgagttga

SEQ ID NO: 6318 - DNA, 71 bp, chicken (Gallus Gallus)
  misc_feature (36): n=a or g
cttttcgctaactgcaaagtcaatacagaggcatcnttaggattatgtgaagtattcaaccttattccttt

SEQ ID NO: 6319 - DNA, 71 bp, chicken (Gallus Gallus)
  misc_feature (36): n=c or t
cgttagccagctcccttaggaccttgagatatatgntatccaaccctatagtcttgtacatattcagcctc

SEQ ID NO: 6320 - DNA, 71 bp, chicken (Gallus Gallus)
  misc_feature (36): n=a or g
attcaattaaactttgtttattgaataattcctttncagatattctcaaagcttaatatattgttctgaaa

SEQ ID NO: 6321 - DNA, 71 bp, chicken (Gallus Gallus)
  misc_feature (36): n=a or c
attcctctctattttaatgtatatattgcattagtnacccaggcatcagttttcagcagtgctttccagaa

SEQ ID NO: 6322 - DNA, 71 bp, chicken (Gallus Gallus)
  misc_feature (36): n=a or g
aattttacttcagcagttttacagaacccttttacntttatatcaacgtaagaaagactagaactcaactt

SEQ ID NO: 6323 - DNA, 71 bp, chicken (Gallus Gallus)
  misc_feature (36): n=a or g
gctcactcaggatcacaaacacaagtcactgatgcntggcatcacctccagtgatacactggaaggtagaa

SEQ ID NO: 6324 - DNA, 71 bp, chicken (Gallus Gallus)
  misc_feature (36): n=c or t
ctcacatatcacatacagacgaaatatccctgttcngaggagctcgttgtcagctggatcccagggcaacc

SEQ ID NO: 6325 - DNA, 71 bp, chicken (Gallus Gallus)
  misc_feature (36): n=c or t
agaagaccaaagcattcaagacaaggtgaatgcagnaccacttcgttcagtagtgatagtagaagcacaag

SEQ ID NO: 6326 - DNA, 71 bp, chicken (Gallus Gallus)
  misc_feature (36): n=a or g
aactgcctttgtagccctcctttggacactctccantagttctgtgtcctttccattctgcagtgcccaga

SEQ ID NO: 6327 - DNA, 71 bp, chicken (Gallus Gallus)
  misc_feature (36): n=c or t
tgaacaccacttgtagtccttattcctcttattttncatcagctgatgttgatgacaaatggaagattatg

SEQ ID NO: 6328 - DNA, 71 bp, chicken (Gallus Gallus)
  misc_feature (36): n=c or t
tccttcctcctgccttctcccattcattaggcagancacaagttctctagtggtgagctctgtactgtctg

SEQ ID NO: 6329 - DNA, 71 bp, chicken (Gallus Gallus)
  misc_feature (36): n=c or t
gctaacactacagctaccattagatgtcattgtctnaggcatattagtaggtgaaaacatggaatatgaga

SEQ ID NO: 6330 - DNA, 71 bp, chicken (Gallus Gallus)
  misc_feature (36): n=a or g
gatttgtctccttagctgttccctattcacacccanttttgttgccccacttaccctgtcccctgtgtctc

SEQ ID NO: 6331 - DNA, 71 bp, chicken (Gallus Gallus)
  misc_feature (36): n=c or t
tcagagttcaaacaagaatttacactgaaggaacangtagatgtccaacccagtgcttcagcaatggctgt

SEQ ID NO: 6332 - DNA, 71 bp, chicken (Gallus Gallus)
  misc_feature (36): n=c or t
cttggcttcctggcactgctgcaagctacacctttntcatttccttcagccaaaaatgggcaatttgtgaa

SEQ ID NO: 6333 - DNA, 71 bp, chicken (Gallus Gallus)
  misc_feature (36): n=a or c
atgttttattacaggtgcagaaatgaggaaagagantgtaaagcatcccaagctgtcacgttttcatttca

SEQ ID NO: 6334 - DNA, 71 bp, chicken (Gallus Gallus)
  misc_feature (36): n=c or t
catggggaagctgtttacctgagccatgtcattaangttgatatttgtaatagaagtttactgaggtgatg

SEQ ID NO: 6335 - DNA, 71 bp, chicken (Gallus Gallus)
  misc_feature (36): n=a or c
atgaagaacaacaccttttgtcagcagaacaaaccntcctgagtaggactaagggaagcgtgagctggaag

SEQ ID NO: 6336 - DNA, 71 bp, chicken (Gallus Gallus)
  misc_feature (36): n=a or g
aggaggaaagctgccacaagacagcaacctcagctnccaaattagccacattcagttaaaatgaaattatt

SEQ ID NO: 6337 - DNA, 71 bp, chicken (Gallus Gallus)
  misc_feature (36): n=c or t
caggctgccactgcctccttcctgcacccatcccancgcacagtgggcactgcaaaattcagttaaagttt

SEQ ID NO: 6338 - DNA, 71 bp, chicken (Gallus Gallus)
  misc_feature (36): n=a or g
gtgagatgaatttcatcagatactttggaacaagcnggctacacaaattcatcgttcaatcaatagtcttc

SEQ ID NO: 6339 - DNA, 71 bp, chicken (Gallus Gallus)
  misc_feature (36): n=a or g
ttaggctgattttgaaggagctttttgtatctgaantctgattatattctgtgttcctgatgaggactttg

SEQ ID NO: 6340 - DNA, 71 bp, chicken (Gallus Gallus)
  misc_feature (36): n=c or t
attcagccatgagctgatagcctccataaggtgacnttgtcatcttagtcacctgctggtccaattcaatt

SEQ ID NO: 6341 - DNA, 71 bp, chicken (Gallus Gallus)
  misc_feature (36): n=c or t
catttcacacatctatacccaattcacaaaaatttncagaacaagagctgaattcatacatgtattcttca

SEQ ID NO: 6342 - DNA, 71 bp, chicken (Gallus Gallus)
  misc_feature (36): n=c or t
tgcttacaagttttcaatagtccatcacaaaaagantcacatttgtttgcgttacacaccgccgggattaa

SEQ ID NO: 6343 - DNA, 71 bp, chicken (Gallus Gallus)
  misc_feature (36): n=c or t
catgcatatatgcagatatggggatgatattattcnttccctactacaagtacttttaaacagttcattaa

SEQ ID NO: 6344 - DNA, 71 bp, chicken (Gallus Gallus)
  misc_feature (36): n=a or g
gattggcagagaggcttgaggagggctgtgccagcncagagcatgttcaccctgtgctaacatccagccct

SEQ ID NO: 6345 - DNA, 71 bp, chicken (Gallus Gallus)
  misc_feature (36): n=a or g
aaagcctcagaaaagaaattacttttttaatccccnggatagaaaagcaattggataatatttctattgat

SEQ ID NO: 6346 - DNA, 71 bp, chicken (Gallus Gallus)
  misc_feature (36): n=g or t
ggttcttggccaccattgggtggtgcccatcacttncatcatcactaggtttatttattttaacttattta

SEQ ID NO: 6347 - DNA, 71 bp, chicken (Gallus Gallus)
  misc_feature (36): n=a or g
tcgtgagcttactgagaagctgtccaatttacagcnttatttcgtgttgtgtgtctctaaccaactgacag

SEQ ID NO: 6348 - DNA, 71 bp, chicken (Gallus Gallus)
  misc_feature (36): n=c or t
tttcagtgctagcgcctgggtgctcgtatttgtacngttatttctgctctttattcgtgataggtggtgct

SEQ ID NO: 6349 - DNA, 71 bp, chicken (Gallus Gallus)
  misc_feature (36): n=c or t
tttctgggatttagcacctcctcaagcatcagcttnggagaaatctgctgctgacagaaagacagaaatac

SEQ ID NO: 6350 - DNA, 71 bp, chicken (Gallus Gallus)
  misc_feature (36): n=g or t
atgctgtcttcatatgtcttcaaaattaaagcaganaaactttttggtgatgtcacaagctcagtcttgtc

SEQ ID NO: 6351 - DNA, 71 bp, chicken (Gallus Gallus)
  misc_feature (36): n=a or g
tttcttaccaggagggcgtcctcttcattccagagnaaggtcagtcctaacttggcagaaactttgatata

SEQ ID NO: 6352 - DNA, 71 bp, chicken (Gallus Gallus)
  misc_feature (36): n=c or t
agcctaagcttaacatgggcctaaacaaacctaacnagagaagatgcaggaaacacctcagccacacgaca

SEQ ID NO: 6353 - DNA, 71 bp, chicken (Gallus Gallus)
  misc_feature (36): n=c or t
tgcatacccttagggtctgagaatggcttctggccnactctacccactcgtgtagacttgtcgcgacatcg

SEQ ID NO: 6354 - DNA, 71 bp, chicken (Gallus Gallus)
  misc_feature (36): n=c or t
aacaatatcagtagcactgcagtgagaaataataanacaaataatgataatacaaaagcaaagaagcgcac

SEQ ID NO: 6355 - DNA, 71 bp, chicken (Gallus Gallus)
  misc_feature (36): n=a or g
tgaaagtgaagaaaaacagctatgtacattgtaccnatgatgagatactgttaggcaagattatgtattac

SEQ ID NO: 6356 - DNA, 71 bp, chicken (Gallus Gallus)
  misc_feature (36): n=c or t
aggctgatgggttttggtgatgaagccctgcttganggccttcacctctgtgtttgctctgggtgggcaac

SEQ ID NO: 6357 - DNA, 71 bp, chicken (Gallus Gallus)
  misc_feature (36): n=c or t
tctctttagaggatttcacctcccggtcaatttctncattgcagccaaataacaaaccggcagattaacaa

SEQ ID NO: 6358 - DNA, 71 bp, chicken (Gallus Gallus)
  misc_feature (36): n=c or t
aaaccccattccttaccaaaactactgctgtggagnagaaaggggcaatctactccacgaggaggggaaga

SEQ ID NO: 6359 - DNA, 71 bp, chicken (Gallus Gallus)
  misc_feature (36): n=c or t
agcttattctgttttcactgaggcgtgcttctttgntaaagtgggcaggaacagaaaggaactaatatgtc

SEQ ID NO: 6360 - DNA, 71 bp, chicken (Gallus Gallus)
  misc_feature (36): n=a or g
ataaaagcattacctcaaatatttgctctcatatancaagaaaaagaaaggccagaaatttactaaaatac

SEQ ID NO: 6361 - DNA, 71 bp, chicken (Gallus Gallus)
  misc_feature (36): n=a or t
aagagattgttaaagaaaaatttaattaatgaatgncttaaagcactgaaaatgctgcaattttgattata

SEQ ID NO: 6362 - DNA, 71 bp, chicken (Gallus Gallus)
  misc_feature (36): n=a or g
ttatgagtcaggtggaattatgaatttgaggagctnggaaaggactcctggtagcactgcctcaagctgta

SEQ ID NO: 6363 - DNA, 71 bp, chicken (Gallus Gallus)
  misc_feature (36): n=c or t
gcaaagaaaggaagacacaaactcactttttttttnctcctattccttctccctcaatctcaccacatcac

SEQ ID NO: 6364 - DNA, 71 bp, chicken (Gallus Gallus)
  misc_feature (36): n=a or t
aagccaggctggtttcttttttgttttgtggttggntggtttctgtttttaaagcaccatgctcactctgt

SEQ ID NO: 6365 - DNA, 71 bp, chicken (Gallus Gallus)
  misc_feature (36): n=a or c
gactacccagccacttcagtgatattagtaaagggntagagatacactgaaatatctatttctataatgaa

SEQ ID NO: 6366 - DNA, 71 bp, chicken (Gallus Gallus)
  misc_feature (36): n=a or t
aacagcaataaaggagaggaggaatcataagagaanagacactgctcaaggtgacggagagaaaccgtaag

SEQ ID NO: 6367 - DNA, 71 bp, chicken (Gallus Gallus)
  misc_feature (36): n=a or g
agacctttcttcagtaagaatgtctaataatttctnaggtaccttcttcagacaaaaagacagagcaaggc

SEQ ID NO: 6368 - DNA, 71 bp, chicken (Gallus Gallus)
  misc_feature (36): n=a or g
tggcactctgactttgggagaaacacaaaatcaccntgtggagctgtgcttccctcgcacatgggcacctt

SEQ ID NO: 6369 - DNA, 71 bp, chicken (Gallus Gallus)
  misc_feature (36): n=g or t
ttgctttctgcagattctgttgtgaaagtagtcatntgtaacagaagacagaagctctttcaccgttgcaa

SEQ ID NO: 6370 - DNA, 71 bp, chicken (Gallus Gallus)
  misc_feature (36): n=a or g
tgtttacataccctgcacacttgtgtaaacttccanttgggatacaagctaaagatttgccaaaatcaaag

SEQ ID NO: 6371 - DNA, 71 bp, chicken (Gallus Gallus)
  misc_feature (36): n=c or t
tgatgcacctgggacactgggatcctcagagacacnattactttccatggtacatcagtctcgggtctact

SEQ ID NO: 6372 - DNA, 71 bp, chicken (Gallus Gallus)
  misc_feature (36): n=a or t
ctcttggtgtttctgagagaggaatgagcagttttnagtgtacatacagtgcttgttaaaatgactccatt

SEQ ID NO: 6373 - DNA, 71 bp, chicken (Gallus Gallus)
  misc_feature (36): n=c or t
aggaaatagcaatgtgaaggaagggttgtgactctntttttttcccagcttgtacacgtatctagcgtttg

SEQ ID NO: 6374 - DNA, 71 bp, chicken (Gallus Gallus)
  misc_feature (36): n=c or t
ttaaggaatttgatgagtttgcctgaggatctgcangaggatgggtgaagatggaccactctccagcccct

SEQ ID NO: 6375 - DNA, 71 bp, chicken (Gallus Gallus)
  misc_feature (36): n=c or t
cagggacaagaacataaaaggttacagaaaaggaanaccaagaatctcaacagcagtgcagctgatatgcc

SEQ ID NO: 6376 - DNA, 71 bp, chicken (Gallus Gallus)
  misc_feature (36): n=a or g
gcctcactgtgtggggtcccacccagtcggagcttnctgttgttccaccgctaataaataactgcagaatt

SEQ ID NO: 6377 - DNA, 71 bp, chicken (Gallus Gallus)
  misc_feature (36): n=a or g
aaaggttggattatgttgacatacattaaacgtgtntgtaaacgcatgcaaatatgcactagtaaaaggca

SEQ ID NO: 6378 - DNA, 71 bp, chicken (Gallus Gallus)
  misc_feature (36): n=a or t
tacagggagagttgttttgcttatctaaagccttantgttgctgtttgcaccacagttttcagatagagca

SEQ ID NO: 6379 - DNA, 71 bp, chicken (Gallus Gallus)
  misc_feature (36): n=c or t
ggatgcgtgcagcaattaattaggggttctcattcngagcacgctgccagcttgatgaatcggcgtaggga

SEQ ID NO: 6380 - DNA, 71 bp, chicken (Gallus Gallus)
  misc_feature (36): n=c or t
aaatatgaaatatcttccacttccacatagaacttncccatcttttcctgatacaagtgtcaggtctgaaa

SEQ ID NO: 6381 - DNA, 71 bp, chicken (Gallus Gallus)
  misc_feature (36): n=c or t
tcttttcgagaactctgcataaactttctaagcaanaccttcagcactgctacctgactccccatctctct

SEQ ID NO: 6382 - DNA, 71 bp, chicken (Gallus Gallus)
  misc_feature (36): n=c or t
gacacacgggaactgcagtttgctttttcagctcantgaagtgtgggaggtaaataaaaaacccacaccat

SEQ ID NO: 6383 - DNA, 71 bp, chicken (Gallus Gallus)
  misc_feature (36): n=a or g
tgtctcatgaaactcttcttcagtttcctcttttgngtagctgtatttaagtttttctccccaacaactat

SEQ ID NO: 6384 - DNA, 71 bp, chicken (Gallus Gallus)
  misc_feature (36): n=c or g
gggcagcagttgtgagacatgaaaaaaagacttaanagattttcagggccatccctctgccaagcaaaaag

SEQ ID NO: 6385 - DNA, 71 bp, chicken (Gallus Gallus)
  misc_feature (36): n=c or t
gttgcccactgtaacacacactcttgtatgtctttntgtagctctctgttggttaaagtccactttatttc

SEQ ID NO: 6386 - DNA, 71 bp, chicken (Gallus Gallus)
  misc_feature (36): n=a or c
tttgatgttgaataagggtttgcagcttatacttangagggaacttcacttttaggcatgctccgacactt

SEQ ID NO: 6387 - DNA, 71 bp, chicken (Gallus Gallus)
  misc_feature (36): n=c or t
gaaaaggcgttgccaaaaaatgccacatggaactgnaaaataagcttccaaaaataaacttggttccacgt

SEQ ID NO: 6388 - DNA, 71 bp, chicken (Gallus Gallus)
  misc_feature (36): n=a or g
aagggagagcctggagatttgagaagtgggaacatntgtcttgcaggtgtcccagtggctgaaaacacaac

SEQ ID NO: 6389 - DNA, 71 bp, chicken (Gallus Gallus)
  misc_feature (36): n=a or g
taatcttctagcttccagatacaaccagaaaggtcncatgcaatggatgtatagttgggaatgttgcaagg

SEQ ID NO: 6390 - DNA, 71 bp, chicken (Gallus Gallus)
  misc_feature (36): n=g or t
aaaaacatttatccctagaactgggctgcaacgtgnctgtgagagaagaaaagccttaaagacttgaaaat

SEQ ID NO: 6391 - DNA, 71 bp, chicken (Gallus Gallus)
  misc_feature (36): n=a or g
gaacttcctaaattcacaccattgggaaaaagaagnttttaagcttggctctgctgatcatttgctgcata

SEQ ID NO: 6392 - DNA, 71 bp, chicken (Gallus Gallus)
  misc_feature (36): n=a or g
ccagtttgcaatgcaaatgtttgctaacaggctatnctaacgtcagaattgtcaaaacagcatctgttggt

SEQ ID NO: 6393 - DNA, 71 bp, chicken (Gallus Gallus)
  misc_feature (36): n=c or g
ttaatctgagagattttgagtgactaattctggagnagcttggtcatacagatatctggcttaattggaag

SEQ ID NO: 6394 - DNA, 71 bp, chicken (Gallus Gallus)
  misc_feature (36): n=c or t
ctctcagttacctgctcaaatgtgaatccaaagganatgggttgaaaatgagctgtgcagtggctgtaatc

SEQ ID NO: 6395 - DNA, 71 bp, chicken (Gallus Gallus)
  misc_feature (36): n=a or g
atactttggttattactgaaagcattgtttaatttngcttctgttctaagtagttaaagagtaaaaaagga

SEQ ID NO: 6396 - DNA, 71 bp, chicken (Gallus Gallus)
  misc_feature (36): n=a or c
ttgatgctttattgaacatatttatgtaaagtgaanagctttcttctagcctttacagtagttcacatatt

SEQ ID NO: 6397 - DNA, 71 bp, chicken (Gallus Gallus)
  misc_feature (36): n=a or c
actgaaccgaaaaaaagtacattcacattaactgcnaacactgaaagttactgtgagcttgcaggctgaat

SEQ ID NO: 6398 - DNA, 71 bp, chicken (Gallus Gallus)
  misc_feature (36): n=a or g
atgggataacagaatgggggatgtaagcaatccccnaacgataaggaacaatgggcaggacttgcgacttg

SEQ ID NO: 6399 - DNA, 71 bp, chicken (Gallus Gallus)
  misc_feature (36): n=a or t
acaccaacaggactttgacattcaaatctttagaanagttacttgtttcagaatagtagcgccattagaaa

SEQ ID NO: 6400 - DNA, 71 bp, chicken (Gallus Gallus)
  misc_feature (36): n=a or g
gttatgtgttgtacatgtataataaatttttgaaangagagaaaagaaaacctccaaacctcagaacgcaa

SEQ ID NO: 6401 - DNA, 71 bp, chicken (Gallus Gallus)
  misc_feature (36): n=a or g
tccaaaggtatcttgatgcatacagtcaaaacacanctccacattatatccatgattcagcaacagcctta

SEQ ID NO: 6402 - DNA, 71 bp, chicken (Gallus Gallus)
  misc_feature (36): n=a or g
ttccccaaatggaaaggcagcattctgaaatttgtntgttttaaatgggagtagttacttcggttgctgta

SEQ ID NO: 6403 - DNA, 71 bp, chicken (Gallus Gallus)
  misc_feature (36): n=a or g
tttgatctcataatgaatttactgagacactactcncagactgtttcaagcaggatatctggttgattcag

SEQ ID NO: 6404 - DNA, 71 bp, chicken (Gallus Gallus)
  misc_feature (36): n=a or g
agtctgcaggctctgctgatagctgctcttctctcncaccaagtgtagcagctgcaggaggtactgctgat

SEQ ID NO: 6405 - DNA, 71 bp, chicken (Gallus Gallus)
  misc_feature (36): n=g or t
atgaatgttaagactcctgtaaaggacaggaaagancagactgaggaactaaaaataacctcatacatgaa

SEQ ID NO: 6406 - DNA, 71 bp, chicken (Gallus Gallus)
  misc_feature (36): n=a or g
catgagtaatgtttctcggaggaaaagacatgttcntgctcactgatgaattatgagttttaaagtcatta

SEQ ID NO: 6407 - DNA, 71 bp, chicken (Gallus Gallus)
  misc_feature (36): n=c or t
gcagtcatgagaaataaatttaatgtctccatctcntccagcctgagaagaccgaataaatagtcatacat

SEQ ID NO: 6408 - DNA, 71 bp, chicken (Gallus Gallus)
  misc_feature (36): n=a or g
gaccctagttttggttattcctgtttttgcaagccnggatttgtggtgagctgctgacattctttcttctc

SEQ ID NO: 6409 - DNA, 71 bp, chicken (Gallus Gallus)
  misc_feature (36): n=a or g
ctgagaccattcctaggggtgtcagtctggtcctanggatgctgagatcgattttaggcatgctgagactg

SEQ ID NO: 6410 - DNA, 71 bp, chicken (Gallus Gallus)
  misc_feature (36): n=a or g
ttttggatcactgaagctgatctaggaatgaagaanaaaggatgaagtcatatgatgggataagagtgtga

SEQ ID NO: 6411 - DNA, 71 bp, chicken (Gallus Gallus)
  misc_feature (36): n=a or c
ggaagagaactgtaatgctgaagaacttgccacttnaaaatcctccatattattataagggtaataattgt

SEQ ID NO: 6412 - DNA, 71 bp, chicken (Gallus Gallus)
  misc_feature (36): n=c or t
tggtttctcagtcaagcagatcagctcggcaggcantgaggaatctcagtttcaggctgccttgtaaccag

SEQ ID NO: 6413 - DNA, 71 bp, chicken (Gallus Gallus)
  misc_feature (36): n=a or g
tagtcagataactataattcagcagtgttaggacanaggaagaaggctaatcctgttcttctgggatccaa

SEQ ID NO: 6414 - DNA, 71 bp, chicken (Gallus Gallus)
  misc_feature (36): n=a or g
tggactcctgatgaatgctatgatcccacagtcaanctttcccacaagaattgcttaactcatggcttctg

SEQ ID NO: 6415 - DNA, 71 bp, chicken (Gallus Gallus)
  misc_feature (36): n=a or g
ttaacacatcaactgtgtaaataaactgatgttacntaaagacatctaaagtgactcccagtcatatctta

SEQ ID NO: 6416 - DNA, 71 bp, chicken (Gallus Gallus)
  misc_feature (36): n=a or t
atttagagcttgcatactttgcagcagataatagantgagataatagaaattttaagaagcaaaactagca

SEQ ID NO: 6417 - DNA, 71 bp, chicken (Gallus Gallus)
  misc_feature (36): n=a or g
ccatccaacctggtcttgaacagctccagtatcctntgtccctcagttgatatgagtgatgggttttttga

SEQ ID NO: 6418 - DNA, 71 bp, chicken (Gallus Gallus)
  misc_feature (36): n=c or t
acagagctcatctgggacaatggttagtatcttttnggtaataatgttttcacttcatacaatgtgtatta

SEQ ID NO: 6419 - DNA, 71 bp, chicken (Gallus Gallus)
  misc_feature (36): n=a or g
tgtttgcacttctgaagcatgttttaatataaagangtgtgaaggtgtagaggtgctacaagtccagatat

SEQ ID NO: 6420 - DNA, 71 bp, chicken (Gallus Gallus)
  misc_feature (36): n=c or t
gagtggcaaaaccttctatcctaaatctaaaagcangtgtctttgacttttaataaagctatttcatttgg

SEQ ID NO: 6421 - DNA, 71 bp, chicken (Gallus Gallus)
  misc_feature (36): n=a or c
tcgctatgtgaaaacactgttgacaaacaggaaacngagccacagagaatatgatgtaacaaaagtcttta

SEQ ID NO: 6422 - DNA, 71 bp, chicken (Gallus Gallus)
  misc_feature (36): n=c or g
cactacagaaatgttttctttctcagtttggaaaanacgcttgtattctgcacaaatctccttcccagcta

SEQ ID NO: 6423 - DNA, 71 bp, chicken (Gallus Gallus)
  misc_feature (36): n=c or t
ttttttccttgcagacagctctactttccaaaacangtatatattttaagaaaaattgctgggctgggaat

SEQ ID NO: 6424 - DNA, 71 bp, chicken (Gallus Gallus)
  misc_feature (36): n=c or t
attgtagtcttctttaacccagacagtaagcagggngtgaaaacgatgagacaaaggctgtgttccacatc

SEQ ID NO: 6425 - DNA, 71 bp, chicken (Gallus Gallus)
  misc_feature (36): n=a or g
gtgtttacaatagttaaaaacatcatatttcagaancttctcagtctgtgctacgtatgatatgaaagtgc

SEQ ID NO: 6426 - DNA, 71 bp, chicken (Gallus Gallus)
  misc_feature (36): n=a or c
ttttttctgttgttttttttttttacctaaggggtnattctttcctttctgaaaacacatctcatgtttcc

SEQ ID NO: 6427 - DNA, 71 bp, chicken (Gallus Gallus)
  misc_feature (36): n=a or g
agctcagtgatcaggaagattaatcctaaagatggnagtagacacagtaacattccttgagagatacagta

SEQ ID NO: 6428 - DNA, 71 bp, chicken (Gallus Gallus)
  misc_feature (36): n=a or g
tctagtcacacaagcaaaattctccaggccagcctnactaataaggaagcaatggtacatttatttcctct

SEQ ID NO: 6429 - DNA, 71 bp, chicken (Gallus Gallus)
  misc_feature (36): n=a or g
aggaagatgctcccatgattttccagggcaagaacngagaatgagaattttttccctttttctccatatgc

SEQ ID NO: 6430 - DNA, 71 bp, chicken (Gallus Gallus)
  misc_feature (36): n=c or t
agctgaatttctgtttctttacagttttcctgtagncgtagtccccgctcttggataattgccacagagca

SEQ ID NO: 6431 - DNA, 71 bp, chicken (Gallus Gallus)
  misc_feature (36): n=a or g
agaatttaagcacatattgacttcggcctttcttcnagacctgcatgtcaattcagaagtccaaagattcg

SEQ ID NO: 6432 - DNA, 71 bp, chicken (Gallus Gallus)
  misc_feature (36): n=a or g
caaaagagaatacaagtatttcgtggaaaaaggganagactggtagatcagatgagtgaaggtttaagtga

SEQ ID NO: 6433 - DNA, 71 bp, chicken (Gallus Gallus)
  misc_feature (36): n=a or g
acgtaaatttatttttaaactctattgattacaggncagaacgtgtcccagaacaaccaaaatacagtgga

SEQ ID NO: 6434 - DNA, 71 bp, chicken (Gallus Gallus)
  misc_feature (36): n=a or g
gcagaaataggaaataagccaaagcttaattaaatntaagtaaacttatatatgcttcattacccttaaca

SEQ ID NO: 6435 - DNA, 71 bp, chicken (Gallus Gallus)
  misc_feature (36): n=a or g
agagaccattttactttaacaaacttgtaatataanctacaccattccctaatcacttccacattcaatgc

SEQ ID NO: 6436 - DNA, 71 bp, chicken (Gallus Gallus)
  misc_feature (36): n=a or c
actcccacctaaagtgatttattcacacacacacanaggaaaatcacaggatgcttaccagaaggcaaacc

SEQ ID NO: 6437 - DNA, 71 bp, chicken (Gallus Gallus)
  misc_feature (36): n=c or t
ttccccaaagacctttgtgcttcaccatggagaaanggggggctctggggggagctgaaagcacaacctgg

SEQ ID NO: 6438 - DNA, 71 bp, chicken (Gallus Gallus)
  misc_feature (36): n=a or g
acgctatttgctcaaaatattgatcataatgcaacntagatacacctgagctagctttaaactcacttgtg

SEQ ID NO: 6439 - DNA, 71 bp, chicken (Gallus Gallus)
  misc_feature (36): n=c or t
cagcagcccatggacagagctggacatccacacgtngctttgacaggagcactatcagctaaaatctcaat

SEQ ID NO: 6440 - DNA, 71 bp, chicken (Gallus Gallus)
  misc_feature (36): n=c or t
taatatcaaaaccagatgagagatctataattaggnttgcatttgtccctataaaagtctgaagagttaaa

SEQ ID NO: 6441 - DNA, 71 bp, chicken (Gallus Gallus)
  misc_feature (36): n=c or t
tgtgaagctgaacagtggaagtaaagcactggttanggagcactggagaagcattctctgctacagtagag

SEQ ID NO: 6442 - DNA, 71 bp, chicken (Gallus Gallus)
  misc_feature (36): n=c or t
acaaaaagcaaacgtttcaaaagcagggtaattctntgcccagctcctcttgaacagattttccaagacct

SEQ ID NO: 6443 - DNA, 71 bp, chicken (Gallus Gallus)
  misc_feature (36): n=c or t
taccctcctagaaaatccagactgggagctgctcantgatggaagcagctttgtagttagcagagaatgga

SEQ ID NO: 6444 - DNA, 71 bp, chicken (Gallus Gallus)
  misc_feature (36): n=c or t
agtaagatcatctcaacaattacatttttgttgtcngcagtctaacgctcaggaacatacagaaaccacag

SEQ ID NO: 6445 - DNA, 71 bp, chicken (Gallus Gallus)
  misc_feature (36): n=a or g
ccagcagaaccacacacagctgcatatgcagagganaatccacaggactgctggcatttaattgccttcag

SEQ ID NO: 6446 - DNA, 71 bp, chicken (Gallus Gallus)
  misc_feature (36): n=g or t
aggaagtttgggcatagtgctgtgctgttaggacangattgcaggacttcgtgttgcagatgtaagtgcgc

SEQ ID NO: 6447 - DNA, 71 bp, chicken (Gallus Gallus)
  misc_feature (36): n=c or t
agtgaaatgctgacataatgaagtccttcctcctcngaccagtaaacaagctgtgagctcagtttacttag

SEQ ID NO: 6448 - DNA, 71 bp, chicken (Gallus Gallus)
  misc_feature (36): n=a or t
ccttttaaagctcagatcaagaaaggactgaaatcnattggctccttcctcttttaccactgctgctgact

SEQ ID NO: 6449 - DNA, 71 bp, chicken (Gallus Gallus)
  misc_feature (36): n=a or g
ctgcactgcaatcagaatcaggagattcaggaatgnctggatttatagctctaagaaacacagaaaaacac

SEQ ID NO: 6450 - DNA, 71 bp, chicken (Gallus Gallus)
  misc_feature (36): n=a or g
attcaaccctttaactgttttcttcccactgtgcangagctctgtaagaaatgtacaagcctaggatagac

SEQ ID NO: 6451 - DNA, 71 bp, chicken (Gallus Gallus)
  misc_feature (36): n=a or g
ttctgtgtaataattatgaaattatgaagaataaangcaacagctgtggtgtcagaccgaagaagcaaatt

SEQ ID NO: 6452 - DNA, 71 bp, chicken (Gallus Gallus)
  misc_feature (36): n=a or g
agactttcacaggaattaaaaatacctgtggtcaanaataacctttaaatgatgcagttccatgtattaat

SEQ ID NO: 6453 - DNA, 71 bp, chicken (Gallus Gallus)
  misc_feature (36): n=g or t
gccttaaaaagagaagacaatatgatgttttgaaanacatatccatgcaacttcctcataattgtagttca

SEQ ID NO: 6454 - DNA, 71 bp, chicken (Gallus Gallus)
  misc_feature (36): n=c or t
ctgactgatttggagccgttaagccataagctcttnctaaaggaagggcgatccctcaagactgttggtat

SEQ ID NO: 6455 - DNA, 71 bp, chicken (Gallus Gallus)
  misc_feature (36): n=g or t
aatgttaaccagacttgtggtgaggccaggcacagnggcattcaaaacaagtcgtaattaatctgaaccac

SEQ ID NO: 6456 - DNA, 71 bp, chicken (Gallus Gallus)
  misc_feature (36): n=c or t
actaaatatcaaagctgtttacatagagagctgttngtagagaactgatggaaagcacactttccctcagg

SEQ ID NO: 6457 - DNA, 71 bp, chicken (Gallus Gallus)
  misc_feature (36): n=a or g
gatacaagagaagagaacttgaggaaagggaaagcncaatgactccgttagtaaagctctgagtacacatc

SEQ ID NO: 6458 - DNA, 71 bp, chicken (Gallus Gallus)
  misc_feature (36): n=g or t
ataactggaatgaatactgtttaaagaaatgtaatnaatatgtaggaatgggtatccactaatgggtaaga

SEQ ID NO: 6459 - DNA, 71 bp, chicken (Gallus Gallus)
  misc_feature (36): n=c or t
gaagaagcaaaggaaaaaatcaaaatgcataacctnagaagcacttttatcagaacatagcactttctaga

SEQ ID NO: 6460 - DNA, 71 bp, chicken (Gallus Gallus)
  misc_feature (36): n=c or t
tcacctcagctttccatttgcttcagcacaggcaangtttggacccttaaagtacaagctcccttctgcag

SEQ ID NO: 6461 - DNA, 71 bp, chicken (Gallus Gallus)
  misc_feature (36): n=a or g
cacctcttctaaatggagaaatgttgagtcctgagnaagacaagctatgttcatttcagcatttttgcttt

SEQ ID NO: 6462 - DNA, 71 bp, chicken (Gallus Gallus)
  misc_feature (36): n=a or g
atgcaaaaaaatgtgcattttacataagtttgcttncttttttcacattggcaactggggttaacagtaca

SEQ ID NO: 6463 - DNA, 71 bp, chicken (Gallus Gallus)
  misc_feature (36): n=a or c
gagttcacagaagtgcagcaaaagcaaacaatcacntcccattgagaaaaggttcttgtttagcacagctg

SEQ ID NO: 6464 - DNA, 71 bp, chicken (Gallus Gallus)
  misc_feature (36): n=c or t
ggctttcccacttcctatcctgaacaaggagaaagnatttaatcaccactatggccactgcgctcttggcc

SEQ ID NO: 6465 - DNA, 71 bp, chicken (Gallus Gallus)
  misc_feature (36): n=a or g
aatgcttgggaaaaaatgtattaaaatcttgacagntgatacaaccaataaagaatgaagagacagcaatg

SEQ ID NO: 6466 - DNA, 71 bp, chicken (Gallus Gallus)
  misc_feature (36): n=g or t
gaagtttaaggggggaaatctcaaattttcctcttngcatttattgttttagcctgaagggccagaaatcg

SEQ ID NO: 6467 - DNA, 71 bp, chicken (Gallus Gallus)
  misc_feature (36): n=a or g
taattgattgaatcttaaaactgtttgtttattccnaaagaggaatttagggtaactaacttgtatgtaga

SEQ ID NO: 6468 - DNA, 71 bp, chicken (Gallus Gallus)
  misc_feature (36): n=c or t
atgttgaccttacgggggctctttataatgaacaangtgcaagtgaaatcagaatttgtctcagcgagtaa

SEQ ID NO: 6469 - DNA, 71 bp, chicken (Gallus Gallus)
  misc_feature (36): n=c or t
ctgtcttatgcaggaaactccttgtccttaccagtnagaactgtgattaaatatataaatgcctcaggaaa

SEQ ID NO: 6470 - DNA, 71 bp, chicken (Gallus Gallus)
  misc_feature (36): n=a or g
acaatctgcttagtagaaattacactgaaagatctntcaagctatataaaacaatttttgcctagtccaac

SEQ ID NO: 6471 - DNA, 71 bp, chicken (Gallus Gallus)
  misc_feature (36): n=a or g
gcagtttttacattgcttgtaacattctaggtctgngtacaagctatttcttctaagtgccattaatgtgc

SEQ ID NO: 6472 - DNA, 71 bp, chicken (Gallus Gallus)
  misc_feature (36): n=c or t
ctgcagatccttgttgcagactcaaccctgatgagnctcattgggcttgtttggtttagaggtcgagtttg

SEQ ID NO: 6473 - DNA, 71 bp, chicken (Gallus Gallus)
  misc_feature (36): n=a or g
gagaccttggagttcactggaaaaacatctgtattnttctccatggtgtggaggtcttaaaacatcctccc

SEQ ID NO: 6474 - DNA, 71 bp, chicken (Gallus Gallus)
  misc_feature (36): n=g or t
gatccactgttaactttattggttctaaaattttanacttttaaatcttctgatatggctttgaatacata

SEQ ID NO: 6475 - DNA, 71 bp, chicken (Gallus Gallus)
  misc_feature (36): n=g or t
agaggaggacagacttcagtctcacacaggactcgnccactatggcatgtacactgtgtgcaagagtcaat

SEQ ID NO: 6476 - DNA, 71 bp, chicken (Gallus Gallus)
  misc_feature (36): n=a or c
aataacattttacatgaccatatttgagttgaagantattaatacaaatattttgattttaagcccctata

SEQ ID NO: 6477 - DNA, 71 bp, chicken (Gallus Gallus)
  misc_feature (36): n=a or g
agatttgctcagtgaatctttaaacccaacagacanggacgatctcaagcacccagtcctgcaataacttc

SEQ ID NO: 6478 - DNA, 71 bp, chicken (Gallus Gallus)
  misc_feature (36): n=g or t
caacacagaaaactgtgtgttataactctaatattntttgataactaaatgtgacatctaaattaaaagtt

SEQ ID NO: 6479 - DNA, 71 bp, chicken (Gallus Gallus)
  misc_feature (36): n=a or g
aatattctgtgggatattattgcctgcaatatcaangtgaaatattctgtttcatgcatagaatttactta

SEQ ID NO: 6480 - DNA, 71 bp, chicken (Gallus Gallus)
  misc_feature (36): n=a or g
aatagcagcagcaaagtctgtttccactgtctcacnaagcagctgagaatttggacaaaaaccaaccgtct

SEQ ID NO: 6481 - DNA, 71 bp, chicken (Gallus Gallus)
  misc_feature (36): n=a or g
cttttcatggttagatcagtgcaagcttatttcagncacaaactccagcctcattttcagaatttttatta

SEQ ID NO: 6482 - DNA, 71 bp, chicken (Gallus Gallus)
  misc_feature (36): n=c or t
aagtagctaaagcctgtcagttaagggcagaagatntctgtgttcagcttaccaatgattatgaagccaaa

SEQ ID NO: 6483 - DNA, 71 bp, chicken (Gallus Gallus)
  misc_feature (36): n=a or g
tattcaagtaattgctgctttttcatctctggtagntaatttgaggtgtggagcaactccttcctgatgta

SEQ ID NO: 6484 - DNA, 71 bp, chicken (Gallus Gallus)
  misc_feature (36): n=c or g
ccacttcactgcatacacgtgacttcattcacatgncacacagtgggtcaaaatacagattctcctatata

SEQ ID NO: 6485 - DNA, 71 bp, chicken (Gallus Gallus)
  misc_feature (36): n=c or t
caggatttaattctttttccgaaatagacagcttgngatgtaccaattgaatgatcttgcaagagcatata

SEQ ID NO: 6486 - DNA, 71 bp, chicken (Gallus Gallus)
  misc_feature (36): n=a or g
aactcacattaatttccaagtgccagcatttgagtncatttgatttttaatttttgtaaggattcttttat

SEQ ID NO: 6487 - DNA, 71 bp, chicken (Gallus Gallus)
  misc_feature (36): n=a or g
cacccaactcagcttgctctctctttgattcctccnttctgctctgccagttgcaacctccttccacttca

SEQ ID NO: 6488 - DNA, 71 bp, chicken (Gallus Gallus)
  misc_feature (36): n=a or g
gcctctacaggagcctgctgctgctgttcaccaagnggtgaaagacttgagtaccaagagcttgcttggct

SEQ ID NO: 6489 - DNA, 71 bp, chicken (Gallus Gallus)
  misc_feature (36): n=c or g
ctcgatccgaagccctgcgagtctcaaagcactccnttttcctccttacaccatgaaaaaaacaacccacc

SEQ ID NO: 6490 - DNA, 71 bp, chicken (Gallus Gallus)
  misc_feature (36): n=c or t
gtgcacactctcacagtactcctctacaggcattangcttccatatacttcacccaaacctgctaaacacc

SEQ ID NO: 6491 - DNA, 71 bp, chicken (Gallus Gallus)
  misc_feature (36): n=c or t
cagacagaattgcagaagatgagccactaccttganaacaaaagccagcagaaaggtactgaaaggtcagt

SEQ ID NO: 6492 - DNA, 71 bp, chicken (Gallus Gallus)
  misc_feature (36): n=c or t
agctgtccaaaggtttgtaggagaacctttctaagngtgcttttttggggggggatgatgctgagtatgga

SEQ ID NO: 6493 - DNA, 71 bp, chicken (Gallus Gallus)
  misc_feature (36): n=a or g
gaactaaattcaacagaacacttctctcttgacacntaacaaagactatactataggaaccatctgtgtgc

SEQ ID NO: 6494 - DNA, 71 bp, chicken (Gallus Gallus)
  misc_feature (36): n=c or t
tttatcttaattctctttatcatctgatactcccantgccagtccctttaatctgcagaaagatgcttgct

SEQ ID NO: 6495 - DNA, 71 bp, chicken (Gallus Gallus)
  misc_feature (36): n=a or g
tatttgtatctgctgcaccttcagagaaaagcagcnctgccaatcacaggaattctttctgaaatgtcagt

SEQ ID NO: 6496 - DNA, 71 bp, chicken (Gallus Gallus)
  misc_feature (36): n=c or t
ttccataactgatgtacagaagagaaaaatgatggntcatcactagcaggaaacaatcatctcataagaca

SEQ ID NO: 6497 - DNA, 71 bp, chicken (Gallus Gallus)
  misc_feature (36): n=c or t
aacctgtttgcccagcactatggacacaactcaccngaaatgcagcacaacgcctgagaacaacagaagct

SEQ ID NO: 6498 - DNA, 71 bp, chicken (Gallus Gallus)
  misc_feature (36): n=c or t
gagcaatttccggaggtgccttccaacaccagctcntttctgattctgtgagaataatacttctacattaa

SEQ ID NO: 6499 - DNA, 71 bp, chicken (Gallus Gallus)
  misc_feature (36): n=c or t
ctgttactctccatattctgctgaagttctcagtangggagagacatagacctgatggagtgcatccagag

SEQ ID NO: 6500 - DNA, 71 bp, chicken (Gallus Gallus)
  misc_feature (36): n=c or t
gcaaataattggcttaaaatcttacacaagaatgancttccaactataacaaaaaattaacatatgccctt

SEQ ID NO: 6501 - DNA, 71 bp, chicken (Gallus Gallus)
  misc_feature (36): n=c or t
tcccagagcctctcctctagtgctgctgggcaccantgaggctgccttctcctcttgcatattcttccctg

SEQ ID NO: 6502 - DNA, 71 bp, chicken (Gallus Gallus)
  misc_feature (36): n=c or t
cagcgggcagctcttttcagaagggggcattactgnttaaaaacgcactatgcaagaaagaaattacaccg

SEQ ID NO: 6503 - DNA, 71 bp, chicken (Gallus Gallus)
  misc_feature (36): n=c or t
aatagagtgcagttttcctttcatcatcataactanttgaaatgtgatcatccaagatagtattgacatca

SEQ ID NO: 6504 - DNA, 71 bp, chicken (Gallus Gallus)
  misc_feature (36): n=c or t
ctttggctgcagctaacatctgctttcttgattgtnaaagattttttaacagtctccctcttgagtacagg

SEQ ID NO: 6505 - DNA, 71 bp, chicken (Gallus Gallus)
  misc_feature (36): n=c or t
tcacagattcaggatctcaagatgttttctaatccngtaaatccaagtaattttccaacattgggaaggat

SEQ ID NO: 6506 - DNA, 71 bp, chicken (Gallus Gallus)
  misc_feature (36): n=c or t
tctttaacatgagcataatatggcaaacagtcaaanactgcaggtaggattctcttggttatctgtaatat

SEQ ID NO: 6507 - DNA, 71 bp, chicken (Gallus Gallus)
  misc_feature (36): n=a or g
agtttttaaattgtctaagtttctaaaactttctgntatgctgtttctttatgcaggttttcactgttatg

SEQ ID NO: 6508 - DNA, 71 bp, chicken (Gallus Gallus)
  misc_feature (36): n=c or t
tttgaaaaagggggttaaaatgttagttcttggatntgcatgtgtacttgcagtctgggcacgaagctggg

SEQ ID NO: 6509 - DNA, 71 bp, chicken (Gallus Gallus)
  misc_feature (36): n=c or t
atctcagcttccaattcatgaactattggtgatatntggtagatcacattagcggcctttctgctatttga

SEQ ID NO: 6510 - DNA, 71 bp, chicken (Gallus Gallus)
  misc_feature (36): n=c or g
gtgcctggattgtagcagtgggcgaacgccgcttcncttccagtaaagttttggccagagagaggaaggga

SEQ ID NO: 6511 - DNA, 71 bp, chicken (Gallus Gallus)
  misc_feature (36): n=c or t
atacagcaagtcagattgagggagtgggatggaatngctgcatgtgttgcgccataaaaggtggcacatgg

SEQ ID NO: 6512 - DNA, 71 bp, chicken (Gallus Gallus)
  misc_feature (36): n=c or t
aaagagatcagcccccttctgacaaagctccagctngtggtcagccctcctgctcgataaacagaactgat

SEQ ID NO: 6513 - DNA, 71 bp, chicken (Gallus Gallus)
  misc_feature (36): n=c or t
acaaaagtgttggagatgaagccatccagtgtgcanagagcatcttaatggcagttaaattttctgatgag

SEQ ID NO: 6514 - DNA, 71 bp, chicken (Gallus Gallus)
  misc_feature (36): n=c or g
ggtattggaatgctttctttttattgcatgttaagnttttgtggtaagaaaacattaatttcttaaaacat

SEQ ID NO: 6515 - DNA, 71 bp, chicken (Gallus Gallus)
  misc_feature (36): n=a or g
tagaatcatctaggttggaaaagaccttcaaaatcntgaaggcctaccacatacctcatctacagagtctc

SEQ ID NO: 6516 - DNA, 71 bp, chicken (Gallus Gallus)
  misc_feature (36): n=c or t
ggtctcagacatcatcacagaaggtggctgattcanagtgagatgcagaacgctgttagccacccctatgg

SEQ ID NO: 6517 - DNA, 71 bp, chicken (Gallus Gallus)
  misc_feature (36): n=a or g
ttcatgccagtttgaaaggttaatgaatactttganaatgacgtagaatatgtatgggacctacatgtgtg

SEQ ID NO: 6518 - DNA, 71 bp, chicken (Gallus Gallus)
  misc_feature (36): n=a or g
gtgtcagggtattgttaccatcagtgctcaagtcanggtcaccccacaggagctggtgacagcggctccag

SEQ ID NO: 6519 - DNA, 71 bp, chicken (Gallus Gallus)
  misc_feature (36): n=a or g
ttgcagacgttgcttttgctttgcaaattcagtatntacataaccagctaagtatgaattaaattgtgtat

SEQ ID NO: 6520 - DNA, 71 bp, chicken (Gallus Gallus)
  misc_feature (36): n=a or g
ttcagtaggaatgacctgttagagatccactcaaanctagtttattgtctactgactggagccttgtttgg

SEQ ID NO: 6521 - DNA, 71 bp, chicken (Gallus Gallus)
  misc_feature (36): n=g or t
tctgtaatcctatggccatttacacaattttccttncaaaaacctgaaataaaacaaaatacagccactag

SEQ ID NO: 6522 - DNA, 71 bp, chicken (Gallus Gallus)
  misc_feature (36): n=c or t
tgatctacttacaaaccaaagataggcaatgcagtntctgcccaattcttctggcaaccctgaacagtggc

SEQ ID NO: 6523 - DNA, 71 bp, chicken (Gallus Gallus)
  misc_feature (36): n=g or t
tcatgcatgtaggtacatgtttattcatacatgccnggtattgattcatgtgtgttttataactactcttt

SEQ ID NO: 6524 - DNA, 71 bp, chicken (Gallus Gallus)
  misc_feature (36): n=a or c
gccacacaaccggagtctgctacaacgaacgtcagnccagggagcaaattaacatccctgaggggcgacgt

SEQ ID NO: 6525 - DNA, 71 bp, chicken (Gallus Gallus)
  misc_feature (36): n=c or t
gtcagctcaggatcagaaatcagagtttgcttacanccgttcttcagctgcatgtttgagtgatgtgtctg

SEQ ID NO: 6526 - DNA, 71 bp, chicken (Gallus Gallus)
  misc_feature (36): n=a or c
aggagtagcagaggtaagagctcactgttgcacacncttggttggatgctgacccaatgatgccttgctct

SEQ ID NO: 6527 - DNA, 71 bp, chicken (Gallus Gallus)
  misc_feature (36): n=c or t
tcccgatggattcgtacgaacggaactcgatgtctngctgtgcaggctggaaagaagcgatagaggccaat

SEQ ID NO: 6528 - DNA, 71 bp, chicken (Gallus Gallus)
  misc_feature (36): n=c or t
accttgggtatgttgcaacatctcatattctgttgngcctttcgtaaaatgttcagcttaatatattactg

SEQ ID NO: 6529 - DNA, 71 bp, chicken (Gallus Gallus)
  misc_feature (36): n=c or g
ctatacaaagggcaaactagtgagtatctaggtatntgtccactttccctgttcaaagaatatgctgccca

SEQ ID NO: 6530 - DNA, 71 bp, chicken (Gallus Gallus)
  misc_feature (36): n=a or g
catgtgaaaattaccctgcttcagctctggaaatcntgtttgtaggcacaaagggagcagcttttcttctt

SEQ ID NO: 6531 - DNA, 71 bp, chicken (Gallus Gallus)
  misc_feature (36): n=a or g
cataaagacaggtcaaagcactcctgcacacagctngagggcaaatcctgcacaccctgggactgggacag

SEQ ID NO: 6532 - DNA, 71 bp, chicken (Gallus Gallus)
  misc_feature (36): n=a or g
ctaattgataggatgatcagaaactgacctcacacngagggcatagggaattttctctgaattttctattt

SEQ ID NO: 6533 - DNA, 71 bp, chicken (Gallus Gallus)
  misc_feature (36): n=c or g
gtagcacaaggctacagtctaaggattggattcaanttttattattcaacatcgtcttctaggataaatta

SEQ ID NO: 6534 - DNA, 71 bp, chicken (Gallus Gallus)
  misc_feature (36): n=a or g
gctccagtcatcttttttgctctgtgctgcgtgcantacttgctataacctgcttatttccaaacagttac

SEQ ID NO: 6535 - DNA, 71 bp, chicken (Gallus Gallus)
  misc_feature (36): n=c or t
cctgttactatttttaaatgttgcttcagaaggcangagtaaatagagggaagaagtagttaaagctgaaa

SEQ ID NO: 6536 - DNA, 71 bp, chicken (Gallus Gallus)
  misc_feature (36): n=a or c
ggctatcctcatctatcacaactgtggctgtgacancggcacacagctggggacagagtccttcccctgca

SEQ ID NO: 6537 - DNA, 71 bp, chicken (Gallus Gallus)
  misc_feature (36): n=a or g
aaatggcccatacctgagtattgtagggagaatgcnttctggccccagccaaagctattttaaggacagtg

SEQ ID NO: 6538 - DNA, 71 bp, chicken (Gallus Gallus)
  misc_feature (36): n=g or t
tttaagcgtacaaactgtaatttttctgcattcagnaaagatggagcaatatttctatccaagtataattt

SEQ ID NO: 6539 - DNA, 71 bp, chicken (Gallus Gallus)
  misc_feature (36): n=c or t
taatctgttagttatgttacagcagagagtaagcanaagacaagaaatagtcatactatgtttgactcaca

SEQ ID NO: 6540 - DNA, 71 bp, chicken (Gallus Gallus)
  misc_feature (36): n=a or g
ttttatggttcatactactggctctatgaatatagnaagctacaatttatttaaatgtttggtttgtttat

SEQ ID NO: 6541 - DNA, 71 bp, chicken (Gallus Gallus)
  misc_feature (36): n=a or g
cagaagaaataattaaaagtaggaaagacatatttngggctgaggttcctagacaattcagagtgcaatgt

SEQ ID NO: 6542 - DNA, 71 bp, chicken (Gallus Gallus)
  misc_feature (36): n=a or g
agtaaacatatgctgcaacatgcgcgtgcttgtgancctctgctggacacaacaaaccccgttctgatctc

SEQ ID NO: 6543 - DNA, 71 bp, chicken (Gallus Gallus)
  misc_feature (36): n=a or g
caacttactgaatcactctatctctgttcaggtggngttttgtgcacccattgcaaactgtgttaacctct

SEQ ID NO: 6544 - DNA, 71 bp, chicken (Gallus Gallus)
  misc_feature (36): n=a or g
ccaaaggagggctacagccatctctaccccagagcnacaactgagagctgttctggtaaacagggccccag

SEQ ID NO: 6545 - DNA, 71 bp, chicken (Gallus Gallus)
  misc_feature (36): n=a or g
ttaactctgctgtgaacagcttctactccattaatntattctgtgtgtacctgactgaaaccaaaggcagg

SEQ ID NO: 6546 - DNA, 71 bp, chicken (Gallus Gallus)
  misc_feature (36): n=a or g
tatggccacatgtggcattgtttactcatgacactntaaatgattaatgtggaaaagctgcatttgaacaa

SEQ ID NO: 6547 - DNA, 71 bp, chicken (Gallus Gallus)
  misc_feature (36): n=c or t
ggccacttagctaaagttgattgaacatgataaccncagccttttcctgtctaccctgtaggtcatttatc

SEQ ID NO: 6548 - DNA, 71 bp, chicken (Gallus Gallus)
  misc_feature (36): n=a or g
gttttaacagtaagtagtattttaacatggtggcanctaagctccaccattcctcccatgatctctcactt

SEQ ID NO: 6549 - DNA, 71 bp, chicken (Gallus Gallus)
  misc_feature (36): n=c or t
tttcttttggtgcatttccttccacattcgccacanaccttcagctcaatatatatcttcatttggtgaaa

SEQ ID NO: 6550 - DNA, 71 bp, chicken (Gallus Gallus)
  misc_feature (36): n=a or g
ccagctagtcttcaattttgcagcagcatgttacangacttaggaaatctctctacacttctaaaatgacc

SEQ ID NO: 6551 - DNA, 71 bp, chicken (Gallus Gallus)
  misc_feature (36): n=c or t
gtgttttgaggcagatcctgtgcactactcaggacnaaggcaagggttacttcctttcttaaaggtttcct

SEQ ID NO: 6552 - DNA, 71 bp, chicken (Gallus Gallus)
  misc_feature (36): n=c or t
cgctctttccattcggtctgagaaacacaaaacttntcgttgtcaaaaggcaactttattttcggatgagc

SEQ ID NO: 6553 - DNA, 71 bp, chicken (Gallus Gallus)
  misc_feature (36): n=a or c
gttatcatccagcagtctgggctcagaactgatagnttcagtctccacagtatgtgaaaaacagtttgtgg

SEQ ID NO: 6554 - DNA, 71 bp, chicken (Gallus Gallus)
  misc_feature (36): n=a or g
atacatccagatagttaacatgtaaaccttattggntttctttccaaaatcaaaacacatgagctccctgt

SEQ ID NO: 6555 - DNA, 71 bp, chicken (Gallus Gallus)
  misc_feature (36): n=c or t
aagctgagggtgtctgggatgggaagtgacttgggnggagtcatttgatgatagtccgatgcagaaaactc

SEQ ID NO: 6556 - DNA, 71 bp, chicken (Gallus Gallus)
  misc_feature (36): n=c or t
tctcagacattttgtagtatctcagtggtactatcngatggaatttttagtacagtttaaagaaagtagat

SEQ ID NO: 6557 - DNA, 71 bp, chicken (Gallus Gallus)
  misc_feature (36): n=a or g
gcaccggtagacgatacgtgagcaaagctcatgagngtgcccttttttggacttctgtgtacacaatcttg

SEQ ID NO: 6558 - DNA, 71 bp, chicken (Gallus Gallus)
  misc_feature (36): n=c or t
tcctcccaacaacttcagagaagtcaccattacgtntacttggtcaatggaatacaaactataattataaa

SEQ ID NO: 6559 - DNA, 71 bp, chicken (Gallus Gallus)
  misc_feature (36): n=c or t
gcctgtggaagctgaacactgccacagatgacaaangtagccaacattgtggttgtgtaccataatctacc

SEQ ID NO: 6560 - DNA, 71 bp, chicken (Gallus Gallus)
  misc_feature (36): n=c or t
ttccttgctgcttgggccagacaatggtgaactacncagactcaacctgaaaacaaaaacgacttagagaa

SEQ ID NO: 6561 - DNA, 71 bp, chicken (Gallus Gallus)
  misc_feature (36): n=a or g
agatctcttaccttatatgaggttcacactgctggnccttatgtttcaggaagagcagagagaaatgggag

SEQ ID NO: 6562 - DNA, 71 bp, chicken (Gallus Gallus)
  misc_feature (36): n=a or g
catgcttggcaagtggatggacagataataccccantacagaaatacttcttggaactctgcttgaatcct

SEQ ID NO: 6563 - DNA, 71 bp, chicken (Gallus Gallus)
  misc_feature (36): n=a or c
tgtctccatacctccagtgtatacataagagtttancttgaaaagctattgtagaaaaagataattgctta

SEQ ID NO: 6564 - DNA, 71 bp, chicken (Gallus Gallus)
  misc_feature (36): n=a or g
gctgatggcttagttctgcatgataaaataaataangttgattaagttcaagctccagtacctcagatgtt

SEQ ID NO: 6565 - DNA, 71 bp, chicken (Gallus Gallus)
  misc_feature (36): n=a or t
ctatttgcagtgttggccaaatatgtcaaaaaaggnggtcggtgtagaacaggcttttctgggctacagct

SEQ ID NO: 6566 - DNA, 71 bp, chicken (Gallus Gallus)
  misc_feature (36): n=a or g
aatacacaagttcaaacaattatagttactctaaangcttggtttatgtggtagttatatgaatttattca

SEQ ID NO: 6567 - DNA, 71 bp, chicken (Gallus Gallus)
  misc_feature (36): n=a or g
tctggacatcgctttgcagaaagggaagaagaattnggaggcgttgggcacagctgtgccgtgctggcagc

SEQ ID NO: 6568 - DNA, 71 bp, chicken (Gallus Gallus)
  misc_feature (36): n=c or t
agctgaaggctcctgctgcttgccagctgtgtttcnagtgtaaaagggattataaatgaaactggaggatc

SEQ ID NO: 6569 - DNA, 71 bp, chicken (Gallus Gallus)
  misc_feature (36): n=a or g
ctttctagaggcttatattattctccttcaaaagcnctgcagcatagcagaaatggaaaacttgagaaaaa

SEQ ID NO: 6570 - DNA, 71 bp, chicken (Gallus Gallus)
  misc_feature (36): n=c or t
tatttgggaagtgagctgtgggagaattaagagcantggcatcttagcagtgtttgccaggctgagaaatg

SEQ ID NO: 6571 - DNA, 71 bp, chicken (Gallus Gallus)
  misc_feature (36): n=a or g
agcagaataatgccaggataagcagtataagcagcnaaacacctggctgaggaaatcagcttacacgtgct

SEQ ID NO: 6572 - DNA, 71 bp, chicken (Gallus Gallus)
  misc_feature (36): n=c or t
gctctccaaatgagcacttctgagggcaagtctgcntgttgatgtgcccttgaaggtcgcaggttgcattc

SEQ ID NO: 6573 - DNA, 71 bp, chicken (Gallus Gallus)
  misc_feature (36): n=c or t
aaaacagctttacttcttgtggataataagttcttntacttctgggccttggttcagcaattatgtagaat

SEQ ID NO: 6574 - DNA, 71 bp, chicken (Gallus Gallus)
  misc_feature (36): n=c or t
tgcaccacggagctcatttccagcccctaggccagnccctaacgtacaccgatgcatacagttcctttcca

SEQ ID NO: 6575 - DNA, 71 bp, chicken (Gallus Gallus)
  misc_feature (36): n=a or g
atagaagatctatgagcaattttgctttaaaatttnactgtaaaacatctgtgcttatttttgacgttatg

SEQ ID NO: 6576 - DNA, 71 bp, chicken (Gallus Gallus)
  misc_feature (36): n=c or t
actcatggtactgtatagggctttgcaagatgtganttgcagcttctctctcactatagctgtccgccttg

SEQ ID NO: 6577 - DNA, 71 bp, chicken (Gallus Gallus)
  misc_feature (36): n=a or g
aaatcgatataagtgataattggcaggcagttagantcttcatgaagtaatactctcaccatttaaagggt

SEQ ID NO: 6578 - DNA, 71 bp, chicken (Gallus Gallus)
  misc_feature (36): n=a or g
tgaaaggattgaaatggatcaagaatgacagcacgnagcatagcaagcttatttgctttttaccaaactca

SEQ ID NO: 6579 - DNA, 71 bp, chicken (Gallus Gallus)
  misc_feature (36): n=g or t
ttgtggccaggatgtgcttcctgaggcagtgcctgncttgcttttctccatcaggagcttctgttttggag

SEQ ID NO: 6580 - DNA, 71 bp, chicken (Gallus Gallus)
  misc_feature (36): n=a or g
attggagcactgggaatacataactgcaggtggcangcatgtgactgtacaccacttttttcttattctgc

SEQ ID NO: 6581 - DNA, 71 bp, chicken (Gallus Gallus)
  misc_feature (36): n=a or t
gagctcacttaaaactgaagacataccagatttgcnttgaatctgggtttaagatcacgtataaggttttc

SEQ ID NO: 6582 - DNA, 71 bp, chicken (Gallus Gallus)
  misc_feature (36): n=c or t
catttattacatttctgattttttcttgttcccacngggaaacagaaatgcagaagaatgaaaccacctac

SEQ ID NO: 6583 - DNA, 71 bp, chicken (Gallus Gallus)
  misc_feature (36): n=c or t
gaaggtcaacatttctcattttctgtacttaagctnataatgcatgcaatttctcttgcaaacattgccag

SEQ ID NO: 6584 - DNA, 71 bp, chicken (Gallus Gallus)
  misc_feature (36): n=c or t
ggattccaccacaagctaagagcccagatgctctcncacagttgagtcttgctggtttgcttctgacatgg

SEQ ID NO: 6585 - DNA, 71 bp, chicken (Gallus Gallus)
  misc_feature (36): n=a or g
tgcattattttgaaagtttccattcctcttcccaanaattcttcttattcttttaagtaacggaataatac

SEQ ID NO: 6586 - DNA, 71 bp, chicken (Gallus Gallus)
  misc_feature (36): n=a or g
aaatcaaaatctatggtgagaagtgcataaatcacngtgaataactacttttcgtaccaaaaaaaaaaaaa

SEQ ID NO: 6587 - DNA, 71 bp, chicken (Gallus Gallus)
  misc_feature (36): n=c or t
ctgaccttaaggtataatccaagagccctatgctangctctgttattcttgctgggagaaaaaggaggtgg

SEQ ID NO: 6588 - DNA, 71 bp, chicken (Gallus Gallus)
  misc_feature (36): n=a or g
agccaagttcaagtgtggaaaagctgtagtgaggcnatcactgatgttagttatcaacctgatttttgtgc

SEQ ID NO: 6589 - DNA, 71 bp, chicken (Gallus Gallus)
  misc_feature (36): n=c or t
tgtaccagctgtgagcagcacctgtagtgccccccnatcccactgcactgtggctgttagtcagagagttt

SEQ ID NO: 6590 - DNA, 71 bp, chicken (Gallus Gallus)
  misc_feature (36): n=c or t
gtgagcagacccacttggtagctaaaggatctgacnctccttcattccttccacctcccagtcccttgctc

SEQ ID NO: 6591 - DNA, 71 bp, chicken (Gallus Gallus)
  misc_feature (36): n=a or t
gattccaagttgtcctgcatatattgcgttatgtancctttcctcataaatcctactccatgttcatctct

SEQ ID NO: 6592 - DNA, 71 bp, chicken (Gallus Gallus)
  misc_feature (36): n=a or g
aaataaaaaagagtgcatgtatctttcttgattacngagcgacattatgttacatttgttttgtatatttc

SEQ ID NO: 6593 - DNA, 71 bp, chicken (Gallus Gallus)
  misc_feature (36): n=a or g
gggaggaagactccttctgagactggcaggctgtgnatcagcctggcctgtagccccattagagagaaccg

SEQ ID NO: 6594 - DNA, 71 bp, chicken (Gallus Gallus)
  misc_feature (36): n=a or g
aataaagctgacttaaaaataccatctgaagcaccncgcacaatcccgtggtaacatcaaaatattttagc

SEQ ID NO: 6595 - DNA, 71 bp, chicken (Gallus Gallus)
  misc_feature (36): n=c or t
tgaacctagatagccactgctgaaggatttcaagangtagcacagaaatcatctaagatcaggctacatgc

SEQ ID NO: 6596 - DNA, 71 bp, chicken (Gallus Gallus)
  misc_feature (36): n=a or g
tttcagaaaaaatatagagatatatcaataaaccantaagtattctgatctcccatgaaagctgtgagctc

SEQ ID NO: 6597 - DNA, 71 bp, chicken (Gallus Gallus)
  misc_feature (36): n=a or g
tttaaatcattcttcacaaataacaggatgtggctnggtttaagcagctgagcaagcctggcattgcagac

SEQ ID NO: 6598 - DNA, 71 bp, chicken (Gallus Gallus)
  misc_feature (36): n=a or g
atcttagcagtacaaatataggtagagagagaatanaagtatacaacacttcattcaatagtgaaaattcc

SEQ ID NO: 6599 - DNA, 71 bp, chicken (Gallus Gallus)
  misc_feature (36): n=a or g
tggcattgcatggaatgatggaatgcctgagctaantcatcaacaagaccttctgcaaatgctctttgtag

SEQ ID NO: 6600 - DNA, 71 bp, chicken (Gallus Gallus)
  misc_feature (36): n=c or t
attgatgtcaaaattagaaatagctagggaaataanagtgtatataccaaaaaagggcataaaatcagcaa

SEQ ID NO: 6601 - DNA, 71 bp, chicken (Gallus Gallus)
  misc_feature (36): n=a or c
atagacatagtacttgaaacagaagagacttgatcnccatcagatcatgcaggcctaacagtgaatacaca

SEQ ID NO: 6602 - DNA, 71 bp, chicken (Gallus Gallus)
  misc_feature (36): n=c or t
tacttgccctggtctcagctgggatagggcatgacntgaccattcttataaaaggagacaactaaatgcat

SEQ ID NO: 6603 - DNA, 71 bp, chicken (Gallus Gallus)
  misc_feature (36): n=a or g
tttaatggacaatttaacaactgtccataagagttnccagccttctaattgttggacatatgtattatcca

SEQ ID NO: 6604 - DNA, 71 bp, chicken (Gallus Gallus)
  misc_feature (36): n=c or t
gcacgaatatagggtgtaagctcaaatgaagtctgnagtcctgtgttttctctgggaccagggtataacgg

SEQ ID NO: 6605 - DNA, 71 bp, chicken (Gallus Gallus)
  misc_feature (36): n=c or t
cttgctgttattaatatatccttactctttgcccangtatattttcatgcaaaaagaagaaaccatgagaa

SEQ ID NO: 6606 - DNA, 71 bp, chicken (Gallus Gallus)
  misc_feature (36): n=g or t
tataatactgggaaatgctgggcactaatgtagatnaagtattactgctatttttaatttaatttgccatg

SEQ ID NO: 6607 - DNA, 71 bp, chicken (Gallus Gallus)
  misc_feature (36): n=c or t
ctgtaagaatctttcctaatatataaagaggaattntctttcccttccctggatagagacagctcatccag

SEQ ID NO: 6608 - DNA, 71 bp, chicken (Gallus Gallus)
  misc_feature (36): n=a or g
aagaataagcaaccatgacaatttaacatcacacanttaagtagcttcctagtacaaactgcaatagaccc

SEQ ID NO: 6609 - DNA, 71 bp, chicken (Gallus Gallus)
  misc_feature (36): n=a or g
cgggaaatcagacacagcaactaagaaacatttgtnatgatctgacctcactcaggccaaagactcgtctg

SEQ ID NO: 6610 - DNA, 71 bp, chicken (Gallus Gallus)
  misc_feature (36): n=c or t
cctacaatgatttacaaaaattaatgatcttaactnagttttccttttactctcccacaaccctgcagaag

SEQ ID NO: 6611 - DNA, 71 bp, chicken (Gallus Gallus)
  misc_feature (36): n=g or t
catttcttcacattcgctcttatcactcttttgtcnctgcgccttctccagtccctttttctccattagtg

SEQ ID NO: 6612 - DNA, 71 bp, chicken (Gallus Gallus)
  misc_feature (36): n=c or t
gggtaggcaaggtaaggggattgtcatgagcagagntctttatcatttgctgtgttatttgtccttgtaca

SEQ ID NO: 6613 - DNA, 71 bp, chicken (Gallus Gallus)
  misc_feature (36): n=a or g
caccaaattgtgctttaaaactgtattaaccctgtncaggaaagacgatgatcatatacaaattccacaaa

SEQ ID NO: 6614 - DNA, 71 bp, chicken (Gallus Gallus)
  misc_feature (36): n=a or g
ggagtgttgtttactctccctagctcccttctctcntagatttctgacatatatgatcttggcagcacttc

SEQ ID NO: 6615 - DNA, 71 bp, chicken (Gallus Gallus)
  misc_feature (36): n=a or g
tggatggatggcatgacaggggtaagctggtggacngagccaggaggcaagttgtatgcgtgctttgtgcc

SEQ ID NO: 6616 - DNA, 71 bp, chicken (Gallus Gallus)
  misc_feature (36): n=g or t
tacatgatggaagcctgtgccagcttgaatagaaangttacagaaatattcttaagataattttccctgaa

SEQ ID NO: 6617 - DNA, 71 bp, chicken (Gallus Gallus)
  misc_feature (36): n=c or t
gttgaaaagagaactctaaaaaataattggtctcangtgagctcactgagagcaagtagagaaaagatgcc

SEQ ID NO: 6618 - DNA, 71 bp, chicken (Gallus Gallus)
  misc_feature (36): n=a or c
acagaaaaaggactcatggggttaaaataacctccnatctttatccttaatcagggctgctaaggtagatc

SEQ ID NO: 6619 - DNA, 71 bp, chicken (Gallus Gallus)
  misc_feature (36): n=c or t
aaagtggaataaagctctgtagcgatgtcatcagangtgggatgtataggctgaacagactgtgctcattg

SEQ ID NO: 6620 - DNA, 71 bp, chicken (Gallus Gallus)
  misc_feature (36): n=a or g
ccactttcaagcgctctaattgatggcttcaaaacncagatacaatggattcagaaccaaccatcaagtgc

SEQ ID NO: 6621 - DNA, 71 bp, chicken (Gallus Gallus)
  misc_feature (36): n=a or g
cttttgcacaacttgccacttcattctcaccagacnttcacaagagaagccttctaacttcaatattagca

SEQ ID NO: 6622 - DNA, 71 bp, chicken (Gallus Gallus)
  misc_feature (36): n=c or t
accaataggccgagctgtcaaaattcatatgcatangggtaaaatcaaaaggtaaatctcttcaggaccga

SEQ ID NO: 6623 - DNA, 71 bp, chicken (Gallus Gallus)
  misc_feature (36): n=c or g
gagatccttgtttttttgtaccaagcagcccagaantggatacagtactccatgtgaggcctgaccagggc

SEQ ID NO: 6624 - DNA, 71 bp, chicken (Gallus Gallus)
  misc_feature (36): n=a or g
taacagagattaggcaatgcattttaaagaaacaantgacttaatacatctgtaccttaagattaaataga

SEQ ID NO: 6625 - DNA, 71 bp, chicken (Gallus Gallus)
  misc_feature (36): n=c or t
atacttccagaaatattgcctgaactcagtggaaanatagctttagttttcctcttataaaggatagctta

SEQ ID NO: 6626 - DNA, 71 bp, chicken (Gallus Gallus)
  misc_feature (36): n=g or t
tccaaggaatggggtggaagaaagatggccagtctngcctgaaagatacctgtatggcttctcttcaagta

SEQ ID NO: 6627 - DNA, 71 bp, chicken (Gallus Gallus)
  misc_feature (36): n=a or g
taaccttaaacagttgaattcaatgccattaatgcntccatctgagagagggttgttctggtttccacctg

SEQ ID NO: 6628 - DNA, 71 bp, chicken (Gallus Gallus)
  misc_feature (36): n=a or g
ttctacctttctactcttagaagcctatcactgaangttttctggttatgaaagttcaagaatgaacttac

SEQ ID NO: 6629 - DNA, 71 bp, chicken (Gallus Gallus)
  misc_feature (36): n=c or t
gctcaagttgtgctaaattaagggcattccaaattngaacactgtgtaaacaaccttacacatactgtgtt

SEQ ID NO: 6630 - DNA, 71 bp, chicken (Gallus Gallus)
  misc_feature (36): n=c or g
tgggatgtttgggaagacctgaatggtgctgagatncacgtgtggatctgcaactgttctccacctccggg

SEQ ID NO: 6631 - DNA, 71 bp, chicken (Gallus Gallus)
  misc_feature (36): n=c or t
ccagaatgtaaggtcaacacagaaaataatttatanagtcttccctagagctttgatgctctcagaattca

SEQ ID NO: 6632 - DNA, 71 bp, chicken (Gallus Gallus)
  misc_feature (36): n=a or g
aagtctctgagatcataagcagcaaagacaaggccntctatgcagccatccaggcagcagtttcagaagtc

SEQ ID NO: 6633 - DNA, 71 bp, chicken (Gallus Gallus)
  misc_feature (36): n=c or t
ctgtaaatcagcacacatccattgtagccagcctcngctcttaattgtgcttactttaccttggagctcct

SEQ ID NO: 6634 - DNA, 71 bp, chicken (Gallus Gallus)
  misc_feature (36): n=a or g
aaaagagattagtggagctcctccagctttcagacntggcctgctgactatggcaaagcaggagatgcaaa

SEQ ID NO: 6635 - DNA, 71 bp, chicken (Gallus Gallus)
  misc_feature (36): n=a or g
gggctgatgttccagccttttcattccctttcaggncaggcagctctgtggtcaggctgagtgatgtccca

SEQ ID NO: 6636 - DNA, 71 bp, chicken (Gallus Gallus)
  misc_feature (36): n=c or t
tttagatttaagtatcttttaaaagaattcctcttntaaagtgctcaatgtctctaagatttttaaaaaga

SEQ ID NO: 6637 - DNA, 71 bp, chicken (Gallus Gallus)
  misc_feature (36): n=a or t
cccggcttcctatacttgggagttccctatatggancaagaatcacacttgggtatcccaaacggccgggg

SEQ ID NO: 6638 - DNA, 71 bp, chicken (Gallus Gallus)
  misc_feature (36): n=c or t
aagaatggtgaggacatacagaatttccacaatcangtaagttaagagtatcagcttgtgttctaattccc

SEQ ID NO: 6639 - DNA, 71 bp, chicken (Gallus Gallus)
  misc_feature (36): n=a or g
ttcagtatctatagcttatatcagaattactgtgtnttacctgtaaatcagacagatagttttatctgttg

SEQ ID NO: 6640 - DNA, 71 bp, chicken (Gallus Gallus)
  misc_feature (36): n=a or g
tatttgtgggaaaaacaaaatgcaaaacccaaacanattgggaaggagcaggcttggcttcccagctgcag

SEQ ID NO: 6641 - DNA, 71 bp, chicken (Gallus Gallus)
  misc_feature (36): n=a or g
aacatcatcatttttcaccatcccaagtcatactcnctgcaatgcttcatttttacaacacagttagcccg

SEQ ID NO: 6642 - DNA, 71 bp, chicken (Gallus Gallus)
  misc_feature (36): n=a or g
ctatgcatatgtgagaggcgatattaggcaaaatantttagcaaacacgtatcaaatcagtgtactgacta

SEQ ID NO: 6643 - DNA, 71 bp, chicken (Gallus Gallus)
  misc_feature (36): n=a or g
aatataagttgcagtatacattctgagtgatgcaantcaaatgtgtttagatacagttccatgtatgtaca

SEQ ID NO: 6644 - DNA, 71 bp, chicken (Gallus Gallus)
  misc_feature (36): n=a or g
gaagtcagatcactattttcactttttcaacccttnggcaattcttcctaatttttaatgccttaaggctt

SEQ ID NO: 6645 - DNA, 71 bp, chicken (Gallus Gallus)
  misc_feature (36): n=a or c
gtagtaagaatacattagtggtcacagaacagctcnattttcagttggagattttgtcccttctgttattt

SEQ ID NO: 6646 - DNA, 71 bp, chicken (Gallus Gallus)
  misc_feature (36): n=a or g
cttcctgcaaatatttgtgcttctgtcttatgtggntgatacaaaatagtctcgcacaagcaattagctgg

SEQ ID NO: 6647 - DNA, 71 bp, chicken (Gallus Gallus)
  misc_feature (36): n=a or g
ttactggagaggaaagtcatgcaactccatgtgaantagctattcctttaagggataaattgagagtaaat

SEQ ID NO: 6648 - DNA, 71 bp, chicken (Gallus Gallus)
  misc_feature (36): n=a or g
tttttgaagttaactttatgactaaaaagagaacanccaccttttgtcactgttgaaagatgaatggatta

SEQ ID NO: 6649 - DNA, 71 bp, chicken (Gallus Gallus)
  misc_feature (36): n=c or t
ctgcccagaagcactaagcttccaaagcaaagtctnattaccctctatttcatatggtactgctctcacta

SEQ ID NO: 6650 - DNA, 71 bp, chicken (Gallus Gallus)
  misc_feature (36): n=a or g
gagtcttactcacgtgagggagtagctggcgatgtnaagtcggagaactaattttgcatttcagtgatccc

SEQ ID NO: 6651 - DNA, 71 bp, chicken (Gallus Gallus)
  misc_feature (36): n=a or g
gtgcagctgatagcatttcaacagccagaggaagtncagtgcctgagctgccaaaaatcacccatctgacc

SEQ ID NO: 6652 - DNA, 71 bp, chicken (Gallus Gallus)
  misc_feature (36): n=a or g
tgctccttcctcagaaaaacagcagcaagctgaacntggcagggcaatggcttggattctggttatcccac

SEQ ID NO: 6653 - DNA, 71 bp, chicken (Gallus Gallus)
  misc_feature (36): n=a or g
tgatgtctgaaatgcatgggaaatgagctcaggacnttactgctcaagtgtgaagaggctgtgagatctga

SEQ ID NO: 6654 - DNA, 71 bp, chicken (Gallus Gallus)
  misc_feature (36): n=c or t
catgcaagacaagacaactcttatctctttagaaangtgtagccatagccgtttgggaaactgacagctcc

SEQ ID NO: 6655 - DNA, 71 bp, chicken (Gallus Gallus)
  misc_feature (36): n=c or t
aatgttttgagacaatgatttttgcagcctcttacngtcagtgctttaaaaaatgtttcatctctggtttc

SEQ ID NO: 6656 - DNA, 71 bp, chicken (Gallus Gallus)
  misc_feature (36): n=a or c
cacaccaacatattaatggatgacatataaacgatnttctcatgtatttaagagagatacagcgtatcttg

SEQ ID NO: 6657 - DNA, 71 bp, chicken (Gallus Gallus)
  misc_feature (36): n=c or t
gcagtgtttcttcacagtaattcttgatgaagtaanactcagtgctgataggattccctggtgagctcgtg

SEQ ID NO: 6658 - DNA, 71 bp, chicken (Gallus Gallus)
  misc_feature (36): n=a or g
ctcccagtgcatcctgtgacagtgctcagggcagcntttacagctctgcatagactgagcatcaggtccta

SEQ ID NO: 6659 - DNA, 71 bp, chicken (Gallus Gallus)
  misc_feature (36): n=c or t
cagattcagtgatctctgtatttggggtcagacttnggagacttagagaggctatgctgttaacgctctgt

SEQ ID NO: 6660 - DNA, 71 bp, chicken (Gallus Gallus)
  misc_feature (36): n=a or g
tgcaggaccaagctctgctctgaaacttgttgaacngcagggtgcagccatggctccaatgtgaaatcagt

SEQ ID NO: 6661 - DNA, 71 bp, chicken (Gallus Gallus)
  misc_feature (36): n=a or g
tttggtttgtacacagctgcaggatacaaatgtagnaaaggaaaacctttggggcatagaagtgatttttc

SEQ ID NO: 6662 - DNA, 71 bp, chicken (Gallus Gallus)
  misc_feature (36): n=c or t
agctcacggttgaacctacttcctgctctgccctcntctttaatcagatacaaccctgtgaccagtacctc

SEQ ID NO: 6663 - DNA, 71 bp, chicken (Gallus Gallus)
  misc_feature (36): n=a or g
cactccagacatggcctcaccagagtaggcagggangatcactattgaacaaggacagacctggcactgac

SEQ ID NO: 6664 - DNA, 71 bp, chicken (Gallus Gallus)
  misc_feature (36): n=c or t
ctgcagcaagagttatccacttatttttcatatggnattttttgaactaactgttgaagctgaatacaaat

SEQ ID NO: 6665 - DNA, 71 bp, chicken (Gallus Gallus)
  misc_feature (36): n=a or g
agtcaaagaggagcttgtgaacgcggcaagatgggngtcggcctcttcttccacttaactagtgataggat

SEQ ID NO: 6666 - DNA, 71 bp, chicken (Gallus Gallus)
  misc_feature (36): n=a or c
aaactctttggccatgggagcaaaggaatgggctcnaagagcttgggtacagtcagaagcacactgatgca

SEQ ID NO: 6667 - DNA, 71 bp, chicken (Gallus Gallus)
  misc_feature (36): n=c or t
tacaaaagctttgttgttaatatttacatcaatcantggttctctctggccagatcacaccttaaccaaga

SEQ ID NO: 6668 - DNA, 71 bp, chicken (Gallus Gallus)
  misc_feature (36): n=c or t
caggtgctctcccttgtctcccctttgttcctgcanagaacatgaaggtatcccccaagtctaacatgagt

SEQ ID NO: 6669 - DNA, 71 bp, chicken (Gallus Gallus)
  misc_feature (36): n=a or c
agtggacaggaaacagacctcaggaaatttggagtntgtgtcagactggttttgtctgaggcttctgctga

SEQ ID NO: 6670 - DNA, 71 bp, chicken (Gallus Gallus)
  misc_feature (36): n=c or t
tggttactgctgccaatttttagctgcttcaaagcntggacaattcttttgtctcttcttcatcacggtat

SEQ ID NO: 6671 - DNA, 71 bp, chicken (Gallus Gallus)
  misc_feature (36): n=a or t
attcagtattgttattctaacctcagtttgacagcnaattaatgcaagatcaatagacagagtacttcaag

SEQ ID NO: 6672 - DNA, 71 bp, chicken (Gallus Gallus)
  misc_feature (36): n=a or g
acccatgaaatccccccagcctgcaagaaaccccanaaaagcccataacatccgcccaaaaaggccccaat

SEQ ID NO: 6673 - DNA, 71 bp, chicken (Gallus Gallus)
  misc_feature (36): n=c or t
tatttaaaagtcaatatttatcaactcttactattngaatttgcaattccaattcttatttgatctccact

SEQ ID NO: 6674 - DNA, 71 bp, chicken (Gallus Gallus)
  misc_feature (36): n=c or t
attagcaggcttgtattttagtgtgatcactccctncagaaagggaattgttagctttattttcaagtatc

SEQ ID NO: 6675 - DNA, 71 bp, chicken (Gallus Gallus)
  misc_feature (36): n=a or c
acctctgcacccacatcggctttacctgagaaatanactcattctccaacagtatatgtcaggcaagtcta

SEQ ID NO: 6676 - DNA, 71 bp, chicken (Gallus Gallus)
  misc_feature (36): n=c or t
gatttttgttgatgccgcccccagagcttctgtctnctccatatgtagggtgactgagcccatgctgttac

SEQ ID NO: 6677 - DNA, 71 bp, chicken (Gallus Gallus)
  misc_feature (36): n=a or c
tgcaaatactctgatagtcaaatccataaccatttnttttagctgttttgattgtgactctagatttcacg

SEQ ID NO: 6678 - DNA, 71 bp, chicken (Gallus Gallus)
  misc_feature (36): n=a or g
agtcacagatatataaaattacccttaagaaagaancaaatggtcttgtttccccagaagtgggattgtag

SEQ ID NO: 6679 - DNA, 71 bp, chicken (Gallus Gallus)
  misc_feature (36): n=a or g
acaaggtaacagcccaggctattagtgaaagcacangctccccaaggatgcagtgggattgtttccactgc

SEQ ID NO: 6680 - DNA, 71 bp, chicken (Gallus Gallus)
  misc_feature (36): n=g or t
atgaaaagctctacattgtttcagtcatgttctccntattaacaaactgcatactatagctacaattttgc

SEQ ID NO: 6681 - DNA, 71 bp, chicken (Gallus Gallus)
  misc_feature (36): n=c or g
gggacacccatctgcatgctcagcccacaagccaanattttctatgctatgcaccccaacagttcagcctg

SEQ ID NO: 6682 - DNA, 71 bp, chicken (Gallus Gallus)
  misc_feature (36): n=a or g
aagacacaactacttttttcttgctctttggtgagnttgaaactaaagttttcccatccctccattgtaaa

SEQ ID NO: 6683 - DNA, 71 bp, chicken (Gallus Gallus)
  misc_feature (36): n=a or g
agaaatacttttaagtattagttttgtaaagcagtnttctacatgtatgatgacatcaggactggaaaagt

SEQ ID NO: 6684 - DNA, 71 bp, chicken (Gallus Gallus)
  misc_feature (36): n=c or t
gcctacaaactgctgtgatagtcctgtgtcccacangggcctgatgcacacaaaaagaagtgcatattcta

SEQ ID NO: 6685 - DNA, 71 bp, chicken (Gallus Gallus)
  misc_feature (36): n=c or t
cagaattagaagtttttgatgtgcaatgaggataanggaagtaaatgagttacactaaatctggtgattaa

SEQ ID NO: 6686 - DNA, 71 bp, chicken (Gallus Gallus)
  misc_feature (36): n=a or g
ttatcaaatgcaatcccaagagagagatggagaagncatggtgataaaggctgaatttgttgcttacgttg

SEQ ID NO: 6687 - DNA, 71 bp, chicken (Gallus Gallus)
  misc_feature (36): n=c or t
ctttggcatgtaaatttcttgtaacctgcaagcaantatagcacagctcccatgctggaggagtgtgtctc

SEQ ID NO: 6688 - DNA, 71 bp, chicken (Gallus Gallus)
  misc_feature (36): n=a or g
tgggtgtgacatccaaagactgtcccattgctcaancccccatgcccactccccatgccccgtgtgacatc

SEQ ID NO: 6689 - DNA, 71 bp, chicken (Gallus Gallus)
  misc_feature (36): n=a or g
aaggtctgatttaatttttttcagctgccattggtntaatgtattatatgatgctcttagtaggtacagca

SEQ ID NO: 6690 - DNA, 71 bp, chicken (Gallus Gallus)
  misc_feature (36): n=a or g
atctatatacagcaatgggttttcacagttcacccnaaggatgattcagaatattacaaatattcacaagc

SEQ ID NO: 6691 - DNA, 71 bp, chicken (Gallus Gallus)
  misc_feature (36): n=a or g
ccttaattacttgactcccagtctaaattattgtcngcaataatgatgatacttttccattgaatacaaaa

SEQ ID NO: 6692 - DNA, 71 bp, chicken (Gallus Gallus)
  misc_feature (36): n=a or g
gtgagagacattccctaccaatttaatcaggccagngaatttctagtctgattaagagtggtcgaaatgaa

SEQ ID NO: 6693 - DNA, 71 bp, chicken (Gallus Gallus)
  misc_feature (36): n=c or t
tggaaaaaatgtactatttccactgagcactgatgnctttgacatctgcttccaagtgttattcatcacca

SEQ ID NO: 6694 - DNA, 71 bp, chicken (Gallus Gallus)
  misc_feature (36): n=c or t
actttctgatcttacttttagtagggccctctgtanggggaactacttagccacattgctgcaggtaaaag

SEQ ID NO: 6695 - DNA, 71 bp, chicken (Gallus Gallus)
  misc_feature (36): n=c or t
gaatgtctattagaaaggctgtctgacagagcagtntcacatccacctggagcagaacagcttttccttga

SEQ ID NO: 6696 - DNA, 71 bp, chicken (Gallus Gallus)
  misc_feature (36): n=c or t
gatcagaatgctgttgggagctctgatttcgctccngtgcaaagggaactcaagaaaaaacaatcctgcta

SEQ ID NO: 6697 - DNA, 71 bp, chicken (Gallus Gallus)
  misc_feature (36): n=a or g
ccacattgttattttgaataatacctcagttccaanctgtttgcatttgagagaggaacagcagagtaatc

SEQ ID NO: 6698 - DNA, 71 bp, chicken (Gallus Gallus)
  misc_feature (36): n=a or g
cttccactgactttttcttcacacacagtgccccanccaaaagcagttacaagaacgattcttaaacccag

SEQ ID NO: 6699 - DNA, 71 bp, chicken (Gallus Gallus)
  misc_feature (36): n=c or t
aagtcatcttatccgttgtatgcttttctttgtgtnctgcatagtaaactggataaaaaatgttgaatgaa

SEQ ID NO: 6700 - DNA, 71 bp, chicken (Gallus Gallus)
  misc_feature (36): n=a or g
cagctatctttcaagaaaccatccagattttttccnacaaacaagcccaaaagtcacgaacagttctgctc

SEQ ID NO: 6701 - DNA, 71 bp, chicken (Gallus Gallus)
  misc_feature (36): n=c or t
ttttcttaatgtacagctcatttttccaaacttttntagcccaaaatcctagtatttcttcatctttagta

SEQ ID NO: 6702 - DNA, 71 bp, chicken (Gallus Gallus)
  misc_feature (36): n=a or g
actttgaaaggaactgaataggtagcagttactccnaaagtattgctttttacagaacagacagaggatta

SEQ ID NO: 6703 - DNA, 71 bp, chicken (Gallus Gallus)
  misc_feature (36): n=a or g
accatacagaaattttgaagggacactgaagcaatnaatggcttttgctgcagctctctttccacagcata

SEQ ID NO: 6704 - DNA, 71 bp, chicken (Gallus Gallus)
  misc_feature (36): n=g or t
gacttcttaactatcaacagaattactggataattnatatgtcagtggaacagcttattctttatcacaga

SEQ ID NO: 6705 - DNA, 71 bp, chicken (Gallus Gallus)
  misc_feature (36): n=c or t
tttgtgttttgttcctgaccatgagaaattataaangtcattgtatgtgtcatctgagactagattagaga

SEQ ID NO: 6706 - DNA, 71 bp, chicken (Gallus Gallus)
  misc_feature (36): n=c or t
agtttcgtttgtggagtctaactaattgaaaattanagaggcactcttgcacctgttgctgttaagggtcc

SEQ ID NO: 6707 - DNA, 71 bp, chicken (Gallus Gallus)
  misc_feature (36): n=c or t
ggctgctgtccactatggacatctcattgaaaaccntcatggagatggagggggaggtggaagtggagatg

SEQ ID NO: 6708 - DNA, 71 bp, chicken (Gallus Gallus)
  misc_feature (36): n=c or t
gactagtaatcggggaataataaggaagaatttctngtagtttggctccccatcctggaactttttcctag

SEQ ID NO: 6709 - DNA, 71 bp, chicken (Gallus Gallus)
  misc_feature (36): n=g or t
agcaatgttgcagctctcaggaaaggagtttggcanttgtttggggtttcacagtggtcctccataaacca

SEQ ID NO: 6710 - DNA, 71 bp, chicken (Gallus Gallus)
  misc_feature (36): n=a or t
gttaggtgtttaaataactttgcaaaattaatctgngggaacacatgacaggatgacatgagacatgaaaa

SEQ ID NO: 6711 - DNA, 71 bp, chicken (Gallus Gallus)
  misc_feature (36): n=a or c
ggagaatgtacaggctgactctgatagaggacctcngcgctgtttcctggattacagctatgctgtgggac

SEQ ID NO: 6712 - DNA, 71 bp, chicken (Gallus Gallus)
  misc_feature (36): n=c or t
ttttgccattcatacccatacctataccattccaanaaacgtttcagttgaatatgaccttattagaaaag

SEQ ID NO: 6713 - DNA, 71 bp, chicken (Gallus Gallus)
  misc_feature (36): n=c or t
gaggtgaggctggcaggcctgtaagttcctgattcntccatcttgccctttctgaagtttgatgtgacatt

SEQ ID NO: 6714 - DNA, 71 bp, chicken (Gallus Gallus)
  misc_feature (36): n=a or g
aaataaaatatacacacatttcttccattgcatgtncagccagccagtcaaggcaatgcaagtcagctggg

SEQ ID NO: 6715 - DNA, 71 bp, chicken (Gallus Gallus)
  misc_feature (36): n=c or t
gcaacagctctgatcagctctgaattattgaacgcnttttcagaaagcagatttcaaatttgtggtttaag

SEQ ID NO: 6716 - DNA, 71 bp, chicken (Gallus Gallus)
  misc_feature (36): n=c or t
gtgagaacttagcaagctttctcagcttgctaaganactgtggtgttctatgaaattttctgtaaatcctt

SEQ ID NO: 6717 - DNA, 71 bp, chicken (Gallus Gallus)
  misc_feature (36): n=a or g
cttatgggagctttttctatccattaaagtgagcanctataagtcaggacactgggttctattcccaaatc

SEQ ID NO: 6718 - DNA, 71 bp, chicken (Gallus Gallus)
  misc_feature (36): n=a or g
ctgccatgctgtgtgtttctctctgtagaagactangggggtttcctgaaagagtagtgatacagctactt

SEQ ID NO: 6719 - DNA, 71 bp, chicken (Gallus Gallus)
  misc_feature (36): n=a or c
attctatgtttctgtgatcaagttccctctgagtgnggatgcataaagtgttagttcacttatcacatctg

SEQ ID NO: 6720 - DNA, 71 bp, chicken (Gallus Gallus)
  misc_feature (36): n=g or t
ttttgaggcttgccttcttaaaagtattggtgcacntctgtaaaaccaagctcacctggaagtcaggactt

SEQ ID NO: 6721 - DNA, 71 bp, chicken (Gallus Gallus)
  misc_feature (36): n=c or t
agccaaaggcagctgacaggtataacccagccttanggaccatctctaggactgctgatttttggaagtga

SEQ ID NO: 6722 - DNA, 71 bp, chicken (Gallus Gallus)
  misc_feature (36): n=c or t
aactgcttaagaataattacacattggagttctttnagtggcagaagggggtcattccctaggcaacagat

SEQ ID NO: 6723 - DNA, 71 bp, chicken (Gallus Gallus)
  misc_feature (36): n=a or g
ttctggtttcttctaacatgctgggctgcaaatacnagtgctgagctagacaaaaaaaaagggttattgag

SEQ ID NO: 6724 - DNA, 71 bp, chicken (Gallus Gallus)
  misc_feature (36): n=c or t
ccaagtccaaaggtttgggttggtttttcccatgtntgaggaaactcaacgcatgtgaatccatttcagta

SEQ ID NO: 6725 - DNA, 71 bp, chicken (Gallus Gallus)
  misc_feature (36): n=c or t
caaattgtgaacatactaaaaaccgttgctcgttgnttcctagcaaaaggcacacatataagcagcatatc

SEQ ID NO: 6726 - DNA, 71 bp, chicken (Gallus Gallus)
  misc_feature (36): n=a or g
tcactcttcccctttcacatgttcaattttcctccnctatttattagaacctccaatttcaatttatctga

SEQ ID NO: 6727 - DNA, 71 bp, chicken (Gallus Gallus)
  misc_feature (36): n=c or t
tctctgagaaggaatgacacaaagagctgtgcgtgngttcacagataagctgcaaagaaacaagggaatcc

SEQ ID NO: 6728 - DNA, 71 bp, chicken (Gallus Gallus)
  misc_feature (36): n=c or t
ttcaagtgaactcacaaagaaatgtctaaagctagncaatgtagtaataaattataaatacttccatcaca

SEQ ID NO: 6729 - DNA, 71 bp, chicken (Gallus Gallus)
  misc_feature (36): n=a or g
tttccatggagataaagagaaggaattactttcacnttgagttacttatttatacttccaacagcacatgg

SEQ ID NO: 6730 - DNA, 71 bp, chicken (Gallus Gallus)
  misc_feature (36): n=a or c
tctgggagagggttatttcaagctctggtggctgcngtggtctgactggaacacacaaaaaaatgaaagaa

SEQ ID NO: 6731 - DNA, 71 bp, chicken (Gallus Gallus)
  misc_feature (36): n=c or t
gacaaatataaaattccataacaatttttcatctgnataccgtacactatgctgagcacagtggagttctc

SEQ ID NO: 6732 - DNA, 71 bp, chicken (Gallus Gallus)
  misc_feature (36): n=a or g
cctgtgacttcatgtgcatctgtgctcttgtttgtngtgttcttaatgttgtttctcctttctttgtctac

SEQ ID NO: 6733 - DNA, 71 bp, chicken (Gallus Gallus)
  misc_feature (36): n=a or g
ggccctgggcacctaccaccaggcactgccacaccntatgactcagccagctttcacctcttccaagcagc

SEQ ID NO: 6734 - DNA, 71 bp, chicken (Gallus Gallus)
  misc_feature (36): n=c or t
ttttcttttatttagaacaactgcagcacttgtgcnaccctgtgcagttaggggttcccagctccatggcc

SEQ ID NO: 6735 - DNA, 71 bp, chicken (Gallus Gallus)
  misc_feature (36): n=a or g
aatattgtgcaataacacagagtacatagaagctanaagttgctgctagggacactgtgctttaacagatt

SEQ ID NO: 6736 - DNA, 71 bp, chicken (Gallus Gallus)
  misc_feature (36): n=c or t
aagacctgctggagccaaagcttgtccccacggggntggctgcttggactctatgcacattctttagcaaa

SEQ ID NO: 6737 - DNA, 71 bp, chicken (Gallus Gallus)
  misc_feature (36): n=a or c
tgctcatgcagtgatgtcctgaaagataccgtgaanacactctgtttacagctatccttgggctgttaagt

SEQ ID NO: 6738 - DNA, 71 bp, chicken (Gallus Gallus)
  misc_feature (36): n=c or t
aacttcgttgtggttaagattgatacctttggccgntgagctggtataatctccaacagggctataaatgt

SEQ ID NO: 6739 - DNA, 71 bp, chicken (Gallus Gallus)
  misc_feature (36): n=c or t
aatttgcccaagaaaaggggctacatactcattggntggtgtgtatctaccatgtctggcagctaaatctg

SEQ ID NO: 6740 - DNA, 71 bp, chicken (Gallus Gallus)
  misc_feature (36): n=a or g
ttacatggaactgccaagaattacaatgggaaaagncaagcagaacacactacagttttagttcacttttt

SEQ ID NO: 6741 - DNA, 71 bp, chicken (Gallus Gallus)
  misc_feature (36): n=a or c
ttaggatttcttacatgttatacagagacactgagnggctctgtcacaggttagcatcatcctgatgcaca

SEQ ID NO: 6742 - DNA, 71 bp, chicken (Gallus Gallus)
  misc_feature (36): n=g or t
ttgcacatattcattgtgcttatgtgaaatattctnttcaaggaaagtatttgcatttttcttaatacatc

SEQ ID NO: 6743 - DNA, 71 bp, chicken (Gallus Gallus)
  misc_feature (36): n=c or t
aaagcttttggaacgtgcaaataaggttcttccccntctagacaaacactggaggaaatcaggtagtctga

SEQ ID NO: 6744 - DNA, 71 bp, chicken (Gallus Gallus)
  misc_feature (36): n=c or t
tgcatcaaagataatctgactccatatgcaggtatntcatggagatttttgttccatcttagtgtgtgtat

SEQ ID NO: 6745 - DNA, 71 bp, chicken (Gallus Gallus)
  misc_feature (36): n=a or g
caatatgagatctaatctgggaggggaacaaaaccntagctaggagagtgggaaaattatctgcaacatct

SEQ ID NO: 6746 - DNA, 71 bp, chicken (Gallus Gallus)
  misc_feature (36): n=c or t
gtaacctgctgccctcttgttgccacgagggtttcntgaaggtctctggaatttccttgatacttctgcgt

SEQ ID NO: 6747 - DNA, 71 bp, chicken (Gallus Gallus)
  misc_feature (36): n=c or t
gcacagtttggcagctgtcaggtaaggaagcagagntggatgcctgaatgactgaaggggcacatcactaa

SEQ ID NO: 6748 - DNA, 71 bp, chicken (Gallus Gallus)
  misc_feature (36): n=a or g
cactgacaatttttacagacatgaaagctaaataantcagtcagtgtattcaatgtccagtgatcttggca

SEQ ID NO: 6749 - DNA, 71 bp, chicken (Gallus Gallus)
  misc_feature (36): n=a or g
aataaagaattttacctggctcttctactgcagganaaaagctaaaagggagcccctactcccaaggctac

SEQ ID NO: 6750 - DNA, 71 bp, chicken (Gallus Gallus)
  misc_feature (36): n=c or t
tggagaatgtgctgccaagttggcagagaggagaangctattcaataggcttacactcaaataagagctga

SEQ ID NO: 6751 - DNA, 71 bp, chicken (Gallus Gallus)
  misc_feature (36): n=c or t
ttatacacctttgcctagggcagcataaggaccttntctggtgaatcactaggtccccaaggcttttgatc

SEQ ID NO: 6752 - DNA, 71 bp, chicken (Gallus Gallus)
  misc_feature (36): n=c or t
agcctcactgaagaccttaaaaacattcttgtttgnattaatgtttgtctgtaattgttacacagacaacg

SEQ ID NO: 6753 - DNA, 71 bp, chicken (Gallus Gallus)
  misc_feature (36): n=c or t
ccatttagtgtacagtggtcaaagacatttaattanggcagtaagtaatcacaggttaagttaaaactggc

SEQ ID NO: 6754 - DNA, 71 bp, chicken (Gallus Gallus)
  misc_feature (36): n=a or t
ctttttcctctttcatctgatttgagaaaagcaganatttttctctcttgatgcagaaggggcacattttt

SEQ ID NO: 6755 - DNA, 71 bp, chicken (Gallus Gallus)
  misc_feature (36): n=a or g
agaagtctgtatcctccagcaaaataagacaggacngaatgggaagcaggagacagagaagggcgggaaag

SEQ ID NO: 6756 - DNA, 71 bp, chicken (Gallus Gallus)
  misc_feature (36): n=g or t
caacacttaacctggctaggtgaactacttgaatcntttgtattcactgtacattagaatcctataaagaa

SEQ ID NO: 6757 - DNA, 71 bp, chicken (Gallus Gallus)
  misc_feature (36): n=a or g
catactttggctaatgaagcaaggctggttgggaancagctgaaggagcttcagaatttggccattctgta

SEQ ID NO: 6758 - DNA, 71 bp, chicken (Gallus Gallus)
  misc_feature (36): n=c or g
atctacctagcatacagtgtttactatatatagtgnctacctagcagtaagcccacttgatattgcccttt

SEQ ID NO: 6759 - DNA, 71 bp, chicken (Gallus Gallus)
  misc_feature (36): n=a or g
gcagcaaattaaatgattataaaaacattcactaantgttcaaataaagacaggtgcaatatattcatgta

SEQ ID NO: 6760 - DNA, 71 bp, chicken (Gallus Gallus)
  misc_feature (36): n=c or t
gctctcttgagaagaagcaggataattgtagctctngctacactttaaaatagttctgaatatgtgtccca

SEQ ID NO: 6761 - DNA, 71 bp, chicken (Gallus Gallus)
  misc_feature (36): n=c or t
ctgcacatttcttcaagtctgaaaggtgaatttacnagcattgctacatctcagtgttggtaatagagacg

SEQ ID NO: 6762 - DNA, 71 bp, chicken (Gallus Gallus)
  misc_feature (36): n=c or t
atttatgtggaaaaataatgtattactaatactccnacaagctgcaaatacagtataattttgagaaaaat

SEQ ID NO: 6763 - DNA, 71 bp, chicken (Gallus Gallus)
  misc_feature (36): n=a or c
aggaaccagctcctaaataattattatccaccagtntgaatacaactgggatgcctgggttaggaacctgg

SEQ ID NO: 6764 - DNA, 71 bp, chicken (Gallus Gallus)
  misc_feature (36): n=c or t
gttttacctcacagggtatatatgagctctatatgngcacaggctgcagagatgcttcccaacaaggcaag

SEQ ID NO: 6765 - DNA, 71 bp, chicken (Gallus Gallus)
  misc_feature (36): n=c or t
atcagaaacagaaacctctaacccattcaggactcngaagaacatattttggagcaaaaacagcagccaaa

SEQ ID NO: 6766 - DNA, 71 bp, chicken (Gallus Gallus)
  misc_feature (36): n=a or g
ctaatttaatagggaaatagtgcacattcagtgagnaactgtgctgtgtgatcattgagttattcttcaat

SEQ ID NO: 6767 - DNA, 71 bp, chicken (Gallus Gallus)
  misc_feature (36): n=c or t
ctatacatgtgcagctcagcctgctcagggtctgcntgtgtactgtactaagcaatgtatttggatgggag

SEQ ID NO: 6768 - DNA, 71 bp, chicken (Gallus Gallus)
  misc_feature (36): n=g or t
cctgaaataaacattaagtatgcatttattaaattnattaaggtaaggtataggatagataggaataatct

SEQ ID NO: 6769 - DNA, 71 bp, chicken (Gallus Gallus)
  misc_feature (36): n=c or t
tgtgtactgagttaaggcatcgatcgaggtgttggntgtgggacttgcagctttggcatctttgagggcaa

SEQ ID NO: 6770 - DNA, 71 bp, chicken (Gallus Gallus)
  misc_feature (36): n=c or g
aggacaatcctttatgaacctgccacataatcacanctactgttatcaacctgcaacgtgctcacattttt

SEQ ID NO: 6771 - DNA, 71 bp, chicken (Gallus Gallus)
  misc_feature (36): n=a or g
aaggcaaattttaaagaataagttgtcagtagcaanacagacagctcagtaaaaatagcctaaataatttt

SEQ ID NO: 6772 - DNA, 71 bp, chicken (Gallus Gallus)
  misc_feature (36): n=a or c
ttggcactagcacctaaaagctagcaagtgacaacnaggtctgatgtaaatcataactgaatcatggaatc

SEQ ID NO: 6773 - DNA, 71 bp, chicken (Gallus Gallus)
  misc_feature (36): n=a or g
acacctaaattttaagagtgggtttggtggtggaangcagagttactctgagacctcctcccctaagtgat

SEQ ID NO: 6774 - DNA, 71 bp, chicken (Gallus Gallus)
  misc_feature (36): n=c or g
cctggggttaaatatccccatttttctccatctccnaaaggagagagtcagcctctaaacctcctgataag

SEQ ID NO: 6775 - DNA, 71 bp, chicken (Gallus Gallus)
  misc_feature (36): n=a or c
gtaaacaaatactaatttttggactgaacagcaccnccaaagacgatgaagagactgacagcagtttcaca

SEQ ID NO: 6776 - DNA, 71 bp, chicken (Gallus Gallus)
  misc_feature (36): n=a or g
gtatccaattacccaaactatgatatatcactgacnaaatgaaatgaactttaaggcaaatttatcaggaa

SEQ ID NO: 6777 - DNA, 71 bp, chicken (Gallus Gallus)
  misc_feature (36): n=c or t
atgctttgcagaaagtatttctggatttttaattgnatcctatctgtcataaattactagactgcaaacag

SEQ ID NO: 6778 - DNA, 71 bp, chicken (Gallus Gallus)
  misc_feature (36): n=c or t
aacatcattgttaagtgtcacaatcagaactgttanggcccttgcatacctgatgagagcagagctgagta

SEQ ID NO: 6779 - DNA, 71 bp, chicken (Gallus Gallus)
  misc_feature (36): n=a or c
aggacataatgaagataagttcattaatgtttgttnaacaatgaaaagtcaataatgaaacaaatagtcct

SEQ ID NO: 6780 - DNA, 71 bp, chicken (Gallus Gallus)
  misc_feature (36): n=c or t
agtccagaggcatatatcttttcttccttaatctgnggggtggcaaacagatagcacaggttttatttagt

SEQ ID NO: 6781 - DNA, 71 bp, chicken (Gallus Gallus)
  misc_feature (36): n=c or t
acttcattttaaccctgtgcaaatttaattatcagnagaaattcatttatgctagtaattttcgacaagaa

SEQ ID NO: 6782 - DNA, 71 bp, chicken (Gallus Gallus)
  misc_feature (36): n=a or c
gaggttagttacattcaagtcattcaggtgggtgcnacacatctgcaccggccagaggaaaaatagtgatt

SEQ ID NO: 6783 - DNA, 71 bp, chicken (Gallus Gallus)
  misc_feature (36): n=c or t
acactgcgttggcccaagcttgcgtagaaagatgtnagcacatgaggtgactggagataatgagagaacag

SEQ ID NO: 6784 - DNA, 71 bp, chicken (Gallus Gallus)
  misc_feature (36): n=a or c
gtgtgctgcagttttcctcccagagattatctgggnagctttcagagattggtgtagtgcagcccagggaa

SEQ ID NO: 6785 - DNA, 71 bp, chicken (Gallus Gallus)
  misc_feature (36): n=a or g
actactgaaaaggcttacaaggattcaagcaagaantttgtaaaatttttgaaaggtaccatggaaactgc

SEQ ID NO: 6786 - DNA, 71 bp, chicken (Gallus Gallus)
  misc_feature (36): n=g or t
gaacctggactgcctctgagcctttggtattgtgcntcatagtcctgacagacataccttctgattgaaag

SEQ ID NO: 6787 - DNA, 71 bp, chicken (Gallus Gallus)
  misc_feature (36): n=a or g
acaaggagcctttatctctcagctatttgcagggtnccattctctccaaaaggagaaatctgatacttaaa

SEQ ID NO: 6788 - DNA, 71 bp, chicken (Gallus Gallus)
  misc_feature (36): n=c or t
aaactccctgcagcaccatcacttgtcatttctgangaggacttccctgaaagaacacagctttgtcttac

SEQ ID NO: 6789 - DNA, 71 bp, chicken (Gallus Gallus)
  misc_feature (36): n=a or g
tattattggtctatgtggtactatgtggatagaganttaagaattatttgcgaaaaagttgtatgaggagc

SEQ ID NO: 6790 - DNA, 71 bp, chicken (Gallus Gallus)
  misc_feature (36): n=a or g
aaaaagcacaagacagcagaggagcaaggcctcatnccacattaatgagaatcttctctgatgtaacagca

SEQ ID NO: 6791 - DNA, 71 bp, chicken (Gallus Gallus)
  misc_feature (36): n=a or g
caagatgaacattatgtgtgtagaacaatcaatccntaattttgccagaatgattagctaccctgatgtcc

SEQ ID NO: 6792 - DNA, 71 bp, chicken (Gallus Gallus)
  misc_feature (36): n=a or g
ccacctaatatctttctttagatgtgggggaactgnggaaaccaggctttttgttgttgctttttgtttct

SEQ ID NO: 6793 - DNA, 71 bp, chicken (Gallus Gallus)
  misc_feature (36): n=c or t
gaagggtctcttaaacatccctgtccatttgtttcngagaaattgttccaattagagcatgatattaattt

SEQ ID NO: 6794 - DNA, 71 bp, chicken (Gallus Gallus)
  misc_feature (36): n=c or t
gatccctcaccatttcaagttgaagttgagctttcnttacatcatctctgcaaacttaaactgtgtctctg

SEQ ID NO: 6795 - DNA, 71 bp, chicken (Gallus Gallus)
  misc_feature (36): n=a or g
tgtatcagtaaatatattgctgttcatctttaagtntgaatatctactatggtgtcagaaacacctcctgt

SEQ ID NO: 6796 - DNA, 71 bp, chicken (Gallus Gallus)
  misc_feature (36): n=c or t
ctttcacatatgtaaccttacgacctcgcatggaanctttcagtggggctggaaaagcagggcagaaattc

SEQ ID NO: 6797 - DNA, 71 bp, chicken (Gallus Gallus)
  misc_feature (36): n=c or t
tggagacaaaattggattcatgagataatccactancgttcttctaaaatccatactgttttttttttttt

SEQ ID NO: 6798 - DNA, 71 bp, chicken (Gallus Gallus)
  misc_feature (36): n=a or g
tatacaaattaggccaagaaagactcaaagataccnttgcattgtttataggtgaattttatagcttaaaa

SEQ ID NO: 6799 - DNA, 71 bp, chicken (Gallus Gallus)
  misc_feature (36): n=a or g
caaacaaaactgcaaagtaatactgccattgtctantttgtaataggctgtggaaattttgcagtgaatta

SEQ ID NO: 6800 - DNA, 71 bp, chicken (Gallus Gallus)
  misc_feature (36): n=c or t
aatatccatatatccatgtctagcacttttcccttnctttccagcagaaaacaatttgctgacagctgact

SEQ ID NO: 6801 - DNA, 71 bp, chicken (Gallus Gallus)
  misc_feature (36): n=a or g
tgagtgtagcagtttcaaagcagttttcatttatcntgacttcgataatttaaagcaatcctctcttctct

SEQ ID NO: 6802 - DNA, 71 bp, chicken (Gallus Gallus)
  misc_feature (36): n=a or g
gcagcgtggccgtgctgggcttccagggtctgcacngacaccacaaagcaggttttagctttgtgtaactg

SEQ ID NO: 6803 - DNA, 71 bp, chicken (Gallus Gallus)
  misc_feature (36): n=c or t
ctcagccccaccgccccatcccgccacggctgggcngaagcggacatcaccccctatttatccccagcaaa

SEQ ID NO: 6804 - DNA, 71 bp, chicken (Gallus Gallus)
  misc_feature (36): n=g or t
ctcaagtaattcatgaactacattcttagtaggaanaaaagaaatgcctttccattcatgaagatgactca

SEQ ID NO: 6805 - DNA, 71 bp, chicken (Gallus Gallus)
  misc_feature (36): n=a or c
agccacatcaggctgcatgcggagacgatcatgctnttctggtggtcccttagctgccattccacatgtgg

SEQ ID NO: 6806 - DNA, 71 bp, chicken (Gallus Gallus)
  misc_feature (36): n=g or t
gggttcctgcaaagaactttttcttcaacaaaaatntcactgtttacagtgctgacataaagaattgtcat

SEQ ID NO: 6807 - DNA, 71 bp, chicken (Gallus Gallus)
  misc_feature (36): n=a or g
acacaagagctttgtacagtgtaagctgttggctcnagagatgagttttgtcagcgtggcatttgcagttg

SEQ ID NO: 6808 - DNA, 71 bp, chicken (Gallus Gallus)
  misc_feature (36): n=a or g
gtatctctctctctctctgtcatgtacttctccacnttttcttcctggatcctgttagaggaatacaattt

SEQ ID NO: 6809 - DNA, 71 bp, chicken (Gallus Gallus)
  misc_feature (36): n=a or t
atgtatgaacagcctttaaaggagtaactcccttcntactgcatctcatacctttggcagcctcagtcctg

SEQ ID NO: 6810 - DNA, 71 bp, chicken (Gallus Gallus)
  misc_feature (36): n=c or t
cataacagactatgcccatactgttctgtttctctntataagcacagcttattacccacacattctgctcc

SEQ ID NO: 6811 - DNA, 71 bp, chicken (Gallus Gallus)
  misc_feature (36): n=a or g
ttcagcagtgggaatgtcacatcagtctgttttacntcagacaaatgcatagtaatgacctagattttagg

SEQ ID NO: 6812 - DNA, 71 bp, chicken (Gallus Gallus)
  misc_feature (36): n=a or g
agcctggtagcaaagtcctgtcactgttgattgagnaaattaaagggaaaaccaactagaacagcttataa

SEQ ID NO: 6813 - DNA, 71 bp, chicken (Gallus Gallus)
  misc_feature (36): n=a or g
atgcaagcatgtattctcagtattgcttctattgtnattacaatactaagaacattcttcatattaaagaa

SEQ ID NO: 6814 - DNA, 71 bp, chicken (Gallus Gallus)
  misc_feature (36): n=a or g
ttcaggtaataaatacaggtgatgcagcgcccatcnccattcgggttgtccacatgacgcacatacccagt

SEQ ID NO: 6815 - DNA, 71 bp, chicken (Gallus Gallus)
  misc_feature (36): n=a or g
ccctgaatggagatgataatgtgcagtggatgcttnggagctatgatgaaggctgagggactgggtttttt

SEQ ID NO: 6816 - DNA, 71 bp, chicken (Gallus Gallus)
  misc_feature (36): n=c or t
ttgatggaagaaaggccatacactataatcacctgncagctggtgacttctgactgtgaagaagattttgg

SEQ ID NO: 6817 - DNA, 71 bp, chicken (Gallus Gallus)
  misc_feature (36): n=c or t
cttaccagttgatgataatgttcagtggctcatttncttgggaccaaagaaagtacagttattaagcactt

SEQ ID NO: 6818 - DNA, 71 bp, chicken (Gallus Gallus)
  misc_feature (36): n=c or t
aaagaaggagggaccatggggtagcataaacatganagagtcagcttattttatgtgctgataccaatcta

SEQ ID NO: 6819 - DNA, 71 bp, chicken (Gallus Gallus)
  misc_feature (36): n=a or g
gccacatttggtgatctctgacttgtcactgactgnagctctgggttcacacaggtgtatgtagaccccct

SEQ ID NO: 6820 - DNA, 71 bp, chicken (Gallus Gallus)
  misc_feature (36): n=c or t
actattcattatcaaaggtgatgcaaattgaatttntcctaaaaggctgctcagacaactctgataattat

SEQ ID NO: 6821 - DNA, 71 bp, chicken (Gallus Gallus)
  misc_feature (36): n=a or g
ggaaagttgatgctatcctatttcctctgtgtgccngggtttttgtaactggtgcatctggttgattcctg

SEQ ID NO: 6822 - DNA, 71 bp, chicken (Gallus Gallus)
  misc_feature (36): n=a or c
aaaaatctaaatttccgttctgagtaaatctgcacngtcttcttaagaagtttttgatctctccctcgact

SEQ ID NO: 6823 - DNA, 71 bp, chicken (Gallus Gallus)
  misc_feature (36): n=a or g
tcaggagctgggagttgaactcaaggatccttatgngtcctttccaactcaggacatttattcagtgattc

SEQ ID NO: 6824 - DNA, 71 bp, chicken (Gallus Gallus)
  misc_feature (36): n=c or t
tctgatatttacattaagattttataataaatctcngagatgtctgaattgtaagaataaaaattgctgcc

SEQ ID NO: 6825 - DNA, 71 bp, chicken (Gallus Gallus)
  misc_feature (36): n=a or g
ctgcagcctaaagcagtgaatcaggaaaagctgagntggtgcacagtggtttttgctgcctgaactgatga

SEQ ID NO: 6826 - DNA, 71 bp, chicken (Gallus Gallus)
  misc_feature (36): n=c or t
ttcatagccagaaggctgaccaaaatacaggcttcnaggggagctaccactaccccttgtactctctgcaa

SEQ ID NO: 6827 - DNA, 71 bp, chicken (Gallus Gallus)
  misc_feature (36): n=a or t
cttattaataagcttactttgaataattgtactcanatgagggctgtgaactcatagtggctttgacaata

SEQ ID NO: 6828 - DNA, 71 bp, chicken (Gallus Gallus)
  misc_feature (36): n=c or t
gattaataattcttgactttctgaggtacagattantgtgattataggctaacatcaagaaaaaatacaat

SEQ ID NO: 6829 - DNA, 71 bp, chicken (Gallus Gallus)
  misc_feature (36): n=c or g
ccaaatccctttcttgtttgctatctcactgtcacnaaagcccagttcttcaggagcatctgatacatgca

SEQ ID NO: 6830 - DNA, 71 bp, chicken (Gallus Gallus)
  misc_feature (36): n=a or g
ctggagtaagtgatctgcacaatagctcagggcaantgaagggcaatgtagtcactggattgattccttca

SEQ ID NO: 6831 - DNA, 71 bp, chicken (Gallus Gallus)
  misc_feature (36): n=c or t
aaattagggaaacattacaaaaagctgtaactcttnagctaggtcccgaggttctggctgtattgacaaag

SEQ ID NO: 6832 - DNA, 71 bp, chicken (Gallus Gallus)
  misc_feature (36): n=g or t
tcctggggctcaccagctattcagtgagcagccagntgggacctgtgaaatgtttggtgagcacagcctgg

SEQ ID NO: 6833 - DNA, 71 bp, chicken (Gallus Gallus)
  misc_feature (36): n=c or t
acagttgtctggttggaatgttcttcctatcaccanctctggagtctgacctacctggagctatctgcatg

SEQ ID NO: 6834 - DNA, 71 bp, chicken (Gallus Gallus)
  misc_feature (36): n=c or t
tctgtttctactggcctttaaactgcaacaagagcncaaacctgttgtttacagatgtagaatttagagtt

SEQ ID NO: 6835 - DNA, 71 bp, chicken (Gallus Gallus)
  misc_feature (36): n=a or g
cgcgcaggtaggtgttcatcacagccgggatttgcntctttaggttccaaagctctcagtccgcttgcaga

SEQ ID NO: 6836 - DNA, 71 bp, chicken (Gallus Gallus)
  misc_feature (36): n=a or c
cttccagcccatcacagcctggtttgcagcttttanaagcacgatcttgctttgcactgaactgcagttac

SEQ ID NO: 6837 - DNA, 71 bp, chicken (Gallus Gallus)
  misc_feature (36): n=c or t
tgaattcagtgtgagaagaggtcagggtctgtgcantgcagtttctctctgccattttgtgtttctcacaa

SEQ ID NO: 6838 - DNA, 71 bp, chicken (Gallus Gallus)
  misc_feature (36): n=g or t
gcagctgtggccctgctgttaaatgcaccgagcatnaaaaaagtaagtgatttgtaagaaaagactgagat

SEQ ID NO: 6839 - DNA, 71 bp, chicken (Gallus Gallus)
  misc_feature (36): n=a or g
aggggattcaagtaagggtgaagatatcaaaaaagnacaccttaagagactttgaacgaaaaacgaagtgt

SEQ ID NO: 6840 - DNA, 71 bp, chicken (Gallus Gallus)
  misc_feature (36): n=a or g
agatttctgaacgctcagggccccgtataagaaagnaaagcatcaaggatagctattttcagttctcaggt

SEQ ID NO: 6841 - DNA, 71 bp, chicken (Gallus Gallus)
  misc_feature (36): n=a or g
ttctgttcatcttgacaggatgccagcaacaacatntctctcgctgaagttacgtcgtaactcactgtaag

SEQ ID NO: 6842 - DNA, 71 bp, chicken (Gallus Gallus)
  misc_feature (36): n=a or g
cccaatattgactaggaaacataaaacatattttgnagatctgaagtcaggttcatagctggcacactggc

SEQ ID NO: 6843 - DNA, 71 bp, chicken (Gallus Gallus)
  misc_feature (36): n=a or g
aaaaaaaaaaaaaaaaaaccaatcagataaatcacntagtcttatatctaagggataattcagcattaggc

SEQ ID NO: 6844 - DNA, 71 bp, chicken (Gallus Gallus)
  misc_feature (36): n=a or t
tcagctgctatcacatggggcaaatccactgcctanctgtaggctggtgccagtggtgtcctagataacta

SEQ ID NO: 6845 - DNA, 71 bp, chicken (Gallus Gallus)
  misc_feature (36): n=a or g
gctgtctctcagtagagaaaagcattgtaaaggagnctgcaagatgataaacaagcaattacaaatagcat

SEQ ID NO: 6846 - DNA, 71 bp, chicken (Gallus Gallus)
  misc_feature (36): n=c or t
ttattcttctccttacactgtcttcataaaacaggnctttattgccaacatactttataatagcattgtat

SEQ ID NO: 6847 - DNA, 71 bp, chicken (Gallus Gallus)
  misc_feature (36): n=c or t
ataaactcacagacatgcatccttgagcatgaaganggactccgatgcactctgatctttgcaaagcacag

SEQ ID NO: 6848 - DNA, 71 bp, chicken (Gallus Gallus)
  misc_feature (36): n=a or c
tatttacacctaatcttgaaatcattaagcagcttntcttgctataaacatccccttaattatgtatttat

SEQ ID NO: 6849 - DNA, 71 bp, chicken (Gallus Gallus)
  misc_feature (36): n=a or c
cttcagacaacggcaactatttccatcaccacagcnaagacaaatcttaagagctgtttgatatgcaagta

SEQ ID NO: 6850 - DNA, 71 bp, chicken (Gallus Gallus)
  misc_feature (36): n=c or t
agctgttggctccagaaggagggagggatgtgtcantgccatcatcctcacccttttgtgttatggccagc

SEQ ID NO: 6851 - DNA, 71 bp, chicken (Gallus Gallus)
  misc_feature (36): n=c or t
agctgagctacagggtgaggttagcttgggattgcntctaagcggatacagagaagcagagaaccatccct

SEQ ID NO: 6852 - DNA, 71 bp, chicken (Gallus Gallus)
  misc_feature (36): n=c or t
ctgaggcggtgccttacccaaaaggcagagctcaangggcaacttgggagcaaacgtttttaagtgtattt

SEQ ID NO: 6853 - DNA, 71 bp, chicken (Gallus Gallus)
  misc_feature (36): n=a or c
atttcaaatggatgaagggctaggagttattcagcnaagatgtgaatctacagctccagagagagcaggca

SEQ ID NO: 6854 - DNA, 71 bp, chicken (Gallus Gallus)
  misc_feature (36): n=a or g
actccgaagccttatttcatgagttattctaaacanaaccagaaaaagactaccagttaagcctaggaaag

SEQ ID NO: 6855 - DNA, 71 bp, chicken (Gallus Gallus)
  misc_feature (36): n=a or g
tgccaagtcactaaagctgactccccctccgctacnaataccacaccttttttagatgaatacatctgaaa

SEQ ID NO: 6856 - DNA, 71 bp, chicken (Gallus Gallus)
  misc_feature (36): n=a or g
accctcttttccaaaaaagatgcctagctggctgtnatcaggttgcctgatgttgtcctgtgagttccagt

SEQ ID NO: 6857 - DNA, 71 bp, chicken (Gallus Gallus)
  misc_feature (36): n=a or g
aggctttaacaatcaaaagccattatagaaaagcancgtgctcaaagacagaaggatatacacttgttcac

SEQ ID NO: 6858 - DNA, 71 bp, chicken (Gallus Gallus)
  misc_feature (36): n=c or t
tgcacatcctgggatgttgaggttggagcatcctgncttggtgtcaaagtggcagaaataagctccaggca

SEQ ID NO: 6859 - DNA, 71 bp, chicken (Gallus Gallus)
  misc_feature (36): n=a or g
gtaagccgtacgtagtacagtctttgcctttctgtntacttctctagtcctaatttgtatttaaaatcttt

SEQ ID NO: 6860 - DNA, 71 bp, chicken (Gallus Gallus)
  misc_feature (36): n=a or c
caggccctccttgtagctgagaacatgcacagaggncatcataacactttgacctccttccctgctgctct

SEQ ID NO: 6861 - DNA, 71 bp, chicken (Gallus Gallus)
  misc_feature (36): n=c or g
atacttcatttatcatattgcacaggggcacagacnccaaacaccggggcaagaatgaagaattgttcttt

SEQ ID NO: 6862 - DNA, 71 bp, chicken (Gallus Gallus)
  misc_feature (36): n=a or g
tttctcctgcctgctggaaggggcaggttaattctngacagagtctgccctgcagtccgagccgcgtgcag

SEQ ID NO: 6863 - DNA, 71 bp, chicken (Gallus Gallus)
  misc_feature (36): n=a or g
ggctgcaagtgtacactgctggctcatgttcaggcngagagaatatcaaacaggcttcacaggagttcaga

SEQ ID NO: 6864 - DNA, 71 bp, chicken (Gallus Gallus)
  misc_feature (36): n=g or t
ggtttttgtaatagagagctttatttctgaacgacntgatttgttgctgttaacactcagtgttagaaaag

SEQ ID NO: 6865 - DNA, 71 bp, chicken (Gallus Gallus)
  misc_feature (36): n=a or g
agcacctcgttcttgctgccaggttgtattttaccnccttgtacatctcattcacccctctcataccagca

SEQ ID NO: 6866 - DNA, 71 bp, chicken (Gallus Gallus)
  misc_feature (36): n=a or g
catttgattgtggtgctatctggagccttcacttcnaatttggcgctgcatttggatgatcaagatatata

SEQ ID NO: 6867 - DNA, 71 bp, chicken (Gallus Gallus)
  misc_feature (36): n=a or g
atcaatgaagaaaattaaacatctggtttctgttantagtatcaggttggaaatgatttcttgatgttaat

SEQ ID NO: 6868 - DNA, 71 bp, chicken (Gallus Gallus)
  misc_feature (36): n=a or g
gctgaatgccctggctcttaccagcatcccaggctnagtgatctgaaggaaaccatggtaagtaacgtggt

SEQ ID NO: 6869 - DNA, 71 bp, chicken (Gallus Gallus)
  misc_feature (36): n=a or c
aagagttatttgcattagaaagctaattgtaaaaantacccacataaactgttaatttattgtgcacagta

SEQ ID NO: 6870 - DNA, 71 bp, chicken (Gallus Gallus)
  misc_feature (36): n=a or g
acacaagatttcattatcaatatagctgaaagaggntctcagaacagctgttacaaagatttcactaacaa

SEQ ID NO: 6871 - DNA, 71 bp, chicken (Gallus Gallus)
  misc_feature (36): n=g or t
agcagtgtgtcctgtccgtgtgggtggggagaaacnagagcttggaaataacctgccccagccaagcactg

SEQ ID NO: 6872 - DNA, 71 bp, chicken (Gallus Gallus)
  misc_feature (36): n=a or g
aaatcatctggaccttacattttgatagcttcatcnagcaagggggcacaggtaaaccagggagattccat

SEQ ID NO: 6873 - DNA, 71 bp, chicken (Gallus Gallus)
  misc_feature (36): n=c or t
attttgtatcattatagccattataactctaaacangttaggagtaagaagactgagatgtcaacaaacct

SEQ ID NO: 6874 - DNA, 71 bp, chicken (Gallus Gallus)
  misc_feature (36): n=a or g
agaagggcttttcatgtgatctagacaaagttaagntcacctgaagctggaaaacaccacatctatacaga

SEQ ID NO: 6875 - DNA, 71 bp, chicken (Gallus Gallus)
  misc_feature (36): n=c or t
attgtttggaagctgcccaaagaatattacaccacngactgcattcctagcccagtgggtatctgtagccc

SEQ ID NO: 6876 - DNA, 71 bp, chicken (Gallus Gallus)
  misc_feature (36): n=c or t
atgtccttaatttaaagtcctcctccaaggtgccanggtgcccaaacagcaaagcgtaggcagtataccgt

SEQ ID NO: 6877 - DNA, 71 bp, chicken (Gallus Gallus)
  misc_feature (36): n=g or t
ctatttatatacagaaagacacagatatttagacanatgtaaaactcattttaaaccgcttctgattacac

SEQ ID NO: 6878 - DNA, 71 bp, chicken (Gallus Gallus)
  misc_feature (36): n=a or c
tcgctctccaggttattgacttctgagctctttggngaggcagtgcccaaagcattgtgttacagacatcg

SEQ ID NO: 6879 - DNA, 71 bp, chicken (Gallus Gallus)
  misc_feature (36): n=c or t
agtgctaggcactcgcagctgctctctgaactcatntggttcacctcacagcctgaggacaagtgctgcac

SEQ ID NO: 6880 - DNA, 71 bp, chicken (Gallus Gallus)
  misc_feature (36): n=c or t
ctctctgctgccttatttattccctacctgtttgcngtggtacatcagctggcaaactcactcagggtcac

SEQ ID NO: 6881 - DNA, 71 bp, chicken (Gallus Gallus)
  misc_feature (36): n=c or t
caattaaagaaaaatattctgcattctgaaaacagngtatatacttaagcaacccatctgctgtgtaggga

SEQ ID NO: 6882 - DNA, 71 bp, chicken (Gallus Gallus)
  misc_feature (36): n=a or g
ccatgtgtggctcacacgtgggaaaagtgactcatngcagaacacgtccagacagctcactgcctgcccct

SEQ ID NO: 6883 - DNA, 71 bp, chicken (Gallus Gallus)
  misc_feature (36): n=a or g
catcatctctaaactgaaaccaggattgtgcaaaantttgcccctgttgcaaatcttgaagctagaacaca

SEQ ID NO: 6884 - DNA, 71 bp, chicken (Gallus Gallus)
  misc_feature (36): n=a or g
gtacacatacctgtaaaaagcaaaacaagttgcccnattcacctagcacacatactgtgagctagacagca

SEQ ID NO: 6885 - DNA, 71 bp, chicken (Gallus Gallus)
  misc_feature (36): n=c or t
tggcacagcacctcagcagcacaaaagggaacttanggagctgccataatgcacaaggctgcagcgatgct

SEQ ID NO: 6886 - DNA, 71 bp, chicken (Gallus Gallus)
  misc_feature (36): n=c or t
gtgttctgcgtctgctggtggtaaagaacacagaantgaattccatttggatgcaaccattacacatacaa

SEQ ID NO: 6887 - DNA, 71 bp, chicken (Gallus Gallus)
  misc_feature (36): n=c or g
caataacagattcttcattttccaaccggctattgntgcaagtgaattgctctggtttgcatgtaatatac

SEQ ID NO: 6888 - DNA, 71 bp, chicken (Gallus Gallus)
  misc_feature (36): n=a or c
taaagcaaaccataaaatgtgtgcaagaggactaangggagacagtaatatctgcaatcttagatctctct

SEQ ID NO: 6889 - DNA, 71 bp, chicken (Gallus Gallus)
  misc_feature (36): n=c or t
ggtatttactcagcagtctgtaaaggcagcataggnccatatctaagtttttctgtgctttgtgtattcct

SEQ ID NO: 6890 - DNA, 71 bp, chicken (Gallus Gallus)
  misc_feature (36): n=a or t
aaaagaatggtaattaaaatatgtttagtagtaaanctgttggctaaaatctctaattgtacaaaaagaaa

SEQ ID NO: 6891 - DNA, 71 bp, chicken (Gallus Gallus)
  misc_feature (36): n=a or g
gtcccactggaagagcccatgtgggtgttaaacacntagcaggcaagttagcaaagtttttatggcaaaac

SEQ ID NO: 6892 - DNA, 71 bp, chicken (Gallus Gallus)
  misc_feature (36): n=c or t
aggtattagcttggttttgcatagagtttgggctgntgttggtttgagaagggtatgacaccatcccagtg

SEQ ID NO: 6893 - DNA, 71 bp, chicken (Gallus Gallus)
  misc_feature (36): n=a or t
tacacagtaaaaatttccacaggctattggtctaantaacaactaatgacagtctctaattgtttgtacaa

SEQ ID NO: 6894 - DNA, 71 bp, chicken (Gallus Gallus)
  misc_feature (36): n=c or t
ccaactgttaatgatacgtttaagctcctgtacttngtaatgtcaaatgatccatcaattgaaattagtag

SEQ ID NO: 6895 - DNA, 71 bp, chicken (Gallus Gallus)
  misc_feature (36): n=a or g
acccaaaaaggatgctgaggaaagtgagaaggtgtnctaacagtatagagccaggtgggatgtgatgtgct

SEQ ID NO: 6896 - DNA, 71 bp, chicken (Gallus Gallus)
  misc_feature (36): n=g or t
ttttcttggtttccttatccacagagactgaagctnttgtaggtgcaccacccacatcctctgcagcatca

SEQ ID NO: 6897 - DNA, 71 bp, chicken (Gallus Gallus)
  misc_feature (36): n=c or t
atgtcttatttacagtgcaaataaaacagtctgatnttcctaattttggccctggaaaacacctactgaca

SEQ ID NO: 6898 - DNA, 71 bp, chicken (Gallus Gallus)
  misc_feature (36): n=g or t
ttgtagctgtcaggagtgaagtgctgtaactagatntatgcatgttgggaggaatgggccactgacctttg

SEQ ID NO: 6899 - DNA, 71 bp, chicken (Gallus Gallus)
  misc_feature (36): n=a or t
gccactgcttgtggtggacaagattttcatataccnaggccaaatttctggaaggatggggatctgcaggt

SEQ ID NO: 6900 - DNA, 71 bp, chicken (Gallus Gallus)
  misc_feature (36): n=c or t
atgtctcattaaacattttctccctttatatacttnctacttcttacaatattcaagaacaattggtatgt

SEQ ID NO: 6901 - DNA, 71 bp, chicken (Gallus Gallus)
  misc_feature (36): n=a or g
ttgaggttgatatgagtataactgggagaaactcanaatgtgttgtaaatcagagaagctggaggttcttt

SEQ ID NO: 6902 - DNA, 71 bp, chicken (Gallus Gallus)
  misc_feature (36): n=a or g
agcagggcaaaaacaaagcccgtgacttagcttcanagaggaggtggctcattaacaacatctcaccctga

SEQ ID NO: 6903 - DNA, 71 bp, chicken (Gallus Gallus)
  misc_feature (36): n=c or t
gtaatcatatccttgatggctgagctctggcagcantttcttcctaaatcctcttgctatggagatgaata

SEQ ID NO: 6904 - DNA, 71 bp, chicken (Gallus Gallus)
  misc_feature (36): n=c or t
agggctaaaaggaaaaaggaacagatcaactactcnattaccaatacctaatagacaaaagctgaggagtc

SEQ ID NO: 6905 - DNA, 71 bp, chicken (Gallus Gallus)
  misc_feature (36): n=c or t
ataggaatccatcagtagtcctaaaaaggagtctgntggcatggaatacagattaactatgcattgctttt

SEQ ID NO: 6906 - DNA, 71 bp, chicken (Gallus Gallus)
  misc_feature (36): n=a or g
ctcctggtagtacattggttaaaataggttttatantattagaaaaatacatatctgaattcttttttcca

SEQ ID NO: 6907 - DNA, 71 bp, chicken (Gallus Gallus)
  misc_feature (36): n=a or g
gcagcagacatcattagcaatttcctcctctgaacnagtccacggtggaactgtttacttgtaagacacgg

SEQ ID NO: 6908 - DNA, 71 bp, chicken (Gallus Gallus)
  misc_feature (36): n=c or t
gcattagttccttatccattagttgaatcttctgtnttccatacactggattttgttgactcaccacttcc

SEQ ID NO: 6909 - DNA, 71 bp, chicken (Gallus Gallus)
  misc_feature (36): n=a or g
tctcatactttcacactcacccagggaacagctgtngtccatatatgatcctcaagagcagagaccactgc

SEQ ID NO: 6910 - DNA, 71 bp, chicken (Gallus Gallus)
  misc_feature (36): n=a or g
taattttttttataattaacttaaccctggataagnactgcaacatgagctacagtgacattattcaggaa

SEQ ID NO: 6911 - DNA, 71 bp, chicken (Gallus Gallus)
  misc_feature (36): n=c or t
tttgttgcagggatacacagtaaatatttagatttntttctttctccaaaagtttatttaactatatactt

SEQ ID NO: 6912 - DNA, 71 bp, chicken (Gallus Gallus)
  misc_feature (36): n=c or t
aggaggaaaatcacctttccaaagtaggagaaaacntcccaaaagcagttctgagaaacaggctggagagc

SEQ ID NO: 6913 - DNA, 71 bp, chicken (Gallus Gallus)
  misc_feature (36): n=a or g
catgaactgcagagtatcacccagtgattaccatanaatctttacacaaagcagctgactttatatttcct

SEQ ID NO: 6914 - DNA, 71 bp, chicken (Gallus Gallus)
  misc_feature (36): n=c or t
cagccaggggctgtgagagactgcagagcttgatcngtgagaagttattttgaaagaaacagtgcagtctg

SEQ ID NO: 6915 - DNA, 71 bp, chicken (Gallus Gallus)
  misc_feature (36): n=c or t
ggtggccctgccatgacaccacagcctgcagatggnatggcatgttccaggctcaggtgatttccccaggc

SEQ ID NO: 6916 - DNA, 71 bp, chicken (Gallus Gallus)
  misc_feature (36): n=c or t
gaaccatcttttaaaatgtaaagtatcttggattcnttcctccccttttcctacctttcttcctttcatct

SEQ ID NO: 6917 - DNA, 71 bp, chicken (Gallus Gallus)
  misc_feature (36): n=g or t
ttcagttgcccagatagctttacaagtcacttgagncatgatttacttaaaaattatatgaatcaattata

SEQ ID NO: 6918 - DNA, 71 bp, chicken (Gallus Gallus)
  misc_feature (36): n=c or t
atgacagtttcgggaatgcagcatagttacaaaaangtgagtacgctctcaaaaacagtgagggacaaaac

SEQ ID NO: 6919 - DNA, 71 bp, chicken (Gallus Gallus)
  misc_feature (36): n=a or g
tggtggctagtctacagtgaagtagaatggcaatgnaaagtagctcagaggttaaaatataatgcttgtct

SEQ ID NO: 6920 - DNA, 71 bp, chicken (Gallus Gallus)
  misc_feature (36): n=c or t
ttacaaatgatgccccagctcatttcactgtgggangatgaccctttgtaagctacttaagcttaaaccaa

SEQ ID NO: 6921 - DNA, 71 bp, chicken (Gallus Gallus)
  misc_feature (36): n=c or t
agcctgctggcctagggaccctgtttcctgaaggancccacagtaaactgaatcttcttgctaatttaaca

SEQ ID NO: 6922 - DNA, 71 bp, chicken (Gallus Gallus)
  misc_feature (36): n=c or t
ccagacccacttgtgctgcaatgtaggcagtgtagnacacctgcctcaaagcctcacatttaggcccagag

SEQ ID NO: 6923 - DNA, 71 bp, chicken (Gallus Gallus)
  misc_feature (36): n=a or t
gggtgccctggtagcaaagaacactgagaaagcatnctgttttctcagcagttcctgaattctttctttcc

SEQ ID NO: 6924 - DNA, 71 bp, chicken (Gallus Gallus)
  misc_feature (36): n=c or t
agagttcagaaagaagtggagctttcccttaatagnttctcccttgaagcatctgtccaggcaagggtagg

SEQ ID NO: 6925 - DNA, 71 bp, chicken (Gallus Gallus)
  misc_feature (36): n=a or g
tgcaatgtgtacatgctcactcaaagctggtattcngagcaaaagccgttgttcttgtaggcaaaaaaaac

SEQ ID NO: 6926 - DNA, 71 bp, chicken (Gallus Gallus)
  misc_feature (36): n=a or g
tgtatgcttatacacggggcaccagctttcggaagnggaagaacaacaactgcaacagcaaagtgaaccac

SEQ ID NO: 6927 - DNA, 71 bp, chicken (Gallus Gallus)
  misc_feature (36): n=a or g
ctgaagtatgtaacgtccttcaaaagtgaaaattcngatagaaagttacttctctggacagcaaacaaaaa

SEQ ID NO: 6928 - DNA, 71 bp, chicken (Gallus Gallus)
  misc_feature (36): n=a or c
gaggtatctcccactattttgatgtctgctgtgctncagggtctggtctctgggagggcagcaagcaggtt

SEQ ID NO: 6929 - DNA, 71 bp, chicken (Gallus Gallus)
  misc_feature (36): n=a or g
caatttaaacaacgatcaagagacttactgtacctngtcacggccatgctacatttatgagctgcctgtgt

SEQ ID NO: 6930 - DNA, 71 bp, chicken (Gallus Gallus)
  misc_feature (36): n=a or g
acaagtgacttgtagaaaatattgtcatttagttcnttcatttcatcactttcagttgcaggaagccaccc

SEQ ID NO: 6931 - DNA, 71 bp, chicken (Gallus Gallus)
  misc_feature (36): n=c or t
ccaggactgctgatgctggggctcacctcactcccnttcctggctaggtttgtgtcactgttggcacagga

SEQ ID NO: 6932 - DNA, 71 bp, chicken (Gallus Gallus)
  misc_feature (36): n=a or g
tatcttgatgtccttgggatttctctctaataatgntggtacagtgctcagaattagtggagccttcctgt

SEQ ID NO: 6933 - DNA, 71 bp, chicken (Gallus Gallus)
  misc_feature (36): n=g or t
atggttgctcagaagttctaaatcagtgtggcagtnaggaactggaacatgttgggagaaagactgaaatc

SEQ ID NO: 6934 - DNA, 71 bp, chicken (Gallus Gallus)
  misc_feature (36): n=a or c
tcttggattaagcagtaagaagaaaaaaaagagctngaaagatgagtcactgctgagtgaaatgtactctt

SEQ ID NO: 6935 - DNA, 71 bp, chicken (Gallus Gallus)
  misc_feature (36): n=a or c
atcctgagttaaaatacagtcatgaatacagtgganaaaccatcaaatgctttctgatagagtatctttaa

SEQ ID NO: 6936 - DNA, 71 bp, chicken (Gallus Gallus)
  misc_feature (36): n=c or t
gaaggataactaggaatgtaggaatcccaaattcantgagcctttgttgtattgctgcctagttttcacat

SEQ ID NO: 6937 - DNA, 71 bp, chicken (Gallus Gallus)
  misc_feature (36): n=a or g
taagaacgggatttgtggagagcaaatagaggagancgtagcaattacaaaaggagtttattccttctgga

SEQ ID NO: 6938 - DNA, 71 bp, chicken (Gallus Gallus)
  misc_feature (36): n=c or t
tggtggtaccttctccagtaggggaggcagtggtgngatgttggtaaacttcatatagtttgaatattgct

SEQ ID NO: 6939 - DNA, 71 bp, chicken (Gallus Gallus)
  misc_feature (36): n=a or g
taacagcaaaaatgcaaaatcagtatggagctttanaatagctaacaaacctgagctggagtcctgcagac

SEQ ID NO: 6940 - DNA, 71 bp, chicken (Gallus Gallus)
  misc_feature (36): n=a or g
ccttccgcttcataccatgttccattttcacagacngttcagtcacttgccatttgaacaggacctttaag

SEQ ID NO: 6941 - DNA, 71 bp, chicken (Gallus Gallus)
  misc_feature (36): n=a or g
tcacgttgctcctctcccctacagaagtcctacgancacttggcaaaaatccgagcggcgagagaagcgcc

SEQ ID NO: 6942 - DNA, 71 bp, chicken (Gallus Gallus)
  misc_feature (36): n=a or g
ccttctcagccatctgtttgacaggaagatatatanaggaaagcactgtgtagctaaggtaaaataagaag

SEQ ID NO: 6943 - DNA, 71 bp, chicken (Gallus Gallus)
  misc_feature (36): n=a or g
aaagagaagctcggtgtaagtgaatttcagcagganttgcttactgactagagcagagagcagccttctgc

SEQ ID NO: 6944 - DNA, 71 bp, chicken (Gallus Gallus)
  misc_feature (36): n=c or g
ttgcttgtgtggaagcaacaggaggtttttcctaancattaagaaatattcacatactacgaaactgttct

SEQ ID NO: 6945 - DNA, 71 bp, chicken (Gallus Gallus)
  misc_feature (36): n=c or t
tgatgtaccggcagtcagttggactcccctaggagngcttgagaagagtttttggattttgtgccaggacg

SEQ ID NO: 6946 - DNA, 71 bp, chicken (Gallus Gallus)
  misc_feature (36): n=c or t
ctccagttttaaataaaaatttaatcatgccaaaancagatttagcactcacagggactatatttggaccc

SEQ ID NO: 6947 - DNA, 71 bp, chicken (Gallus Gallus)
  misc_feature (36): n=c or t
gagcgtccaacttttgaatatttgcagggttttctngaagactacttcactgcaacagaaccccagtacca

SEQ ID NO: 6948 - DNA, 71 bp, chicken (Gallus Gallus)
  misc_feature (36): n=a or g
ctgaggtatgggaaggaactggagagctatggaatnggtgaaagatgaagaacctgtaaagtcacttctac

SEQ ID NO: 6949 - DNA, 71 bp, chicken (Gallus Gallus)
  misc_feature (36): n=c or t
tttgtgctttggagaaacagaccaagtacaaaagcnatgggaatgcaaggtgagtgctgtgcatttcctgg

SEQ ID NO: 6950 - DNA, 71 bp, chicken (Gallus Gallus)
  misc_feature (36): n=c or t
gggcagcctgtgccagggtctcatcacccaaatatnattaactccctctttcatttagcaaaagtaaggga

SEQ ID NO: 6951 - DNA, 71 bp, chicken (Gallus Gallus)
  misc_feature (36): n=a or t
ctgcataatgcagtccctctaaactggagtttgtanaactgagtttggactttgccagtgtagatgtcatt

SEQ ID NO: 6952 - DNA, 71 bp, chicken (Gallus Gallus)
  misc_feature (36): n=c or g
atcaaagggaaagttgccgtagcatttagacagatntaagtgttcagtattgcttcttgtattgcattttt

SEQ ID NO: 6953 - DNA, 71 bp, chicken (Gallus Gallus)
  misc_feature (36): n=a or g
tcatattatgtcttccatagaatgacttagtgaccntctttccattggtggtcgcagctgaatactgatgt

SEQ ID NO: 6954 - DNA, 71 bp, chicken (Gallus Gallus)
  misc_feature (36): n=c or t
gaaggggagagaagcttctctgtgtctgatggattnactggtctcgtccctgtgaaacaaatgaggagtct

SEQ ID NO: 6955 - DNA, 71 bp, chicken (Gallus Gallus)
  misc_feature (36): n=a or t
gagcacaaatgtgattctggaaatttttcctgcaanatacaaaggtgggatcatgatgacaagcaaaaaat

SEQ ID NO: 6956 - DNA, 71 bp, chicken (Gallus Gallus)
  misc_feature (36): n=a or g
ttctccagaactaccagaagcaatggtgaggagtcngcaagccccatgggccctctatttctccatcagag

SEQ ID NO: 6957 - DNA, 71 bp, chicken (Gallus Gallus)
  misc_feature (36): n=g or t
agctagcaagcatgaaatatcactttttgaaggcantctgttgcatttatgcagtgtacaattacattagg

SEQ ID NO: 6958 - DNA, 71 bp, chicken (Gallus Gallus)
  misc_feature (36): n=c or t
gtattgagtcacctgcaggtcacaggacagcagtcnaggtggctattcctgcaaaccctttcagctcatga

SEQ ID NO: 6959 - DNA, 71 bp, chicken (Gallus Gallus)
  misc_feature (36): n=a or g
ggatgttcccatggcttgggtctcaccatgatgtgngtccctgcaacccacttggttcccttcatgggtag

SEQ ID NO: 6960 - DNA, 71 bp, chicken (Gallus Gallus)
  misc_feature (36): n=c or t
aaggcataggaacaactggtgatgtgacaggagagngcctttagttttgtcctcacagccatgtacaaaca

SEQ ID NO: 6961 - DNA, 71 bp, chicken (Gallus Gallus)
  misc_feature (36): n=a or g
ttctaagctctggttacggtttataccattctatcnagtttgtgtttcattgccaaaagcaaatgcattaa

SEQ ID NO: 6962 - DNA, 71 bp, chicken (Gallus Gallus)
  misc_feature (36): n=c or t
acttgcttcttaatttacacacttgttcctgaaagngaagaagaaaaaaatattgctttggtttaagcttc

SEQ ID NO: 6963 - DNA, 71 bp, chicken (Gallus Gallus)
  misc_feature (36): n=a or g
gccgttaggaaaatgtgttgggtctttctgagaagntgctgcttttattacatgtagagcttaaatcacag

SEQ ID NO: 6964 - DNA, 71 bp, chicken (Gallus Gallus)
  misc_feature (36): n=g or t
tcccccaaataatccatgtttagcagcttggtagtngatgttaatagaatcgttgtcccttagtctgaaaa

SEQ ID NO: 6965 - DNA, 71 bp, chicken (Gallus Gallus)
  misc_feature (36): n=c or t
catatggcttttgtccaaagcttattgattgctgcntttgttattccatccagattcgttccgataaggac

SEQ ID NO: 6966 - DNA, 71 bp, chicken (Gallus Gallus)
  misc_feature (36): n=a or g
tagcaaatgaaggcaggcttctggtttccaaagtanccattgctcacacactgtctagggatcatgggaaa

SEQ ID NO: 6967 - DNA, 71 bp, chicken (Gallus Gallus)
  misc_feature (36): n=a or c
tagacaaccttatggtgtctttggaatcctccagtnctgggcctgttcctggggcccttagaggtggtctg

SEQ ID NO: 6968 - DNA, 71 bp, chicken (Gallus Gallus)
  misc_feature (36): n=a or g
ctgcttcaagagagctgttcttaggtctcacaaacntaagttgttcttcccagcaggcagcacctattact

SEQ ID NO: 6969 - DNA, 71 bp, chicken (Gallus Gallus)
  misc_feature (36): n=g or t
aaaaatacggaccaagtcaaaatctgatcagatttngggtaatagtggatagccaggagttaagggtcaga

SEQ ID NO: 6970 - DNA, 71 bp, chicken (Gallus Gallus)
  misc_feature (36): n=a or g
gatgagctaaataattcacatcagatatattacatntttttgatttttcacaaataccatgcatgacatgc

SEQ ID NO: 6971 - DNA, 71 bp, chicken (Gallus Gallus)
  misc_feature (36): n=a or g
ttttaaagtgctaagatgctgcgattgtgagtgacnaggaagaaacttgtaggaaactaatcaattttctg

SEQ ID NO: 6972 - DNA, 71 bp, chicken (Gallus Gallus)
  misc_feature (36): n=a or g
ttccttcactgtctgtgttgaacagagaacataatncttcaagaaaactgcatgatatttcttactgctta

SEQ ID NO: 6973 - DNA, 71 bp, chicken (Gallus Gallus)
  misc_feature (36): n=a or g
aagggatgttttacaatatcatgcaatgtatcaagncttgcttcgtgactattaaactcatcttaatacat

SEQ ID NO: 6974 - DNA, 71 bp, chicken (Gallus Gallus)
  misc_feature (36): n=c or t
agtttatctgagaattcatcttcttcatattagtangactgtaagaagttgatataattgaaaaatccctc

SEQ ID NO: 6975 - DNA, 71 bp, chicken (Gallus Gallus)
  misc_feature (36): n=a or g
tgattcaaatgttagttgattatttcttgttctgtntagatatgaacatatatgcatacagatctattaag

SEQ ID NO: 6976 - DNA, 71 bp, chicken (Gallus Gallus)
  misc_feature (36): n=a or g
aaagcatgctcttgtaatagtttacttcccgtttanttgtctgtagtgatcagagtactacatttgtctct

SEQ ID NO: 6977 - DNA, 71 bp, chicken (Gallus Gallus)
  misc_feature (36): n=c or t
atttatgcaagaggggctttgatttaaccggtgcanggaaggcagcagcttccttgtttccggtgttcttg

SEQ ID NO: 6978 - DNA, 71 bp, chicken (Gallus Gallus)
  misc_feature (36): n=a or g
gcacacaaatccccacccggcacagtgtgtcccacnctgatgggagaccattcctaaacctctaaaagaag

SEQ ID NO: 6979 - DNA, 71 bp, chicken (Gallus Gallus)
  misc_feature (36): n=g or t
tggctacctatgagtgctatcgaatttgagctattnttggccagactgcatagtaatgagagatgggaaag

SEQ ID NO: 6980 - DNA, 71 bp, chicken (Gallus Gallus)
  misc_feature (36): n=c or t
cccaataatatccatttaagtgaaatgattaaaaangattgaggaaaaaacagcaaatgtgaattgtcaaa

SEQ ID NO: 6981 - DNA, 71 bp, chicken (Gallus Gallus)
  misc_feature (36): n=a or c
gccagggcagagattagacacagctgcgtgattcanagctataaccaaggggcttcaaaccactgcttaag

SEQ ID NO: 6982 - DNA, 71 bp, chicken (Gallus Gallus)
  misc_feature (36): n=c or g
ggttgatacagagctctggggacttctcaggtgaanggagtgtgtggtgaataggatgcttcccagtactg

SEQ ID NO: 6983 - DNA, 71 bp, chicken (Gallus Gallus)
  misc_feature (36): n=c or t
tttgaggaaaaacagctgatacactgtcccagatantattctctaatagcacaaatcatgagtggagaggg

SEQ ID NO: 6984 - DNA, 71 bp, chicken (Gallus Gallus)
  misc_feature (36): n=c or t
tctcctcctatgttaaagacttcctgtttttatgcngcagctgactccttatttaaatctccacataggca

SEQ ID NO: 6985 - DNA, 71 bp, chicken (Gallus Gallus)
  misc_feature (36): n=c or t
tttgtctctgagcaaagtcagaaagctacaagtgcnggaaccccacacatgcccagcagaacgaatacctt

SEQ ID NO: 6986 - DNA, 71 bp, chicken (Gallus Gallus)
  misc_feature (36): n=c or t
tgcatgtgatgcaggtacagataggtttacctacangtataaaaatgcgtcgcggcgctctgcaatgatgc

SEQ ID NO: 6987 - DNA, 71 bp, chicken (Gallus Gallus)
  misc_feature (36): n=a or g
ggccgcatgcaaaatgaggatttagaggctaatggnaagggggaaggccttggctgtgctgctcggggctg

SEQ ID NO: 6988 - DNA, 71 bp, chicken (Gallus Gallus)
  misc_feature (36): n=a or c
caaagatacctactgcagccatctcagaaggtaatnctgagacaatgacactagatgttaaaattaaactg

SEQ ID NO: 6989 - DNA, 71 bp, chicken (Gallus Gallus)
  misc_feature (36): n=a or g
cagaacacagagacatcagcccaccacccagtactnagctagtaccagactggcatgttcatcccgcatgc

SEQ ID NO: 6990 - DNA, 71 bp, chicken (Gallus Gallus)
  misc_feature (36): n=a or g
ataaatttcagagaagtggaaaccaagcaactgtgntgatattcagctgcccatgtagctgcgaacctttc

SEQ ID NO: 6991 - DNA, 71 bp, chicken (Gallus Gallus)
  misc_feature (36): n=c or t
attctagttgtgtaaggtgaggttgcagatctcttnctctatctggtagaaaccaatgtggttccattatt

SEQ ID NO: 6992 - DNA, 71 bp, chicken (Gallus Gallus)
  misc_feature (36): n=c or t
aacaaaatctgatccttttgagtagctctcttctcngaagtttcaaactcaagcattccaatactaatttt

SEQ ID NO: 6993 - DNA, 71 bp, chicken (Gallus Gallus)
  misc_feature (36): n=a or g
gttcttatgttaacctcataggagggatgaggaacnagcacctctgtttgggttttaactgcagcctattt

SEQ ID NO: 6994 - DNA, 71 bp, chicken (Gallus Gallus)
  misc_feature (36): n=a or g
ctaggagatgcatggcctaataaattcagctctacnttttaaggattatctgtatggctcacagagagaaa

SEQ ID NO: 6995 - DNA, 71 bp, chicken (Gallus Gallus)
  misc_feature (36): n=c or t
cctcctccctctagtgatgagctcattaatgacccngctgcagacactaattagaaaatagcacgccgcag

SEQ ID NO: 6996 - DNA, 71 bp, chicken (Gallus Gallus)
  misc_feature (36): n=c or t
gggtgaaaagcaatgggatcttctcaaaaatcactngtattcaggcacaccttattagtgtgaacaaatcc

SEQ ID NO: 6997 - DNA, 71 bp, chicken (Gallus Gallus)
  misc_feature (36): n=c or t
tgccttctcttctcctcatatgagggaacaccaatntgaccttcaggaggaacagggatgatgggtaacac

SEQ ID NO: 6998 - DNA, 71 bp, chicken (Gallus Gallus)
  misc_feature (36): n=a or g
aaattaaatttaaaaattcctcactttttacttttnacatttcctgtttctcttcttttaagctcagggca

SEQ ID NO: 6999 - DNA, 71 bp, chicken (Gallus Gallus)
  misc_feature (36): n=c or t
gaagacctctcaagatacccgctccagttgactccngttttaatcattaagagttgtccataaacactatt

SEQ ID NO: 7000 - DNA, 71 bp, chicken (Gallus Gallus)
  misc_feature (36): n=a or g
aactcccttatcaaagtagtttacctcttcaaggcnaggctggatagggccctgagcagcctggtctagta

SEQ ID NO: 7001 - DNA, 71 bp, chicken (Gallus Gallus)
  misc_feature (36): n=a or g
aataattcagataaataagttcttgcagggctctantgattttgtttgtggcaatttgagaagttaccatc

SEQ ID NO: 7002 - DNA, 71 bp, chicken (Gallus Gallus)
  misc_feature (36): n=c or t
atctggtagaaatcagaaaagcttcattaaagtcantggctcaataccaagttacttctgctgaaaatttt

SEQ ID NO: 7003 - DNA, 71 bp, chicken (Gallus Gallus)
  misc_feature (36): n=a or t
cagtaaataaaaaagaattttgtaacaagaattagnattaatgtagctattgcaaaagatcttatagctaa

SEQ ID NO: 7004 - DNA, 71 bp, chicken (Gallus Gallus)
  misc_feature (36): n=a or g
tagttattttaaaatggtttggtttgtgattcagcngaaaacatgctttgcgtgcagaccttatttgaaag

SEQ ID NO: 7005 - DNA, 71 bp, chicken (Gallus Gallus)
  misc_feature (36): n=c or t
agaaagcttctacaaataagtacctattatgaagtnatttcttccctggtactactgatccaagcatattt

SEQ ID NO: 7006 - DNA, 71 bp, chicken (Gallus Gallus)
  misc_feature (36): n=a or g
aaacatctttatttatttcaatttttggtttacacntgactctgagctcagcatcttctcttatacaatta

SEQ ID NO: 7007 - DNA, 71 bp, chicken (Gallus Gallus)
  misc_feature (36): n=c or g
ttgagactaaggaactcatcagacttctctttatantgagcaaagacagttaagtactttcagaactcagt

SEQ ID NO: 7008 - DNA, 71 bp, chicken (Gallus Gallus)
  misc_feature (36): n=a or g
ccgttaagtcacgtctaatgtgtgatttccaacatntctaacaacaacagcagcaagttctgttttttgac

SEQ ID NO: 7009 - DNA, 71 bp, chicken (Gallus Gallus)
  misc_feature (36): n=a or g
tgtattgcaagaagggagctggttgactgcacatcntttggtagttctgtttcagccagttcagtcccaaa

SEQ ID NO: 7010 - DNA, 71 bp, chicken (Gallus Gallus)
  misc_feature (36): n=c or t
gtttgcctctccttagggtgttgcttcttgtttccngtgcagatgtctttcatctttactgccttatgttt

SEQ ID NO: 7011 - DNA, 71 bp, chicken (Gallus Gallus)
  misc_feature (36): n=a or g
aaaccatataacttatagacccttggaagtctgtgnttgcaacatcattcaggtttggatttgctgtagta

SEQ ID NO: 7012 - DNA, 71 bp, chicken (Gallus Gallus)
  misc_feature (36): n=c or t
caaaactgaggtgcagtctgttttttttcactcctntgattttctcaaggcagaagctcgctcattttttg

SEQ ID NO: 7013 - DNA, 71 bp, chicken (Gallus Gallus)
  misc_feature (36): n=a or g
gaatataccaacataaaaaaatgcctcctgaatganattttatgaccataatttatcagattcctaccacc

SEQ ID NO: 7014 - DNA, 71 bp, chicken (Gallus Gallus)
  misc_feature (36): n=c or t
cattgtgcaaaggcagaacaaagatggcttgcatantgatcttacatggcaaggttttggtagctgggggc

SEQ ID NO: 7015 - DNA, 71 bp, chicken (Gallus Gallus)
  misc_feature (36): n=a or c
gataaaatgcttgtatttagtggctctggctcaagnagtttcatctcctgtgagaaagatgaaggcttcat

SEQ ID NO: 7016 - DNA, 71 bp, chicken (Gallus Gallus)
  misc_feature (36): n=a or g
tttgacagctcagtcataaatattccacttttggcngttactcattttcaaaatactgagtgccctaaaga

SEQ ID NO: 7017 - DNA, 71 bp, chicken (Gallus Gallus)
  misc_feature (36): n=c or t
tccacccttgtcctcaattacatcaacttgcatcanccgtgtctgttgtgtaggaacaattaccatgcttc

SEQ ID NO: 7018 - DNA, 71 bp, chicken (Gallus Gallus)
  misc_feature (36): n=a or g
caggtcatctgtgagggtcaagaagaagccaggacncaggagggccctttcctagttgcagctcatgagaa

SEQ ID NO: 7019 - DNA, 71 bp, chicken (Gallus Gallus)
  misc_feature (36): n=c or t
atcacccatgctccatagtagtaaaagttcagtttngactgaaagctgcattttgattttccacctcagat

SEQ ID NO: 7020 - DNA, 71 bp, chicken (Gallus Gallus)
  misc_feature (36): n=a or g
gtttctttccagtgatttttagaacaaaaatgtaanttgtcaaaaaaaaaaaaaaattctgtccattgtac

SEQ ID NO: 7021 - DNA, 71 bp, chicken (Gallus Gallus)
  misc_feature (36): n=c or t
tgacttgctattttgacataggatcatgttcaaaangaaaagaagtagaatgagttcttttcaagagctca

SEQ ID NO: 7022 - DNA, 71 bp, chicken (Gallus Gallus)
  misc_feature (36): n=a or g
ctgaacacaatgctgaatcctttctcccattcctantggctaaaaatattgaggtcaaggaaaataacgtc

SEQ ID NO: 7023 - DNA, 71 bp, chicken (Gallus Gallus)
  misc_feature (36): n=c or t
caaccatcagtattattttttattttaataaggagnccttttcaatattggaacaaacttcatcagcatag

SEQ ID NO: 7024 - DNA, 71 bp, chicken (Gallus Gallus)
  misc_feature (36): n=a or g
aactgctgatgtctgatcaacaagcaatgtcccatnaatgcttcaagacatcatgcacacatacacagata

SEQ ID NO: 7025 - DNA, 71 bp, chicken (Gallus Gallus)
  misc_feature (36): n=c or t
tcctgactgaagaggatggaacatcacttaaatagnacagatcagagtttttcagcttggagcttccttcc

SEQ ID NO: 7026 - DNA, 71 bp, chicken (Gallus Gallus)
  misc_feature (36): n=a or g
tgcaggactgattaacaataggtactgaaaattaantgtcttctacagtggcactatgctgaggtacatga

SEQ ID NO: 7027 - DNA, 71 bp, chicken (Gallus Gallus)
  misc_feature (36): n=a or t
ctgagtgctggctgcttttgtccccacttaactccntactgatttgttcaatgtgctcttccccactgtag

SEQ ID NO: 7028 - DNA, 71 bp, chicken (Gallus Gallus)
  misc_feature (36): n=c or t
tctgttctcccctagaactgattttcatttagttanggtttaggtatgatttgctgtcccagctcctttgg

SEQ ID NO: 7029 - DNA, 71 bp, chicken (Gallus Gallus)
  misc_feature (36): n=a or g
cagattaatattgccttgacgtaattgttcattcancacgactgctaatttgtcagtggagctatcccagg

SEQ ID NO: 7030 - DNA, 71 bp, chicken (Gallus Gallus)
  misc_feature (36): n=c or t
ccatgaagtgggctgcaccttcagacatccagcaanaagcagcaaacttttgatcagctctgattcatctc

SEQ ID NO: 7031 - DNA, 71 bp, chicken (Gallus Gallus)
  misc_feature (36): n=a or g
gagtcaggttaaaaagaactggaaagtccttcccantatgcaatggcatcttcacttacggtatagcaata

SEQ ID NO: 7032 - DNA, 71 bp, chicken (Gallus Gallus)
  misc_feature (36): n=a or g
tgtcccttttcacagcttgttggcatttattcagcnccagccaggtccttgagtctctctggaaagatgag

SEQ ID NO: 7033 - DNA, 71 bp, chicken (Gallus Gallus)
  misc_feature (36): n=c or t
atttgagtctagtacttccaacctcagatgttgaantggtagcttaagaaatattccaatgaaaacatggt

SEQ ID NO: 7034 - DNA, 71 bp, chicken (Gallus Gallus)
  misc_feature (36): n=g or t
gcacagtaagcttgtttgaagtttctctttgaacancagcactccactccactgctgtaagcagtcacttt

SEQ ID NO: 7035 - DNA, 71 bp, chicken (Gallus Gallus)
  misc_feature (36): n=a or g
ttggtagatcacttattgtataaactttttgaacantatgtcaaaacaaattgtatttaatacatcatctt

SEQ ID NO: 7036 - DNA, 71 bp, chicken (Gallus Gallus)
  misc_feature (36): n=a or g
aatacaagcttactaaaaaaagaattacagagttcnttaaataagattctcattattcaggagagcagtta

SEQ ID NO: 7037 - DNA, 71 bp, chicken (Gallus Gallus)
  misc_feature (36): n=c or t
tgactcgcagccctttgggagtggagcttaatatanttggtgataaaccgcagaatgattttcagcatgtt

SEQ ID NO: 7038 - DNA, 71 bp, chicken (Gallus Gallus)
  misc_feature (36): n=c or t
aaaccaaaatgacatcaacttcattgtgttgtgatnaagtaagagctgcagataaaaacccattgcacaaa

SEQ ID NO: 7039 - DNA, 71 bp, chicken (Gallus Gallus)
  misc_feature (36): n=a or g
gtaaactgagacacagctatgtcaggaatgtttggntgaagagctggtagttcatgatataaattgggaaa

SEQ ID NO: 7040 - DNA, 71 bp, chicken (Gallus Gallus)
  misc_feature (36): n=a or g
gtaattttcatagaaaatcattctgaaacagaaacnttgcaggctaccaaagagctcactatcgctatgac

SEQ ID NO: 7041 - DNA, 71 bp, chicken (Gallus Gallus)
  misc_feature (36): n=a or g
ggaatccaaattggaatttagatatatgacatctcntgttaaaagtacaggtgaagtgtcaatgcactatt

SEQ ID NO: 7042 - DNA, 71 bp, chicken (Gallus Gallus)
  misc_feature (36): n=c or t
cttttcccagtcttcattatagtaagccattctctngctagttaagtacttttcacgtggttttcactgca

SEQ ID NO: 7043 - DNA, 71 bp, chicken (Gallus Gallus)
  misc_feature (36): n=a or g
gaaaccgacccccccatggggctgagtctttcttgnccagagtggtttttaagtaccacaagctgtagagt

SEQ ID NO: 7044 - DNA, 71 bp, chicken (Gallus Gallus)
  misc_feature (36): n=a or c
agttaaggctggaaaagctgcaaaggaagaaaaaantaaccaggaatatctcatcatagggtctgactaca

SEQ ID NO: 7045 - DNA, 71 bp, chicken (Gallus Gallus)
  misc_feature (36): n=c or t
gcagtgctttgtggtcaagtgagccaaatagaaacnaagtgatgctcttccgcacaacagctgggtgctac

SEQ ID NO: 7046 - DNA, 71 bp, chicken (Gallus Gallus)
  misc_feature (36): n=g or t
attcctcccagaaaagcaaaaggcttttttattggnaattattgcagaagtttcttcattgccacttcatg

SEQ ID NO: 7047 - DNA, 71 bp, chicken (Gallus Gallus)
  misc_feature (36): n=a or g
tgtccagttaaaggtggtcctgttggttgcttgatngatggacatgagtttggtcaaggaatagtaatggc

SEQ ID NO: 7048 - DNA, 71 bp, chicken (Gallus Gallus)
  misc_feature (36): n=a or t
cttttgtcactgttaaaagtttttgaaactaagacnatcgcttaatcagtttaggagaatcttgctgtcgc

SEQ ID NO: 7049 - DNA, 71 bp, chicken (Gallus Gallus)
  misc_feature (36): n=c or t
aagagaaaggattaatcttttcaactgtcacagcanatagcctgcattgtactgttggacatgatggtaat

SEQ ID NO: 7050 - DNA, 71 bp, chicken (Gallus Gallus)
  misc_feature (36): n=c or t
ctaaaacaaggaaatagttttgctatctaatctgcntcctgaagacagctgcctaaagacagctcctgctt

SEQ ID NO: 7051 - DNA, 71 bp, chicken (Gallus Gallus)
  misc_feature (36): n=c or t
agaatagagctgttgcctgctgtattattgagacangactctattgttatcccattctgaataacttttac

SEQ ID NO: 7052 - DNA, 71 bp, chicken (Gallus Gallus)
  misc_feature (36): n=a or c
aggtgaagaagcaaagaaaattaatagctgcctgantcaattttttcccatgattcctggtgcaaaaggaa

SEQ ID NO: 7053 - DNA, 71 bp, chicken (Gallus Gallus)
  misc_feature (36): n=c or t
caagaacaaactaaatcatggggatgtgctgcagcnctgctccctacgacaagaactctttcattctcgct

SEQ ID NO: 7054 - DNA, 71 bp, chicken (Gallus Gallus)
  misc_feature (36): n=g or t
ttttccctggtgaaacttggctgagataaatgtctnccccagtgtgactaaaggcagaaactcaaccttat

SEQ ID NO: 7055 - DNA, 71 bp, chicken (Gallus Gallus)
  misc_feature (36): n=a or g
ccatgcagacccatcctgagcatgatggagctgggnacactcccaagcaaagagcttgggagaaaccgaac

SEQ ID NO: 7056 - DNA, 71 bp, chicken (Gallus Gallus)
  misc_feature (36): n=c or t
acagtgaggcagagacaaagcttgagtttggacgtngcaggtttgggctctcggctcacccctcagctcca

SEQ ID NO: 7057 - DNA, 71 bp, chicken (Gallus Gallus)
  misc_feature (36): n=c or t
aataaagatggaacttaacctagatagttactgcangcaatttagaagtgataaataccagaaatctgcag

SEQ ID NO: 7058 - DNA, 71 bp, chicken (Gallus Gallus)
  misc_feature (36): n=c or t
aaaagcactgtcttaagtaacttcctgttgctatgntaatgatgggattgcggctattaggatcagttgtc

SEQ ID NO: 7059 - DNA, 71 bp, chicken (Gallus Gallus)
  misc_feature (36): n=c or t
actgttgtagggacttagagcatcattagtttctangcttaaacatggaaaatgatatataagaactaagc

SEQ ID NO: 7060 - DNA, 71 bp, chicken (Gallus Gallus)
  misc_feature (36): n=a or g
ccatcctgaaaaccatttagtttttgcaggctgggnttctcttccctcagcacattctccccttgtattta

SEQ ID NO: 7061 - DNA, 71 bp, chicken (Gallus Gallus)
  misc_feature (36): n=a or g
acatcatgcttcacttatgaaaagacagatttacanctctcttagcagtgcttgtacttgctaagaggaag

SEQ ID NO: 7062 - DNA, 71 bp, chicken (Gallus Gallus)
  misc_feature (36): n=a or g
atgactgaggtggtcagtaatattaaatgttatatnaaaatgaagcctactcacttagatgtctcaacagg

SEQ ID NO: 7063 - DNA, 71 bp, chicken (Gallus Gallus)
  misc_feature (36): n=c or t
attcatttgctgtacaggagaagtaagagggaaagnaaggactgcaggactaggcacaacatacagaaatg

SEQ ID NO: 7064 - DNA, 71 bp, chicken (Gallus Gallus)
  misc_feature (36): n=c or t
atcccatcagcttgctcataatgccttggctaaacntcatgggagaattcacagtctcaagtttatctgat

SEQ ID NO: 7065 - DNA, 71 bp, chicken (Gallus Gallus)
  misc_feature (36): n=a or g
cggggaaaagggcatgtaactcagagcattaattanggataacgagtttcaagcttagtgctacaaagaaa

SEQ ID NO: 7066 - DNA, 71 bp, chicken (Gallus Gallus)
  misc_feature (36): n=c or t
cggctgcctcccagcgagtacgttatcatcccatcnacatacgaaccccaccaggagggagaattcatcct

SEQ ID NO: 7067 - DNA, 71 bp, chicken (Gallus Gallus)
  misc_feature (36): n=a or g
atagtctggaagtacctagttctcttatgcagttanaatttcagaattgtaaaatcttgatttggaagaga

SEQ ID NO: 7068 - DNA, 71 bp, chicken (Gallus Gallus)
  misc_feature (36): n=a or t
aaacatgaaaagcaagttcccagaaaagctgttatngggagtgttaatgtgaactgatttagagtacactg

SEQ ID NO: 7069 - DNA, 71 bp, chicken (Gallus Gallus)
  misc_feature (36): n=c or t
tattcatgagagcagctggctgtcagctgctgcctntgcacaaacataacgagcgaagggcctctgcaccc

SEQ ID NO: 7070 - DNA, 71 bp, chicken (Gallus Gallus)
  misc_feature (36): n=a or g
ttaattgattctctaatctcttacatgctgtcaccnttcttcttcttctggctaacttcatctttgaatca

SEQ ID NO: 7071 - DNA, 71 bp, chicken (Gallus Gallus)
  misc_feature (36): n=c or t
actacattgctataatggtatgtactaatgggctanccattttctctcatgaccttgactttcttattaaa

SEQ ID NO: 7072 - DNA, 71 bp, chicken (Gallus Gallus)
  misc_feature (36): n=a or t
ttgaaaaggacaatgcttaaaatagatctcttccancttgggatctcccagcttaattcattctttcctat

SEQ ID NO: 7073 - DNA, 71 bp, chicken (Gallus Gallus)
  misc_feature (36): n=g or t
ggtatttttgttcttatgcttgccagccttgatacngttaactccctgagctgcatgtgctgtttggacac

SEQ ID NO: 7074 - DNA, 71 bp, chicken (Gallus Gallus)
  misc_feature (36): n=a or g
taaatataaaagcacaaagattatatttaagagcantaataaacaagacacaacctcactgacttacagag

SEQ ID NO: 7075 - DNA, 71 bp, chicken (Gallus Gallus)
  misc_feature (36): n=c or t
agaggaggaatatttgtagagagatctgtgaagatnaccacacacttcgctcaagctcagtattctgcccg

SEQ ID NO: 7076 - DNA, 71 bp, chicken (Gallus Gallus)
  misc_feature (36): n=a or g
caacgtggagcagttaagtctcacttgccaagtgcntggggttattcagggtaaaaccagcatcacggcag

SEQ ID NO: 7077 - DNA, 71 bp, chicken (Gallus Gallus)
  misc_feature (36): n=a or g
cagggcagggaagtcttcagctcactgcactccagnactgggaaaaaggaagaagacatttcaggcaaagg

SEQ ID NO: 7078 - DNA, 71 bp, chicken (Gallus Gallus)
  misc_feature (36): n=a or g
ctcagtccatcactatttgactgacagttgttagcntgctaccaagactgttctgggcccaagctcctctt

SEQ ID NO: 7079 - DNA, 71 bp, chicken (Gallus Gallus)
  misc_feature (36): n=c or t
attgattagatgggaattactgattatagataatcngaaataccgaacatcgctcttttaaatatagcaat

SEQ ID NO: 7080 - DNA, 71 bp, chicken (Gallus Gallus)
  misc_feature (36): n=c or t
ctgactgtagtcttcactctgctgcttcatctcttnttagctttctaaagcctgaaaatacctggggggat

SEQ ID NO: 7081 - DNA, 71 bp, chicken (Gallus Gallus)
  misc_feature (36): n=c or t
gctcctcagcaatcacagcaaaaaacggaatgctgnaaattcatactgggacagtccaaaaagagggagaa

SEQ ID NO: 7082 - DNA, 71 bp, chicken (Gallus Gallus)
  misc_feature (36): n=g or t
ggacacaggcctcaaccacagcgtgacatggggagntggtggaaagagttgccctgaagatagttgggaaa

SEQ ID NO: 7083 - DNA, 71 bp, chicken (Gallus Gallus)
  misc_feature (36): n=a or c
ctgccccactagtgaaaaacaagcagcccacaggangggtataaatatagctccttgagcagaatctgttt

SEQ ID NO: 7084 - DNA, 71 bp, chicken (Gallus Gallus)
  misc_feature (36): n=c or t
accagccacctctttcctcattgtgtccttgtgtcncatggagatgccaccttacagatgggcctaactca

SEQ ID NO: 7085 - DNA, 71 bp, chicken (Gallus Gallus)
  misc_feature (36): n=c or t
ggttaagaatgtcttaaaagtggggaaaaaaacttngttttgattttgcattatattaggcagaaaatcta

SEQ ID NO: 7086 - DNA, 71 bp, chicken (Gallus Gallus)
  misc_feature (36): n=a or c
aactgcttctcagagaaggcagacgtggaaatttgnttattgattttagaggggcaaacgatgttcactct

SEQ ID NO: 7087 - DNA, 71 bp, chicken (Gallus Gallus)
  misc_feature (36): n=a or g
agccaacaaacaaaagcaaatggaataaaagacaantaagtgcttagtaccacacactaactacagaaaat

SEQ ID NO: 7088 - DNA, 71 bp, chicken (Gallus Gallus)
  misc_feature (36): n=c or t
ttagctataagtgccatgcctatatatgcacaggantatgcatcaaaagagctgaatgcatttcttttgtg

SEQ ID NO: 7089 - DNA, 71 bp, chicken (Gallus Gallus)
  misc_feature (36): n=c or t
aaaagcacacaatgcttctatgtttaccttcagatnttcgtgacttactacctttactcagcctgcaactt

SEQ ID NO: 7090 - DNA, 71 bp, chicken (Gallus Gallus)
  misc_feature (36): n=c or t
taacctggatttaggccctttgaccatctgtcttcncaagcagctgttagcccattgcagataagtctaac

SEQ ID NO: 7091 - DNA, 71 bp, chicken (Gallus Gallus)
  misc_feature (36): n=g or t
atcagaactggaccatgtagtttcaagcaaattgtnttcctcctgaaaatggtagactgccagagtgctca

SEQ ID NO: 7092 - DNA, 71 bp, chicken (Gallus Gallus)
  misc_feature (36): n=g or t
cctacatcctctgaatgtctgactgtgatgtccctnaaatatctttctgaattccttatcaacttaaaaac

SEQ ID NO: 7093 - DNA, 71 bp, chicken (Gallus Gallus)
  misc_feature (36): n=c or t
ccttggaatagagggcctgtgtttcagatttgcatngtgaaaaagttcagaacatgtttattaaggtacca

SEQ ID NO: 7094 - DNA, 71 bp, chicken (Gallus Gallus)
  misc_feature (36): n=a or g
acttagaagtgtagataagagcacgttaggaaaatntgaagttcttttttatttagctgccccattttctg

SEQ ID NO: 7095 - DNA, 71 bp, chicken (Gallus Gallus)
  misc_feature (36): n=g or t
atgaataaacacagaatttcaagcttctttcactcntggtgaagaacaatacaggtattgagcacagttaa

SEQ ID NO: 7096 - DNA, 71 bp, chicken (Gallus Gallus)
  misc_feature (36): n=g or t
tgatagctactactgtctgctggctctgcaaaagtnaaagtccacacatagaaaaggctacagtgcttctt

SEQ ID NO: 7097 - DNA, 71 bp, chicken (Gallus Gallus)
  misc_feature (36): n=c or t
agtctaccaagcactgaactgaaagataagcataangtgtaagaaaccttcaagaacagctttatgagtaa

SEQ ID NO: 7098 - DNA, 71 bp, chicken (Gallus Gallus)
  misc_feature (36): n=a or g
ctatataatacatttctctgagctaaatctgtattnactagacctgaactggtgtctgactggttttcttc

SEQ ID NO: 7099 - DNA, 71 bp, chicken (Gallus Gallus)
  misc_feature (36): n=a or g
catctatttagatatgacagtaagtaagcggaaaanggaagtgctgttactgatttcatttaaaatgctgg

SEQ ID NO: 7100 - DNA, 71 bp, chicken (Gallus Gallus)
  misc_feature (36): n=a or g
ctaactttcaacattcaccagcttccaggaaacatnattcacctggaaacccaggggcttttcttctgctc

SEQ ID NO: 7101 - DNA, 71 bp, chicken (Gallus Gallus)
  misc_feature (36): n=a or g
ggagaccttatagttccctacacaataccttacacnaggttgtgatgaggtgggggttggcctcttatccc

SEQ ID NO: 7102 - DNA, 71 bp, chicken (Gallus Gallus)
  misc_feature (36): n=a or g
gccagcaccctgctgtaccggggctctacagacagnttgctctgccagagagaaggaaagctcatgattat

SEQ ID NO: 7103 - DNA, 71 bp, chicken (Gallus Gallus)
  misc_feature (36): n=c or t
tttagcctggaaagctgcaacagcacaagaataggnagtcggtaagtcttctcctaaaccacccagttcag

SEQ ID NO: 7104 - DNA, 71 bp, chicken (Gallus Gallus)
  misc_feature (36): n=c or t
tgcccaagctccaacctcaggaggacgcagcctccngctgagcaagaggcaggaagtgagagtcataaaac

SEQ ID NO: 7105 - DNA, 71 bp, chicken (Gallus Gallus)
  misc_feature (36): n=a or g
cataattgttaatttcagtttagcttctcacttaancctcactttcttcattcccgatgtcacttctacac

SEQ ID NO: 7106 - DNA, 71 bp, chicken (Gallus Gallus)
  misc_feature (36): n=a or g
tggggcacatccatattgaccagtggttgactaacnttgaccatgagcctgcagtgtgctctgatggccaa

SEQ ID NO: 7107 - DNA, 71 bp, chicken (Gallus Gallus)
  misc_feature (36): n=c or t
gaactcagagtccaccaacttcacccacatcagaangccaccactggaacctatgacatcagtaaggaggc

SEQ ID NO: 7108 - DNA, 71 bp, chicken (Gallus Gallus)
  misc_feature (36): n=g or t
tcagatgagattagcagttcttttactgttgtgaanattctctgtgcttgagatagtccttctaccattgt

SEQ ID NO: 7109 - DNA, 71 bp, chicken (Gallus Gallus)
  misc_feature (36): n=a or g
tgatcgaggggagcgtgaattcctgtcatgattacntagctctaaaagcttacaataaagcaggcaatatc

SEQ ID NO: 7110 - DNA, 71 bp, chicken (Gallus Gallus)
  misc_feature (36): n=c or t
tatattgccatttgtaattagggcttcttacttacngttcattttaacctacaggaaataatttcttatga

SEQ ID NO: 7111 - DNA, 71 bp, chicken (Gallus Gallus)
  misc_feature (36): n=c or t
ggctcatgctgtacatgtgctgtgggcaagcactcngtcctttgcttttgcagacagtgcttgtggtactg

SEQ ID NO: 7112 - DNA, 71 bp, chicken (Gallus Gallus)
  misc_feature (36): n=c or t
gatgcagtctgtttgagccttctgtttctgttctgntgccagaagccaccaaaaaaattccttagttgcct

SEQ ID NO: 7113 - DNA, 71 bp, chicken (Gallus Gallus)
  misc_feature (36): n=c or t
ttatgtccctttcttgcaacacagagagtgtaatangaattgcactgattacgtcttatgtcagtcatttt

SEQ ID NO: 7114 - DNA, 71 bp, chicken (Gallus Gallus)
  misc_feature (36): n=a or g
aacctgcggttagctgaccactgaggtcagaccatntttcagaaggcagttactggcagattcaggtgttt

SEQ ID NO: 7115 - DNA, 71 bp, chicken (Gallus Gallus)
  misc_feature (36): n=c or t
ctagtaaacactctcttaaaagcttaaagctagtangtgatcctgcatgtcaacatgaagataagtcagaa

SEQ ID NO: 7116 - DNA, 71 bp, chicken (Gallus Gallus)
  misc_feature (36): n=g or t
tttctcctataaggaggtgaaaacaaagaagagagnatttcacatctgtcacatgagcacccgacagaagc

SEQ ID NO: 7117 - DNA, 71 bp, chicken (Gallus Gallus)
  misc_feature (36): n=c or t
cactatttgccactatagagagctgctgcagctagnaacttttcttgggagttctgtttaaagcaagcgta

SEQ ID NO: 7118 - DNA, 71 bp, chicken (Gallus Gallus)
  misc_feature (36): n=g or t
ggttgaagatgaaagctgcaattgtcccagcagatnaaaaggagatgtagacagaaaagccccctctcccc

SEQ ID NO: 7119 - DNA, 71 bp, chicken (Gallus Gallus)
  misc_feature (36): n=g or t
gcaggtggtgtcagagagggttgggagtattagctnatgtaacagcagtataactgacttggttcttgcct

SEQ ID NO: 7120 - DNA, 71 bp, chicken (Gallus Gallus)
  misc_feature (36): n=a or g
gtaaatacaaaacactatttttcaacataatcaccnccatcagccatgcgtttttgccggcaatgagcaag

SEQ ID NO: 7121 - DNA, 71 bp, chicken (Gallus Gallus)
  misc_feature (36): n=c or t
tagagtggttcctatcaattatcgtctttgcaaatncttcagagtttacaatagctgtgccacactgaaaa

SEQ ID NO: 7122 - DNA, 71 bp, chicken (Gallus Gallus)
  misc_feature (36): n=c or t
tcagctctcaaaaagcttgggagaaacttaagcacngttgacaatctttctagtgtgataaagcatcctgc

SEQ ID NO: 7123 - DNA, 71 bp, chicken (Gallus Gallus)
  misc_feature (36): n=c or t
tgaaaaaaaaaccctagcttacctgaaccagaatanaaacagtaaaagcagatgacttcttaataaaggac

SEQ ID NO: 7124 - DNA, 71 bp, chicken (Gallus Gallus)
  misc_feature (36): n=c or t
cagtaggaaagtttatttagtaaagtgcaataagcnatttttagactgaaatctgtcatcaaagagccacc

SEQ ID NO: 7125 - DNA, 71 bp, chicken (Gallus Gallus)
  misc_feature (36): n=a or g
attccttttatcttgacatagaggaagatttgtagnctgttagctaaagtgaaatatagttgtataaagaa

SEQ ID NO: 7126 - DNA, 71 bp, chicken (Gallus Gallus)
  misc_feature (36): n=a or g
ctgaggatgggctttcagtagtgccatgctttcacntaacagtgtaatgccttcctgcttatccaaaaaag

SEQ ID NO: 7127 - DNA, 71 bp, chicken (Gallus Gallus)
  misc_feature (36): n=a or g
caaaagggattctgcaaagatagctttgaacatatnacagaaagcactttaagattagctaggcaccttgg

SEQ ID NO: 7128 - DNA, 71 bp, chicken (Gallus Gallus)
  misc_feature (36): n=a or c
taaattaaccagattaccctgtgttgtaagattcancagcttgtgccagttagtctcccatagattttata

SEQ ID NO: 7129 - DNA, 71 bp, chicken (Gallus Gallus)
  misc_feature (36): n=a or g
aaaatgattctgctgtacgagatataaatcaggtgntttaattgttagggtattgtcagctcaactgtaac

SEQ ID NO: 7130 - DNA, 71 bp, chicken (Gallus Gallus)
  misc_feature (36): n=c or t
atgatagggaactagaagcatttgagaagctgcagngctcccatttgctcttgacagagtcagtctcgaga

SEQ ID NO: 7131 - DNA, 71 bp, chicken (Gallus Gallus)
  misc_feature (36): n=c or g
acagcacagggttatattgtcctgatggatgcatgnagatttgcttaggcaattcctggaaatatggagag

SEQ ID NO: 7132 - DNA, 71 bp, chicken (Gallus Gallus)
  misc_feature (36): n=a or g
tatcagagtagtgcatagaacccaataatctgtatntcctggtatctttaatgggtaattcttagaaggaa

SEQ ID NO: 7133 - DNA, 71 bp, chicken (Gallus Gallus)
  misc_feature (36): n=a or g
tcagcaagcttgagtgactggaagatgacccaatgngttccaaagaatcatagaattgtaggggttggaag

SEQ ID NO: 7134 - DNA, 71 bp, chicken (Gallus Gallus)
  misc_feature (36): n=a or c
ggaaagccaagagacccacagccttgcccagcatgnctgccagatattcagaaactcatttcccactgact

SEQ ID NO: 7135 - DNA, 71 bp, chicken (Gallus Gallus)
  misc_feature (36): n=c or g
cgccgtggccatcctcaaccaggaggtctccataanagccccatccatgagctgatatccccatcccatcc

SEQ ID NO: 7136 - DNA, 71 bp, chicken (Gallus Gallus)
  misc_feature (36): n=c or t
atcttccaaaaaaagaatcagtctgatgcatgcacntgacatagaaattttcagcctgaatggttaatatg

SEQ ID NO: 7137 - DNA, 71 bp, chicken (Gallus Gallus)
  misc_feature (36): n=a or g
aaccactaaaccaccctgatttatttcattttatanatatgcctatacggacaccctaaatatgttttttc

SEQ ID NO: 7138 - DNA, 71 bp, chicken (Gallus Gallus)
  misc_feature (36): n=a or g
tgaaggaagtacagacattgggtttggtgatgtccntcatttgtggattcggcataaactttatagaaatg

SEQ ID NO: 7139 - DNA, 71 bp, chicken (Gallus Gallus)
  misc_feature (36): n=a or t
ttacttcaaggagcaaaactctgcatgttcagtgcncaatgtacatttacagtcatgtgtttaataacaaa

SEQ ID NO: 7140 - DNA, 71 bp, chicken (Gallus Gallus)
  misc_feature (36): n=a or c
ctcttaatacagttaaaatattgcacaaccatgtgnaaacacctccaaagcttctggataagttacattaa

SEQ ID NO: 7141 - DNA, 71 bp, chicken (Gallus Gallus)
  misc_feature (36): n=c or t
gtaccgtctcacagtttcacatacttcttttccagnggatcaggcaaacgatttcagaaccctggctttct

SEQ ID NO: 7142 - DNA, 71 bp, chicken (Gallus Gallus)
  misc_feature (36): n=c or t
cagaagcaggtgtacctttaaataacatatgaatgngatcaataatgcaagctgatgaggaggaacttaag

SEQ ID NO: 7143 - DNA, 71 bp, chicken (Gallus Gallus)
  misc_feature (36): n=g or t
acctgtatctgttttaagaattaaaaatgttccagngtgccaaattttgccttgccaaattccagttccag

SEQ ID NO: 7144 - DNA, 71 bp, chicken (Gallus Gallus)
  misc_feature (36): n=a or g
aggatggctaatctatagcaaggtgacacacttccnctaatttggttttatttaaaaaccgccgtttccca

SEQ ID NO: 7145 - DNA, 71 bp, chicken (Gallus Gallus)
  misc_feature (36): n=c or t
ggaagccattttatagttggacattacgattacttnaatggatttgagtgaagcagcttgagacatgaggc

SEQ ID NO: 7146 - DNA, 71 bp, chicken (Gallus Gallus)
  misc_feature (36): n=c or t
caggcttataattcaaaataactctttgaaggactntatgaactctctctgtgttctccctgtgtgatcta

SEQ ID NO: 7147 - DNA, 71 bp, chicken (Gallus Gallus)
  misc_feature (36): n=c or t
cagtcaccttaggaaaaagaatttaacttgtgtgtntacattattgtgttacattacagtaaatctacatg

SEQ ID NO: 7148 - DNA, 71 bp, chicken (Gallus Gallus)
  misc_feature (36): n=a or g
ttttttattttccctgtagaggtctatggttaagtnctttaaaactcttgttgtcttttcatctagttctt

SEQ ID NO: 7149 - DNA, 71 bp, chicken (Gallus Gallus)
  misc_feature (36): n=c or t
gctcaaaacaaaggcataaaccctgcaatgcatgangcagtgcagccccagtgctgagcccccagggaagc

SEQ ID NO: 7150 - DNA, 71 bp, chicken (Gallus Gallus)
  misc_feature (36): n=c or t
tagaggtacgagtttagaagaagagctgggcagtanccaaccactcatttttaaggaattctgtagaattc

SEQ ID NO: 7151 - DNA, 71 bp, chicken (Gallus Gallus)
  misc_feature (36): n=c or t
agcaaaatttagctgaacttcaaagatgtgcatgtnatatattaatttcatgtaacagaatgtcagtaata

SEQ ID NO: 7152 - DNA, 71 bp, chicken (Gallus Gallus)
  misc_feature (36): n=c or t
aaggttggatctgggggaggtacgtattaattggcnggatttttattaaatacatttacatagcatcatgc

SEQ ID NO: 7153 - DNA, 71 bp, chicken (Gallus Gallus)
  misc_feature (36): n=a or g
tgcatgctttgaatatgtcaccttcagtaggtcatngagcagcttactgcattacacaggctgtccatcta

SEQ ID NO: 7154 - DNA, 71 bp, chicken (Gallus Gallus)
  misc_feature (36): n=g or t
ggggatttgttccacgttgggagaactgtactcacncacaactccagcaacaggcttcgcttcagcctccc

SEQ ID NO: 7155 - DNA, 71 bp, chicken (Gallus Gallus)
  misc_feature (36): n=c or t
gaaagaccactaagataatctagtccaatcctcaantcatcactaccacgtcactcagtgagacatccaca

SEQ ID NO: 7156 - DNA, 71 bp, chicken (Gallus Gallus)
  misc_feature (36): n=a or t
ggaaggtcccaagtcttaatcgtacagtccattgangaagttattagccaacgaccatcaggactgaaagt

SEQ ID NO: 7157 - DNA, 71 bp, chicken (Gallus Gallus)
  misc_feature (36): n=a or c
ctcattttccccagcttgcaggacaaaacttatacncatgcttaacattcgctcattttgctttttatatc

SEQ ID NO: 7158 - DNA, 71 bp, chicken (Gallus Gallus)
  misc_feature (36): n=c or t
agacactcccgtaaacgatgggagcgctttgttcanagcgagaaccaacatctggtgagtcctgaagctct

SEQ ID NO: 7159 - DNA, 71 bp, chicken (Gallus Gallus)
  misc_feature (36): n=a or g
atgtggctgttttcgggtacacgacagcctgagggngacccaggtttaaaatgcatctccagataaagcag

SEQ ID NO: 7160 - DNA, 71 bp, chicken (Gallus Gallus)
  misc_feature (36): n=g or t
tctgttactaaatgatcccaggtggcagtgtatcanccaaaaggcaaaaatagctgtcatccatagcacta

SEQ ID NO: 7161 - DNA, 71 bp, chicken (Gallus Gallus)
  misc_feature (36): n=a or g
gctctgctctgcttagcttctgcagctttcagactngcagaggagagcacatacctgcacctcacttattt

SEQ ID NO: 7162 - DNA, 71 bp, chicken (Gallus Gallus)
  misc_feature (36): n=c or t
atgaaaacttgagtttatctgccttcagctgcttcngtggttcttcagaaataaaaacaacagaacatgct

SEQ ID NO: 7163 - DNA, 71 bp, chicken (Gallus Gallus)
  misc_feature (36): n=a or g
ccctcagactgttctaactggggactacagtttgcnctgcaagctttgctctatggagctgcacttcccaa

SEQ ID NO: 7164 - DNA, 71 bp, chicken (Gallus Gallus)
  misc_feature (36): n=a or g
tttctgggtgattaagtaaaaagtaacatttgttcngtatgttctgtcactgtgcgtatggaatcggacat

SEQ ID NO: 7165 - DNA, 71 bp, chicken (Gallus Gallus)
  misc_feature (36): n=c or t
ccttcggtagcccattctaatacaacatcactcttncagagaagaaatttttcctaatatctgacttgaac

SEQ ID NO: 7166 - DNA, 71 bp, chicken (Gallus Gallus)
  misc_feature (36): n=c or t
accactgaagtacgactcatgagaagtaaggcatgnaaatctaactcaaaatccaaaaggagcaatgggca

SEQ ID NO: 7167 - DNA, 71 bp, chicken (Gallus Gallus)
  misc_feature (36): n=c or t
catgacatcagctttcgtcaaattcctctgtctttnggacagaataattattaactgtattccttaaatcc

SEQ ID NO: 7168 - DNA, 71 bp, chicken (Gallus Gallus)
  misc_feature (36): n=a or c
gtaatctaccaagatttggcaatactacaaacatgnaggaaaagccctcagtacaggagtccttggtacag

SEQ ID NO: 7169 - DNA, 71 bp, chicken (Gallus Gallus)
  misc_feature (36): n=c or t
ccctctaggagctgggatggaaaaagggacagaggntttcaaggatgccccagaaatgcttgggattgtga

SEQ ID NO: 7170 - DNA, 71 bp, chicken (Gallus Gallus)
  misc_feature (36): n=a or g
ctgtatttgaaacccagtgaaagattgccagagctnttagcttttatgtttattactgttgttcttcaaat

SEQ ID NO: 7171 - DNA, 71 bp, chicken (Gallus Gallus)
  misc_feature (36): n=a or g
tttaaggtgaagggctcaattctctgctgcagtgantcacttagtaggttaaacaaacaaatctatggtaa

SEQ ID NO: 7172 - DNA, 71 bp, chicken (Gallus Gallus)
  misc_feature (36): n=a or t
tggcctctttggatttcagcatgattaacctgtgtnatacaagctcataccttcacctggaatggtaacca

SEQ ID NO: 7173 - DNA, 71 bp, chicken (Gallus Gallus)
  misc_feature (36): n=a or g
atacaacatcttcagctgaaagcatgttcagtaccnacaatcttgcttcactggaaagtgtattcaaccaa

SEQ ID NO: 7174 - DNA, 71 bp, chicken (Gallus Gallus)
  misc_feature (36): n=c or t
catggtgattgtcacagataatgaatcacttgtgtngctactgtgtgcaaaagataggttacaattactca

SEQ ID NO: 7175 - DNA, 71 bp, chicken (Gallus Gallus)
  misc_feature (36): n=a or g
accagcaagctgcttctcaggttcagggaagtaacngagcagatcctcctggaaatcatttcagccacatt

SEQ ID NO: 7176 - DNA, 71 bp, chicken (Gallus Gallus)
  misc_feature (36): n=a or c
tttgcctacccatttctgagatatctgtaattgagngatgccatttaacagtgcttcagtgatgctactcg

SEQ ID NO: 7177 - DNA, 71 bp, chicken (Gallus Gallus)
  misc_feature (36): n=a or g
taaaaaagtatgattaaaaaagtgcagatctgatcncttgcattctgttgtagactgtgtgttgaatacca

SEQ ID NO: 7178 - DNA, 71 bp, chicken (Gallus Gallus)
  misc_feature (36): n=c or t
aaatcatgcttctggggctactgcacaaatctgganaacagatcaaagcacatctcacagcttcaaaagtc

SEQ ID NO: 7179 - DNA, 71 bp, chicken (Gallus Gallus)
  misc_feature (36): n=a or g
gccgtgtgaggaaactcaatattacaatggatcaantgccatgccacatggagctgacgtgctgctgtgcg

SEQ ID NO: 7180 - DNA, 71 bp, chicken (Gallus Gallus)
  misc_feature (36): n=a or g
ggagtgctgtagccctccaatctgctctcagtaaancatttgtccctccatgctaactgctgcatgcccat

SEQ ID NO: 7181 - DNA, 71 bp, chicken (Gallus Gallus)
  misc_feature (36): n=a or c
tgatagcactggtacagatgaatcaagtgccacttnaggttagtttggcttgttgctgaacatcattctgg

SEQ ID NO: 7182 - DNA, 71 bp, chicken (Gallus Gallus)
  misc_feature (36): n=c or t
ctgagcttgtgtttgcccagggacatacaggaattnggctacctgcaagaatcatcagataataaccttca

SEQ ID NO: 7183 - DNA, 71 bp, chicken (Gallus Gallus)
  misc_feature (36): n=c or t
ttttaaaatagctattgaagtatggatttgaaagtncaaaacatcaaaaagcaaatttgagaagtgatacc

SEQ ID NO: 7184 - DNA, 71 bp, chicken (Gallus Gallus)
  misc_feature (36): n=a or g
gagtgattgtcttcccttagtaatacaaagtgaagnctgattataaactccagaaagaattagtggcactc

SEQ ID NO: 7185 - DNA, 71 bp, chicken (Gallus Gallus)
  misc_feature (36): n=a or g
ttgcgggtggctgttgccatgagggcattaaaaacngagccgtaggtgagcactgccttagtaacacatct

SEQ ID NO: 7186 - DNA, 71 bp, chicken (Gallus Gallus)
  misc_feature (36): n=a or g
tgaagaagagttgtcagcattcaactgtgttttaanctccaccagaggaatctgggacatgagtttttatg

SEQ ID NO: 7187 - DNA, 71 bp, chicken (Gallus Gallus)
  misc_feature (36): n=a or g
gcaccaaatctacctacctccatctgctccccagcntttgtcagcgttcatttttataagaaattgagagt

SEQ ID NO: 7188 - DNA, 71 bp, chicken (Gallus Gallus)
  misc_feature (36): n=g or t
tgtgacctgaactaacagagtagctgtcaaaaagtngtgcatgatgtttgggtttttttattactaatccg

SEQ ID NO: 7189 - DNA, 71 bp, chicken (Gallus Gallus)
  misc_feature (36): n=c or t
ctgaattcatattgatatttgatgggcagaagtcancttgtcagcaaatcagagagctggctgtccaggtg

SEQ ID NO: 7190 - DNA, 71 bp, chicken (Gallus Gallus)
  misc_feature (36): n=a or g
ttctcagttctctttccttctgaggctgttttaatntgaccatgggaactcattccctagcagccccagtg

SEQ ID NO: 7191 - DNA, 71 bp, chicken (Gallus Gallus)
  misc_feature (36): n=c or t
cttcctaatctgtttcagacaaaatgtaaccacagnccatattttctaacctgactggcttttgcctggag

SEQ ID NO: 7192 - DNA, 71 bp, chicken (Gallus Gallus)
  misc_feature (36): n=c or t
ttctaagcagagtaattcagattatatgagacatcnactagatgagtggcctcatgcagtgagtgtcctta

SEQ ID NO: 7193 - DNA, 71 bp, chicken (Gallus Gallus)
  misc_feature (36): n=a or c
ttacagaatgttgatccctttctccaccatttcaantgtttatttaccaaaattctctcactaatcctctt

SEQ ID NO: 7194 - DNA, 71 bp, chicken (Gallus Gallus)
  misc_feature (36): n=a or g
acagattatacatacaattttcaagtagagcaaaangctttgtttctttttcccccctcattttttaaaga

SEQ ID NO: 7195 - DNA, 71 bp, chicken (Gallus Gallus)
  misc_feature (36): n=a or t
gtgatggtcattacacaagaactaattactactgangaagagcactgttgtggactgcaaggcattgcagg

SEQ ID NO: 7196 - DNA, 71 bp, chicken (Gallus Gallus)
  misc_feature (36): n=c or t
ccctcctggcaccagcagttatatctctttctattncccttaagctcttctgaacctgttgctcggaatga

SEQ ID NO: 7197 - DNA, 71 bp, chicken (Gallus Gallus)
  misc_feature (36): n=a or g
gagccaggcatgctctgaaaattattctctggctgntgaggacccatatggcattctctctttagctttta

SEQ ID NO: 7198 - DNA, 71 bp, chicken (Gallus Gallus)
  misc_feature (36): n=c or t
ctgccccctctgggtgttcctgagtaaaattagctngcagcagaactccctacaggtgattggcagcagtt

SEQ ID NO: 7199 - DNA, 71 bp, chicken (Gallus Gallus)
  misc_feature (36): n=c or t
aattaccttcctaacgcaaatcagtgggtcagacanaataatacgttgcatttcacttcaccaaatgttag

SEQ ID NO: 7200 - DNA, 71 bp, chicken (Gallus Gallus)
  misc_feature (36): n=g or t
atctgatcatggctgtttttcaaaggcagctctttncaatctatccacttcttaacgcagagagcaactcc

SEQ ID NO: 7201 - DNA, 71 bp, chicken (Gallus Gallus)
  misc_feature (36): n=a or c
ccagttagtgtaaagatcagtgcatgcgttggcagnagagttttttactagccaggcaggcaaacctagtt

SEQ ID NO: 7202 - DNA, 71 bp, chicken (Gallus Gallus)
  misc_feature (36): n=a or g
taatgaagagtgtagttgccagctgttagtctgggnagttattttaagctttaagtgcttgtttaagaatc

SEQ ID NO: 7203 - DNA, 71 bp, chicken (Gallus Gallus)
  misc_feature (36): n=a or g
actctgattgtataaaaaagatggttatttcagtgntcctactttgagttattcaaaccaacagcgtatta

SEQ ID NO: 7204 - DNA, 71 bp, chicken (Gallus Gallus)
  misc_feature (36): n=a or g
tttacagatctttctctatgctgtaggaagccaagncttcttctagagaagctccatccaaagaggatgct

SEQ ID NO: 7205 - DNA, 71 bp, chicken (Gallus Gallus)
  misc_feature (36): n=c or t
aaggtaatctcatgttatagatttctttctttccangaagctatctggaataaataatgtgaattctttct

SEQ ID NO: 7206 - DNA, 71 bp, chicken (Gallus Gallus)
  misc_feature (36): n=a or g
gccttgctcacctgctccccagctcccttggcaaancttgactgtatgtgtgaggaatgcgctcctttacg

SEQ ID NO: 7207 - DNA, 71 bp, chicken (Gallus Gallus)
  misc_feature (36): n=a or g
atgtgtgacaccatacaggtgatttcactctgctcngatgtagctgggggactgtacacacaataaggaca

SEQ ID NO: 7208 - DNA, 71 bp, chicken (Gallus Gallus)
  misc_feature (36): n=a or g
tgggctgcaaggtccttttcatcccagccgttcccnatgatacccaatgctatgccatgcgacagttccat

SEQ ID NO: 7209 - DNA, 71 bp, chicken (Gallus Gallus)
  misc_feature (36): n=c or t
tatcataatcttcataaaaatcattatacactagtnctactctcatatgttgtagagcaccacatacatta

SEQ ID NO: 7210 - DNA, 71 bp, chicken (Gallus Gallus)
  misc_feature (36): n=g or t
ggtcgtggggagagcaacagcaacggcactccgggngcgtttatggcatcataccgcatcagtgtgggctg

SEQ ID NO: 7211 - DNA, 71 bp, chicken (Gallus Gallus)
  misc_feature (36): n=c or g
agccttccttacagttcctctaaccttcaagagganagacttacagtttgtttatatacaatcaccatcac

SEQ ID NO: 7212 - DNA, 71 bp, chicken (Gallus Gallus)
  misc_feature (36): n=a or c
cgtccttaaagtggccgacaaaatccctttaagttntgagacacaggataaaagacacaagaggatggtgg

SEQ ID NO: 7213 - DNA, 71 bp, chicken (Gallus Gallus)
  misc_feature (36): n=g or t
tgacatcatcagaaatatggaagtactgagtttacnaacacaggctaataggaagctgggttttgatgaga

SEQ ID NO: 7214 - DNA, 71 bp, chicken (Gallus Gallus)
  misc_feature (36): n=a or g
tgtcacttcagaaagcttctcagcttaaacacttgncaactgacggagctgttcaacttttagtgaatgag

SEQ ID NO: 7215 - DNA, 71 bp, chicken (Gallus Gallus)
  misc_feature (36): n=c or t
ccccagtcttaatcacaaagctccacctaatggagngagaagagaattgtacagagaaaaaggaacacaga

SEQ ID NO: 7216 - DNA, 71 bp, chicken (Gallus Gallus)
  misc_feature (36): n=c or t
ggttccaccccacagaaaagatgctggtgcaggctnagcatggactttgtgcagtgtacattgggaaccta

SEQ ID NO: 7217 - DNA, 71 bp, chicken (Gallus Gallus)
  misc_feature (36): n=c or t
gttacctcttcctgtgttgactgtggtctttataanagaccatgaagtcttaaagccttaaaatactcctt

SEQ ID NO: 7218 - DNA, 71 bp, chicken (Gallus Gallus)
  misc_feature (36): n=c or g
gtcatctctctgtaatcatgcaagtcttggaccagnctttgacatttttataacaatttagaagaaacaac

SEQ ID NO: 7219 - DNA, 71 bp, chicken (Gallus Gallus)
  misc_feature (36): n=a or g
cgtgtctagaatcaaagcaacattgactttttaaanccagcaaacaggttacacagctaattataaaagaa

SEQ ID NO: 7220 - DNA, 71 bp, chicken (Gallus Gallus)
  misc_feature (36): n=c or t
cttaaagaacttacctactggcagatgttcaaagangtaagtcaaattcaaaacaaacatgttagtaaacc

SEQ ID NO: 7221 - DNA, 71 bp, chicken (Gallus Gallus)
  misc_feature (36): n=c or t
tgaagctatgaataatatgggaaaaataaacacaancctttccccactcttttgcatctcagaccaagggc

SEQ ID NO: 7222 - DNA, 71 bp, chicken (Gallus Gallus)
  misc_feature (36): n=a or g
aattggtaaacacttgagtttttaaatgaattttancaacaaaaaatgaatacattctgggtgtttcatat

SEQ ID NO: 7223 - DNA, 71 bp, chicken (Gallus Gallus)
  misc_feature (36): n=c or g
ggaaaccccaaagcaggagaaaaagaggagctactnattcaaactgcctcagccagcattgctcaaagttt

SEQ ID NO: 7224 - DNA, 71 bp, chicken (Gallus Gallus)
  misc_feature (36): n=c or t
atgaggaaaaagtcttttgctgatgacaggctgttnctgttggagcaatgggaatgcaagttataagacag

SEQ ID NO: 7225 - DNA, 71 bp, chicken (Gallus Gallus)
  misc_feature (36): n=c or t
ataaactttccagttctcatctgcagccagctaagnaatgttgcctcttcccagagctgtttgccctgttt

SEQ ID NO: 7226 - DNA, 71 bp, chicken (Gallus Gallus)
  misc_feature (36): n=a or t
taatttgttttgattttatcaaaagaacttcaaatnatttcctgtaacttttactctcacttagttgtaat

SEQ ID NO: 7227 - DNA, 71 bp, chicken (Gallus Gallus)
  misc_feature (36): n=c or t
cttgctactgatccacgtacctgaatgcaggtcccngtgcattccttgcagaggctgcaggacagagccca

SEQ ID NO: 7228 - DNA, 71 bp, chicken (Gallus Gallus)
  misc_feature (36): n=a or t
atcatatgctcccaaattcaatagatcctttaaccngcttactttccacaagccctagagcagtctgaaac

SEQ ID NO: 7229 - DNA, 71 bp, chicken (Gallus Gallus)
  misc_feature (36): n=c or t
tcacagtcacacgcccggtgctttgatctgtcccantgctggaatcagtcaacttttctcttgaagtgcag

SEQ ID NO: 7230 - DNA, 71 bp, chicken (Gallus Gallus)
  misc_feature (36): n=a or g
aataaaagatactgggagcaacctttggaagatctnctgagctccaccagaacattgtagaaccagatcgg

SEQ ID NO: 7231 - DNA, 71 bp, chicken (Gallus Gallus)
  misc_feature (36): n=c or t
atttctagaacagttgtctgggccatgtgagctgcntttctagcactccagctgactccaggagctgaatt

SEQ ID NO: 7232 - DNA, 71 bp, chicken (Gallus Gallus)
  misc_feature (36): n=a or t
agttcagatcaatgggggtataaaccatggcaaatnagccaccgcaacattactgaagcattggcattgat

SEQ ID NO: 7233 - DNA, 71 bp, chicken (Gallus Gallus)
  misc_feature (36): n=a or g
atttagaggaggtctctccagcagtatggagcatcntaaaacagataataaatacttcttttaattagtac

SEQ ID NO: 7234 - DNA, 71 bp, chicken (Gallus Gallus)
  misc_feature (36): n=a or g
caccagggcctgagtaccattttctcctgcgaaccngctgcccatcccacactccatctcatgtattcccc

SEQ ID NO: 7235 - DNA, 71 bp, chicken (Gallus Gallus)
  misc_feature (36): n=g or t
gtgctaggcatttctgaggaggaaaatatctggggnccacaacccagcagcttttacattcagggtcctta

SEQ ID NO: 7236 - DNA, 71 bp, chicken (Gallus Gallus)
  misc_feature (36): n=a or t
tctggacaaagaggatttgattgcatctgtgattcngagagtgtcttttcagtggaaacacatggagaggg

SEQ ID NO: 7237 - DNA, 71 bp, chicken (Gallus Gallus)
  misc_feature (36): n=g or t
ggatgtgtgcaggaatgcccagctccatgtgcttcnttagatggccaaggtgcactgttagaggagcaagg

SEQ ID NO: 7238 - DNA, 71 bp, chicken (Gallus Gallus)
  misc_feature (36): n=c or t
gctattgatttttgaagatacacctgaacaattacnttctgttaaacaagaaactgatcaatactagcagg

SEQ ID NO: 7239 - DNA, 71 bp, chicken (Gallus Gallus)
  misc_feature (36): n=a or g
agagcagtggggtataaaagaaaatgtaaagagatntaaagcagatataaacactgctgctacagaacagc

SEQ ID NO: 7240 - DNA, 71 bp, chicken (Gallus Gallus)
  misc_feature (36): n=c or t
gctgctgctgtgctcaccaccatcaatgattgaggnggagcgagggggctgatgctgcagcgggaggcaga

SEQ ID NO: 7241 - DNA, 71 bp, chicken (Gallus Gallus)
  misc_feature (36): n=a or g
gcagctgtattcatctacacacatgtcaatggctgncagttgcagctgggcacttctctctcattcctagc

SEQ ID NO: 7242 - DNA, 71 bp, chicken (Gallus Gallus)
  misc_feature (36): n=c or g
caggccaccaatgtcagctccttcacctggactatntttgggcagagacaaagctctgtccagcatgcctc

SEQ ID NO: 7243 - DNA, 71 bp, chicken (Gallus Gallus)
  misc_feature (36): n=a or c
aaaataagtggagacatgggaaaacaggcgagcaangctgaaaggcaaagaagcagattgcgacaaccgag

SEQ ID NO: 7244 - DNA, 71 bp, chicken (Gallus Gallus)
  misc_feature (36): n=a or g
aggctaaggagtcaaaaatataaaaagagaaagagngaaaagagggagaaaaataattaggaaggtatgga

SEQ ID NO: 7245 - DNA, 71 bp, chicken (Gallus Gallus)
  misc_feature (36): n=a or g
tggaagacagggaactgatacaggagaacctgcatngtttcaccaagggcaaatcctacttgaccaaccta

SEQ ID NO: 7246 - DNA, 71 bp, chicken (Gallus Gallus)
  misc_feature (36): n=g or t
gcttattcttaactccgatttcacttgctcttgcancacattttttgatttaaaactgctgatggttgtga

SEQ ID NO: 7247 - DNA, 71 bp, chicken (Gallus Gallus)
  misc_feature (36): n=a or g
ctattgctttgaaaaacattagcagcttgtcagttntatgttattttgtatttgattgtgtttgatctgtg

SEQ ID NO: 7248 - DNA, 71 bp, chicken (Gallus Gallus)
  misc_feature (36): n=a or g
aggcaccggaagattttgatgagcatcttctcatcnttgcctgctttctccacacacgtcatctacggcaa

SEQ ID NO: 7249 - DNA, 71 bp, chicken (Gallus Gallus)
  misc_feature (36): n=c or g
gtgcttgaaccaggagattactctgcttagccaaanatcagtgtgctcagcctggctggcagggtgccaga

SEQ ID NO: 7250 - DNA, 71 bp, chicken (Gallus Gallus)
  misc_feature (36): n=a or g
ggtactgctcaactataagctaatttgatggaagtnaaagtaactacagtgagcacatccaatacttgaaa

SEQ ID NO: 7251 - DNA, 71 bp, chicken (Gallus Gallus)
  misc_feature (36): n=c or t
gtcacatccatgtatttttcagatccttcggtaaangcaactcagaaaaaagtgcattcaactttttcaag

SEQ ID NO: 7252 - DNA, 71 bp, chicken (Gallus Gallus)
  misc_feature (36): n=c or t
ctgttgtataccttctcctgcaaatccactaaaaanaataatactttggtgagacaagtcagtagacatac

SEQ ID NO: 7253 - DNA, 71 bp, chicken (Gallus Gallus)
  misc_feature (36): n=a or c
ccctccttgctgctgttgaccaggaagtatccaganccttccacaagactgaacagctcctgtcaatgaaa

SEQ ID NO: 7254 - DNA, 71 bp, chicken (Gallus Gallus)
  misc_feature (36): n=a or c
tactgagcatagacgtactgagttgtacttaactcnagagattaccaggactgctttctgtgggaaaaagc

SEQ ID NO: 7255 - DNA, 71 bp, chicken (Gallus Gallus)
  misc_feature (36): n=c or t
cactccagcatgagatcctggctgagtttggcagcnccaagctctggctttccaggaaacacataggtcta

SEQ ID NO: 7256 - DNA, 71 bp, chicken (Gallus Gallus)
  misc_feature (36): n=c or t
atcaatgtgcctgctctgttgtttcacagaagtacncttcccttctgctaaagccaaacctgccttatttc

SEQ ID NO: 7257 - DNA, 71 bp, chicken (Gallus Gallus)
  misc_feature (36): n=c or g
agcacagattcattttgaatctgtatgtactgaatnactcctgtcttctaggccatctttgacccaaaagt

SEQ ID NO: 7258 - DNA, 71 bp, chicken (Gallus Gallus)
  misc_feature (36): n=c or t
cacctcttcagtgatgaaagctgtggttttatgacngtgtctttcagtaacctgtgcagtgatgcagagaa

SEQ ID NO: 7259 - DNA, 71 bp, chicken (Gallus Gallus)
  misc_feature (36): n=c or t
ccttcctatggggtcactgaaagcaccaatgctacngactgcgtcggcactgccatcgtgaatttgacaag

SEQ ID NO: 7260 - DNA, 71 bp, chicken (Gallus Gallus)
  misc_feature (36): n=c or t
atatggacatcattcagtatttgtagaaatgtatanacatagaaagttgaggaaaaaaagtgttttccact

SEQ ID NO: 7261 - DNA, 71 bp, chicken (Gallus Gallus)
  misc_feature (36): n=a or c
aaaactaatggcatatcatactcgtccttcagagtncagagttattttgttattaggattctcaacagtta

SEQ ID NO: 7262 - DNA, 71 bp, chicken (Gallus Gallus)
  misc_feature (36): n=a or t
gggctgcaggtttcccacgtgatggaatctcatggntttccacttccaaagtgcctttgtgtacaccgtgc

SEQ ID NO: 7263 - DNA, 71 bp, chicken (Gallus Gallus)
  misc_feature (36): n=a or c
gttacatgtctccaaggtactcagcaagtttatccnaactcagatgtttgtagataggtgtgatcacagct

SEQ ID NO: 7264 - DNA, 71 bp, chicken (Gallus Gallus)
  misc_feature (36): n=g or t
ttcttcacgtacttcagtcacagggagggcagagantgtgagataaagaaaaagcaataagataaagattt

SEQ ID NO: 7265 - DNA, 71 bp, chicken (Gallus Gallus)
  misc_feature (36): n=g or t
tgatacatacagtcagtaaacaaattaacgaacttngacaatacaaatcctttccatacctgtcagttgat

SEQ ID NO: 7266 - DNA, 71 bp, chicken (Gallus Gallus)
  misc_feature (36): n=a or g
taatcaaaaagacactgcattccaatcacagaaacncccacaccactctgcaaagcatgtgatttgtaagt

SEQ ID NO: 7267 - DNA, 71 bp, chicken (Gallus Gallus)
  misc_feature (36): n=a or g
agttaatgtaagaagcctttaccagtattcctttgnaaaatttgatgaaggagccatctcttgttcttgat

SEQ ID NO: 7268 - DNA, 71 bp, chicken (Gallus Gallus)
  misc_feature (36): n=c or t
tttttaaaatctgcctttacaggtttgttccaaatnagttctttccataatgtggctccttgagaagtgca

SEQ ID NO: 7269 - DNA, 71 bp, chicken (Gallus Gallus)
  misc_feature (36): n=g or t
gattagcagcagtgcatcccacagtgtagaacaagntagaaggtaggactgaagtgttggcaataataggg

SEQ ID NO: 7270 - DNA, 71 bp, chicken (Gallus Gallus)
  misc_feature (36): n=a or c
aatgaatgcacctagaattgtaggcttcttagtatnatgtagtactttgttatttcttaccaatcttgaaa

SEQ ID NO: 7271 - DNA, 71 bp, chicken (Gallus Gallus)
  misc_feature (36): n=g or t
tatcagaaatggcaggtggctccagacccaggtatncctttatcaggaaactcagctctgcaaatgcctca

SEQ ID NO: 7272 - DNA, 71 bp, chicken (Gallus Gallus)
  misc_feature (36): n=a or c
caaccacaccctattcaatattccttctgaggtaanaagcccactgcagaacaattttgactaggttgtca

SEQ ID NO: 7273 - DNA, 71 bp, chicken (Gallus Gallus)
  misc_feature (36): n=a or c
ctgtgggttgacctacttgcccacatcttttccagnagtgtgtattctgtttctcttttaaaattcatgtg

SEQ ID NO: 7274 - DNA, 71 bp, chicken (Gallus Gallus)
  misc_feature (36): n=a or c
agccaagactgtgaagtcagccccacctgggagccnaggctgaaagagaatctgcatagcatgtttgacac

SEQ ID NO: 7275 - DNA, 71 bp, chicken (Gallus Gallus)
  misc_feature (36): n=a or c
tcgcttacaaggtgtggctggaccaggagtaccagngaagaaatgactgagttgctacacaattgagaact

SEQ ID NO: 7276 - DNA, 71 bp, chicken (Gallus Gallus)
  misc_feature (36): n=a or g
acaacagtggatgtagctacaccatctgttcatganccagtacttttccagacagcgagggaccctttagg

SEQ ID NO: 7277 - DNA, 71 bp, chicken (Gallus Gallus)
  misc_feature (36): n=a or c
agcagtaaacttagtcctttgcttcacattggttcngttttatttttaagtgaatagcagaaataaagtat

SEQ ID NO: 7278 - DNA, 71 bp, chicken (Gallus Gallus)
  misc_feature (36): n=a or g
tggtctaatgatctaatcttaagctcaatgaaacanagaggttcctttgtcaaataaatatgacttaaaaa

SEQ ID NO: 7279 - DNA, 71 bp, chicken (Gallus Gallus)
  misc_feature (36): n=a or g
caggagacatgtgctgtcttgctggagcagtgtctncaatgtgtagagtctaaattttcaaacaacacaat

SEQ ID NO: 7280 - DNA, 71 bp, chicken (Gallus Gallus)
  misc_feature (36): n=a or g
catctctctagcatctgtcttcttgcaccttcaccncctttctgaggtctcagtttgaatactatttcttt

SEQ ID NO: 7281 - DNA, 71 bp, chicken (Gallus Gallus)
  misc_feature (36): n=c or t
aggcaaaagaagaactattcgtgtgctacaagtcangaacaaaaaatgcagcaacagagacaactgagatt

SEQ ID NO: 7282 - DNA, 71 bp, chicken (Gallus Gallus)
  misc_feature (36): n=a or g
tgtagtggtggtgttgcctggttttaggctattagngaatacattgatttcatgctctatttttgaagttt

SEQ ID NO: 7283 - DNA, 71 bp, chicken (Gallus Gallus)
  misc_feature (36): n=a or g
gggtgagtctaaaattctatttatgatgggtaaacntattcaaagcatcagatcaaaaaatcagctgcatt

SEQ ID NO: 7284 - DNA, 71 bp, chicken (Gallus Gallus)
  misc_feature (36): n=c or t
gatgcactgaaaataatttatccagagcagacctgnattttttaagaaaattacaccgtcttcctctacta

SEQ ID NO: 7285 - DNA, 71 bp, chicken (Gallus Gallus)
  misc_feature (36): n=a or g
tctaataatgtgagattatatagacagctaatcctntgagagggatgtgcaaaagactggtttctaactga

SEQ ID NO: 7286 - DNA, 71 bp, chicken (Gallus Gallus)
  misc_feature (36): n=a or c
atctgatttagtaaacatgctctgagagtgtatagnaaggaggaagttctttctcctgagtgaactactca

SEQ ID NO: 7287 - DNA, 71 bp, chicken (Gallus Gallus)
  misc_feature (36): n=a or g
tattttccacgttcaaaatgaaaggctgcaaacacntaattatttgaggttgggctgttgttgttttgggt

SEQ ID NO: 7288 - DNA, 71 bp, chicken (Gallus Gallus)
  misc_feature (36): n=c or t
gttcctgtcttagatctctcttaaggcatgtggcancaagatggttagttattgttgcatgctgagtgcgt

SEQ ID NO: 7289 - DNA, 71 bp, chicken (Gallus Gallus)
  misc_feature (36): n=c or t
cccgtttcacccagcctgtgattacctggattatgnggtgggagccctttgtacgaagcaaataaacaaac

SEQ ID NO: 7290 - DNA, 71 bp, chicken (Gallus Gallus)
  misc_feature (36): n=a or g
ttagaactacgtgcatcaggcaactatataggccanagttctcacgtacagcaagacagaaagatggaaac

SEQ ID NO: 7291 - DNA, 71 bp, chicken (Gallus Gallus)
  misc_feature (36): n=a or g
gggtttttccctttgttgtttattttttaaactttnttaagaattcaagcctgtgcaaaaaatgtaatcct

SEQ ID NO: 7292 - DNA, 71 bp, chicken (Gallus Gallus)
  misc_feature (36): n=a or g
gaaaaactactaaacgttcagaaacatcaagaccanctggttgctcagggcttttctctgcagaaggagaa

SEQ ID NO: 7293 - DNA, 71 bp, chicken (Gallus Gallus)
  misc_feature (36): n=a or g
aaattaatattcttcagctggaagtatcttctgggntgggagactgtgctaatcaggaagtttagatatca

SEQ ID NO: 7294 - DNA, 71 bp, chicken (Gallus Gallus)
  misc_feature (36): n=c or t
tcgctgtcttcttagtgaggttgatagtttccaaanagaactaatgcttgtgtgagttgtcctcttacgtt

SEQ ID NO: 7295 - DNA, 71 bp, chicken (Gallus Gallus)
  misc_feature (36): n=a or g
gaggccttgtcactggccaagtgttcttcttcccantttctctcttgcagctcattgttctacagtggtgg

SEQ ID NO: 7296 - DNA, 71 bp, chicken (Gallus Gallus)
  misc_feature (36): n=a or c
ggagatacagagcccagacatacgatcactttgtanttcaatgtaattcaattctctttcttatctgagct

SEQ ID NO: 7297 - DNA, 71 bp, chicken (Gallus Gallus)
  misc_feature (36): n=a or c
cctctgctccagcaacttcttatgaattttacatgngtgagtcaccagataaaaccagaaacggagcttgg

SEQ ID NO: 7298 - DNA, 71 bp, chicken (Gallus Gallus)
  misc_feature (36): n=a or g
tggggaagagaaatgatgaaggttgtgccaatggcngaggaatactgtaagaagaccattcgtcacatggc

SEQ ID NO: 7299 - DNA, 71 bp, chicken (Gallus Gallus)
  misc_feature (36): n=c or t
taactataggatacataagggtcattatcaaagacngaagctttataaacagagaaaatttgtctcagttc

SEQ ID NO: 7300 - DNA, 71 bp, chicken (Gallus Gallus)
  misc_feature (36): n=c or t
gtgtggcctaccagggctttctcttcccctgagtancagcagaggtcagtgtcaacgagtgacaatgacac

SEQ ID NO: 7301 - DNA, 71 bp, chicken (Gallus Gallus)
  misc_feature (36): n=c or t
gatagataaaataaaccacctcgttaagtttaatcngatgctgacaattctgtcatttctttaatcacacc

SEQ ID NO: 7302 - DNA, 71 bp, chicken (Gallus Gallus)
  misc_feature (36): n=c or t
tcatcagatgcgtgttaagcatagaacagaaagctnactatgtaaattctgaagaaattcttcaactttat

SEQ ID NO: 7303 - DNA, 71 bp, chicken (Gallus Gallus)
  misc_feature (36): n=g or t
ttgtgtgagtgggcgagttattaattcctatttctnttgcactaacctacaaacttacgaatattatgcca

SEQ ID NO: 7304 - DNA, 71 bp, chicken (Gallus Gallus)
  misc_feature (36): n=a or c
ggataaaatatagcatatattaccttgagtgtaacngtaaatacaagcacagtgaacaccagtgttccaaa

SEQ ID NO: 7305 - DNA, 71 bp, chicken (Gallus Gallus)
  misc_feature (36): n=g or t
tgtgctgcttttagagacattttttaagactagaancaggttcctttgcagaatgaaggcagcaataccag

SEQ ID NO: 7306 - DNA, 71 bp, chicken (Gallus Gallus)
  misc_feature (36): n=c or t
caaaaagtgatgtatgtaagaaacattaaatggganaaattgtattgagagaagttactcttcagcaaata

SEQ ID NO: 7307 - DNA, 71 bp, chicken (Gallus Gallus)
  misc_feature (36): n=c or t
tttttaagattgagccttctcaactgaatatgcaanatattctagccaaatgtgcgttcacatttcacttc

SEQ ID NO: 7308 - DNA, 71 bp, chicken (Gallus Gallus)
  misc_feature (36): n=c or t
taagcagaaggtattttagcttttcgtcgttgtcangagggtttgaaagaagtggaggagtttgcatatgc

SEQ ID NO: 7309 - DNA, 71 bp, chicken (Gallus Gallus)
  misc_feature (36): n=a or t
gtctatgatttccaggatacatctttcccttccaancctttcttaaaagataatgactttttcctttttcc

SEQ ID NO: 7310 - DNA, 71 bp, chicken (Gallus Gallus)
  misc_feature (36): n=c or t
tctctattgctagcttcagatatacctggttgtccnggagtaccaggttcaccatcccttcctggaattcc

SEQ ID NO: 7311 - DNA, 71 bp, chicken (Gallus Gallus)
  misc_feature (36): n=c or t
atacaacgcaatttttattgtaacatttcagcctcngactgcattcagtaaataaaacctacctcatgagc

SEQ ID NO: 7312 - DNA, 71 bp, chicken (Gallus Gallus)
  misc_feature (36): n=c or t
gtatagtttggggtatttttcttttctgtggaatanttgaagctgttatatcactaacaggaatgacaaac

SEQ ID NO: 7313 - DNA, 71 bp, chicken (Gallus Gallus)
  misc_feature (36): n=a or c
ctgctgttttcctaaggtgagatttgcttgtcaaanccacctatcaggcaccagtacccaatccagccagc

SEQ ID NO: 7314 - DNA, 71 bp, chicken (Gallus Gallus)
  misc_feature (36): n=a or g
gcattcaatattaatgtcctttcccattgcatgacnaggttatggaagtaaatggactagaataagacagt

SEQ ID NO: 7315 - DNA, 71 bp, chicken (Gallus Gallus)
  misc_feature (36): n=a or g
tttagtggaccaagcactatttgtgcagtggagaangtgtggggttgggatagctactgtgggattagcac

SEQ ID NO: 7316 - DNA, 71 bp, chicken (Gallus Gallus)
  misc_feature (36): n=a or g
tcatgctattaacatatctcagtgataactaatgcntaatattctataaaacccacagacataaacagatg

SEQ ID NO: 7317 - DNA, 71 bp, chicken (Gallus Gallus)
  misc_feature (36): n=a or c
tgccagcatttccatgatgacaaatgttcctcctcntcatcatcatcatcaaaaaaaaaaaaaaaaaaaaa

SEQ ID NO: 7318 - DNA, 71 bp, chicken (Gallus Gallus)
  misc_feature (36): n=a or t
tgtgctgggtaataggcagaagaatgaaacatgatnaaattatcgcaagagcaataaatcctacaaaatag

SEQ ID NO: 7319 - DNA, 71 bp, chicken (Gallus Gallus)
  misc_feature (36): n=a or c
tctgctccatgacttttcccagcacagtgatgagantgacaggtcagtagtacccagggccatccttttca

SEQ ID NO: 7320 - DNA, 71 bp, chicken (Gallus Gallus)
  misc_feature (36): n=a or g
aacttccatttggtccttattttctgaactgactgntttttgaaaggtatttctttctggtgagctgggcc

SEQ ID NO: 7321 - DNA, 71 bp, chicken (Gallus Gallus)
  misc_feature (36): n=g or t
caagttgaaacctcccaaccaaacattgttttcacnatctttataattttcgtatctcttggattcctttc

SEQ ID NO: 7322 - DNA, 71 bp, chicken (Gallus Gallus)
  misc_feature (36): n=c or t
gggtggaattgtcactggatgaagaataagttgganggttattgcaagaggattgtgatcaatgtctcttt

SEQ ID NO: 7323 - DNA, 71 bp, chicken (Gallus Gallus)
  misc_feature (36): n=a or g
agacaaccttcagattcctaagtttgtggcatactnccatgcctggggaaatatgagctgagttcaactca

SEQ ID NO: 7324 - DNA, 71 bp, chicken (Gallus Gallus)
  misc_feature (36): n=a or g
ctgagatttttttgcagctccttgcatttcatttcnattttatctgatgatacttgacaatgtgagatgat

SEQ ID NO: 7325 - DNA, 71 bp, chicken (Gallus Gallus)
  misc_feature (36): n=c or t
ctgaaggtgtttgctggcagtaggttttggaccttnctgacactttttaatagactgctccattttttttt

SEQ ID NO: 7326 - DNA, 71 bp, chicken (Gallus Gallus)
  misc_feature (36): n=c or t
atgtgtggatttcagaggacaaaaacaacacttccnatgatcattaggttaaataatggtcagctaccaaa

SEQ ID NO: 7327 - DNA, 71 bp, chicken (Gallus Gallus)
  misc_feature (36): n=c or t
gcttctttatttcctgtaaatatagcatcaatgaanccaggaacgttacatttctgtatatcaaaacaaaa

SEQ ID NO: 7328 - DNA, 71 bp, chicken (Gallus Gallus)
  misc_feature (36): n=g or t
ggcatcttgctctgaagcttgcttgtttctttgtgngaccctgtcattatttataagttttagagttttgg

SEQ ID NO: 7329 - DNA, 71 bp, chicken (Gallus Gallus)
  misc_feature (36): n=c or t
tgtgaaagaaggtgcaaggtcatctatagagaatantaacattcatacaaaacaggaacaaatcctatcta

SEQ ID NO: 7330 - DNA, 71 bp, chicken (Gallus Gallus)
  misc_feature (36): n=a or c
cacatctttggtatcatcagcaaacttgctgagggnacactcaaatccaatgtcagtgacattgatgaaga

SEQ ID NO: 7331 - DNA, 71 bp, chicken (Gallus Gallus)
  misc_feature (36): n=c or t
aagcaggggaatcatgcgaagcatcatctgaggaangcacccagtgactctcagctgtgtaaatgtatggg

SEQ ID NO: 7332 - DNA, 71 bp, chicken (Gallus Gallus)
  misc_feature (36): n=c or t
gactgcatctcaccaatgcagcctaactcacactgngtgggaatttttactctaggagacgctgctttaag

SEQ ID NO: 7333 - DNA, 71 bp, chicken (Gallus Gallus)
  misc_feature (36): n=a or g
attcaaggtttagtaaatgcaatgtgatgattcatntctgtgctcgtttgaacttatggctgagaaagttc

SEQ ID NO: 7334 - DNA, 71 bp, chicken (Gallus Gallus)
  misc_feature (36): n=a or g
cattcatgtgtatatatatatatatatatatatatntatgtatgtatacctgtggaggtgtaatcacagaa

SEQ ID NO: 7335 - DNA, 71 bp, chicken (Gallus Gallus)
  misc_feature (36): n=c or t
ttacagagagcccccactataacacaaacacatagntgtgcttgcaacttctttgactcatttgcaattgt

SEQ ID NO: 7336 - DNA, 71 bp, chicken (Gallus Gallus)
  misc_feature (36): n=a or g
gtgggggcagcggtttcactctggtgactgaagatngtgacgggctcggtcttgatgtgggggacacaggg

SEQ ID NO: 7337 - DNA, 71 bp, chicken (Gallus Gallus)
  misc_feature (36): n=c or t
gatgtctgccttattgcccctccccatgatccttanccatagagattcgatctcatcattcccagccccaa

SEQ ID NO: 7338 - DNA, 71 bp, chicken (Gallus Gallus)
  misc_feature (36): n=a or g
gaatgcatggagcctggatcatctgcaaatgcatanaaacctgatgtaagaccacatatgcagttgaaatt

SEQ ID NO: 7339 - DNA, 71 bp, chicken (Gallus Gallus)
  misc_feature (36): n=c or t
ctagcaattcccacataaggtgagaataaagtgganctgaatgaaagctagatattattgtgaaaatacaa

SEQ ID NO: 7340 - DNA, 71 bp, chicken (Gallus Gallus)
  misc_feature (36): n=a or g
aggttataaggagtagtcagtgtggattcaccaagnggaaatcatgctctaccaatctggtagcctcctat

SEQ ID NO: 7341 - DNA, 71 bp, chicken (Gallus Gallus)
  misc_feature (36): n=a or g
tattgattaatttttaaaaaattcttgattagttgnaggcatatagaatgaacattgagctacaaagcata

SEQ ID NO: 7342 - DNA, 71 bp, chicken (Gallus Gallus)
  misc_feature (36): n=a or t
accctattactttcctgggaggggaaatcattttgntaattgtttaattcatttctaagggatgctgcagc

SEQ ID NO: 7343 - DNA, 71 bp, chicken (Gallus Gallus)
  misc_feature (36): n=a or g
atattgttgcctgtagccttgaaagaaagagtgagnagatacatcactggaggtcttcccccatgttgtct

SEQ ID NO: 7344 - DNA, 71 bp, chicken (Gallus Gallus)
  misc_feature (36): n=c or t
cttgactaggaagggatccttaaaggccatgtagtncagctcccctggaatgaacaacaacatccacagct

SEQ ID NO: 7345 - DNA, 71 bp, chicken (Gallus Gallus)
  misc_feature (36): n=a or t
aatgttccaatggtctttcattaagaagttgaacancttcaatacataattcatggaattgatactaacat

SEQ ID NO: 7346 - DNA, 71 bp, chicken (Gallus Gallus)
  misc_feature (36): n=c or t
tccagcattagagttaacttgtataacagcagttangttaggggaatgatgcagagggaagaaatgagaag

SEQ ID NO: 7347 - DNA, 71 bp, chicken (Gallus Gallus)
  misc_feature (36): n=a or g
cctccacaatctgtgaggagctcagacatgtcatantagctaacaaactcccataaacaggcttccagatt

SEQ ID NO: 7348 - DNA, 71 bp, chicken (Gallus Gallus)
  misc_feature (36): n=c or t
ttctaaaagcttggaagggatggggaaggacagacnttttgagtgttttggtagtgaagaaaagctagacg

SEQ ID NO: 7349 - DNA, 71 bp, chicken (Gallus Gallus)
  misc_feature (36): n=c or t
gtcaatcttctaacaaacaaaacaaaacctcacctnggtgaaggagtagaaatggatgatctttaaggtct

SEQ ID NO: 7350 - DNA, 71 bp, chicken (Gallus Gallus)
  misc_feature (36): n=c or g
gctacaagcagtattacttctaattctgactaattntttttgagtgagatacagaaatggctgcagtttga

SEQ ID NO: 7351 - DNA, 71 bp, chicken (Gallus Gallus)
  misc_feature (36): n=g or t
tctgctttggcgtccttaggtgtgtctgtacttcanactggtgtcttaattgatctgatatgggtagtggg

SEQ ID NO: 7352 - DNA, 71 bp, chicken (Gallus Gallus)
  misc_feature (36): n=c or t
gagcaaatgtctcttaaaggcttgctgtaagttccnggtctcactggttgtctgcagctgatattccagca

SEQ ID NO: 7353 - DNA, 71 bp, chicken (Gallus Gallus)
  misc_feature (36): n=c or g
gctgctgattcacagagcatagaaaaatgcttcccntgtctcatcaccatgcactgctatacagtctctca

SEQ ID NO: 7354 - DNA, 71 bp, chicken (Gallus Gallus)
  misc_feature (36): n=g or t
ttccccatcccataatactactctgcaaatcctgcngtgtgcactgtgataggatgcagtggttggggtgg

SEQ ID NO: 7355 - DNA, 71 bp, chicken (Gallus Gallus)
  misc_feature (36): n=c or t
ggagtcttaaacttctttcaacctccgtggttcgantgaatgtctagttatagtgtatggttgcctagaag

SEQ ID NO: 7356 - DNA, 71 bp, chicken (Gallus Gallus)
  misc_feature (36): n=c or t
attatcaaatattaaaaatacaaagtattgcaaagnattttttctccctaccccagccagggtactttcta

SEQ ID NO: 7357 - DNA, 71 bp, chicken (Gallus Gallus)
  misc_feature (36): n=a or g
gttctttggaggctgcaagagagtgaaggtactgcntgcagtggccagcgccgctgacaccattctcatag

SEQ ID NO: 7358 - DNA, 71 bp, chicken (Gallus Gallus)
  misc_feature (36): n=a or c
gattatggcgaaagaagtagagaattcgtatatacngggagagattgaagactcctcagttgctgatcaca

SEQ ID NO: 7359 - DNA, 71 bp, chicken (Gallus Gallus)
  misc_feature (36): n=a or g
aaaagatgcgtggctttgggtgctggaactaacganagttggtgtggctctctgtggaagtgacttctgct

SEQ ID NO: 7360 - DNA, 71 bp, chicken (Gallus Gallus)
  misc_feature (36): n=a or g
gggacagctaggatattttagtttgtagagaatgtngagaaagcagaaaaatactcagatggctcctgtag

SEQ ID NO: 7361 - DNA, 71 bp, chicken (Gallus Gallus)
  misc_feature (36): n=a or c
tcaggtttcagatcatttctgattcatcgcagtggntgaatgtgacaaagttctgtggtagggcattgcca

SEQ ID NO: 7362 - DNA, 71 bp, chicken (Gallus Gallus)
  misc_feature (36): n=a or g
tgtcaggcagggattttgtcactggtcaaaacccangagtctcttattcttctaatcaggttttgagaaag

SEQ ID NO: 7363 - DNA, 71 bp, chicken (Gallus Gallus)
  misc_feature (36): n=a or g
gctgtgaagtttgaaaatggatgcaaatggtaaccncgttctgagtttctccataggagcactgactgaat

SEQ ID NO: 7364 - DNA, 71 bp, chicken (Gallus Gallus)
  misc_feature (36): n=c or t
cccaatcctacatatagtgaagtcaataaaaatatngtcattaattctagggttatgaaacaagttaacat

SEQ ID NO: 7365 - DNA, 71 bp, chicken (Gallus Gallus)
  misc_feature (36): n=g or t
agaaaattcctcgcaagctcttttctccagtgtttnttcatttatcatttattgtactggagactcattag

SEQ ID NO: 7366 - DNA, 71 bp, chicken (Gallus Gallus)
  misc_feature (36): n=a or g
gggagcagaaactgcccataagaagcagctcttgantgccattaatttggaagcattgggatatttcacat

SEQ ID NO: 7367 - DNA, 71 bp, chicken (Gallus Gallus)
  misc_feature (36): n=c or t
aggtgagctagaaactgccttaattaattagagaangatgacttcatcctccttccccatgaggatgctac

SEQ ID NO: 7368 - DNA, 71 bp, chicken (Gallus Gallus)
  misc_feature (36): n=a or g
atgtatgagacatcaatattgctaacttcttcccgngttcagcatgaaatatcgtctcattggtcagtcat

SEQ ID NO: 7369 - DNA, 71 bp, chicken (Gallus Gallus)
  misc_feature (36): n=c or t
tttgaatttgtctacctttaattttcagccagtggngttcattgcatcactgtctatggaactgagagctt

SEQ ID NO: 7370 - DNA, 71 bp, chicken (Gallus Gallus)
  misc_feature (36): n=a or g
gatttaagtaggatacaaggaaaatgtattttacantgagggtggtgaggtgctggaacaggttgcccaga

SEQ ID NO: 7371 - DNA, 71 bp, chicken (Gallus Gallus)
  misc_feature (36): n=a or g
ggaactcctcagcttatagaggtaaaggccatcctngtcactgctgtgcaacaccaggtctaagctcacca

SEQ ID NO: 7372 - DNA, 71 bp, chicken (Gallus Gallus)
  misc_feature (36): n=c or t
ttgcaacctgcacttttaggaaggcacttgaacagntgcagtcagctgcactgactgaacatgtgaaaaaa

SEQ ID NO: 7373 - DNA, 71 bp, chicken (Gallus Gallus)
  misc_feature (36): n=a or t
cacttactcttaaagaagtccttattaagctagccntttttttttttttaagaaatctttaataaaagtga

SEQ ID NO: 7374 - DNA, 71 bp, chicken (Gallus Gallus)
  misc_feature (36): n=a or g
aaaagagactccatagtttttcacaaagagaaagcngggaagggaacttatctcagagcatggaatcagag

SEQ ID NO: 7375 - DNA, 71 bp, chicken (Gallus Gallus)
  misc_feature (36): n=a or g
ttatgccctgcctgttttcattgtataaaggtaaantatacatagtatgtgagggtcaaagaatcccaaag

SEQ ID NO: 7376 - DNA, 71 bp, chicken (Gallus Gallus)
  misc_feature (36): n=c or t
ctagcagtatccagaaatttctgaatgaagaacgcncagcttctgtatattccagacaatattttcatggc

SEQ ID NO: 7377 - DNA, 71 bp, chicken (Gallus Gallus)
  misc_feature (36): n=a or t
tttgcctaaagtgcatacatggatctcctctgttcnacatatattgccagatgaacagaagaaaatagaat

SEQ ID NO: 7378 - DNA, 71 bp, chicken (Gallus Gallus)
  misc_feature (36): n=c or t
ggtacagtttaatgctgctctctctcatcccatcantgtgacactgtgggaaaagaggccaaccccccccc

SEQ ID NO: 7379 - DNA, 71 bp, chicken (Gallus Gallus)
  misc_feature (36): n=c or t
tcatcaggatctagtcattcacactctactgttacngttgattttataacatagctttttagtaattagag

SEQ ID NO: 7380 - DNA, 71 bp, chicken (Gallus Gallus)
  misc_feature (36): n=c or t
cagttcctgaagaaattaaggtttgctcagggcagnatggaaggtactcagccttgagctaatgtaagcct

SEQ ID NO: 7381 - DNA, 71 bp, chicken (Gallus Gallus)
  misc_feature (36): n=a or g
tttctctctggtaaaaggggttttataaaagtctancaaagagacattatcaagtattcaagttaaatatc

SEQ ID NO: 7382 - DNA, 71 bp, chicken (Gallus Gallus)
  misc_feature (36): n=a or c
gatgccatcaactcagtgtctctagtaatagtcctntgatagcaccaattatattttcatcttcaaagaaa

SEQ ID NO: 7383 - DNA, 71 bp, chicken (Gallus Gallus)
  misc_feature (36): n=a or g
atccctttgaatatttttgtggcctaatactggatncacagagtagaggggcaatatcgtgtccctcgcct

SEQ ID NO: 7384 - DNA, 71 bp, chicken (Gallus Gallus)
  misc_feature (36): n=c or t
aatgctttgttattaatctgtgcagcaacagggcanggcagagctggatttatttcttcctttttcctttt

SEQ ID NO: 7385 - DNA, 71 bp, chicken (Gallus Gallus)
  misc_feature (36): n=c or t
agcagtggtaatgcttatggtcccaaggctgaattntgctttgataaacttagaaggaatggctgccaaaa

SEQ ID NO: 7386 - DNA, 71 bp, chicken (Gallus Gallus)
  misc_feature (36): n=c or g
atcagctttcactgccaaaagtccatccaatagctnaacctcatgatgcagatggatataatgaatgcaat

SEQ ID NO: 7387 - DNA, 71 bp, chicken (Gallus Gallus)
  misc_feature (36): n=c or g
ccagggcaggggctgttccttttgaaaactctcttnaaagtttttgatacttgcaactgcaatactgccaa

SEQ ID NO: 7388 - DNA, 71 bp, chicken (Gallus Gallus)
  misc_feature (36): n=a or g
attcttgctgaggaaagtcttgaaattgaggagggnaggctcggagctgatgtgtgggagctgaaaggctg

SEQ ID NO: 7389 - DNA, 71 bp, chicken (Gallus Gallus)
  misc_feature (36): n=a or g
acgttgacatcatgtttatgttataatgaagaaganacacaaagcaacctgctaacctgtggggcagatga

SEQ ID NO: 7390 - DNA, 71 bp, chicken (Gallus Gallus)
  misc_feature (36): n=a or g
ctggtgaaggctgccagtgagaatggtgctgctgtngaccagtcctgaagcgatctgtacaagatcttcag

SEQ ID NO: 7391 - DNA, 71 bp, chicken (Gallus Gallus)
  misc_feature (36): n=c or t
gtccaatcccatgccacttttgctaaatgcatcccngaacttccatgcagatgcagagcacagcggatgcc

SEQ ID NO: 7392 - DNA, 71 bp, chicken (Gallus Gallus)
  misc_feature (36): n=a or g
ctcactgctgcgctaaggggaaggaggcagaagccngccttgcgtagagctctagtttaacctctgtgtaa

SEQ ID NO: 7393 - DNA, 71 bp, chicken (Gallus Gallus)
  misc_feature (36): n=c or t
ctcaaagctgttccgtgctttacactgcagttgtgngcttgaaacacaattctcacaggacatgtgctttc

SEQ ID NO: 7394 - DNA, 71 bp, chicken (Gallus Gallus)
  misc_feature (36): n=g or t
ttgctactggatcactgcataacagcatctacagtnttcactttactatcctctgctgtaattcagacaat

SEQ ID NO: 7395 - DNA, 71 bp, chicken (Gallus Gallus)
  misc_feature (36): n=c or t
ctagaccaagcctgcactatagatctatgtaatatngggttattctgaacatctacacatttatattagct

SEQ ID NO: 7396 - DNA, 71 bp, chicken (Gallus Gallus)
  misc_feature (36): n=a or g
tacttgaagcgtgctcctctttcttcacactcgttnaaaacaatctaatttctgtggttgtgggagcacct

SEQ ID NO: 7397 - DNA, 71 bp, chicken (Gallus Gallus)
  misc_feature (36): n=a or g
ataaaagaggagaaagatctgtcagtggtcttatcntgtatggcaaaaagtattacattatccagggacga

SEQ ID NO: 7398 - DNA, 71 bp, chicken (Gallus Gallus)
  misc_feature (36): n=c or t
ggaattcagatcagtgtatgagccaacacagactanatcttaaatccaaagttttattgagaagtttagta

SEQ ID NO: 7399 - DNA, 71 bp, chicken (Gallus Gallus)
  misc_feature (36): n=a or g
atttggctgttttgctgctttgttcaaacctattcnttctgtacagctacatgtatcttgatgatgctttc

SEQ ID NO: 7400 - DNA, 71 bp, chicken (Gallus Gallus)
  misc_feature (36): n=a or g
ttacataatgtcttctaatcttaatcccttgagatngagcccatacaggccaatggacggctaagaaaaag

SEQ ID NO: 7401 - DNA, 71 bp, chicken (Gallus Gallus)
  misc_feature (36): n=c or t
atgaattcaaatgcaggagttggtttagattttagnaactgagtgagtatgccagggctgggcagaggaat

SEQ ID NO: 7402 - DNA, 71 bp, chicken (Gallus Gallus)
  misc_feature (36): n=a or g
tgaaagacagcaattaacatagtgagcagatgtganaaagagtgtgaagggaaaggctgtgatagatcctc

SEQ ID NO: 7403 - DNA, 71 bp, chicken (Gallus Gallus)
  misc_feature (36): n=c or t
ttttccaaccttaatgattctatgattctgtgattnaaagcctgcacctctatgggctcattgcaatgccc

SEQ ID NO: 7404 - DNA, 71 bp, chicken (Gallus Gallus)
  misc_feature (36): n=c or t
aactgctgcctccctaaactatgtctgttgtacctngtagtgatactaagcatggtgtgagtcataaggca

SEQ ID NO: 7405 - DNA, 71 bp, chicken (Gallus Gallus)
  misc_feature (36): n=c or t
ctgggtctaaataatgcaagatgctttttttatgcntctacccactgtgagcagcttatgttctgtatatc

SEQ ID NO: 7406 - DNA, 71 bp, chicken (Gallus Gallus)
  misc_feature (36): n=c or t
cctcatcaggacactgttctcaatccatttcgcagngattaacagtcttacacttgttgctcaggaagaga

SEQ ID NO: 7407 - DNA, 71 bp, chicken (Gallus Gallus)
  misc_feature (36): n=a or g
cgggttacgtgatcaaagatgcactttcagagactnggcatgttgatgttgagtgggacgcagttgaccag

SEQ ID NO: 7408 - DNA, 71 bp, chicken (Gallus Gallus)
  misc_feature (36): n=a or g
cgtaaaacagacactaacttggtcaccttaactgcntggtcatacaccttctggaaactcagtttgggctc

SEQ ID NO: 7409 - DNA, 71 bp, chicken (Gallus Gallus)
  misc_feature (36): n=a or g
cacgatagaaggatatcacaacacgaggatatcacnatagtaacgtataacgatggcagccccagtggcgg

SEQ ID NO: 7410 - DNA, 71 bp, chicken (Gallus Gallus)
  misc_feature (36): n=a or g
ccaaatgtatacttgccctgaggaatataaagggcnctatgaaaagatgctgtttaaaattagataagtat

SEQ ID NO: 7411 - DNA, 71 bp, chicken (Gallus Gallus)
  misc_feature (36): n=a or c
ccagaacatactttaatgctgccattaaggtgattntcagttaggggatggttggtttggctcctgagtga

SEQ ID NO: 7412 - DNA, 71 bp, chicken (Gallus Gallus)
  misc_feature (36): n=a or g
tggaatgctgaccatgtgagcaccaatgaaacaaancaaacaaagcaccaacctgctgtaccatggtcacc

SEQ ID NO: 7413 - DNA, 71 bp, chicken (Gallus Gallus)
  misc_feature (36): n=a or g
cctccttcccaacccgctattccgctgtgtaaactnggcccgaaaataaataaataatttagcattgaaaa

SEQ ID NO: 7414 - DNA, 71 bp, chicken (Gallus Gallus)
  misc_feature (36): n=a or g
agacaagcaaagagattaaaccactttttctgtacngtatagggagcaagctctaagaacagagaaagtat

SEQ ID NO: 7415 - DNA, 71 bp, chicken (Gallus Gallus)
  misc_feature (36): n=g or t
tataagtatatgcttgccgtttgaaacgcccatctncccaagcctgacagatcatttcagtgaaataaaat

SEQ ID NO: 7416 - DNA, 71 bp, chicken (Gallus Gallus)
  misc_feature (36): n=a or g
cccagaagaacatctcctattttacagttgctgtancatttcctctttggacatttgctgcatatctgaag

SEQ ID NO: 7417 - DNA, 71 bp, chicken (Gallus Gallus)
  misc_feature (36): n=c or g
gccataactttttttgtacagtgccttcagtttagnactggtagtttcctattcaagaactgatttaaatc

SEQ ID NO: 7418 - DNA, 71 bp, chicken (Gallus Gallus)
  misc_feature (36): n=a or g
ctttggaaagggccaatggaaatcagcggatcacanttctccatgcttgtgactggccagccaaaactgac

SEQ ID NO: 7419 - DNA, 71 bp, chicken (Gallus Gallus)
  misc_feature (36): n=a or g
cagcagctgctataaaaccttaactacagacagagnaaagaacataatactaaaaccaattacataaggca

SEQ ID NO: 7420 - DNA, 71 bp, chicken (Gallus Gallus)
  misc_feature (36): n=c or t
tatacacatgtcaattcaagaaaaggcaagaagtcntttcttatccgctggaagagcttgttgaattccat

SEQ ID NO: 7421 - DNA, 71 bp, chicken (Gallus Gallus)
  misc_feature (36): n=c or t
gggccttcactgtgtaacagaaattttcttctaaangaccaattttttaaaaacattttcacaatgaaaat

SEQ ID NO: 7422 - DNA, 71 bp, chicken (Gallus Gallus)
  misc_feature (36): n=c or t
cagctagactagaaaaggccttcaaatcatcttgtngaaccatcagcctgacttactaagtcccatcatta

SEQ ID NO: 7423 - DNA, 71 bp, chicken (Gallus Gallus)
  misc_feature (36): n=a or g
tgtgggtgacttaaacccattattttgtagacaccntatcacaaaccctcccactttctgatactctgata

SEQ ID NO: 7424 - DNA, 71 bp, chicken (Gallus Gallus)
  misc_feature (36): n=c or t
atttttgtaactaatcgcttttccaggaactctgangtaaaaacggtgaacgacatgtatacctgtgacag

SEQ ID NO: 7425 - DNA, 71 bp, chicken (Gallus Gallus)
  misc_feature (36): n=a or g
gacttccattttaaaaaagaccacagatacgtaacnttcctctgtgaataaggatgaacataggttaatga

SEQ ID NO: 7426 - DNA, 71 bp, chicken (Gallus Gallus)
  misc_feature (36): n=c or g
aaccagccccagataatgtgttttcctgcaaatagnaaagtggaagagtgtggaatgagcctaatggccat

SEQ ID NO: 7427 - DNA, 71 bp, chicken (Gallus Gallus)
  misc_feature (36): n=g or t
acacttgtggtaaattgagatgctcagcggtgtgtntgtgcaagaacattttcaacttccacaaatttctc

SEQ ID NO: 7428 - DNA, 71 bp, chicken (Gallus Gallus)
  misc_feature (36): n=a or t
gtagcttatcttaacccagaaacattcattgtagcnaataaccaaacttacatactggtttatatttttca

SEQ ID NO: 7429 - DNA, 71 bp, chicken (Gallus Gallus)
  misc_feature (36): n=a or t
acaagcttcaatcctggctggtagaagaaaaaaaanttgatatttgttgtgagagaaggaatccaaagcta

SEQ ID NO: 7430 - DNA, 71 bp, chicken (Gallus Gallus)
  misc_feature (36): n=a or g
aaagtaataagtgtctgtgttgatagatattctaanctgactggagtcatttaaaagattgctaaatcaca

SEQ ID NO: 7431 - DNA, 71 bp, chicken (Gallus Gallus)
  misc_feature (36): n=c or t
acagaagatgggctacctgttctggtttaattacangcctaacaatccataacacctattttaccaacagc

SEQ ID NO: 7432 - DNA, 71 bp, chicken (Gallus Gallus)
  misc_feature (36): n=a or g
acagaaccccattgctcaggcttcgctgtaacaccnaaggaagtttagagacaggctttcaaaggtactga

SEQ ID NO: 7433 - DNA, 71 bp, chicken (Gallus Gallus)
  misc_feature (36): n=a or t
gttgacaaaatacttcgctcaaaatcaaggaaactnagtgactgtatatgaagttcatgaaaaagatagaa

SEQ ID NO: 7434 - DNA, 71 bp, chicken (Gallus Gallus)
  misc_feature (36): n=a or g
aaataataccaaatttgaacgtcttcttggaaagtnttttactctcagtgttgattaacaaaataaacaaa

SEQ ID NO: 7435 - DNA, 71 bp, chicken (Gallus Gallus)
  misc_feature (36): n=a or g
attttattttattttattttattttattttattttntttattttttaaattgcctgtgactgtgcctaata

SEQ ID NO: 7436 - DNA, 71 bp, chicken (Gallus Gallus)
  misc_feature (36): n=a or g
catcatgtattgctgtgttgcataggatgccagacntgctcaaacatagagcaatagatcacagctgataa

SEQ ID NO: 7437 - DNA, 71 bp, chicken (Gallus Gallus)
  misc_feature (36): n=a or c
aagcgctcaaaattaagaccggtactaaaatatatntctaagaaatagagctacctgaagaattaaaacca

SEQ ID NO: 7438 - DNA, 71 bp, chicken (Gallus Gallus)
  misc_feature (36): n=a or g
cttgtattcttccctgcaactttttcccagtctccnttgcagactgagtcccagtctgttgcttgtaactg

SEQ ID NO: 7439 - DNA, 71 bp, chicken (Gallus Gallus)
  misc_feature (36): n=a or g
accccaatgctctctatgatgaggttagtgatgccnaggacaagggagtgcctcacatactatatatcttc

SEQ ID NO: 7440 - DNA, 71 bp, chicken (Gallus Gallus)
  misc_feature (36): n=a or g
gaagtgcctcaagtgtttgttgttcagctgtcatantgcctaggaggttcttgataaatattgctccctaa

SEQ ID NO: 7441 - DNA, 71 bp, chicken (Gallus Gallus)
  misc_feature (36): n=a or g
gtataacaacgtgtagcttctaagtcaaaaatttgnattctttgaaacaaaagaggaattaaagatccaga

SEQ ID NO: 7442 - DNA, 71 bp, chicken (Gallus Gallus)
  misc_feature (36): n=c or t
tggttaccttgaaggttgcatttgacgatgaccagnagagatcttgcttggggtaatagtgtactcctaat

SEQ ID NO: 7443 - DNA, 71 bp, chicken (Gallus Gallus)
  misc_feature (36): n=a or g
gatatcatgaaactggctttaaaactgcgtgaattntgattctgttgtcaagcttttcagacccatttagt

SEQ ID NO: 7444 - DNA, 71 bp, chicken (Gallus Gallus)
  misc_feature (36): n=a or g
tgaagaagcagaggagtggttattctgggcaaaacngggggggggaaacctgtaaaagtgtgttcttagtg

SEQ ID NO: 7445 - DNA, 71 bp, chicken (Gallus Gallus)
  misc_feature (36): n=c or t
acatctgtatctctatccctcccttcctcccagtgnttgtgacaactgctacctcctggctgaaccttttc

SEQ ID NO: 7446 - DNA, 71 bp, chicken (Gallus Gallus)
  misc_feature (36): n=c or t
acacatctttgggtgttggtcatttcactgatcgtngtgtattggaacggctaaagtcagagatgttctcc

SEQ ID NO: 7447 - DNA, 71 bp, chicken (Gallus Gallus)
  misc_feature (36): n=a or t
aagaatcaccagtcacgcattcattaaatatgaatntatgaagggaagcagctttgaattccatctataca

SEQ ID NO: 7448 - DNA, 71 bp, chicken (Gallus Gallus)
  misc_feature (36): n=a or g
gatttctacacatatccattcatgtaggctgccctnggagatgtgctgaatcagtgcctttctccatcagc

SEQ ID NO: 7449 - DNA, 71 bp, chicken (Gallus Gallus)
  misc_feature (36): n=c or t
caaagcataaatgctttattgtgaaaattcaaatantggtgtgagattaagttagttcgagatgaaactaa

SEQ ID NO: 7450 - DNA, 71 bp, chicken (Gallus Gallus)
  misc_feature (36): n=g or t
cactggctcataagtcatatttcaagcaatgaagtnatctctttttcattagaaaatgcagagaaataaaa

SEQ ID NO: 7451 - DNA, 71 bp, chicken (Gallus Gallus)
  misc_feature (36): n=c or t
agagtaacatgggtaccattcacaattacgttagcnactcctatctattttccagaattctttaaagaaat

SEQ ID NO: 7452 - DNA, 71 bp, chicken (Gallus Gallus)
  misc_feature (36): n=c or t
aaataataggttttagcctttttgtctcagcacttntataaagcaccactggtgtaattacagcagtatat

SEQ ID NO: 7453 - DNA, 71 bp, chicken (Gallus Gallus)
  misc_feature (36): n=a or g
tccgaaagcctcaggaaaaacaaaacttggtattancaacaaacagaaaatacagagttacattgctcctg

SEQ ID NO: 7454 - DNA, 71 bp, chicken (Gallus Gallus)
  misc_feature (36): n=a or g
tgtggttgtcacaggttatcatctcagggaatgatnccttgtgaagggatgttttcccaacgtttctcact

SEQ ID NO: 7455 - DNA, 71 bp, chicken (Gallus Gallus)
  misc_feature (36): n=c or t
actaaatagtgaagcagtatttagtctgtatttgantaattggaaatttagattaaattctcctagtgtgt

SEQ ID NO: 7456 - DNA, 71 bp, chicken (Gallus Gallus)
  misc_feature (36): n=a or t
tgcagcaaatgactgttatttcagatcagttctganttttttaccacttcaatcaatattaagtaaaccgc

SEQ ID NO: 7457 - DNA, 71 bp, chicken (Gallus Gallus)
  misc_feature (36): n=c or t
gatttaatacaaaattaaaagcataacaacttcacngtaaaatgctgctgatgaaattttgtcattttaat

SEQ ID NO: 7458 - DNA, 71 bp, chicken (Gallus Gallus)
  misc_feature (36): n=c or t
agtttatcttcacagaataaaaaggacgagagcaanggtaagctgaatgtcaaccaccataatgttttcaa

SEQ ID NO: 7459 - DNA, 71 bp, chicken (Gallus Gallus)
  misc_feature (36): n=a or g
catcgtgtttaaaacttgtcaatgcatttctaagcnagacctggatatcagtgaagaaaaggacatgtttg

SEQ ID NO: 7460 - DNA, 71 bp, chicken (Gallus Gallus)
  misc_feature (36): n=a or g
aatagacctttattcaaaagcccaactcagatttgntatttgtttttgccttaatcaacattggatgagat

SEQ ID NO: 7461 - DNA, 71 bp, chicken (Gallus Gallus)
  misc_feature (36): n=c or t
aggcataactgttcaattagagctggaactgctccntggattttaccccagttttcaggcagatgggtgag

SEQ ID NO: 7462 - DNA, 71 bp, chicken (Gallus Gallus)
  misc_feature (36): n=c or t
aaaaaacactctttgggatggagcaattggcactgnaccatgcacttaaaatacaattcaatctattatat

SEQ ID NO: 7463 - DNA, 71 bp, chicken (Gallus Gallus)
  misc_feature (36): n=c or t
aataaatttttgtactcaaaccttcccgaacttaantgctatttgaagaagaaatctcttagcaaaagcca

SEQ ID NO: 7464 - DNA, 71 bp, chicken (Gallus Gallus)
  misc_feature (36): n=c or t
gaacacaccaggcttccctacaggctttgctcttangagcaggtacttcaagaattgcaacacagctgcta

SEQ ID NO: 7465 - DNA, 71 bp, chicken (Gallus Gallus)
  misc_feature (36): n=c or t
ggtatttgttgtgataatttaaagggtttgtgttgnatcattacccttcattattgggctttttgtaatgg

SEQ ID NO: 7466 - DNA, 71 bp, chicken (Gallus Gallus)
  misc_feature (36): n=a or g
aacagaagagctgctcccctccctgctacctggatntcaatatagatgaagataatgtatggcttcacttc

SEQ ID NO: 7467 - DNA, 71 bp, chicken (Gallus Gallus)
  misc_feature (36): n=c or t
ccttaaatagatatttacataaaaaacttgttcttnagtagcacataaacaaaaagcaacgagaaagcaag

SEQ ID NO: 7468 - DNA, 71 bp, chicken (Gallus Gallus)
  misc_feature (36): n=c or t
aacttattaagcttctcatcacaacttgaaagccangctgtgatcaagcaatacaagctacaaaagtaaac

SEQ ID NO: 7469 - DNA, 71 bp, chicken (Gallus Gallus)
  misc_feature (36): n=g or t
ttcaagaagaaacacattcaaggtgcaggtaaaagncaacgcgttgacaccagcactgagtgtaaccatag

SEQ ID NO: 7470 - DNA, 71 bp, chicken (Gallus Gallus)
  misc_feature (36): n=a or g
taccacagttagcagaatacttaatttttctgttanttttgtggttgttcttttccatgagcaatgaataa

SEQ ID NO: 7471 - DNA, 71 bp, chicken (Gallus Gallus)
  misc_feature (36): n=a or t
gcaaattccaagaaggtcatataatctgagtaactnttttgcatcacaatgataggcatcatgtcttaact

SEQ ID NO: 7472 - DNA, 71 bp, chicken (Gallus Gallus)
  misc_feature (36): n=c or t
acaaatcctgaggcactttctgaaaatattaccccngttcttttggcactcttgcctggaatttcacatct

SEQ ID NO: 7473 - DNA, 71 bp, chicken (Gallus Gallus)
  misc_feature (36): n=a or g
tcagttaccttgttgtgtgtaacagataaccatcanctcctggctcacatctccacttcttctgactggaa

SEQ ID NO: 7474 - DNA, 71 bp, chicken (Gallus Gallus)
  misc_feature (36): n=a or g
ccagtttcatggatgaattcttcctaaattctgaancaagctatctgaattctttaatcaagccaatggaa

SEQ ID NO: 7475 - DNA, 71 bp, chicken (Gallus Gallus)
  misc_feature (36): n=g or t
agaggataagaatatgggttgcagacaagcaatagngcatcagaataatacttgaatggtatcttctttta

SEQ ID NO: 7476 - DNA, 71 bp, chicken (Gallus Gallus)
  misc_feature (36): n=c or t
gagagggccaggtattctcaccggtccagtcgacantcgtatttggtttgtgttgaaactgtatttttccc

SEQ ID NO: 7477 - DNA, 71 bp, chicken (Gallus Gallus)
  misc_feature (36): n=a or c
tgtggacccacttaatttcacaagctttactcctanagtgatcctaaagtaatgttcctatttatttccat

SEQ ID NO: 7478 - DNA, 71 bp, chicken (Gallus Gallus)
  misc_feature (36): n=c or t
cacagatcctttccaacacacttcattccctttccngttttcatgcacatatgctttttctattagtcaaa

SEQ ID NO: 7479 - DNA, 71 bp, chicken (Gallus Gallus)
  misc_feature (36): n=a or g
ttttttgttatgtgaaaaacttgctatgacttattntttattactacatttttatttcttttaatttttcc

SEQ ID NO: 7480 - DNA, 71 bp, chicken (Gallus Gallus)
  misc_feature (36): n=a or g
cgagatcaagagcagcctcagcaagtttgcagaccncaacaagttgagtagtgcatttgacgtgctagagg

SEQ ID NO: 7481 - DNA, 71 bp, chicken (Gallus Gallus)
  misc_feature (36): n=a or g
cagttcatgattctctcattcatagtgcatattacnaatatgtgatgaatgagagaattattgtgcattat

SEQ ID NO: 7482 - DNA, 71 bp, chicken (Gallus Gallus)
  misc_feature (36): n=a or g
taacactagaagtttccactgatttatcagtttccntgtgttttctcacaataagcccttgggaggtgcag

SEQ ID NO: 7483 - DNA, 71 bp, chicken (Gallus Gallus)
  misc_feature (36): n=a or g
aacaaatctgcaaaagtaaaacaaacagcttccacnggattcctgcaagataatggtcagtactgagataa

SEQ ID NO: 7484 - DNA, 71 bp, chicken (Gallus Gallus)
  misc_feature (36): n=c or g
tgtttcacttgctgaaaggtttgtcctttttctagntgtaactgatgcagtgaggcatgcatttgaattga

SEQ ID NO: 7485 - DNA, 71 bp, chicken (Gallus Gallus)
  misc_feature (36): n=c or t
tctgagatacagagacagcctggttgggtgaggctnacagcttcattagtagcacagcagcttgtatcagc

SEQ ID NO: 7486 - DNA, 71 bp, chicken (Gallus Gallus)
  misc_feature (36): n=c or t
gtgagatagaaaccttgacactcaacagtctcccangtacacgcatacagttgcttaggccctcatataaa

SEQ ID NO: 7487 - DNA, 71 bp, chicken (Gallus Gallus)
  misc_feature (36): n=a or t
aaacttcagttttggaggaggtacaacacaactttntttctgcatgaagatgtttcctataagaggtcatc

SEQ ID NO: 7488 - DNA, 71 bp, chicken (Gallus Gallus)
  misc_feature (36): n=c or g
tcctttccaactgaaaccaagacatatcctaatagnagcattattaaaagcactcattgtaatggcaggca

SEQ ID NO: 7489 - DNA, 71 bp, chicken (Gallus Gallus)
  misc_feature (36): n=c or t
tggaacataggagaacaggccaaaagcccttagganataaggattaagatttaaaaaaaataataaaaata

SEQ ID NO: 7490 - DNA, 71 bp, chicken (Gallus Gallus)
  misc_feature (36): n=c or t
gcatctctgggcaacctgttccagtgcctcaccacncttactgcaaaaacgttttccttatatctggccta

SEQ ID NO: 7491 - DNA, 71 bp, chicken (Gallus Gallus)
  misc_feature (36): n=g or t
acagtgaatggacaactgcaaaaacattgttcaatntaacaggtccaccagcagatgtcttacctgctaag

SEQ ID NO: 7492 - DNA, 71 bp, chicken (Gallus Gallus)
  misc_feature (36): n=c or g
acttggctcttccctcaaggccggaatctgaatagntttttgttccttcccattttgtggggtgggaatat

SEQ ID NO: 7493 - DNA, 71 bp, chicken (Gallus Gallus)
  misc_feature (36): n=a or c
tctgctatgttttgcatagaatagatggaggcaggnaggaatttgggaggagtgagctgtgattctaggct

SEQ ID NO: 7494 - DNA, 71 bp, chicken (Gallus Gallus)
  misc_feature (36): n=c or g
ctgtggttgtaggacatgctgcaccaggcttcccantctgtctccttgtgagaggttccttagatagctct

SEQ ID NO: 7495 - DNA, 71 bp, chicken (Gallus Gallus)
  misc_feature (36): n=a or g
tttgtgttgaaaagcaaatgtcaagaacagaaaccngttttggagaaatcaaagtaatttttaatttttct

SEQ ID NO: 7496 - DNA, 71 bp, chicken (Gallus Gallus)
  misc_feature (36): n=g or t
tgcaggatcacagaagcgtccttagtctggtaggtntgacactgtagttttcatgttaggtatagtccaca

SEQ ID NO: 7497 - DNA, 71 bp, chicken (Gallus Gallus)
  misc_feature (36): n=a or c
acaaatgaaagcgcatgcgtaaagcagtgctgagcncatgcgtaaagttaagcgcatgtccaatggaattg

SEQ ID NO: 7498 - DNA, 71 bp, chicken (Gallus Gallus)
  misc_feature (36): n=c or t
cctgtgagaaattgggcaggacttccacggagctanggcatagttgtttgtgatggccctgaggatacttg

SEQ ID NO: 7499 - DNA, 71 bp, chicken (Gallus Gallus)
  misc_feature (36): n=a or g
tctctgcttacaggtatgggtatcccaatctgcccncaggctttaatcagttctgatttttacatgctcct

SEQ ID NO: 7500 - DNA, 71 bp, chicken (Gallus Gallus)
  misc_feature (36): n=c or t
acagtgattccccttggcactccttttgttgtctangtatttctaaaatcactttttgttatcttttacaa

SEQ ID NO: 7501 - DNA, 71 bp, chicken (Gallus Gallus)
  misc_feature (36): n=c or g
gtatttaaaagtagttggatgaaattgtttttatanagggcaggtgcagcctacaacagcaatagaattaa

SEQ ID NO: 7502 - DNA, 71 bp, chicken (Gallus Gallus)
  misc_feature (36): n=a or g
tgcccttcactttcccctcccattaacacataagantatctatgctttctcatactttgatcacagaaaaa

SEQ ID NO: 7503 - DNA, 71 bp, chicken (Gallus Gallus)
  misc_feature (36): n=a or g
ccttcaaaccagatgtttgaaatgtggatgcactcngataagcctgcacctaggcagcagcaataaccaag

SEQ ID NO: 7504 - DNA, 71 bp, chicken (Gallus Gallus)
  misc_feature (36): n=c or t
gagatggggatttacagtgtgcagaactgggagtcntgttttaactatgattctctgtaatctccagttca

SEQ ID NO: 7505 - DNA, 71 bp, chicken (Gallus Gallus)
  misc_feature (36): n=c or t
gattcttcatgggtctgtaagagaggaggtgatttntagaggtcttctggtgaatttagaaactgctctgt

SEQ ID NO: 7506 - DNA, 71 bp, chicken (Gallus Gallus)
  misc_feature (36): n=a or g
cacttctcttcttcattcctctaggagggaggaggnagcaaaaattggtgctgagctgttgccagattaaa

SEQ ID NO: 7507 - DNA, 71 bp, chicken (Gallus Gallus)
  misc_feature (36): n=c or t
tttggtggccttaggcctgctgcactgctgtggagngggagtctattttgaagcttgtgtctttagatacc

SEQ ID NO: 7508 - DNA, 71 bp, chicken (Gallus Gallus)
  misc_feature (36): n=a or t
gcactcggtgcttttgttatataaaattttaagagnggatttgcaaatattcaacactggtgtcgcatcta

SEQ ID NO: 7509 - DNA, 71 bp, chicken (Gallus Gallus)
  misc_feature (36): n=a or g
agcaaccttaacaatttattcgaccacatctgtcanccatacagactagaactaccatatttcctgcacct

SEQ ID NO: 7510 - DNA, 71 bp, chicken (Gallus Gallus)
  misc_feature (36): n=a or g
gtcgttcatatttaatcacctaatttacaactaatngcttgcaggtttgccagggacatttttctctccag

SEQ ID NO: 7511 - DNA, 71 bp, chicken (Gallus Gallus)
  misc_feature (36): n=c or t
agactttaccaggcaagacacagcagggtgtacatngaaagccaaaagcatttctttggtttggtttttgg

SEQ ID NO: 7512 - DNA, 71 bp, chicken (Gallus Gallus)
  misc_feature (36): n=a or g
agcaattctatgattctatgattctaagatgggagnctccacaaactgactgaaggaacattccatatcaa

SEQ ID NO: 7513 - DNA, 71 bp, chicken (Gallus Gallus)
  misc_feature (36): n=a or g
tcccacagcactttaagatggtaatcgagtcgctcnctcttatccagcacactgacagcctcgcaacaaac

SEQ ID NO: 7514 - DNA, 71 bp, chicken (Gallus Gallus)
  misc_feature (36): n=a or g
cacaaataatcacctagtttagcaaggatttacaanccaatgccatttcagagcagcataccaaagaaagg

SEQ ID NO: 7515 - DNA, 71 bp, chicken (Gallus Gallus)
  misc_feature (36): n=c or t
cctatcagtgacagtgcgaagtaagtcagcagaccngtactctggtggttttcccactaatggaatcacac

SEQ ID NO: 7516 - DNA, 71 bp, chicken (Gallus Gallus)
  misc_feature (36): n=c or t
cacaattactgtatgctaaaaccatgctgagcctanagcatctgctttacaagctgcttttctgggctcct

SEQ ID NO: 7517 - DNA, 71 bp, chicken (Gallus Gallus)
  misc_feature (36): n=a or g
aaaaaataaaattatgctatcttaaaaagtgatgancaatggtaacttttaaggaagttatacatcagaat

SEQ ID NO: 7518 - DNA, 71 bp, chicken (Gallus Gallus)
  misc_feature (36): n=c or t
gcctttacacatcagctgaggtgcctgaggagagcngagaagtttggtcaggatgactatacaagctcaga

SEQ ID NO: 7519 - DNA, 71 bp, chicken (Gallus Gallus)
  misc_feature (36): n=c or t
agctattatttgcctaagaagctctgatacttacanggaaaatgagtatatacgtagatagaattatattt

SEQ ID NO: 7520 - DNA, 71 bp, chicken (Gallus Gallus)
  misc_feature (36): n=a or c
ggagagtatgagcaaagaaaagttttcaaacatttnaaacctcctggttactattcagctgaagtcataaa

SEQ ID NO: 7521 - DNA, 71 bp, chicken (Gallus Gallus)
  misc_feature (36): n=c or t
gcaatgatcagaagtacaagttgagaaccagactantctataagaaaactttctgagagaataggaaatga

SEQ ID NO: 7522 - DNA, 71 bp, chicken (Gallus Gallus)
  misc_feature (36): n=c or g
ttggtgttcatcatcaaggctaccattttccattgntttggtagacactgtatggtatttcatgcattttc

SEQ ID NO: 7523 - DNA, 71 bp, chicken (Gallus Gallus)
  misc_feature (36): n=c or g
tggtctctgcccaagacaactcccgacctctacatntaccaccagtccactgttcatgaacagcaggtcta

SEQ ID NO: 7524 - DNA, 71 bp, chicken (Gallus Gallus)
  misc_feature (36): n=c or t
tatttatttggttggtaagctggaaacctgcagganctctggagggaacaaatgggatttaggcctcagga

SEQ ID NO: 7525 - DNA, 71 bp, chicken (Gallus Gallus)
  misc_feature (36): n=c or t
ctcttcctgcatcttcctgctctgtgtcagtgaaantgctgatggttcttttatctgacgagcacaaatta

SEQ ID NO: 7526 - DNA, 71 bp, chicken (Gallus Gallus)
  misc_feature (36): n=g or t
atcgtgaggaagaagcagatcactgtaagcacaaangtatcatctttcctggctatatctactgcaacaga

SEQ ID NO: 7527 - DNA, 71 bp, chicken (Gallus Gallus)
  misc_feature (36): n=a or g
cctctaattatataaggtacactgaggtgcatttantgtcattttaatagttcacttgtgaagaggttaaa

SEQ ID NO: 7528 - DNA, 71 bp, chicken (Gallus Gallus)
  misc_feature (36): n=a or g
aggaaaaatacagggagaaaagcaacaggtctcccntattccactggaaaattactgagcctctgcacatt

SEQ ID NO: 7529 - DNA, 71 bp, chicken (Gallus Gallus)
  misc_feature (36): n=c or t
gtgaatgtgataaataacttataccttccctgcctntaggtgctgatattgctaatgtttgtaacgaagct

SEQ ID NO: 7530 - DNA, 71 bp, chicken (Gallus Gallus)
  misc_feature (36): n=c or t
aacaaaattacttcataaattgcctaaaaatttccngaagtcttggttttgttctgttttgttttcctcct

SEQ ID NO: 7531 - DNA, 71 bp, chicken (Gallus Gallus)
  misc_feature (36): n=a or c
tcgtctgtggtgcataatactaggctgggaatatanattttttctgtggtcacgcagaacgtgccaatctt

SEQ ID NO: 7532 - DNA, 71 bp, chicken (Gallus Gallus)
  misc_feature (36): n=g or t
tcaatctcaaccattcatttaaaaagctcgctcctntagaaaaacaatgatagggtctgcaaggaaacaca

SEQ ID NO: 7533 - DNA, 71 bp, chicken (Gallus Gallus)
  misc_feature (36): n=a or g
ttttctctttttcatacctgttttttattttgtccnttacttgggaacaaaaagtcatggagacagtattt

SEQ ID NO: 7534 - DNA, 71 bp, chicken (Gallus Gallus)
  misc_feature (36): n=c or t
tagttctcaaaatgtttcatccaaaggtacgctacntcatagcttcccctgaattttatctgttattcaat

SEQ ID NO: 7535 - DNA, 71 bp, chicken (Gallus Gallus)
  misc_feature (36): n=g or t
tttcacagtatttctgataattttaaaacagtacanagtataactcagaattaatatgctgaaatctacaa

SEQ ID NO: 7536 - DNA, 71 bp, chicken (Gallus Gallus)
  misc_feature (36): n=c or t
gtatagatgcacttctgctgggctattggacacctngcagccacggcacgctgccccaggctcctatctag

SEQ ID NO: 7537 - DNA, 71 bp, chicken (Gallus Gallus)
  misc_feature (36): n=a or g
cctcaatgaaattaaacaaaaccctgcaatgagctnaagaaatacattctcacttttatgactttatttga

SEQ ID NO: 7538 - DNA, 71 bp, chicken (Gallus Gallus)
  misc_feature (36): n=c or t
gggtggcagaagggagttttgcaattcaaagcattngggaattactggtgtgggaggttgcaaagaatatt

SEQ ID NO: 7539 - DNA, 71 bp, chicken (Gallus Gallus)
  misc_feature (36): n=c or t
gccttccattacgttataggccaacgtgtgttatcngtcttaaatgacactttcaagaggttctgtgaact

SEQ ID NO: 7540 - DNA, 71 bp, chicken (Gallus Gallus)
  misc_feature (36): n=a or g
aaattcggaataaaatatgatcaaattaatcttcanctgtgaaagtcctgtagctcaatttacctatagta

SEQ ID NO: 7541 - DNA, 71 bp, chicken (Gallus Gallus)
  misc_feature (36): n=a or g
ttggaaagctctttctgccaatcctgcaggagatgnaggacactcagaaggggagcggtcaccacctccac

SEQ ID NO: 7542 - DNA, 71 bp, chicken (Gallus Gallus)
  misc_feature (36): n=c or g
caaagtgaaaactccggataattcactcagacaaanagttttcagaactgtttctctccatggatgcacac

SEQ ID NO: 7543 - DNA, 71 bp, chicken (Gallus Gallus)
  misc_feature (36): n=a or g
tctatagtttacaattaaaactttcagcagaacgcnatgtttttctctctatttcctttttttttcttcca

SEQ ID NO: 7544 - DNA, 71 bp, chicken (Gallus Gallus)
  misc_feature (36): n=g or t
aaatcactgtctttagcctgactgtgacactcgtantttttgcaaaacagctttattctctgtgtgttttt

SEQ ID NO: 7545 - DNA, 71 bp, chicken (Gallus Gallus)
  misc_feature (36): n=c or t
ccattgttgtcattcttttgggtatttcaggtgtantctcttttatgaattgtaatttctattagaaatac

SEQ ID NO: 7546 - DNA, 71 bp, chicken (Gallus Gallus)
  misc_feature (36): n=c or t
ctgggttagcaacaaaagctttgcgaagtgcagctnggaaactgcctttgaataagcaaagccctgctttt

SEQ ID NO: 7547 - DNA, 71 bp, chicken (Gallus Gallus)
  misc_feature (36): n=c or t
cttcatgatgtttcctcaggtgctgccagatttctnattaaggagctttcgtaccacaatctggagctgga

SEQ ID NO: 7548 - DNA, 71 bp, chicken (Gallus Gallus)
  misc_feature (36): n=c or g
tgggatggaagaatattatcaaatatttatcatatnatttaataaaaatgggttgttttttttttttttat

SEQ ID NO: 7549 - DNA, 71 bp, chicken (Gallus Gallus)
  misc_feature (36): n=c or t
aggagcagcagcatctgcctgtgctccaaaccctgngtttcctataaaaccagaactgagacactttgaaa

SEQ ID NO: 7550 - DNA, 71 bp, chicken (Gallus Gallus)
  misc_feature (36): n=a or c
tctataagtgtaaaagaggaactaatcataagacanttttgcaatctattccagcatacactgcaaggagt

SEQ ID NO: 7551 - DNA, 71 bp, chicken (Gallus Gallus)
  misc_feature (36): n=c or t
gaaagcaaactagtcacacagcagagatgtacccantgtacaagcaaaatcagactacttcccctatttcc

SEQ ID NO: 7552 - DNA, 71 bp, chicken (Gallus Gallus)
  misc_feature (36): n=c or t
cttcgcatttcattaccaactccttttcaacaaagntgctactcagccagctagtgacaccactgagacag

SEQ ID NO: 7553 - DNA, 71 bp, chicken (Gallus Gallus)
  misc_feature (36): n=c or t
gtggtattgtagactctgcaacaggatgactgtggnttcacccagtcaaaatagtcatcaatccaggatga

SEQ ID NO: 7554 - DNA, 71 bp, chicken (Gallus Gallus)
  misc_feature (36): n=g or t
caagacccacttccatcagccttcagccagtactgngtctgatcaaaaatgcaatgttcccagttatgggc

SEQ ID NO: 7555 - DNA, 71 bp, chicken (Gallus Gallus)
  misc_feature (36): n=c or t
tcaccttcctccccttccatcatagatgtgggctanagcaaagctgatggttggaaatgtctgtcccctgg

SEQ ID NO: 7556 - DNA, 71 bp, chicken (Gallus Gallus)
  misc_feature (36): n=c or t
acaactaataaacactctatgaactcctctattagnggattcatagttctattcagaaggtccttctatgt

SEQ ID NO: 7557 - DNA, 71 bp, chicken (Gallus Gallus)
  misc_feature (36): n=a or c
gcaagcctctacattttgctaaaaagtggattactnaaacagcattgcacactacaattatattggtggct

SEQ ID NO: 7558 - DNA, 71 bp, chicken (Gallus Gallus)
  misc_feature (36): n=a or g
tttcttttttttttttttttccaggggaaagcaatnaaggaacattaaaccatcattttttattgtaggta

SEQ ID NO: 7559 - DNA, 71 bp, chicken (Gallus Gallus)
  misc_feature (36): n=c or t
aaaattcatgctgtgaattttactcctcccttcaancaacacagcaccaaataataaaaaataaataaata

SEQ ID NO: 7560 - DNA, 71 bp, chicken (Gallus Gallus)
  misc_feature (36): n=a or g
aaaggacatgctggtttctagcttctctcttgtctntaatgagtcagttagtaaagctaagcagtaaagtg

SEQ ID NO: 7561 - DNA, 71 bp, chicken (Gallus Gallus)
  misc_feature (36): n=g or t
gctttcctcttagtctctcagaacaaggattcagtngcacagctctagaaaatagtaggtataatagtcat

SEQ ID NO: 7562 - DNA, 71 bp, chicken (Gallus Gallus)
  misc_feature (36): n=c or t
aacttcaatttgctcttgtgtagctctgcatccttngccaccattaaagacatctgtagagcagatattaa

SEQ ID NO: 7563 - DNA, 71 bp, chicken (Gallus Gallus)
  misc_feature (36): n=g or t
gcttcaggatataggcaagctttaaaaagacaatangcaccactgttagagagtttttagatttaggaaac

SEQ ID NO: 7564 - DNA, 71 bp, chicken (Gallus Gallus)
  misc_feature (36): n=a or g
ctataatcatacatactctagtgttagattggatgnctcaatatcagtagtttcccaccttctaacttgct

SEQ ID NO: 7565 - DNA, 71 bp, chicken (Gallus Gallus)
  misc_feature (36): n=a or t
tcacagaggaaatgagaaatccccaaggtggtgagngtccccttccttcatctgatgaatggaaagtgtca

SEQ ID NO: 7566 - DNA, 71 bp, chicken (Gallus Gallus)
  misc_feature (36): n=c or t
tgagagcagacctgcagaggacttagagatattagnagatgaaaaattggatgcaagccagcactgagcac

SEQ ID NO: 7567 - DNA, 71 bp, chicken (Gallus Gallus)
  misc_feature (36): n=a or g
ttctctgaagagaatatttctatttctttgctgagncttgcctgggaaaaacaactgtatctggttctgaa

SEQ ID NO: 7568 - DNA, 71 bp, chicken (Gallus Gallus)
  misc_feature (36): n=c or g
ttaatttttattactggagctactgcctgtaacttngacttttgatggtgcacaaaaagcacactgaacaa

SEQ ID NO: 7569 - DNA, 71 bp, chicken (Gallus Gallus)
  misc_feature (36): n=a or g
ctgtactgatgtttactccataaaccagagactagnaatgattcaacttgttctttagaacagagtttcat

SEQ ID NO: 7570 - DNA, 71 bp, chicken (Gallus Gallus)
  misc_feature (36): n=a or t
agaatgttgtgctttcagttatgcttttcatttatncctgatcttaagcaaacttcacgttagctcctaca

SEQ ID NO: 7571 - DNA, 71 bp, chicken (Gallus Gallus)
  misc_feature (36): n=a or g
ttcagtgatacttgaaattactttttcaagttaacngcaaaagcttttccgtgttctatttctggattgat

SEQ ID NO: 7572 - DNA, 71 bp, chicken (Gallus Gallus)
  misc_feature (36): n=c or t
gtctccctgtagtatgatagggatctctacaaatgntttgcatgatgatgttttgtatatatgctccaaat

SEQ ID NO: 7573 - DNA, 71 bp, chicken (Gallus Gallus)
  misc_feature (36): n=c or t
ttctgtttttgctgactttatcacatttattgcttnctttctgactcatcacatttttagtggaatcggtt

SEQ ID NO: 7574 - DNA, 71 bp, chicken (Gallus Gallus)
  misc_feature (36): n=a or c
ctgtgaaaggaaaatctgcatgcacctgaagagaanatggcaagaatcattctgaaaatggaccttggaag

SEQ ID NO: 7575 - DNA, 71 bp, chicken (Gallus Gallus)
  misc_feature (36): n=c or t
ctgttagggccctttctgctccttgtcctgacagtnggtgggatctacataggtggtttccaggctcctga

SEQ ID NO: 7576 - DNA, 71 bp, chicken (Gallus Gallus)
  misc_feature (36): n=a or t
taaggatttttaaaggtctgacttctctccaccacncttcttactctagactgcaaaactcaaaggaaaga

SEQ ID NO: 7577 - DNA, 71 bp, chicken (Gallus Gallus)
  misc_feature (36): n=c or t
gggcgttatatttaatgtactgtaaactagaatgcnagaacaatgaactcttcaaaacactttataaaatc

SEQ ID NO: 7578 - DNA, 71 bp, chicken (Gallus Gallus)
  misc_feature (36): n=a or g
aattgtcactatggtttattgacgcagtaattatanaaattacatttgaaacatatagataaactgacaat

SEQ ID NO: 7579 - DNA, 71 bp, chicken (Gallus Gallus)
  misc_feature (36): n=c or t
gtgcaagtagagaccattcactgatttaggacttcncattcagatgcttattatgatgcaagagaagggat

SEQ ID NO: 7580 - DNA, 71 bp, chicken (Gallus Gallus)
  misc_feature (36): n=c or t
attaaaaaaaaaaaaacaacaaaaaaaaacatcccngagggatggttacttaagatactaagaagtctttt

SEQ ID NO: 7581 - DNA, 71 bp, chicken (Gallus Gallus)
  misc_feature (36): n=a or g
gcaagcttcggttcagctggaacatagtaattaccngctttcctggccatcctggccatgcggatctcctg

SEQ ID NO: 7582 - DNA, 71 bp, chicken (Gallus Gallus)
  misc_feature (36): n=a or t
ttgagtttctggtcataagcatgaaagttgcttacntaaattcaagcctgcaaactgaaacaccagcgttg

SEQ ID NO: 7583 - DNA, 71 bp, chicken (Gallus Gallus)
  misc_feature (36): n=c or t
agtccttagaaggttagttcgattacttatctttgnccctgaaaaccagctgaagctagtggaagagcatg

SEQ ID NO: 7584 - DNA, 71 bp, chicken (Gallus Gallus)
  misc_feature (36): n=a or g
ctgttaggggtcaaagggagaaacagaaatccacancaccaaagaatcagtgatcggagccttgtggtaaa

SEQ ID NO: 7585 - DNA, 71 bp, chicken (Gallus Gallus)
  misc_feature (36): n=c or t
ttagctttacatttgggcttattcatattcagaacnaagtctaaacgataagagattttgaactgtcctca

SEQ ID NO: 7586 - DNA, 71 bp, chicken (Gallus Gallus)
  misc_feature (36): n=a or c
gtgaagctacactagaaagactcaaacctttcatanagcagaattaagcagtgcttcagaaaaaaaaaaaa

SEQ ID NO: 7587 - DNA, 71 bp, chicken (Gallus Gallus)
  misc_feature (36): n=a or c
tatggaaatatgggattgtgaatataagttgacacnctgtgagataagcaagaaaaaattaacgttcatag

SEQ ID NO: 7588 - DNA, 71 bp, chicken (Gallus Gallus)
  misc_feature (36): n=a or g
gaagtatttcagtgcagctagttggtctttgaacanctgtgcattgttttctgcactagtgccccagtgat

SEQ ID NO: 7589 - DNA, 71 bp, chicken (Gallus Gallus)
  misc_feature (36): n=c or t
gtatcttccaacttcccagttgccactgacaagaancactttgatgggctcctgcctctacatcctctgct

SEQ ID NO: 7590 - DNA, 71 bp, chicken (Gallus Gallus)
  misc_feature (36): n=c or t
atttggcttgcgagagcttccagacattgcttcttnactaccaagaattttcttattgcaaatatcctcac

SEQ ID NO: 7591 - DNA, 71 bp, chicken (Gallus Gallus)
  misc_feature (36): n=c or t
ctgaataatacatcaacttgtttgcaccatcagcanagtttcaaagaagagtttgttattcttttatttaa

SEQ ID NO: 7592 - DNA, 71 bp, chicken (Gallus Gallus)
  misc_feature (36): n=a or g
tgtagtagaggttctgctgtagcatctcattagctngtatgtttatcgaccaagccagatgggatgagaca

SEQ ID NO: 7593 - DNA, 71 bp, chicken (Gallus Gallus)
  misc_feature (36): n=c or t
gccttagaatttcttgggttatgtgacagctgtggnattccccttctaaagctgaagttggttcctgaagt

SEQ ID NO: 7594 - DNA, 71 bp, chicken (Gallus Gallus)
  misc_feature (36): n=a or g
tgtctccatcatcgtggcactgctgtgacttggacngtgaaatgatttgcattactgaccaagtagtatgt

SEQ ID NO: 7595 - DNA, 71 bp, chicken (Gallus Gallus)
  misc_feature (36): n=c or t
atcatctttctttgtttagaatgtttaatagacctngaaccagtcctgagaacgtttgatgaaatagctat

SEQ ID NO: 7596 - DNA, 71 bp, chicken (Gallus Gallus)
  misc_feature (36): n=a or g
cacatcaaacctcattagttacttgatcaaccaggngactgagttgcaccaaaaaaagtggtaaacgtcat

SEQ ID NO: 7597 - DNA, 71 bp, chicken (Gallus Gallus)
  misc_feature (36): n=a or g
ttcaaacaaacagccatagtgttgtcttttggagtnctgcactactggtatttcttattagatgcttagag

SEQ ID NO: 7598 - DNA, 71 bp, chicken (Gallus Gallus)
  misc_feature (36): n=a or g
caagagtctggtattcggacttctccaactttgttnttgtacctactttctaatgtaatgatgcattatat

SEQ ID NO: 7599 - DNA, 71 bp, chicken (Gallus Gallus)
  misc_feature (36): n=a or t
tgcagagatggttggacagctcctgagacaacactncatgagccaccttgcccagctgggaataacccagc

SEQ ID NO: 7600 - DNA, 71 bp, chicken (Gallus Gallus)
  misc_feature (36): n=c or t
cagccacagccgtgacctgagcatctcgcgtggtcnggcattctgaacatgaagtgcctcatctttgcttt

SEQ ID NO: 7601 - DNA, 71 bp, chicken (Gallus Gallus)
  misc_feature (36): n=c or t
aacaaacaaacaaacaaactccagacacacaacatnctaaatggaaaattgcatagcactgtagttgcatg

SEQ ID NO: 7602 - DNA, 71 bp, chicken (Gallus Gallus)
  misc_feature (36): n=c or t
tgctgcctctccttttgtctgcacagggatgaaacngagtgcagatgaacttgagacagcaaggaaggcac

SEQ ID NO: 7603 - DNA, 71 bp, chicken (Gallus Gallus)
  misc_feature (36): n=a or g
caatactgaggattcggtgattacagatgatgaacncaaaattaattggataacgccaggatggaaatcct

SEQ ID NO: 7604 - DNA, 71 bp, chicken (Gallus Gallus)
  misc_feature (36): n=a or g
gagagaatggatggaggcatggcaggttagatgganaaggagactctttgtttcccactctgtcaggtcct

SEQ ID NO: 7605 - DNA, 71 bp, chicken (Gallus Gallus)
  misc_feature (36): n=g or t
ctctttcgatattctgtgattctatcacagcggggnttcttttctacttctgctgcttgcgtttagcttgg

SEQ ID NO: 7606 - DNA, 71 bp, chicken (Gallus Gallus)
  misc_feature (36): n=g or t
gactcagtgatccctctttgtccctgcctactcttncgatattctgtgattctatcacagcgggggttctt

SEQ ID NO: 7607 - DNA, 71 bp, chicken (Gallus Gallus)
  misc_feature (36): n=a or g
tttagacaaaccttgccaacaggaacattcttaacntcttctacaaacacaacttccctcagagaccactg

SEQ ID NO: 7608 - DNA, 71 bp, chicken (Gallus Gallus)
  misc_feature (36): n=c or t
atctggatctgaattagaactgctctgacagtttgnattactagaagtgcctggaaatttgacagcaacat

SEQ ID NO: 7609 - DNA, 71 bp, chicken (Gallus Gallus)
  misc_feature (36): n=c or g
cagcgtatgatatgcagtgggttgtgtttatgtganttaatactcagaatatgctctgacatccccacact

SEQ ID NO: 7610 - DNA, 71 bp, chicken (Gallus Gallus)
  misc_feature (36): n=c or g
acagtttgcagttctggaaatgtccactgctgctgncaaatagacctcaggaggaggaactttccctacca

SEQ ID NO: 7611 - DNA, 71 bp, chicken (Gallus Gallus)
  misc_feature (36): n=c or g
tggatagttcacctatcctttattgataatagaggntgcatttgtatcatatgctgataattttcctttct

SEQ ID NO: 7612 - DNA, 71 bp, chicken (Gallus Gallus)
  misc_feature (36): n=a or g
tcccattcccccttaaatcagtgcgaagagatgcantgatccctttgcttttgaggccaccgcattaattc

SEQ ID NO: 7613 - DNA, 71 bp, chicken (Gallus Gallus)
  misc_feature (36): n=a or g
tcctagctcttcagtgttgcattcattttcaaaatncctagttgtttacatacgaagtaccagaatttttc

SEQ ID NO: 7614 - DNA, 71 bp, chicken (Gallus Gallus)
  misc_feature (36): n=a or g
tctgaaggtttttttttttttctgtcctattttacngcagtatagaaattgaacaccaaaattctgcttat

SEQ ID NO: 7615 - DNA, 71 bp, chicken (Gallus Gallus)
  misc_feature (36): n=a or g
gatgtccccatacagagactacatattacacctggngtagatggtctttgtgttttaaggaagcccactcc

SEQ ID NO: 7616 - DNA, 71 bp, chicken (Gallus Gallus)
  misc_feature (36): n=c or t
cccatttacactcagaaagattggctgtgctgtgtngctgtcctgttcatcagttctcaccttgcacttac

SEQ ID NO: 7617 - DNA, 71 bp, chicken (Gallus Gallus)
  misc_feature (36): n=c or t
tcagtagtgtccaaagaccctggtatacggttgcangttggcaaagaccacacattttctaattaaatttc

SEQ ID NO: 7618 - DNA, 71 bp, chicken (Gallus Gallus)
  misc_feature (36): n=c or t
gaaaatagctgagcatacatacatgcatgaattaantttgccttatcacagatgcgttcacaacttccaga

SEQ ID NO: 7619 - DNA, 71 bp, chicken (Gallus Gallus)
  misc_feature (36): n=a or g
ttaaccattattattacttaagatcagtgtcaatcntaggatcagggaatcatagtatcatagggtcatag

SEQ ID NO: 7620 - DNA, 71 bp, chicken (Gallus Gallus)
  misc_feature (36): n=c or t
tttccttgctatatccatggtgttttttttcagagnggtctcctgtgagcattctggaagcagctcttccc

SEQ ID NO: 7621 - DNA, 71 bp, chicken (Gallus Gallus)
  misc_feature (36): n=c or t
tgatctattcataaactcaaagttaattttactccntatagaattttcttggggcttaacctcagtctgca

SEQ ID NO: 7622 - DNA, 71 bp, chicken (Gallus Gallus)
  misc_feature (36): n=c or t
cacacatgctttggaagcaagtgcctcctctttaanatcaaccacacctaccagggtatgtgtgcactgaa

SEQ ID NO: 7623 - DNA, 71 bp, chicken (Gallus Gallus)
  misc_feature (36): n=a or g
acacactgacagtttaaggaagagatttcccacatntggatctatgggaaattcaaacttctgatcatgat

SEQ ID NO: 7624 - DNA, 71 bp, chicken (Gallus Gallus)
  misc_feature (36): n=a or g
gtgagcaggtgatctcatgtgaccatgagctgccancctggcagaagcatgtgtgttggggtctgtttgca

SEQ ID NO: 7625 - DNA, 71 bp, chicken (Gallus Gallus)
  misc_feature (36): n=a or c
tcattgctgcaagtcccccatgcccgtgaaggaggntggagccactgggagatgataaaaacatcaaccct

SEQ ID NO: 7626 - DNA, 71 bp, chicken (Gallus Gallus)
  misc_feature (36): n=c or g
ttgttaagtgaatacattcctcatgtctgttgcctncctgtatttctcactagggaggctaagtccccttg

SEQ ID NO: 7627 - DNA, 71 bp, chicken (Gallus Gallus)
  misc_feature (36): n=a or g
ctgctttattatgtgactctgggactggtgacatgntgcaatgtctacctgcgcttaagtgccacacgctg

SEQ ID NO: 7628 - DNA, 71 bp, chicken (Gallus Gallus)
  misc_feature (36): n=a or g
actgcatggtaacaaaaaaaattggctttagtttcnacaaggatattaagccactcttggtatagcaagaa

SEQ ID NO: 7629 - DNA, 71 bp, chicken (Gallus Gallus)
  misc_feature (36): n=a or g
gccttctgattagcatcagttcttccactactgacntatactgcaagtaaattaagtttttctcccactta

SEQ ID NO: 7630 - DNA, 71 bp, chicken (Gallus Gallus)
  misc_feature (36): n=c or g
gtcatcaacagtacccatctgttctgtatacctttnctttctttttctgttaattcttttcttatatcttc

SEQ ID NO: 7631 - DNA, 71 bp, chicken (Gallus Gallus)
  misc_feature (36): n=a or g
tgccactccattccccatggagcagtttgtcccacntatttatccatttatcaagacagatcatcaaacaa

SEQ ID NO: 7632 - DNA, 71 bp, chicken (Gallus Gallus)
  misc_feature (36): n=a or t
ctgcatttaaacagcagaagtgtcagagaaatcacnttagcaagcactcctgccaagcatttacagaaaag

SEQ ID NO: 7633 - DNA, 71 bp, chicken (Gallus Gallus)
  misc_feature (36): n=c or g
tcaagaagtcacatggtcacaaaagtaaggaaatantcagcctgggttaataactttcttagataacaaac

SEQ ID NO: 7634 - DNA, 71 bp, chicken (Gallus Gallus)
  misc_feature (36): n=c or t
taaaatcagatgtgggctgacagtgaaatatttcantgctgctttacagataaagatatttgaatggaaac

SEQ ID NO: 7635 - DNA, 71 bp, chicken (Gallus Gallus)
  misc_feature (36): n=c or g
aaaagtggaataaatcatgttgttcccttcaccctnaccctccactggcttaactagaatgagggctattc

SEQ ID NO: 7636 - DNA, 71 bp, chicken (Gallus Gallus)
  misc_feature (36): n=a or g
agtagactgactttttacacgatgtgatggtgaccnggcaagggggaaaggctttaaactaaaagaaagga

SEQ ID NO: 7637 - DNA, 71 bp, chicken (Gallus Gallus)
  misc_feature (36): n=a or g
gggaggatggtatctttgtatttctcaaaaccaganccctctccttcctctcccttagcagttgcttatca

SEQ ID NO: 7638 - DNA, 71 bp, chicken (Gallus Gallus)
  misc_feature (36): n=a or g
ttagaaataaattttatgcacactgtacatgacacntctgagttgtaagagcaagaacaggacagtgcttg

SEQ ID NO: 7639 - DNA, 71 bp, chicken (Gallus Gallus)
  misc_feature (36): n=a or g
ataggtctgtgatgtttcccacatagaaacatgccncttatctgattctgattccttgcagcagcagaaag

SEQ ID NO: 7640 - DNA, 71 bp, chicken (Gallus Gallus)
  misc_feature (36): n=c or t
cttcttaaatggagcacacagacacctggaaagganggctatttagaaccagcttataagaaatactcaaa

SEQ ID NO: 7641 - DNA, 71 bp, chicken (Gallus Gallus)
  misc_feature (36): n=a or g
caggacagacaagcatttgctgtacactagacaacnaccttggatgtcgaataataacaaagtacaccatt

SEQ ID NO: 7642 - DNA, 71 bp, chicken (Gallus Gallus)
  misc_feature (36): n=a or g
ccatgcagcctgaagtctgttattgatggcaaacangaatcagatagtatatgtaataagcaatacataca

SEQ ID NO: 7643 - DNA, 71 bp, chicken (Gallus Gallus)
  misc_feature (36): n=a or g
tgccatgcagtttgtctacagctgaggaagggcacntggagaggactgaaggctggagcagccaccgtggc

SEQ ID NO: 7644 - DNA, 71 bp, chicken (Gallus Gallus)
  misc_feature (36): n=g or t
tcagtctgtatgttttacaaattatgaaacccaaanaacaatccctaaagtgtggttctgttactgtacag

SEQ ID NO: 7645 - DNA, 71 bp, chicken (Gallus Gallus)
  misc_feature (36): n=a or g
ctgccacttcagctcatgaggcaatcaccaattgcncggcaaactgtctagcaaaggttctcaccatgctc

SEQ ID NO: 7646 - DNA, 71 bp, chicken (Gallus Gallus)
  misc_feature (36): n=c or t
ctgtaaaagagctgtaattctttctgaaagattgcnttgacttgttgctctgctcatctggtgtttgtgtt

SEQ ID NO: 7647 - DNA, 71 bp, chicken (Gallus Gallus)
  misc_feature (36): n=a or g
cggttacctgactgtgtatccaaataaggtccatcncttttaagggtaaggggctggatttgctcctgtgt

SEQ ID NO: 7648 - DNA, 71 bp, chicken (Gallus Gallus)
  misc_feature (36): n=a or c
caagagagaggcttcactgaaatacagaagagcaantggatgacagctagcctctgcacgaagagcacagc

SEQ ID NO: 7649 - DNA, 71 bp, chicken (Gallus Gallus)
  misc_feature (36): n=a or c
gaggagggggtgggacgtatctaagatgtatactgncccctaatctttgtacagagttattacctgataaa

SEQ ID NO: 7650 - DNA, 71 bp, chicken (Gallus Gallus)
  misc_feature (36): n=a or g
cagattccctaaccctccttggaggaataaacccantcttttcattaagtaaattcagacctgcatgagca

SEQ ID NO: 7651 - DNA, 71 bp, chicken (Gallus Gallus)
  misc_feature (36): n=a or t
gcctttataaataaggcactttaatgaccacaatancaaaaattgttaatgaagataatattccctcccta

SEQ ID NO: 7652 - DNA, 71 bp, chicken (Gallus Gallus)
  misc_feature (36): n=c or t
aaagcaaagactgcttttttttttcctccttgcaanacttggaaaatatctctgattctctccctttcccc

SEQ ID NO: 7653 - DNA, 71 bp, chicken (Gallus Gallus)
  misc_feature (36): n=c or t
tgctaacgtggtgcgctaccaggtcctgtgggcagnctgctgctacttcctcagtatgatatgccctaaat

SEQ ID NO: 7654 - DNA, 71 bp, chicken (Gallus Gallus)
  misc_feature (36): n=a or g
gataatatttggatgcctgcactgcttggagctaantccacgtgctgatgttgtgctctgagggcagcccc

SEQ ID NO: 7655 - DNA, 71 bp, chicken (Gallus Gallus)
  misc_feature (36): n=a or t
agcagaagaatgtggaagatgtctatatgcaaaacngcaagtctaccctcatttcctaagatctgtaccaa

SEQ ID NO: 7656 - DNA, 71 bp, chicken (Gallus Gallus)
  misc_feature (36): n=a or g
acacctgtcacaaggaggaaactcaggagcaggcangaaaaagaactgctgacttgcctgttcccttgccc

SEQ ID NO: 7657 - DNA, 71 bp, chicken (Gallus Gallus)
  misc_feature (36): n=a or g
gtaggaagtaaataaactatattctttgcctttgtntattttttttccatgtgcagagcatatactctgtt

SEQ ID NO: 7658 - DNA, 71 bp, chicken (Gallus Gallus)
  misc_feature (36): n=g or t
acatacctgcaatgattttcaaatgaaagaatgacnggatactctgatgtaacaaaagctgtttccttaat

SEQ ID NO: 7659 - DNA, 71 bp, chicken (Gallus Gallus)
  misc_feature (36): n=a or c
ctttgatatccacaggaaacacttttgcctgctgcncagtgatagcgatattgcgtgatagaggatctgat

SEQ ID NO: 7660 - DNA, 71 bp, chicken (Gallus Gallus)
  misc_feature (36): n=c or t
cagagtttcattaggtgttataccagtgcatttggntatggcatattaaccagagatactaaccttgatct

SEQ ID NO: 7661 - DNA, 71 bp, chicken (Gallus Gallus)
  misc_feature (36): n=c or t
tttgacagactgaatactgttgaggtaacattcatntgggagacctaataagccagaaccgcaagtgatcc

SEQ ID NO: 7662 - DNA, 71 bp, chicken (Gallus Gallus)
  misc_feature (36): n=c or t
gttcttggtctctgctgtgcaaacataccctattcngcgatggattcatctgatgggagggaaactgtaat

SEQ ID NO: 7663 - DNA, 71 bp, chicken (Gallus Gallus)
  misc_feature (36): n=g or t
ttgtctcaatttcctatgattttagtgaaaagaagncactaaagaataattaaaagtccacagtaaatttt

SEQ ID NO: 7664 - DNA, 71 bp, chicken (Gallus Gallus)
  misc_feature (36): n=a or g
cacagcaaaatttgtgtggtagaattgtacccccanattgttgtacatccaggagaagacatggtgtgcat

SEQ ID NO: 7665 - DNA, 71 bp, chicken (Gallus Gallus)
  misc_feature (36): n=c or g
tctgtttttgagtgcatctgtcactgttttcaaagngggacaattttacagttgtcatgcttaagttatca

SEQ ID NO: 7666 - DNA, 71 bp, chicken (Gallus Gallus)
  misc_feature (36): n=a or g
tagaggtaaattgccctttcctacaaaataaaaatnaattacaaagtgccagcttgaaaacactaagatac

SEQ ID NO: 7667 - DNA, 71 bp, chicken (Gallus Gallus)
  misc_feature (36): n=a or c
aacatttcataaacactgccttagccctgtaggggntttaatgtaacctgcagggagacacgtaaccacag

SEQ ID NO: 7668 - DNA, 71 bp, chicken (Gallus Gallus)
  misc_feature (36): n=c or t
ttgtccagcaaaccaacatttagttttgtatgaacnacctccttcagtaaaacatctattatttcagtagg

SEQ ID NO: 7669 - DNA, 71 bp, chicken (Gallus Gallus)
  misc_feature (36): n=c or t
cacatttcttccagtagaaataggtacctttactcntcaaaaataatttaagaatatgtaatatatgacta

SEQ ID NO: 7670 - DNA, 71 bp, chicken (Gallus Gallus)
  misc_feature (36): n=c or t
ttgaaatcaggaataaaaggtactagataatccagnacagcacttaagaatttcaacctaagcgctttcct

SEQ ID NO: 7671 - DNA, 71 bp, chicken (Gallus Gallus)
  misc_feature (36): n=c or t
cttggtcctctgaaacaacttgtagaacttttaagngcctaagtagcaaggacaccaaaaagcacagagaa

SEQ ID NO: 7672 - DNA, 71 bp, chicken (Gallus Gallus)
  misc_feature (36): n=g or t
accagaaacagaaaagaaaataaaaacaattcccanttgaacaatctctcagcaggccattagtttctata

SEQ ID NO: 7673 - DNA, 71 bp, chicken (Gallus Gallus)
  misc_feature (36): n=a or g
gaagaaaggtattggtaactaagactcaaatattgncatccagtactgaagcattgatatattgactcaaa

SEQ ID NO: 7674 - DNA, 71 bp, chicken (Gallus Gallus)
  misc_feature (36): n=c or t
acctgccctaggtcagagaaaaggtgtagtctagcnaatgtagcgttctaattagtatgttcacctaggag

SEQ ID NO: 7675 - DNA, 71 bp, chicken (Gallus Gallus)
  misc_feature (36): n=c or t
tgaactggggctctttgagcggatgcaggtgtctcnattcttaaaaatgtttaaatcctttaaaagagttt

SEQ ID NO: 7676 - DNA, 71 bp, chicken (Gallus Gallus)
  misc_feature (36): n=c or t
ttagccttttttttttttcttagcttcaactttgtnttgtcacttaatatgatgaaaagaaatttattttg

SEQ ID NO: 7677 - DNA, 71 bp, chicken (Gallus Gallus)
  misc_feature (36): n=c or g
aaaatgtcactttggaaagaacatagatgaaacttncctctatcatcatatgttcttttccttcaagcctg

SEQ ID NO: 7678 - DNA, 71 bp, chicken (Gallus Gallus)
  misc_feature (36): n=c or g
gtatctttttcatgacatggttgagactgtgaaganaacacgtagaatcaggtttgcttgctgaagctgga

SEQ ID NO: 7679 - DNA, 71 bp, chicken (Gallus Gallus)
  misc_feature (36): n=a or g
ttgcaatagttattacttagttattagttactgcgntaactgaagacccagctagtaagagttgctatgga

SEQ ID NO: 7680 - DNA, 71 bp, chicken (Gallus Gallus)
  misc_feature (36): n=a or g
cttccagagtttggaccagaattttgctgagggtangcacagatatatgccctggattgtttgtgtgtggt

SEQ ID NO: 7681 - DNA, 71 bp, chicken (Gallus Gallus)
  misc_feature (36): n=a or g
tatagtgaaaatgagaatgtttatagattatggtcngctttgggacaacgcaggtgatttttgatggaaag

SEQ ID NO: 7682 - DNA, 71 bp, chicken (Gallus Gallus)
  misc_feature (36): n=c or t
tttaaaacaaaaagactatttaaattactgtaatcntatttgttaacatttatcaattgaaagatatatag

SEQ ID NO: 7683 - DNA, 71 bp, chicken (Gallus Gallus)
  misc_feature (36): n=c or t
agacaaggtaggaggactgccttgtacagctgctangtgtactcaaaaaactcactgtgcgcgtctgaagc

SEQ ID NO: 7684 - DNA, 71 bp, chicken (Gallus Gallus)
  misc_feature (36): n=c or t
tagagatgagcagatctgactaactcagctgggctnggactcctggccaaggatatctatttattatgggg

SEQ ID NO: 7685 - DNA, 71 bp, chicken (Gallus Gallus)
  misc_feature (36): n=g or t
gacagttccttcacattcaagatacattacatttgntctttcttctacagacatcaggagctagacttaat

SEQ ID NO: 7686 - DNA, 71 bp, chicken (Gallus Gallus)
  misc_feature (36): n=c or t
ttggaatgtaatatgccaaaaaaaggtaacaattgncaaatgaaatgtctctctgctttaaaacagaaaat

SEQ ID NO: 7687 - DNA, 71 bp, chicken (Gallus Gallus)
  misc_feature (36): n=a or t
ctttcagaaccagaaggaaaaattccttttttgctnagagtttccagattttgctgtaaacagttgtgaag

SEQ ID NO: 7688 - DNA, 71 bp, chicken (Gallus Gallus)
  misc_feature (36): n=c or t
ttttgtactctgtggtttatttaatctcactagacnaactggttagctagaggcttgctagtatatccttg

SEQ ID NO: 7689 - DNA, 71 bp, chicken (Gallus Gallus)
  misc_feature (36): n=c or t
tgtaatctaggcatcagttttgtgaattacctatgngaagctctggttgctcaggggtttccttctgcctg

SEQ ID NO: 7690 - DNA, 71 bp, chicken (Gallus Gallus)
  misc_feature (36): n=a or g
aactgaaagtgcagttgcagaattaagtgacaaganaaaagcgttggatttgggggaaaaaaaaatcttga

SEQ ID NO: 7691 - DNA, 71 bp, chicken (Gallus Gallus)
  misc_feature (36): n=a or g
tgctgcagctgacagcctgggcactccaagggcatncatacaccagcatcactggcaacttcttaccagaa

SEQ ID NO: 7692 - DNA, 71 bp, chicken (Gallus Gallus)
  misc_feature (36): n=c or g
tggtgaacaacagaacaaggggcaacaggcagaagntggagtatagcaagttccataggaaaacaaagaac

SEQ ID NO: 7693 - DNA, 71 bp, chicken (Gallus Gallus)
  misc_feature (36): n=a or g
ctgaacaggcttcaacagacagatgtattgcttgtncagttgctattctcgccagaactcatatgttacca

SEQ ID NO: 7694 - DNA, 71 bp, chicken (Gallus Gallus)
  misc_feature (36): n=g or t
gctaagcagaagtccctttgttgcccttacctctgnggccctgcagctctgttgagcactgaacaacacca

SEQ ID NO: 7695 - DNA, 71 bp, chicken (Gallus Gallus)
  misc_feature (36): n=c or t
ccactacggctcactggttctggcttcagtctgagnctgacttgctctcacttggtgtgaacaagctacat

SEQ ID NO: 7696 - DNA, 71 bp, chicken (Gallus Gallus)
  misc_feature (36): n=a or g
accaaatagatgcacactccttccagtaacctacanatttttaaaccaatatcctgaaatgtggcaaaaca

SEQ ID NO: 7697 - DNA, 71 bp, chicken (Gallus Gallus)
  misc_feature (36): n=a or g
gcctgcagaagaagatgtttcttcatgtcattatgnttttcagtgcctgcttgtgtcctttctttcttcct

SEQ ID NO: 7698 - DNA, 71 bp, chicken (Gallus Gallus)
  misc_feature (36): n=c or t
aatggcatggttaagcagcaagaattaaagtaaganaggctgataaagaaaataattattttgcagtagtt

SEQ ID NO: 7699 - DNA, 71 bp, chicken (Gallus Gallus)
  misc_feature (36): n=a or t
ggactaaataagtactgtgtcatatctgctattatnttctatcagggtacatctgcagatacatttaaaag

SEQ ID NO: 7700 - DNA, 71 bp, chicken (Gallus Gallus)
  misc_feature (36): n=c or t
aaggcttcactcttctagtactttccattagaaacngcatatggactggcatggaaaagtactgaaaaaga

SEQ ID NO: 7701 - DNA, 71 bp, chicken (Gallus Gallus)
  misc_feature (36): n=a or g
agctgctgtcagatgatctcctaaaaaaaaagcagnaaaagcctttgagaagaaataaaacatgtatattg

SEQ ID NO: 7702 - DNA, 71 bp, chicken (Gallus Gallus)
  misc_feature (36): n=c or t
cagtaattaatattaaatggttgttttacctgttgntgaagtaactgttttctaagtatctatgaagtaac

SEQ ID NO: 7703 - DNA, 71 bp, chicken (Gallus Gallus)
  misc_feature (36): n=a or g
aaagaccacaatgattcaatatttttcacaattcantgccttttttaaactgtgaaaaggaagaaatctct

SEQ ID NO: 7704 - DNA, 71 bp, chicken (Gallus Gallus)
  misc_feature (36): n=c or t
agatgaagctgtgctgcctctctgggcacttgtggnatcgggtctggtgagattctgatgcacctcttttt

SEQ ID NO: 7705 - DNA, 71 bp, chicken (Gallus Gallus)
  misc_feature (36): n=c or t
cagtctgggtgagataaaattcatgctggaatagangcaggatgaaatccccacattgtacactgatactt

SEQ ID NO: 7706 - DNA, 71 bp, chicken (Gallus Gallus)
  misc_feature (36): n=a or c
attaaaaaaaaaaaagcttttaaatttaagtataantcaatttatgggcacgaaatgcctggttcaacttg

SEQ ID NO: 7707 - DNA, 71 bp, chicken (Gallus Gallus)
  misc_feature (36): n=g or t
agcacagagaggaatggctggagcaaggggttttcnttgtttgctcaatgtgcctgtgggagagtgcacaa

SEQ ID NO: 7708 - DNA, 71 bp, chicken (Gallus Gallus)
  misc_feature (36): n=g or t
gggaggggtggggaaaaaaaaatccctatatcacanagaaagtgcctttacacaccaaagaaactcttact

SEQ ID NO: 7709 - DNA, 71 bp, chicken (Gallus Gallus)
  misc_feature (36): n=a or g
ctttttcaaaggcacagagaatcttaaagctgtggnagatgcagcatttcaggtaaagggaggaagctaga

SEQ ID NO: 7710 - DNA, 71 bp, chicken (Gallus Gallus)
  misc_feature (36): n=a or c
agggatgttagctctagctagtgatgaaaatagccncctcttctggtaccctcctccccaaggtgtggact

SEQ ID NO: 7711 - DNA, 71 bp, chicken (Gallus Gallus)
  misc_feature (36): n=a or g
ttgataaagctaaatatccctgtgtatgtaagtaanctcattttttcagtgtcattttatagctaccagtg

SEQ ID NO: 7712 - DNA, 71 bp, chicken (Gallus Gallus)
  misc_feature (36): n=c or t
aaatattttttccaattttggaaagaattaaaacgnacaatgtgggatctgtactttttgtgtagtaagca

SEQ ID NO: 7713 - DNA, 71 bp, chicken (Gallus Gallus)
  misc_feature (36): n=a or g
ttgctattccactctagaagtaagcttgcaaagccnggtagtttggtaagtgccagctgtggaaaaggaat

SEQ ID NO: 7714 - DNA, 71 bp, chicken (Gallus Gallus)
  misc_feature (36): n=c or t
accatatctactattcctgcatcacggatatgtatntccacagataaaggcagctgcctaattacctttcc

SEQ ID NO: 7715 - DNA, 71 bp, chicken (Gallus Gallus)
  misc_feature (36): n=a or c
tcagaaacatttcaggctcagtggcaattacaaaancaaaagtttgtggaaaagacacgagaagattggaa

SEQ ID NO: 7716 - DNA, 71 bp, chicken (Gallus Gallus)
  misc_feature (36): n=a or g
gcagtaatgaccaaatccacataatatgatactgcnttgtttgttgttgtcctgacaagtcagaattgaag

SEQ ID NO: 7717 - DNA, 71 bp, chicken (Gallus Gallus)
  misc_feature (36): n=a or c
aacgctactggctgaacacttgatactgcttacacnaggtaacccaaatctcagtattttccatccaggtc

SEQ ID NO: 7718 - DNA, 71 bp, chicken (Gallus Gallus)
  misc_feature (36): n=c or t
tcactcacagatattctgtgtggagctaagtacacngtactcatttggatgagcgcaggcatgtccaaccc

SEQ ID NO: 7719 - DNA, 71 bp, chicken (Gallus Gallus)
  misc_feature (36): n=c or t
gaaaaaaaaaaacacctcacctcagaaaggagcagncaatgacaaggatatagagagtaaattactttgca

SEQ ID NO: 7720 - DNA, 71 bp, chicken (Gallus Gallus)
  misc_feature (36): n=a or c
catttttcagggtgcaggagcatcaaacacctttanaagtatatgaccacttctattgccggcaattatct

SEQ ID NO: 7721 - DNA, 71 bp, chicken (Gallus Gallus)
  misc_feature (36): n=c or t
gacactctgaggaacccttcggtactttaggagaanggctctaagatgcaatgaacaaattgtgctgacat

SEQ ID NO: 7722 - DNA, 71 bp, chicken (Gallus Gallus)
  misc_feature (36): n=c or t
acttcacaacattcagtattttctctcataatatcncttctaaggagagaatacttgtcctcattttgcag

SEQ ID NO: 7723 - DNA, 71 bp, chicken (Gallus Gallus)
  misc_feature (36): n=a or t
gcattctgtacatgtggagaaaaaagaatcctgacntcaacattaggagctctctctcaatcacttttgaa

SEQ ID NO: 7724 - DNA, 71 bp, chicken (Gallus Gallus)
  misc_feature (36): n=a or c
taaggaaataattgagaggtcacttattctgtgtgntctttatcaaccactgcaatcagcatctcatttca

SEQ ID NO: 7725 - DNA, 71 bp, chicken (Gallus Gallus)
  misc_feature (36): n=a or g
tgaaactaaatgatatgaatctgtattttctttcantcccaaggcataggtgtttctgaagtagtgaaaca

SEQ ID NO: 7726 - DNA, 71 bp, chicken (Gallus Gallus)
  misc_feature (36): n=c or t
agagggaagccaatatgtattgaaaatagtaataanagtaatcttttaaactgcatttacggaatgcagaa

SEQ ID NO: 7727 - DNA, 71 bp, chicken (Gallus Gallus)
  misc_feature (36): n=a or g
cagcctgtggtgctgcaatgtgcaggtgagagcagngaccataaagtcaccttcacagctgggtatggtcc

SEQ ID NO: 7728 - DNA, 71 bp, chicken (Gallus Gallus)
  misc_feature (36): n=c or t
cacagtgtttattgatgtaaggggagtacagagcanagtgtactggaacccttccaacctcacccaagcac

SEQ ID NO: 7729 - DNA, 71 bp, chicken (Gallus Gallus)
  misc_feature (36): n=a or g
aataacccaagttgttcagaaaagaattatgacagnaaattattctccggcaaactgtactggtgttaaga

SEQ ID NO: 7730 - DNA, 71 bp, chicken (Gallus Gallus)
  misc_feature (36): n=a or g
atgtcaagaaactgcagctgctaacaaaagtgtccncaatgcgcagacaaaaagcggacaaaacagcaaca

SEQ ID NO: 7731 - DNA, 71 bp, chicken (Gallus Gallus)
  misc_feature (36): n=a or g
tgcttttggatttcgcagcactttccactgtttgcnaagcctggatctcttagatagtcattgctcaagcc

SEQ ID NO: 7732 - DNA, 71 bp, chicken (Gallus Gallus)
  misc_feature (36): n=a or g
cctctaaaaagaaaaaccaaaaaaccaaacacaacnccttcttagctgtgaatacagacccaaaaatcctg

SEQ ID NO: 7733 - DNA, 71 bp, chicken (Gallus Gallus)
  misc_feature (36): n=a or c
tattttctacctttttatattattttcattatgtgncaccagcaaccaaagaagaggtggttgtgtaaccg

SEQ ID NO: 7734 - DNA, 71 bp, chicken (Gallus Gallus)
  misc_feature (36): n=c or t
actcccatgttacataatttatttggtatccaagcncctctgtcagatcttgaatgtaaaaataagaggca

SEQ ID NO: 7735 - DNA, 71 bp, chicken (Gallus Gallus)
  misc_feature (36): n=g or t
aaaacagaccgttatctatgtagtaaactagaactnaatatatttcacaactcaccagaaattatgttata

SEQ ID NO: 7736 - DNA, 71 bp, chicken (Gallus Gallus)
  misc_feature (36): n=g or t
ctgaagtccttgtgcagccattgtacttactcaatncatttcagttttaagatgttactcctcccaaccaa

SEQ ID NO: 7737 - DNA, 71 bp, chicken (Gallus Gallus)
  misc_feature (36): n=a or g
agaggaagcaaattaacagcagccaaagcctaattnaagtatttatacacggagaagtaccactcttcagc

SEQ ID NO: 7738 - DNA, 71 bp, chicken (Gallus Gallus)
  misc_feature (36): n=c or t
aaaggaaaataaatattatttaatcctgttgaatangttaccacatcccgtaccaaactttggtactacac

SEQ ID NO: 7739 - DNA, 71 bp, chicken (Gallus Gallus)
  misc_feature (36): n=a or g
ccacagacttcttggaacaagcccgctgtctggtgnaggcccatatttaggtctgcagtctcagagactgc

SEQ ID NO: 7740 - DNA, 71 bp, chicken (Gallus Gallus)
  misc_feature (36): n=a or g
ttgaccagatgaggatcctgactttcagaacattantattaggagaaaatatatcaagttctaaataatta

SEQ ID NO: 7741 - DNA, 71 bp, chicken (Gallus Gallus)
  misc_feature (36): n=c or t
acagaagacttgtattaagggtatatactggaagtncctacattctttgcagaaaaaaagacagaaatcct

SEQ ID NO: 7742 - DNA, 71 bp, chicken (Gallus Gallus)
  misc_feature (36): n=a or t
taactgctatctgtgttgcctagcagatctagggangttctgtgtctatagaaaaatagtgcattcccaga

SEQ ID NO: 7743 - DNA, 71 bp, chicken (Gallus Gallus)
  misc_feature (36): n=a or g
agttccactggacgctagttattaaacagcattacntgtgcatgggcagcaacagtgagatttttcagaat

SEQ ID NO: 7744 - DNA, 71 bp, chicken (Gallus Gallus)
  misc_feature (36): n=c or t
ttttactgtgccgttttatatgtttagttctgagcntgaggctgagcacttatcagggagaaaaaggcccg

SEQ ID NO: 7745 - DNA, 71 bp, chicken (Gallus Gallus)
  misc_feature (36): n=a or g
aaacacagtgggtaggttcctgggcacttgttctgntggccagatagtcaaattgtcttctttcgtctcca

SEQ ID NO: 7746 - DNA, 71 bp, chicken (Gallus Gallus)
  misc_feature (36): n=c or t
tggtagagcccccaaaatgtaaagcattagctagcngcattcagagctttctttccatgttatagggaaga

SEQ ID NO: 7747 - DNA, 71 bp, chicken (Gallus Gallus)
  misc_feature (36): n=a or g
cttgttaataatttagcgttgtttgcttgctgtatntatcaatgttgggtcttagtctttctttccttctg

SEQ ID NO: 7748 - DNA, 71 bp, chicken (Gallus Gallus)
  misc_feature (36): n=a or g
ttaaatctgtgagctctgagctactatgtagttttnccattgttaaggtataaagaaactgtcgtacaatg

SEQ ID NO: 7749 - DNA, 71 bp, chicken (Gallus Gallus)
  misc_feature (36): n=a or t
cagtggcttagctgtgccagactgaatctcagcctncagctggaatgaaggctgaaattattctcagtatt

SEQ ID NO: 7750 - DNA, 71 bp, chicken (Gallus Gallus)
  misc_feature (36): n=a or g
acaactgttggcatgttattattaaagatgtgattngtaatttctcacatatttcacatatttcttgagca

SEQ ID NO: 7751 - DNA, 71 bp, chicken (Gallus Gallus)
  misc_feature (36): n=a or g
ctggctgaaatgaatggtgtgtttgtacaaaaccangctgccaaagatatgttaaaaggaaaaggtccttc

SEQ ID NO: 7752 - DNA, 71 bp, chicken (Gallus Gallus)
  misc_feature (36): n=c or t
agcctttcctcataggggagatgctccaggcccttnatcatctttgtggttctccactggatgctctccaa

SEQ ID NO: 7753 - DNA, 71 bp, chicken (Gallus Gallus)
  misc_feature (36): n=a or g
aagttaatatacttgaccagatcggtaacttgactncttagtccattggcttatttacactgggtagaacc

SEQ ID NO: 7754 - DNA, 71 bp, chicken (Gallus Gallus)
  misc_feature (36): n=c or g
gttatgagatgtactttgaagctgtcttatacactnatgatatctagaatcttaggatttggaaacacctc

SEQ ID NO: 7755 - DNA, 71 bp, chicken (Gallus Gallus)
  misc_feature (36): n=a or c
gacatgcaagttaagaggaatcaaaaatatgaatgngaaattctgaatgtgtaactagacagctgcttagt

SEQ ID NO: 7756 - DNA, 71 bp, chicken (Gallus Gallus)
  misc_feature (36): n=a or c
acagtttaaaagtgccttaaatgaaaagaaaaatcngataatcaaagtacattaaccgtatttaaaaacaa

SEQ ID NO: 7757 - DNA, 71 bp, chicken (Gallus Gallus)
  misc_feature (36): n=a or g
acacaattcagtttaaggattcacagatgcaatctntagaggaacttggatttttttccgtgctgctgtga

SEQ ID NO: 7758 - DNA, 71 bp, chicken (Gallus Gallus)
  misc_feature (36): n=c or g
tttttattattattttttttaattttcagatccctngcacttcttataagagagattctgcctggttctgt

SEQ ID NO: 7759 - DNA, 71 bp, chicken (Gallus Gallus)
  misc_feature (36): n=a or c
aatattataagaaaagtaggaatataggtagaaatnacaaaaaatataaggattatttttcttagaaaata

SEQ ID NO: 7760 - DNA, 71 bp, chicken (Gallus Gallus)
  misc_feature (36): n=c or t
agacttcctcacatttgacctcagtcccagacccgnttcctaattattcttgttcaaatttgagaagcttt

SEQ ID NO: 7761 - DNA, 71 bp, chicken (Gallus Gallus)
  misc_feature (36): n=a or g
tcaaaaaacaaaaagggaagaacaagatagcagaancaggaagacaaaagttttcttggagaacatgggtt

SEQ ID NO: 7762 - DNA, 71 bp, chicken (Gallus Gallus)
  misc_feature (36): n=g or t
agagggctgtattcttggagtaagactggcagcctntctttaagactggggaacggtggcaactcagagag

SEQ ID NO: 7763 - DNA, 71 bp, chicken (Gallus Gallus)
  misc_feature (36): n=c or g
gtaataaggaggcaactctgcaaagcaaaaaataanatagattaatacaataaaactactgtaaattagaa

SEQ ID NO: 7764 - DNA, 71 bp, chicken (Gallus Gallus)
  misc_feature (36): n=c or t
acacaaatatttgtctatatgtctatgcagctcagnctgctgcacaccatgaaataaatgtaaatcacatg

SEQ ID NO: 7765 - DNA, 71 bp, chicken (Gallus Gallus)
  misc_feature (36): n=a or g
caggtgagaaaggagactcgcatgcactgaactacnttttctgctccctcttctgtttctgcagaatctga

SEQ ID NO: 7766 - DNA, 71 bp, chicken (Gallus Gallus)
  misc_feature (36): n=a or t
aatcttttctgttggtagaaacagcaaaaggaaaantcattcagaaggtagttagcatctctttgtatgtt

SEQ ID NO: 7767 - DNA, 71 bp, chicken (Gallus Gallus)
  misc_feature (36): n=c or t
aatgattacttagttgttaaccaagcccaaagggtnagtcatgataattagactatgaattattaacacac

SEQ ID NO: 7768 - DNA, 71 bp, chicken (Gallus Gallus)
  misc_feature (36): n=a or g
ccagctgggtgaacaaattcacaggctttggttgcntggtgcacacaccttgtagttatatattagaatga

SEQ ID NO: 7769 - DNA, 71 bp, chicken (Gallus Gallus)
  misc_feature (36): n=c or t
agcagcttcagttatcagtatgattagtgtaccatncattcctggatttcacaaagactagcactacctgt

SEQ ID NO: 7770 - DNA, 71 bp, chicken (Gallus Gallus)
  misc_feature (36): n=a or g
tttccagtttcacatcccattcagtttctactacantctactattagaaaatccaaaccatttcctagtcc

SEQ ID NO: 7771 - DNA, 71 bp, chicken (Gallus Gallus)
  misc_feature (36): n=a or c
ttgagattttatgtaaattctccatcctgttttaanagtaattacagtgagaacttggatatttaattttt

SEQ ID NO: 7772 - DNA, 71 bp, chicken (Gallus Gallus)
  misc_feature (36): n=c or t
acagatataaaaagcatgataacactacttgatagngcacatgctcagctatagagcaccttttcaatata

SEQ ID NO: 7773 - DNA, 71 bp, chicken (Gallus Gallus)
  misc_feature (36): n=a or g
ggaggaggaagaagttgaggtggtaaatgaggaggnaatccaaacatagggctgttttgtggagggaagtt

SEQ ID NO: 7774 - DNA, 71 bp, chicken (Gallus Gallus)
  misc_feature (36): n=a or g
agacctgagaacagaggagggatgggaattttgtcnagagaagcatttgaatcaggtgaagctgagccaga

SEQ ID NO: 7775 - DNA, 71 bp, chicken (Gallus Gallus)
  misc_feature (36): n=c or t
gtaaaaattttaacatttgacagctgactttgcctnggcattagcttttcctgttactgagtgtatttaca

SEQ ID NO: 7776 - DNA, 71 bp, chicken (Gallus Gallus)
  misc_feature (36): n=a or g
gtgcgagatgtgcaaattcatgacagaaattcttgncaatactatctccaatatccctgcctaaagaaata

SEQ ID NO: 7777 - DNA, 71 bp, chicken (Gallus Gallus)
  misc_feature (36): n=c or t
atatagaaaaataagtggacccaaagggctggatcnagtgccatccaaagtccaacctgaattattctgtg

SEQ ID NO: 7778 - DNA, 71 bp, chicken (Gallus Gallus)
  misc_feature (36): n=c or g
gagcactaacacatttaatcaacaaaagttatactntcactgaagtggatgttaaattagtctgattagtt

SEQ ID NO: 7779 - DNA, 71 bp, chicken (Gallus Gallus)
  misc_feature (36): n=c or t
ccattgttagcataaatatttgaaattctgtcccantggtgttttaatagccaaaaatttatgaaatcctt

SEQ ID NO: 7780 - DNA, 71 bp, chicken (Gallus Gallus)
  misc_feature (36): n=a or c
acagcctggagagtttggtggagaggaaccttacgnggtttaacaaggacaactgtagagtcctacatgtg

SEQ ID NO: 7781 - DNA, 71 bp, chicken (Gallus Gallus)
  misc_feature (36): n=c or t
ctgtagctagtctttatatgggtgggaatgcagcantgtaagagtaattagacactagaacctgcagtgga

SEQ ID NO: 7782 - DNA, 71 bp, chicken (Gallus Gallus)
  misc_feature (36): n=a or t
gcagctcagaagtgcatagccctgctcaactgcacnccagttcttctttaattgtggctgagggccagaga

SEQ ID NO: 7783 - DNA, 71 bp, chicken (Gallus Gallus)
  misc_feature (36): n=c or t
ggttagcacacatcagagaaactccaagttttctgnaggatctccaagcaccaaaacctcctcctctcaga

SEQ ID NO: 7784 - DNA, 71 bp, chicken (Gallus Gallus)
  misc_feature (36): n=c or t
gttttagctacttgatagagtaagcagcagtaacangggtaatgcagttctgaactcactgaaatcagtgg

SEQ ID NO: 7785 - DNA, 71 bp, chicken (Gallus Gallus)
  misc_feature (36): n=a or c
aatgctactatgccagcaatgaactgaaacagtcanggtaaacagatcagtctgtagagattcactgcttc

SEQ ID NO: 7786 - DNA, 71 bp, chicken (Gallus Gallus)
  misc_feature (36): n=a or g
cccgacaaataaatgcttgtgtcagaaatgctgacnagtagcttttctgtctccgttgctggtgtggaggt

SEQ ID NO: 7787 - DNA, 71 bp, chicken (Gallus Gallus)
  misc_feature (36): n=c or t
ctgatttcagacttctaaaaacttcaagtcctatanacctctgggtttgaagaagaagtaaatttggtgtc

SEQ ID NO: 7788 - DNA, 71 bp, chicken (Gallus Gallus)
  misc_feature (36): n=a or g
cccaaagtcagatctaaatggaatgattttgctgcntttcattcctgccaggacaaagcaaaggtggtctt

SEQ ID NO: 7789 - DNA, 71 bp, chicken (Gallus Gallus)
  misc_feature (36): n=a or g
actaatgtaaatacaaaaggtgttcaatgaggagangactaaaagatctgctctgttaaagagagctggag

SEQ ID NO: 7790 - DNA, 71 bp, chicken (Gallus Gallus)
  misc_feature (36): n=a or g
tttgaagatttcacctgaatatgtacacttaacgtntatcttctcaaatcagacttgagagctgcaacagt

SEQ ID NO: 7791 - DNA, 71 bp, chicken (Gallus Gallus)
  misc_feature (36): n=a or c
cttggaagggcttctggtcccagtttcaaattgaantggttcattttatttgacatgaatgcatgtggaca

SEQ ID NO: 7792 - DNA, 71 bp, chicken (Gallus Gallus)
  misc_feature (36): n=c or t
acttgtagtttgatgggttttctgttcaacttctgnttcttgatcagtagcacaagcaaaatggaacaggc

SEQ ID NO: 7793 - DNA, 71 bp, chicken (Gallus Gallus)
  misc_feature (36): n=a or g
gtaatttacagtgggagaaatcccagggctatcacnttcataacctacatgcacaaagcctatgtcttgtc

SEQ ID NO: 7794 - DNA, 71 bp, chicken (Gallus Gallus)
  misc_feature (36): n=a or g
caacctcctgccagcaacagcacttccttgctaacncatgcaatatccgctcaagtgggtcagaagatgag

SEQ ID NO: 7795 - DNA, 71 bp, chicken (Gallus Gallus)
  misc_feature (36): n=g or t
gcaagggaagtatgtgattaaaaatgctgctttttngggttgtgccctaattgcttctgacttggaataag

SEQ ID NO: 7796 - DNA, 71 bp, chicken (Gallus Gallus)
  misc_feature (36): n=a or g
tggaggaagttttgcctgtggggacccatgctagancagttcctgaaggatgggccctgtggtacagaccc

SEQ ID NO: 7797 - DNA, 71 bp, chicken (Gallus Gallus)
  misc_feature (36): n=a or g
attttgataaaagagaaaaaacagcatagaaggtgnattactccttcttcagagatctttaagaattttgc

SEQ ID NO: 7798 - DNA, 71 bp, chicken (Gallus Gallus)
  misc_feature (36): n=a or g
atcaccccgcattacaggaaaggaaaacatttgggncactggtccattttcccaaactataaactaaaaat

SEQ ID NO: 7799 - DNA, 71 bp, chicken (Gallus Gallus)
  misc_feature (36): n=a or t
tcttcctctgcttttattgaatatttcctcacacanggaacatcatattgtaagggaaaagaataatttga

SEQ ID NO: 7800 - DNA, 71 bp, chicken (Gallus Gallus)
  misc_feature (36): n=c or t
gagatgtcttaaattaaaaaaaaagtcatatctctntgaaccaactccatcctctctaccagtgctctctc

SEQ ID NO: 7801 - DNA, 71 bp, chicken (Gallus Gallus)
  misc_feature (36): n=c or t
cagtagactcctgctaagaaacatcagtaaaatgantccttgtctttagccactgatttgtacaaataaga

SEQ ID NO: 7802 - DNA, 71 bp, chicken (Gallus Gallus)
  misc_feature (36): n=a or c
accccaggctggcatgccctggggtagctgtacctngagcaagctttgagagggaaagtctgaaataaaca

SEQ ID NO: 7803 - DNA, 71 bp, chicken (Gallus Gallus)
  misc_feature (36): n=a or c
ggtggataatttgaagcagagattcatcccgaggcngtctatgcagtgaggccgtctatgcagtgaggccg

SEQ ID NO: 7804 - DNA, 71 bp, chicken (Gallus Gallus)
  misc_feature (36): n=a or g
ggggtagattgatggatatggctctagcaatcaccntgccctctgacttcacataacatctatcttcatcc

SEQ ID NO: 7805 - DNA, 71 bp, chicken (Gallus Gallus)
  misc_feature (36): n=a or c
acagctctataaacctatagacctacggatccacanacccatcgatccgtagttatttagatctataccgg

SEQ ID NO: 7806 - DNA, 71 bp, chicken (Gallus Gallus)
  misc_feature (36): n=a or g
cagcaaaaccgatctgtatggaaattcaggattgancgtgctgattgaatggtgatttcatctgctggctc

SEQ ID NO: 7807 - DNA, 71 bp, chicken (Gallus Gallus)
  misc_feature (36): n=c or t
acccgtcagcaaaggtctgtgctgaaaggtcacaangataccccagagctcagctgccatgctcccaatga

SEQ ID NO: 7808 - DNA, 71 bp, chicken (Gallus Gallus)
  misc_feature (36): n=c or g
tgtgctatttcctacaatagcatctgcacagaagantcaacacctccaggagatgcagcattccagaaaca

SEQ ID NO: 7809 - DNA, 71 bp, chicken (Gallus Gallus)
  misc_feature (36): n=g or t
atacagatatgaaactgctgatgaagctaaatcctnaaatttacatactccattaggcatttgttaatatc

SEQ ID NO: 7810 - DNA, 71 bp, chicken (Gallus Gallus)
  misc_feature (36): n=c or g
cggctgtgggtggcttctttggtgaatgagcaagtntggacatgtcaacagaggagtctcctccaaccacc

SEQ ID NO: 7811 - DNA, 71 bp, chicken (Gallus Gallus)
  misc_feature (36): n=a or c
gaagaatatttctgattggctaccagctgttggagntgaacagatgagctggaaagtagcaatttacaagc

SEQ ID NO: 7812 - DNA, 71 bp, chicken (Gallus Gallus)
  misc_feature (36): n=a or g
actctctccctgcccaggtgtacagggagaagaaangggagaaaaaggcttcttcccaaggtgaaggacac

SEQ ID NO: 7813 - DNA, 71 bp, chicken (Gallus Gallus)
  misc_feature (36): n=c or t
attaactggcttctttggtgagctgtggatttgtantggagccaaggagggggcttgcaaagctggatttc

SEQ ID NO: 7814 - DNA, 71 bp, chicken (Gallus Gallus)
  misc_feature (36): n=a or g
acatgcaaagcattgagacccttcaaacgctgagcnacctctgaataacgaacatggaatttgcatcagat

SEQ ID NO: 7815 - DNA, 71 bp, chicken (Gallus Gallus)
  misc_feature (36): n=a or t
aagcaatgaggactctgctacgtattcaaatttttngtgaatacggggctgtactgtggtccaatacagtg

SEQ ID NO: 7816 - DNA, 71 bp, chicken (Gallus Gallus)
  misc_feature (36): n=c or t
aggccatccaaaaagagaggcaatgctcgtggctcnggagagacagacgtggggcaggcagaaaggaagtg

SEQ ID NO: 7817 - DNA, 71 bp, chicken (Gallus Gallus)
  misc_feature (36): n=a or g
gcattgtacagccctggttaacttctgcgatgacanagcagcacctcccatccacctctgttgtgacccag

SEQ ID NO: 7818 - DNA, 71 bp, chicken (Gallus Gallus)
  misc_feature (36): n=a or g
gtaggagcagccattcccattgctctgggtaacacntggtttcctctcacgctgctggtggcactcaggtt

SEQ ID NO: 7819 - DNA, 71 bp, chicken (Gallus Gallus)
  misc_feature (36): n=c or t
tcctggtgctccttctgcctcatgtactggtagcgntgcaaaaacaggtcttttgcataatcgtacaattc

SEQ ID NO: 7820 - DNA, 71 bp, chicken (Gallus Gallus)
  misc_feature (36): n=a or g
ttggtttaatctttcttttgttggagaagcttttcnatggatgtccaaaactcttagtgtggcaagtccac

SEQ ID NO: 7821 - DNA, 71 bp, chicken (Gallus Gallus)
  misc_feature (36): n=a or g
ctgctttaggtgcagtgaccttttatgtttgttttnagttacattgttcttttatccatgacaaaaccttc

SEQ ID NO: 7822 - DNA, 71 bp, chicken (Gallus Gallus)
  misc_feature (36): n=a or g
gcatgtctgataccaacaaaacgatttcttttatcnccagtaacgatgcctacagcatacaaatcctttct

SEQ ID NO: 7823 - DNA, 71 bp, chicken (Gallus Gallus)
  misc_feature (36): n=a or g
gcagcacggcgtgttcccacctgcaggcacagcaanccctgaagaattgagcttacatcactgtcagggag

SEQ ID NO: 7824 - DNA, 71 bp, chicken (Gallus Gallus)
  misc_feature (36): n=a or g
aaaaaccacaaaaccaccgataatttgtaaaggctntaacatgcaatttggttaaaagcattttaaatggt

SEQ ID NO: 7825 - DNA, 71 bp, chicken (Gallus Gallus)
  misc_feature (36): n=c or t
tgacttctttgtggttgtaaatgtcagagataacanaagaaaacatttcttctctccttatcctttcctac

SEQ ID NO: 7826 - DNA, 71 bp, chicken (Gallus Gallus)
  misc_feature (36): n=a or t
gatagaaaaaattttctgcaaagtttaacagtgaangttttatgtatagaaatgcactggaagctgccatt

SEQ ID NO: 7827 - DNA, 71 bp, chicken (Gallus Gallus)
  misc_feature (36): n=g or t
gttctctgttctggtgcccagagttctgaaaaattnggcaagtgtgtttgttttaatgaattcgccattca

SEQ ID NO: 7828 - DNA, 71 bp, chicken (Gallus Gallus)
  misc_feature (36): n=c or t
ctcacaggaatcctttgcactttttggggtctcacncaaagtccattggagttaggtggatcctccccact

SEQ ID NO: 7829 - DNA, 71 bp, chicken (Gallus Gallus)
  misc_feature (36): n=a or c
ggagggaaagtgaggcacaaaggtgtgcagggtacntgcagtcctgctgggccatggccctgtataacaag

SEQ ID NO: 7830 - DNA, 71 bp, chicken (Gallus Gallus)
  misc_feature (36): n=a or g
catggggacttacttctccctgagcagcacaagtancattcttgatcagcaccagccctgattactgattt

SEQ ID NO: 7831 - DNA, 71 bp, chicken (Gallus Gallus)
  misc_feature (36): n=a or g
ttactcacaatgaagaactacatgtcactgtaatcntcctttttagtagtaactcttgttccaataaccaa

SEQ ID NO: 7832 - DNA, 71 bp, chicken (Gallus Gallus)
  misc_feature (36): n=c or t
ggaaacctccctcaccgctgtgccacgtgcgctttntgggttggtgctaatcattgattatcactattaat

SEQ ID NO: 7833 - DNA, 71 bp, chicken (Gallus Gallus)
  misc_feature (36): n=c or t
cggagccagactttcttttgatttatgccgactttntaccttctcccaatggctcatttccctattttgtc

SEQ ID NO: 7834 - DNA, 71 bp, chicken (Gallus Gallus)
  misc_feature (36): n=c or g
agattatttttatatggcttcattcttgattctacnaatcagcatggcacgtgtcaggtgagagatgcagt

SEQ ID NO: 7835 - DNA, 71 bp, chicken (Gallus Gallus)
  misc_feature (36): n=a or g
actcttttcatgttggttagaattgtccttggtccncagggctcaatcaagtaatacctaatagagttcaa

SEQ ID NO: 7836 - DNA, 71 bp, chicken (Gallus Gallus)
  misc_feature (36): n=c or t
gcaacaatgccttggctagcaagtaccatgatggcngttaaaccaacgctaaatatagcactttgtccaaa

SEQ ID NO: 7837 - DNA, 71 bp, chicken (Gallus Gallus)
  misc_feature (36): n=a or t
ggaagaatggagttctaggattaaaaatgatcagtncagagtcactgagtaagggtgggaggcgttctgct

SEQ ID NO: 7838 - DNA, 71 bp, chicken (Gallus Gallus)
  misc_feature (36): n=a or g
ctttgacagtttaagggattactgagcctagatgtnctttcatgagaatgaacagaaagtgtgactggatt

SEQ ID NO: 7839 - DNA, 71 bp, chicken (Gallus Gallus)
  misc_feature (36): n=c or t
gagagttcggactaagaaaaagatgtattagcatcngggtggtgcaggcaattttaaggggatatgcaaaa

SEQ ID NO: 7840 - DNA, 71 bp, chicken (Gallus Gallus)
  misc_feature (36): n=c or t
tcatattggacagggctgcaatagcaaagcagcagngggcagctgtttcccatttattcacatgtaacctc

SEQ ID NO: 7841 - DNA, 71 bp, chicken (Gallus Gallus)
  misc_feature (36): n=g or t
caaatacttatttaggttaagtacccagggctgaanttcaatcacagtatttggtgttcctatttattaca

SEQ ID NO: 7842 - DNA, 71 bp, chicken (Gallus Gallus)
  misc_feature (36): n=a or g
tctgttgaaataacatactccttgtaaaggtcaccntgttcatcagatacgtagcaagttatacagtctgt

SEQ ID NO: 7843 - DNA, 71 bp, chicken (Gallus Gallus)
  misc_feature (36): n=a or c
aagggatggcagacatgttccaggccaaagagaagnattttaaacaactctttggagatctgaaggcaggc

SEQ ID NO: 7844 - DNA, 71 bp, chicken (Gallus Gallus)
  misc_feature (36): n=g or t
attaaatatgtgggtacttatgttaggacaaagttnaaacttagttgtctaatcagatactgctctgaaca

SEQ ID NO: 7845 - DNA, 71 bp, chicken (Gallus Gallus)
  misc_feature (36): n=c or g
aagacaagtatacagcaatatcatattgagtacaanatcacaagaatcaacagatctgttatgtatcttgt

SEQ ID NO: 7846 - DNA, 71 bp, chicken (Gallus Gallus)
  misc_feature (36): n=a or g
atgtttacgggctctcaacctttgtcacgagagtgnagcaaactgcagcaggtcgtactgccataaggcac

SEQ ID NO: 7847 - DNA, 71 bp, chicken (Gallus Gallus)
  misc_feature (36): n=c or t
tactcaaagaatcacaacattacataggttaagtgnagctttacaatattttccacagctttgaatgttaa

SEQ ID NO: 7848 - DNA, 71 bp, chicken (Gallus Gallus)
  misc_feature (36): n=g or t
agaggtgcctcaagactttgtcttacctcttcagcnaatagacaggagcgaacccatatcctgccttgaaa

SEQ ID NO: 7849 - DNA, 71 bp, chicken (Gallus Gallus)
  misc_feature (36): n=c or t
tgtgtctgttgatgagctgaatgatattggtttganacacactggaagttctgtgtaacaggttatttgct

SEQ ID NO: 7850 - DNA, 71 bp, chicken (Gallus Gallus)
  misc_feature (36): n=a or g
acagaatcactgtgtctcttgaggataccatgaatncatgaagtaaatggtaaatcctttcagtgacggga

SEQ ID NO: 7851 - DNA, 71 bp, chicken (Gallus Gallus)
  misc_feature (36): n=a or g
tccagaggtagaaaaagcagatgtgaatgcttgaancagtctccccagtgctattagtctctcccatatta

SEQ ID NO: 7852 - DNA, 71 bp, chicken (Gallus Gallus)
  misc_feature (36): n=c or g
gctcacctctacctgctccttccactcacaccagantgcacacatggatgctccctgcagaaagaagtcag

SEQ ID NO: 7853 - DNA, 71 bp, chicken (Gallus Gallus)
  misc_feature (36): n=a or g
agaaatatcctgattgtgctgaccaaaatccttccntggtatccgaaagtgttgaacctgggccaagcctt

SEQ ID NO: 7854 - DNA, 71 bp, chicken (Gallus Gallus)
  misc_feature (36): n=a or g
gaaggcaggatttgcaccatagcattgttacagatncaaagaaggaaagggtgattttctagactgcagtt

SEQ ID NO: 7855 - DNA, 71 bp, chicken (Gallus Gallus)
  misc_feature (36): n=g or t
ggagctagcaacgctaactcaattcctcttattttngggcaaattattttaataagatacctctgtggagc

SEQ ID NO: 7856 - DNA, 71 bp, chicken (Gallus Gallus)
  misc_feature (36): n=a or g
agaatgtgcttagtcctccattagtttttatctgtnaagggattaaatcccatcgtcttcatcccactgct

SEQ ID NO: 7857 - DNA, 71 bp, chicken (Gallus Gallus)
  misc_feature (36): n=c or t
gggctgaactagtctcaaagatagaagtaaagtacngataacttaaagcaggtgcagtgttcttcgtggct

SEQ ID NO: 7858 - DNA, 71 bp, chicken (Gallus Gallus)
  misc_feature (36): n=a or c
acatctgacctaatcttttgttgttgataggacttntttgagtgagaggttagaatacctgacctccagag

SEQ ID NO: 7859 - DNA, 71 bp, chicken (Gallus Gallus)
  misc_feature (36): n=a or t
taatacctatcctaatatgtctatccaaaaggtctnctctttgctccactgccttcagcttccaataaccc

SEQ ID NO: 7860 - DNA, 71 bp, chicken (Gallus Gallus)
  misc_feature (36): n=g or t
ataaaagggccattttttactcagagatgcaattcngtttcatgaccagaatggtcagatgcaacaggatg

SEQ ID NO: 7861 - DNA, 71 bp, chicken (Gallus Gallus)
  misc_feature (36): n=c or t
tctcctcctaactatctcaaaaggaaaaacaagttngcaaagttcttaagcaagtattctgggttggtgtg

SEQ ID NO: 7862 - DNA, 71 bp, chicken (Gallus Gallus)
  misc_feature (36): n=c or g
atacttaagaacaaatttattgtaacacaaagctgntaaaaattatattactttttacaaattagtagtta

SEQ ID NO: 7863 - DNA, 71 bp, chicken (Gallus Gallus)
  misc_feature (36): n=c or t
gtgctgttgctgatgttattgtcattgcactcctanggcttaaaaatcgtaacatgtattttcagttaata

SEQ ID NO: 7864 - DNA, 71 bp, chicken (Gallus Gallus)
  misc_feature (36): n=a or g
atttcatgaaaccaaaagaatactgcacttttctcntagtctttgccaggaccatgtgtcattcatttggg

SEQ ID NO: 7865 - DNA, 71 bp, chicken (Gallus Gallus)
  misc_feature (36): n=g or t
gcactgccattcaagagttcccagaaatgactgcanctatctccagcttctcatttttgagcatgaaatca

SEQ ID NO: 7866 - DNA, 71 bp, chicken (Gallus Gallus)
  misc_feature (36): n=a or c
tttatttgtaaactaattctagaaattcaggtattncatattttcttcacttaaatgtgacttcttaagag

SEQ ID NO: 7867 - DNA, 71 bp, chicken (Gallus Gallus)
  misc_feature (36): n=c or t
tttgggtataaaaagggtttaaggccagtggtgctncctctctttttcctaggccattcacatggcattga

SEQ ID NO: 7868 - DNA, 71 bp, chicken (Gallus Gallus)
  misc_feature (36): n=c or t
attgttccaattatatttcaaatgaaagtctccagngtctctgtcaccaacagagaacttcattacctcaa

SEQ ID NO: 7869 - DNA, 71 bp, chicken (Gallus Gallus)
  misc_feature (36): n=c or t
atcattgcatgtatcctgaccttcccctcctttagngtaattaatcccaaaacatgtgctcccggctgcct

SEQ ID NO: 7870 - DNA, 71 bp, chicken (Gallus Gallus)
  misc_feature (36): n=c or t
tttctcttgacacacgatggggcttttgacaacagngtgcatggcaccgccattcatggcgcttcccgagt

SEQ ID NO: 7871 - DNA, 71 bp, chicken (Gallus Gallus)
  misc_feature (36): n=c or t
tctggaggccaggcttgggcttggccctgaaccaangtaactctgacctgctcccatgtcacgagaaaggg

SEQ ID NO: 7872 - DNA, 71 bp, chicken (Gallus Gallus)
  misc_feature (36): n=a or g
ataatgaactgcatttatctaaatgagttatggaanggagcagcagaggactctgtggacaaaatacccac

SEQ ID NO: 7873 - DNA, 71 bp, chicken (Gallus Gallus)
  misc_feature (36): n=c or t
agtacatcttttgttaatgctgtagcatttaccatncagcaacataaaatagtaaaaaataagtcagtgat

SEQ ID NO: 7874 - DNA, 71 bp, chicken (Gallus Gallus)
  misc_feature (36): n=a or g
gtcttgcacaattggtaaataagtttgcacttcatngacagctggagtgctgttttgaacaggcattgaca

SEQ ID NO: 7875 - DNA, 71 bp, chicken (Gallus Gallus)
  misc_feature (36): n=c or t
acagcaaaagcccaagctaactagttgtagtctgtngcatgctgctaattattacctgtggttaatataaa

SEQ ID NO: 7876 - DNA, 71 bp, chicken (Gallus Gallus)
  misc_feature (36): n=c or g
aatacagacagttcaacacaatctttttggctgctntgttgaatacctgaagttcttccactagctgtgca

SEQ ID NO: 7877 - DNA, 71 bp, chicken (Gallus Gallus)
  misc_feature (36): n=a or g
agcccatttcctcagcatccttgtatttctgtcgtngggggggggagaagcaggaacactgtggctgcaca

SEQ ID NO: 7878 - DNA, 71 bp, chicken (Gallus Gallus)
  misc_feature (36): n=c or g
tgctggtatgtgcatgtttttcctttctgatctttntccatcaaattgcctgccattgggtcagtcaccat

SEQ ID NO: 7879 - DNA, 71 bp, chicken (Gallus Gallus)
  misc_feature (36): n=c or t
tgctggatgtatgcggtgctctcttccaaaatctanggatggcatctggagggcaaacaaaaaaggccaag

SEQ ID NO: 7880 - DNA, 71 bp, chicken (Gallus Gallus)
  misc_feature (36): n=a or g
tagtttggcacatggttttgcaaatcccttaaaaantataaaatgtacagtacttagcatcattaaagttc

SEQ ID NO: 7881 - DNA, 71 bp, chicken (Gallus Gallus)
  misc_feature (36): n=c or t
ccagggatcactgtatctgagaagccgatcattgcngctaggagtgcttaactagaacttgcttgctctgt

SEQ ID NO: 7882 - DNA, 71 bp, chicken (Gallus Gallus)
  misc_feature (36): n=c or g
gtatccatcattttaaatatcgcaatgtccacgcanataatacacagaaatgggcagggttgcatttacaa

SEQ ID NO: 7883 - DNA, 71 bp, chicken (Gallus Gallus)
  misc_feature (36): n=c or t
taataaccatgtatatttccaagttcattttatgantctgattgttagaattacttgtaaaaggtttacag

SEQ ID NO: 7884 - DNA, 71 bp, chicken (Gallus Gallus)
  misc_feature (36): n=c or t
ctcctacaattcaggatttggtaggagcaacagganagactatttgtgcttcttggctgtggattatttca

SEQ ID NO: 7885 - DNA, 71 bp, chicken (Gallus Gallus)
  misc_feature (36): n=a or g
taaaactcactgatctacagaaaaaaaatagtaacnccccttcccctcccctaaacctataattaccactt

SEQ ID NO: 7886 - DNA, 71 bp, chicken (Gallus Gallus)
  misc_feature (36): n=a or g
attaattccttcccctcctttgtttttatttccacnaaaaacttactttatgataaacctacagtaaagct

SEQ ID NO: 7887 - DNA, 71 bp, chicken (Gallus Gallus)
  misc_feature (36): n=c or t
ggggcagggaaggggtgataaagaacatgtcaccanggtcttctcagcagtgccctgtgacaggacaagag

SEQ ID NO: 7888 - DNA, 71 bp, chicken (Gallus Gallus)
  misc_feature (36): n=a or g
tggactagctaatacacatataccagattctaaaantgtccatgtatggttgcttacactttaactgacta

SEQ ID NO: 7889 - DNA, 71 bp, chicken (Gallus Gallus)
  misc_feature (36): n=c or t
acatatataagctagagacaaagcttttttcttttntatgcttacataatttctcacatgccttcacttat

SEQ ID NO: 7890 - DNA, 71 bp, chicken (Gallus Gallus)
  misc_feature (36): n=c or t
tcataatcccagtgattttgttcagatgaattattnttcattttagaaaatgtgcagaccaaatctgaaga

SEQ ID NO: 7891 - DNA, 71 bp, chicken (Gallus Gallus)
  misc_feature (36): n=a or t
caatctcatgttctgagataccaaagtaattttgtntttattgtagagaagtagtgacgttagttcttaag

SEQ ID NO: 7892 - DNA, 71 bp, chicken (Gallus Gallus)
  misc_feature (36): n=a or t
gattaacaacactaattctcagaggcaatccggttnagatttaggacttcaggaaagtcttatgtttgttt

SEQ ID NO: 7893 - DNA, 71 bp, chicken (Gallus Gallus)
  misc_feature (36): n=a or g
cctatcaataatgtaagtggcccacagccctttgcngggctattgggaacactgcttttaggtcacaaaac

SEQ ID NO: 7894 - DNA, 71 bp, chicken (Gallus Gallus)
  misc_feature (36): n=a or c
agagccaattttcagagcttgggtaaaggccaaagntccacagtgaccatcggattttgaagtcaagtgtg

SEQ ID NO: 7895 - DNA, 71 bp, chicken (Gallus Gallus)
  misc_feature (36): n=a or g
cactatgctgtgtaacctacaacagtacctgtatgntgagcagatgagtcttgacacaaggatttgcctac

SEQ ID NO: 7896 - DNA, 71 bp, chicken (Gallus Gallus)
  misc_feature (36): n=a or g
gtatgtggaagaaaacactgctctggagcattcctngctggtgtctacagagcagcattctgaaatagggt

SEQ ID NO: 7897 - DNA, 71 bp, chicken (Gallus Gallus)
  misc_feature (36): n=c or t
gctgaagctgtcagcaatttccaaaaagaaaggttntagacatgcttgctatttggcttccatcctttcag

SEQ ID NO: 7898 - DNA, 71 bp, chicken (Gallus Gallus)
  misc_feature (36): n=g or t
agttctaagcaagctctatttggcaacaaaccacanctgggaggcagctcagggaagaggatggaggtgga

SEQ ID NO: 7899 - DNA, 71 bp, chicken (Gallus Gallus)
  misc_feature (36): n=a or g
tgggtgagtggatgcagtaggataatcagtctcttntgcttgtagttttgctcattctggagatctggacc

SEQ ID NO: 7900 - DNA, 71 bp, chicken (Gallus Gallus)
  misc_feature (36): n=c or t
tgtctggcagacatagatgtaaaggcaaaataacangacagagagctaaagtgctggcatttgtatatggg

SEQ ID NO: 7901 - DNA, 71 bp, chicken (Gallus Gallus)
  misc_feature (36): n=c or t
gggcttcctttctctctgctaacaattaggggccanataaaaagatgaccctttgaaaattaagttcataa

SEQ ID NO: 7902 - DNA, 71 bp, chicken (Gallus Gallus)
  misc_feature (36): n=a or t
tactgtatttcatggctagttgaaacatgggcaaanctgtaattttatttctttacccattgatcgttgat

SEQ ID NO: 7903 - DNA, 71 bp, chicken (Gallus Gallus)
  misc_feature (36): n=a or g
ctccataataattgattaactgtgtattaacatgcnaattaactcttcatcagctcttcatgaaatatata

SEQ ID NO: 7904 - DNA, 71 bp, chicken (Gallus Gallus)
  misc_feature (36): n=c or t
ttgctcatagagagaacaaaccgagtctccttggcnataatttggctagacaccctgcttctatgcaggac

SEQ ID NO: 7905 - DNA, 71 bp, chicken (Gallus Gallus)
  misc_feature (36): n=a or g
gtgcagctgcatacagtacataaatccagaaggacngtatgccaatcttggctaacgaagccaggatctca

SEQ ID NO: 7906 - DNA, 71 bp, chicken (Gallus Gallus)
  misc_feature (36): n=c or t
tcctccatgctggctgtatttattaacagtgaaaantggaggtgcctatatttgtccagcaagagattgtt

SEQ ID NO: 7907 - DNA, 71 bp, chicken (Gallus Gallus)
  misc_feature (36): n=a or g
ggctcagacaaggtgtgacacagaataggagtgcantagaaactttctgctaatgaagttagtccttcctt

SEQ ID NO: 7908 - DNA, 71 bp, chicken (Gallus Gallus)
  misc_feature (36): n=c or t
gacccatttccagcctcaggacatatatcatactcnccaagagcacccacacctctgcccatcacagctgg

SEQ ID NO: 7909 - DNA, 71 bp, chicken (Gallus Gallus)
  misc_feature (36): n=c or t
ttgtacacagttgtatagaaacatcagacatatganactcagatctatctcctcagcagcaatggcaaaat

SEQ ID NO: 7910 - DNA, 71 bp, chicken (Gallus Gallus)
  misc_feature (36): n=c or t
actagaagatatttgctgaatgctatggagttgcanaaattaaatactaagcataccttttctaaatatgc

SEQ ID NO: 7911 - DNA, 71 bp, chicken (Gallus Gallus)
  misc_feature (36): n=a or g
caggctttctgagcctctagaacagaaaaagaaatnctgtcatggtactcaaataatttacagtatcatga

SEQ ID NO: 7912 - DNA, 71 bp, chicken (Gallus Gallus)
  misc_feature (36): n=c or t
aaaactggcaaatttttagggacatcttttccaggnactgtcaaatagcaattgatgtccttacataattt

SEQ ID NO: 7913 - DNA, 71 bp, chicken (Gallus Gallus)
  misc_feature (36): n=a or c
aatatctaccatgaatgaagagaggactgagttccngtatttaactcagagctacctcagacactgaattt

SEQ ID NO: 7914 - DNA, 71 bp, chicken (Gallus Gallus)
  misc_feature (36): n=a or g
ctaaaggaaaaactcgttcatatgtaatctattctnatatcacaaatcattaaaaaaaggataaaataagc

SEQ ID NO: 7915 - DNA, 71 bp, chicken (Gallus Gallus)
  misc_feature (36): n=a or g
ggcactggagatgtcaggatacaacccatgcagtgnaatcttcattgaacaccatacacatcagtaaggaa

SEQ ID NO: 7916 - DNA, 71 bp, chicken (Gallus Gallus)
  misc_feature (36): n=c or t
acagctatatccacactactcttaaacataactcangacataactttacctttctctaactccgcctgcct

SEQ ID NO: 7917 - DNA, 71 bp, chicken (Gallus Gallus)
  misc_feature (36): n=a or g
ccctctcctgttctaagcttgaaaaagtctgaaacntcaccaggcagcagaacagcccctctcctcccctc

SEQ ID NO: 7918 - DNA, 71 bp, chicken (Gallus Gallus)
  misc_feature (36): n=a or c
gcacaaatgctttggtggctacaggcgtgtgccctnacagcactgcccggattacatgtgtgaaggcagga

SEQ ID NO: 7919 - DNA, 71 bp, chicken (Gallus Gallus)
  misc_feature (36): n=c or t
aatacaaagagaaaattaagagctataaacaaacgntaaaagtatgctttcaggtgagatttgaaaggaga

SEQ ID NO: 7920 - DNA, 71 bp, chicken (Gallus Gallus)
  misc_feature (36): n=c or g
aacagtataagcactgagcagtgggagacctcaaanaagtgcaaataacctggctgaggaagacaggaata

SEQ ID NO: 7921 - DNA, 71 bp, chicken (Gallus Gallus)
  misc_feature (36): n=c or t
atgtccttaactgtcaaatatgaagtgctggctgtngttcactggcctgtgcctgagtgagacaaaaatag

SEQ ID NO: 7922 - DNA, 71 bp, chicken (Gallus Gallus)
  misc_feature (36): n=c or t
ctttgctacacaaaacaaaaacaaccaaaggagaangtcatcagcaggttgcaggtaacatgcctactttt

SEQ ID NO: 7923 - DNA, 71 bp, chicken (Gallus Gallus)
  misc_feature (36): n=c or t
tacagacggccttttggctgtgcggtcctcagtatngcggatttgctggcaggagattcaaaggatgacct

SEQ ID NO: 7924 - DNA, 71 bp, chicken (Gallus Gallus)
  misc_feature (36): n=a or t
gacagactgcattttagaacttctataactgcttangatacttttattatttcatattatatgaattccaa

SEQ ID NO: 7925 - DNA, 71 bp, chicken (Gallus Gallus)
  misc_feature (36): n=c or t
ctgggagaggaactggaagtaatcttctcactcttngatagtaaagaaaatcgacccatcaggtagcatat

SEQ ID NO: 7926 - DNA, 71 bp, chicken (Gallus Gallus)
  misc_feature (36): n=c or g
agactgtgcatcccacaatagagcatggcagtgaanggaaaccagcaagcagcccaatgaagtttttgctt

SEQ ID NO: 7927 - DNA, 71 bp, chicken (Gallus Gallus)
  misc_feature (36): n=a or c
aacactgtttttctcgtaaagccaaaacataacatnacaccagacactatgaaggaaataactctgcctca

SEQ ID NO: 7928 - DNA, 71 bp, chicken (Gallus Gallus)
  misc_feature (36): n=c or t
atagaaaatatccaagatttctcaatgaggctctgngattacacctttaagaaagttcagattttaagttc

SEQ ID NO: 7929 - DNA, 71 bp, chicken (Gallus Gallus)
  misc_feature (36): n=a or g
agccacactgagagtctgaagctgcgactgctccantactgctctgcaggatggaataacagtgataggtt

SEQ ID NO: 7930 - DNA, 71 bp, chicken (Gallus Gallus)
  misc_feature (36): n=c or t
tctgaatgcactaagccatttcctccagtcatactncacatctcccacagcattttcctcccttggcctgg

SEQ ID NO: 7931 - DNA, 71 bp, chicken (Gallus Gallus)
  misc_feature (36): n=a or g
taacatacagaacgttgaagatcactaccaaataantctgctctgttgcctctaaaatgtacacatcttcc

SEQ ID NO: 7932 - DNA, 71 bp, chicken (Gallus Gallus)
  misc_feature (36): n=a or g
gaatacccaaattatagttttgagttttatatatantataaatagttcaatagctattgcatatagcagtt

SEQ ID NO: 7933 - DNA, 71 bp, chicken (Gallus Gallus)
  misc_feature (36): n=a or g
aacaactgcagaaagcataagaggctgtagggatcntggataccaagatggcttaggtgcatgtgagaagg

SEQ ID NO: 7934 - DNA, 71 bp, chicken (Gallus Gallus)
  misc_feature (36): n=g or t
gtgagcttagcattcaaaggcgttttcctctgtctntaatgtagtaatccttgggacaccgcagttcatga

SEQ ID NO: 7935 - DNA, 71 bp, chicken (Gallus Gallus)
  misc_feature (36): n=a or g
tgccaaatctggcttcttacagacctaaactggganaagacattgtcatccctgcctgtttactaccactg

SEQ ID NO: 7936 - DNA, 71 bp, chicken (Gallus Gallus)
  misc_feature (36): n=c or t
ccaagtgattgagcagtgcccagagaaggagtgcanggctggaagaagtaaaaaggaatagcagtagcgaa

SEQ ID NO: 7937 - DNA, 71 bp, chicken (Gallus Gallus)
  misc_feature (36): n=c or t
atggtagggtttctgattttacttagatgacctaanctagaaaaactgttaaggttttaccttggtaaaat

SEQ ID NO: 7938 - DNA, 71 bp, chicken (Gallus Gallus)
  misc_feature (36): n=c or g
tttaaaagccactgctgcctcagttgtggttcttgnttttctgggaggacgcaactcagcttccaggtccc

SEQ ID NO: 7939 - DNA, 71 bp, chicken (Gallus Gallus)
  misc_feature (36): n=a or g
agaaaagagttgtaccatcacctctaaatttaacanctttctccctaattcgctaatatcttttggaaaca

SEQ ID NO: 7940 - DNA, 71 bp, chicken (Gallus Gallus)
  misc_feature (36): n=c or t
tctatgttttagcatagactgcacataaagcagacntcagtgatatcagtcatggtttttttctgaattta

SEQ ID NO: 7941 - DNA, 71 bp, chicken (Gallus Gallus)
  misc_feature (36): n=g or t
caatcacagaacacatgtcaaagacaatttaacctncactgttcgtataattagcttatccactatttttg

SEQ ID NO: 7942 - DNA, 71 bp, chicken (Gallus Gallus)
  misc_feature (36): n=a or g
tttggctgggcttgcactcccaaaatgaacggggantgtatttctttggaaagacactgtgatccacgctc

SEQ ID NO: 7943 - DNA, 71 bp, chicken (Gallus Gallus)
  misc_feature (36): n=a or c
tgccctctactggttgaagcgtgtcagcaactaaantattacctggaagctacggttttcaaacacaaaac

SEQ ID NO: 7944 - DNA, 71 bp, chicken (Gallus Gallus)
  misc_feature (36): n=c or t
ggctgcctttatatacatagtacaacaaatccacanaccatttaatgagaataacaaaaaattggcttcca

SEQ ID NO: 7945 - DNA, 71 bp, chicken (Gallus Gallus)
  misc_feature (36): n=a or t
acacagcactatccaaatccaaaccctatgcctganagcatagtccaaatctcttggcagcttgggactgt

SEQ ID NO: 7946 - DNA, 71 bp, chicken (Gallus Gallus)
  misc_feature (36): n=a or t
ttagtgtcagtggaaatctaggcaaaagaaatgtangcgatggtatgtttgtctcttattcttaaatgttg

SEQ ID NO: 7947 - DNA, 71 bp, chicken (Gallus Gallus)
  misc_feature (36): n=c or g
tgtactgcacgtgacagaggttttgtatggctggtntaattctaagtgaaggagaatcaacatttttactc

SEQ ID NO: 7948 - DNA, 71 bp, chicken (Gallus Gallus)
  misc_feature (36): n=a or c
agctacacatgcttttgatcaggatatttacaaagntctctttctaatccagaaggagacagttcagacct

SEQ ID NO: 7949 - DNA, 71 bp, chicken (Gallus Gallus)
  misc_feature (36): n=g or t
cagttttaaactaacttttcaaattcaggatatttngatattcagtgaataatgtaaaagggtctgaatta

SEQ ID NO: 7950 - DNA, 71 bp, chicken (Gallus Gallus)
  misc_feature (36): n=c or t
caagaagttaattcacagagctacgggaagtctgtnggagaatgcagtctcctatgtgcaaagaaacactt

SEQ ID NO: 7951 - DNA, 71 bp, chicken (Gallus Gallus)
  misc_feature (36): n=a or t
tctaagccttataatgcatctagtttcacgcgatanctattctgaaactcactgcagaatagtagaagtgc

SEQ ID NO: 7952 - DNA, 71 bp, chicken (Gallus Gallus)
  misc_feature (36): n=g or t
gtaaatctagggtggggccattaaagaaaacagcanagactgctttgtgcattgcagtgaagttctctttc

SEQ ID NO: 7953 - DNA, 71 bp, chicken (Gallus Gallus)
  misc_feature (36): n=c or g
tttgtttcttttgctgaagaagaatatttaaatggntgggctgttgaagccagataactacttaaatatat

SEQ ID NO: 7954 - DNA, 71 bp, chicken (Gallus Gallus)
  misc_feature (36): n=c or t
gaagatggagagaaagaagccaagcttagacgcaanttaaatggtaaggtttaacctttaaacctttgcag

SEQ ID NO: 7955 - DNA, 71 bp, chicken (Gallus Gallus)
  misc_feature (36): n=a or t
ctctttctgagaataaatttttcctaatacccaaantgaatctccccagacacaggtatctcagcttttcc

SEQ ID NO: 7956 - DNA, 71 bp, chicken (Gallus Gallus)
  misc_feature (36): n=c or t
caggctgaagtatggcataagaagcacatacactgnggttagggctggagtttctgtcctgagcgatcgca

SEQ ID NO: 7957 - DNA, 71 bp, chicken (Gallus Gallus)
  misc_feature (36): n=a or c
ctgaccttgttctgacttatcaaaataaactggagnctgtaagcgtgatggttaatgcatagcataactgc

SEQ ID NO: 7958 - DNA, 71 bp, chicken (Gallus Gallus)
  misc_feature (36): n=a or c
aaaatatcattccttttgcacaagcactgtccttcngcaatggaatacaaaacttctgatgttctttaaaa

SEQ ID NO: 7959 - DNA, 71 bp, chicken (Gallus Gallus)
  misc_feature (36): n=a or g
ctctatagctgcatgagatgtgaatatttttctcantgttcatgatttgatttaggtctgcaggagggaca

SEQ ID NO: 7960 - DNA, 71 bp, chicken (Gallus Gallus)
  misc_feature (36): n=a or g
ccctttggaactgcctgaggtttaggcaagagtgantctgagtggggatttgagtgtcaggttaacacatt

SEQ ID NO: 7961 - DNA, 71 bp, chicken (Gallus Gallus)
  misc_feature (36): n=g or t
gtgtttctgtgatgattttccattccaacaaagcgnaacctctgctcatggctgaagctgagagttctatg

SEQ ID NO: 7962 - DNA, 71 bp, chicken (Gallus Gallus)
  misc_feature (36): n=g or t
tctatgatttgggacaatcagtgggacatgtgggcnctaaggctcttgcagcctgctatgggcagagtaaa

SEQ ID NO: 7963 - DNA, 71 bp, chicken (Gallus Gallus)
  misc_feature (36): n=c or g
tgattccagaacctccctagaagggagaaactctcncagaaactctcttctcttcccagatggaaaatttt

SEQ ID NO: 7964 - DNA, 71 bp, chicken (Gallus Gallus)
  misc_feature (36): n=c or t
tgtttctatttgatttattgatgattctgctaaccnatcacataatgtggtgtggaactgcaagcagcact

SEQ ID NO: 7965 - DNA, 71 bp, chicken (Gallus Gallus)
  misc_feature (36): n=a or g
gcatttctgagctctgagtaccctctgctggagaanactacaactaagaaatggccatttcattttcattc

SEQ ID NO: 7966 - DNA, 71 bp, chicken (Gallus Gallus)
  misc_feature (36): n=c or t
tttgtggccaagaatgccagtagtaccccagttgancaactaggttgtccatacgcatgagagcagtgtgc

SEQ ID NO: 7967 - DNA, 71 bp, chicken (Gallus Gallus)
  misc_feature (36): n=c or t
taaaattaaaattaaaaatagaatcagtagcctcantcaccacacttgatttatagcagaatccataccag

SEQ ID NO: 7968 - DNA, 71 bp, chicken (Gallus Gallus)
  misc_feature (36): n=a or g
tgtattgtgttgaatcttgatgcttttcccacttcngtgcgattttcgactatctctaatgtcatctttgt

SEQ ID NO: 7969 - DNA, 71 bp, chicken (Gallus Gallus)
  misc_feature (36): n=a or g
ccgcagaccagcctggtgcttgccttctattaccantgcacaaatagcacaggcctgaacatttcaaaact

SEQ ID NO: 7970 - DNA, 71 bp, chicken (Gallus Gallus)
  misc_feature (36): n=a or g
gaaaatgcaacatctgaccactctgcaagggattcntgagcttcctttttaccagcaagacctctcttttc

SEQ ID NO: 7971 - DNA, 71 bp, chicken (Gallus Gallus)
  misc_feature (36): n=a or g
gggatgtggcaggacttgcatgtaaagtcttgaggnctgattctaaagtaatcagataggaaatcaagcct

SEQ ID NO: 7972 - DNA, 71 bp, chicken (Gallus Gallus)
  misc_feature (36): n=a or g
gcatgttcacttcccagtgaatggagaggaccaganctggatctcagggctcaagccaactgttcagggct

SEQ ID NO: 7973 - DNA, 71 bp, chicken (Gallus Gallus)
  misc_feature (36): n=a or g
caggctaccttcagagggcagatatatgtaaatacnaattcctgctcctcagggtttcatatggaaacatt

SEQ ID NO: 7974 - DNA, 71 bp, chicken (Gallus Gallus)
  misc_feature (36): n=a or g
ttccctaagtgttctttatagtaaagtgtttcatgnacaatgactgtatgaactgaattcattcataatgt

SEQ ID NO: 7975 - DNA, 71 bp, chicken (Gallus Gallus)
  misc_feature (36): n=c or t
gctgtaaaagtgcttaagtttggtgccataaataanggcaatttaaaacaaaacaaaatattccgagcttt

SEQ ID NO: 7976 - DNA, 71 bp, chicken (Gallus Gallus)
  misc_feature (36): n=g or t
tgctggggtgctcccccagtcccaggaaacacaagnacaaactgacatctgcattgcatgcaccacacttc

SEQ ID NO: 7977 - DNA, 71 bp, chicken (Gallus Gallus)
  misc_feature (36): n=c or t
tagcccaactgtaggtggccgacaggagggcttccngtgtttcacaacctgtccctagatagtattgcagt

SEQ ID NO: 7978 - DNA, 71 bp, chicken (Gallus Gallus)
  misc_feature (36): n=c or t
gctgagcaaaatgatagctgttaaaaatcaggcatnttagtgttttaagagctggacatttttgattacag

SEQ ID NO: 7979 - DNA, 71 bp, chicken (Gallus Gallus)
  misc_feature (36): n=a or t
atgtgtggacagaagtaatccagtatctaaagctanggaaaagcagttttaatacacaccaagatctgaaa

SEQ ID NO: 7980 - DNA, 71 bp, chicken (Gallus Gallus)
  misc_feature (36): n=a or g
acagaaccattttcctagaatcacagaaagagatcnctttgctgggattaaaaataagcagtgatgccttg

SEQ ID NO: 7981 - DNA, 71 bp, chicken (Gallus Gallus)
  misc_feature (36): n=a or g
agttaaatattaaaacatggagataaagcagagagnagatgcttggaagtgaagcagtgcattggcagaca

SEQ ID NO: 7982 - DNA, 71 bp, chicken (Gallus Gallus)
  misc_feature (36): n=c or t
acctcaaatgaaaatggcaagttgaactgcatttanagcagaagtactttcatctattaccaaagcacaat

SEQ ID NO: 7983 - DNA, 71 bp, chicken (Gallus Gallus)
  misc_feature (36): n=c or g
tctaaacccttggcacatccatatcagtgtcgattnatcgcgctcctgttccctcaatgtaaaaaagagga

SEQ ID NO: 7984 - DNA, 71 bp, chicken (Gallus Gallus)
  misc_feature (36): n=c or t
tttctcagcgcagcagttggagctgcacagacctcnatttggttttctgggtagaaatgatgaaatccaaa

SEQ ID NO: 7985 - DNA, 71 bp, chicken (Gallus Gallus)
  misc_feature (36): n=c or t
tctatcaacattagactgtggaaggttgggccatgngtatgctaaaaccagcttatagctgaatctcctca

SEQ ID NO: 7986 - DNA, 71 bp, chicken (Gallus Gallus)
  misc_feature (36): n=a or g
ttaattatgatgcctccttatatttgtttcactgtnttgataaagagacgtggctcaaatagctgctttct

SEQ ID NO: 7987 - DNA, 71 bp, chicken (Gallus Gallus)
  misc_feature (36): n=c or t
aagttaaatttccatagcctgaattcattgttgatnctttgtatgtcattaatactgctgggcaaatgtct

SEQ ID NO: 7988 - DNA, 71 bp, chicken (Gallus Gallus)
  misc_feature (36): n=g or t
tccgtcagctttttaagcaagtattcaatctgtagngaaatacaagcaaaaattaatcactttcagcagac

SEQ ID NO: 7989 - DNA, 71 bp, chicken (Gallus Gallus)
  misc_feature (36): n=a or g
gttccaacccactgctgtgaaatctgtgagaagtcnagcaaagcagctctaacactcacttctacctttgc

SEQ ID NO: 7990 - DNA, 71 bp, chicken (Gallus Gallus)
  misc_feature (36): n=a or g
cgtgttgaagcactgtactttaacctggagtaatgntattctttctctatacttctccatagcctttatgg

SEQ ID NO: 7991 - DNA, 71 bp, chicken (Gallus Gallus)
  misc_feature (36): n=c or t
agggctacaaaataacaaaagcagctttagacaccnagtttcttccatcaaattcaaaggcgcaaatggaa

SEQ ID NO: 7992 - DNA, 71 bp, chicken (Gallus Gallus)
  misc_feature (36): n=a or g
tgatgttgcttctcaaaagtgggatcaaatttcttnaagtgggcaattgcagttgtaccctgagcagtgag

SEQ ID NO: 7993 - DNA, 71 bp, chicken (Gallus Gallus)
  misc_feature (36): n=c or t
aaagtgggaggagagggatgagtgaaaagaacttanaagagtataaccctgtgatgttagttttgttacac

SEQ ID NO: 7994 - DNA, 71 bp, chicken (Gallus Gallus)
  misc_feature (36): n=c or t
ctgcataaaacattatgtgacttaaatgtatattantgcattacttgataaagcatgcacctaataccgag

SEQ ID NO: 7995 - DNA, 71 bp, chicken (Gallus Gallus)
  misc_feature (36): n=c or g
tatactttgtttaaagctgagataaacacgagttcnctgcacatagctgaaacgctttaaaagtgtaggct

SEQ ID NO: 7996 - DNA, 71 bp, chicken (Gallus Gallus)
  misc_feature (36): n=a or g
tccaaagccatccagagaggccgcttccctcccacnctacctgtgctcttgagcaaggtcagtgtgttcaa

SEQ ID NO: 7997 - DNA, 71 bp, chicken (Gallus Gallus)
  misc_feature (36): n=a or g
tgggaacaaaaaagaaaaaaataccaaactttaccngagcacagccaccattcactagtaaaacaagcaag

SEQ ID NO: 7998 - DNA, 71 bp, chicken (Gallus Gallus)
  misc_feature (36): n=a or t
gtggcaatcacaaattaaaaactaaaaatgagtgcnctgagaactgacccaccaagttcttatcctggcac

SEQ ID NO: 7999 - DNA, 71 bp, chicken (Gallus Gallus)
  misc_feature (36): n=a or g
ttaatcctgtggagggcaataatttctgtatcttgnagtggcacacctttttgggtcaaaaaattcagtgt

SEQ ID NO: 8000 - DNA, 71 bp, chicken (Gallus Gallus)
  misc_feature (36): n=g or t
acttggttgtagactttgccttgcagcaagcaccanactggtgctccccttgacagttacagcgctctctg

SEQ ID NO: 8001 - DNA, 71 bp, chicken (Gallus Gallus)
  misc_feature (36): n=c or t
gtagagtatactttataaaaaacagttaccactgtngattccaaagtgcccatgaacatgtaagaaggcaa

SEQ ID NO: 8002 - DNA, 71 bp, chicken (Gallus Gallus)
  misc_feature (36): n=a or g
acacgttttctcactgtgtgccccaccagcaaagcncacttccatggacagagcacaaatagtcatataca

SEQ ID NO: 8003 - DNA, 71 bp, chicken (Gallus Gallus)
  misc_feature (36): n=c or t
acatggaggttcctttttgattatttacttttcttnctcttttttttcttcagaaaagccttacctagaaa

SEQ ID NO: 8004 - DNA, 71 bp, chicken (Gallus Gallus)
  misc_feature (36): n=a or g
gtgaatatatttttttcagtctcatatataccaacngtttggttagatcatgtaaaaacaagaaggattaa

SEQ ID NO: 8005 - DNA, 71 bp, chicken (Gallus Gallus)
  misc_feature (36): n=c or t
cacaaaaataacacatctgtagatactatcattgcnaccacttggcatgaaagatcaatgaaagttgttgt

SEQ ID NO: 8006 - DNA, 71 bp, chicken (Gallus Gallus)
  misc_feature (36): n=a or g
cagattttggagatgtttctgaaattcctttgcatntcagtgatgaagtcatcttctgtgtgattcttgtg

SEQ ID NO: 8007 - DNA, 71 bp, chicken (Gallus Gallus)
  misc_feature (36): n=a or t
tgaggtgatgctaacaggaaaaatatttcagattantatgattattaagttttttcaaaaacctaatcttc

SEQ ID NO: 8008 - DNA, 71 bp, chicken (Gallus Gallus)
  misc_feature (36): n=c or t
cacaaacagagatttgatgagctgtttgtcaaatcncagaagtcacagatattgttgccattttgatttac

SEQ ID NO: 8009 - DNA, 71 bp, chicken (Gallus Gallus)
  misc_feature (36): n=a or g
tgccactttgggcttcttactttgttttcttgagangctaaatccactttggaattcaacagatattgttg

SEQ ID NO: 8010 - DNA, 71 bp, chicken (Gallus Gallus)
  misc_feature (36): n=a or c
agtgtagtgaaatccctttattgaagtattttatanagggaggtcttctaaccttattttcaattgatagc

SEQ ID NO: 8011 - DNA, 71 bp, chicken (Gallus Gallus)
  misc_feature (36): n=a or t
tgtccagatggaagaggattggtttagacagcctancatacgagaaaccgagtttgctaattcaacaacaa

SEQ ID NO: 8012 - DNA, 71 bp, chicken (Gallus Gallus)
  misc_feature (36): n=a or g
ggaaatgatggtttgtgaagtatttacaataatgtncactgattatttacatagattttgggtataaactg

SEQ ID NO: 8013 - DNA, 71 bp, chicken (Gallus Gallus)
  misc_feature (36): n=a or g
ttcagctctcgcttattgatgtcattgctgctgttnttgtccaactggctgaagtaccagtgtaccactcg

SEQ ID NO: 8014 - DNA, 71 bp, chicken (Gallus Gallus)
  misc_feature (36): n=c or t
ctctagttatttcttttcttatgctcacacacatcngttagtttaacagtggcacctgatcatttcttctg

SEQ ID NO: 8015 - DNA, 71 bp, chicken (Gallus Gallus)
  misc_feature (36): n=c or t
atgcaacttagcaaaacttttactgcatttgcttcnagcttgctcttgatgttatttgctattatctgatg

SEQ ID NO: 8016 - DNA, 71 bp, chicken (Gallus Gallus)
  misc_feature (36): n=a or g
cctttcctccaaaatgcagcatccgtgccttgcttnttcctcttttgccttactccttgctatccctggat

SEQ ID NO: 8017 - DNA, 71 bp, chicken (Gallus Gallus)
  misc_feature (36): n=a or t
acatttcaagaggacattccattgggaatttctctntcctaagccttctatataacttcagtgaatcaatc

SEQ ID NO: 8018 - DNA, 71 bp, chicken (Gallus Gallus)
  misc_feature (36): n=g or t
tgggtatggttgccaccctatgctgtagttgaaatnggatgattctagatggttccatcagaagttccatt

SEQ ID NO: 8019 - DNA, 71 bp, chicken (Gallus Gallus)
  misc_feature (36): n=c or t
cttccccagcacctgcaaaagcggccacagaagctnagagctgcatctcagtcactcctcttttctgtttc

SEQ ID NO: 8020 - DNA, 71 bp, chicken (Gallus Gallus)
  misc_feature (36): n=a or g
aacaaaaaacaccttggaaacaaaattgtcatgtgntacataaatagagaatttggggattcatttaaaaa

SEQ ID NO: 8021 - DNA, 71 bp, chicken (Gallus Gallus)
  misc_feature (36): n=c or t
tatacttgcttgtgtattctgtggatagaaaagtangatcgtaaattcaacaaaatcagttcaaggagaat

SEQ ID NO: 8022 - DNA, 71 bp, chicken (Gallus Gallus)
  misc_feature (36): n=c or g
ctgaagtaggtgaaaagttttctgtctgcattgaanggaccacctccagcttccccatctgacttcaaagg

SEQ ID NO: 8023 - DNA, 71 bp, chicken (Gallus Gallus)
  misc_feature (36): n=c or t
tattatcagttgatgtcattgccagagaaggatttnactagttcatgctgagtttatagattcatgtgaac

SEQ ID NO: 8024 - DNA, 71 bp, chicken (Gallus Gallus)
  misc_feature (36): n=c or t
ctcgtttctgttgctgtaatggaagcaggaattacngcacacaactctcccatctgttattatagcagaat

SEQ ID NO: 8025 - DNA, 71 bp, chicken (Gallus Gallus)
  misc_feature (36): n=c or t
ctccaaaatgttgcttatcatgttttattttcacancttctgtggtagcctttgtgttagattactcactc

SEQ ID NO: 8026 - DNA, 71 bp, chicken (Gallus Gallus)
  misc_feature (36): n=a or g
tctaaacaaaattgtaatcagtcatgtttaagaacnatacattcaatccagtgctgttgcagagcatggtc

SEQ ID NO: 8027 - DNA, 71 bp, chicken (Gallus Gallus)
  misc_feature (36): n=c or t
ctgtgaacctgctttcctgtgacctgcctaaaaacngtcaaactgcatgtagcagactgtgcagagataaa

SEQ ID NO: 8028 - DNA, 71 bp, chicken (Gallus Gallus)
  misc_feature (36): n=a or g
aggcccttaattcatgtacacaatgagtgcaacagngatgtttacacctgtgagagatgaccaactttttt

SEQ ID NO: 8029 - DNA, 71 bp, chicken (Gallus Gallus)
  misc_feature (36): n=a or g
ttctatgatatgatatgatatgactatgggtccacncaagctttcatctctcagacgttcataaagcagca

SEQ ID NO: 8030 - DNA, 71 bp, chicken (Gallus Gallus)
  misc_feature (36): n=a or t
aaagtatgagacgaatagcaaagttttgggtgaganacagtttttcagatggtttctgattctatgtggct

SEQ ID NO: 8031 - DNA, 71 bp, chicken (Gallus Gallus)
  misc_feature (36): n=c or t
aagtccgtgttgctgtagacttctattttttcaagngaccaaaaaaaaagtatgcaagaatccattagaat

SEQ ID NO: 8032 - DNA, 71 bp, chicken (Gallus Gallus)
  misc_feature (36): n=c or t
taggtagggatctcaaatttttaccattgctcctcngcccattgttacatgtgcttacatgaatcctttct

SEQ ID NO: 8033 - DNA, 71 bp, chicken (Gallus Gallus)
  misc_feature (36): n=a or c
acctgacacttgagagcaggatttgtgctaaaaaanaaaaacaaaaaaaaaaaaacagtattcattaatat

SEQ ID NO: 8034 - DNA, 71 bp, chicken (Gallus Gallus)
  misc_feature (36): n=a or c
aaacggaagggttggaggtttaaatcaattgttttnatggtattattgcatcttttgataaaataagagcg

SEQ ID NO: 8035 - DNA, 71 bp, chicken (Gallus Gallus)
  misc_feature (36): n=a or g
gtacagcagcattaaaaaaaaaaaaaccaaaaaacnttcattcagggtgaaaaggtgaaagaatggtctat

SEQ ID NO: 8036 - DNA, 71 bp, chicken (Gallus Gallus)
  misc_feature (36): n=a or g
aaaaatgaaagtgacatccttgtgtctaagttatgntattccagagcaaagcacctcttattctagctgac

SEQ ID NO: 8037 - DNA, 71 bp, chicken (Gallus Gallus)
  misc_feature (36): n=a or g
agaaaaacggaccatttgcaagtgcatgtggtagcncttttagtacttgatgctacttagtggcatatgta

SEQ ID NO: 8038 - DNA, 71 bp, chicken (Gallus Gallus)
  misc_feature (36): n=a or g
agatttgctcacaaactattacccacagaacagctntagatatcaggggtcccactttgccattcatactc

SEQ ID NO: 8039 - DNA, 71 bp, chicken (Gallus Gallus)
  misc_feature (36): n=c or t
atatcttctttctaccagatgctgaatccccagccngagaagactttcattcgcaacaaagcagcgcaagt

SEQ ID NO: 8040 - DNA, 71 bp, chicken (Gallus Gallus)
  misc_feature (36): n=c or t
tgctacctgatgtagctactgctatgacattggatncaatttttagtttgacctgaaatgtatgtctgttt

SEQ ID NO: 8041 - DNA, 71 bp, chicken (Gallus Gallus)
  misc_feature (36): n=a or g
gtgaaattctgctaaaaatatgcagtgatcttactntaccctgtaaagttccttgaacattggaacattgt

SEQ ID NO: 8042 - DNA, 71 bp, chicken (Gallus Gallus)
  misc_feature (36): n=c or g
cctatcctcagtttcaaagaggtacaacgcctactnttctccattacttctttgtctcaaaagctacccat

SEQ ID NO: 8043 - DNA, 71 bp, chicken (Gallus Gallus)
  misc_feature (36): n=a or t
aactttccttttttggacaggaatcgtcctacaacnctgtggcttaaggagacttagttgtaacaagaagc

SEQ ID NO: 8044 - DNA, 71 bp, chicken (Gallus Gallus)
  misc_feature (36): n=c or t
accatcccagctcctcaccacgcgctctgcagggangcagtgcatcactgaggcaacccagaatgagaaag

SEQ ID NO: 8045 - DNA, 71 bp, chicken (Gallus Gallus)
  misc_feature (36): n=c or t
agttacccatttgcaaaagaaaaaaaaagagccaanctctaaatctccagaagcgggaggatgctgtctgc

SEQ ID NO: 8046 - DNA, 71 bp, chicken (Gallus Gallus)
  misc_feature (36): n=a or g
ctagcatctgctctctttccccctgctcacccgtcncctgctccagttttcctcttggctgtgttactctg

SEQ ID NO: 8047 - DNA, 71 bp, chicken (Gallus Gallus)
  misc_feature (36): n=a or g
tcaaggaaacctcactgttactgaaacatttgcttnttttaggtttccagaaacgcccttggtgccgcatt

SEQ ID NO: 8048 - DNA, 71 bp, chicken (Gallus Gallus)
  misc_feature (36): n=c or t
atgtaacgaacttacggtgctctctctcacattctntccagatgccatgaagtacacaattgtggtgtctg

SEQ ID NO: 8049 - DNA, 71 bp, chicken (Gallus Gallus)
  misc_feature (36): n=a or g
tgtgtggctgcccttactcgagcgtgccctaagganggaccagctgtggtaggtcagttcattcaagatgt

SEQ ID NO: 8050 - DNA, 71 bp, chicken (Gallus Gallus)
  misc_feature (36): n=a or g
ctacttaaaaagccctgcaggttgcaaggcccgtcnttaagtatttcactgcatagggaataataacatat

SEQ ID NO: 8051 - DNA, 71 bp, chicken (Gallus Gallus)
  misc_feature (36): n=a or c
tccccatcagacacaggacagaaattattacagttnctatttcttaacttgttgttcaagagacactgctt

SEQ ID NO: 8052 - DNA, 71 bp, chicken (Gallus Gallus)
  misc_feature (36): n=c or t
agagcacacaactgatatattctgcagttactttantttacaaaaactttaaagagattttgtgcactgta

SEQ ID NO: 8053 - DNA, 71 bp, chicken (Gallus Gallus)
  misc_feature (36): n=c or g
tttatttttattgcaatatttttattttatcatttnttattttagccatcaacattacttctcagccatgt

SEQ ID NO: 8054 - DNA, 71 bp, chicken (Gallus Gallus)
  misc_feature (36): n=a or g
aaacagcaactgccatctgtttttacagagtaaacnttaagatcacacattaattttaaaaagcagttaag

SEQ ID NO: 8055 - DNA, 71 bp, chicken (Gallus Gallus)
  misc_feature (36): n=c or t
tgctgtttgtgatagcttctagtctgctttgacagngaatcatagaattgctcaggttggaaaagacctta

SEQ ID NO: 8056 - DNA, 71 bp, chicken (Gallus Gallus)
  misc_feature (36): n=a or g
caggccacagctgcaggctagtgtgtggcacacatngctgatgaagataaattagctgcaaggcatccgca

SEQ ID NO: 8057 - DNA, 71 bp, chicken (Gallus Gallus)
  misc_feature (36): n=a or g
tcacaaattaaccgtgttatgtctcaaataacaccnatgacaaaagggagaagctgaatcaaatgatttat

SEQ ID NO: 8058 - DNA, 71 bp, chicken (Gallus Gallus)
  misc_feature (36): n=c or t
ctgcgctgtgcacactgctgttaggatgatggtatnctgtgatgtgataaactggagaagctgtaattgca

SEQ ID NO: 8059 - DNA, 71 bp, chicken (Gallus Gallus)
  misc_feature (36): n=g or t
actgttctgtgctatacaatcaaagcaaaacacgcnttagaaaatagaaattctgtgtgtttccaggggaa

SEQ ID NO: 8060 - DNA, 71 bp, chicken (Gallus Gallus)
  misc_feature (36): n=a or g
tgttcagaagggttgataagagaaagcgtatgggancctgtggttgcaattaactgctgagaacataatct

SEQ ID NO: 8061 - DNA, 71 bp, chicken (Gallus Gallus)
  misc_feature (36): n=c or t
cactttgtttctccagttgtcctgggaaaaccacanaagcagatgatgagagggacattgaatcttttttt

SEQ ID NO: 8062 - DNA, 71 bp, chicken (Gallus Gallus)
  misc_feature (36): n=g or t
gcttagattccaatccatgatatagcacctggtctntataatcttatgatccctggcctggccacagcctc

SEQ ID NO: 8063 - DNA, 71 bp, chicken (Gallus Gallus)
  misc_feature (36): n=c or t
gcttacctccatgagactagcccatacagggatctnatcatagcatgggtggcactgccagacatcttccc

SEQ ID NO: 8064 - DNA, 71 bp, chicken (Gallus Gallus)
  misc_feature (36): n=c or t
cttgtccatagtacaatcaaaattgttaagtgtganggtagtcctaagttggcacagtgcaagtcaaggct

SEQ ID NO: 8065 - DNA, 71 bp, chicken (Gallus Gallus)
  misc_feature (36): n=c or t
gtcattcagcttgcttagcccagcaaagcaaagtcngacagatgatctgcttgctgcttatgcatcagccg

SEQ ID NO: 8066 - DNA, 71 bp, chicken (Gallus Gallus)
  misc_feature (36): n=c or t
acatgggtacccaagttacctttgtacaagactgcntctcagcacagttcaagagaattggtttaagtgca

SEQ ID NO: 8067 - DNA, 71 bp, chicken (Gallus Gallus)
  misc_feature (36): n=c or g
gtgatggttgcacacaattactttccagcttttaancgagtcatgacaaacttgatcccatcaatgattca

SEQ ID NO: 8068 - DNA, 71 bp, chicken (Gallus Gallus)
  misc_feature (36): n=c or t
gttcagatggagcattcttggtgccatctgtatttnagagagtgctccagccccaggtactggtgtgacac

SEQ ID NO: 8069 - DNA, 71 bp, chicken (Gallus Gallus)
  misc_feature (36): n=a or g
aaagatatatagtaagttgcaatgaaatgcaccctnttcctacgagagtaatttgtggctctgcctaagta

SEQ ID NO: 8070 - DNA, 71 bp, chicken (Gallus Gallus)
  misc_feature (36): n=c or t
tcaagacagccagcaccgcttcaacaatggcagatngtgcctctggtggcatagatgatggactgatgtaa

SEQ ID NO: 8071 - DNA, 71 bp, chicken (Gallus Gallus)
  misc_feature (36): n=a or g
actcagcatttcattcaagaaaagaagaaggacatnggatgcaatttttagaacaagctgaagatataaca

SEQ ID NO: 8072 - DNA, 71 bp, chicken (Gallus Gallus)
  misc_feature (36): n=a or c
cctggtactgtactggaaatatgcggtggtcaggcnatctgctgtcactgtggcccacgtctggctgtttt

SEQ ID NO: 8073 - DNA, 71 bp, chicken (Gallus Gallus)
  misc_feature (36): n=a or t
atacagatagttgtataaaattttcttatattctancattttctaatctgacaagctaaatgaaagccagt

SEQ ID NO: 8074 - DNA, 71 bp, chicken (Gallus Gallus)
  misc_feature (36): n=c or t
agctccttggacacgacatagaaatacatttttggncactggctcaaggcagctgcttaaaaagttactca

SEQ ID NO: 8075 - DNA, 71 bp, chicken (Gallus Gallus)
  misc_feature (36): n=a or g
acattagcatgctgcaggtcatcaaagtcatgggtncagccaggaagaaatccatttgcctgggctctatt

SEQ ID NO: 8076 - DNA, 71 bp, chicken (Gallus Gallus)
  misc_feature (36): n=a or g
agagacattaagagttaactgctttctaggctattnttaaaagaaacaaatagcaacatatttaacaagaa

SEQ ID NO: 8077 - DNA, 71 bp, chicken (Gallus Gallus)
  misc_feature (36): n=a or g
aatagttctgaaatcctcacatattgaatacttacntcaaacaggacattcaacttgctaaatgcatgaaa

SEQ ID NO: 8078 - DNA, 71 bp, chicken (Gallus Gallus)
  misc_feature (36): n=a or t
ttctacttagttccagtgataatttagtgaaaaaantaatttattccttcaatcttttttttttctaaaat

SEQ ID NO: 8079 - DNA, 71 bp, chicken (Gallus Gallus)
  misc_feature (36): n=c or t
caacagggtttggtggactttgttgcttaatactgntgctgccatctctacatgtgggaatgcaccatgac

SEQ ID NO: 8080 - DNA, 71 bp, chicken (Gallus Gallus)
  misc_feature (36): n=c or t
atagatacatgagcttatttggtgtattttgcaatngaagtattaaaattactaaatgttgctatgtagat

SEQ ID NO: 8081 - DNA, 71 bp, chicken (Gallus Gallus)
  misc_feature (36): n=a or g
ttgccctagttttggatatgtttgttatcttataantgaagctatcttttggcttgaagaacaatggaaga

SEQ ID NO: 8082 - DNA, 71 bp, chicken (Gallus Gallus)
  misc_feature (36): n=a or g
taaggtccgaagctaccttaagtcctcagaatctgncagctacaaggtaatctaaagaaaacccagtttca

SEQ ID NO: 8083 - DNA, 71 bp, chicken (Gallus Gallus)
  misc_feature (36): n=c or t
agttattatagaagggtgatgtatttagttacccantgtaatcattcacacttcagttataccgaatatat

SEQ ID NO: 8084 - DNA, 71 bp, chicken (Gallus Gallus)
  misc_feature (36): n=c or t
aacaacaaaaaaagatctgtgcagttccagaagatntcttaaaaaaataaaaattggaaacaaaaaacact

SEQ ID NO: 8085 - DNA, 71 bp, chicken (Gallus Gallus)
  misc_feature (36): n=c or t
cactgaagtgatagtttttgatctctaaacattttncttggagttgtagtttgtagatgttttgccactgt

SEQ ID NO: 8086 - DNA, 71 bp, chicken (Gallus Gallus)
  misc_feature (36): n=a or g
acttcctccgctatggcagaagcatttaaacagccnagattcctatttaagttttgtattttaaagcaaag

SEQ ID NO: 8087 - DNA, 71 bp, chicken (Gallus Gallus)
  misc_feature (36): n=a or g
gtaaagaggaaacaataacaaggtgaatttaggggnaaaaaaaaaaaaaggatgggacaaggctcacacat

SEQ ID NO: 8088 - DNA, 71 bp, chicken (Gallus Gallus)
  misc_feature (36): n=a or g
gcgtagtttgactgatgtccaacttcagtgcagagngatctataacactttgacaagatattgttgcttca

SEQ ID NO: 8089 - DNA, 71 bp, chicken (Gallus Gallus)
  misc_feature (36): n=g or t
cattttacaaagggtcaattatccactctactccantgaaaatactgtagatactgcctctgacaacagtg

SEQ ID NO: 8090 - DNA, 71 bp, chicken (Gallus Gallus)
  misc_feature (36): n=c or t
ctacggtagggctagtgttcattacctgtaaagaangaaacgctgcccctgaagtctgcgttgtggcttcc

SEQ ID NO: 8091 - DNA, 71 bp, chicken (Gallus Gallus)
  misc_feature (36): n=c or t
aggacattagtggaggtagtgtacaacacttccttngctgcacttctatttcagtccacgttgcaattcaa

SEQ ID NO: 8092 - DNA, 71 bp, chicken (Gallus Gallus)
  misc_feature (36): n=a or g
ttccacccatgttgcgtaaaaaaggtttggcaggtntttgccacaacgtgagaatctgtaggcattgctta

SEQ ID NO: 8093 - DNA, 71 bp, chicken (Gallus Gallus)
  misc_feature (36): n=a or g
acctgcagacagcaattcagacttaacaggtgagcngtgccatcgtgctgctctccctttccccagctcat

SEQ ID NO: 8094 - DNA, 71 bp, chicken (Gallus Gallus)
  misc_feature (36): n=c or t
atggcaaaggtgggtgaggtacataagggtctattnttaaaacgataataggtgagttataaatagcattt

SEQ ID NO: 8095 - DNA, 71 bp, chicken (Gallus Gallus)
  misc_feature (36): n=c or t
taattatgcagtcctgatttggcaaatatatttaantaaatgccacagagagaactgcgataaaaaatgag

SEQ ID NO: 8096 - DNA, 71 bp, chicken (Gallus Gallus)
  misc_feature (36): n=c or t
gcctatgccaacaagttattctggttttacatgagngtgcttcccagagccaccctgtgcagcacatgaca

SEQ ID NO: 8097 - DNA, 71 bp, chicken (Gallus Gallus)
  misc_feature (36): n=g or t
taatagagtatctcaaattagacaggccagcaaagntttctcaatgctgaataggaccccataagaactgt

SEQ ID NO: 8098 - DNA, 71 bp, chicken (Gallus Gallus)
  misc_feature (36): n=c or t
taaaatcataggtatctacaacgaacagtaaaacanccaaccttgttacaggatccagatttaaggcagtt

SEQ ID NO: 8099 - DNA, 71 bp, chicken (Gallus Gallus)
  misc_feature (36): n=c or t
tatgggagaggggcagtttttgcatcaccgagtgtngatatagatgcaaagccaaggctggaagagagcca

SEQ ID NO: 8100 - DNA, 71 bp, chicken (Gallus Gallus)
  misc_feature (36): n=a or g
tgagaaagctgaaggtcaaaaaaataccagtctcanttgagatggggagccctgcactagaacatcaaggc

SEQ ID NO: 8101 - DNA, 71 bp, chicken (Gallus Gallus)
  misc_feature (36): n=a or g
tttaataagaattcgtgatcatttctaatcatgttntttagccttcttccctcatcctcaacatttacagg

SEQ ID NO: 8102 - DNA, 71 bp, chicken (Gallus Gallus)
  misc_feature (36): n=c or g
gtgcccaggaccacgtccatatggcttctgaagatntccaaggaggagactccacagactctctgagcagc

SEQ ID NO: 8103 - DNA, 71 bp, chicken (Gallus Gallus)
  misc_feature (36): n=a or g
aaaaatcactcttttacatacaattttttaaagtangaccctttgcagtgactgtggtccaacagagtact

SEQ ID NO: 8104 - DNA, 71 bp, chicken (Gallus Gallus)
  misc_feature (36): n=a or g
ccgggaaaaagttttccccaccaataggacgcccangtgataaagaaattcatttctttaccttgggtact

SEQ ID NO: 8105 - DNA, 71 bp, chicken (Gallus Gallus)
  misc_feature (36): n=c or g
taacctgattgcttgtggtagtctgaatgccattantaaaccataaaaaaaccaacagatttaatgtttca

SEQ ID NO: 8106 - DNA, 71 bp, chicken (Gallus Gallus)
  misc_feature (36): n=a or g
aattactttatgcagtgagatgttaccttttctcangtgtaaatgtaacatctagatatttttatccagtg

SEQ ID NO: 8107 - DNA, 71 bp, chicken (Gallus Gallus)
  misc_feature (36): n=c or g
gcagcagccaccctgggaacatcatgctgagacagnaatgggactgtagcatcagctgtgggatctgctgc

SEQ ID NO: 8108 - DNA, 71 bp, chicken (Gallus Gallus)
  misc_feature (36): n=a or g
atttcagaactctgcagaattcattgtaaatgctgnagattgccattacaacgtctcatattaatttttat

SEQ ID NO: 8109 - DNA, 71 bp, chicken (Gallus Gallus)
  misc_feature (36): n=c or t
ttttgtaaaagtattgtaacacattacctttgtaangtgaagacatgaagatatgttgtcaaaacttctct

SEQ ID NO: 8110 - DNA, 71 bp, chicken (Gallus Gallus)
  misc_feature (36): n=c or t
tgagcttgccataatgtaagtttcatttcaaatgcngttattgtatgaaacattgcacagataaggtgatt

SEQ ID NO: 8111 - DNA, 71 bp, chicken (Gallus Gallus)
  misc_feature (36): n=a or t
gacactgatgacagatcagtaactgaagcaatactngtcaaccaaggatttcatataaggatttgcatagg

SEQ ID NO: 8112 - DNA, 71 bp, chicken (Gallus Gallus)
  misc_feature (36): n=c or t
acacttaatttggaaacttgtgattaattgtgtcantttggaatccagtcagatgctaacagattctttgg

SEQ ID NO: 8113 - DNA, 71 bp, chicken (Gallus Gallus)
  misc_feature (36): n=c or t
ctctgctaggttcgagctgcatctcctcaatcgcanctaaatgggaccttgacatggagcccaccaagagg

SEQ ID NO: 8114 - DNA, 71 bp, chicken (Gallus Gallus)
  misc_feature (36): n=a or t
ttagatatattttgcttttattttccgttacttaantaaatgctttaacagaatacccttctttagaagag

SEQ ID NO: 8115 - DNA, 71 bp, chicken (Gallus Gallus)
  misc_feature (36): n=a or g
aaaggaaaaacatgcattattttcattattttgacntttcacaatttggagttgttggctactctgaagta

SEQ ID NO: 8116 - DNA, 71 bp, chicken (Gallus Gallus)
  misc_feature (36): n=a or g
tgaaaaagtttgtaatgatttgtatctgcttgttgngtaatcctatgggtacttcttaccaaccactgtca

SEQ ID NO: 8117 - DNA, 71 bp, chicken (Gallus Gallus)
  misc_feature (36): n=a or g
agtcaaatttaattcctatccttcttccttatccanacaacatctcccaagattacattttctttttttgg

SEQ ID NO: 8118 - DNA, 71 bp, chicken (Gallus Gallus)
  misc_feature (36): n=g or t
aaacatgacttagcacattcagtgaaacacatcacnccacctgaatcacttcagtttacatttgctgtgag

SEQ ID NO: 8119 - DNA, 71 bp, chicken (Gallus Gallus)
  misc_feature (36): n=c or t
tacaatggtaaatcacagccctgagtatctttaaangttctttgtcactgactgtactgagacatttccag

SEQ ID NO: 8120 - DNA, 71 bp, chicken (Gallus Gallus)
  misc_feature (36): n=a or g
caacacagcagataaatcataatggtaacaaatacntataaatacctcagcactcctgtgcataatttccc

SEQ ID NO: 8121 - DNA, 71 bp, chicken (Gallus Gallus)
  misc_feature (36): n=a or g
ctggtttttaattctgatatgggaggcactgggagnagagaggacagaatgatctgctggggaaaacagca

SEQ ID NO: 8122 - DNA, 71 bp, chicken (Gallus Gallus)
  misc_feature (36): n=a or g
ggggacctctgctgtttggaaacatgctttgatttngtaatagtgagcagttcagtgacagttatgcagct

SEQ ID NO: 8123 - DNA, 71 bp, chicken (Gallus Gallus)
  misc_feature (36): n=c or t
tgtggttactcagtgtatcagtttcataaacttccntgcttgccctctgtgactcagttaataataattaa

SEQ ID NO: 8124 - DNA, 71 bp, chicken (Gallus Gallus)
  misc_feature (36): n=c or t
tcgctgagatgctctgacgctggcataaattcctcngcatatgaggataattaatgaacaggaggtctttc

SEQ ID NO: 8125 - DNA, 71 bp, chicken (Gallus Gallus)
  misc_feature (36): n=a or g
aacatgaccagtcttgaggggcagcaaaaaatgccntcagcatttataagataaatgttttaaatgtttta

SEQ ID NO: 8126 - DNA, 71 bp, chicken (Gallus Gallus)
  misc_feature (36): n=c or g
aggtaattggccaatcttcaggtgtgttttcatcanatggagtcctggagcaagcaggagatgaggaggca

SEQ ID NO: 8127 - DNA, 71 bp, chicken (Gallus Gallus)
  misc_feature (36): n=c or t
tgttattcaaaaacagatgtcattttcctcagctcntccagaaaaacatcaggctaccaaattgcagttaa

SEQ ID NO: 8128 - DNA, 71 bp, chicken (Gallus Gallus)
  misc_feature (36): n=g or t
ctctgaacagatggcggtaatttgaattgtgttaangggagaaaaagggtcacaactgatttccaccacat

SEQ ID NO: 8129 - DNA, 71 bp, chicken (Gallus Gallus)
  misc_feature (36): n=g or t
agacatgagtcattcttaaaaaaacaaggtagcaantagaatgccacctttacagactatattattcttgt

SEQ ID NO: 8130 - DNA, 71 bp, chicken (Gallus Gallus)
  misc_feature (36): n=a or g
aataaacttcttgatagctataattggaagacatgntgtgattaactcagaagtgttgacctctcagattt

SEQ ID NO: 8131 - DNA, 71 bp, chicken (Gallus Gallus)
  misc_feature (36): n=a or c
cattcattcagttatttgtactatattcttcggatntttttccactctcttctcttaatgcaactagattt

SEQ ID NO: 8132 - DNA, 71 bp, chicken (Gallus Gallus)
  misc_feature (36): n=c or g
aggaggaatgtttaaagaacacaacagcacttttanccagacctggaagcaaaggtagcagagaggattac

SEQ ID NO: 8133 - DNA, 71 bp, chicken (Gallus Gallus)
  misc_feature (36): n=a or g
tctgcctctcatcatgaccttgcaagaagtgatgcnttctcttcattatatgaacaatgtgttatgttaat

SEQ ID NO: 8134 - DNA, 71 bp, chicken (Gallus Gallus)
  misc_feature (36): n=a or g
acatagatagaaaaactcagcttgaaagaagcagtngtcttctgatgcaacattctgctctgaagttattg

SEQ ID NO: 8135 - DNA, 71 bp, chicken (Gallus Gallus)
  misc_feature (36): n=a or g
aacagacataaaggaactaatgccaaaatattcaanagcgtcacttaatgtttcacactttaatagctcaa

SEQ ID NO: 8136 - DNA, 71 bp, chicken (Gallus Gallus)
  misc_feature (36): n=c or t
ttacaacccatatttcactatatttgcaactgtcanggctcagagctgctccacctaataaacacaccctt

SEQ ID NO: 8137 - DNA, 71 bp, chicken (Gallus Gallus)
  misc_feature (36): n=c or t
agattctgaaggatctgccagagatcaaatatcaanatctaactatgacaaactggattcctctggatatg

SEQ ID NO: 8138 - DNA, 71 bp, chicken (Gallus Gallus)
  misc_feature (36): n=a or g
tgagtaaagtggagttagttaagcaggaacaggagngaagggcagggcccaaggcctcacaacaccatgag

SEQ ID NO: 8139 - DNA, 71 bp, chicken (Gallus Gallus)
  misc_feature (36): n=a or g
gtgtgtcaatttacacgaaggaccctttatattcantgtagacctaggtaatgcatgtagttaggtcatga

SEQ ID NO: 8140 - DNA, 71 bp, chicken (Gallus Gallus)
  misc_feature (36): n=a or t
gaggactactggggtagatttaaacacctggattgnatctggtgtattgtttgcagtcatatctacacgtg

SEQ ID NO: 8141 - DNA, 71 bp, chicken (Gallus Gallus)
  misc_feature (36): n=a or g
ctgaattcatatggaatcaatcattaaaatgaaggnacattttctattttgacagtgttgtgtaatataaa

SEQ ID NO: 8142 - DNA, 71 bp, chicken (Gallus Gallus)
  misc_feature (36): n=a or g
gttgaacccttccttcagtagctgggcttggagganagaagtgtgtgtgctgatcattagcctgggctggc

SEQ ID NO: 8143 - DNA, 71 bp, chicken (Gallus Gallus)
  misc_feature (36): n=g or t
ggcttgactatataatggcttgactatacaatgggngtatctctggctgatagtgctcatggcccattacc

SEQ ID NO: 8144 - DNA, 71 bp, chicken (Gallus Gallus)
  misc_feature (36): n=a or g
taaaggtttttattctattccttaattcaactttcnttctctgcattgattcagcaatcctgaatcaatat

SEQ ID NO: 8145 - DNA, 71 bp, chicken (Gallus Gallus)
  misc_feature (36): n=a or g
tttttagctttattctattgcttcttccgtcttttnaaagtaaaaactgcctcgcttcctttccagaccct

SEQ ID NO: 8146 - DNA, 71 bp, chicken (Gallus Gallus)
  misc_feature (36): n=c or t
ggctgtgggaaaaccatgaatgtaggtctgcactangatcactattcagtgaacgcttctcagcagcaaaa

SEQ ID NO: 8147 - DNA, 71 bp, chicken (Gallus Gallus)
  misc_feature (36): n=c or t
ttctttccaagacttcttagtaaattctgtactaanaatgatgtttctataattactcctgttatcaccag

SEQ ID NO: 8148 - DNA, 71 bp, chicken (Gallus Gallus)
  misc_feature (36): n=g or t
ggtctctgaggctgctttcttagatagcagtaagtntgtcacaccaacttttcatcttcttacccagagct

SEQ ID NO: 8149 - DNA, 71 bp, chicken (Gallus Gallus)
  misc_feature (36): n=a or g
tcattcactgctttggtaaggacaaggggtgcactngaagtactatggataatatagcagaatcatagaat

SEQ ID NO: 8150 - DNA, 71 bp, chicken (Gallus Gallus)
  misc_feature (36): n=a or g
cataccactagtagatacttaggttctttaataccntttgttacagcgttgttgctttcctctcaggtaac

SEQ ID NO: 8151 - DNA, 71 bp, chicken (Gallus Gallus)
  misc_feature (36): n=a or g
caggtgtttccttatagtaaaaccaaaaactctgcnattaaacctcctgagttccagaaacccttcaaaaa

SEQ ID NO: 8152 - DNA, 71 bp, chicken (Gallus Gallus)
  misc_feature (36): n=c or t
actatcaccagaagtccttttgatctctgtagggcnacaattgcatctcttgctctaattactaatgttgt

SEQ ID NO: 8153 - DNA, 71 bp, chicken (Gallus Gallus)
  misc_feature (36): n=a or c
taatggagtggatttattagtaccagctgaggatcnagccttactcctgactgagatgctagtaatgagat

SEQ ID NO: 8154 - DNA, 71 bp, chicken (Gallus Gallus)
  misc_feature (36): n=c or t
gagatttcagcttgctgtgatgaaatgtttagcccncatctcactctacaagacaaagtgttgtctgtatg

SEQ ID NO: 8155 - DNA, 71 bp, chicken (Gallus Gallus)
  misc_feature (36): n=a or g
gcttgttccttcacgcgtgtcaccttgttaatcacnagctaacaaatgactggatatgcaacatctgcaat

SEQ ID NO: 8156 - DNA, 71 bp, chicken (Gallus Gallus)
  misc_feature (36): n=c or t
caaaagattttaattaatgtacaggcgtttggctcnaattgtttcttagaacaccataaaacactgtacaa

SEQ ID NO: 8157 - DNA, 71 bp, chicken (Gallus Gallus)
  misc_feature (36): n=c or t
cttaacatctgctgtttctcatgtggttgggattgntctgctaaaagatggaatttctataggtattttag

SEQ ID NO: 8158 - DNA, 71 bp, chicken (Gallus Gallus)
  misc_feature (36): n=a or c
tatttgctagttcagtcagttgtcttagatctctantgtgttttactgaatttaggaagtaaatactgcat

SEQ ID NO: 8159 - DNA, 71 bp, chicken (Gallus Gallus)
  misc_feature (36): n=a or t
gtaatcttaaaatgtttctgtagcaacctgggcacntaaaagatgtccatgataaaaagaaaggaagcact

SEQ ID NO: 8160 - DNA, 71 bp, chicken (Gallus Gallus)
  misc_feature (36): n=a or g
atagtatcaactacaaattttgtggcaatttcatanaagttgctatttattcccaggtgtgcctcagcatt

SEQ ID NO: 8161 - DNA, 71 bp, chicken (Gallus Gallus)
  misc_feature (36): n=c or t
ttgtgcctcgtggcaaatttcaaatcctaatagccncactgctattctccgttgttttatctatttatctc

SEQ ID NO: 8162 - DNA, 71 bp, chicken (Gallus Gallus)
  misc_feature (36): n=c or g
atgacctgtttatcggttaaacttcttaatagtctntgtagatttttctgctaatgttcccaggtgaatga

SEQ ID NO: 8163 - DNA, 71 bp, chicken (Gallus Gallus)
  misc_feature (36): n=c or g
aataaaatttttctatttcatgtcatagttgaatgnagtggataacagacagcaaggtatttccctatcca

SEQ ID NO: 8164 - DNA, 71 bp, chicken (Gallus Gallus)
  misc_feature (36): n=a or g
aattactgcactcaaacagaaatttgcagatttacngtatgattatatgcatttagtttcctttaaaggaa

SEQ ID NO: 8165 - DNA, 71 bp, chicken (Gallus Gallus)
  misc_feature (36): n=c or t
acagaccagtctatattacagggtgaattcccacanatatttgagacagtggcaagagctgccgcagactg

SEQ ID NO: 8166 - DNA, 71 bp, chicken (Gallus Gallus)
  misc_feature (36): n=c or t
gaccagtccagccatttggttacattttgcccatantgggtaaagaaaaaagtccatttacactccctcag

SEQ ID NO: 8167 - DNA, 71 bp, chicken (Gallus Gallus)
  misc_feature (36): n=g or t
tgaggaagcacaaatcctaaacgagctcaatattcncatcttccttaattacagacggagccctcctcccc

SEQ ID NO: 8168 - DNA, 71 bp, chicken (Gallus Gallus)
  misc_feature (36): n=c or t
tccttgatccaaacttcaatatacaccatattggtngtgattaaatattctagtgaaacgtaaaagcactc

SEQ ID NO: 8169 - DNA, 71 bp, chicken (Gallus Gallus)
  misc_feature (36): n=c or g
ccactgaagcaataggtattaaatccgttatagcantgagttataaatgaggaaggattattttctgatat

SEQ ID NO: 8170 - DNA, 71 bp, chicken (Gallus Gallus)
  misc_feature (36): n=a or g
cgtctggaaggcaacacagtgggtgtggaggcagcnaaggttattgccaaagccttggagaagaagtcgga

SEQ ID NO: 8171 - DNA, 71 bp, chicken (Gallus Gallus)
  misc_feature (36): n=c or g
cttagcaggcagtaattactttgcaaatttttaganacatgataacagattggtttataaagaggtggtaa

SEQ ID NO: 8172 - DNA, 71 bp, chicken (Gallus Gallus)
  misc_feature (36): n=c or t
gatatctgatatactgtatagaacaatctttgtccntggttatgaaaaagagggtaacatcaccgcacata

SEQ ID NO: 8173 - DNA, 71 bp, chicken (Gallus Gallus)
  misc_feature (36): n=c or t
gttgggcagagcgttaacagagctaagccactcatnctgttacactgatggatgctgggttgtactagcga

SEQ ID NO: 8174 - DNA, 71 bp, chicken (Gallus Gallus)
  misc_feature (36): n=a or g
gaagaaaagaacagtggactcaatcactggaaaacnttactgcatgactcacaacagaagttgcaaactaa

SEQ ID NO: 8175 - DNA, 71 bp, chicken (Gallus Gallus)
  misc_feature (36): n=c or t
cagagccatcctaaagcctgggatggcctgaatacngtgtgtgtgtctaactctgcatgggactgagggct

SEQ ID NO: 8176 - DNA, 71 bp, chicken (Gallus Gallus)
  misc_feature (36): n=a or g
cagctgcactagaattagtttctatagcaacagagnaaataatgtgaagaattgcactgcaatgcaagatg

SEQ ID NO: 8177 - DNA, 71 bp, chicken (Gallus Gallus)
  misc_feature (36): n=c or t
atgaggtaattcttaaaaataggtaacagaattctnttcctcccttcagctaggagtgaatcatcactctt

SEQ ID NO: 8178 - DNA, 71 bp, chicken (Gallus Gallus)
  misc_feature (36): n=a or c
atcgccctgaagaaaagcttgatttacctgaagagngtaacctagaaaatgaagttgaagtaaatgcatct

SEQ ID NO: 8179 - DNA, 71 bp, chicken (Gallus Gallus)
  misc_feature (36): n=g or t
gaaatgcaaacagaacaataaaataagcgtccaaanctgctgccattgctgtaaactgaacaaagcagaaa

SEQ ID NO: 8180 - DNA, 71 bp, chicken (Gallus Gallus)
  misc_feature (36): n=a or t
tcccacatcactgcacatcactgagcagtagaactnctttagcacagctgcacttatataatgaaaatgat

SEQ ID NO: 8181 - DNA, 71 bp, chicken (Gallus Gallus)
  misc_feature (36): n=c or t
aataatactatggatctccaccagtgtgtatttttnccatttttcagttatatgaacacagcacaaaccac

SEQ ID NO: 8182 - DNA, 71 bp, chicken (Gallus Gallus)
  misc_feature (36): n=c or g
aaagtcttggcagatatttggaaattgctcttgcangatttggtgaaaaacactgtgacttcttgatcaga

SEQ ID NO: 8183 - DNA, 71 bp, chicken (Gallus Gallus)
  misc_feature (36): n=a or g
ctgtagtgagtctagggcttcaaaacaccatgggcnaggtcattaatggatttctgtgcagacatttatac

SEQ ID NO: 8184 - DNA, 71 bp, chicken (Gallus Gallus)
  misc_feature (36): n=c or g
tggcataatatataactataatctgctttatacatnctattgtaaaatgtctttgtacagcctggatgttg

SEQ ID NO: 8185 - DNA, 71 bp, chicken (Gallus Gallus)
  misc_feature (36): n=c or t
tctactgagggatattgttgtgtgatttttaaaagngtccgttatgtcctcctatattcacagatgcatta

SEQ ID NO: 8186 - DNA, 71 bp, chicken (Gallus Gallus)
  misc_feature (36): n=c or t
ataactcaggctgctgtatgtaacttattgagacangctgttcttaggctttcctctgtctctatgcccaa

SEQ ID NO: 8187 - DNA, 71 bp, chicken (Gallus Gallus)
  misc_feature (36): n=c or g
taagatctttatcagcaccatttcttgaaataacanctcaagtaaaactgtatactggttgggaaactttt

SEQ ID NO: 8188 - DNA, 71 bp, chicken (Gallus Gallus)
  misc_feature (36): n=a or t
agcagccttctgtcagtctgcagaggagaatcggtntcttattatgaaacataaagcagggaggaccccgg

SEQ ID NO: 8189 - DNA, 71 bp, chicken (Gallus Gallus)
  misc_feature (36): n=c or t
ccctgaaacggcaccaacaaacttctcttcctcctngtctcacaagacattctttgtctcctttctattcc

SEQ ID NO: 8190 - DNA, 71 bp, chicken (Gallus Gallus)
  misc_feature (36): n=c or t
aagacagagcacgtctgccctggttttcctatttgnagaagctatcaacagagatagggactggcttaaat

SEQ ID NO: 8191 - DNA, 71 bp, chicken (Gallus Gallus)
  misc_feature (36): n=c or t
gtgatctcattgattttatttagacatccagctaanccgcctctcctttctagattcatccaaaattgtct

SEQ ID NO: 8192 - DNA, 71 bp, chicken (Gallus Gallus)
  misc_feature (36): n=c or t
tgcttcacttgtgctccactgatcagtggatttgtngggtttaacgaggagctgacgctctatccacaaca

SEQ ID NO: 8193 - DNA, 71 bp, chicken (Gallus Gallus)
  misc_feature (36): n=a or g
ccacaggattgtggtgcttggggatgcactgctgangagactttgggtcttcaggtgttgtcaggctgaag

SEQ ID NO: 8194 - DNA, 71 bp, chicken (Gallus Gallus)
  misc_feature (36): n=a or g
aaagaaaataaagctatttccttgaacagagaagtnctctgtgaaggacaaataaacaagctgaaaagcga

SEQ ID NO: 8195 - DNA, 71 bp, chicken (Gallus Gallus)
  misc_feature (36): n=c or g
tgtacgaaagcaatttcattcagtcttctaagttcnaatacaaagacttgagatttgacatatttattgca

SEQ ID NO: 8196 - DNA, 71 bp, chicken (Gallus Gallus)
  misc_feature (36): n=c or t
taaaaatatctgctttcaagactcccatccaaatcngtctgacataaatatgtatttgtgtaagagtttgg

SEQ ID NO: 8197 - DNA, 71 bp, chicken (Gallus Gallus)
  misc_feature (36): n=c or t
gctgacaactagaacaacatttctcttttctcctcnttaaataatgcccagtgatcattttactgcagatt

SEQ ID NO: 8198 - DNA, 71 bp, chicken (Gallus Gallus)
  misc_feature (36): n=a or g
ttctgccctgaaggcttcagtcccagtctgtgaaancgttataaaagacagctatctggcatgactagtgt

SEQ ID NO: 8199 - DNA, 71 bp, chicken (Gallus Gallus)
  misc_feature (36): n=a or g
atttggatatgcacttttacactggtataattgtcnttaccctaggggagttgtactacttaagctacact

SEQ ID NO: 8200 - DNA, 71 bp, chicken (Gallus Gallus)
  misc_feature (36): n=c or t
agacaggcagtcttcattgttacagtttaggggtgnggatagcaattagcaaacctgctctgtagctccac

SEQ ID NO: 8201 - DNA, 71 bp, chicken (Gallus Gallus)
  misc_feature (36): n=a or g
tccaaaaaacaatagacagtgtgttattttcagagnagagaactgacaatcttacttcaaaattcaggttg

SEQ ID NO: 8202 - DNA, 71 bp, chicken (Gallus Gallus)
  misc_feature (36): n=a or g
gtggagccacaagtggattactgtgtctggttccgngctcttctgttcaaacaagactgacaacatctaga

SEQ ID NO: 8203 - DNA, 71 bp, chicken (Gallus Gallus)
  misc_feature (36): n=a or g
ggagggaatgagaagattttccatttgcagacagcnacactgtgcttgatgctcaatgttcaatgttcact

SEQ ID NO: 8204 - DNA, 71 bp, chicken (Gallus Gallus)
  misc_feature (36): n=c or t
gggaatagttctataaaaatatttgttcccattacnatcaaactgcaaaagaataaattagcactcttcct

SEQ ID NO: 8205 - DNA, 71 bp, chicken (Gallus Gallus)
  misc_feature (36): n=a or c
aacgtttacttagtaagtaattattcagtaaataanaattgctcaaaccctatttgccccagtcgacccca

SEQ ID NO: 8206 - DNA, 71 bp, chicken (Gallus Gallus)
  misc_feature (36): n=c or t
tgggcaagaatctgtttcagctcatgtgcttatcanttactacagctctaaactgggttctgaagaagtac

SEQ ID NO: 8207 - DNA, 71 bp, chicken (Gallus Gallus)
  misc_feature (36): n=a or g
taaaaatatctttgttcagttccaaacatctgagantctgagattctgaatttatctgaaacctgtctata

SEQ ID NO: 8208 - DNA, 71 bp, chicken (Gallus Gallus)
  misc_feature (36): n=c or t
actaaagaaagccacacagggtcaatagtgcagctncaacttcaggcagcccctggctccatgtgtgcagt

SEQ ID NO: 8209 - DNA, 71 bp, chicken (Gallus Gallus)
  misc_feature (36): n=c or t
tggcttacctacctgaagcatgatctaatgatacanctattcagataagtgcaattattcattttaacaag

SEQ ID NO: 8210 - DNA, 71 bp, chicken (Gallus Gallus)
  misc_feature (36): n=a or g
ttaagactgaaaccatcgtaacacacttaaagcacntatcatcactttcttcattcttaactttaagcatt

SEQ ID NO: 8211 - DNA, 71 bp, chicken (Gallus Gallus)
  misc_feature (36): n=a or g
aggagtaggttagttgttaaattagccaaagcaatnagagattgacctaggaatacaggattatagagatg

SEQ ID NO: 8212 - DNA, 71 bp, chicken (Gallus Gallus)
  misc_feature (36): n=a or g
gcaaacctcagaacttataagacagaaaatagggantcaggcttatcttcttccagctgtaatgatttgca

SEQ ID NO: 8213 - DNA, 71 bp, chicken (Gallus Gallus)
  misc_feature (36): n=c or g
ggaaactcaaatttgcgctaatcacgtaaatatcancacagtatttgacccaactatggcaaaatacatca

SEQ ID NO: 8214 - DNA, 71 bp, chicken (Gallus Gallus)
  misc_feature (36): n=c or t
tactcacatgagggcagggaagaattatggttctantagttttgtttattagccttgcttctataggatat

SEQ ID NO: 8215 - DNA, 71 bp, chicken (Gallus Gallus)
  misc_feature (36): n=a or c
accaagccaagtgaggtcgggctctatcagccctgnatatggatcatacatcaactgtatgtactctccat

SEQ ID NO: 8216 - DNA, 71 bp, chicken (Gallus Gallus)
  misc_feature (36): n=a or g
gggggttccaggactttcacaaattctagattcacntggatttcaactcctagcataagtgcaactttgaa

SEQ ID NO: 8217 - DNA, 71 bp, chicken (Gallus Gallus)
  misc_feature (36): n=c or t
aaaggtaaggaattgattttgattaaatgtaaatcnatatctatctcacaaacataacaggagaagagaca

SEQ ID NO: 8218 - DNA, 71 bp, chicken (Gallus Gallus)
  misc_feature (36): n=a or g
tttattttcagaatatgatctatcagcctcagaaangcagtaaaaataagtctggagttttatgctgttcc

SEQ ID NO: 8219 - DNA, 71 bp, chicken (Gallus Gallus)
  misc_feature (36): n=c or t
gccttcactagagtcttgagaaagtaacttctctantgggtattagaagcctcttttcctgtttcctactc

SEQ ID NO: 8220 - DNA, 71 bp, chicken (Gallus Gallus)
  misc_feature (36): n=a or g
ggccatgtgtgcagtgagcatttagtgaaaagctgncagaaactgtagaggatcagtaccatcttaacatc

SEQ ID NO: 8221 - DNA, 71 bp, chicken (Gallus Gallus)
  misc_feature (36): n=a or g
accgaggctactcagcaactgtggatctggatgatnatgaagtattagggcaattggtggtgtatctttct

SEQ ID NO: 8222 - DNA, 71 bp, chicken (Gallus Gallus)
  misc_feature (36): n=g or t
ttgaaaatgtcaacttataattctctgcatctttgnctatgtaagtctcataaatgttttgagaactttac

SEQ ID NO: 8223 - DNA, 71 bp, chicken (Gallus Gallus)
  misc_feature (36): n=a or g
ctgggctcagtgcaacagaggcttcacgcctacccntgtcccattctgccaaagctggagtgcatcaaaat

SEQ ID NO: 8224 - DNA, 71 bp, chicken (Gallus Gallus)
  misc_feature (36): n=a or t
tggaaaagaggaaaatatgtaagagaaaagatattngaatggaatttgcatctgtaaaacacaggaggaag

SEQ ID NO: 8225 - DNA, 71 bp, chicken (Gallus Gallus)
  misc_feature (36): n=a or c
actggaataccccacctgctgcagaatcatcatcangctcaccttgcagtaatctccccatttctgtcaca

SEQ ID NO: 8226 - DNA, 71 bp, chicken (Gallus Gallus)
  misc_feature (36): n=c or t
acaagcaatggctgctctgagccacaaatgtggtcngcttggtggacacctatcagggcccacttctttga

SEQ ID NO: 8227 - DNA, 71 bp, chicken (Gallus Gallus)
  misc_feature (36): n=g or t
tgccattaggctgactgtcatctcttttgtgttatnacttgcagctattttatatactgggagtcgtcatc

SEQ ID NO: 8228 - DNA, 71 bp, chicken (Gallus Gallus)
  misc_feature (36): n=c or t
ccattttcaccagtaagtacttccttaacagctaanatttcttgatgtggtactacctttagcaaaaagca

SEQ ID NO: 8229 - DNA, 71 bp, chicken (Gallus Gallus)
  misc_feature (36): n=a or c
gcagagcagctaccatggctatggtgagttgactgncagagctagcaaaggaacagacatacctgtttaca

SEQ ID NO: 8230 - DNA, 71 bp, chicken (Gallus Gallus)
  misc_feature (36): n=a or c
aaacaaaaaagtaattttgcaagatcacaaaggacnaccaaccttcaagaatatagcactgaatttgtgaa

SEQ ID NO: 8231 - DNA, 71 bp, chicken (Gallus Gallus)
  misc_feature (36): n=c or t
attaacatcaactgttaggacactgattgcaggtangactgaattattatagggaaggtattgttacctcc

SEQ ID NO: 8232 - DNA, 71 bp, chicken (Gallus Gallus)
  misc_feature (36): n=c or g
aatattcttgttatatcgctgtattaaaaccaccantatgttttcatgtcagccagcgtgcaggaaagtgc

SEQ ID NO: 8233 - DNA, 71 bp, chicken (Gallus Gallus)
  misc_feature (36): n=a or t
tttggggggtttattgtgttcaatttgcctttttcnttgctatgtcctgtgcttcagtcaaacaaaatttc

SEQ ID NO: 8234 - DNA, 71 bp, chicken (Gallus Gallus)
  misc_feature (36): n=g or t
gttcaatccaaaattctgtgccactcatatcatttntgtgttatgcagaaactgaatctataactatttaa

SEQ ID NO: 8235 - DNA, 71 bp, chicken (Gallus Gallus)
  misc_feature (36): n=g or t
gtcgtgcaagctgaagactttctgcgtggggccggnggactgctgctttgggtcctttgtagtaacaacct

SEQ ID NO: 8236 - DNA, 71 bp, chicken (Gallus Gallus)
  misc_feature (36): n=g or t
ttcagaattaatgaaaagtctgataaagcattcatnggtgacctgttaattttgcattactcagtgggaag

SEQ ID NO: 8237 - DNA, 71 bp, chicken (Gallus Gallus)
  misc_feature (36): n=a or g
aaagaaaccacaagcacagagttgttaattaagccntacacagctacgcaggcaatgtttcacactgctgt

SEQ ID NO: 8238 - DNA, 71 bp, chicken (Gallus Gallus)
  misc_feature (36): n=a or g
ggcaaaaattcattatatagacaccagagtaatgcnaaggtgaatgaggcttcctgatgtactttgttttt

SEQ ID NO: 8239 - DNA, 71 bp, chicken (Gallus Gallus)
  misc_feature (36): n=c or t
ttttcagcacattttacaattgattgtgattttccnggagataaaaagattcaacttaacaaaaaatattt

SEQ ID NO: 8240 - DNA, 71 bp, chicken (Gallus Gallus)
  misc_feature (36): n=c or t
ccaaaatattttcttctggcttctttaaaaataaanaccatatctttttattaactttgattcctcttcct

SEQ ID NO: 8241 - DNA, 71 bp, chicken (Gallus Gallus)
  misc_feature (36): n=c or t
gtacagtgacagtaacaagataaattaaattacaanggaaattaatacagcaatagcaaacgtacttcaga

SEQ ID NO: 8242 - DNA, 71 bp, chicken (Gallus Gallus)
  misc_feature (36): n=g or t
ccattaaagttcaaagaacttagtcattccacttanacagtttcacagataaaaattagggtaggtgaagc

SEQ ID NO: 8243 - DNA, 71 bp, chicken (Gallus Gallus)
  misc_feature (36): n=a or t
ccaagcctcactgtctggtcttctagtgcaagtganatcttcaatggtctcacttaggaaaagagaagtag

SEQ ID NO: 8244 - DNA, 71 bp, chicken (Gallus Gallus)
  misc_feature (36): n=c or t
gttttgtctgtcagttctgggttagcgacgatccantcatcagctagtttaggaaaagaggacgaatcaaa

SEQ ID NO: 8245 - DNA, 71 bp, chicken (Gallus Gallus)
  misc_feature (36): n=c or t
cctaaaggaacaaaagactttgaaggcatacttggnttggaagtgcctattgcattaacagcaaatacacg

SEQ ID NO: 8246 - DNA, 71 bp, chicken (Gallus Gallus)
  misc_feature (36): n=a or g
gcagtggcgattcatagtaacaaattcatttattcntgcgtaattactgactgctaggcatttggaaatgt

SEQ ID NO: 8247 - DNA, 71 bp, chicken (Gallus Gallus)
  misc_feature (36): n=c or t
catccaaaaatccaggttatataacatgagagatanctaaaaacattgggtcaagatcctcatatagtcat

SEQ ID NO: 8248 - DNA, 71 bp, chicken (Gallus Gallus)
  misc_feature (36): n=a or g
aaaagtaggacactagaagaattgacagcaccatcnaaacctaactagctgtttgcctgatcacccagctt

SEQ ID NO: 8249 - DNA, 71 bp, chicken (Gallus Gallus)
  misc_feature (36): n=c or t
accagaccatccaggcaaccgctcagagaaagttanatgccagtgagggattagcacagattcttctcaag

SEQ ID NO: 8250 - DNA, 71 bp, chicken (Gallus Gallus)
  misc_feature (36): n=c or t
aggtccatccattttcctttaaaccacttaacattnggctttcggagaagatctttggcttctactttggc

SEQ ID NO: 8251 - DNA, 71 bp, chicken (Gallus Gallus)
  misc_feature (36): n=a or g
cagtgctgtaagcctgatcacagcacctatcacagnataaaaaggaaaatgtatagtaaagtccaatagac

SEQ ID NO: 8252 - DNA, 71 bp, chicken (Gallus Gallus)
  misc_feature (36): n=c or t
ttacgaattgattataaaaattaatgacacctaagngtctgtgaccaccatctgaaattacgaaacaaaga

SEQ ID NO: 8253 - DNA, 71 bp, chicken (Gallus Gallus)
  misc_feature (36): n=c or t
aggctttatgtacttgccatatatcgctttttcttnattgccactaaagcagtattttccctgtctatcac

SEQ ID NO: 8254 - DNA, 71 bp, chicken (Gallus Gallus)
  misc_feature (36): n=a or g
gacttaaaataagttgttccctcgccttcaaagcangatgtactgctgtgccagcatgttccctaacatgc

SEQ ID NO: 8255 - DNA, 71 bp, chicken (Gallus Gallus)
  misc_feature (36): n=c or t
ttcaccagctaggtggctggccagcatttctgctcngatcaggaccgctctccttctgcaagctgataccc

SEQ ID NO: 8256 - DNA, 71 bp, chicken (Gallus Gallus)
  misc_feature (36): n=a or g
ttgatatggagagttcacgttttcttttcacgtcantgcaagtcggttcttggtttcaggagaaccttaag

SEQ ID NO: 8257 - DNA, 71 bp, chicken (Gallus Gallus)
  misc_feature (36): n=c or t
gtcttgcacagggctggggtgacaagcaggctctgnagcaggtctttgtgagttgatgtggtgttggtagt

SEQ ID NO: 8258 - DNA, 71 bp, chicken (Gallus Gallus)
  misc_feature (36): n=a or g
cgtgcagaagaactctaagcaggatccattttccanagtgattaggttctttcttttgtgcagctgtttga

SEQ ID NO: 8259 - DNA, 71 bp, chicken (Gallus Gallus)
  misc_feature (36): n=a or t
ataaaaccaccaaagcatcctgctctaggaaatgtntaggtctttatacgagaatatgttgtgtataaaca

SEQ ID NO: 8260 - DNA, 71 bp, chicken (Gallus Gallus)
  misc_feature (36): n=a or t
atgaggtgcagaagggaagtatgagtatttgctgtncaggtgaaaatgtcaatgaaaaatttcaggggagt

SEQ ID NO: 8261 - DNA, 71 bp, chicken (Gallus Gallus)
  misc_feature (36): n=c or t
ttttcttacatactgtactgtatttccatcttgatntatccttgcagacacattgagtgtacatgcagaga

SEQ ID NO: 8262 - DNA, 71 bp, chicken (Gallus Gallus)
  misc_feature (36): n=a or c
tccattgcacacgtgcttgttccttagttgaaattncctattttttttctgaggagggctggaggtagtgt

SEQ ID NO: 8263 - DNA, 71 bp, chicken (Gallus Gallus)
  misc_feature (36): n=a or g
aacttaggtgctattaaaggaattattagcgatacngtgagtgattctactcaactgactggttcctcttt

SEQ ID NO: 8264 - DNA, 71 bp, chicken (Gallus Gallus)
  misc_feature (36): n=a or g
gaacagtgtgggaaatagtttaaataaagtgacagnttttcaggcatacttagctaaccaggaacgtcaac

SEQ ID NO: 8265 - DNA, 71 bp, chicken (Gallus Gallus)
  misc_feature (36): n=c or t
atctacccatagctcatacggcaaagattaataggntgctttctttatgtacattaaaaccttttcccttt

SEQ ID NO: 8266 - DNA, 71 bp, chicken (Gallus Gallus)
  misc_feature (36): n=a or g
tgagatggctctgtatacaggctgtgaaaaagaagnaggagcaagtcaattcacaacacttctcaccaaat

SEQ ID NO: 8267 - DNA, 71 bp, chicken (Gallus Gallus)
  misc_feature (36): n=c or t
aatactgaaaacaaggcatccaggcagcttcctaanccaacatcagacttggctaaaagagacccaatgtt

SEQ ID NO: 8268 - DNA, 71 bp, chicken (Gallus Gallus)
  misc_feature (36): n=c or t
tttattgcaatgtgcttagaaactatcagacagatngacaaatttgacattgaatttctggaggtccaagg

SEQ ID NO: 8269 - DNA, 71 bp, chicken (Gallus Gallus)
  misc_feature (36): n=a or g
ttggatattaagaagaagttattctcagcaagagcngggctgcagtggcacaggctgcccagggaggtggt

SEQ ID NO: 8270 - DNA, 71 bp, chicken (Gallus Gallus)
  misc_feature (36): n=a or g
aatctttgttggataggttacaacaaagttgaaacnccattttagcgtgacacgattctgcaggagctcag

SEQ ID NO: 8271 - DNA, 71 bp, chicken (Gallus Gallus)
  misc_feature (36): n=c or t
attttaggatatccttaattcctggtaattaaacangttaagtcctagcaataagagtaaaatcttacctg

SEQ ID NO: 8272 - DNA, 71 bp, chicken (Gallus Gallus)
  misc_feature (36): n=c or t
gcaatgcagccagccaggcaggtcagcaaatccaantgaggtaaggtgtgatggaggaatgaaacagaaga

SEQ ID NO: 8273 - DNA, 71 bp, chicken (Gallus Gallus)
  misc_feature (36): n=g or t
tcatatcttaaaaccaaaggcagtacatcaaataangcaaaaatatacgtataagataaataatattatac

SEQ ID NO: 8274 - DNA, 71 bp, chicken (Gallus Gallus)
  misc_feature (36): n=a or g
acaatgaatctctaacaaatcattttttggaatagntagttttagcagttgaagattgcctaacatatgta

SEQ ID NO: 8275 - DNA, 71 bp, chicken (Gallus Gallus)
  misc_feature (36): n=c or t
ccacttgagactcattcccagggagctccttctgancttcattcatgtttttcacttagtaaattgtgtgg

SEQ ID NO: 8276 - DNA, 71 bp, chicken (Gallus Gallus)
  misc_feature (36): n=c or t
ttgaatagggttttattatggacttatctctgatangttgtaagagtaagcattaacgttcggacatttgc

SEQ ID NO: 8277 - DNA, 71 bp, chicken (Gallus Gallus)
  misc_feature (36): n=a or g
ctggaaactttaaattagtttgcttgcaggacactnaaggaagtttcttttcaaaaggcgtactatcggtg

SEQ ID NO: 8278 - DNA, 71 bp, chicken (Gallus Gallus)
  misc_feature (36): n=c or t
ctgcccgcttagtaagtgaacccaaggtctcaaatnagaaaacatctcttccatggatggtttgtcttcga

SEQ ID NO: 8279 - DNA, 71 bp, chicken (Gallus Gallus)
  misc_feature (36): n=c or t
taaaaagagtgcttacattggaatatacatctacanttgttatttaggtatttaaacagaaattgcttttg

SEQ ID NO: 8280 - DNA, 71 bp, chicken (Gallus Gallus)
  misc_feature (36): n=c or t
gagacattcattgaagccccattcctccctctagcncactcatcttcatatttctcacttctttggcctca

SEQ ID NO: 8281 - DNA, 71 bp, chicken (Gallus Gallus)
  misc_feature (36): n=c or t
ctgcaacactgccaaaggtgatagacagcaattgtngagcagtatgcaggcaacactaacacagcaatgct

SEQ ID NO: 8282 - DNA, 71 bp, chicken (Gallus Gallus)
  misc_feature (36): n=a or g
acggtgatcaaaatgtgtaccaagcctacctaagcntagtcgtgtctttaaattctgtactgtatttcatg

SEQ ID NO: 8283 - DNA, 71 bp, chicken (Gallus Gallus)
  misc_feature (36): n=c or t
gatatgatactgagtgtatctgaacagtatctggcntagtgcagcacaggtcagcagcacagcagtgcagg

SEQ ID NO: 8284 - DNA, 71 bp, chicken (Gallus Gallus)
  misc_feature (36): n=a or g
gctgaagtgtgccgggggagggatggatctgaatgntagctgctgagtgcgggaactaagaatgctgtttc

SEQ ID NO: 8285 - DNA, 71 bp, chicken (Gallus Gallus)
  misc_feature (36): n=a or g
tagtactgctgcgtgctgtacgatgtcttttaacanagtattcttctttgttcctaaacatatccatcaca

SEQ ID NO: 8286 - DNA, 71 bp, chicken (Gallus Gallus)
  misc_feature (36): n=a or g
gcggaggagctaataatgctcagctaagaaaatccnaagggaaaaggcaatggtggcaagtctaaatgcta

SEQ ID NO: 8287 - DNA, 71 bp, chicken (Gallus Gallus)
  misc_feature (36): n=a or t
cagtttcttctgtagtctcctgatacttgaaatganaacaagaagagcttcagagtctttggatattgctg

SEQ ID NO: 8288 - DNA, 71 bp, chicken (Gallus Gallus)
  misc_feature (36): n=c or t
gatgtgaaatgatgacaagtatttgtatttcacttncatttttttttctgcttgattattttggttcctca

SEQ ID NO: 8289 - DNA, 71 bp, chicken (Gallus Gallus)
  misc_feature (36): n=a or g
ttggctcgtctttccttcctatctgctgaatctggnaaacacaagcctaattctcccctctgcactatgat

SEQ ID NO: 8290 - DNA, 71 bp, chicken (Gallus Gallus)
  misc_feature (36): n=a or g
acctttgccataactaaaaccattctgcagcagccntgcagagaggcactgggtatggactgagcaaatga

SEQ ID NO: 8291 - DNA, 71 bp, chicken (Gallus Gallus)
  misc_feature (36): n=c or t
ttccatcgtgctttggctactagaccaccaaacagngtgtggcaaagcattcctaatgctcatgtgtatgg

SEQ ID NO: 8292 - DNA, 71 bp, chicken (Gallus Gallus)
  misc_feature (36): n=a or c
ccttgtctggtacggttgactgctcagtttggtttnaggcgtgcctgacaaagtaccttgttccagagttc

SEQ ID NO: 8293 - DNA, 71 bp, chicken (Gallus Gallus)
  misc_feature (36): n=c or t
agcttagatttccatatactccaagttaaaatgacngtgttcagcccaggcttcctttaagagaaaaatat

SEQ ID NO: 8294 - DNA, 71 bp, chicken (Gallus Gallus)
  misc_feature (36): n=a or g
acaaggttaaaattaaatggggacacctgaccatgntatttttaattagaagacttctgggttcaaactat

SEQ ID NO: 8295 - DNA, 71 bp, chicken (Gallus Gallus)
  misc_feature (36): n=c or t
ttttgtcctcaactgtttgcctgttgttcttacacncagggaatgtgaatgttcagaacctgagatgctgc

SEQ ID NO: 8296 - DNA, 71 bp, chicken (Gallus Gallus)
  misc_feature (36): n=c or t
attagttgttgtttgattaggaagatctcctattangaagacaaaagcattaactggaattaagtgccaat

SEQ ID NO: 8297 - DNA, 71 bp, chicken (Gallus Gallus)
  misc_feature (36): n=c or t
gcatccccactcacttaaaatatctgtcagcccaancagtcccatcctattctgcaatatttaaggggcaa

SEQ ID NO: 8298 - DNA, 71 bp, chicken (Gallus Gallus)
  misc_feature (36): n=a or g
aacattccaccagtatttcttgatgtcttcttaccntgtaacagatggcagcaggggggcagtctgatgga

SEQ ID NO: 8299 - DNA, 71 bp, chicken (Gallus Gallus)
  misc_feature (36): n=g or t
gttatttcaaaccttgtacttccttcactttcagtnttgcttgaagagaagaaaaacaatatatgaatatt

SEQ ID NO: 8300 - DNA, 71 bp, chicken (Gallus Gallus)
  misc_feature (36): n=a or g
agtgagaaattgtactttatagtgtttttgcagtangcagttatttagctcagtcaactactgaaaaagtc

SEQ ID NO: 8301 - DNA, 71 bp, chicken (Gallus Gallus)
  misc_feature (36): n=g or t
cttctgtatgcgctccagattgggattacagtgcanaaactttcaagtttgtacacctgctccctcaacgg

SEQ ID NO: 8302 - DNA, 71 bp, chicken (Gallus Gallus)
  misc_feature (36): n=c or t
ataatctttttgcaaacaatctgtcttctttgaccntgtagtatctgggggtgttgcttgtttttgcttga

SEQ ID NO: 8303 - DNA, 71 bp, chicken (Gallus Gallus)
  misc_feature (36): n=a or c
gtcagggtgtctggttccctcctgagcactgagatnaggttgtgtctgatctgtggggctattcccagcct

SEQ ID NO: 8304 - DNA, 71 bp, chicken (Gallus Gallus)
  misc_feature (36): n=c or g
tgattcactagccaaaagatcttaagcattcttaangcttacattgcatttctaggtgtgtctttaaaaat

SEQ ID NO: 8305 - DNA, 71 bp, chicken (Gallus Gallus)
  misc_feature (36): n=g or t
agcatttttcacttggctatagaacaatctacagtnaaagcaaagccaataaaaattgcacccctccaaga

SEQ ID NO: 8306 - DNA, 71 bp, chicken (Gallus Gallus)
  misc_feature (36): n=c or t
atgaaaatgagccttctgacaaacagctgaagtganttgaagtgagagacttaggaaaaataagtgtatcc

SEQ ID NO: 8307 - DNA, 71 bp, chicken (Gallus Gallus)
  misc_feature (36): n=a or g
ccaccaaaatccaagttattgttttgcatcatgacntctttcttcttaggtcaagcatccaccatttttga

SEQ ID NO: 8308 - DNA, 71 bp, chicken (Gallus Gallus)
  misc_feature (36): n=a or g
tgttctcttgcttttggaagacaagcaaaggaaagngaaaagaatttcaccaaggagagacgctttttctc

SEQ ID NO: 8309 - DNA, 71 bp, chicken (Gallus Gallus)
  misc_feature (36): n=c or t
atgaatcagactatctgattatatatatgattatangatagaaatggatactgctccaatagaacaaggtt

SEQ ID NO: 8310 - DNA, 71 bp, chicken (Gallus Gallus)
  misc_feature (36): n=c or g
tcataattcattttcaagttgcactcaggttaccanaaagcacagaaatgtgagcagaaagtaggacatgc

SEQ ID NO: 8311 - DNA, 71 bp, chicken (Gallus Gallus)
  misc_feature (36): n=a or g
aaagtttcagtgatgtaatgtaacatttgcattgtnaacatagccatgatgcttagtactgcacaaaaagt

SEQ ID NO: 8312 - DNA, 71 bp, chicken (Gallus Gallus)
  misc_feature (36): n=a or g
tttttttttagtataaaccaacagattttaaaaatngatacaaaaaaagacgcagcttattaagaggtatt

SEQ ID NO: 8313 - DNA, 71 bp, chicken (Gallus Gallus)
  misc_feature (36): n=a or g
actgcacatattgataaatgccagcataagtcaaantagcattttaaattgtggttatacttaacactgat

SEQ ID NO: 8314 - DNA, 71 bp, chicken (Gallus Gallus)
  misc_feature (36): n=a or c
gtttcaggatgactcagcaagctgtgatgatcccanatatctctgaagtactgatatcaagtcaatccctg

SEQ ID NO: 8315 - DNA, 71 bp, chicken (Gallus Gallus)
  misc_feature (36): n=a or t
ccacttggtcttctggttatgtatttccaaacagtntggtggagtaaggaaatcagaggtatcaaaaatat

SEQ ID NO: 8316 - DNA, 71 bp, chicken (Gallus Gallus)
  misc_feature (36): n=a or t
aagtggtgtttagtgtatattgaaatgagttgcacngcagctggcctgatagagatattcagaaataaaca

SEQ ID NO: 8317 - DNA, 71 bp, chicken (Gallus Gallus)
  misc_feature (36): n=a or g
atggagacagggcaaaaccacacctccatctgctcntgtatccagcccaggaaggaggtagttcggctgta

SEQ ID NO: 8318 - DNA, 71 bp, chicken (Gallus Gallus)
  misc_feature (36): n=c or t
atggtataggggtggactgcaagctatgaccttacncaccaaatttccagcctgttcaaaatgtaagaatt

SEQ ID NO: 8319 - DNA, 71 bp, chicken (Gallus Gallus)
  misc_feature (36): n=c or t
ggcagaccaatcttacagtgcttctttcactatcanacaccaggttcatttaaaggacaacctgcagccta

SEQ ID NO: 8320 - DNA, 71 bp, chicken (Gallus Gallus)
  misc_feature (36): n=a or g
gccagtcctctcacaaagtcagggttaaccatttanactctcaagaagtgcttgtgctgatgacttcagga

SEQ ID NO: 8321 - DNA, 71 bp, chicken (Gallus Gallus)
  misc_feature (36): n=c or t
attaaaaacagtagctgtaagcaggtatccactcanagaactgtcaaattgtttgagttggaaggaacttt

SEQ ID NO: 8322 - DNA, 71 bp, chicken (Gallus Gallus)
  misc_feature (36): n=c or t
cttcagagataaacgctgctagattgatttacaacncattagaccaccttgacctgagctattctgagatg

SEQ ID NO: 8323 - DNA, 71 bp, chicken (Gallus Gallus)
  misc_feature (36): n=c or t
tttatttggggaactgaagaagataaagtggagcanagattttcatgttggtagcagatttacattttgct

SEQ ID NO: 8324 - DNA, 71 bp, chicken (Gallus Gallus)
  misc_feature (36): n=a or g
tatatcattagttagtggaaaatgcttttcatagcngaactaaataacacaggtctgctttggaaacaaat

SEQ ID NO: 8325 - DNA, 71 bp, chicken (Gallus Gallus)
  misc_feature (36): n=a or g
caccccacatttgctcaagtgttctgccttttgtcnatgaaatgctaatcagggtacagggctgtatttgc

SEQ ID NO: 8326 - DNA, 71 bp, chicken (Gallus Gallus)
  misc_feature (36): n=c or t
ggacctgatgtattctttggttaaggtgcagcatcnctctggctctgctggacctgaccgtcagggcagtg

SEQ ID NO: 8327 - DNA, 71 bp, chicken (Gallus Gallus)
  misc_feature (36): n=a or g
agcccctcgaaggctatttcattcatttctactttntgttttctttctaataaggaaaataggagctcctg

SEQ ID NO: 8328 - DNA, 71 bp, chicken (Gallus Gallus)
  misc_feature (36): n=c or t
agtctgctggttatatgctgtataagtgctttgggnatataacagtagtcaattacctagcagttatgagt

SEQ ID NO: 8329 - DNA, 71 bp, chicken (Gallus Gallus)
  misc_feature (36): n=c or t
acgcaaacaataggaaaaaaaaaaacaaaaaccacngaatttccaaactgaaatcctgacatgtaaataac

SEQ ID NO: 8330 - DNA, 71 bp, chicken (Gallus Gallus)
  misc_feature (36): n=a or t
ggttagaactactccatagaagatactgaacacccnaagttcagacagagcttttggtagtgtattatgtg

SEQ ID NO: 8331 - DNA, 71 bp, chicken (Gallus Gallus)
  misc_feature (36): n=a or g
tcccatcactttttgagctcactgtcaacattcacntgtacctgatcatagaatcatacagtcatagaatc

SEQ ID NO: 8332 - DNA, 71 bp, chicken (Gallus Gallus)
  misc_feature (36): n=a or t
cttttaccttctgtactccaggttagtacaccaagntctgtatgtatttgctgaatgtgttgcgctggtca

SEQ ID NO: 8333 - DNA, 71 bp, chicken (Gallus Gallus)
  misc_feature (36): n=a or g
attatgttgctgtatcacccactgtccagtcccacntgcaagtacataacgacaacatctctgactacctg

SEQ ID NO: 8334 - DNA, 71 bp, chicken (Gallus Gallus)
  misc_feature (36): n=c or t
aaagctcttgccttgtgagggggactctaaattggnttgagaactcttctcaacccatgtatcccactttc

SEQ ID NO: 8335 - DNA, 71 bp, chicken (Gallus Gallus)
  misc_feature (36): n=c or g
ttcagcttcaaatgcactatgttttgacgtcttatnaacaactacacgaaaacaaaatcactccctccttt

SEQ ID NO: 8336 - DNA, 71 bp, chicken (Gallus Gallus)
  misc_feature (36): n=a or t
gttttcatatcaaaaaccatatgccaaaggagatcncaatttcagactaatgatagcagcactgctcaagt

SEQ ID NO: 8337 - DNA, 71 bp, chicken (Gallus Gallus)
  misc_feature (36): n=c or t
tttctacatccttttcagtccctgctgacaaggggntgaacccaatttttaacgtctacaagatgtacttg

SEQ ID NO: 8338 - DNA, 71 bp, chicken (Gallus Gallus)
  misc_feature (36): n=g or t
tcttttatctattgctgctgtttataatttccctgncttgcttatttgtattatttttttttttcttaaaa

SEQ ID NO: 8339 - DNA, 71 bp, chicken (Gallus Gallus)
  misc_feature (36): n=c or t
attttcagtcccacaaataatttctgtggggacatntatggttacactgttcctccccgataggatcttac

SEQ ID NO: 8340 - DNA, 71 bp, chicken (Gallus Gallus)
  misc_feature (36): n=a or g
ttttgccttttcccatcctacccagaaccagttctntagaggtactggagcaaaaccatcaaagctagtag

SEQ ID NO: 8341 - DNA, 71 bp, chicken (Gallus Gallus)
  misc_feature (36): n=c or t
aaataataagaatatatgctcgtgtacaacttaaantgcttgcatttctgttcagaaacgcacattttgcc

SEQ ID NO: 8342 - DNA, 71 bp, chicken (Gallus Gallus)
  misc_feature (36): n=g or t
tgtgttggatcttaatcttcagtaaaacaaaactgntccttcaaggctcataactgtagacaatgggcact

SEQ ID NO: 8343 - DNA, 71 bp, chicken (Gallus Gallus)
  misc_feature (36): n=a or g
gagtacagaacttgcttttagtggatcatataatcntacaaatgtgggtgttgcaattttcaaattcggtt

SEQ ID NO: 8344 - DNA, 71 bp, chicken (Gallus Gallus)
  misc_feature (36): n=a or g
tcgtgatgacaccctttgtctaccttgtacttctgntcagtatttaaaataatggtctgtgagcataactg

SEQ ID NO: 8345 - DNA, 71 bp, chicken (Gallus Gallus)
  misc_feature (36): n=a or g
cccaggtatcatctctgtcaagatgagtatactttnttgctttaattccctcctctgaggagcagcactaa

SEQ ID NO: 8346 - DNA, 71 bp, chicken (Gallus Gallus)
  misc_feature (36): n=c or t
tcctgtggcatttatgatgaatgatttgattgatangtttgctgtgtgttcttgtttatgcgtatgtttat

SEQ ID NO: 8347 - DNA, 71 bp, chicken (Gallus Gallus)
  misc_feature (36): n=c or t
ataccacgccaccctaaccagtggctgtaaaactgngtgcctgcttcacaaccacatctttctgagctttc

SEQ ID NO: 8348 - DNA, 71 bp, chicken (Gallus Gallus)
  misc_feature (36): n=a or t
atcagtagcaacaggacaaagtaggaatcagaagcnagcaggaatagtttcatcccttaggtctagtctct

SEQ ID NO: 8349 - DNA, 71 bp, chicken (Gallus Gallus)
  misc_feature (36): n=c or g
ttcagtcctagaacattctgcttagagattctgtanaagttcactagaacagggtcttggctttaacagag

SEQ ID NO: 8350 - DNA, 71 bp, chicken (Gallus Gallus)
  misc_feature (36): n=c or t
acaactacaaaaaaatcacaagagctcatgcactgngtttgcatgtttctctggtttatgtcttactgtat

SEQ ID NO: 8351 - DNA, 71 bp, chicken (Gallus Gallus)
  misc_feature (36): n=c or t
tgtatttttccttcagcatcacttgttatttgttcncttgcactttgcacagatctttgttttctttttca

SEQ ID NO: 8352 - DNA, 71 bp, chicken (Gallus Gallus)
  misc_feature (36): n=a or g
taagcaaactggtctgacctcacagctaaccctacntttagcaggaggttgacgagggacctcctgaggtg

SEQ ID NO: 8353 - DNA, 71 bp, chicken (Gallus Gallus)
  misc_feature (36): n=a or t
cttcttgccacaaatctgaaatgaccagtgtggctnaataggaaaggggaagagtggccctttctccaggc

SEQ ID NO: 8354 - DNA, 71 bp, chicken (Gallus Gallus)
  misc_feature (36): n=a or c
ttaatgattactttagttgcctttcctgggaggtanttgggttgaattatactgaatcatactgaatgctt

SEQ ID NO: 8355 - DNA, 71 bp, chicken (Gallus Gallus)
  misc_feature (36): n=a or c
taaactcacttgtggtactgtagaggagtacagctncccactaggactcatagtcaggttgcttaatgaac

SEQ ID NO: 8356 - DNA, 71 bp, chicken (Gallus Gallus)
  misc_feature (36): n=c or t
gtttcagcgtgttcacatatatcaaacaaactgaancttactctcaccaaaaaacaggaacattcgtgtaa

SEQ ID NO: 8357 - DNA, 71 bp, chicken (Gallus Gallus)
  misc_feature (36): n=a or t
ccccttcctggattctactgtaggtgcagttcctanatgaaagtggtgatgaagctgcttttttttttttt

SEQ ID NO: 8358 - DNA, 71 bp, chicken (Gallus Gallus)
  misc_feature (36): n=a or t
ttagaattaacaggacacagggcaatgatatagtcnagtcatgttctatgtcttatctacttaaattattt

SEQ ID NO: 8359 - DNA, 71 bp, chicken (Gallus Gallus)
  misc_feature (36): n=g or t
ggaggccagtcgtgactgctatgccctgggttccancctgggaccagagttcttccacatcaatgacctag

SEQ ID NO: 8360 - DNA, 71 bp, chicken (Gallus Gallus)
  misc_feature (36): n=c or g
agacaatccattggacaaagcatcagcatacctccntggagtggactccagtcagtgaggggtttgagcac

SEQ ID NO: 8361 - DNA, 71 bp, chicken (Gallus Gallus)
  misc_feature (36): n=a or g
taggaatgtacaatctaccatgggacaagggaatanactagttttgcaggatttctctcagcccagttttc

SEQ ID NO: 8362 - DNA, 71 bp, chicken (Gallus Gallus)
  misc_feature (36): n=a or t
tagcgtgtatgaccttaagcatcagttacacagagngggattgtgtttgtttctgttgccgtgcgtgccaa

SEQ ID NO: 8363 - DNA, 71 bp, chicken (Gallus Gallus)
  misc_feature (36): n=a or g
attaatactggcagtaacccctgcccttttctgtgnccacacctgtgatgtgcctgtttctgaatacctga

SEQ ID NO: 8364 - DNA, 71 bp, chicken (Gallus Gallus)
  misc_feature (36): n=c or t
gcaatgaagctgagaggaaatacggatggtggaggnggtcagctactaaagtttcaagccactgaaccagt

SEQ ID NO: 8365 - DNA, 71 bp, chicken (Gallus Gallus)
  misc_feature (36): n=a or g
acacaccggcttccaccgcggcaccgctcgtacccnacgcttctcgcttctacttcctcaacttaaccacg

SEQ ID NO: 8366 - DNA, 71 bp, chicken (Gallus Gallus)
  misc_feature (36): n=c or g
gatgatgggacagatggagccagtggaaaacaaatnttgaaagaatctcttaagatggctacttggcaccg

SEQ ID NO: 8367 - DNA, 71 bp, chicken (Gallus Gallus)
  misc_feature (36): n=g or t
gcagttgtagagatagcattatcaaatagctatctnaagctgtttcatggattcacttaatatgactcaaa

SEQ ID NO: 8368 - DNA, 71 bp, chicken (Gallus Gallus)
  misc_feature (36): n=c or t
ctctctgggcacaaaccagttccttatccaacaaanattccactcatcaaatttctatctttccaatttgg

SEQ ID NO: 8369 - DNA, 71 bp, chicken (Gallus Gallus)
  misc_feature (36): n=g or t
tctaagaacagcaagagcttgcacttccttccccanccacaccaacagcgtttaagtggagacaatacaaa

SEQ ID NO: 8370 - DNA, 71 bp, chicken (Gallus Gallus)
  misc_feature (36): n=a or g
tcattttcaaatctcaattttcaaatcaatttcaantcctgccacgttgtgctattggttcagcctatgtt

SEQ ID NO: 8371 - DNA, 71 bp, chicken (Gallus Gallus)
  misc_feature (36): n=a or g
tgactggggaagaaaactgtcagcaaacagttacanttcttttctctgctcagacctcagagaactcacat

SEQ ID NO: 8372 - DNA, 71 bp, chicken (Gallus Gallus)
  misc_feature (36): n=a or g
aagagatagagggcagcactttttatgaacacaagnacttctttatgatcactattctgtcagatttttct

SEQ ID NO: 8373 - DNA, 71 bp, chicken (Gallus Gallus)
  misc_feature (36): n=g or t
gcatgctgtgcttataaaaatctgttgcagcggagnaggtgcagtgttgttttgtcagtgctgaaactcat

SEQ ID NO: 8374 - DNA, 71 bp, chicken (Gallus Gallus)
  misc_feature (36): n=c or t
ggttttcctgctcagtgtttaaattacaacttagcnccagtgaacaaccttaacagctccaggacataaat

SEQ ID NO: 8375 - DNA, 71 bp, chicken (Gallus Gallus)
  misc_feature (36): n=c or t
caagtggagggtgttgttctcatggaaagatatttntgtgctccttttcaagttttggcaattgactgtgt

SEQ ID NO: 8376 - DNA, 71 bp, chicken (Gallus Gallus)
  misc_feature (36): n=a or g
agtaaaatctgcagagaagtaaaatcccactggctnacaaagttactttccaagtgtgtggtagttaagtg

SEQ ID NO: 8377 - DNA, 71 bp, chicken (Gallus Gallus)
  misc_feature (36): n=a or g
atttttagaagggcaatgggagaaatagcaaaacantatttgccaatttgaaattatttaaaaaccagctc

SEQ ID NO: 8378 - DNA, 71 bp, chicken (Gallus Gallus)
  misc_feature (36): n=c or t
gttccgtaaagcttttaaggacactgcacatagcantttgagacctcacctccccattctgggcaaactga

SEQ ID NO: 8379 - DNA, 71 bp, chicken (Gallus Gallus)
  misc_feature (36): n=c or g
tcagttgtttagttctgcaacattttctccctgcantctgccttttaaatgggagttcattgggatccact

SEQ ID NO: 8380 - DNA, 71 bp, chicken (Gallus Gallus)
  misc_feature (36): n=c or t
ggaattgggatcaatgtttgaaccaaaagaccaggnacctaggtcatctgtttaaaagactgaagccagaa

SEQ ID NO: 8381 - DNA, 71 bp, chicken (Gallus Gallus)
  misc_feature (36): n=c or t
tactttttttgacaaaattttatgaaaaatacgaangtagctgcaccttcacagctatataatgatggttt

SEQ ID NO: 8382 - DNA, 71 bp, chicken (Gallus Gallus)
  misc_feature (36): n=c or t
ctgggattaatgatacatgctggagtgagtagaagntgactgcctcctggcagtttagctttgaaattact

SEQ ID NO: 8383 - DNA, 71 bp, chicken (Gallus Gallus)
  misc_feature (36): n=g or t
ttagtgagagagaggaaaagccacatggtacaaaancttcagtattttgtaattacttcagaactggatta

SEQ ID NO: 8384 - DNA, 71 bp, chicken (Gallus Gallus)
  misc_feature (36): n=a or g
cccttatctacaagcatttgctgtaaaccagaactntgcattggcaggaattctttgtatgaggaagcatg

SEQ ID NO: 8385 - DNA, 71 bp, chicken (Gallus Gallus)
  misc_feature (36): n=a or g
gtttgcaaatgagaccaagctgtgtggtgtggtcantacacccaaaggatgggatgacatttagagaagcc

SEQ ID NO: 8386 - DNA, 71 bp, chicken (Gallus Gallus)
  misc_feature (36): n=c or t
gtttcaaggctgaacgtcaatgcattgcctgatgangtttatggagaaaaaatgtctcctcagccaatccc

SEQ ID NO: 8387 - DNA, 71 bp, chicken (Gallus Gallus)
  misc_feature (36): n=a or t
aatgccctgaaggctgctggttgtaatataccagtngcttcaggtaagtgttttgttaaaataatcaatta

SEQ ID NO: 8388 - DNA, 71 bp, chicken (Gallus Gallus)
  misc_feature (36): n=a or g
tgagcttaatgaatataggcactttgtatcgaattncttgtatagcctcaaatctgcatgttacagagcaa

SEQ ID NO: 8389 - DNA, 71 bp, chicken (Gallus Gallus)
  misc_feature (36): n=c or t
tgtgtatatcctgcaagagtcaccgatgctgttaangccctgaaggctgctggttgtaatataccagttgc

SEQ ID NO: 8390 - DNA, 71 bp, chicken (Gallus Gallus)
  misc_feature (36): n=c or g
caaagggtgacactggaagaagaaagagtacatcanaactatgagaggagttgtgcatctctgcaagaaga

SEQ ID NO: 8391 - DNA, 71 bp, chicken (Gallus Gallus)
  misc_feature (36): n=a or g
ttaccctgaaggacaaaataaagcacttgtgcacancagatagtcaaaagtgtcataaaggtcatatagaa

SEQ ID NO: 8392 - DNA, 71 bp, chicken (Gallus Gallus)
  misc_feature (36): n=a or t
ctagtagtttgttggaagacattgagaaacaggttngttgctaatagttttcagatttttagagagaaaca

SEQ ID NO: 8393 - DNA, 71 bp, chicken (Gallus Gallus)
  misc_feature (36): n=c or t
agcattgtaacctgagaaaatgaaacttggttattnctttctgttataaaatcttggtagcaaaaaacctt

SEQ ID NO: 8394 - DNA, 71 bp, chicken (Gallus Gallus)
  misc_feature (36): n=a or g
tcatagataaataatttttaattttagcatctctcngataaggcgatatctagtttctcactgtgtgtact

SEQ ID NO: 8395 - DNA, 71 bp, chicken (Gallus Gallus)
  misc_feature (36): n=c or t
atcttgctctaatcacatctgtcccttacaagagantggctgtgggtacaagctctgcccaggtatagcag

SEQ ID NO: 8396 - DNA, 71 bp, chicken (Gallus Gallus)
  misc_feature (36): n=c or t
gctcttcttcattgctggtgagaatgcacagctagnggtggttgaaaaattctgttttgtagctgacagtt

SEQ ID NO: 8397 - DNA, 71 bp, chicken (Gallus Gallus)
  misc_feature (36): n=g or t
ccccagcccagtagaggtttgtcttgggcagttggntatgcagttaccatctcaatggcatacaaagtgct

SEQ ID NO: 8398 - DNA, 71 bp, chicken (Gallus Gallus)
  misc_feature (36): n=c or t
tcattgggaaagatttctgctcacacaactcttganggactccttttagatcaaaatatgtcaactgcaca

SEQ ID NO: 8399 - DNA, 71 bp, chicken (Gallus Gallus)
  misc_feature (36): n=a or c
tctgggagcaggcgtgtgctggctagccaagcagcntaaatatagctcttgtgatgcctcttccctattca

SEQ ID NO: 8400 - DNA, 71 bp, chicken (Gallus Gallus)
  misc_feature (36): n=a or g
ttgcaatagatattataacgtgccagcgtgaatgtntataggtcttggttcatacagacatcaaatgaaag

SEQ ID NO: 8401 - DNA, 71 bp, chicken (Gallus Gallus)
  misc_feature (36): n=a or t
aacaatcaatagggaaaatcaacaaaaatcaggaanagacgagaacatataaagaattcttcttattgggt

SEQ ID NO: 8402 - DNA, 71 bp, chicken (Gallus Gallus)
  misc_feature (36): n=c or g
cctctggtgctgaatacaaattctatttaatatctnttcttttttagtaatatgtggagaaagcttagtgt

SEQ ID NO: 8403 - DNA, 71 bp, chicken (Gallus Gallus)
  misc_feature (36): n=a or t
agagtaagaaagactgagccaatgcttggccatcantttgtagcttatacctttatatgaaaacattattt

SEQ ID NO: 8404 - DNA, 71 bp, chicken (Gallus Gallus)
  misc_feature (36): n=c or g
atctcatttttgcttttttagaaattcatggccagnaacagccctattttttttctatgactacatgcgaa

SEQ ID NO: 8405 - DNA, 71 bp, chicken (Gallus Gallus)
  misc_feature (36): n=a or c
cagtggtaaagtgtattgaccgaggaaatcatttgnaaccagagagatctcatcttgtacgcagaagcgta

SEQ ID NO: 8406 - DNA, 71 bp, chicken (Gallus Gallus)
  misc_feature (36): n=g or t
cgatttcatgtgctaatttctgagaaaagaaaagcnaagctgcctggctcccccttctccccctcctttcc

SEQ ID NO: 8407 - DNA, 71 bp, chicken (Gallus Gallus)
  misc_feature (36): n=c or t
tcagaagtgttgctatctagaccgtctggaaaaaanatactatggcaattgtatatacccactgttatttt

SEQ ID NO: 8408 - DNA, 71 bp, chicken (Gallus Gallus)
  misc_feature (36): n=a or g
tgtctgaaaattacatcatgcagatgtgcatctatngctgtacatatataatcgtatttgttaacactacc

SEQ ID NO: 8409 - DNA, 71 bp, chicken (Gallus Gallus)
  misc_feature (36): n=a or g
ttctatattggtataaatgtcaatacataatcttantgacaacgtttgtccaagtgctggagatcttactt

SEQ ID NO: 8410 - DNA, 71 bp, chicken (Gallus Gallus)
  misc_feature (36): n=a or g
tgtctaagaatttcccattttgcagttccattggtnttcctgatgtctggaagtttaaggccactgtaaaa

SEQ ID NO: 8411 - DNA, 71 bp, chicken (Gallus Gallus)
  misc_feature (36): n=g or t
gcaataatttatgttcctttatcaaagttacgtagnctgccaaatgtgtgctacagattatgggacaaact

SEQ ID NO: 8412 - DNA, 71 bp, chicken (Gallus Gallus)
  misc_feature (36): n=c or t
ccaattctgactgcaaaataaccttatttttgtcancgtagttggatgctttagcaataagtaatcagaca

SEQ ID NO: 8413 - DNA, 71 bp, chicken (Gallus Gallus)
  misc_feature (36): n=c or t
tatggtaatgtgtagcaagctgttgtcctgcaaganaatttggtttaccaagagttggtactatattacat

SEQ ID NO: 8414 - DNA, 71 bp, chicken (Gallus Gallus)
  misc_feature (36): n=c or t
agctatagtgtagctgcaactcttatcacatggtanagtcagaacttcattagagttggagatcctattgt

SEQ ID NO: 8415 - DNA, 71 bp, chicken (Gallus Gallus)
  misc_feature (36): n=c or t
ggtatgtgtaaacttggaagagaatatgtttttcanggtggagaatagatactgttgtagatggagaagaa

SEQ ID NO: 8416 - DNA, 71 bp, chicken (Gallus Gallus)
  misc_feature (36): n=c or g
gcagcaccacagaattttcagactctcataaggcantgaaacaatgtctttttctttttttaatcttgtaa

SEQ ID NO: 8417 - DNA, 71 bp, chicken (Gallus Gallus)
  misc_feature (36): n=a or g
tttgttctcaatacatgaaaaacgtgaataaaactngacgtggattttatgaagataaggagatcttgttt

SEQ ID NO: 8418 - DNA, 71 bp, chicken (Gallus Gallus)
  misc_feature (36): n=a or g
ttaagattgatggtgttaatccttagtggttggccnaattccagtttctcttattctgttcttctaaacta

SEQ ID NO: 8419 - DNA, 71 bp, chicken (Gallus Gallus)
  misc_feature (36): n=c or t
tttttctgatgttctctattaactcatgtgctgagntagtatcaggaaactacaggaaaacgtgaacttct

SEQ ID NO: 8420 - DNA, 71 bp, chicken (Gallus Gallus)
  misc_feature (36): n=c or t
ataattgattctgtaccaacactgccagcaaagaanccatttgactctcaaatacgcagctcttaagacaa

SEQ ID NO: 8421 - DNA, 71 bp, chicken (Gallus Gallus)
  misc_feature (36): n=a or c
gccagtctgtagctgctagagctactagttctgtanatgtcttttactagacaagaagcagctcacctgtg

SEQ ID NO: 8422 - DNA, 71 bp, chicken (Gallus Gallus)
  misc_feature (36): n=c or t
gactacatagaaaggagcagaacaaactcacttcanttctaatcttgaagatacattcccaagagtttcag

SEQ ID NO: 8423 - DNA, 71 bp, chicken (Gallus Gallus)
  misc_feature (36): n=a or c
tctgtgggggcaaggtaccagctgcccttgcaatgntgtgtgtcacaagcagagtaagtttccatttattt

SEQ ID NO: 8424 - DNA, 71 bp, chicken (Gallus Gallus)
  misc_feature (36): n=a or c
ttggcaatgctcccgaaaccagagcactgcaactantgcgtgtattttcaacctatgctcagagggttaga

SEQ ID NO: 8425 - DNA, 71 bp, chicken (Gallus Gallus)
  misc_feature (36): n=a or g
tttcctaggaaaatgtgtttcactgaactggtgagnaaactgagggattcagtatttgtttagaactgggt

SEQ ID NO: 8426 - DNA, 71 bp, chicken (Gallus Gallus)
  misc_feature (36): n=c or g
gatgtaattgagaacaagttgtgcctggagatcctnaactctttgcatatcactttttacattgagacctg

SEQ ID NO: 8427 - DNA, 71 bp, chicken (Gallus Gallus)
  misc_feature (36): n=a or g
tattaatgtccgtttaggccgtttcaagagttgggntagtacggtcaggttgcgcttggacttgatgatct

SEQ ID NO: 8428 - DNA, 71 bp, chicken (Gallus Gallus)
  misc_feature (36): n=a or g
actagttcaggcaaggtcctctaccagtaagagtcntatcagacctgtgcacacctcagcactgggcaatt

SEQ ID NO: 8429 - DNA, 71 bp, chicken (Gallus Gallus)
  misc_feature (36): n=a or c
gtagagtgagcatcacatttagatatggtatcaagnatctaacctgcatctcagtgccaggacatctcttg

SEQ ID NO: 8430 - DNA, 71 bp, chicken (Gallus Gallus)
  misc_feature (36): n=c or t
aacactgcagtttactacacctatagaatcttttgngtcttcagcccttctcaggcttctgtaagaaatta

SEQ ID NO: 8431 - DNA, 71 bp, chicken (Gallus Gallus)
  misc_feature (36): n=a or g
aaggaagggtttctgagtgttgatcttgaactgtantgaagagaagaaaccaaaaggtttttttctgggac

SEQ ID NO: 8432 - DNA, 71 bp, chicken (Gallus Gallus)
  misc_feature (36): n=c or t
atgtgtgtttaaaaacgctgcatggcagtcacagangtcttgtgctgcattttcatgttatatactacaag

SEQ ID NO: 8433 - DNA, 71 bp, chicken (Gallus Gallus)
  misc_feature (36): n=c or t
cagctgagcttttctaactcaagtgtaatttgttanagtaactagaagacacgcagttatggaaaaagcca

SEQ ID NO: 8434 - DNA, 71 bp, chicken (Gallus Gallus)
  misc_feature (36): n=a or g
ataaattcaagtaatctataaggacagctctcttcnttatttcttcaacatcattttctctacagtgtgta

SEQ ID NO: 8435 - DNA, 71 bp, chicken (Gallus Gallus)
  misc_feature (36): n=a or g
tgctcctgtgactgctgaagagatcactagcaatantattatttttcttgtcacatggctgctttctgttt

SEQ ID NO: 8436 - DNA, 71 bp, chicken (Gallus Gallus)
  misc_feature (36): n=g or t
acagagaatatttatagtgagctttccatgtgaagncttggggctcctgatctatcatatatatatatata

SEQ ID NO: 8437 - DNA, 71 bp, chicken (Gallus Gallus)
  misc_feature (36): n=c or t
tcctgtggaagccccagatgatcaagtcctgtagtnttccattgtttgccctcgtaaatctcaaacttgag

SEQ ID NO: 8438 - DNA, 71 bp, chicken (Gallus Gallus)
  misc_feature (36): n=c or t
caacagagactttgcctataccatgcttctgccatnatgtgccttcactttcaggtgctctgacatttttg

SEQ ID NO: 8439 - DNA, 71 bp, chicken (Gallus Gallus)
  misc_feature (36): n=a or t
acatttatttgtgcttggaggcctgtggtgcaaacnattaggtgccttgtatttccttaagaaaagaaaga

SEQ ID NO: 8440 - DNA, 71 bp, chicken (Gallus Gallus)
  misc_feature (36): n=a or g
aatgtaagcaacaataaagtggccttatgtgcattncgagtgggattggttcacaattgttaaataccaac

SEQ ID NO: 8441 - DNA, 71 bp, chicken (Gallus Gallus)
  misc_feature (36): n=a or c
aaaaaacaaaaacaaaaacacgctacaaaaggatcntctgattaaaacatctgagaagaattagagtgaat

SEQ ID NO: 8442 - DNA, 71 bp, chicken (Gallus Gallus)
  misc_feature (36): n=c or t
agtagtatgcaccttcataaactgaaagtcctgatnggatttgctcctttaaaaggtgatggccctacttt

SEQ ID NO: 8443 - DNA, 71 bp, chicken (Gallus Gallus)
  misc_feature (36): n=a or g
tgaaaattgaatacgttctagtattagtgtttagtnggttaactgcatagatccttctccactttgttcat

SEQ ID NO: 8444 - DNA, 71 bp, chicken (Gallus Gallus)
  misc_feature (36): n=a or c
gaacagtgaaccccagggtgtgacatgggcagggancactcttactgagaaggacagctgtattctgggga

SEQ ID NO: 8445 - DNA, 71 bp, chicken (Gallus Gallus)
  misc_feature (36): n=a or g
attggtcaaaacacatttgaacattccagtactgcntttaggacaggggtgtcaacacaagaaagatgtag

SEQ ID NO: 8446 - DNA, 71 bp, chicken (Gallus Gallus)
  misc_feature (36): n=a or c
ttttatttccctgcaacaggaagaatttggggaagnaaaggtgatgagcggctcagatattaaacctgcgg

SEQ ID NO: 8447 - DNA, 71 bp, chicken (Gallus Gallus)
  misc_feature (36): n=a or t
catgtagttacgagagtacagcacagccagaattgngcagcttttctggagaagccagcagtgtttaaaaa

SEQ ID NO: 8448 - DNA, 71 bp, chicken (Gallus Gallus)
  misc_feature (36): n=a or g
tacatgtacatatgtacctaaacaacaatttaagcnttgaaggttatcagatacactatgttagtcctgaa

SEQ ID NO: 8449 - DNA, 71 bp, chicken (Gallus Gallus)
  misc_feature (36): n=a or g
ctgattcattatgtttcttacgtgtaaaatctatgngattttagagaaagcatgaaggagaaattctgttt

SEQ ID NO: 8450 - DNA, 71 bp, chicken (Gallus Gallus)
  misc_feature (36): n=a or g
cttttagcatgcaaactcaccactgcctggtcacgncgaatctcctccaaacttcaccttctcctgacgtt

SEQ ID NO: 8451 - DNA, 71 bp, chicken (Gallus Gallus)
  misc_feature (36): n=a or t
caatttcctttcctcattttttctatggagatcctnaatcgagtgcatcacagtcacacctgaactccgct

SEQ ID NO: 8452 - DNA, 71 bp, chicken (Gallus Gallus)
  misc_feature (36): n=c or g
cagaaagactgaggtacaccacctctagaacaccanctcatttgcagcttttcctggacttctgtttttcc

SEQ ID NO: 8453 - DNA, 71 bp, chicken (Gallus Gallus)
  misc_feature (36): n=c or g
atgagtcttttctcatctgactttcctcccattctnttgaggggaactgaaagagcagcacgggagagcaa

SEQ ID NO: 8454 - DNA, 71 bp, chicken (Gallus Gallus)
  misc_feature (36): n=c or g
taatttgctttgtgtaaaatgcttttgtttctgctnttcccagtgctttagtatttctcagcccttagcaa

SEQ ID NO: 8455 - DNA, 71 bp, chicken (Gallus Gallus)
  misc_feature (36): n=c or t
ggctgcaaacactcattgccagctcctgttgaatcnttcattaactgacacccccaaatccttcccctcag

SEQ ID NO: 8456 - DNA, 71 bp, chicken (Gallus Gallus)
  misc_feature (36): n=a or t
actgtttcctaaagaatttactacaaggacagaagnactaagaaggagcctagtgagaaagttactgaaat

SEQ ID NO: 8457 - DNA, 71 bp, chicken (Gallus Gallus)
  misc_feature (36): n=g or t
gcctaataaaacctccacagtattacaagagacccngagccttcagatgcgctctccagcattaattatct

SEQ ID NO: 8458 - DNA, 71 bp, chicken (Gallus Gallus)
  misc_feature (36): n=a or g
aattgatgcattaatgtcactctgataacgtttcangaaaacctgtgaggaataaaccctatgtttagcca

SEQ ID NO: 8459 - DNA, 71 bp, chicken (Gallus Gallus)
  misc_feature (36): n=g or t
ttgtctacaaaatgttgtttacaaaacattgtcagnttctgttatcatatctgaatgcactctaccagctg

SEQ ID NO: 8460 - DNA, 71 bp, chicken (Gallus Gallus)
  misc_feature (36): n=a or g
atgccaaactggaaggcagtctcaggatatggcctnaggcagtgtacattggtcccacacagatcatgttg

SEQ ID NO: 8461 - DNA, 71 bp, chicken (Gallus Gallus)
  misc_feature (36): n=c or t
atttacgactgcaagagcttctacttcctgataaangcaggtttaacttcattctatgttctgatacagtc

SEQ ID NO: 8462 - DNA, 71 bp, chicken (Gallus Gallus)
  misc_feature (36): n=c or t
aactatcagagttactggagacttgtccatttctancaaacacattttcaaacaaacacaactctacaaac

SEQ ID NO: 8463 - DNA, 71 bp, chicken (Gallus Gallus)
  misc_feature (36): n=a or t
atgtccttcaggaattgcatctttaaacatagcaanttttttcctataaaaggtaccagcaggaaaatcct

SEQ ID NO: 8464 - DNA, 71 bp, chicken (Gallus Gallus)
  misc_feature (36): n=a or g
ctagaaatacaatgctgtatgatcagctgacacagncctgatgtgatggaaagcaaaaaacatccagaata

SEQ ID NO: 8465 - DNA, 71 bp, chicken (Gallus Gallus)
  misc_feature (36): n=a or g
cagacttcagatcctacaggtagaaacacaaaaccnaacagaccgcattttcacgttgaatgacttcagct

SEQ ID NO: 8466 - DNA, 71 bp, chicken (Gallus Gallus)
  misc_feature (36): n=g or t
tgtttgtctacatgaaccttgataaagacaactcantaaataacattataatctcttgtaagtcaccatgg

SEQ ID NO: 8467 - DNA, 71 bp, chicken (Gallus Gallus)
  misc_feature (36): n=c or g
tgccacctcagcccagcgagggttcaggaaaaattncactcagtcatgtccagccgggagcttttccaagc

SEQ ID NO: 8468 - DNA, 71 bp, chicken (Gallus Gallus)
  misc_feature (36): n=c or t
ttgtcttgtaatttcttgagttgttcaggatttagngctggatcagctttgctatttgtctctctagatat

SEQ ID NO: 8469 - DNA, 71 bp, chicken (Gallus Gallus)
  misc_feature (36): n=c or g
ttgtgcagcataaacggacctcagcagaaatatacnagttcaaataaaaacatacagccataattattttt

SEQ ID NO: 8470 - DNA, 71 bp, chicken (Gallus Gallus)
  misc_feature (36): n=g or t
gagaacaactttgtaaatttaaacagcacttgctcngacaaaaaaagtgtaagaagtacaaggagttggcc

SEQ ID NO: 8471 - DNA, 71 bp, chicken (Gallus Gallus)
  misc_feature (36): n=c or t
cactgataaaataatactatatcatatatcagaacnttggatcattttccttatacatgcttatgtgtgtt

SEQ ID NO: 8472 - DNA, 71 bp, chicken (Gallus Gallus)
  misc_feature (36): n=a or g
tattaactatttcgaagtgcaataagcatcaaagcntgtattttaaacaactggactgcagggattatttt

SEQ ID NO: 8473 - DNA, 71 bp, chicken (Gallus Gallus)
  misc_feature (36): n=c or t
cccagttaaacaaacgaggaaggaaggaaggaaagnagcaacagatttccataaaatagcagcttgttaaa

SEQ ID NO: 8474 - DNA, 71 bp, chicken (Gallus Gallus)
  misc_feature (36): n=a or g
tgttgactacacaccaccatacgatcagaagtagcnaagtatctgagttatcatctcaccttaatatcact

SEQ ID NO: 8475 - DNA, 71 bp, chicken (Gallus Gallus)
  misc_feature (36): n=a or t
tactagtgtaaccaacctcagcagaagcaaaggagngcacagtattgaatacgtagcaaaattttataatc

SEQ ID NO: 8476 - DNA, 71 bp, chicken (Gallus Gallus)
  misc_feature (36): n=a or c
gaaagctagtgaaatcaggaggaaagaaaactttcnatcagagcaaatacaggaagctactgcttgagagc

SEQ ID NO: 8477 - DNA, 71 bp, chicken (Gallus Gallus)
  misc_feature (36): n=c or t
acagacaggcaactcttggagtgactggtagtgcantaaaaagagcttggccaacaggtcgagggaggttc

SEQ ID NO: 8478 - DNA, 71 bp, chicken (Gallus Gallus)
  misc_feature (36): n=a or g
tgctgcccaagtaacacgtttctccattgctggacnatgatgcggtaaggctactttatggacaaggcctc

SEQ ID NO: 8479 - DNA, 71 bp, chicken (Gallus Gallus)
  misc_feature (36): n=c or t
cggaagcttgttagctatgttataaatcacatcacngcagaagcaagtcgtctgcaggtacatggcacttt

SEQ ID NO: 8480 - DNA, 71 bp, chicken (Gallus Gallus)
  misc_feature (36): n=c or t
tttcacattcattgcaatctacgaattacagttganttcaataaacaagaagctaacactgacatacctga

SEQ ID NO: 8481 - DNA, 71 bp, chicken (Gallus Gallus)
  misc_feature (36): n=a or g
cgcatgcattaaagtaagcagcgcctatgctgcaanggaaaggctgggaatttttagttttgcattaagct

SEQ ID NO: 8482 - DNA, 71 bp, chicken (Gallus Gallus)
  misc_feature (36): n=a or g
tttcataatattaaatagaaaatagaaaccaggtcnaattcagccatcactgaatctttcttgttactttg

SEQ ID NO: 8483 - DNA, 71 bp, chicken (Gallus Gallus)
  misc_feature (36): n=g or t
caaaaaaatgatgtaataggtggatgcgtcaaagtntagagcaccactggaaactttagaactataaacgc

SEQ ID NO: 8484 - DNA, 71 bp, chicken (Gallus Gallus)
  misc_feature (36): n=a or g
tggcattgcctagcatttactatgtaggcaagaaangcaaaagttgagagatgggaagctctacttcatct

SEQ ID NO: 8485 - DNA, 71 bp, chicken (Gallus Gallus)
  misc_feature (36): n=a or g
agtaaagtcggagtaacatgcagcttgagcaatacntagcttgtatataaacattcccagaaccaccttag

SEQ ID NO: 8486 - DNA, 71 bp, chicken (Gallus Gallus)
  misc_feature (36): n=c or t
ttaataaaaaatgacaaaaatacaaaataatactgngtgtcagttgtcaatagaagattaactcagacagg

SEQ ID NO: 8487 - DNA, 71 bp, chicken (Gallus Gallus)
  misc_feature (36): n=c or t
ctaagtattcatttccttttatagcacgtgtaactncagttatggagttacgcagtgtgtaactccagtta

SEQ ID NO: 8488 - DNA, 71 bp, chicken (Gallus Gallus)
  misc_feature (36): n=a or g
aaagatcatctcgttcaaactccctgccatgggcanggttgccaaatacctggaaacgtaacacacacagc

SEQ ID NO: 8489 - DNA, 71 bp, chicken (Gallus Gallus)
  misc_feature (36): n=a or g
taacattttagaactctctcaccccaaactcacccntatcaaatatcctgacttatatgtgaggacaaggt

SEQ ID NO: 8490 - DNA, 71 bp, chicken (Gallus Gallus)
  misc_feature (36): n=a or g
gccaagaaatcactccagaaaataattgcatgactnaagatgaaaagatctattgcacaccactgaggcaa

SEQ ID NO: 8491 - DNA, 71 bp, chicken (Gallus Gallus)
  misc_feature (36): n=a or g
tctgtaaactggcctcttcagccttacttctgcttnctcagagagcttgttttgtgaaaatttaaagcccc

SEQ ID NO: 8492 - DNA, 71 bp, chicken (Gallus Gallus)
  misc_feature (36): n=c or t
cacctccatgctgatggagatccccatgagggcagngatgtccttgagggcacagtggctatgtatggctc

SEQ ID NO: 8493 - DNA, 71 bp, chicken (Gallus Gallus)
  misc_feature (36): n=c or t
gaattttttaaccaaattgtatcacctgtcaagagntctcatgtgattcttggaagcctgctacagagtct

SEQ ID NO: 8494 - DNA, 71 bp, chicken (Gallus Gallus)
  misc_feature (36): n=a or g
ccaggccattctatgattctgtgattctataagcanggctggatgtctgttgttaggcagatggacacaca

SEQ ID NO: 8495 - DNA, 71 bp, chicken (Gallus Gallus)
  misc_feature (36): n=c or g
attaaaagtagtgtgatacttaaccttgtgcttgtnaaattaatgcatcaggctgttttggtggaagtggt

SEQ ID NO: 8496 - DNA, 71 bp, chicken (Gallus Gallus)
  misc_feature (36): n=c or t
aggctcgttaggagcaagctgaggcttctggaatantggagaattgctgtaagaaactctgaatgaagtgt

SEQ ID NO: 8497 - DNA, 71 bp, chicken (Gallus Gallus)
  misc_feature (36): n=a or g
gctaaggaagaaactatgaatttgtatcgacttccntatcatcatgcactgtgtcactgctgagcaggcta

SEQ ID NO: 8498 - DNA, 71 bp, chicken (Gallus Gallus)
  misc_feature (36): n=c or t
gtggcttatctgattaaactgcttgtaagagtacantacaacataacattggaggagaatactcagtggct

SEQ ID NO: 8499 - DNA, 71 bp, chicken (Gallus Gallus)
  misc_feature (36): n=c or g
atcagtgtggtattacactaatgtgcataacagcanctttgtttcatacatttatcttgaaaagcaaaact

SEQ ID NO: 8500 - DNA, 71 bp, chicken (Gallus Gallus)
  misc_feature (36): n=a or g
aaccccgatgacttctccctgtccccatcctctgcnttttgatttcttactgtctttctaaacataggaat

SEQ ID NO: 8501 - DNA, 71 bp, chicken (Gallus Gallus)
  misc_feature (36): n=c or t
ctgatccagaaagtggtttcaccttatttgggcacntatggtctgtattccagtgatggacccttcacaca

SEQ ID NO: 8502 - DNA, 71 bp, chicken (Gallus Gallus)
  misc_feature (36): n=g or t
tatttttttttaccccactattacaatttactatgnaaagatatgacttccccaccttcctccccctttcc

SEQ ID NO: 8503 - DNA, 71 bp, chicken (Gallus Gallus)
  misc_feature (36): n=a or g
cctctttgaagaagagctgatgaagggactataaanccagtcttctgaaaagtggctgagggaaatggtac

SEQ ID NO: 8504 - DNA, 71 bp, chicken (Gallus Gallus)
  misc_feature (36): n=c or t
atgttccaaattaaagacacagggcagcacgcagcnttctttgtctctcagggtcagattttcaaaactta

SEQ ID NO: 8505 - DNA, 71 bp, chicken (Gallus Gallus)
  misc_feature (36): n=c or t
tggctggcctagacaccagattagcactccgtatangagtggtatctcaccaacttgaactggcagagcac

SEQ ID NO: 8506 - DNA, 71 bp, chicken (Gallus Gallus)
  misc_feature (36): n=a or g
tttctgcaaatccctgtggaccacaggacaaagccnaagatatcaggcatgaagttaataatgagttctta

SEQ ID NO: 8507 - DNA, 71 bp, chicken (Gallus Gallus)
  misc_feature (36): n=c or t
aaaaaattgaattacttgccatagtaaaattgatantgcagtctgtataaagggaaattgaatgcaaaaca

SEQ ID NO: 8508 - DNA, 71 bp, chicken (Gallus Gallus)
  misc_feature (36): n=a or c
atttcacagtgaaaaaggaaattcctcaacagtgcnaagccaaactggttacaatagagacacaaagaaaa

SEQ ID NO: 8509 - DNA, 71 bp, chicken (Gallus Gallus)
  misc_feature (36): n=c or t
actttatcaggctcttgaagaattgtcagtgttttnttataagtcttacaaagacatccagtgacttagcc

SEQ ID NO: 8510 - DNA, 71 bp, chicken (Gallus Gallus)
  misc_feature (36): n=a or g
aggaagtgtgggatagatgagaggatagttaggtanattgaaaattggctgattggcggagctcaaaggct

SEQ ID NO: 8511 - DNA, 71 bp, chicken (Gallus Gallus)
  misc_feature (36): n=c or t
tctaagttgtatttcaaaagaattacaataggaatnaagtcaaatatgtttttgtgcagacctgagtcaga

SEQ ID NO: 8512 - DNA, 71 bp, chicken (Gallus Gallus)
  misc_feature (36): n=a or g
ccatgtggtgaaggacatgtttgtataaatggaccnggcaattaccgctgtgagtgcaagtctgggtattc

SEQ ID NO: 8513 - DNA, 71 bp, chicken (Gallus Gallus)
  misc_feature (36): n=a or g
agcatatatttaacccactcttctttttccatttgncagatattgatgagtgtgttacagaaactcacaac

SEQ ID NO: 8514 - DNA, 71 bp, chicken (Gallus Gallus)
  misc_feature (36): n=a or g
atgacgtgaggtaaggcctgcagtaactcagatganggttggatggagtcaaaatttcagcttacacatgc

SEQ ID NO: 8515 - DNA, 71 bp, chicken (Gallus Gallus)
  misc_feature (36): n=a or g
agatttgtttggctccttctgacttccaactgtttnagataatgaatgatttactgtgtgggcaacatttt

SEQ ID NO: 8516 - DNA, 71 bp, chicken (Gallus Gallus)
  misc_feature (36): n=a or g
tgtttaccagtatctgttatattaagggtgtggaancatctacaaatacctgatcttaaactttgttttgc

SEQ ID NO: 8517 - DNA, 71 bp, chicken (Gallus Gallus)
  misc_feature (36): n=c or g
tagatagttttatctaaattcgtgagttctactttntggttgtttttttttccctgtcccactgggaagtg

SEQ ID NO: 8518 - DNA, 71 bp, chicken (Gallus Gallus)
  misc_feature (36): n=a or c
tctttctttctttcttcctttctttcttttttttantggagaaatttctgttttaaggaagatattcgtgg

SEQ ID NO: 8519 - DNA, 71 bp, chicken (Gallus Gallus)
  misc_feature (36): n=a or g
tacttttacaatacatatgacttgtgttgttgaacntacatttttatatacagataaatttaaaataataa

SEQ ID NO: 8520 - DNA, 71 bp, chicken (Gallus Gallus)
  misc_feature (36): n=a or g
cagctcctgtaaacagcttttgatttgctagatttntatctacatgggagaactttagtcacaagtatgta

SEQ ID NO: 8521 - DNA, 71 bp, chicken (Gallus Gallus)
  misc_feature (36): n=a or c
gagaatgtgagagaggcttctgattgtttactcagncagtacaataatctccttcctactttgagatcttt

SEQ ID NO: 8522 - DNA, 71 bp, chicken (Gallus Gallus)
  misc_feature (36): n=a or g
agatcttcatttatacacagactgacaaaggctagncatgcttcagaattcaggacttagaagctgttgat

SEQ ID NO: 8523 - DNA, 71 bp, chicken (Gallus Gallus)
  misc_feature (36): n=c or t
aagctgcaagaataatttgtccagggataggttcanttttgttcaacagatttttcagcgctcagcttgaa

SEQ ID NO: 8524 - DNA, 71 bp, chicken (Gallus Gallus)
  misc_feature (36): n=c or t
gttttagagacagtttctggtttcttgcagttatanctgagtttagtgatacatattagctgatgcatcgt

SEQ ID NO: 8525 - DNA, 71 bp, chicken (Gallus Gallus)
  misc_feature (36): n=a or g
tgggacatgggggcagagactgttgtggtcaatggnccagaaatttccaagcttgcatccattgcctcaca

SEQ ID NO: 8526 - DNA, 71 bp, chicken (Gallus Gallus)
  misc_feature (36): n=a or g
ctctggatactctgagggaggagaaattgttctccntgcttcaggtttccttgataggtgaggttgactga

SEQ ID NO: 8527 - DNA, 71 bp, chicken (Gallus Gallus)
  misc_feature (36): n=c or t
gactgttaagagtacttgcttgctcctgtaaaccantttcaagctaatacttcagcgatggttgcttgaca

SEQ ID NO: 8528 - DNA, 71 bp, chicken (Gallus Gallus)
  misc_feature (36): n=a or g
gtattgtatcaaaaccatctccgtattgacattgcntttgagctgttttatggtaacgtaaactgaaaaaa

SEQ ID NO: 8529 - DNA, 71 bp, chicken (Gallus Gallus)
  misc_feature (36): n=c or t
gtggccgcattgggtatgttcacaggagcatataanaggcatgcttccctgtacattgggcctttattgct

SEQ ID NO: 8530 - DNA, 71 bp, chicken (Gallus Gallus)
  misc_feature (36): n=a or g
gcagccctgggctcacagggacttataggaaaggcnaagtcacttacacaagcgtgagtgtaaaaatccca

SEQ ID NO: 8531 - DNA, 71 bp, chicken (Gallus Gallus)
  misc_feature (36): n=g or t
cagaccaggtgaaaatcagtgcacgcaggactttcngtgaggccaggattttcatagaatcatagaatgaa

SEQ ID NO: 8532 - DNA, 71 bp, chicken (Gallus Gallus)
  misc_feature (36): n=c or t
agctgctcagattgagaataggtttaacatgtttgnttgctttattcatttatttattttatcggatactt

SEQ ID NO: 8533 - DNA, 71 bp, chicken (Gallus Gallus)
  misc_feature (36): n=c or t
ttggaccttcgggagaggcaatgtaaggtgtagggntggaccttgtcacagtacccctgggtatctccatg

SEQ ID NO: 8534 - DNA, 71 bp, chicken (Gallus Gallus)
  misc_feature (36): n=c or t
ttttatttaagaacagcaagcctaaaattttctaantctactttgctcttccctgtgataacttcatttga

SEQ ID NO: 8535 - DNA, 71 bp, chicken (Gallus Gallus)
  misc_feature (36): n=a or g
gattcacgaactgtattttcctttggatgggggagngctaggatgtccatctactctttgctctcccaaat

SEQ ID NO: 8536 - DNA, 71 bp, chicken (Gallus Gallus)
  misc_feature (36): n=c or g
gaaacattcttagtattcgtgaatgctcttgggaanatgctgtctcaaagatgaaggtttcttcttcttta

SEQ ID NO: 8537 - DNA, 71 bp, chicken (Gallus Gallus)
  misc_feature (36): n=a or g
gcttctccaagcagcagcagcacatcctgcttcacnctgacctgctggctgctatgcggtttctaaaatca

SEQ ID NO: 8538 - DNA, 71 bp, chicken (Gallus Gallus)
  misc_feature (36): n=c or t
acctgaatgtggccacacagaagttgcaagaagtangaatgcacaggtgtctgtcttcttgcagtctgcat

SEQ ID NO: 8539 - DNA, 71 bp, chicken (Gallus Gallus)
  misc_feature (36): n=c or t
tctcctcttcttgctttaatagcttgtctgagactnccacattggtgggagaaacaataatgaattttgtt

SEQ ID NO: 8540 - DNA, 71 bp, chicken (Gallus Gallus)
  misc_feature (36): n=a or t
attaggataactcaggattaaatctgttagcaaaangaaacagttcatcccagaagccaaatgaacaagtc

SEQ ID NO: 8541 - DNA, 71 bp, chicken (Gallus Gallus)
  misc_feature (36): n=c or t
gaaacatacacttttttttttatctgctcagaaaangcaactgaagtaccatgttcaaaaaagagaagcag

SEQ ID NO: 8542 - DNA, 71 bp, chicken (Gallus Gallus)
  misc_feature (36): n=a or g
tgtccacagtcctagtggtgagaccactagcaaacngtgacctacaggatgcgatccttccttaggtgagg

SEQ ID NO: 8543 - DNA, 71 bp, chicken (Gallus Gallus)
  misc_feature (36): n=a or c
ctgtgactaaatgaatctgtcctaagatatgcaganttttctcttcttaaatgttgctctgaaagtaatgc

SEQ ID NO: 8544 - DNA, 71 bp, chicken (Gallus Gallus)
  misc_feature (36): n=a or g
ttgtcagagatctctttgctagcctagcagtcatanttcacagttcacagtcatagctaattgagatgcag

SEQ ID NO: 8545 - DNA, 71 bp, chicken (Gallus Gallus)
  misc_feature (36): n=c or t
tcttgtatgtggattaacttatcttccaggattctntgctccatcaccttcccagacagggaagtcagaag

SEQ ID NO: 8546 - DNA, 71 bp, chicken (Gallus Gallus)
  misc_feature (36): n=a or g
ctgagaagtgtcctgtgcatcagtgtttctgatgancctgtatgacctggttttgccaaaccctgctggct

SEQ ID NO: 8547 - DNA, 71 bp, chicken (Gallus Gallus)
  misc_feature (36): n=a or g
caagacaaaagctgacttatctccttagtgccaggncatccaagtggtggatcatgacaccaccacgagtg

SEQ ID NO: 8548 - DNA, 71 bp, chicken (Gallus Gallus)
  misc_feature (36): n=c or t
atgactgcatggttagggcaccactgttttgaaganatctattgctttctctacctgagggaccaaagttt

SEQ ID NO: 8549 - DNA, 71 bp, chicken (Gallus Gallus)
  misc_feature (36): n=c or t
acttgtgttagcagtggcatgacttgtaccagatgnacatgattaacaccctttagatgttttaggaaatc

SEQ ID NO: 8550 - DNA, 71 bp, chicken (Gallus Gallus)
  misc_feature (36): n=c or t
gcttttgagaggagctaaaactgagcagttttgganagggttgagggcaggactcccctgtctctctctgg

SEQ ID NO: 8551 - DNA, 71 bp, chicken (Gallus Gallus)
  misc_feature (36): n=a or g
gggctggccatgtaacttcgagaaaaggcacaaacntggtgatgaacaattgcagagacagcagatcctct

SEQ ID NO: 8552 - DNA, 71 bp, chicken (Gallus Gallus)
  misc_feature (36): n=c or t
gggtccaatatgagtcccaagtgttaagagccctgntggtcagggctgttaccagcatttttatgagagtg

SEQ ID NO: 8553 - DNA, 71 bp, chicken (Gallus Gallus)
  misc_feature (36): n=c or t
acaactgttgtataggaagcttgatatgcaaattcncacttcattgctctccagatgaaacttctcaagca

SEQ ID NO: 8554 - DNA, 71 bp, chicken (Gallus Gallus)
  misc_feature (36): n=a or g
tgtatgagaaataacagggaaaaacacagcaagcanatttgcccctaggttcaaactgttgcgtatgaaga

SEQ ID NO: 8555 - DNA, 71 bp, chicken (Gallus Gallus)
  misc_feature (36): n=a or g
ggcattaagtaaagagaacagcattggtactgtacncaagcaaaagtgtctagcttgtgaatgccaagcag

SEQ ID NO: 8556 - DNA, 71 bp, chicken (Gallus Gallus)
  misc_feature (36): n=a or g
tgaaatgtaagaaatgactggtcaatctgttgttanaacctctgtagttgttgcctggaatattattccaa

SEQ ID NO: 8557 - DNA, 71 bp, chicken (Gallus Gallus)
  misc_feature (36): n=a or g
agccagtttttagctaccaaagagaacacctgtctnaggtacagactgccagcttctccaggagaatactg

SEQ ID NO: 8558 - DNA, 71 bp, chicken (Gallus Gallus)
  misc_feature (36): n=c or t
ttacacttgttgatacaagattttgtgtgagacatntatgcactgttctccctttgtgcttaatttctttt

SEQ ID NO: 8559 - DNA, 71 bp, chicken (Gallus Gallus)
  misc_feature (36): n=g or t
ttattatccttttctttttctctattttagtaaatngttttatctcaatccacacgttctacatttttttt

SEQ ID NO: 8560 - DNA, 71 bp, chicken (Gallus Gallus)
  misc_feature (36): n=c or t
agttccctttaagaaaatctcattttttctgaacanttatgaaagaaacaataccaaaataccatagtaac

SEQ ID NO: 8561 - DNA, 71 bp, chicken (Gallus Gallus)
  misc_feature (36): n=c or t
gtggcacagagtgccagtgatactccctgccttttnatatgaaatgatcttggcaacactgttacaaagag

SEQ ID NO: 8562 - DNA, 71 bp, chicken (Gallus Gallus)
  misc_feature (36): n=a or c
agaactgtctctaaccagtgcttgagaatcagcaanaggaaatcaccgccacttactgtctgttgatttct

SEQ ID NO: 8563 - DNA, 71 bp, chicken (Gallus Gallus)
  misc_feature (36): n=c or t
agccctgcacgcatcctgggtgggctggctcacacngggcaagtctcaggatggaaacgagccatgtcctc

SEQ ID NO: 8564 - DNA, 71 bp, chicken (Gallus Gallus)
  misc_feature (36): n=g or t
tactcttacatttccacataaggtctccttttaatnttttttctcttgttccattgaagttaacagcaaca

SEQ ID NO: 8565 - DNA, 71 bp, chicken (Gallus Gallus)
  misc_feature (36): n=a or g
gtgtgacaaatccaaaggctcaaacttgcttttagntcaagactaaaggcaagactgcttaaagaagtgat

SEQ ID NO: 8566 - DNA, 71 bp, chicken (Gallus Gallus)
  misc_feature (36): n=a or g
gtttcagaaatttattcagagctcacaggtacagancatggtccagtgatggaaaaattgtgcctttaaag

SEQ ID NO: 8567 - DNA, 71 bp, chicken (Gallus Gallus)
  misc_feature (36): n=c or t
ggggtgagaccaatagcgcagctaaaatgcatctangccaatgcatacagcgtgggcaacaaagaagagta

SEQ ID NO: 8568 - DNA, 71 bp, chicken (Gallus Gallus)
  misc_feature (36): n=a or t
attttaaaatattgctttcactttagctagtaagtngaagttttttaaagtaaagatatcgaatacagatc

SEQ ID NO: 8569 - DNA, 71 bp, chicken (Gallus Gallus)
  misc_feature (36): n=c or t
atatttttattcagacttatctgtatcaacatgtanatgcatggaggtgatggagaatagcattgtttagt

SEQ ID NO: 8570 - DNA, 71 bp, chicken (Gallus Gallus)
  misc_feature (36): n=c or t
ctgagacaattcagttgactctaaactgtcattaangtatgaagcttgcggatttgcaagctgctttttac

SEQ ID NO: 8571 - DNA, 71 bp, chicken (Gallus Gallus)
  misc_feature (36): n=a or g
ttaagctctgaaaacaagtttaaatagcgattttantaagtggaagagccacgtgtgcaaggaaattccat

SEQ ID NO: 8572 - DNA, 71 bp, chicken (Gallus Gallus)
  misc_feature (36): n=c or g
ttttcaatgctgatatcagtggctaagtaatcttancttcatatttctataaatcaaagtttcaggtctga

SEQ ID NO: 8573 - DNA, 71 bp, chicken (Gallus Gallus)
  misc_feature (36): n=c or t
tctgcattttgatacactggctaaacacagtcctgngaacagggaaaagtacacagttgtgctttccgttt

SEQ ID NO: 8574 - DNA, 71 bp, chicken (Gallus Gallus)
  misc_feature (36): n=c or g
aacgctgtactcagagcaggttgattgcataactanaggacaacaggtaggagagcatctaacaatatcca

SEQ ID NO: 8575 - DNA, 71 bp, chicken (Gallus Gallus)
  misc_feature (36): n=c or t
ggcataatttagcctcatgcataacgtcttgcattnttccacatgagacacagtttagggcatttctacca

SEQ ID NO: 8576 - DNA, 71 bp, chicken (Gallus Gallus)
  misc_feature (36): n=a or g
tgggagggctgtatgtttgtggggatagtgtgcatntgctgtagtagcctagacagcctaatctgactttg

SEQ ID NO: 8577 - DNA, 71 bp, chicken (Gallus Gallus)
  misc_feature (36): n=a or t
aaatgaggcaatatatgatagctaaaaatcactgcntgataattaattgtctgttcattcaaaaggtatga

SEQ ID NO: 8578 - DNA, 71 bp, chicken (Gallus Gallus)
  misc_feature (36): n=a or g
tgttcattcttgatcagtgcattgaaggttttaaancataccctatgaagtctgttctatttgcaagaagc

SEQ ID NO: 8579 - DNA, 71 bp, chicken (Gallus Gallus)
  misc_feature (36): n=c or t
caaacatacaaataacagcaatggcaaattagaacnaggcagtcctgccctttggtatatcatgacagtac

SEQ ID NO: 8580 - DNA, 71 bp, chicken (Gallus Gallus)
  misc_feature (36): n=c or t
aaaaactggctaacagaagacaacaggaggtaatgncaacaggaggtaaccacttctgttgctattacaat

SEQ ID NO: 8581 - DNA, 71 bp, chicken (Gallus Gallus)
  misc_feature (36): n=a or c
tactgttttcaaaacaaaaatatattttcttttatnaaacatacttttgagcaccacatgaacaaacagct

SEQ ID NO: 8582 - DNA, 71 bp, chicken (Gallus Gallus)
  misc_feature (36): n=c or t
catagctggtcatttcaatctcagcagaaggggcangggaataaaaagcagggaagtgttctgctggtggc

SEQ ID NO: 8583 - DNA, 71 bp, chicken (Gallus Gallus)
  misc_feature (36): n=c or t
ggagaaaaagcaggtcacaaggacctaagtctgtgngtcaccaaatggaaagacctgcccatgcttatttt

SEQ ID NO: 8584 - DNA, 71 bp, chicken (Gallus Gallus)
  misc_feature (36): n=c or t
tctgctgattatccttggtaagtgcacacatccagngtttaaggagtgatcacatattcataattttataa

SEQ ID NO: 8585 - DNA, 71 bp, chicken (Gallus Gallus)
  misc_feature (36): n=c or t
caagaaaagctactgcatcccaccccccaccccccnatcagttaaatcagagaggcgaggcttataatgag

SEQ ID NO: 8586 - DNA, 71 bp, chicken (Gallus Gallus)
  misc_feature (36): n=a or g
ttcatacaaacttgtaaataatatgatgcatccttncatagggaaggtggagcaacaggggagagctgtgt

SEQ ID NO: 8587 - DNA, 71 bp, chicken (Gallus Gallus)
  misc_feature (36): n=a or g
ttgacctgacctgccgtctggagaaaccagtaagtnttgtggataaggctgaaaaatcttcaggcttgcct

SEQ ID NO: 8588 - DNA, 71 bp, chicken (Gallus Gallus)
  misc_feature (36): n=c or t
atctcatgtagaaccttgtatcccacgcaggataangccatctataacctgcttccagacataatcagtcg

SEQ ID NO: 8589 - DNA, 71 bp, chicken (Gallus Gallus)
  misc_feature (36): n=c or t
gaagagcagtaacatgaaaagggatacgagaaaccnggtcagtgctgacagcacttctttcccttcctcag

SEQ ID NO: 8590 - DNA, 71 bp, chicken (Gallus Gallus)
  misc_feature (36): n=c or t
acttttccctacttctgaccactctttttggacttntatgaactttctccagctctaccctattgtttcaa

SEQ ID NO: 8591 - DNA, 71 bp, chicken (Gallus Gallus)
  misc_feature (36): n=c or t
tcccccactgtaaccaagcacatatcttatttgctnctagtggttatgcccattcaagagggaacaatatc

SEQ ID NO: 8592 - DNA, 71 bp, chicken (Gallus Gallus)
  misc_feature (36): n=a or g
gtcccatcagtgataccaagcagcgggccaaacccnaaacttccagaaagcatgcggttcatgtgctgccg

SEQ ID NO: 8593 - DNA, 71 bp, chicken (Gallus Gallus)
  misc_feature (36): n=c or t
atctcagctcctgcccgtttacagatcagacactgnccttgcattgattattagcgcctctccagcatacg

SEQ ID NO: 8594 - DNA, 71 bp, chicken (Gallus Gallus)
  misc_feature (36): n=g or t
gattagagcaaccccctctacaacagcaatcacatnctcaagggaagataactgcaaagacaacttaaagc

SEQ ID NO: 8595 - DNA, 71 bp, chicken (Gallus Gallus)
  misc_feature (36): n=a or g
ttattgaaggttcttaccatgttcccaatcatgtcnttcatcatgccgaacatgtctataaagccacccgc

SEQ ID NO: 8596 - DNA, 71 bp, chicken (Gallus Gallus)
  misc_feature (36): n=c or t
gatcctgactgcggcatagatgaagaatccttccanactattatgaggtatgtaaaatctaaaatgagggt

SEQ ID NO: 8597 - DNA, 71 bp, chicken (Gallus Gallus)
  misc_feature (36): n=g or t
cttgtagacttggatgagtgcacagattttgtggangaactttgcagtcattactgtaataattatattgg

SEQ ID NO: 8598 - DNA, 71 bp, chicken (Gallus Gallus)
  misc_feature (36): n=a or c
aacgggtttcttgcattgaaatcacagctacaaaancatgttgaacgaagaggaaaatggtgtttataaaa

SEQ ID NO: 8599 - DNA, 71 bp, chicken (Gallus Gallus)
  misc_feature (36): n=a or g
gaggttgtataaaaaagtttaaatacacaaggaagnatagcattaataaataatcactctctccctctaga

SEQ ID NO: 8600 - DNA, 71 bp, chicken (Gallus Gallus)
  misc_feature (36): n=c or t
tttcctttctgggtgattacaccatccttttttccntccccccccccccctaaaactcaaagtttcgtaag

SEQ ID NO: 8601 - DNA, 71 bp, chicken (Gallus Gallus)
  misc_feature (36): n=a or g
actgctagtgattttctttctaaagtggatgatccnaaactcaacagttctgaggtgaggaattctgtgtc

SEQ ID NO: 8602 - DNA, 71 bp, chicken (Gallus Gallus)
  misc_feature (36): n=a or g
taaatgtctttagggaaaatattttaaaaatgcagntactcatgagatatgggtgtgagcactcttcatta

SEQ ID NO: 8603 - DNA, 71 bp, chicken (Gallus Gallus)
  misc_feature (36): n=a or g
caaggatacagcagcagtaagaaggaatcacctgtncccaagggagcagaaaagtcaggacatattcctac

SEQ ID NO: 8604 - DNA, 71 bp, chicken (Gallus Gallus)
  misc_feature (36): n=c or t
attctgcaggtctgagagggcagaggttgaaatcangatgaaagcaatgatggctgagtgagctccatgct

SEQ ID NO: 8605 - DNA, 71 bp, chicken (Gallus Gallus)
  misc_feature (36): n=a or g
atgacagtaaagggagaatagtaaagccatgtggantgcaggggccaaagacagtggtttcttacacctgg

SEQ ID NO: 8606 - DNA, 71 bp, chicken (Gallus Gallus)
  misc_feature (36): n=c or t
ctcacagcacttatggctttagcagtcagcttcacnaatgagtccttgcagaagcaggcgtgtgaaaccct

SEQ ID NO: 8607 - DNA, 71 bp, chicken (Gallus Gallus)
  misc_feature (36): n=c or t
accataaagtaaacaagatgcaggagtcaggcttcntttcaccttctcatacgggttgactccagaaagtt

SEQ ID NO: 8608 - DNA, 71 bp, chicken (Gallus Gallus)
  misc_feature (36): n=a or g
ataaagtacagggttttgatgcagtattgaggcacngtcaatattcactgattgatgaccaagaccctacc

SEQ ID NO: 8609 - DNA, 71 bp, chicken (Gallus Gallus)
  misc_feature (36): n=c or t
acatgaacagtttatttctctttttctcattcttanctagacaataatacaataaaaacttcctttctggt

SEQ ID NO: 8610 - DNA, 71 bp, chicken (Gallus Gallus)
  misc_feature (36): n=a or g
tgtttgctttttccaaggctctactagcaaactgancaaatccaaaatcacttcatcattctaatttttca

SEQ ID NO: 8611 - DNA, 71 bp, chicken (Gallus Gallus)
  misc_feature (36): n=a or g
cagctgtatttgaaaaggaatgggaaacaaagggtntcaaacaaagcctataggagaggacttgctagatg

SEQ ID NO: 8612 - DNA, 71 bp, chicken (Gallus Gallus)
  misc_feature (36): n=a or g
ggcccagtaatgaaaacagtgtatgtgtctaagagnaaaaacacaaaaaaaatttaggggccttgaaaact

SEQ ID NO: 8613 - DNA, 71 bp, chicken (Gallus Gallus)
  misc_feature (36): n=a or c
tgtactccatgtacactttcatgacctgcccaaaancaaaacggctattactacctccatgaaaggtaatg

SEQ ID NO: 8614 - DNA, 71 bp, chicken (Gallus Gallus)
  misc_feature (36): n=a or g
cagtactggatgtcaaggcactgaaggtgattgttnacagtcttttcatggttctgtagggccaatacttg

SEQ ID NO: 8615 - DNA, 71 bp, chicken (Gallus Gallus)
  misc_feature (36): n=c or t
aagaattctatgattctatacacaattatctcccangcactatgatcctcctcttgcttctaggtccatct

SEQ ID NO: 8616 - DNA, 71 bp, chicken (Gallus Gallus)
  misc_feature (36): n=c or g
gaagttcatgcctgatcaatctagtggctttctgcnatggagtgttggcatcagtggacaaagaaaaggca

SEQ ID NO: 8617 - DNA, 71 bp, chicken (Gallus Gallus)
  misc_feature (36): n=c or t
tgactcgggagtgctcgaacattaaaaacaatctcngcatactttggtatttgatagatgttgttatattt

SEQ ID NO: 8618 - DNA, 71 bp, chicken (Gallus Gallus)
  misc_feature (36): n=a or g
aagtttctgctgttacttacaagcacttgtgtcaanggcagattccaaatatgaattattcagtatattct

SEQ ID NO: 8619 - DNA, 71 bp, chicken (Gallus Gallus)
  misc_feature (36): n=a or c
acaattgaataatactttcttgtgggatctcagctnaaggtttgttctacacgcctccagaacagtgacta

SEQ ID NO: 8620 - DNA, 71 bp, chicken (Gallus Gallus)
  misc_feature (36): n=g or t
cttctttaaaaaggaataagtgggacctttttctgngataggcccccataagaattcctcaagtcaccaga

SEQ ID NO: 8621 - DNA, 71 bp, chicken (Gallus Gallus)
  misc_feature (36): n=c or t
atagggtgaaaaagaaacatcccaagaaatgtatgntgggggaggagtatagaattaaaatactaaaattg

SEQ ID NO: 8622 - DNA, 71 bp, chicken (Gallus Gallus)
  misc_feature (36): n=a or g
ttggatatatctttgttttatgcttggaaatcctcnttctctttgttttattcttaacattttctgatgca

SEQ ID NO: 8623 - DNA, 71 bp, chicken (Gallus Gallus)
  misc_feature (36): n=c or t
aagagggagcttttctgtgaacattaaaggaatggngaaacctctgctgcagcccagccaggactgtgctc

SEQ ID NO: 8624 - DNA, 71 bp, chicken (Gallus Gallus)
  misc_feature (36): n=c or t
ttaaagggtgtacaaaacacatacgcaagcaactgntggtgagtaacatcagctgtggtattgtgtgttct

SEQ ID NO: 8625 - DNA, 71 bp, chicken (Gallus Gallus)
  misc_feature (36): n=c or g
aaaatccattcatagaaaccagatagaaaaacaaanaaacaaacagtctcatagttttgagaatagttaaa

SEQ ID NO: 8626 - DNA, 71 bp, chicken (Gallus Gallus)
  misc_feature (36): n=c or g
gtgtagtacatgcttttagaggtttaaaataatggnttatgaaacagtttagttctggaacagtttagttc

SEQ ID NO: 8627 - DNA, 71 bp, chicken (Gallus Gallus)
  misc_feature (36): n=c or t
aatgatttaaaaacatctgctgcactcatctgttcnatgtgcagccctgacaacaagccttccccaacaaa

SEQ ID NO: 8628 - DNA, 71 bp, chicken (Gallus Gallus)
  misc_feature (36): n=c or g
ataggcgctgttctgtggagaagctctttgaagcanaaaattaatggaggggaaaagagatgtgagtggtg

SEQ ID NO: 8629 - DNA, 71 bp, chicken (Gallus Gallus)
  misc_feature (36): n=a or g
tcactttgaactgcttcagcacttctggagtttttncatctggatgttatgtaacctgtgctgttgctgtt

SEQ ID NO: 8630 - DNA, 71 bp, chicken (Gallus Gallus)
  misc_feature (36): n=a or g
tgatcatagcaatatatctcttcttctgaaaacatntcacagcagactggtatatcttctctgtttagaga

SEQ ID NO: 8631 - DNA, 71 bp, chicken (Gallus Gallus)
  misc_feature (36): n=a or g
caatcagtggttcaagccataactcaacagttcccntacagcatgcaatcacttttcttagtgtttggaga

SEQ ID NO: 8632 - DNA, 71 bp, chicken (Gallus Gallus)
  misc_feature (36): n=a or g
ataagaattttgaatccactatatatctacagttancttagtgatgaagtcactgggacactagtctttgt

SEQ ID NO: 8633 - DNA, 71 bp, chicken (Gallus Gallus)
  misc_feature (36): n=c or t
tccttctcttaacgaaaggtattcccttgttctcgnttcgaagctgccattatgcgggtgctgctttgcca

SEQ ID NO: 8634 - DNA, 71 bp, chicken (Gallus Gallus)
  misc_feature (36): n=c or t
aaagtacccacaaccacctaccatatactctaccanatgcaagaacaacgcaaaattgtgagcatttgtca

SEQ ID NO: 8635 - DNA, 71 bp, chicken (Gallus Gallus)
  misc_feature (36): n=c or t
catttaggcactagtttcagagcttagagatctaanccactgaaagcactaattatgtgagacaagactct

SEQ ID NO: 8636 - DNA, 71 bp, chicken (Gallus Gallus)
  misc_feature (36): n=a or g
tcagagtaaaggagagtggggctcagaagcatattnaacttgcacttatccttctgactttcttgatgagt

SEQ ID NO: 8637 - DNA, 71 bp, chicken (Gallus Gallus)
  misc_feature (36): n=g or t
acttgaactcttagggctttttatctctccagcaanacatttatttgttagaaaagtcaataattttcttt

SEQ ID NO: 8638 - DNA, 71 bp, chicken (Gallus Gallus)
  misc_feature (36): n=a or g
actgattttccaaagttttgcagaacatgaagtgcngaataactgaagatgtatccctgagctctacgatg

SEQ ID NO: 8639 - DNA, 71 bp, chicken (Gallus Gallus)
  misc_feature (36): n=c or t
atcctggagctgaagcactctctgaaagccactgangctgggattttctggcctccttttaggtcaagttg

SEQ ID NO: 8640 - DNA, 71 bp, chicken (Gallus Gallus)
  misc_feature (36): n=a or g
cctcaaaaaccacaggaatactcgagcctcaccccnaggtggtgagtttgagccactctcctgttccacag

SEQ ID NO: 8641 - DNA, 71 bp, chicken (Gallus Gallus)
  misc_feature (36): n=a or g
actaaagcttgaatgggtacagttggcatcacaacngctagttctcaggccactgtgcttactagttccct

SEQ ID NO: 8642 - DNA, 71 bp, chicken (Gallus Gallus)
  misc_feature (36): n=a or g
agtgtttatttgctttgtttttggtatttctaatgncttcacacacacctttcctgggccagaccccctta

SEQ ID NO: 8643 - DNA, 71 bp, chicken (Gallus Gallus)
  misc_feature (36): n=c or t
tccccatagcggagatccataggcccatctgcattngtatttgacttctgcttaaggcaaaggacagaaaa

SEQ ID NO: 8644 - DNA, 71 bp, chicken (Gallus Gallus)
  misc_feature (36): n=a or t
atggagttcagatggttagggaactgcagcatgtantataggagaatagggtaagagaactggattttgtt

SEQ ID NO: 8645 - DNA, 71 bp, chicken (Gallus Gallus)
  misc_feature (36): n=c or t
gggacacactaggtgcatgggcagcatcctctcctngtgttggcccattttaaagactgcagcttcatctc

SEQ ID NO: 8646 - DNA, 71 bp, chicken (Gallus Gallus)
  misc_feature (36): n=c or t
tttaatgtgggctgcaaatcaaagacctcagaaccnaggaagtacatgcaataatatcacgagctcactgc

SEQ ID NO: 8647 - DNA, 71 bp, chicken (Gallus Gallus)
  misc_feature (36): n=c or g
tttggaaaggcagaagcttacaaaagtcagggtagngagttgggtcaccttgctcactgcctcttctctgt

SEQ ID NO: 8648 - DNA, 71 bp, chicken (Gallus Gallus)
  misc_feature (36): n=a or g
tgtgggggggagatgcatggccttaagagccaaaanccttcctcaatcagccgctgccaacctgcgtgctc

SEQ ID NO: 8649 - DNA, 71 bp, chicken (Gallus Gallus)
  misc_feature (36): n=c or t
gaacatagctgttactgtaaatcctgtttctgccangttctcttgttttagagaattattcaaagatcact

SEQ ID NO: 8650 - DNA, 71 bp, chicken (Gallus Gallus)
  misc_feature (36): n=a or c
gccttaatctgcctactctcagtacaaagtgaaagnatataggcaccagtggcatggctctgcagtctaga

SEQ ID NO: 8651 - DNA, 71 bp, chicken (Gallus Gallus)
  misc_feature (36): n=a or g
cccaacctgaacctcccctggcaaaacttgaggccnttccctcttgccttattgctgttacctgagagaag

SEQ ID NO: 8652 - DNA, 71 bp, chicken (Gallus Gallus)
  misc_feature (36): n=a or g
gtgacagtgtggctttgctgagataggaagggagtnaatgatctgagagcccctctgtgaattcctctggt

SEQ ID NO: 8653 - DNA, 71 bp, chicken (Gallus Gallus)
  misc_feature (36): n=a or g
tgcgtctgtgcctgtgggaactgggtgtgcactgcnatgacatgtgaaggtctgtctgctctccagagggt

SEQ ID NO: 8654 - DNA, 71 bp, chicken (Gallus Gallus)
  misc_feature (36): n=a or g
tcctgcctttaaaatatgctgcagtactgaggcttntgagaaactagaagtagtcttctgtggtgtaagcc

SEQ ID NO: 8655 - DNA, 71 bp, chicken (Gallus Gallus)
  misc_feature (36): n=a or c
cagcagacccttctcttgcagataaaagcaaaaaancaccagacccagcatttccagagctcagttttccc

SEQ ID NO: 8656 - DNA, 71 bp, chicken (Gallus Gallus)
  misc_feature (36): n=a or t
cagccaccatccatgtgctagattgcacagcaggtnggtaacagagtgagacttctttgcaccacctttct

SEQ ID NO: 8657 - DNA, 71 bp, chicken (Gallus Gallus)
  misc_feature (36): n=a or g
cagtttcacaccgtgattcccaagaagtactgaatntcttgctctttgtggcagccacgtaggggaggtag

SEQ ID NO: 8658 - DNA, 71 bp, chicken (Gallus Gallus)
  misc_feature (36): n=c or t
ttctatttcagaaggaatcggtaacattgctgacangtgcccaaaagcttttagagacaactgcagttatg

SEQ ID NO: 8659 - DNA, 71 bp, chicken (Gallus Gallus)
  misc_feature (36): n=c or t
atgtattcaagtctctccttcccccccccgcacccngcctccccttttatttttctagaggagttagaaat

SEQ ID NO: 8660 - DNA, 71 bp, chicken (Gallus Gallus)
  misc_feature (36): n=a or g
accactaaactacagggactgaacttgtttcaatcnggatgtcccaccatcctgaacttgcggccaacatt

SEQ ID NO: 8661 - DNA, 71 bp, chicken (Gallus Gallus)
  misc_feature (36): n=c or t
ggtgaacctcgccttctactcagcactggtgaggcnatgcctggagttctgtatgctattctgggctgtcc

SEQ ID NO: 8662 - DNA, 71 bp, chicken (Gallus Gallus)
  misc_feature (36): n=a or g
caatccctcagctggcagaaggcatctgcagtctcnctgcttatgactgcaagttccagatgaccataaga

SEQ ID NO: 8663 - DNA, 71 bp, chicken (Gallus Gallus)
  misc_feature (36): n=c or t
taggtaagcgaaaatacgatgcaaagttggtctctntcattgcaatggacagttagctgtatttgttttca

SEQ ID NO: 8664 - DNA, 71 bp, chicken (Gallus Gallus)
  misc_feature (36): n=a or g
agcaccatacaggctatgcattaactgcaagcagcntatacatcaatttgttgtttggtagcttccctctt

SEQ ID NO: 8665 - DNA, 71 bp, chicken (Gallus Gallus)
  misc_feature (36): n=c or t
aggagttcacgttcccttacagtctgtcctcagccnggaacaggttgcaactctgcattaagcagactgag

SEQ ID NO: 8666 - DNA, 71 bp, chicken (Gallus Gallus)
  misc_feature (36): n=a or g
gaaaaggcttgctacgtgagacttaaatcttctacntaaaagcaacacctttaaaatattgaacaatcaac

SEQ ID NO: 8667 - DNA, 71 bp, chicken (Gallus Gallus)
  misc_feature (36): n=a or g
acgatgacgatgatgatgactaactgtgactctgtncagtttgacttgtggaggccgagaggcctccccct

SEQ ID NO: 8668 - DNA, 71 bp, chicken (Gallus Gallus)
  misc_feature (36): n=a or g
cttctacagcaaggtgggcattcttatcagctgcangtagctcaaaactgctaacacatattcaggagaag

SEQ ID NO: 8669 - DNA, 71 bp, chicken (Gallus Gallus)
  misc_feature (36): n=a or g
gatgaagaaacacctcgtaaagtgaaaactaggccntcatccctcaacttggattcacttcttccagcttc

SEQ ID NO: 8670 - DNA, 71 bp, chicken (Gallus Gallus)
  misc_feature (36): n=a or g
gtaacacctacagttctgaggcttttcaaggcaccntgttcttcagagctgcccagctcctcacctcaaac

SEQ ID NO: 8671 - DNA, 71 bp, chicken (Gallus Gallus)
  misc_feature (36): n=c or t
agtttaactaaacactcactgcagtctctttctgcngcccacgtaatattcttcttgtactctctttctct

SEQ ID NO: 8672 - DNA, 71 bp, chicken (Gallus Gallus)
  misc_feature (36): n=c or t
tcctgccaatagtcattgccgtgatgccttcagagntccttccagtgaggaatattggtagagaaataatg

SEQ ID NO: 8673 - DNA, 71 bp, chicken (Gallus Gallus)
  misc_feature (36): n=a or g
atgattctacgattctgtaagagggaaaaactgtgnttttctgatttcatctgaacttctatcattttttg

SEQ ID NO: 8674 - DNA, 71 bp, chicken (Gallus Gallus)
  misc_feature (36): n=a or c
gtgacccttccacatggtcttcccttctgaaggggntgatccatggggattctcctttttgaacacacaga

SEQ ID NO: 8675 - DNA, 71 bp, chicken (Gallus Gallus)
  misc_feature (36): n=c or t
tccctgagactttccacgttggttctgaagcgtgcnccaaggctggtttctcactgttgtattgcaagatg

SEQ ID NO: 8676 - DNA, 71 bp, chicken (Gallus Gallus)
  misc_feature (36): n=c or t
acacagtgggtacaaattaggcggaattcccctacncaccctggtccccagacctctagcatcccatcccc

SEQ ID NO: 8677 - DNA, 71 bp, chicken (Gallus Gallus)
  misc_feature (36): n=a or g
taaattgctgataaggaagggtaatgcttgcttctngtcacttcttacagtttaatttaactgtacctcta

SEQ ID NO: 8678 - DNA, 71 bp, chicken (Gallus Gallus)
  misc_feature (36): n=c or t
ttaaaatgggtaaatgcacacaggcccagtaaggtngagaaggtcaaaaccttattctctaaggaaatgaa

SEQ ID NO: 8679 - DNA, 71 bp, chicken (Gallus Gallus)
  misc_feature (36): n=c or t
acagaaaacagatatccagcttcttggccttgcttntgtttttgagcgaggatgggcacagctcttagtgc

SEQ ID NO: 8680 - DNA, 71 bp, chicken (Gallus Gallus)
  misc_feature (36): n=c or g
ttccaattctgactcatgaagagagacagggactgnagaaagctatgctgccaccgtcatggagaattctc

SEQ ID NO: 8681 - DNA, 71 bp, chicken (Gallus Gallus)
  misc_feature (36): n=a or g
aatacctataagcattaggaagatgtggccatctgnagcagaaggtatatgtgctaggacagagtaacaga

SEQ ID NO: 8682 - DNA, 71 bp, chicken (Gallus Gallus)
  misc_feature (36): n=a or g
aagatgttcaggccatcatataatgttagtcagacntgaatacaaggtgctgtcagccagtgggagcctgg

SEQ ID NO: 8683 - DNA, 71 bp, chicken (Gallus Gallus)
  misc_feature (36): n=a or g
tgtttgctgcacggttaacggctgcttcaaacagcncccaagtaatttccaaatgacatatcccctcttgg

SEQ ID NO: 8684 - DNA, 71 bp, chicken (Gallus Gallus)
  misc_feature (36): n=g or t
tccattgtgtggaaggcaatctagtagaccagactnctacagctttagcatcctgctgagcagggttctca

SEQ ID NO: 8685 - DNA, 71 bp, chicken (Gallus Gallus)
  misc_feature (36): n=a or g
cagctaggcagtcgaactacttcttgtcaaagttcntgtttgtggtgtgactgtgggagaggactagctta

SEQ ID NO: 8686 - DNA, 71 bp, chicken (Gallus Gallus)
  misc_feature (36): n=a or g
cagtgtttttcctgcaatgttagatacacagtctgnagagactgtctttttctgccagctgagaaaagtct

SEQ ID NO: 8687 - DNA, 71 bp, chicken (Gallus Gallus)
  misc_feature (36): n=a or c
actacttctaatcagcacgtgaaattttagcatcantatgagtttagctaaagctggagcataaagggaaa

SEQ ID NO: 8688 - DNA, 71 bp, chicken (Gallus Gallus)
  misc_feature (36): n=c or t
cacaactaaatccgagacaattgaaatattttaagntacagctcagtttctgccacacatcatttgtgtga

SEQ ID NO: 8689 - DNA, 71 bp, chicken (Gallus Gallus)
  misc_feature (36): n=a or g
cttcagtccaggatctgtcccatgctaagtctagangctgtacgagcagcacatcccatgtcacccaacgt

SEQ ID NO: 8690 - DNA, 71 bp, chicken (Gallus Gallus)
  misc_feature (36): n=c or t
cagcaacacttcctgagtcttccaaatcaagaattnatcctaagtgttttgtttgctcatatatagcctcc

SEQ ID NO: 8691 - DNA, 71 bp, chicken (Gallus Gallus)
  misc_feature (36): n=a or c
acaacttagggcagcttacctaaatatttgtagtgnactacatcaactgctgattggaagaaaattgggaa

SEQ ID NO: 8692 - DNA, 71 bp, chicken (Gallus Gallus)
  misc_feature (36): n=a or g
atctttgaaagagtcagaccttgcaagttttctccntctcagctgcagaacccaagacggagagctcacat

SEQ ID NO: 8693 - DNA, 71 bp, chicken (Gallus Gallus)
  misc_feature (36): n=a or g
ctatggacttcaagattaaagatttgattcagactnggtaaaatacagaactaaaacaggactaaacaact

SEQ ID NO: 8694 - DNA, 71 bp, chicken (Gallus Gallus)
  misc_feature (36): n=a or c
tgaattgttatcatcttttctcatagcatgaatttnttgaatgaacagctctcactcaccttcctaaaaag

SEQ ID NO: 8695 - DNA, 71 bp, chicken (Gallus Gallus)
  misc_feature (36): n=a or g
gaaattcagtgcttcgtgttagaggaacacaagtgnctaataaacaacccagcatgggcagaggatagata

SEQ ID NO: 8696 - DNA, 71 bp, chicken (Gallus Gallus)
  misc_feature (36): n=a or g
atttctctgcatgcagattcacccacaacacaagancattggaagtgcagcttacagatatttcactttta

SEQ ID NO: 8697 - DNA, 71 bp, chicken (Gallus Gallus)
  misc_feature (36): n=c or t
acataagtgcagcaaaatggaatcaaagatcatgcntgtttatttaacacttactgagatagatattgctg

SEQ ID NO: 8698 - DNA, 71 bp, chicken (Gallus Gallus)
  misc_feature (36): n=a or g
gagctagggccttagcagataacagggattaaaccnaagagaaaaggaagtactgttaagactgcaagtct

SEQ ID NO: 8699 - DNA, 71 bp, chicken (Gallus Gallus)
  misc_feature (36): n=a or g
tgttttgtacgttgtgagaaaattgcagaattgcanaaacagtttgggctggaaaagactttaaagacctt

SEQ ID NO: 8700 - DNA, 71 bp, chicken (Gallus Gallus)
  misc_feature (36): n=a or g
aaaaacaagattaggtgaaatatagttctagtagcncacagaggcaaaagagacataaaaagaatatatga

SEQ ID NO: 8701 - DNA, 71 bp, chicken (Gallus Gallus)
  misc_feature (36): n=a or g
caaagggaaatctttctttaacagggaacttgttcntggttatggttaaaacaaacttggaaacctttgaa

SEQ ID NO: 8702 - DNA, 71 bp, chicken (Gallus Gallus)
  misc_feature (36): n=c or t
tcagatggtaattggtttttctagaaaggaattttntgcagtgtattcttttgtgcctagatacttcagag

SEQ ID NO: 8703 - DNA, 71 bp, chicken (Gallus Gallus)
  misc_feature (36): n=a or g
accacttcattacaatgcgaaatgatagcataaggncattgctgtgaaatatgattgctttagattgctct

SEQ ID NO: 8704 - DNA, 71 bp, chicken (Gallus Gallus)
  misc_feature (36): n=c or t
cagactcacagggattctgttagggaatgttttggncatcacctatgttgccagaataacttgtacagcac

SEQ ID NO: 8705 - DNA, 71 bp, chicken (Gallus Gallus)
  misc_feature (36): n=a or g
aggctctgctcatgtcccacaggcagttggttagcntttgggcactcctgtacgtcctcatcctcatctcg

SEQ ID NO: 8706 - DNA, 71 bp, chicken (Gallus Gallus)
  misc_feature (36): n=a or g
ggagcttttaggttggtactggagccagtgaaccantctgtgccttctatagactacgatatttgaaaaaa

SEQ ID NO: 8707 - DNA, 71 bp, chicken (Gallus Gallus)
  misc_feature (36): n=c or t
aagtcaacatttcagagatgccagcagagttattcnctaggttagcaatataccaccagtgtcagcagcat

SEQ ID NO: 8708 - DNA, 71 bp, chicken (Gallus Gallus)
  misc_feature (36): n=a or g
ggcatttctgtgacactgatcaatgctgacacacanatctgtctgcatgtatgagtctagaaaggccagtg

SEQ ID NO: 8709 - DNA, 71 bp, chicken (Gallus Gallus)
  misc_feature (36): n=a or g
gatcttcaactcatattgccttatataattagtatncttatgtcactgccctgttcagctcatgccctata

SEQ ID NO: 8710 - DNA, 71 bp, chicken (Gallus Gallus)
  misc_feature (36): n=a or g
caatgaaacgtcctgtatctttctgctgctgttagnaacctttcatattgcagaactagaaagacattata

SEQ ID NO: 8711 - DNA, 71 bp, chicken (Gallus Gallus)
  misc_feature (36): n=c or t
tatacctatttcaatttaaggagtactgttgtaggnattcattcaaactgaaaaaaggttgcacacgtgag

SEQ ID NO: 8712 - DNA, 71 bp, chicken (Gallus Gallus)
  misc_feature (36): n=a or g
gataaaggttcatcttattacttcaaagacattaanggaggaaaaatctcttttatactagtctagagagt

SEQ ID NO: 8713 - DNA, 71 bp, chicken (Gallus Gallus)
  misc_feature (36): n=c or t
tagtaacaatttgtgtgggagacactatgggatgcntccctactaaggtaacagagccatgtcaacctgtt

SEQ ID NO: 8714 - DNA, 71 bp, chicken (Gallus Gallus)
  misc_feature (36): n=a or c
taatctatcagagtaacatatcatgcctttctccantgcaacttgaaatctgagattcagtatgacactcc

SEQ ID NO: 8715 - DNA, 71 bp, chicken (Gallus Gallus)
  misc_feature (36): n=a or g
gtgtagtgttgatcattgcaaaatttggcattttcnggcctattcactaaaaggaatcccacaacatttgt

SEQ ID NO: 8716 - DNA, 71 bp, chicken (Gallus Gallus)
  misc_feature (36): n=a or g
cactggcaaataccaactcagtaactatgatttganaacagcagggtgcatagaagaaagaggactggcac

SEQ ID NO: 8717 - DNA, 71 bp, chicken (Gallus Gallus)
  misc_feature (36): n=a or g
taaaataatgaattcctaaaatccataagttgccantaaaataatgacatagtagatgtttctacaaagta

SEQ ID NO: 8718 - DNA, 71 bp, chicken (Gallus Gallus)
  misc_feature (36): n=a or g
ttatcttgtaatttttcagctatgattttgagacanggatttgcagtctttgtagtaagatttgctccagc

SEQ ID NO: 8719 - DNA, 71 bp, chicken (Gallus Gallus)
  misc_feature (36): n=c or t
tggttaatgttcattatatttgcaaggaactctganacatgaaagaaaatgttaagggatattgaccagct

SEQ ID NO: 8720 - DNA, 71 bp, chicken (Gallus Gallus)
  misc_feature (36): n=a or g
ttcagtctacaacgtgcctttagaaagaaaccaggnttaaacgatacacaacatgtagtacttcagccacc

SEQ ID NO: 8721 - DNA, 71 bp, chicken (Gallus Gallus)
  misc_feature (36): n=c or t
tcgtaagtaaacagtgaaagttttgtttaagggaanatttggaagaatagcgtttccctgtcttataggtc

SEQ ID NO: 8722 - DNA, 71 bp, chicken (Gallus Gallus)
  misc_feature (36): n=a or g
acaagtactgctctggctttaccttacttcatctanaagaactgactattttagtttcccttctctgtaat

SEQ ID NO: 8723 - DNA, 71 bp, chicken (Gallus Gallus)
  misc_feature (36): n=a or g
aaagaggaaaacgtgaagcgggacgtgaaaagctgngagcgggagggggcaagagggaacggggaagccgg

SEQ ID NO: 8724 - DNA, 71 bp, chicken (Gallus Gallus)
  misc_feature (36): n=c or t
aagtttatttttaatactgttctgttatctgatggnagaaaacactggatggatgacttacaaatgtttcc

SEQ ID NO: 8725 - DNA, 71 bp, chicken (Gallus Gallus)
  misc_feature (36): n=c or t
cttattgccactgctcatttgaatccctctgactangctagtggtttttgaatatatcttcagtttaatca

SEQ ID NO: 8726 - DNA, 71 bp, chicken (Gallus Gallus)
  misc_feature (36): n=a or g
aaaataatgactataagggaatgagaaatatatacntttaagaaatctcagaaaataattctggtgtccca

SEQ ID NO: 8727 - DNA, 71 bp, chicken (Gallus Gallus)
  misc_feature (36): n=c or t
gattccctgtaaaatattatgcacatttatccattnatgaacctgtaatctgacaaggatgctgtaagaat

SEQ ID NO: 8728 - DNA, 71 bp, chicken (Gallus Gallus)
  misc_feature (36): n=a or c
ccaactcctggttccacacagcaccaaccaaaattnagagcctgtgtctgagagcactgtccaaaagattc

SEQ ID NO: 8729 - DNA, 71 bp, chicken (Gallus Gallus)
  misc_feature (36): n=a or c
cactgactggtttggccactgaagtcctggactgcnacctttggccccaaattagatattttccctaccca

SEQ ID NO: 8730 - DNA, 71 bp, chicken (Gallus Gallus)
  misc_feature (36): n=a or c
gtttcttcttctctgcttttagggtgttcccacatnctgctttcaagctcttctctttcagaaactctaaa

SEQ ID NO: 8731 - DNA, 71 bp, chicken (Gallus Gallus)
  misc_feature (36): n=g or t
gaatgaacaggggttgggactggagcatacaatatntgcttccatttaaagctctacagaatttgcactgc

SEQ ID NO: 8732 - DNA, 71 bp, chicken (Gallus Gallus)
  misc_feature (36): n=c or t
gctaccaagattattacagccatatcatataacttntgcacacatgcagatagcacaatacactgtgaaga

SEQ ID NO: 8733 - DNA, 71 bp, chicken (Gallus Gallus)
  misc_feature (36): n=c or t
tttatcaagactagcctcaactctgtctttcaattnaagttaatcccctgctaagtaaagaagaccaacat

SEQ ID NO: 8734 - DNA, 71 bp, chicken (Gallus Gallus)
  misc_feature (36): n=a or g
tgtgccagagaagtacttaaaccactaataatgtgnctaagtgttgagtctgtcagcgttcatctaattac

SEQ ID NO: 8735 - DNA, 71 bp, chicken (Gallus Gallus)
  misc_feature (36): n=c or t
taggttggctttaagcagcaaactataatctattcngacttgaaaaagaatttgattgttttcctgacagt

SEQ ID NO: 8736 - DNA, 71 bp, chicken (Gallus Gallus)
  misc_feature (36): n=a or t
aggcagacccccgaattgggaaatgctatctcacanaagagtccacaattgtcttatagtggagtcatttc

SEQ ID NO: 8737 - DNA, 71 bp, chicken (Gallus Gallus)
  misc_feature (36): n=a or g
aagccatgttgttttcctcattctctccatttcctnccctttttcaatctgatgaaataatgccataattg

SEQ ID NO: 8738 - DNA, 71 bp, chicken (Gallus Gallus)
  misc_feature (36): n=a or g
atgcaataaatcacaggtgttagtttaattttttanttaattcataattattatataattttaaaattgag

SEQ ID NO: 8739 - DNA, 71 bp, chicken (Gallus Gallus)
  misc_feature (36): n=c or t
taactaacataattttcactaatcagttgagacttncaggccaaataatgccactatggtattattaatga

SEQ ID NO: 8740 - DNA, 71 bp, chicken (Gallus Gallus)
  misc_feature (36): n=c or t
ttcatatgttttcatttcttacattgtgggagatanatccattcttacaatgttgctggagtcctctaaat

SEQ ID NO: 8741 - DNA, 71 bp, chicken (Gallus Gallus)
  misc_feature (36): n=g or t
tttactttttctgagtcctctctttgaactttcaancaacaggaatgccaactgaaattaattccaggtaa

SEQ ID NO: 8742 - DNA, 71 bp, chicken (Gallus Gallus)
  misc_feature (36): n=a or g
atgcagagaaatgaacagattatctgagcaggatgngtatgtctcaacacaagaagacatgacagaagtcc

SEQ ID NO: 8743 - DNA, 71 bp, chicken (Gallus Gallus)
  misc_feature (36): n=a or g
atatagttcatgtcaatagaaagtactgaatgaccnttagagttaggcacacttacacagaactagtgaca

SEQ ID NO: 8744 - DNA, 71 bp, chicken (Gallus Gallus)
  misc_feature (36): n=g or t
aaagctgcctcacctatcctttcaacatgggttaanaatccagagatgtgtttagcctcattctaaacaca

SEQ ID NO: 8745 - DNA, 71 bp, chicken (Gallus Gallus)
  misc_feature (36): n=a or c
tcttgtccctcccgctgcttgcccatgtctaaattnaacacaaaatgccaaagtgggtttgtgcatatggt

SEQ ID NO: 8746 - DNA, 71 bp, chicken (Gallus Gallus)
  misc_feature (36): n=c or t
agctgtggatgttcataattgtggacactccaggtncagaagagaacagtcaatatgtggatgtgtagcct

SEQ ID NO: 8747 - DNA, 71 bp, chicken (Gallus Gallus)
  misc_feature (36): n=a or g
ccaaaccagtgcatccaggtttggactccactgccngtcattctccttgcagaccgcctggccttcagcag

SEQ ID NO: 8748 - DNA, 71 bp, chicken (Gallus Gallus)
  misc_feature (36): n=a or c
gtacaacacagcccaggactgaacagcagcaggagnaaatctagagaacaaacagacattctattacactg

SEQ ID NO: 8749 - DNA, 71 bp, chicken (Gallus Gallus)
  misc_feature (36): n=g or t
acagctgagactaatattttgaaggaaggcatgcanttactgtggctgagatggagtctcaggaccaaaac

SEQ ID NO: 8750 - DNA, 71 bp, chicken (Gallus Gallus)
  misc_feature (36): n=c or t
atttacatgagtgggaaatgagtcaaagaagagttnagttaaagctgtgtttcatcctgcttgactcaagt

SEQ ID NO: 8751 - DNA, 71 bp, chicken (Gallus Gallus)
  misc_feature (36): n=a or c
acatgcactcacaaaaagtattctccagctacgttnatctgtgaaaataggagtaagttcctccttgtgcc

SEQ ID NO: 8752 - DNA, 71 bp, chicken (Gallus Gallus)
  misc_feature (36): n=c or t
tatctcccaagatgggaaaacttgttcttttaatangtggttacttgaagatgtaatagctaaattagctg

SEQ ID NO: 8753 - DNA, 71 bp, chicken (Gallus Gallus)
  misc_feature (36): n=c or t
ccttcttgtatgttgggtgagatttattgacgtganttgagtaagaggtacatcttagaataatcaaggca

SEQ ID NO: 8754 - DNA, 71 bp, chicken (Gallus Gallus)
  misc_feature (36): n=a or g
tacaaggaggcagagagaaatatcataaatggttanagtacaagggaaattgcagccatggagggccattg

SEQ ID NO: 8755 - DNA, 71 bp, chicken (Gallus Gallus)
  misc_feature (36): n=a or g
gcatagctttcctccgtgtcacccagcataatacantaagctatactatactccatataaataaataaatc

SEQ ID NO: 8756 - DNA, 71 bp, chicken (Gallus Gallus)
  misc_feature (36): n=c or t
caccaggccctgacctgactccttagctcagtgcancagcctgcatagaggcctagcctcaaatcaaggcc

SEQ ID NO: 8757 - DNA, 71 bp, chicken (Gallus Gallus)
  misc_feature (36): n=a or g
aaaaagttatctcacattctgagctttaaaagcagnagaagagtaactgttgcagtccctaaccaaaactg

SEQ ID NO: 8758 - DNA, 71 bp, chicken (Gallus Gallus)
  misc_feature (36): n=a or g
gccagaaatcacaggattaaagttcagtgtcaaagntggcaaagtactaagagtgttcgaataactgttat

SEQ ID NO: 8759 - DNA, 71 bp, chicken (Gallus Gallus)
  misc_feature (36): n=c or t
ccaggaaacaaacaccaagcaaaaaaaaacccaacnaataactcacaaataaacaaattcaaccataaagt

SEQ ID NO: 8760 - DNA, 71 bp, chicken (Gallus Gallus)
  misc_feature (36): n=c or t
tgagtccaaacccctgctaaagcagttctctacagncagttgcacaaataagcatccagacaagtcttgaa

SEQ ID NO: 8761 - DNA, 71 bp, chicken (Gallus Gallus)
  misc_feature (36): n=c or t
tgaaaaactgagacaatccttgatatgtttgagtanagtgttaattcatcatggctttttagctaaattca

SEQ ID NO: 8762 - DNA, 71 bp, chicken (Gallus Gallus)
  misc_feature (36): n=g or t
gatggatgttggaccctttgtccagaagaatactgngaaagacagcactgaaaattttgctgaaatccaaa

SEQ ID NO: 8763 - DNA, 71 bp, chicken (Gallus Gallus)
  misc_feature (36): n=a or g
tttcacgttttgatagtacagctatatttctgtccnggaggttttgctttctagcagtgttgccacgtacc

SEQ ID NO: 8764 - DNA, 71 bp, chicken (Gallus Gallus)
  misc_feature (36): n=a or g
cgtgcacattattatatcctatacacaaggcacagncattttaaagtatttcaataattagtaaaggaaaa

SEQ ID NO: 8765 - DNA, 71 bp, chicken (Gallus Gallus)
  misc_feature (36): n=c or t
cattcctgagcattatatttttagagaagacagtgnttgggtgtggtaggactatagatagatatataaat

SEQ ID NO: 8766 - DNA, 71 bp, chicken (Gallus Gallus)
  misc_feature (36): n=a or g
tttccagctgcagctccactgtgtagataacatggnaatccctgaacagttctggaaaacacaggggcttt

SEQ ID NO: 8767 - DNA, 71 bp, chicken (Gallus Gallus)
  misc_feature (36): n=c or t
cagtaatgtagtgctgtgatcactcaagaaagtatnagtcatttttaatttttttttttgttgagaggaga

SEQ ID NO: 8768 - DNA, 71 bp, chicken (Gallus Gallus)
  misc_feature (36): n=c or t
aacattaaatggcaaatcctacagttcacagagtangatatactattgtctttaagaaaatacagtacaag

SEQ ID NO: 8769 - DNA, 71 bp, chicken (Gallus Gallus)
  misc_feature (36): n=a or g
cataggaaacttccaaataatggagatgaacatgancctcgcctaagtaacttcctcttttctgggcactc

SEQ ID NO: 8770 - DNA, 71 bp, chicken (Gallus Gallus)
  misc_feature (36): n=c or t
aggagactcactggctgtatgcttgtagcctgatangtggattttctcaactcttttcagtgtctaggagc

SEQ ID NO: 8771 - DNA, 71 bp, chicken (Gallus Gallus)
  misc_feature (36): n=a or g
cctaaaaatacttctggttctcagaaggtcatcatntttgagaaagaagctagtaatttatataactggtt

SEQ ID NO: 8772 - DNA, 71 bp, chicken (Gallus Gallus)
  misc_feature (36): n=c or t
aactctggaaaatggtgaattgcaagtgttggctangatgcaggtttagttcatgatttgttctcattgca

SEQ ID NO: 8773 - DNA, 71 bp, chicken (Gallus Gallus)
  misc_feature (36): n=c or t
ttggtcgctatttctggcccatttttgtggttgctngacctaaccattttccatctcattacaacacagat

SEQ ID NO: 8774 - DNA, 71 bp, chicken (Gallus Gallus)
  misc_feature (36): n=g or t
tgggttggccacaggacatttccctggcaaacccanagtaaaatttgggataccaatatctactccagtat

SEQ ID NO: 8775 - DNA, 71 bp, chicken (Gallus Gallus)
  misc_feature (36): n=a or c
gttctttgggcattcatctgcagcagttcattcagnagcagttgttgctggagttgcttgcttggtgaagc

SEQ ID NO: 8776 - DNA, 71 bp, chicken (Gallus Gallus)
  misc_feature (36): n=c or t
gctaaggttagctttaacgtgtgcaacctgtgctancttcactgctacacttgtagtgcatcaggccgtac

SEQ ID NO: 8777 - DNA, 71 bp, chicken (Gallus Gallus)
  misc_feature (36): n=c or t
atttctttctaaagtctagactaagtctacctgctntcagtttaaaaccatttctcctcatcctgttgctc

SEQ ID NO: 8778 - DNA, 71 bp, chicken (Gallus Gallus)
  misc_feature (36): n=a or t
cagtataagaaggaatctcactgccttcagctctanttttatcctgctgaacttgtcaaaaacaaaaaagg

SEQ ID NO: 8779 - DNA, 71 bp, chicken (Gallus Gallus)
  misc_feature (36): n=a or g
gactgggctaccaaactctcagggcttcaggacaantatggctgttttagttactcaactaatatcaattt

SEQ ID NO: 8780 - DNA, 71 bp, chicken (Gallus Gallus)
  misc_feature (36): n=a or t
acttgactgttaactaagaacaatatattccaggtncctttttagacacacagacaacatggaaaatctag

SEQ ID NO: 8781 - DNA, 71 bp, chicken (Gallus Gallus)
  misc_feature (36): n=c or t
tgtcaaactatactggctttcatagctcttaattcngagctacaagcaagaggaagataagattgaagaac

SEQ ID NO: 8782 - DNA, 71 bp, chicken (Gallus Gallus)
  misc_feature (36): n=a or t
aataatcatttttaggcaaagaatttatgctttttngaaccagagataaatatatttcactttctcagaag

SEQ ID NO: 8783 - DNA, 71 bp, chicken (Gallus Gallus)
  misc_feature (36): n=a or g
ttttggtgcctcctgtcctgcccgggcagaaatgtnctttatttccttgtgtgggtgctctcagagttgct

SEQ ID NO: 8784 - DNA, 71 bp, chicken (Gallus Gallus)
  misc_feature (36): n=c or t
cgggtgaaaactattgcacgacatctggtccgtggnctaaagaacacgcttgttcacaggtaaggacttgt

SEQ ID NO: 8785 - DNA, 71 bp, chicken (Gallus Gallus)
  misc_feature (36): n=c or t
aataaaatgccagcaccatgggctaatacgaccaangtgcacaagctcttacagttcctagagaccactct

SEQ ID NO: 8786 - DNA, 71 bp, chicken (Gallus Gallus)
  misc_feature (36): n=a or t
aaagctcaaagggaagaaaatctaagattaaagatngattcaccaagctttattttcctttccagtttaat

SEQ ID NO: 8787 - DNA, 71 bp, chicken (Gallus Gallus)
  misc_feature (36): n=a or g
cagttgagcaagcttggctccctcttccatgacacngggtaatgaattaggctaaaatgatttccctgttg

SEQ ID NO: 8788 - DNA, 71 bp, chicken (Gallus Gallus)
  misc_feature (36): n=g or t
ccccacaacttgtcttgcacggtcacatgatttatntcagacatggggtgctcttttgagactgagaatga

SEQ ID NO: 8789 - DNA, 71 bp, chicken (Gallus Gallus)
  misc_feature (36): n=c or t
tcctcttgctgtgtggaagtggcttagcaagacagntgaagtttcttttctctttggcacgtagtagcact

SEQ ID NO: 8790 - DNA, 71 bp, chicken (Gallus Gallus)
  misc_feature (36): n=a or g
gaatcactgcaaaaagagtgtgtcatctagatatcnctgtcatcatgctgtatttctcttcacattttagg

SEQ ID NO: 8791 - DNA, 71 bp, chicken (Gallus Gallus)
  misc_feature (36): n=c or t
ggttccctctaagaggtttatttacaaatgccacantcctcataaacagctaaataacttgttttcttgtt

SEQ ID NO: 8792 - DNA, 71 bp, chicken (Gallus Gallus)
  misc_feature (36): n=a or t
gtgaaaagtaaagaactgtgtgtgatgaaaagaagnaaaacagactgttaacctcccaatttttgagtggg

SEQ ID NO: 8793 - DNA, 71 bp, chicken (Gallus Gallus)
  misc_feature (36): n=a or c
aaggcatccacggtgaaaatctgtgtaacgtgtaanccttccaaaaactgacgtgttgattagtttagtac

SEQ ID NO: 8794 - DNA, 71 bp, chicken (Gallus Gallus)
  misc_feature (36): n=a or g
atgtgggttagattttcagatatgctgatgtaactnttgatacaatgaggctccgaatctcatcctaatca

SEQ ID NO: 8795 - DNA, 71 bp, chicken (Gallus Gallus)
  misc_feature (36): n=c or t
gcgacttgttacaaatgaaattgtgtaacttcatgnggaaattacaatatttggggttacagtcttgaggt

SEQ ID NO: 8796 - DNA, 71 bp, chicken (Gallus Gallus)
  misc_feature (36): n=a or t
agaaccagttttaacaaccatagtgaagtaggaacngtcacaaaatcagctgctgcctttcatcctaggca

SEQ ID NO: 8797 - DNA, 71 bp, chicken (Gallus Gallus)
  misc_feature (36): n=g or t
taatgcagcttccttttggatgatcatccctctatnctttgaatagtgtgcaggcaagcaattgctcctca

SEQ ID NO: 8798 - DNA, 71 bp, chicken (Gallus Gallus)
  misc_feature (36): n=c or t
tcattagtcatgtgttaggctcttattattgttcantcatatcagcaaaaactcatttatatttggctaag

SEQ ID NO: 8799 - DNA, 71 bp, chicken (Gallus Gallus)
  misc_feature (36): n=a or g
gcaataaggactttatatcattcttttttatctatntagttcttttgttagaatgtttaaagtgctcttag

SEQ ID NO: 8800 - DNA, 71 bp, chicken (Gallus Gallus)
  misc_feature (36): n=a or g
cttcctgctttttgggttttttttgtttgtttaagntaacttacggtatcaaaattctatttttcttggaa

SEQ ID NO: 8801 - DNA, 71 bp, chicken (Gallus Gallus)
  misc_feature (36): n=c or t
cattcattaaattgttcttattttttgctactgcangctagctgccatgggttggttttcttcaccataac

SEQ ID NO: 8802 - DNA, 71 bp, chicken (Gallus Gallus)
  misc_feature (36): n=g or t
tacattccggagaaaagatgtaccgtgaaacagaancaattattgataataccggatataccttgtatgat

SEQ ID NO: 8803 - DNA, 71 bp, chicken (Gallus Gallus)
  misc_feature (36): n=c or g
cacaagtacagattgcattgtgatgaaagaaggaanccgagaaaagacagggaacagatctcagatgtttc

SEQ ID NO: 8804 - DNA, 71 bp, chicken (Gallus Gallus)
  misc_feature (36): n=c or t
ctgtcacatatttcagaaacattcaaagactgtcangtcaaaagttcttcagtattatggaacagccctca

SEQ ID NO: 8805 - DNA, 71 bp, chicken (Gallus Gallus)
  misc_feature (36): n=a or c
tgaatcctatgctttagtagacaaaatgtcttccangtacactgtaaaacaaatgataccagcatatcttt

SEQ ID NO: 8806 - DNA, 71 bp, chicken (Gallus Gallus)
  misc_feature (36): n=a or g
gaaaggattgagcacagctctaatgaaaaagacctnggggtactgctggatgggaagttggatatgagcca

SEQ ID NO: 8807 - DNA, 71 bp, chicken (Gallus Gallus)
  misc_feature (36): n=a or g
acaccagatatagctttgactactgtcgacttcccntgggctacgtggccaattgtacctacgttttaaag

SEQ ID NO: 8808 - DNA, 71 bp, chicken (Gallus Gallus)
  misc_feature (36): n=g or t
ctggagatcctctagtccaacccccatgaaggtaanctcctggaaataccagtagagcccaagaaagctgc

SEQ ID NO: 8809 - DNA, 71 bp, chicken (Gallus Gallus)
  misc_feature (36): n=a or c
cctaacgctagataaggtcttcaacttaaattctanaaccagacttgaaagtttaatgggttcactcagtc

SEQ ID NO: 8810 - DNA, 71 bp, chicken (Gallus Gallus)
  misc_feature (36): n=c or t
caaaatgcatctacacctcgtttgtttgccccctgngagatttggccgctattctgcaaggtaattaataa

SEQ ID NO: 8811 - DNA, 71 bp, chicken (Gallus Gallus)
  misc_feature (36): n=a or t
cattttaaatgtccaaacaaagcttttaaaggaaantcggcaatgcagaccactgtagtagccacagaggg

SEQ ID NO: 8812 - DNA, 71 bp, chicken (Gallus Gallus)
  misc_feature (36): n=a or g
cagcggggacagagtgaagaaatgcacacaaagacnggggaacatttgtgacaattcagtctagcaaacat

SEQ ID NO: 8813 - DNA, 71 bp, chicken (Gallus Gallus)
  misc_feature (36): n=c or t
cattgctcacaaaggcttaaattactccatagtaancaacagaggtaatggccaatgtgttcgttatctgc

SEQ ID NO: 8814 - DNA, 71 bp, chicken (Gallus Gallus)
  misc_feature (36): n=c or t
attgcaggtcagaactttctcagaacttttaagccnaaagctaacaaaggcagaaacactttccaggcttt

SEQ ID NO: 8815 - DNA, 71 bp, chicken (Gallus Gallus)
  misc_feature (36): n=a or g
ttactctttttcttccatgaagaaggaaattttcantttgcataataaactcttgagtgtttgggcagcat

SEQ ID NO: 8816 - DNA, 71 bp, chicken (Gallus Gallus)
  misc_feature (36): n=a or g
atatatatttaatattgtctttgcatagatgttatnttggggataacagggtccatttctgctggactttc

SEQ ID NO: 8817 - DNA, 71 bp, chicken (Gallus Gallus)
  misc_feature (36): n=a or c
gcccttcctatctgtggaatgcttctaaagtcttanaactttttatgaactgatttgtaaatacaatctta

SEQ ID NO: 8818 - DNA, 71 bp, chicken (Gallus Gallus)
  misc_feature (36): n=c or t
atttcttcaggttgcttaaaagtgcgctgggcaaantgacagaactcattatctctgcgatcaacacaggt

SEQ ID NO: 8819 - DNA, 71 bp, chicken (Gallus Gallus)
  misc_feature (36): n=c or t
tgtttttggcgttttctcatggagcaacataaggtntgaaagaaggtgacactgatgtagcaaaagaaaca

SEQ ID NO: 8820 - DNA, 71 bp, chicken (Gallus Gallus)
  misc_feature (36): n=a or c
ttctggaagttgctctcatcaactgtttcctgtgantgctagaaaactttaatgtaaagatagtgtaaaat

SEQ ID NO: 8821 - DNA, 71 bp, chicken (Gallus Gallus)
  misc_feature (36): n=c or t
ataccctcaatgaagcccaccagaggctgttatctnaggtccttgagaatatgcatttaagaggcatgtta

SEQ ID NO: 8822 - DNA, 71 bp, chicken (Gallus Gallus)
  misc_feature (36): n=a or c
aaaacaaacaagaaagaaacaacacaaagaaatcanagaatcacaggatatcccaagttggaagggacgtg

SEQ ID NO: 8823 - DNA, 71 bp, chicken (Gallus Gallus)
  misc_feature (36): n=c or g
tcagcggtgaaactgacttgccatgaactgtttttntaccaaaatccatctgtggttttggcatgaaaacc

SEQ ID NO: 8824 - DNA, 71 bp, chicken (Gallus Gallus)
  misc_feature (36): n=g or t
ccaaaggtgtggaacaaaaatggtcgaagacaaagntgctctctatgtgacccttggctgtgatcaggggg

SEQ ID NO: 8825 - DNA, 71 bp, chicken (Gallus Gallus)
  misc_feature (36): n=a or g
ttctgtatggaaatacactccccatgagagttctgngaaggctttcaggaaattggagcaaacagttttgt

SEQ ID NO: 8826 - DNA, 71 bp, chicken (Gallus Gallus)
  misc_feature (36): n=a or g
aagcctttatattttatctaaactagagcacttgcnaaacaaatgtatgattctactcacatagacttgga

SEQ ID NO: 8827 - DNA, 71 bp, chicken (Gallus Gallus)
  misc_feature (36): n=a or g
acaagaatatgcacccatttctcgttgcataccacntcacagtgcccactgtgttacagcttgtttccttg

SEQ ID NO: 8828 - DNA, 71 bp, chicken (Gallus Gallus)
  misc_feature (36): n=c or t
tctgacagctcttttgccaaatgcagattggcagancaaggtcttggcttaggaaaccttcccatctgatt

SEQ ID NO: 8829 - DNA, 71 bp, chicken (Gallus Gallus)
  misc_feature (36): n=c or t
tctcctcctacctttctatgatgctctaacttggcngttgcaggttttatttttgcaccaaagagtttagg

SEQ ID NO: 8830 - DNA, 71 bp, chicken (Gallus Gallus)
  misc_feature (36): n=g or t
ttgaacgtagatattgcagttcaattaggaacacangagagcgtagaggtttgtgggtttcttgttatttt

SEQ ID NO: 8831 - DNA, 71 bp, chicken (Gallus Gallus)
  misc_feature (36): n=a or g
ctttagtctactcattcagacctgtatgttttctanaagagattttcatttttccttttgactgtcctatt

SEQ ID NO: 8832 - DNA, 71 bp, chicken (Gallus Gallus)
  misc_feature (36): n=a or g
agaaagaaaagaggagggattatatctctgaatgcnaagcttattttctctgatcccaagtcactggaggg

SEQ ID NO: 8833 - DNA, 71 bp, chicken (Gallus Gallus)
  misc_feature (36): n=a or c
cctctgcctggctctcagccagcatttctcatcctncttcagtacgcggaggctttactgtttttttagga

SEQ ID NO: 8834 - DNA, 71 bp, chicken (Gallus Gallus)
  misc_feature (36): n=a or g
tgtccacttcagttttattaatgctttctactgccngtcctgcagagccagtagaagaatggattctttcc

SEQ ID NO: 8835 - DNA, 71 bp, chicken (Gallus Gallus)
  misc_feature (36): n=c or t
aaagtgaggatttcgtgtatgtttaaataacgtacnagcctggaaattgtgctggctcagctgagctgccc

SEQ ID NO: 8836 - DNA, 71 bp, chicken (Gallus Gallus)
  misc_feature (36): n=a or t
ggttggttcaattatgtcaatatctgtgacatatantcatcataaatatgctgctaaaagttaaatgtgac

SEQ ID NO: 8837 - DNA, 71 bp, chicken (Gallus Gallus)
  misc_feature (36): n=c or t
ttgaagccagtcagtctctcctctatgccctatatntatcatggagcagatcttgctaaaactgtgttcga

SEQ ID NO: 8838 - DNA, 71 bp, chicken (Gallus Gallus)
  misc_feature (36): n=a or g
actctgcagaggagatgtgagtggaggagaatgggnagaaggtagaaagatacagtgggctgaaatcagct

SEQ ID NO: 8839 - DNA, 71 bp, chicken (Gallus Gallus)
  misc_feature (36): n=c or t
acatggtgtggtaagagaagaggcaaaatgcactcngctgtattatgaataaatcaccgagaaagaaaacc

SEQ ID NO: 8840 - DNA, 71 bp, chicken (Gallus Gallus)
  misc_feature (36): n=c or t
gggggggtagttactgtacctcctttcaaatagccntttattcctgagatcttggtatgagtaaaacaagt

SEQ ID NO: 8841 - DNA, 71 bp, chicken (Gallus Gallus)
  misc_feature (36): n=a or g
cacctgaaaaggcaaaacatggatttgttggagaanctacaggtaaatgactaaagatcgcaaacttgtgg

SEQ ID NO: 8842 - DNA, 71 bp, chicken (Gallus Gallus)
  misc_feature (36): n=c or t
ctccttttaactgttatggctgagcaggatttattntttgtctcttgaaaccagccctgagctgatctacc

SEQ ID NO: 8843 - DNA, 71 bp, chicken (Gallus Gallus)
  misc_feature (36): n=c or t
gggcaaggtactttccaaagagacaacccctactangaagaacaggcattcttagcttaatattgctgtga

SEQ ID NO: 8844 - DNA, 71 bp, chicken (Gallus Gallus)
  misc_feature (36): n=c or t
acagatccatgtctctacacatttggatgcagtaanacagatgaggtctcactggaacagagtagaggggc

SEQ ID NO: 8845 - DNA, 71 bp, chicken (Gallus Gallus)
  misc_feature (36): n=a or t
gtaccttctcaagtgtttctatttccagaatataantaatcctcaaaagagaatatttacctaaaattatt

SEQ ID NO: 8846 - DNA, 71 bp, chicken (Gallus Gallus)
  misc_feature (36): n=a or g
ttcttttagtttaaaactgttttccttgtcttattnctacctgtccatgcatccattcacaaacagaaata

SEQ ID NO: 8847 - DNA, 71 bp, chicken (Gallus Gallus)
  misc_feature (36): n=a or g
tttttctaagtccatgtttgctgttagtgctgtgancatgaaattgttcaaaatactgcatgcaccaaaca

SEQ ID NO: 8848 - DNA, 71 bp, chicken (Gallus Gallus)
  misc_feature (36): n=c or t
tgaaattcaatggcttaaacccagctgccttttagncctcgtgatgtcctagactatgcagacaaggtgag

SEQ ID NO: 8849 - DNA, 71 bp, chicken (Gallus Gallus)
  misc_feature (36): n=c or t
acagtagttcccagttcatccacaccggtcttcttnccctacagcttgccttatggaacagcctgttcttg

SEQ ID NO: 8850 - DNA, 71 bp, chicken (Gallus Gallus)
  misc_feature (36): n=c or t
acaaacaaacaaataaaagtagtaattggatttcanggagtcctggtatttcaccctctgtggaagcaagg

SEQ ID NO: 8851 - DNA, 71 bp, chicken (Gallus Gallus)
  misc_feature (36): n=c or t
tttaagcacactgtgaggatatgcaagccaattcangacaaagatttttttacaaacagtataagcaggca

SEQ ID NO: 8852 - DNA, 71 bp, chicken (Gallus Gallus)
  misc_feature (36): n=a or c
accacaacttgattctgggttacattctaaaaaaancaatatatatattttctcctctgtttccagaaata

SEQ ID NO: 8853 - DNA, 71 bp, chicken (Gallus Gallus)
  misc_feature (36): n=g or t
atacagaagtactgtctaggggacctcaaattgaanaattttattagtataattactgatttctaagaaca

SEQ ID NO: 8854 - DNA, 71 bp, chicken (Gallus Gallus)
  misc_feature (36): n=c or t
acatgacaaaactttaaagttagctgtgccttgagnaggaagttaacctaggcaacctccagaagttactt

SEQ ID NO: 8855 - DNA, 71 bp, chicken (Gallus Gallus)
  misc_feature (36): n=a or c
ttcataccattgaatgccttcactgaatgccttatnatgacagaaaaaggcatgttagtactatgaagcag

SEQ ID NO: 8856 - DNA, 71 bp, chicken (Gallus Gallus)
  misc_feature (36): n=c or t
gttcctgttagaaaactgagctttctcggactcacntatctaaattaccactaatacctatacatctatag

SEQ ID NO: 8857 - DNA, 71 bp, chicken (Gallus Gallus)
  misc_feature (36): n=c or g
tttctttacatcataacctgtttttctatattcctncaactctaagttcagcccaggtacattatgaggtg

SEQ ID NO: 8858 - DNA, 71 bp, chicken (Gallus Gallus)
  misc_feature (36): n=c or t
ggctttctgttagctttatggagccttctggtgagncttctctagctttggtttacatctgtgtaaaaagc

SEQ ID NO: 8859 - DNA, 71 bp, chicken (Gallus Gallus)
  misc_feature (36): n=a or g
ggatttaaaagaaagaaaaaaaaaggcaggagcagncttatgtctttttaccaactgcttttgctgcaaga

SEQ ID NO: 8860 - DNA, 71 bp, chicken (Gallus Gallus)
  misc_feature (36): n=a or c
gggtccttttggtgttggagagacagtgtcatcagncttggtggtgttttggtctgaagatgtttatggat

SEQ ID NO: 8861 - DNA, 71 bp, chicken (Gallus Gallus)
  misc_feature (36): n=c or t
agaaaggcagcgtggcactgggatagctttccatantcttaatgaaggttactaagatttttgaggtaagt

SEQ ID NO: 8862 - DNA, 71 bp, chicken (Gallus Gallus)
  misc_feature (36): n=c or t
tcagtactgataagtacattttcaattaagataaanattgacctgccacaaaagccacagggcaaattctg

SEQ ID NO: 8863 - DNA, 71 bp, chicken (Gallus Gallus)
  misc_feature (36): n=a or t
taacagtacagtaacagctacagtaggtgtggaganatgtagagtaagggtctgaagtaaagaatttaagt

SEQ ID NO: 8864 - DNA, 71 bp, chicken (Gallus Gallus)
  misc_feature (36): n=c or t
gggatgagacatgaggtgctgccagccctgtgaggngctactgtaataaacttcagctagtggcactgcta

SEQ ID NO: 8865 - DNA, 71 bp, chicken (Gallus Gallus)
  misc_feature (36): n=c or t
aacccaggccattcagtgactctatgactctgtggngattacctctgctgttactctcaggataaggaacc

SEQ ID NO: 8866 - DNA, 71 bp, chicken (Gallus Gallus)
  misc_feature (36): n=c or g
gaagatgccaagctgctatctatcaaaattgaaagntcatggcagtctggtgaagttctcactgactggaa

SEQ ID NO: 8867 - DNA, 71 bp, chicken (Gallus Gallus)
  misc_feature (36): n=c or t
tgctgttaacctaatttgctgattaatcttttcacncccatttagcattaagtaagcacctggatgcagaa

SEQ ID NO: 8868 - DNA, 71 bp, chicken (Gallus Gallus)
  misc_feature (36): n=c or t
ccaaggatgttccaagccacagaagtatcaaagcgnatccatagctgacaattgcttagtgttacacaggt

SEQ ID NO: 8869 - DNA, 71 bp, chicken (Gallus Gallus)
  misc_feature (36): n=c or t
tgtttttgagtacagatcttcactttttatcagtgngtaattaggacatcgctcttgcagagaaccatctg

SEQ ID NO: 8870 - DNA, 71 bp, chicken (Gallus Gallus)
  misc_feature (36): n=c or t
taggtcatataaacactgattaaaaatataatttancatcgaggctgattcatccattcactgcattcaaa

SEQ ID NO: 8871 - DNA, 71 bp, chicken (Gallus Gallus)
  misc_feature (36): n=a or g
gttaaagtcagcccaccctttacatgccactatatnctttgtgacaaattttgaaaagtctcttcaattat

SEQ ID NO: 8872 - DNA, 71 bp, chicken (Gallus Gallus)
  misc_feature (36): n=c or t
tgaaatgtatttgagatcggagtttttattaattanaagtggcatttgtaagcctcctgctgaagcctgcc

SEQ ID NO: 8873 - DNA, 71 bp, chicken (Gallus Gallus)
  misc_feature (36): n=a or g
ggtgagatgatagtagtgtccaaataagagtttagnatagctgtgcctctcctctttgccaccccattact

SEQ ID NO: 8874 - DNA, 71 bp, chicken (Gallus Gallus)
  misc_feature (36): n=c or t
gctgttggcagggcggctgggaaagagacagcaacngtagcacaccctgtgatttctgcaggtatctccct

SEQ ID NO: 8875 - DNA, 71 bp, chicken (Gallus Gallus)
  misc_feature (36): n=a or g
tttgaggtatttttccaaccttaatggttctgtganctcttagcctaaattttttaagctgtttaagatga

SEQ ID NO: 8876 - DNA, 71 bp, chicken (Gallus Gallus)
  misc_feature (36): n=c or t
tcagcaaaagcttttgtttcctactgatggatgcanttctgtaggcactgcctttcacccttctatcaaat

SEQ ID NO: 8877 - DNA, 71 bp, chicken (Gallus Gallus)
  misc_feature (36): n=c or t
atggttcttgaacagatccagcaatggtgaacccancaccaccttgggcagtccgtgccaatgcatgacca

SEQ ID NO: 8878 - DNA, 71 bp, chicken (Gallus Gallus)
  misc_feature (36): n=a or g
ccccagtgtctgtcccaaccccaatttactgtttgntctctatgtcagcttcatcactgcttcccccagga

SEQ ID NO: 8879 - DNA, 71 bp, chicken (Gallus Gallus)
  misc_feature (36): n=a or g
tcatcagccgctgctacagcctagggaggaatttcntagcagagaacagaacttggctttgtgcatccaga

SEQ ID NO: 8880 - DNA, 71 bp, chicken (Gallus Gallus)
  misc_feature (36): n=c or t
ggtggtgaagaccattgcccattccattggttcagnattgatgcatcctatcactgttccccattgttgcc

SEQ ID NO: 8881 - DNA, 71 bp, chicken (Gallus Gallus)
  misc_feature (36): n=a or c
ggttttctcccttccacatctgtaatctgggcatanaaatgttcttgggtgctccgtctgctgttgatgaa

SEQ ID NO: 8882 - DNA, 71 bp, chicken (Gallus Gallus)
  misc_feature (36): n=a or c
tgaatctttttaagacataacttcccatatgttccngtagtagcgtggctgccaaagcaaaaactttgagc

SEQ ID NO: 8883 - DNA, 71 bp, chicken (Gallus Gallus)
  misc_feature (36): n=a or g
aggagaaggtagctggagggagttctgctttccagncccgcagatggtggtaaatctctctccatgtgaag

SEQ ID NO: 8884 - DNA, 71 bp, chicken (Gallus Gallus)
  misc_feature (36): n=c or t
ttattcaatacaagtttctggtgaaaaatgtttaantatgagaaatcaaaagatgagagctgatggaaaac

SEQ ID NO: 8885 - DNA, 71 bp, chicken (Gallus Gallus)
  misc_feature (36): n=c or t
gcaggcttggatattagcaagaacttctctgaaagngtggtgatgcagtggcatgggctgctcagggaggt

SEQ ID NO: 8886 - DNA, 71 bp, chicken (Gallus Gallus)
  misc_feature (36): n=a or g
actgcttctgtctgtactccattttcctgtccctanaaaaggactcgtacagctttttcacccttctcgag

SEQ ID NO: 8887 - DNA, 71 bp, chicken (Gallus Gallus)
  misc_feature (36): n=c or t
ataatgcacatctgtgaatgagtttcctccagctcngcatctccccctccacccacacccactcactgttt

SEQ ID NO: 8888 - DNA, 71 bp, chicken (Gallus Gallus)
  misc_feature (36): n=c or t
tgctcgccctggtaatgcagcacttttgctgtgtcntccagccgtttctgagacccagtcaataacccagt

SEQ ID NO: 8889 - DNA, 71 bp, chicken (Gallus Gallus)
  misc_feature (36): n=a or g
tacaaagccttgaaaacaaagatattgtctttctgntggctaaaaaaatgtgtcggataactagagagaaa

SEQ ID NO: 8890 - DNA, 71 bp, chicken (Gallus Gallus)
  misc_feature (36): n=c or g
ctgcagagggtcttggattgggcccagctcctggtnacacacacatttccaccagacaatgaagctgttaa

SEQ ID NO: 8891 - DNA, 71 bp, chicken (Gallus Gallus)
  misc_feature (36): n=c or t
tctacctgaggagacttcctgggaccaacaaatccnagggcatcttctaaaaactgtatcttcttgctaaa

SEQ ID NO: 8892 - DNA, 71 bp, chicken (Gallus Gallus)
  misc_feature (36): n=a or g
gagatcactgttctgcagttctgtcagaatacatcntcaacaaatttgagacaaatcaggatgttgcaggc

SEQ ID NO: 8893 - DNA, 71 bp, chicken (Gallus Gallus)
  misc_feature (36): n=a or g
ggggtggcaaagcagattcagagaagagatttaacnctgactgcgcctcgaggaagtccacagaacagtcc

SEQ ID NO: 8894 - DNA, 71 bp, chicken (Gallus Gallus)
  misc_feature (36): n=a or g
tggacacccattacaccagaaaggccaagttcaggngcgttaagtcactctcaagaactcaagacagattg

SEQ ID NO: 8895 - DNA, 71 bp, chicken (Gallus Gallus)
  misc_feature (36): n=c or t
attaccccttatcctctttgccagaccaaacaaacngtttctttagcctctccctgtgagtcaggtgctct

SEQ ID NO: 8896 - DNA, 71 bp, chicken (Gallus Gallus)
  misc_feature (36): n=a or c
agagagcaggtaatgttaccatgtgaagcaggtctngtttttgaatttaggtgacagcagttcagattaac

SEQ ID NO: 8897 - DNA, 71 bp, chicken (Gallus Gallus)
  misc_feature (36): n=a or g
tcccatgatgatcccaaaataaaatgttctcttctnaacacgttatgaaacacaaccaaaatgttgacaag

SEQ ID NO: 8898 - DNA, 71 bp, chicken (Gallus Gallus)
  misc_feature (36): n=g or t
tctttgtttctatatttctgtctattaagtgccctnttctccatttgcctcatagcaatacagtgctggta

SEQ ID NO: 8899 - DNA, 71 bp, chicken (Gallus Gallus)
  misc_feature (36): n=a or g
aatataaatcctatggatttctaatcgttgtcccanagatcaagctatacatctcaagtgaaggtggtatg

SEQ ID NO: 8900 - DNA, 71 bp, chicken (Gallus Gallus)
  misc_feature (36): n=c or t
aactcataccagatgctagcagcactgtctgtttantgaaagcaaggcactgaattaatagatgtgataga

SEQ ID NO: 8901 - DNA, 71 bp, chicken (Gallus Gallus)
  misc_feature (36): n=a or g
gcattggtatcgccaagcagctggaccttggtgagnaaaaggaccacctttcctctgagatgagcacagat

SEQ ID NO: 8902 - DNA, 71 bp, chicken (Gallus Gallus)
  misc_feature (36): n=c or g
gaaccagtttcactaaatgtaatgttgacaggcacngtgcagctactgtgtgtatttgggaagacataata

SEQ ID NO: 8903 - DNA, 71 bp, chicken (Gallus Gallus)
  misc_feature (36): n=g or t
ttttcaagaacaatgacttaaaaattctaacctcanattttttacctcctttataagcgttagaaatgtta

SEQ ID NO: 8904 - DNA, 71 bp, chicken (Gallus Gallus)
  misc_feature (36): n=c or g
actgaagagtatacagtttaccaaaacaatggtaanacttcttacaaaaactccacccaccaaacactaaa

SEQ ID NO: 8905 - DNA, 71 bp, chicken (Gallus Gallus)
  misc_feature (36): n=a or g
tcaaccttctcgtctagcagttctgcaagtgttccnggatggctcttgcatttatatctgcactgcattag

SEQ ID NO: 8906 - DNA, 71 bp, chicken (Gallus Gallus)
  misc_feature (36): n=a or g
ccaatttcagggtaacactcttctgcatgaaataantgctaatctgaaaatctactaagcattgctattta

SEQ ID NO: 8907 - DNA, 71 bp, chicken (Gallus Gallus)
  misc_feature (36): n=c or t
ggtaaaaagctttatgcaggtctcactggcaggcantgcactggtgctgggtgttcccagtagtagaaccc

SEQ ID NO: 8908 - DNA, 71 bp, chicken (Gallus Gallus)
  misc_feature (36): n=a or g
taagcacggaacaaataaatacgtatgttagggtgnaaattagcaaaaaaaaaaaaaatgtttctaactgt

SEQ ID NO: 8909 - DNA, 71 bp, chicken (Gallus Gallus)
  misc_feature (36): n=c or t
tcaaccacctcacagcagactcccatttacagcgcngatttcctgtctgctctacaaccttccataggatt

SEQ ID NO: 8910 - DNA, 71 bp, chicken (Gallus Gallus)
  misc_feature (36): n=a or g
aaaagccaaaacccactagatttccttctctcaaanaagggctaaggagttgttgagagatacacagagaa

SEQ ID NO: 8911 - DNA, 71 bp, chicken (Gallus Gallus)
  misc_feature (36): n=a or g
ttataaagttattagtctgatatttgcttagttacntcctttcattaatttcattgaattttatgttcttt

SEQ ID NO: 8912 - DNA, 71 bp, chicken (Gallus Gallus)
  misc_feature (36): n=c or t
gctgctacttgacaggaggacaggtataggcttggnttctgcagcccccagctgtacgttttggggctgca

SEQ ID NO: 8913 - DNA, 71 bp, chicken (Gallus Gallus)
  misc_feature (36): n=a or c
atgcaaacttgagtgcagtgacaggaaaaacctganggctgattaaaatgagaaacatttggttaaacatc

SEQ ID NO: 8914 - DNA, 71 bp, chicken (Gallus Gallus)
  misc_feature (36): n=c or t
aataccactacaccttataaacatatgctgaattanggaaatattattgccatgcagaaaaatgaaaagta

SEQ ID NO: 8915 - DNA, 71 bp, chicken (Gallus Gallus)
  misc_feature (36): n=c or g
tgttctggataaggaaacactcataaaagcacatanagcagaagtttctggctggaggagcaggcagcatg

SEQ ID NO: 8916 - DNA, 71 bp, chicken (Gallus Gallus)
  misc_feature (36): n=c or t
aatcctactgtgatgatctgttagggatctctgtgnctaaaactgtcttcctatgtacaggtaatccagtg

SEQ ID NO: 8917 - DNA, 71 bp, chicken (Gallus Gallus)
  misc_feature (36): n=g or t
actggccacaaacttgctatttcagtcttggtaganctacttagctcttgtactcacaaaggtctacattt

SEQ ID NO: 8918 - DNA, 71 bp, chicken (Gallus Gallus)
  misc_feature (36): n=c or t
gttgtttagagatactgagaaagacgagataaaaanttcagtaatttgcatcccagaattcatgtggggaa

SEQ ID NO: 8919 - DNA, 71 bp, chicken (Gallus Gallus)
  misc_feature (36): n=a or g
ctgctaaattaaatgtgcaaggcactgcacttttcncatgatccttggtgtgatgctggcttcccataagg

SEQ ID NO: 8920 - DNA, 71 bp, chicken (Gallus Gallus)
  misc_feature (36): n=a or t
acaaagaaaggataactctgctaatcaaatagcaangcagcaaccactaatcatttccccatccttttgct

SEQ ID NO: 8921 - DNA, 71 bp, chicken (Gallus Gallus)
  misc_feature (36): n=a or g
aacaaaatgcttgtatgttcaaaagatgcctgaacntttaggaagagctactgaggaaagtcatgagtgat

SEQ ID NO: 8922 - DNA, 71 bp, chicken (Gallus Gallus)
  misc_feature (36): n=c or t
atcagctgccacatgcattgttttcttccctcttantgatgtttgttcttccttttctcaaaatctttttg

SEQ ID NO: 8923 - DNA, 71 bp, chicken (Gallus Gallus)
  misc_feature (36): n=a or t
tttatcttcatccgaaatacatcttatgtaggggangtttctggaggtcagagttttaatttggggacagg

SEQ ID NO: 8924 - DNA, 71 bp, chicken (Gallus Gallus)
  misc_feature (36): n=a or c
acattgcagcttggggtaggaggcaaatgttatatnttttggatgaaagcttttaaaaacaacagcactct

SEQ ID NO: 8925 - DNA, 71 bp, chicken (Gallus Gallus)
  misc_feature (36): n=c or t
aaagcttcagttaaatgggtgcccaccgaatcctanctactggcacctgctgtgagacgtttgtttcaaaa

SEQ ID NO: 8926 - DNA, 71 bp, chicken (Gallus Gallus)
  misc_feature (36): n=a or c
ccttggctgtgcccctctgatggttcctgtgacccnttcagaacacttgtattttcacattctcctgagaa

SEQ ID NO: 8927 - DNA, 71 bp, chicken (Gallus Gallus)
  misc_feature (36): n=a or g
aatgttcatgcagtcttgggcagggtattcatcttntgaaatcctggcactccttggctgtgaatcctctg

SEQ ID NO: 8928 - DNA, 71 bp, chicken (Gallus Gallus)
  misc_feature (36): n=c or t
gtcttgaaaatgcaatcagaattcctcttctgtttnctccaagcacttcttttattgtctgtccttttaac

SEQ ID NO: 8929 - DNA, 71 bp, chicken (Gallus Gallus)
  misc_feature (36): n=c or g
ttaactcccttctgagaggcgaccactgcaaaaaanacaaaggcactgctgctgttgattgctgcctcctc

SEQ ID NO: 8930 - DNA, 71 bp, chicken (Gallus Gallus)
  misc_feature (36): n=c or t
acagcaaccagctttcttgaaacattcacagaacantgaacatcacatattaaatgcccaggtaataaaaa

SEQ ID NO: 8931 - DNA, 71 bp, chicken (Gallus Gallus)
  misc_feature (36): n=a or g
cccacttaattttcaaaagattaggtgtaaaatacngtttcaaaagcaaggtagctttacagccatttcaa

SEQ ID NO: 8932 - DNA, 71 bp, chicken (Gallus Gallus)
  misc_feature (36): n=a or c
tgttgaaagacatcaaagagtatgctcagcccaagnagcagcagaacattcaagggttgacttggtcccat

SEQ ID NO: 8933 - DNA, 71 bp, chicken (Gallus Gallus)
  misc_feature (36): n=c or t
ccccaggtgcatacccattgtccagcaacaaccagngtgccattaatgcactgtcagatgaaaccagggcg

SEQ ID NO: 8934 - DNA, 71 bp, chicken (Gallus Gallus)
  misc_feature (36): n=c or g
aaaatcttatgggttgcaaaatgaaatcttctgaantgaaaaaaatgtttcccttttaaattaatttgctt

SEQ ID NO: 8935 - DNA, 71 bp, chicken (Gallus Gallus)
  misc_feature (36): n=a or g
ctgtatttaagtcaaacttgcacattcagagtgagnggtgactttttttattgcttttctctgagctcagt

SEQ ID NO: 8936 - DNA, 71 bp, chicken (Gallus Gallus)
  misc_feature (36): n=a or g
acaataagagcttgtggagagcaaggaaagggcatnaggaagtcatacaggctgggggaagaacagatgtt

SEQ ID NO: 8937 - DNA, 71 bp, chicken (Gallus Gallus)
  misc_feature (36): n=c or g
tgcaatacacaatgtacactctcatgtttggttcanagcacctctgacttcattttatttctctaaattaa

SEQ ID NO: 8938 - DNA, 71 bp, chicken (Gallus Gallus)
  misc_feature (36): n=a or g
gtatttcaaaatgtgtcctatcatcttgtttcctantcaatccacagaatgtgtttcccatcagactccag

SEQ ID NO: 8939 - DNA, 71 bp, chicken (Gallus Gallus)
  misc_feature (36): n=c or t
tgggtgtatctcatctaatcctatgaacttgtgtangtccattttttttaaatgttccctaacccaggctt

SEQ ID NO: 8940 - DNA, 71 bp, chicken (Gallus Gallus)
  misc_feature (36): n=a or g
agacaaacaaattggtatacatatttacagcatttncactctggaatcaaacaaaagttccagcctccttt

SEQ ID NO: 8941 - DNA, 71 bp, chicken (Gallus Gallus)
  misc_feature (36): n=c or t
tgaattttgacccatattcaccttagtaaatggagnggctgctcagaatgtgttatactacaggatcttta

SEQ ID NO: 8942 - DNA, 71 bp, chicken (Gallus Gallus)
  misc_feature (36): n=c or g
ctgatgaaaaggaaaaaatgaaaaaaagaagctgtnttttttagtgaatgaatctgttgcatgggccttgg

SEQ ID NO: 8943 - DNA, 71 bp, chicken (Gallus Gallus)
  misc_feature (36): n=c or t
gatgtgagagaggtggcaatttcatgataatgcagnaccatcaagtctgaggttgagttcccagatctgct

SEQ ID NO: 8944 - DNA, 71 bp, chicken (Gallus Gallus)
  misc_feature (36): n=c or t
ttgttgtgttgcggggaggaggtgcagcaccactgntttttagacctgcccttgcatccctctgggccacc

SEQ ID NO: 8945 - DNA, 71 bp, chicken (Gallus Gallus)
  misc_feature (36): n=c or t
tagagcatttacacagtgtggtttcatcttcgcaangcctataatgtgaactgtggactcatactacccta

SEQ ID NO: 8946 - DNA, 71 bp, chicken (Gallus Gallus)
  misc_feature (36): n=c or t
acttgaactttccagaaggactaagcaccattctangtgataaagcaatacatgttcctgcccttacgttc

SEQ ID NO: 8947 - DNA, 71 bp, chicken (Gallus Gallus)
  misc_feature (36): n=c or g
aaaaaacaacattttgatgccaatgaagagaaatancatgaatttatgtgcagctaggtgtctactatagc

SEQ ID NO: 8948 - DNA, 71 bp, chicken (Gallus Gallus)
  misc_feature (36): n=c or t
agatttctgatctatcttactcttcttgtgcttcancactgaaaatagttgttcataaatgcatgaactgc

SEQ ID NO: 8949 - DNA, 71 bp, chicken (Gallus Gallus)
  misc_feature (36): n=a or t
gccctgccttcttgagctgctgcaccacatgtacangatcctcctttttcagtgccttgtttatggcgctg

SEQ ID NO: 8950 - DNA, 71 bp, chicken (Gallus Gallus)
  misc_feature (36): n=c or t
atggtggacaaagatggtgaggtgacagtgacaaangacggagccaccatcctgaacatgatggacgtgga

SEQ ID NO: 8951 - DNA, 71 bp, chicken (Gallus Gallus)
  misc_feature (36): n=c or t
ggtgtacttattttagttgttgtggacttgtctttntttgtaatagcttgtatggtgctatactttggatt

SEQ ID NO: 8952 - DNA, 71 bp, chicken (Gallus Gallus)
  misc_feature (36): n=a or g
caactatttttttttttacatctcttaacctcttcncaccactgtcatatttgggttacctgtaggttacc

SEQ ID NO: 8953 - DNA, 71 bp, chicken (Gallus Gallus)
  misc_feature (36): n=a or g
ccctttctgctgggggatactgaaatattaagcagncagtaggtgggaaggaagatggtagggaaacatca

SEQ ID NO: 8954 - DNA, 71 bp, chicken (Gallus Gallus)
  misc_feature (36): n=a or g
gcacactatggaaacagcaagactcctttgaaacanttccactcagtttttcccctcaagtcaaggaagtg

SEQ ID NO: 8955 - DNA, 71 bp, chicken (Gallus Gallus)
  misc_feature (36): n=a or g
tacagggtgctcaaaggcatccagagtcaggctgcntgaatctgtgctcagtaggtggaaaaggctctgga

SEQ ID NO: 8956 - DNA, 71 bp, chicken (Gallus Gallus)
  misc_feature (36): n=a or g
gaaagtctcgcctctaacttccttgcttctgttagnagtcaggctccatagtaatacaactttcttttttt

SEQ ID NO: 8957 - DNA, 71 bp, chicken (Gallus Gallus)
  misc_feature (36): n=g or t
attgttttttaaacttcaaaagtcaagtcatatttngactcctagaaagttcttgtgacattgaattccat

SEQ ID NO: 8958 - DNA, 71 bp, chicken (Gallus Gallus)
  misc_feature (36): n=a or g
taatcttaggaatttggagaaaaagttttctttctnatttaaataaacttcagaagagcctaattatgaag

SEQ ID NO: 8959 - DNA, 71 bp, chicken (Gallus Gallus)
  misc_feature (36): n=a or g
gtggattagcttttggtgtaccaggaacaaaagggntacaaaaatctccaaattagatttgtttggtatac

SEQ ID NO: 8960 - DNA, 71 bp, chicken (Gallus Gallus)
  misc_feature (36): n=a or g
tttggtttaaggaatgaatgctatataaagcagacngttttggctctttcttaacaaggagtagtgaatgt

SEQ ID NO: 8961 - DNA, 71 bp, chicken (Gallus Gallus)
  misc_feature (36): n=a or g
ctaataaagacaacagtgaatttgttcagattttanctgtaaccatttttgtattcagatgacagctgtgc

SEQ ID NO: 8962 - DNA, 71 bp, chicken (Gallus Gallus)
  misc_feature (36): n=a or g
attcatgcacagtttgtgaaggaaatctacgtttcngtctgcaaatgcctggccatcttgttcatacaatt

SEQ ID NO: 8963 - DNA, 71 bp, chicken (Gallus Gallus)
  misc_feature (36): n=a or t
ttttggtaaataagttgaaattaagtgcatccattnttattttttttttatatatatactaagaattctgt

SEQ ID NO: 8964 - DNA, 71 bp, chicken (Gallus Gallus)
  misc_feature (36): n=a or g
ttcttctgcttttctcaaaatctttctgataattanatgatcacagggtaaatcgtgttcccaattctttt

SEQ ID NO: 8965 - DNA, 71 bp, chicken (Gallus Gallus)
  misc_feature (36): n=c or t
aattttccacactgtttccacaggagaaattcccantattttacttatattttgatttctcttatgtttcc

SEQ ID NO: 8966 - DNA, 71 bp, chicken (Gallus Gallus)
  misc_feature (36): n=c or t
gactcagtttggtggaaaatacctgatatttggtgnatcttccttgccttgttaatgcaaatcacttcagg

SEQ ID NO: 8967 - DNA, 71 bp, chicken (Gallus Gallus)
  misc_feature (36): n=a or g
agagtcagggctgttaatgcagctggactcagtganttttcccaggattcagagcctatagaagtgcaagc

SEQ ID NO: 8968 - DNA, 71 bp, chicken (Gallus Gallus)
  misc_feature (36): n=a or g
gctttttttttttttttttttaagtagtgcaagcantatttcactattgcttctccatatttatccgcttt

SEQ ID NO: 8969 - DNA, 71 bp, chicken (Gallus Gallus)
  misc_feature (36): n=c or t
ttttctgaatgattaagcctatcctgtgcttgtttnctttctgcttccactctttcaagattatttttaag

SEQ ID NO: 8970 - DNA, 71 bp, chicken (Gallus Gallus)
  misc_feature (36): n=c or t
atgagtttcactgcagagttgtagtattttgtcacngtttctagtgtagcagtccgtacctactgaagtaa

SEQ ID NO: 8971 - DNA, 71 bp, chicken (Gallus Gallus)
  misc_feature (36): n=g or t
acactttgttttatgttaagctcagcagtagccttntggcatttcaagttgttcttcacctcatctaaccc

SEQ ID NO: 8972 - DNA, 71 bp, chicken (Gallus Gallus)
  misc_feature (36): n=c or g
caggagagtttcactaggctctggggtagaggagancttactctggttagggatgttctgctgcacagttg

SEQ ID NO: 8973 - DNA, 71 bp, chicken (Gallus Gallus)
  misc_feature (36): n=a or t
atcacttttatctgaatgctgtcatctcagcaacanctcatgtataagcttattccttttcagctgggaca

SEQ ID NO: 8974 - DNA, 71 bp, chicken (Gallus Gallus)
  misc_feature (36): n=c or t
tgcaacactgttaggctatactacccagttttaatnagcaacctgcagaaagtccatatgaagaagtgcta

SEQ ID NO: 8975 - DNA, 71 bp, chicken (Gallus Gallus)
  misc_feature (36): n=a or g
tgccctcgtgaggtcccatgtagagtactgtgtccnggtctggggcccccaatacaagaaaaacaaggagc

SEQ ID NO: 8976 - DNA, 71 bp, chicken (Gallus Gallus)
  misc_feature (36): n=c or t
gtctgcgcattcaccacaagagtagaaattgaccgnggcaggattgctgaaccatcagtgtgcaagaactg

SEQ ID NO: 8977 - DNA, 71 bp, chicken (Gallus Gallus)
  misc_feature (36): n=c or t
gactctatcatttgctgtaagtgccacttaatctcntgtgctgatagagcagtaaccattatgaaggtctt

SEQ ID NO: 8978 - DNA, 71 bp, chicken (Gallus Gallus)
  misc_feature (36): n=a or c
gaaaagcagctcagagtatagtttaacacaatactngatttagtgaataaagcaggtgcagagtacagtgg

SEQ ID NO: 8979 - DNA, 71 bp, chicken (Gallus Gallus)
  misc_feature (36): n=a or g
aaaagagcctctaaatccttaaaattgaaaatttgnttggaattatttcctcctataagttattttctcca

SEQ ID NO: 8980 - DNA, 71 bp, chicken (Gallus Gallus)
  misc_feature (36): n=c or t
tcctaagcaacattttggatcacagtcctgttcccnactcccccgctgtcagggaatcttttttacctggt

SEQ ID NO: 8981 - DNA, 71 bp, chicken (Gallus Gallus)
  misc_feature (36): n=c or t
gtgccatatccataaagaataggaaatcagtactcngactatcttaggtcaaacctaggtcaagatcagta

SEQ ID NO: 8982 - DNA, 71 bp, chicken (Gallus Gallus)
  misc_feature (36): n=a or c
ttcagacttggaagtcagttaataccataactctgntaatatcacatagggctgagccttactattagctc

SEQ ID NO: 8983 - DNA, 71 bp, chicken (Gallus Gallus)
  misc_feature (36): n=a or g
ggatcaggaaagaaactgttaatcaaaacaaacacnctgtataatcccatatgtactccgtgcagttcatg

SEQ ID NO: 8984 - DNA, 71 bp, chicken (Gallus Gallus)
  misc_feature (36): n=a or g
accacaatatgttcaaggaaatgccctgaaaacagnagaggttgggagtagtataataagtcattaatctt

SEQ ID NO: 8985 - DNA, 71 bp, chicken (Gallus Gallus)
  misc_feature (36): n=a or g
acaaaaattaacatatctaagcagatctatgaattngcacttttgttttattattgagtagttatttatga

SEQ ID NO: 8986 - DNA, 71 bp, chicken (Gallus Gallus)
  misc_feature (36): n=a or g
tcccatgcttgacaacaaaattctggggaagatganttcttcattagcgcacttaggaacaagaagattgt

SEQ ID NO: 8987 - DNA, 71 bp, chicken (Gallus Gallus)
  misc_feature (36): n=c or t
agcttgttaaaaataatgtaaaaccattgcaaaaancctttcagattgttcataactcaaactatagaata

SEQ ID NO: 8988 - DNA, 71 bp, chicken (Gallus Gallus)
  misc_feature (36): n=g or t
tactacacatagctgatgttgatgaatcactgcccncatgctaaaggatgctgggggtcaactgcacagac

SEQ ID NO: 8989 - DNA, 71 bp, chicken (Gallus Gallus)
  misc_feature (36): n=a or g
attattattattatttttttaactaataaaagcaancattaccagtcattttcagaaacctgtcaaaatct

SEQ ID NO: 8990 - DNA, 71 bp, chicken (Gallus Gallus)
  misc_feature (36): n=c or t
tgtctcagcagcaggatatacgctctgctacagatncaccacagaagtcatcaattagtttatcatttaac

SEQ ID NO: 8991 - DNA, 71 bp, chicken (Gallus Gallus)
  misc_feature (36): n=a or g
attacatcattctgcaatatctgtcatccaaagtgncagataccggtcagatacagatggagcgaggaaaa

SEQ ID NO: 8992 - DNA, 71 bp, chicken (Gallus Gallus)
  misc_feature (36): n=a or c
aggatgtgtcttttgctacattttaaccctttctgnaaagaatttgcggacaaagaagttgtgttgatagc

SEQ ID NO: 8993 - DNA, 71 bp, chicken (Gallus Gallus)
  misc_feature (36): n=a or g
ctggggagagcatgcagggtttcatgcagatccgangtaacgctaggagatggtcctcgtgtcagaaacat

SEQ ID NO: 8994 - DNA, 71 bp, chicken (Gallus Gallus)
  misc_feature (36): n=c or t
aaatttgggtcatattgaagagaactggacaaattntgctatcaaataccaaccaaacttctataactgat

SEQ ID NO: 8995 - DNA, 71 bp, chicken (Gallus Gallus)
  misc_feature (36): n=c or t
agtcaccttcaagcaaacagcccttgtaaccatccntttggttacagagacacttcttaaaaggtccgatt

SEQ ID NO: 8996 - DNA, 71 bp, chicken (Gallus Gallus)
  misc_feature (36): n=g or t
caatggcagtgttataggagagaggcctaagtatgntgaacacaaatcaatgggtaggtagagaggaagag

SEQ ID NO: 8997 - DNA, 71 bp, chicken (Gallus Gallus)
  misc_feature (36): n=c or t
catcgccagaaaggcaatgtttcaaaaggctaatantggcttttgaaacattaaaggtctaatttcagtac

SEQ ID NO: 8998 - DNA, 71 bp, chicken (Gallus Gallus)
  misc_feature (36): n=c or t
tcaaagggggaaaaaaatcttctggctattctttcnctttgtagtaaaaaagaccattttagactgtgcta

SEQ ID NO: 8999 - DNA, 71 bp, chicken (Gallus Gallus)
  misc_feature (36): n=c or t
agcgctcagattcttaagagctgtcttgcatctaangctgacatatgcaaaccagtattttaaaatatatt

SEQ ID NO: 9000 - DNA, 71 bp, chicken (Gallus Gallus)
  misc_feature (36): n=a or g
aactatgttaaaagttatgtgaactacacatatcantctgtaattcaaatacatggtgctattcactatca

SEQ ID NO: 9001 - DNA, 71 bp, chicken (Gallus Gallus)
  misc_feature (36): n=c or t
gcttgggatacacttctctgcattcaaatgcctatnatatatatgaagctatggcatctcttgtcccaatg

SEQ ID NO: 9002 - DNA, 71 bp, chicken (Gallus Gallus)
  misc_feature (36): n=g or t
tcaaggcaaatattgtgacctttaagtagtaatagnagagatcacagctactgggctacaaagctttactc

SEQ ID NO: 9003 - DNA, 71 bp, chicken (Gallus Gallus)
  misc_feature (36): n=c or t
aaattctccttctcttgcatccaaaacacagcttgncactgcagccacaggccaaaactgggccctcctgg

SEQ ID NO: 9004 - DNA, 71 bp, chicken (Gallus Gallus)
  misc_feature (36): n=c or t
tgtggagatagtcatcctagctaacaggcctgtagntgtccagaattaatgactttaacaaggcttgtgaa

SEQ ID NO: 9005 - DNA, 71 bp, chicken (Gallus Gallus)
  misc_feature (36): n=a or g
aacctctcttaatgcgtgatttctgactgagaaagncagacatgaaaaattaacaccaactcttctaaacc

SEQ ID NO: 9006 - DNA, 71 bp, chicken (Gallus Gallus)
  misc_feature (36): n=a or t
tccagcctgcttccacactgctcccatcttttctcnttcttcagcttctctgttccggcagctttctccca

SEQ ID NO: 9007 - DNA, 71 bp, chicken (Gallus Gallus)
  misc_feature (36): n=c or g
gaggagtcagtgggcaggcaaatgtctgtccttatntcctaaatgtccaactgacaggagggaacttgcac

SEQ ID NO: 9008 - DNA, 71 bp, chicken (Gallus Gallus)
  misc_feature (36): n=a or g
atacatcctcaactcaagacagaactttctcattgngttaagaacacagaagagaaacaggagacaaattt

SEQ ID NO: 9009 - DNA, 71 bp, chicken (Gallus Gallus)
  misc_feature (36): n=a or g
tttctgaatgttgaaaaccctgtaaactaaatgccntatctgcaaactcaattaacaccggctacggacaa

SEQ ID NO: 9010 - DNA, 71 bp, chicken (Gallus Gallus)
  misc_feature (36): n=a or g
ttaaactacagggcttaagtgctggatgcacaactnaactctgatgtttctgaaaattcacacatattcaa

SEQ ID NO: 9011 - DNA, 71 bp, chicken (Gallus Gallus)
  misc_feature (36): n=a or c
ttgttcttctgctaggctacgttgttattaacaaancctctggaggtttgaagtggggatgagtgcaaggg

SEQ ID NO: 9012 - DNA, 71 bp, chicken (Gallus Gallus)
  misc_feature (36): n=c or t
ctttagagtactttctgagtagcaggtagcttactnttgagtaattcttcaaataacactacctacttcaa

SEQ ID NO: 9013 - DNA, 71 bp, chicken (Gallus Gallus)
  misc_feature (36): n=g or t
atttcaagtcgagtaattggtttgggattaatgcanaggggtctaatggcgtagaaaaatggctgaagaac

SEQ ID NO: 9014 - DNA, 71 bp, chicken (Gallus Gallus)
  misc_feature (36): n=a or c
gccttcttgaatgaaggagaatttctaaatgaccanctacatgcattagtgctgttatgtagatcaggaaa

SEQ ID NO: 9015 - DNA, 71 bp, chicken (Gallus Gallus)
  misc_feature (36): n=c or t
tttatttctttagcagttttccatttgctttctgtnggatgggcttttggttgtgcttgatttttttgggg

SEQ ID NO: 9016 - DNA, 71 bp, chicken (Gallus Gallus)
  misc_feature (36): n=a or g
agctagaaatgaaataagtttgactgttcacactgncagacaggagcgtgttgtacgtctgttaccttgtg

SEQ ID NO: 9017 - DNA, 71 bp, chicken (Gallus Gallus)
  misc_feature (36): n=a or g
gctttgtatcaggcatgaaatacagcatgactgatnatgagttagacaccgctcttttcacaaggaacgta

SEQ ID NO: 9018 - DNA, 71 bp, chicken (Gallus Gallus)
  misc_feature (36): n=a or g
ctaagtcttctgcctgataaatccttaaataatacngaatcaattatctcagggaccatctgccaccttcc

SEQ ID NO: 9019 - DNA, 71 bp, chicken (Gallus Gallus)
  misc_feature (36): n=a or g
atgaaaccatgagagtttagggaatggtgtttctcnccttttggaaagatcttaatcttatgatgctgccg

SEQ ID NO: 9020 - DNA, 71 bp, chicken (Gallus Gallus)
  misc_feature (36): n=a or g
gcatcttggccccagatggcctagagagcagccccntggctttttcgtatccaaagcctggtgagttttgt

SEQ ID NO: 9021 - DNA, 71 bp, chicken (Gallus Gallus)
  misc_feature (36): n=a or g
aagaaaactaacaaaacagaaaagcagtgcacaccnggatgcatgcagaaatgtccaatttttccgaattt

SEQ ID NO: 9022 - DNA, 71 bp, chicken (Gallus Gallus)
  misc_feature (36): n=c or t
ttttcattttgagctcaggagccctccactgacatnttgccacaagacagcagcctgaagacttattgtgg

SEQ ID NO: 9023 - DNA, 71 bp, chicken (Gallus Gallus)
  misc_feature (36): n=c or t
ttttgaattagtattttgagtttgttctttggttgnttcatcaaaatacttactagccttacctctggtaa

SEQ ID NO: 9024 - DNA, 71 bp, chicken (Gallus Gallus)
  misc_feature (36): n=c or t
attgtctgtattaaaaggagaaaggcccacctcttncagttggtgctgcaaacagcctgttaatgcatttt

SEQ ID NO: 9025 - DNA, 71 bp, chicken (Gallus Gallus)
  misc_feature (36): n=c or g
ccatcagtcttccttctacttctggggtaggtgagntgcacaaaacagcgttaggtgacgtaattcctttt

SEQ ID NO: 9026 - DNA, 71 bp, chicken (Gallus Gallus)
  misc_feature (36): n=a or g
tctcaacacacaacttcaattgtggttaaaaacaanaacaaaacaacacctaaacctctgccctttctgtt

SEQ ID NO: 9027 - DNA, 71 bp, chicken (Gallus Gallus)
  misc_feature (36): n=a or g
cgggagccttgtccaatcaagatgtcagctacctcnaagcttcaaaaattaaacgaatctggaattcccct

SEQ ID NO: 9028 - DNA, 71 bp, chicken (Gallus Gallus)
  misc_feature (36): n=a or g
cagatagaaaaataacttcttgtgctggatttcacnagattagcacactgcaggctagagatgaaaaatag

SEQ ID NO: 9029 - DNA, 71 bp, chicken (Gallus Gallus)
  misc_feature (36): n=c or t
tcatttttggaagatgctttttcatctccaccacanggagcttctcctgtgcctgagagttctctcactgg

SEQ ID NO: 9030 - DNA, 71 bp, chicken (Gallus Gallus)
  misc_feature (36): n=a or g
ttgaagttagactaccgtgtcagaaaataagaagtntggcgatgaatcatcactccgggcaggtctcgctt

SEQ ID NO: 9031 - DNA, 71 bp, chicken (Gallus Gallus)
  misc_feature (36): n=a or c
gcagaaggggttaccctatctttctaatgacacagnctgagcctcttcgaaatgtagctgaccttcatgct

SEQ ID NO: 9032 - DNA, 71 bp, chicken (Gallus Gallus)
  misc_feature (36): n=g or t
tccagcggttcactggggtcttgtcttttttctctntttccagccagaattctcactgtcatggatacgaa

SEQ ID NO: 9033 - DNA, 71 bp, chicken (Gallus Gallus)
  misc_feature (36): n=g or t
agtatcagactgattcatgttaattacattttttgntttttgtccagagttggatcaggttgaatttaatt

SEQ ID NO: 9034 - DNA, 71 bp, chicken (Gallus Gallus)
  misc_feature (36): n=a or g
tcttttaaattagaaatacaattatctcaggattgnaaggtctcactgtctgtgggtcgtcaggaacaata

SEQ ID NO: 9035 - DNA, 71 bp, chicken (Gallus Gallus)
  misc_feature (36): n=c or t
ttttctggcagctcattcctgaaatcctggtagttnttccaaaaaaaccatctttcctaaagtaggcttct

SEQ ID NO: 9036 - DNA, 71 bp, chicken (Gallus Gallus)
  misc_feature (36): n=a or g
taaattatgcttataaaaaaaaagaggattgatcanactagaggactagtttgtacaataaactcttcatg

SEQ ID NO: 9037 - DNA, 71 bp, chicken (Gallus Gallus)
  misc_feature (36): n=a or g
gctgtttcccaggcactcctgcagcaattgccatcnttgcttattttcactctgctgagattctcctgcct

SEQ ID NO: 9038 - DNA, 71 bp, chicken (Gallus Gallus)
  misc_feature (36): n=c or t
tttttaaaggtcacggtgttatcatttcagttttangctgttgaaagtttggtacaatctctacattttca

SEQ ID NO: 9039 - DNA, 71 bp, chicken (Gallus Gallus)
  misc_feature (36): n=a or g
agatgaaatagctggtgggtcatcaaacaagaatancctagttctgggtctaagatgcctacagcacagta

SEQ ID NO: 9040 - DNA, 71 bp, chicken (Gallus Gallus)
  misc_feature (36): n=a or g
gtccatgactaataacttcagtgcatgtgatcctgncttgctcaacagaaaggcaaatcttctatatggga

SEQ ID NO: 9041 - DNA, 71 bp, chicken (Gallus Gallus)
  misc_feature (36): n=a or t
ttatttctttgtaggattcaccataagatccacttnacatttgccctctccaagatttccaagtagagtct

SEQ ID NO: 9042 - DNA, 71 bp, chicken (Gallus Gallus)
  misc_feature (36): n=a or g
tattcatactattgttaaagtagtaattcatacccntcccaggtagacagctgagaatgtcactggggagc

SEQ ID NO: 9043 - DNA, 71 bp, chicken (Gallus Gallus)
  misc_feature (36): n=c or t
ggagaggacttctgaagttatctgatccaatctccngttctgagaaaggccactgtagttgctattagtct

SEQ ID NO: 9044 - DNA, 71 bp, chicken (Gallus Gallus)
  misc_feature (36): n=c or t
acaaaaaagactgtcatatatatagctaaattgctnagaattgaaggaatatgaatatctaaagattcttt

SEQ ID NO: 9045 - DNA, 71 bp, chicken (Gallus Gallus)
  misc_feature (36): n=a or t
tattcatacaatttatactcatcagcattcattacncatccttctcattattctctggttcaggttggcag

SEQ ID NO: 9046 - DNA, 71 bp, chicken (Gallus Gallus)
  misc_feature (36): n=a or t
aaaattcaagttgtattgcaagctgtgtacacgacntatcctttttaaaaatcttgaaccagtttctccat

SEQ ID NO: 9047 - DNA, 71 bp, chicken (Gallus Gallus)
  misc_feature (36): n=a or g
tgatttgcaataatctacttcaggaacatttttccnttgcggttttcggattccgttgttaaagcacgtca

SEQ ID NO: 9048 - DNA, 71 bp, chicken (Gallus Gallus)
  misc_feature (36): n=g or t
gtttgtatatgtacacacttcaaaagtgatttctanaatggaatctgtgctccctgtcaatgttactaaca

SEQ ID NO: 9049 - DNA, 71 bp, chicken (Gallus Gallus)
  misc_feature (36): n=c or t
aaatttgcatcttaatgaactttctgatcatgcaangtccttctactcgtacttcttattgaagttgtata

SEQ ID NO: 9050 - DNA, 71 bp, chicken (Gallus Gallus)
  misc_feature (36): n=c or t
acttttcccacaaagtctgaagactggcgctttaanggcacaagtatttttgatagattttgtcagcacca

SEQ ID NO: 9051 - DNA, 71 bp, chicken (Gallus Gallus)
  misc_feature (36): n=c or t
gacaatactactgtcagaatgccaaagcttattaangaacatatccatgccacgtcattgacctcttatga

SEQ ID NO: 9052 - DNA, 71 bp, chicken (Gallus Gallus)
  misc_feature (36): n=c or t
caatctcattcctcatacaagggaatccagatgtanataaagagtgactttggtctttactgacctctcat

SEQ ID NO: 9053 - DNA, 71 bp, chicken (Gallus Gallus)
  misc_feature (36): n=g or t
gtcaaactgcaaagcacttattaattgccctcaaanaaattctttcaggaaagttaattgggatctcaggt

SEQ ID NO: 9054 - DNA, 71 bp, chicken (Gallus Gallus)
  misc_feature (36): n=c or g
gatgacagaatggtagagctccattggtagaggaanagtcacaactgtagatgcactcacctacatcctag

SEQ ID NO: 9055 - DNA, 71 bp, chicken (Gallus Gallus)
  misc_feature (36): n=a or g
ttccttgaagtccaaaggaacagcttaggtgagatnaaggtgcctttcatacagttaaatgaaatcaaatc

SEQ ID NO: 9056 - DNA, 71 bp, chicken (Gallus Gallus)
  misc_feature (36): n=c or t
tgttttgcacgtgttatggaaattgtggaacatgtnaggtgtcacgtctgtctgttgtttaggagagcaat

SEQ ID NO: 9057 - DNA, 71 bp, chicken (Gallus Gallus)
  misc_feature (36): n=c or t
gcttgaataaccaagtgttaactcagcctgggtgtngctgagctgttggttgaaattcagcttggtggcct

SEQ ID NO: 9058 - DNA, 71 bp, chicken (Gallus Gallus)
  misc_feature (36): n=c or g
atctttaccagcaagatagcatattttctctctgtntctccatgaattcataattatttatacaaaaagca

SEQ ID NO: 9059 - DNA, 71 bp, chicken (Gallus Gallus)
  misc_feature (36): n=a or g
aggaaaaggaaagacaactagaattatttacaaaancagcctgacttatgtttttttcttatacgtgcact

SEQ ID NO: 9060 - DNA, 71 bp, chicken (Gallus Gallus)
  misc_feature (36): n=c or t
gcctaaaataaaagattcagttgctgaaaggcttcnggagaagttttatcttcttttatatacataaaaat

SEQ ID NO: 9061 - DNA, 71 bp, chicken (Gallus Gallus)
  misc_feature (36): n=c or t
gggccataattatagcagttatttctattggatcancgaaggccctaccaaaatagtttagtttaggactt

SEQ ID NO: 9062 - DNA, 71 bp, chicken (Gallus Gallus)
  misc_feature (36): n=c or t
tcctggagatggtgaacacatgcaacatttgcatantgtccatgtgtcttacaggttactgcaatcagttg

SEQ ID NO: 9063 - DNA, 71 bp, chicken (Gallus Gallus)
  misc_feature (36): n=c or t
gccctcccctccacacagacagcacaaaaatccaancatgtttacctctctctggtaccttcccttgctct

SEQ ID NO: 9064 - DNA, 71 bp, chicken (Gallus Gallus)
  misc_feature (36): n=a or t
aggtgacaaatggttaatttactgtgttgacagacnacagaaaaagatgtattggggtctgagagccttgt

SEQ ID NO: 9065 - DNA, 71 bp, chicken (Gallus Gallus)
  misc_feature (36): n=a or g
ggaagtacacctcgaattcataaggactgaagatcncatcaggaggcctgttcacccacttaaatacctac

SEQ ID NO: 9066 - DNA, 71 bp, chicken (Gallus Gallus)
  misc_feature (36): n=g or t
ataaacaatttgacagcgagctctttgatgctgcantcccagcgggagcagtgcaggagcccgggaggggt

SEQ ID NO: 9067 - DNA, 71 bp, chicken (Gallus Gallus)
  misc_feature (36): n=c or t
tactttctgctatggttgcaggaaccaacctcctgnaagtctgcctccttgtgcaccttccaccagctgga

SEQ ID NO: 9068 - DNA, 71 bp, chicken (Gallus Gallus)
  misc_feature (36): n=c or t
taggaatggagaggtgactagattttgaatgttgtnatgcaaaagaatgagtatagaaaagaaaaagatgg

SEQ ID NO: 9069 - DNA, 71 bp, chicken (Gallus Gallus)
  misc_feature (36): n=a or t
ggagaaacgatgtgtaacagtgctttttgctgagtnatcttgtgagatttatgtaaggagttgtcctctgt

SEQ ID NO: 9070 - DNA, 71 bp, chicken (Gallus Gallus)
  misc_feature (36): n=a or g
ctaactattacacacacctccatttattttgttatntgatttgatattttcaagcagtgctgaaggcttaa

SEQ ID NO: 9071 - DNA, 71 bp, chicken (Gallus Gallus)
  misc_feature (36): n=c or t
ttgcattgtcatcagatccagaggtactgtcttccncttgaggatgctgaatagtgttgaaccatgttcag

SEQ ID NO: 9072 - DNA, 71 bp, chicken (Gallus Gallus)
  misc_feature (36): n=c or t
tcctcagtcccataacgcacaatatattttctgaangaaagttcttcatgggtttgttatgctatctcatt

SEQ ID NO: 9073 - DNA, 71 bp, chicken (Gallus Gallus)
  misc_feature (36): n=c or t
ctgcttcccgacgcattgctcaggtactgagtaganggtctttgcccctatttgtccctgcacaacgcttt

SEQ ID NO: 9074 - DNA, 71 bp, chicken (Gallus Gallus)
  misc_feature (36): n=c or g
gagagcacagcctattcagaaagtctcgcttgatanagatactttgggccatttggggaatgaaagcatag

SEQ ID NO: 9075 - DNA, 71 bp, chicken (Gallus Gallus)
  misc_feature (36): n=a or g
ttacacaaaaaacagctcacaccaaaaatcaaagcnaagctcaaaaaaataaaaccctgcaacctcaccca

SEQ ID NO: 9076 - DNA, 71 bp, chicken (Gallus Gallus)
  misc_feature (36): n=a or g
tcttgaatgcaactgtattactaaaccctgaatgcnattttcactgagcaaacttagaccacgttttaagg

SEQ ID NO: 9077 - DNA, 71 bp, chicken (Gallus Gallus)
  misc_feature (36): n=c or t
gactttagttactttgatagatacctgactgtgttnccagcagctgaagagatcacttctgtcaaggcgcc

SEQ ID NO: 9078 - DNA, 71 bp, chicken (Gallus Gallus)
  misc_feature (36): n=c or t
aatctgccaccaagatggtcatttcaagtgaagaantctcagaaaaatggctgccagtctttagttcatag

SEQ ID NO: 9079 - DNA, 71 bp, chicken (Gallus Gallus)
  misc_feature (36): n=c or t
tccttctggaaataactatcagctgtcaatcacttngataagtttctttggctgtcacaccctaatcactg

SEQ ID NO: 9080 - DNA, 71 bp, chicken (Gallus Gallus)
  misc_feature (36): n=a or g
tttcttcctcagatataaatattctggcctgcaccncccgtaacgtgacactgcagtgttacgtcaggcta

SEQ ID NO: 9081 - DNA, 71 bp, chicken (Gallus Gallus)
  misc_feature (36): n=a or t
aggggcttgcaggaacctaaatagaagcctttctgnacctaagaggagattattgacaaaatggagcctgt

SEQ ID NO: 9082 - DNA, 71 bp, chicken (Gallus Gallus)
  misc_feature (36): n=c or t
aaaatgcattcttagagcaaggtggtttgagacccngacaacactaaagcaaagagataagcattctgaac

SEQ ID NO: 9083 - DNA, 71 bp, chicken (Gallus Gallus)
  misc_feature (36): n=c or t
tccttgactccagttgctcagtgagcacaatgtgtnactgtgtttgactttgctacttcacgaggagtgaa

SEQ ID NO: 9084 - DNA, 71 bp, chicken (Gallus Gallus)
  misc_feature (36): n=a or g
gctaagaagctgagacaaaagaaaggtctttatagntactgaggaaatgtagcatcactgaaagtaaggct

SEQ ID NO: 9085 - DNA, 71 bp, chicken (Gallus Gallus)
  misc_feature (36): n=a or g
atgctgtagttcaccgattcattttcctgtgtgctngcttgtgcactgtggtatttattttaacttgcatg

SEQ ID NO: 9086 - DNA, 71 bp, chicken (Gallus Gallus)
  misc_feature (36): n=c or t
ggataaatattcctgacccaaaggcacacagattcnctggagaatgtaccaagaggaggcagaataaaaca

SEQ ID NO: 9087 - DNA, 71 bp, chicken (Gallus Gallus)
  misc_feature (36): n=c or t
ttgctttttgaagatcactcagtattgtaccctttntaagggaccaccagttccacattttcaaacaattt

SEQ ID NO: 9088 - DNA, 71 bp, chicken (Gallus Gallus)
  misc_feature (36): n=c or t
ttcagttctggaacagaaatgcaaggatcaatgcgnagtacacccaccatcactctaaaacacagaatgct

SEQ ID NO: 9089 - DNA, 71 bp, chicken (Gallus Gallus)
  misc_feature (36): n=c or t
cctttcttcattctaatttcagtgacttcttgtttnaccgtttcttttaagttgattctccagtttgagat

SEQ ID NO: 9090 - DNA, 71 bp, chicken (Gallus Gallus)
  misc_feature (36): n=c or t
tttaaatccatggctcaaggccagttaggaaaacanctatgctgacgtccatcttgtagaaccagtgcttg

SEQ ID NO: 9091 - DNA, 71 bp, chicken (Gallus Gallus)
  misc_feature (36): n=a or t
caagtgactgtaaatggatttcttataactgagctncgcctcttggtttttgagagtgacatgaaaacata

SEQ ID NO: 9092 - DNA, 71 bp, chicken (Gallus Gallus)
  misc_feature (36): n=a or g
taagcaactgttgtttcatactggaagttgtggtanacaataacgtaaatttattgaaaaagctgttgtta

SEQ ID NO: 9093 - DNA, 71 bp, chicken (Gallus Gallus)
  misc_feature (36): n=a or g
tgatctcggagacaagtgaagccaaatcaagtgacnatagggacctagcacctctcaggaacctaacaatt

SEQ ID NO: 9094 - DNA, 71 bp, chicken (Gallus Gallus)
  misc_feature (36): n=c or t
tttggaaaaaactctattgatgttgaatcaacattngttttataattccgcctttttattattcacaacct

SEQ ID NO: 9095 - DNA, 71 bp, chicken (Gallus Gallus)
  misc_feature (36): n=a or g
gctgctttagcataacatactcccagatcttggacntaagccagcagaaaattcctacactgtaacacacc

SEQ ID NO: 9096 - DNA, 71 bp, chicken (Gallus Gallus)
  misc_feature (36): n=a or g
tcatcatctgaacctcacaatttccagggagcacantaggattttctcccagaaaaagatctaggacataa

SEQ ID NO: 9097 - DNA, 71 bp, chicken (Gallus Gallus)
  misc_feature (36): n=c or t
gaaagacgcagactaatgcctactactgaggcttgngtttctcctgcctgcctttggagatagcaatcact

SEQ ID NO: 9098 - DNA, 71 bp, chicken (Gallus Gallus)
  misc_feature (36): n=a or g
tcatagaggctgtatgtttagtatcttctatctatngcccaaattggtacctccctactaagaaagaaatc

SEQ ID NO: 9099 - DNA, 71 bp, chicken (Gallus Gallus)
  misc_feature (36): n=c or t
ataggctctgtggcagacgggtatgtgtaaggttgnttcctctcattttattttaaattttcacaatattt

SEQ ID NO: 9100 - DNA, 71 bp, chicken (Gallus Gallus)
  misc_feature (36): n=g or t
tgatatgggacaaaattaaatgttcaccttgtggtnagttctggagtttcttagcacaagttaccacttgt

SEQ ID NO: 9101 - DNA, 71 bp, chicken (Gallus Gallus)
  misc_feature (36): n=a or g
agaatatacatctcctgacaacataaagaattactntgaacgacctacacatgatgaattacctatacatg

SEQ ID NO: 9102 - DNA, 71 bp, chicken (Gallus Gallus)
  misc_feature (36): n=g or t
cagaaagattaattaacttctcgtgcacccacaagngctcagtgcagacagtcctaccagaccttggctga

SEQ ID NO: 9103 - DNA, 71 bp, chicken (Gallus Gallus)
  misc_feature (36): n=a or g
agcagatgcttattgatggagagagaaataatgcantaataacatgtagcgtggagatgtggcagctttgc

SEQ ID NO: 9104 - DNA, 71 bp, chicken (Gallus Gallus)
  misc_feature (36): n=c or g
ggaaagtgatgctgagctcctgggatctgagatttntgccaaaacgtataaagtagtttctccacaggatt

SEQ ID NO: 9105 - DNA, 71 bp, chicken (Gallus Gallus)
  misc_feature (36): n=c or t
ttagagtggcagcagaaagagttaaaatgatgaaangtaatgtttggtaagtactcttggagtagataaaa

SEQ ID NO: 9106 - DNA, 71 bp, chicken (Gallus Gallus)
  misc_feature (36): n=c or t
gcaactgaggagggaaggaggcttacaggtaaccancagaccgagagcagattggtttgtgttcttgggag

SEQ ID NO: 9107 - DNA, 71 bp, chicken (Gallus Gallus)
  misc_feature (36): n=c or t
gctgcaaccagtcctgggttctaggcttaataacantgagtagataagcagactagataccatctttgtac

SEQ ID NO: 9108 - DNA, 71 bp, chicken (Gallus Gallus)
  misc_feature (36): n=a or g
aatttgaaggacgagtaagacctcatcttaaacagnttaagattgtaggttaagttcagacactcctgagg

SEQ ID NO: 9109 - DNA, 71 bp, chicken (Gallus Gallus)
  misc_feature (36): n=a or g
tcagagctcaggcagagacatgagggacatgagtanccattaagctttcagtgcagtctaatgtgctttta

SEQ ID NO: 9110 - DNA, 71 bp, chicken (Gallus Gallus)
  misc_feature (36): n=a or g
actggctatacattgaaccaggagagtaagtcaccntaggttgtaacaaagcaaatattctgcctgtaagt

SEQ ID NO: 9111 - DNA, 71 bp, chicken (Gallus Gallus)
  misc_feature (36): n=c or g
gccataatagatttgtaaccttctgattcagtcatntagctcttactgtttgcctatttctttattttctt

SEQ ID NO: 9112 - DNA, 71 bp, chicken (Gallus Gallus)
  misc_feature (36): n=c or t
gtagtgaagttttatttttgcagaaattggagttanactcccacctctgccacacttgtgcaagttctagc

SEQ ID NO: 9113 - DNA, 71 bp, chicken (Gallus Gallus)
  misc_feature (36): n=c or g
ccttgagctaaataggttttgctgctctttctgtgncactaaactgcgcggttacagacatgcaatttagg

SEQ ID NO: 9114 - DNA, 71 bp, chicken (Gallus Gallus)
  misc_feature (36): n=g or t
atcactgtaggatgagaggagatgaacacaacagtnctagaactgtaatatactgatctagtccgtgttaa

SEQ ID NO: 9115 - DNA, 71 bp, chicken (Gallus Gallus)
  misc_feature (36): n=a or c
gtttcatatttctagaatgtgattttgcatattgancataaggaaaaaaagcaagcacagtttaatatcgt

SEQ ID NO: 9116 - DNA, 71 bp, chicken (Gallus Gallus)
  misc_feature (36): n=a or g
tgtgggagatcccaaggtcttggagtctcactgttntgcccaaagtggacgtgtccaagtcttgtcaaaac

SEQ ID NO: 9117 - DNA, 71 bp, chicken (Gallus Gallus)
  misc_feature (36): n=c or t
cctggaccatgcttttgccacctttcctagaatcangaagtcatagaaccaaagaattgtagggtcacaga

SEQ ID NO: 9118 - DNA, 71 bp, chicken (Gallus Gallus)
  misc_feature (36): n=a or g
accagtgtctctctgaatataccgtatgatatgatntttcatactctgacagcgtttaacaagagaagatt

SEQ ID NO: 9119 - DNA, 71 bp, chicken (Gallus Gallus)
  misc_feature (36): n=a or g
cctcctggagaggtgaattaaagcccacacttgganatgtctctaagggagagatggcaggaggtccctcc

SEQ ID NO: 9120 - DNA, 71 bp, chicken (Gallus Gallus)
  misc_feature (36): n=a or g
gggaagtgcttcaagctcagtcattgcttggaaagncattcagacttttctgttttgctcaggacatttcc

SEQ ID NO: 9121 - DNA, 71 bp, chicken (Gallus Gallus)
  misc_feature (36): n=a or g
atatatgctttcactgggtcctggaggcttgatagngacagaagtagtcattccaggcatatactgagtct

SEQ ID NO: 9122 - DNA, 71 bp, chicken (Gallus Gallus)
  misc_feature (36): n=c or t
catccaacctggtcttgaacaccttcaaatcttganggcaaatctgcgggcttcataatagtgtagatatc

SEQ ID NO: 9123 - DNA, 71 bp, chicken (Gallus Gallus)
  misc_feature (36): n=g or t
tgcagagtcttaatcaacagttagacttatcaacancaaaagaagccagaatgcccatccaaggcttaatt

SEQ ID NO: 9124 - DNA, 71 bp, chicken (Gallus Gallus)
  misc_feature (36): n=c or g
tgctttgttctctcactcattataccctccttttanttttcattgagccaaaactgactggcaaagcaaca

SEQ ID NO: 9125 - DNA, 71 bp, chicken (Gallus Gallus)
  misc_feature (36): n=a or g
gtatatcaaccagtgtatttagcaaacttaattagngaaaattccaagtctttggttgtctgaatttgtgc

SEQ ID NO: 9126 - DNA, 71 bp, chicken (Gallus Gallus)
  misc_feature (36): n=a or g
agctttctgctttgacaggagtagtgttaaacagcntgttcttctgatgcctaagaaaaaacacatacatg

SEQ ID NO: 9127 - DNA, 71 bp, chicken (Gallus Gallus)
  misc_feature (36): n=c or t
tgcaaagaagcgaaaaacaaagcaatttaatcgccnaacaaaactccaagaaagattgtgctcttcgttgc

SEQ ID NO: 9128 - DNA, 71 bp, chicken (Gallus Gallus)
  misc_feature (36): n=a or g
aaactcaattctacctttaaaaaacctctatcagantgaaagttattcaaataaagcagaaattcttaata

SEQ ID NO: 9129 - DNA, 71 bp, chicken (Gallus Gallus)
  misc_feature (36): n=c or t
aaacttaggctgtggaattagtagtaagaacactanatattcgcaaaaacatttgcaaatgttgcttaaac

SEQ ID NO: 9130 - DNA, 71 bp, chicken (Gallus Gallus)
  misc_feature (36): n=c or g
gcgttactaatggacagtgatcctaaagaaaacagncagccataaaattcctgctgttttcaagcatattg

SEQ ID NO: 9131 - DNA, 71 bp, chicken (Gallus Gallus)
  misc_feature (36): n=a or t
aaattgtgtcacatgaggacagaaagacctactggntaataaaagctaccttcagagctagttctgtctcc

SEQ ID NO: 9132 - DNA, 71 bp, chicken (Gallus Gallus)
  misc_feature (36): n=a or g
gagtaactttccaagactaccacttaatgttgctcnctgccttaagtgatatgagccagatccaccctagg

SEQ ID NO: 9133 - DNA, 71 bp, chicken (Gallus Gallus)
  misc_feature (36): n=c or t
aatgtcacttctgctacagaactttataaatgaagnaatattaatcaattaatggacagtagtgtgtatgc

SEQ ID NO: 9134 - DNA, 71 bp, chicken (Gallus Gallus)
  misc_feature (36): n=a or g
aatcagcgtatgtgaactactcgtaatccctgtgcntttataattaccaaagtggcttggatggctttact

SEQ ID NO: 9135 - DNA, 71 bp, chicken (Gallus Gallus)
  misc_feature (36): n=a or g
acagtgcagaacaacaaaatatgatgaaaactcacntattgtcctgaaaattctgtaaatagatggctgta

SEQ ID NO: 9136 - DNA, 71 bp, chicken (Gallus Gallus)
  misc_feature (36): n=a or g
tccttcaggactttgtaagccctgtttcgatatacnttcagagctttgaaaacatctgctttctgcctgaa

SEQ ID NO: 9137 - DNA, 71 bp, chicken (Gallus Gallus)
  misc_feature (36): n=a or g
tgtattttgtctgccttgccactgatgcttagcaanacggaaatctgccttacccctgctacttccacagc

SEQ ID NO: 9138 - DNA, 71 bp, chicken (Gallus Gallus)
  misc_feature (36): n=c or t
cagggtaaaaagtcgtgtcaactgcctgatgtgaanttctgagcaggtaggtagggtccacgctccctgca

SEQ ID NO: 9139 - DNA, 71 bp, chicken (Gallus Gallus)
  misc_feature (36): n=c or t
ttcatttcattaataataatcttcatttccttatgncatattcctcaaacaatcttcctccaattctcttc

SEQ ID NO: 9140 - DNA, 71 bp, chicken (Gallus Gallus)
  misc_feature (36): n=g or t
atttaccattagtctgcagatctgccagtgtcccanataactgagttattaaagtagcgtggatgctaaaa

SEQ ID NO: 9141 - DNA, 71 bp, chicken (Gallus Gallus)
  misc_feature (36): n=c or t
ttgagcaacccatttctgcacataaagaacagctgnctggggcatgtcctgcaaactccttacctgaggta

SEQ ID NO: 9142 - DNA, 71 bp, chicken (Gallus Gallus)
  misc_feature (36): n=c or t
gatgatattctagggtttttgcagcggattgtattntttttaattgagataataatagagaagcactaata

SEQ ID NO: 9143 - DNA, 71 bp, chicken (Gallus Gallus)
  misc_feature (36): n=a or g
tttctcttacagtctgccttatatttttctcatttngttttatcgtttgaaatataccagtgtttctaaag

SEQ ID NO: 9144 - DNA, 71 bp, chicken (Gallus Gallus)
  misc_feature (36): n=a or g
aaggtaaaaggaacatttaggaattcctttgaacantacaactattatttcttaggagggagggttgctta

SEQ ID NO: 9145 - DNA, 71 bp, chicken (Gallus Gallus)
  misc_feature (36): n=a or g
catgctccggtggaggcctagccatcctttgggatnttttttgtttgtgtgtctggcaactcatctaatca

SEQ ID NO: 9146 - DNA, 71 bp, chicken (Gallus Gallus)
  misc_feature (36): n=c or t
cagcgagatttcaagagcagagctagtggactgaanctcctgtggttgtgaagatggcaaagaaaaaaaaa

SEQ ID NO: 9147 - DNA, 71 bp, chicken (Gallus Gallus)
  misc_feature (36): n=a or g
ccaggtgcttaattactgtttcaagtcatgacttancatttctgctacaagtacatactcctgtacattga

SEQ ID NO: 9148 - DNA, 71 bp, chicken (Gallus Gallus)
  misc_feature (36): n=a or g
cctaacaaatcaccttacttccaactgaaggcacanaagaattttaaaagtttatcacatgccatcctttg

SEQ ID NO: 9149 - DNA, 71 bp, chicken (Gallus Gallus)
  misc_feature (36): n=c or t
aacagagtagagcatgcagctttctcatatccccantgtattctgttttggctagttcttgctgaagttca

SEQ ID NO: 9150 - DNA, 71 bp, chicken (Gallus Gallus)
  misc_feature (36): n=a or t
ttgtttcccaccatgcttcccagatcttgcccaatnttaaactgcgtgactgtgttcctgaagaacaattt

SEQ ID NO: 9151 - DNA, 71 bp, chicken (Gallus Gallus)
  misc_feature (36): n=c or t
gttctgcccaataagcctcgcttcaaaatcaggtantgtactcaccttttaaaacgtaaccaacttgttca

SEQ ID NO: 9152 - DNA, 71 bp, chicken (Gallus Gallus)
  misc_feature (36): n=c or g
gagcaatctggcagcttagtgtagcatcttttcttngtgacagctgggagacatctacccaaaatagcatc

SEQ ID NO: 9153 - DNA, 71 bp, chicken (Gallus Gallus)
  misc_feature (36): n=a or t
gcctgttcatcaggtgtgactgactgtggagctggntgaagtattgctctacatcactggcacaagcaact

SEQ ID NO: 9154 - DNA, 71 bp, chicken (Gallus Gallus)
  misc_feature (36): n=a or c
caatggagggacagctacgttattaagtgaatcagntaagaaagttactctctgacaactttcagcaacag

SEQ ID NO: 9155 - DNA, 71 bp, chicken (Gallus Gallus)
  misc_feature (36): n=a or g
cagcatgcttgttttatctatgttttcttttcccantcacttcagagggaaggtgaaaaactagttgtctt

SEQ ID NO: 9156 - DNA, 71 bp, chicken (Gallus Gallus)
  misc_feature (36): n=c or t
ttcacctttgcctgcttccaggcatagaaacacttnagttagctgagagtgtctttggggctcttctttat

SEQ ID NO: 9157 - DNA, 71 bp, chicken (Gallus Gallus)
  misc_feature (36): n=c or g
gacctccctctgggccaactcagttaattaaaccantaaaaaactatcccaacccaaaaagcaaatagctt

SEQ ID NO: 9158 - DNA, 71 bp, chicken (Gallus Gallus)
  misc_feature (36): n=a or g
gcccttcatggcccataggataggactatgcaggcngctttaatttcacgccgatctccagtatttgtaac

SEQ ID NO: 9159 - DNA, 71 bp, chicken (Gallus Gallus)
  misc_feature (36): n=a or t
taaggattttgctgatatttttcactaagaacttanatcagcatattggtccaatctttgtaaattcagga

SEQ ID NO: 9160 - DNA, 71 bp, chicken (Gallus Gallus)
  misc_feature (36): n=a or g
aattcctctgcttctcagaagatactgtatggttgngcagattttattagcacagaaattttcatgtactc

SEQ ID NO: 9161 - DNA, 71 bp, chicken (Gallus Gallus)
  misc_feature (36): n=g or t
catgcatacagttgttttgaactgaaagacaaaggnaaagactaaacctccctctgctttattccagactt

SEQ ID NO: 9162 - DNA, 71 bp, chicken (Gallus Gallus)
  misc_feature (36): n=a or t
ttcacaacgatctcatcagagacacaaatatccagncatatatctgatgatacaagttgcaggtataaaaa

SEQ ID NO: 9163 - DNA, 71 bp, chicken (Gallus Gallus)
  misc_feature (36): n=a or g
cacataaactgaagctggttgtttagttttaacatnaaatacatagacaggatgtgaattaagggattagc

SEQ ID NO: 9164 - DNA, 71 bp, chicken (Gallus Gallus)
  misc_feature (36): n=a or g
tatgtacatggtaagaaagctgaaatcttgaaagancatgtgggtggaagacaaggtttgagtctcaagaa

SEQ ID NO: 9165 - DNA, 71 bp, chicken (Gallus Gallus)
  misc_feature (36): n=c or g
atcagaaactgggcccactgcagttgcaagtaattnttaatctaacacatcatcttttaaaactgtggctg

SEQ ID NO: 9166 - DNA, 71 bp, chicken (Gallus Gallus)
  misc_feature (36): n=c or t
ctttttcctaacatcatacagctcttgcttttctcngcctttttaatgcattaattatagaatatccaagt

SEQ ID NO: 9167 - DNA, 71 bp, chicken (Gallus Gallus)
  misc_feature (36): n=a or g
ccttctacgtcacagtagtgacaaagaaataacctntgattagaaagcacacacttattcaggagaggtag

SEQ ID NO: 9168 - DNA, 71 bp, chicken (Gallus Gallus)
  misc_feature (36): n=a or g
tgcttgccctgtctccccgtaatgttcaccaaactntgtcacatatgtaaaagtataatataatttttgtc

SEQ ID NO: 9169 - DNA, 71 bp, chicken (Gallus Gallus)
  misc_feature (36): n=c or t
gaatcaaagttcttcaatacttggctttgcagtggngcaccccactccttactcatagtttgacaaatttc

SEQ ID NO: 9170 - DNA, 71 bp, chicken (Gallus Gallus)
  misc_feature (36): n=c or t
aaactgtctaaaatgtgttatgatgctgttctgtcntagctgatattaattctttatgaacacagtgcaac

SEQ ID NO: 9171 - DNA, 71 bp, chicken (Gallus Gallus)
  misc_feature (36): n=c or t
ctgtcctccattagtgtttactcaaattagctgtanaacgtttaagttttactattcagttttgaagggaa

SEQ ID NO: 9172 - DNA, 71 bp, chicken (Gallus Gallus)
  misc_feature (36): n=a or t
gaaaaacggtggcaagtaaatccaggattaaatganattacactctgatccaaaatcatgcatcttgtcta

SEQ ID NO: 9173 - DNA, 71 bp, chicken (Gallus Gallus)
  misc_feature (36): n=a or g
cccttagcctccacgttgtctctatcaacaggagcnccaattaaaattatagtctctgaatttggacacat

SEQ ID NO: 9174 - DNA, 71 bp, chicken (Gallus Gallus)
  misc_feature (36): n=a or g
tggggaacttcactacaagatactcttacatcatcntgtggttgcatttttttttcctgctggtctcataa

SEQ ID NO: 9175 - DNA, 71 bp, chicken (Gallus Gallus)
  misc_feature (36): n=g or t
cgtgtttgtcccatccatttcccttatcttgacagntgagcctccacccaccccccccctcctccccggta

SEQ ID NO: 9176 - DNA, 71 bp, chicken (Gallus Gallus)
  misc_feature (36): n=c or t
ttccatgaaactattgcttgaagctcctgagaatcngagcaggacttcccccagcctggtgtcttcgtgca

SEQ ID NO: 9177 - DNA, 71 bp, chicken (Gallus Gallus)
  misc_feature (36): n=c or t
ctgtaacagtcttggggtttcttcctgttccaaaantgcttattgtttgcccatggtagaagcaataattc

SEQ ID NO: 9178 - DNA, 71 bp, chicken (Gallus Gallus)
  misc_feature (36): n=a or g
ctagcacgcagtcaaatagagcccaactgtttacantaatcatcattagtcaggaggtaatctttcatgat

SEQ ID NO: 9179 - DNA, 71 bp, chicken (Gallus Gallus)
  misc_feature (36): n=a or g
tacatagcaaaacttttttattcatgcatacatacntttattggttatatataaagccacaaccaagatat

SEQ ID NO: 9180 - DNA, 71 bp, chicken (Gallus Gallus)
  misc_feature (36): n=a or g
tatgttagcagtagaataagatggattccatacacntacgtctgataactaggtttggcataggtagagat

SEQ ID NO: 9181 - DNA, 71 bp, chicken (Gallus Gallus)
  misc_feature (36): n=c or g
cagtcctcttgctaaggtgactagcaagtgaattcntacatctgaggagaaagccccatgacaacctgaag

SEQ ID NO: 9182 - DNA, 71 bp, chicken (Gallus Gallus)
  misc_feature (36): n=c or t
ctttatttactgtatttctgaggaactggaaggcantactttgagagcaacctacacatttgatatagatc

SEQ ID NO: 9183 - DNA, 71 bp, chicken (Gallus Gallus)
  misc_feature (36): n=c or t
taagaggatcaacatcgtttcaacacccaaatccangttccctaccccaaaacctagctacagtacttggt

SEQ ID NO: 9184 - DNA, 71 bp, chicken (Gallus Gallus)
  misc_feature (36): n=a or g
ctagtgcaagaatatgtggtaattttttgctggtcnatagatgattttaaaatattaactcaaaacttgct

SEQ ID NO: 9185 - DNA, 71 bp, chicken (Gallus Gallus)
  misc_feature (36): n=a or g
actgaagacgttgatcaacagtcggctgtccacacnaacttgctaagaggacctcaagtgaaagcctaaaa

SEQ ID NO: 9186 - DNA, 71 bp, chicken (Gallus Gallus)
  misc_feature (36): n=g or t
cctgtttgaagaaaaacaagaaaaatgaaaagacanaattagatttttgtcagatgtttaaaagcaacaga

SEQ ID NO: 9187 - DNA, 71 bp, chicken (Gallus Gallus)
  misc_feature (36): n=a or g
aaaacggatgaaaggtagacatactcaccaaaggangggagaacagtaaaaggtaggtgttgtcactggca

SEQ ID NO: 9188 - DNA, 71 bp, chicken (Gallus Gallus)
  misc_feature (36): n=a or g
tgtttctctgttgctgtcattagaacaaccactgcnctgggttaaaaggtgccatagcagtttttcatgcc

SEQ ID NO: 9189 - DNA, 71 bp, chicken (Gallus Gallus)
  misc_feature (36): n=c or t
taaaaacatatggcgtatggttgtgaaccagtacantgaacaattagtacaggatcattatttgtgtcatt

SEQ ID NO: 9190 - DNA, 71 bp, chicken (Gallus Gallus)
  misc_feature (36): n=c or t
acaatatataaatacactaagaattcatggtgcatnagaattactgctgagatttctgaaagctggttgat

SEQ ID NO: 9191 - DNA, 71 bp, chicken (Gallus Gallus)
  misc_feature (36): n=c or t
gatgaaagtaattgtttgacagttatctgagtaggncctatattttgaggtggaaaataagactccatctt

SEQ ID NO: 9192 - DNA, 71 bp, chicken (Gallus Gallus)
  misc_feature (36): n=a or g
gaagaccagtagtcatcttaattgcataagcttatngcctgtggaatactgtatcatgagaaagaaaaaac

SEQ ID NO: 9193 - DNA, 71 bp, chicken (Gallus Gallus)
  misc_feature (36): n=c or t
aaaacagctactgttcaccgtatgtgtacaatgtangtattgctcattctgttaaaaaaataacctcaatt

SEQ ID NO: 9194 - DNA, 71 bp, chicken (Gallus Gallus)
  misc_feature (36): n=g or t
gaggtttgaagaggcaaacactgtgcacagggtgtncttgtgatttaggggcaccctgcacccctgtcagg

SEQ ID NO: 9195 - DNA, 71 bp, chicken (Gallus Gallus)
  misc_feature (36): n=g or t
ttcttctctttctacctcaattatgtgatctgtatncatctgaaacatcattaaggtatgtctgtgaaaca

SEQ ID NO: 9196 - DNA, 71 bp, chicken (Gallus Gallus)
  misc_feature (36): n=a or g
acatagtcctaattgcagtaagtgtttttagcctantgacttgagctggactttgatacttgcctgcaaca

SEQ ID NO: 9197 - DNA, 71 bp, chicken (Gallus Gallus)
  misc_feature (36): n=c or t
cttctgcattaaaaaacaaactgaacaaactgtggnacaaaggaatatagttcatgttgagaaatcctctt

SEQ ID NO: 9198 - DNA, 71 bp, chicken (Gallus Gallus)
  misc_feature (36): n=c or t
agtagctagaccgcacagagctgcacattgctcatngacacagctgcgctacccaactgcactgcagttat

SEQ ID NO: 9199 - DNA, 71 bp, chicken (Gallus Gallus)
  misc_feature (36): n=a or g
attaatcacttggacaagggccttctaaagacactnctgtaggaaacctaagaagctcagtctctatatct

SEQ ID NO: 9200 - DNA, 71 bp, chicken (Gallus Gallus)
  misc_feature (36): n=a or g
aggtgaaactaaaacctctgtgcgcagttctagaantgtggatatttttacactgtggcattaactcagtt

SEQ ID NO: 9201 - DNA, 71 bp, chicken (Gallus Gallus)
  misc_feature (36): n=c or t
gtttttgaaataagagttaacattttatgctcctcngcaatcatgggtgtagctcaggaaaaaagtctgta

SEQ ID NO: 9202 - DNA, 71 bp, chicken (Gallus Gallus)
  misc_feature (36): n=a or g
agcatatgtcagtcgtgcatcctgctaacaatgatngctgaggatgtattagactgtcccaagagaaggat

SEQ ID NO: 9203 - DNA, 71 bp, chicken (Gallus Gallus)
  misc_feature (36): n=a or g
tgctgaagctatgtggtggtatctcacaagcttccntgatgttaagtttagaaaaacctaagtattttaac

SEQ ID NO: 9204 - DNA, 71 bp, chicken (Gallus Gallus)
  misc_feature (36): n=c or t
atataattaaagttaacacataccaggatgttcagnctatcatcttaaagggaagaaatgatagcaagagt

SEQ ID NO: 9205 - DNA, 71 bp, chicken (Gallus Gallus)
  misc_feature (36): n=c or t
gattttctttgccccaacattactgccatgctctangctttgagtcaaatgttatactaaaaagttttcat

SEQ ID NO: 9206 - DNA, 71 bp, chicken (Gallus Gallus)
  misc_feature (36): n=a or g
caatatcatatcttattcatatgacttgtcttggtnttgtgctcctaaattccacacagtcatataattaa

SEQ ID NO: 9207 - DNA, 71 bp, chicken (Gallus Gallus)
  misc_feature (36): n=a or g
tcaatgtgtgtgtgaataaactaaactgatgtgggntggtggtggttttcttttgtcaagtgcttcagctc

SEQ ID NO: 9208 - DNA, 71 bp, chicken (Gallus Gallus)
  misc_feature (36): n=a or g
tacatgtataactatgtacgtataaaaacataagcncacaaaaagcagtgctacataaatcctgccggtca

SEQ ID NO: 9209 - DNA, 71 bp, chicken (Gallus Gallus)
  misc_feature (36): n=a or g
agcactctgaagtttttgaatctctgtatttaaggnaaatattctgaaaagtgaattaatttgtaagcaat

SEQ ID NO: 9210 - DNA, 71 bp, chicken (Gallus Gallus)
  misc_feature (36): n=g or t
gtacatttctgaaattatgttttgaagataaatgtnagcatgagtgatagggaattctgaatgttcctttt

SEQ ID NO: 9211 - DNA, 71 bp, chicken (Gallus Gallus)
  misc_feature (36): n=c or t
gatcagtgttgatcagaatttgaatgcccgggattncactttatactgtgatgtgttattgtcatctcagt

SEQ ID NO: 9212 - DNA, 71 bp, chicken (Gallus Gallus)
  misc_feature (36): n=c or g
gagactttgctgtacttgcagactctacttgtgtanaagcagcagttactgctatgctgagagtgcaaaaa

SEQ ID NO: 9213 - DNA, 71 bp, chicken (Gallus Gallus)
  misc_feature (36): n=c or t
tgtgagaggcgcctgcaccgctgcaatcgatgttcntattgtaaagctgataggtgactcagaacctgcca

SEQ ID NO: 9214 - DNA, 71 bp, chicken (Gallus Gallus)
  misc_feature (36): n=a or g
ttggacttcatccctgtattcttccaaggccaatantacttgtcaaagggtgttaaattatagagatctat

SEQ ID NO: 9215 - DNA, 71 bp, chicken (Gallus Gallus)
  misc_feature (36): n=a or g
tgaaaatgagagtataaccagtagaacatacactgntcatttcttttgcatagagacttatatgagagagg

SEQ ID NO: 9216 - DNA, 71 bp, chicken (Gallus Gallus)
  misc_feature (36): n=c or t
ttgagtttcatcaagtgctgtgaattggcttgtgcnttctgtccttaagctgaaattagccttgctgaata

SEQ ID NO: 9217 - DNA, 71 bp, chicken (Gallus Gallus)
  misc_feature (36): n=c or g
tttgccctcagtgttcttggagtagaaattctgtangaagcatgcaaagttggtgtgaggacagcaagaag

SEQ ID NO: 9218 - DNA, 71 bp, chicken (Gallus Gallus)
  misc_feature (36): n=a or g
atatagtttcattcatattcacttctgacagcagtncaagaaagcagcatgaatttatctctgtagtggag

SEQ ID NO: 9219 - DNA, 71 bp, chicken (Gallus Gallus)
  misc_feature (36): n=a or t
aatttaaacagtgtgcactttctctctggattttgnctttttgctggttatgaaacctaacaacgtgaaga

SEQ ID NO: 9220 - DNA, 71 bp, chicken (Gallus Gallus)
  misc_feature (36): n=c or t
gacttcaacgtatagagagaaatataaacaggaaangtttaattctgtcttagtgaattacgtaccaggca

SEQ ID NO: 9221 - DNA, 71 bp, chicken (Gallus Gallus)
  misc_feature (36): n=a or g
tagcagctcctgacaataccagctccgagaagttcnctgctctaacagcactgcattgaagaggcacatat

SEQ ID NO: 9222 - DNA, 71 bp, chicken (Gallus Gallus)
  misc_feature (36): n=c or t
gctacctgtgactatgaaacaaatgaatctagcaanagcctgactgctgtgttccaggtacacaaaagaaa

SEQ ID NO: 9223 - DNA, 71 bp, chicken (Gallus Gallus)
  misc_feature (36): n=c or t
tgactgcagtgaatttcactgcgctgtcttcagtanaagccgtaaatagagtaaaaactaaaaattgaagt

SEQ ID NO: 9224 - DNA, 71 bp, chicken (Gallus Gallus)
  misc_feature (36): n=c or t
atggcaaagatgatggatccaagagtccttcatcanatgggtatgcgttgcctttttacagcttcagcagg

SEQ ID NO: 9225 - DNA, 71 bp, chicken (Gallus Gallus)
  misc_feature (36): n=a or g
ggcccacttcccacgccgaggcacagacagcaaggngtggaagaggaattaccagtgccagagccacacag

SEQ ID NO: 9226 - DNA, 71 bp, chicken (Gallus Gallus)
  misc_feature (36): n=a or g
tgcaggagtctgaagccagaaaagagtgaagtctcngggctctcgggaaggatatcatttcctttactaag

SEQ ID NO: 9227 - DNA, 71 bp, chicken (Gallus Gallus)
  misc_feature (36): n=a or g
aaaagtctcatacacagctgctaaagggttgactgnatgtggcagtgatctgtgagattataacattgtcc

SEQ ID NO: 9228 - DNA, 71 bp, chicken (Gallus Gallus)
  misc_feature (36): n=c or g
aggattcaaaacataaagtgtgtcattgtgctgttnagcacccaagaaaaatggcatctctgatgaaaggg

SEQ ID NO: 9229 - DNA, 71 bp, chicken (Gallus Gallus)
  misc_feature (36): n=g or t
ctcagcaaataattctgcacaaacaaaatcagactntatattgaaaacagaggcaatacatggtcttaaaa

SEQ ID NO: 9230 - DNA, 71 bp, chicken (Gallus Gallus)
  misc_feature (36): n=c or t
atcagttatacagaaatggatcctgtaattattgcntcagaaggtgttgagaaatttaagaatgaaaactt

SEQ ID NO: 9231 - DNA, 71 bp, chicken (Gallus Gallus)
  misc_feature (36): n=c or t
aggcagccagtggatgacagggcaagcaggatctantaaaacaaataaagcttctatcttctctgtaactc

SEQ ID NO: 9232 - DNA, 71 bp, chicken (Gallus Gallus)
  misc_feature (36): n=a or c
ttctgtaatcagcaaataccttgaacacccactggnaacattttcactctttccattggtaggggttcagg

SEQ ID NO: 9233 - DNA, 71 bp, chicken (Gallus Gallus)
  misc_feature (36): n=a or g
ggtgatgtgatagatgggaaatgcaggcttgagcantccttgcaaatctgctgaggtattgaggcttttta

SEQ ID NO: 9234 - DNA, 71 bp, chicken (Gallus Gallus)
  misc_feature (36): n=a or g
acaccaggagccggaaaaaaaggtgcccctagagcnggcagctctcattgaaggtagactcagtctctcca

SEQ ID NO: 9235 - DNA, 71 bp, chicken (Gallus Gallus)
  misc_feature (36): n=a or g
gatttccattatactgataccagactgaaatgccancactctgcctggttctcagtatttgtgagcaaaag

SEQ ID NO: 9236 - DNA, 71 bp, chicken (Gallus Gallus)
  misc_feature (36): n=c or t
ctgttgtttgccacttagggaatgtgttctgtcctngggacctgggatgtaagcctgataaaggttttggt

SEQ ID NO: 9237 - DNA, 71 bp, chicken (Gallus Gallus)
  misc_feature (36): n=c or t
gtaagctggtatggggagtagccctggtaggtcacnttgttcacatctgccccgtgtttcaccagaagtga

SEQ ID NO: 9238 - DNA, 71 bp, chicken (Gallus Gallus)
  misc_feature (36): n=c or t
ttctgaggcaagcttctggtagctggaatgtgctcnttgcatttagagtgtgctgccttggtccagacccg

SEQ ID NO: 9239 - DNA, 71 bp, chicken (Gallus Gallus)
  misc_feature (36): n=a or c
aaaaaaaaagagaagaaaagaaaaccgcaaaacacnacgaagtatcttcatcctaatgaaggcatcaccgc

SEQ ID NO: 9240 - DNA, 71 bp, chicken (Gallus Gallus)
  misc_feature (36): n=c or t
tctcctctatttacacaattcaagacatccaaatcntcagagcagggccagggctgctgtcagcagctggc

SEQ ID NO: 9241 - DNA, 71 bp, chicken (Gallus Gallus)
  misc_feature (36): n=c or t
ttgaggaaagttttagattaagtgagaggaaattangaaccttaaattagttatccaagcctttttcttag

SEQ ID NO: 9242 - DNA, 71 bp, chicken (Gallus Gallus)
  misc_feature (36): n=a or g
cccctttacggacatagtcttctgctctaggacccnttttccaaccatttaatgccaggcatccttcttga

SEQ ID NO: 9243 - DNA, 71 bp, chicken (Gallus Gallus)
  misc_feature (36): n=c or t
aaccgtgctgtatatacatctgtatgtacagaagtnacataccctcatttttgtttttaccagtttcatct

SEQ ID NO: 9244 - DNA, 71 bp, chicken (Gallus Gallus)
  misc_feature (36): n=a or g
aaagagggtagagacctggaaattgccaccattganagtaataacatttttacttcttttattacctttga

SEQ ID NO: 9245 - DNA, 71 bp, chicken (Gallus Gallus)
  misc_feature (36): n=a or g
tttgctataaacagctcctaatgcaggtgaaaaccntgtattgattacttaaagaaagttaaaataaaagc

SEQ ID NO: 9246 - DNA, 71 bp, chicken (Gallus Gallus)
  misc_feature (36): n=a or g
aactcatgggacattatgaagcttggtttaccaganctgcttatcggtgcgaagagtaagattcttcttag

SEQ ID NO: 9247 - DNA, 71 bp, chicken (Gallus Gallus)
  misc_feature (36): n=a or g
caagaccacactggtgactccaaacactgcagcacnttgacacacctcacactgtaggttggaatggccaa

SEQ ID NO: 9248 - DNA, 71 bp, chicken (Gallus Gallus)
  misc_feature (36): n=c or g
gacctaatatgtccaagcctctgtaagtattttcanaccaccctgttatcctgcgtatatcaagtaccctc

SEQ ID NO: 9249 - DNA, 71 bp, chicken (Gallus Gallus)
  misc_feature (36): n=c or t
ttatttgctgactagcatgttttataattaatatgntatatttcctctaatttgtctatctaatatttagg

SEQ ID NO: 9250 - DNA, 71 bp, chicken (Gallus Gallus)
  misc_feature (36): n=a or g
ctatttagactaacatcaatttcacctgcatttgcnaagtgcagctatacatacacatttgcgtataaaca

SEQ ID NO: 9251 - DNA, 71 bp, chicken (Gallus Gallus)
  misc_feature (36): n=c or t
gatagtgtattcttatatccaacatgtgacaagtgntttgcccagcctgtacttttgccactttttttgat

SEQ ID NO: 9252 - DNA, 71 bp, chicken (Gallus Gallus)
  misc_feature (36): n=a or g
ctatagagtcccagagtacaaaaatcgtattgaacntcatccagactgctgttaacaaacttacagaaaca

SEQ ID NO: 9253 - DNA, 71 bp, chicken (Gallus Gallus)
  misc_feature (36): n=a or g
ccattattttcagtgtactcaatgcacgcaacacanttacaacttcacaccttcttttaacttcagttttc

SEQ ID NO: 9254 - DNA, 71 bp, chicken (Gallus Gallus)
  misc_feature (36): n=c or t
tactacctgtagaaagaccattttaacagaaattgncgtgctgctttaggaaagctgggtcttccttcata

SEQ ID NO: 9255 - DNA, 71 bp, chicken (Gallus Gallus)
  misc_feature (36): n=a or g
gctgttgttctttgatctctccagttccaacgtggnccatatcacgtgagctacacaagagagaatgtcca

SEQ ID NO: 9256 - DNA, 71 bp, chicken (Gallus Gallus)
  misc_feature (36): n=c or t
aaagttatgggaaagttattttgttttgaactgtgntacctcctcccttggtggagctacagaaatgtttc

SEQ ID NO: 9257 - DNA, 71 bp, chicken (Gallus Gallus)
  misc_feature (36): n=a or g
ttctggctttgcaacattttgtgcaaaaggactggntctgtgcaaatgaaacgtagcagccctatttctga

SEQ ID NO: 9258 - DNA, 71 bp, chicken (Gallus Gallus)
  misc_feature (36): n=c or t
gagctctgaagagagcaaagagattttagctcttangggattcatggatactatcagtttccatctgtatg

SEQ ID NO: 9259 - DNA, 71 bp, chicken (Gallus Gallus)
  misc_feature (36): n=c or t
agttccttgggagtgtggcagaccagaccctcgtgnatactccagttaacacttgaccatttgcccagaag

SEQ ID NO: 9260 - DNA, 71 bp, chicken (Gallus Gallus)
  misc_feature (36): n=a or g
taacctttgtctgttatgtgcactgacatgcagcanttgtgtttgtagtggagcctgtgcagcacatatcc

SEQ ID NO: 9261 - DNA, 71 bp, chicken (Gallus Gallus)
  misc_feature (36): n=c or t
tgaagctgtagtgaaacgtgttcagcattggatggnattctcttaactggatgacactttgctttccagtt

SEQ ID NO: 9262 - DNA, 71 bp, chicken (Gallus Gallus)
  misc_feature (36): n=a or g
ctaactttattaaataagcaaaagcttaattgtgtnttctctacttgtgaaaaataccttttttttccatt

SEQ ID NO: 9263 - DNA, 71 bp, chicken (Gallus Gallus)
  misc_feature (36): n=a or g
ttacaggatgctttttcatgcagctgtacaccttgnaagcagaaagcagtcaagcggagccaagattcttg

SEQ ID NO: 9264 - DNA, 71 bp, chicken (Gallus Gallus)
  misc_feature (36): n=c or g
tgtttacagaaagcctgaaatctcaatatgtgaacntatcaattctaattatttgattcattagaacatga

SEQ ID NO: 9265 - DNA, 71 bp, chicken (Gallus Gallus)
  misc_feature (36): n=c or t
gatcttagaggacttttccaacttcagtgattctangatctgaaagtcactacttgactacttgctgagca

SEQ ID NO: 9266 - DNA, 71 bp, chicken (Gallus Gallus)
  misc_feature (36): n=c or t
ggatggccattgcattcttattttctagctgagcanagaggccacaataaaccaaaacaaacaaacaaaaa

SEQ ID NO: 9267 - DNA, 71 bp, chicken (Gallus Gallus)
  misc_feature (36): n=c or t
cacagcccgcgccaccaatctcacgccgctccgcgngctaacccgttagagaagctcacgttacgccgcgc

SEQ ID NO: 9268 - DNA, 71 bp, chicken (Gallus Gallus)
  misc_feature (36): n=c or t
gcaatgtttggagagaggtaaaaaaaaaatacaagngtattctaattcaatggaccctatctgatactgtc

SEQ ID NO: 9269 - DNA, 71 bp, chicken (Gallus Gallus)
  misc_feature (36): n=a or g
tcattcccctgtacccaagaggacatccagaactcncattacttttagtccttctgttagtcttttcttag

SEQ ID NO: 9270 - DNA, 71 bp, chicken (Gallus Gallus)
  misc_feature (36): n=c or t
ctggcagctacaaaggttagaacacagcatgctgcngacatcccgcagcactttaaccttcactgcacttc

SEQ ID NO: 9271 - DNA, 71 bp, chicken (Gallus Gallus)
  misc_feature (36): n=a or g
aaaaacctttaccacacagtactaattgtctatagngcagcaaataatatgtgccttagaactggtattta

SEQ ID NO: 9272 - DNA, 71 bp, chicken (Gallus Gallus)
  misc_feature (36): n=a or g
accccaaaacttctaagaagtacaaagctcttgctntagacccttagaagcaagcacctcttttatatcca

SEQ ID NO: 9273 - DNA, 71 bp, chicken (Gallus Gallus)
  misc_feature (36): n=c or t
gctgtgctttttgacagcttcttttgtggtgcctgnggcccgcagtttaacctttgttcccaaatgttatg

SEQ ID NO: 9274 - DNA, 71 bp, chicken (Gallus Gallus)
  misc_feature (36): n=c or t
acgcctaatacctttattctaaaaggaactgtactnctcaggggaaacagaaaagagactcctctcctagt

SEQ ID NO: 9275 - DNA, 71 bp, chicken (Gallus Gallus)
  misc_feature (36): n=a or g
gtggttggtgtagcacacttcagtttgctgtctccnaaatgctatatgttaatggttggttctgaaaaaat

SEQ ID NO: 9276 - DNA, 71 bp, chicken (Gallus Gallus)
  misc_feature (36): n=c or t
caatgtaaagcaactttcaaatattttttgctcatnccttacaggtatatatatattaaagaaagggtagg

SEQ ID NO: 9277 - DNA, 71 bp, chicken (Gallus Gallus)
  misc_feature (36): n=a or g
attccctaagaagtactgcctctgtgtctccttttncctggagagtgctttgctacaccgctcagtgacgg

SEQ ID NO: 9278 - DNA, 71 bp, chicken (Gallus Gallus)
  misc_feature (36): n=a or g
tttctattttgccatgttctagtcgcagaaagtatnttttaatcacaggtctgttgctgagttttatacat

SEQ ID NO: 9279 - DNA, 71 bp, chicken (Gallus Gallus)
  misc_feature (36): n=a or g
gaaaaactgacttcactgtgcaaattatgtcatccngcaaaagtttaaagaaaaataactgcttgtagctg

SEQ ID NO: 9280 - DNA, 71 bp, chicken (Gallus Gallus)
  misc_feature (36): n=c or t
actttttctggaggtttctaagggctacataatgcnagaaacacatctaggctgcagtggatggacgcatc

SEQ ID NO: 9281 - DNA, 71 bp, chicken (Gallus Gallus)
  misc_feature (36): n=c or t
tattaccaagccctccttccaaggctcccccttccnccagactgaatcatcatatgcttaagtgccttgac

SEQ ID NO: 9282 - DNA, 71 bp, chicken (Gallus Gallus)
  misc_feature (36): n=c or t
gcagataagtgggtgtttggcctggcatgactttcntctgtcccaggagtggggaggctggtggtatccct

SEQ ID NO: 9283 - DNA, 71 bp, chicken (Gallus Gallus)
  misc_feature (36): n=a or g
tagcaatacttggctgttaaaatgaaagccattcanaatgttgcctgtggggtcgatcctgacccctgctc

SEQ ID NO: 9284 - DNA, 71 bp, chicken (Gallus Gallus)
  misc_feature (36): n=c or t
tgcagaatattaggttgttcagaaagtcatttgatnatgaaaagaaaaaaaaacttgataaattttcctgt

SEQ ID NO: 9285 - DNA, 71 bp, chicken (Gallus Gallus)
  misc_feature (36): n=c or g
ggaagtcaccaccttgttgacttcccaaacttgtancagccaggtcatcaagctactaatcattatatctt

SEQ ID NO: 9286 - DNA, 71 bp, chicken (Gallus Gallus)
  misc_feature (36): n=a or g
tcagatagtggtttcatggacatgggacaatctctnagggctcttttgtggctgggctgaggctggggtgt

SEQ ID NO: 9287 - DNA, 71 bp, chicken (Gallus Gallus)
  misc_feature (36): n=a or g
cacgttcttctctgcaggcaactacatgccccaaanttgtatgtggtctaggagagaaacaggagcagctc

SEQ ID NO: 9288 - DNA, 71 bp, chicken (Gallus Gallus)
  misc_feature (36): n=c or t
cagccctctaaaggaacacactgtctcttaccattngtgtccctcatttcctcttctcgtttcttcatata

SEQ ID NO: 9289 - DNA, 71 bp, chicken (Gallus Gallus)
  misc_feature (36): n=a or c
agggcacttcctagtggttcttctggggcacctgcnttccatccaaagttcagggtgtgcgagggaaaagc

SEQ ID NO: 9290 - DNA, 71 bp, chicken (Gallus Gallus)
  misc_feature (36): n=c or t
ttagtggcatcctctttagcatacaggatgtgcccngctgagtcagttatctgtaaaagagataacaaagg

SEQ ID NO: 9291 - DNA, 71 bp, chicken (Gallus Gallus)
  misc_feature (36): n=a or c
atctcatacaagagacagcatcctcctcctcctcancatctgcctggaagcatggactcagtattgactcc

SEQ ID NO: 9292 - DNA, 71 bp, chicken (Gallus Gallus)
  misc_feature (36): n=c or t
gctgaagagaagtctgcctgtttcatggaagtgctntgaaaagtgcagtgcaaggcagtgcagcagcttct

SEQ ID NO: 9293 - DNA, 71 bp, chicken (Gallus Gallus)
  misc_feature (36): n=c or t
aatggctgttctctgcttttctttccttatcctacnattgcatgttcttcaactttactcccctgacagtt

SEQ ID NO: 9294 - DNA, 71 bp, chicken (Gallus Gallus)
  misc_feature (36): n=c or t
cctgtgctgtgtcttccaggacctggctgaaagtgnatttccaacaggtgctttcagtatgctgctaaaaa

SEQ ID NO: 9295 - DNA, 71 bp, chicken (Gallus Gallus)
  misc_feature (36): n=a or g
aattagagtaattccacacaaatactggtaaaagcncattgttaggatagcaaagttgggaatttgcaagc

SEQ ID NO: 9296 - DNA, 71 bp, chicken (Gallus Gallus)
  misc_feature (36): n=a or g
gctctcttttcctcctgctgcccacacagcaactcntgctcctttggtgggcatctttgtgtgcagggggc

SEQ ID NO: 9297 - DNA, 71 bp, chicken (Gallus Gallus)
  misc_feature (36): n=g or t
ccgtggacgtcatccagtcgtggcctttgtgaatcnggagagaacagacccttcctcagcaaggggggaag

SEQ ID NO: 9298 - DNA, 71 bp, chicken (Gallus Gallus)
  misc_feature (36): n=a or g
ttgtctgggacacttaagcagccctcactttcaccnccactttgtggcctctgtactggagatctacagct

SEQ ID NO: 9299 - DNA, 71 bp, chicken (Gallus Gallus)
  misc_feature (36): n=a or g
aagtaattaagaaagcagtgagttatttagctttcnaccctgaactcataaagaagtattgggaaaaaatc

SEQ ID NO: 9300 - DNA, 71 bp, chicken (Gallus Gallus)
  misc_feature (36): n=c or t
tgtagtaaagctgtgtctgcatggatgtcatgctcnaaatagtgggtgaaatactctcatgggtatatgtg

SEQ ID NO: 9301 - DNA, 71 bp, chicken (Gallus Gallus)
  misc_feature (36): n=c or t
ccagtctgtcctacagaagcaggatgaaacccggancgtttctaacaaaggtttgttcctcaccacttcgt

SEQ ID NO: 9302 - DNA, 71 bp, chicken (Gallus Gallus)
  misc_feature (36): n=a or g
gcaaagactctctgcatgtgtataactgtaggtctncataaggcaagacactagcatcctctggtatcgct

SEQ ID NO: 9303 - DNA, 71 bp, chicken (Gallus Gallus)
  misc_feature (36): n=a or t
taattgtgttgctctgagaagaatttgaggaagaantcctggattgggtactgctctgttcatactgtctc

SEQ ID NO: 9304 - DNA, 71 bp, chicken (Gallus Gallus)
  misc_feature (36): n=a or c
gaaaaggaggaaactgaggactacaaccaatttgtnaagatttttctggctcattctacaggctgttgctg

SEQ ID NO: 9305 - DNA, 71 bp, chicken (Gallus Gallus)
  misc_feature (36): n=c or g
tgtaaattataggtccttttctgacttcagacatgngaaaagagaactaagaacacctatttagggtcatg

SEQ ID NO: 9306 - DNA, 71 bp, chicken (Gallus Gallus)
  misc_feature (36): n=a or g
cttgcatccaaagctctccccagtctaatttggttnttgttgctctgcctaggtgctaaagccagtacagt

SEQ ID NO: 9307 - DNA, 71 bp, chicken (Gallus Gallus)
  misc_feature (36): n=a or g
gattcacccaccaagtgcgagtacatgcttaatgcnatccccaagcgactgtgcctcgtgtgtggggacat

SEQ ID NO: 9308 - DNA, 71 bp, chicken (Gallus Gallus)
  misc_feature (36): n=a or g
attgaaggcagggggatgagctaggtttggcagagngtgcttttagcagacatggtatatttgggtgaaca

SEQ ID NO: 9309 - DNA, 71 bp, chicken (Gallus Gallus)
  misc_feature (36): n=c or g
ctggaatcctgctggggctgattcatcacaaatggngttacagtgacgattagggaactcagcctggattg

SEQ ID NO: 9310 - DNA, 71 bp, chicken (Gallus Gallus)
  misc_feature (36): n=c or g
ctgcaattttatattccagcaactttatctgtgcanatggatgctgcagagtcagacctaccagcaacacc

SEQ ID NO: 9311 - DNA, 71 bp, chicken (Gallus Gallus)
  misc_feature (36): n=a or c
acagctatgaacagggggctgaatgtatgtacgggnagggtagcttccatttgaaacatctgttatttgag

SEQ ID NO: 9312 - DNA, 71 bp, chicken (Gallus Gallus)
  misc_feature (36): n=a or g
gattaacaattaattaacaccaagaggcctgcgctntgctgggacctcactgcactcaggcagcctacagg

SEQ ID NO: 9313 - DNA, 71 bp, chicken (Gallus Gallus)
  misc_feature (36): n=a or g
actgatttgtgccttcctggtgcagatttgtcagcncagagtgttcccacagggccagcaggccaggccaa

SEQ ID NO: 9314 - DNA, 71 bp, chicken (Gallus Gallus)
  misc_feature (36): n=c or t
ctggtgacacgtagtggtggtaagtgataagactgncagtggtttggtgacaagcctgcagctgacagctg

SEQ ID NO: 9315 - DNA, 71 bp, chicken (Gallus Gallus)
  misc_feature (36): n=c or g
caaccagaagtattaaccttttcctgaacagagctnaatctacacaagcaccttcctactctttcctccaa

SEQ ID NO: 9316 - DNA, 71 bp, chicken (Gallus Gallus)
  misc_feature (36): n=c or t
atacagtgggaattttattccacctatatttgatanttttacatgttttgatcagccatagattactattt

SEQ ID NO: 9317 - DNA, 71 bp, chicken (Gallus Gallus)
  misc_feature (36): n=a or g
acagaagcatctaaaatggagaattctcctgtatcnaggagcacagttttgtctactagtccttttgccca

SEQ ID NO: 9318 - DNA, 71 bp, chicken (Gallus Gallus)
  misc_feature (36): n=c or t
agttgccttcaaccagcctgaatgcctctgtcctgngagcacccagtgtcactgacaaacattgatcatgc

SEQ ID NO: 9319 - DNA, 71 bp, chicken (Gallus Gallus)
  misc_feature (36): n=c or t
agagcacccagacattcgtgtcctgtaagacatttntcattaccttgtactccaaaaggcattatttagta

SEQ ID NO: 9320 - DNA, 71 bp, chicken (Gallus Gallus)
  misc_feature (36): n=c or t
ctgccgtgcacaagttctgaatcagtggggggatgntgctgaagagcctgtgctggtcttcagtgtctcca

SEQ ID NO: 9321 - DNA, 71 bp, chicken (Gallus Gallus)
  misc_feature (36): n=a or g
cccagcactgagtgattgcagggttaattcccttangtgtgagcttccttctctatgtgggggataacccc

SEQ ID NO: 9322 - DNA, 71 bp, chicken (Gallus Gallus)
  misc_feature (36): n=c or t
ggagagtaaataagaagaaaaataagggcaattgtnttatgagaggatgaaaggaagggggacagaaggaa

SEQ ID NO: 9323 - DNA, 71 bp, chicken (Gallus Gallus)
  misc_feature (36): n=a or g
ttttagtaccttcccatggaaagttattttgctggnaaagattctgtttatgtcaggagggagtttcaaga

SEQ ID NO: 9324 - DNA, 71 bp, chicken (Gallus Gallus)
  misc_feature (36): n=c or g
ccctgtgtccctttcttcactctctgcttaactcancaaagcagatgtgtctgcttgatctgattgacttt

SEQ ID NO: 9325 - DNA, 71 bp, chicken (Gallus Gallus)
  misc_feature (36): n=a or c
tcagcgtatattctaattagagaatttttgcgaacnagtttggtgtgcaatacagtgtagtggttcagaac

SEQ ID NO: 9326 - DNA, 71 bp, chicken (Gallus Gallus)
  misc_feature (36): n=c or t
acaatataaaagctctagcccaactgtatatgccangtgaatcactgttactgttagagaaggaaaattac

SEQ ID NO: 9327 - DNA, 71 bp, chicken (Gallus Gallus)
  misc_feature (36): n=a or g
ctaacatactcaaagaaacatacaagcaaaagcatnggtgtgagtgtacctttcctgttttgttgtaatct

SEQ ID NO: 9328 - DNA, 71 bp, chicken (Gallus Gallus)
  misc_feature (36): n=c or t
ttcctctattttcaatgatgatttgccctaggatcnaagttattcatttttctttgcgtgcttataacttc

SEQ ID NO: 9329 - DNA, 71 bp, chicken (Gallus Gallus)
  misc_feature (36): n=c or t
tgttttccagttatgtaggattaagcagcagacaanagacagttactgattatggaaaggatccaggttgc

SEQ ID NO: 9330 - DNA, 71 bp, chicken (Gallus Gallus)
  misc_feature (36): n=c or t
cagctgctggtgaggatccatacaccaaagagagantgtggtttggtccagagtggaagacaatccttagc

SEQ ID NO: 9331 - DNA, 71 bp, chicken (Gallus Gallus)
  misc_feature (36): n=a or t
tgtgtacagagctgagcatcggtttcaatatgcaancagtggtggcaacattggaatatagcaaaatttgc

SEQ ID NO: 9332 - DNA, 71 bp, chicken (Gallus Gallus)
  misc_feature (36): n=a or g
aatccacagaatgatttactttgcaacaaacctccngagatttctagtccagactctgctgaaatatgtgc

SEQ ID NO: 9333 - DNA, 71 bp, chicken (Gallus Gallus)
  misc_feature (36): n=c or g
aataatacattcctttgctatcatttttgatctttnaatatgaggaagttaaacaaagagagaatgctagt

SEQ ID NO: 9334 - DNA, 71 bp, chicken (Gallus Gallus)
  misc_feature (36): n=a or c
acctgcatcccttttcttgggaggttgagatatggntgaattgatgacaaaaatgacaaactgtttaacaa

SEQ ID NO: 9335 - DNA, 71 bp, chicken (Gallus Gallus)
  misc_feature (36): n=c or t
agtggtggtggctgttgaagatttgtgctttgtagntgagcatttgccctatcaaacagagtggtgctatt

SEQ ID NO: 9336 - DNA, 71 bp, chicken (Gallus Gallus)
  misc_feature (36): n=c or t
caacctaacaaaagcacctcatcagtcaagccatcnaaatgtcactctgcaagcactgtgatactagagct

SEQ ID NO: 9337 - DNA, 71 bp, chicken (Gallus Gallus)
  misc_feature (36): n=c or t
agtggttaaagaacattttttttttttttacagagnagtttcctttgtgttttagaaatgttgtcttcctt

SEQ ID NO: 9338 - DNA, 71 bp, chicken (Gallus Gallus)
  misc_feature (36): n=g or t
cactcagagagtttgctctttgaacaaacgctatancctaatcttacctattgccactgtgtagtagattc

SEQ ID NO: 9339 - DNA, 71 bp, chicken (Gallus Gallus)
  misc_feature (36): n=c or t
tgccttttcactttttattatctcaccacagtctgntctccttcctgtgccctcatgcattcagaggcagt

SEQ ID NO: 9340 - DNA, 71 bp, chicken (Gallus Gallus)
  misc_feature (36): n=g or t
catgaatttcttcctgaaatgagcagtaagcagttngaagtgacagacattgtcctggcatgttctagcaa

SEQ ID NO: 9341 - DNA, 71 bp, chicken (Gallus Gallus)
  misc_feature (36): n=a or g
aaatacactgacagttcacattgttaaaaaattgantgcaaaataaatgtccccttttagtaatcattcat

SEQ ID NO: 9342 - DNA, 71 bp, chicken (Gallus Gallus)
  misc_feature (36): n=a or t
gcaacctagatagagtctgctgaatcaaagggaagngtcctgtcaggtactgtggactaaacatccaggcc

SEQ ID NO: 9343 - DNA, 71 bp, chicken (Gallus Gallus)
  misc_feature (36): n=a or g
tggtgcaaggccatcaataaccccatgtgcttcagngagtaggtaatcctttaggcgtagaaacagaagac

SEQ ID NO: 9344 - DNA, 71 bp, chicken (Gallus Gallus)
  misc_feature (36): n=a or g
tagcacaggagaaagaaaacaagagatgtgtaaagnactgatagaaagcctgccttttgaacttccattcg

SEQ ID NO: 9345 - DNA, 71 bp, chicken (Gallus Gallus)
  misc_feature (36): n=c or t
aaaatgcctagttctgaacttgggtgatggccttgnattacagctctcagtaggtagttggtcctttatgt

SEQ ID NO: 9346 - DNA, 71 bp, chicken (Gallus Gallus)
  misc_feature (36): n=a or t
ctcattgtgctattgccaagttgtggtcttttaggnaagaacaaaaattgctgttgagagaattcacagga

SEQ ID NO: 9347 - DNA, 71 bp, chicken (Gallus Gallus)
  misc_feature (36): n=a or g
gaggtatttcaagcccataatttacttaagaaaacngggtttaaattctaaattatagatgttattttttc

SEQ ID NO: 9348 - DNA, 71 bp, chicken (Gallus Gallus)
  misc_feature (36): n=c or t
tagaatgcaacactacactaaaattttacttttccntgatattgacattttcagatgagtgtataaggaca

SEQ ID NO: 9349 - DNA, 71 bp, chicken (Gallus Gallus)
  misc_feature (36): n=a or g
cttctctgaggactggaattttatagtactcttgtnagtgccactaaggctcagacttttacatataatga

SEQ ID NO: 9350 - DNA, 71 bp, chicken (Gallus Gallus)
  misc_feature (36): n=a or t
ttctccatccttataggaagtattgaatgattttangcttcagaaacagtgttgacttttgtgagcaggca

SEQ ID NO: 9351 - DNA, 71 bp, chicken (Gallus Gallus)
  misc_feature (36): n=a or g
agatcaacaacctggcctctacttctgaaatagctntcagactaaacggagaaaccacaacataccatatg

SEQ ID NO: 9352 - DNA, 71 bp, chicken (Gallus Gallus)
  misc_feature (36): n=c or t
ataaagtgatgtgatcatgtatagacttgttccacntgacctaacatacgctatcacaaaattgttctgaa

SEQ ID NO: 9353 - DNA, 71 bp, chicken (Gallus Gallus)
  misc_feature (36): n=a or g
aatccattggttgaaataagaagaaatattggccancagaattgtttaagttatgtaaaaaatattcttta

SEQ ID NO: 9354 - DNA, 71 bp, chicken (Gallus Gallus)
  misc_feature (36): n=a or g
gtgcttaaaagaatggcaccatctgagcaacaaacntttatgggcatcctgtgcactagtgaggtacctga

SEQ ID NO: 9355 - DNA, 71 bp, chicken (Gallus Gallus)
  misc_feature (36): n=a or t
aagctccacgtatacaaaagatttccatgtttatanaagttacattactagccaacactgtagatatttta

SEQ ID NO: 9356 - DNA, 71 bp, chicken (Gallus Gallus)
  misc_feature (36): n=a or g
acctctgaaagtttttcattaagccaggactccttntgcatgggaagcccttcagctgttgtacactagta

SEQ ID NO: 9357 - DNA, 71 bp, chicken (Gallus Gallus)
  misc_feature (36): n=g or t
ttaaactgtatgtattaaatcaaaaggtaaaatccntgctggattaaagaatcctaattggatcgtgactt

SEQ ID NO: 9358 - DNA, 71 bp, chicken (Gallus Gallus)
  misc_feature (36): n=c or t
gcttgcttctaaaacggaaaattctctggcacttanggatttttgccatgactcatttttagcccagtgga

SEQ ID NO: 9359 - DNA, 71 bp, chicken (Gallus Gallus)
  misc_feature (36): n=c or t
taaatagacaatttaattatttcatttattcttttngttactgattggaatgaaatcctgaaatggtaaat

SEQ ID NO: 9360 - DNA, 71 bp, chicken (Gallus Gallus)
  misc_feature (36): n=c or t
atcctaaagaaatgccaaagtgagaatccagcatgnttcaaacacacaacttcacatgggaggtgctgagc

SEQ ID NO: 9361 - DNA, 71 bp, chicken (Gallus Gallus)
  misc_feature (36): n=a or g
ggttctaccgagcatctgtgaaggaggacctcaacntcaccgaaggtaggagacacgacagagatggtgtc

SEQ ID NO: 9362 - DNA, 71 bp, chicken (Gallus Gallus)
  misc_feature (36): n=c or t
gggcttttatctacctgcttctgatttcaccatgcnatgagttgtactatgggagtacctgttcaagaaca

SEQ ID NO: 9363 - DNA, 71 bp, chicken (Gallus Gallus)
  misc_feature (36): n=a or g
ttcagggcttgcctgggctcttaaaccttttctacntaacattgcttattgtatagctaacacattaacat

SEQ ID NO: 9364 - DNA, 71 bp, chicken (Gallus Gallus)
  misc_feature (36): n=a or g
gcttcgctgtcagctgtccttgagatggacgagcanatatgacagggtaaagggctctccaccacctctct

SEQ ID NO: 9365 - DNA, 71 bp, chicken (Gallus Gallus)
  misc_feature (36): n=c or t
gaccgcacggctcacaaaaagcaccaaacatgagangattttttccagttcggttacacggtctccacaga

SEQ ID NO: 9366 - DNA, 71 bp, chicken (Gallus Gallus)
  misc_feature (36): n=c or t
tacaatttgagggcttttggctctgtttaaagtaangttgtaaatagcccctcttcacttggaagccatga

SEQ ID NO: 9367 - DNA, 71 bp, chicken (Gallus Gallus)
  misc_feature (36): n=a or c
ttacaacaaccaaagtaaccttaacacagagttgtnatttataggtagatatcataggaaatacaattaag

SEQ ID NO: 9368 - DNA, 71 bp, chicken (Gallus Gallus)
  misc_feature (36): n=a or c
ctctctcttttgagattcgcttgcctttggacttcnttctgaaaatatattggggttttccctataaatat

SEQ ID NO: 9369 - DNA, 71 bp, chicken (Gallus Gallus)
  misc_feature (36): n=a or g
atgggatggaaaagcaagaaatttatatatacaccnctaaagaaactaaaattgataaagactgtgatgtt

SEQ ID NO: 9370 - DNA, 71 bp, chicken (Gallus Gallus)
  misc_feature (36): n=c or g
agacctggtgtctctagtattgttctttgcttgcanttttcaagcctatgcaattatcctgtactttccat

SEQ ID NO: 9371 - DNA, 71 bp, chicken (Gallus Gallus)
  misc_feature (36): n=a or g
aactatgataagcattatagtgcatcttcaaaaacntaaaatctttcgcattctttgtaatggtgattact

SEQ ID NO: 9372 - DNA, 71 bp, chicken (Gallus Gallus)
  misc_feature (36): n=c or t
aggtgtggcatctcttatttgtctctgctcaacttnatgaggttgccatcagcaaatcagcctggcttttt

SEQ ID NO: 9373 - DNA, 71 bp, chicken (Gallus Gallus)
  misc_feature (36): n=a or g
cctggaaagacaatgcgcacagttgaggaaacactntttcatcaactttgctacacagaactctatccaaa

SEQ ID NO: 9374 - DNA, 71 bp, chicken (Gallus Gallus)
  misc_feature (36): n=c or t
tttaaaaaactgtaacaaaaaaagcataccatcccngcaggtggatttcttaattttatttttactaatgt

SEQ ID NO: 9375 - DNA, 71 bp, chicken (Gallus Gallus)
  misc_feature (36): n=a or g
tgctgaaataccagctgtgaaatgttttgcatgaantcaagaaaatgcctaatcttccagtcactggtatt

SEQ ID NO: 9376 - DNA, 71 bp, chicken (Gallus Gallus)
  misc_feature (36): n=c or t
aaacatgtgatgtaatcataatataaaaggacattnccgttgctgcttgttcattcacttgatgtctagat

SEQ ID NO: 9377 - DNA, 71 bp, chicken (Gallus Gallus)
  misc_feature (36): n=c or g
agaaaaaaaggcaaacagtggtataatgaacattantaaaaccttgaaaccacacactctttcaggttcca

SEQ ID NO: 9378 - DNA, 71 bp, chicken (Gallus Gallus)
  misc_feature (36): n=c or t
cacttatttatgggcacttgttctaaattcagcttngtagcgtattgcattgccataaattctcctcttta

SEQ ID NO: 9379 - DNA, 71 bp, chicken (Gallus Gallus)
  misc_feature (36): n=a or t
cctccatctatttgtgactacaagcagctgcacagnatagtattgattgtatgcattagatctgtcaatgc

SEQ ID NO: 9380 - DNA, 71 bp, chicken (Gallus Gallus)
  misc_feature (36): n=a or t
cactccccaggctcgcagaaggaccagatgccagcnttcagaaatggatcatgaacaaacactacctaccc

SEQ ID NO: 9381 - DNA, 71 bp, chicken (Gallus Gallus)
  misc_feature (36): n=a or c
ctatcaccataactgccacagcttagctcaccacantgtgaatgtcctcctttccacttggttttacctaa

SEQ ID NO: 9382 - DNA, 71 bp, chicken (Gallus Gallus)
  misc_feature (36): n=c or t
attagctagcgtacttatcaacaaaagagtatctanctacgctgatatattttactacatgttagccccaa

SEQ ID NO: 9383 - DNA, 71 bp, chicken (Gallus Gallus)
  misc_feature (36): n=c or g
ccatacttcttagtaagtcctcttgtctctttcaantagccaacataaaaaccttttctcctggcttatac

SEQ ID NO: 9384 - DNA, 71 bp, chicken (Gallus Gallus)
  misc_feature (36): n=c or t
tgctttgactaaaagaagaaagttctggggtctctnatgtgggctttcaccctggctatctgtgaaggata

SEQ ID NO: 9385 - DNA, 71 bp, chicken (Gallus Gallus)
  misc_feature (36): n=a or g
atgccttccacatatgcactgaaagccttgtccacncagtatcagaattcccttgtacatcatgatcaaaa

SEQ ID NO: 9386 - DNA, 71 bp, chicken (Gallus Gallus)
  misc_feature (36): n=a or g
ctagctggtttcattttggaaatgtaaagaggatanaacatgttgcttacacacatgggcaaatggaggtc

SEQ ID NO: 9387 - DNA, 71 bp, chicken (Gallus Gallus)
  misc_feature (36): n=c or t
tcggtaatacaggtgtttttagtacatgtaaacagnctgcttaggctgaacacatcactgtctacaatcac

SEQ ID NO: 9388 - DNA, 71 bp, chicken (Gallus Gallus)
  misc_feature (36): n=a or g
gtccttacacccgcttatccacgtacagttttacanagggccttatgtgtcccgtaacgctggtgcaaatt

SEQ ID NO: 9389 - DNA, 71 bp, chicken (Gallus Gallus)
  misc_feature (36): n=a or c
gaaactctgccaggtttatcagcccctcatccactngtttttgctagcaatcctcaggccccagttagcat

SEQ ID NO: 9390 - DNA, 71 bp, chicken (Gallus Gallus)
  misc_feature (36): n=a or g
gagaatctgggtcactcagatctctgataccacctnggccaaattttctaaaccatttgttctttttaatg

SEQ ID NO: 9391 - DNA, 71 bp, chicken (Gallus Gallus)
  misc_feature (36): n=c or g
tctcttgcaaaggctaaaccagttaaagtcagtganttaaattccctattccctgtgccaaaaatggtatc

SEQ ID NO: 9392 - DNA, 71 bp, chicken (Gallus Gallus)
  misc_feature (36): n=a or c
taaaaagggaaatatcattatgccactatataaagncacagttatttcctctatttcagtagtcagtggag

SEQ ID NO: 9393 - DNA, 71 bp, chicken (Gallus Gallus)
  misc_feature (36): n=a or g
tgtgtttatatcccaatttgcactgaaggaacctgntctgaagcacttgagccacacagccaagagctgct

SEQ ID NO: 9394 - DNA, 71 bp, chicken (Gallus Gallus)
  misc_feature (36): n=a or c
gaaaggtgatttatgatccaggataaaaggcagttnggagcacaaggattgcccctgttagtaaaataact

SEQ ID NO: 9395 - DNA, 71 bp, chicken (Gallus Gallus)
  misc_feature (36): n=a or g
gtaacattcatcaggcaactatatacttgaaaactncacacaaactaacagatatgcatatatgcatgagt

SEQ ID NO: 9396 - DNA, 71 bp, chicken (Gallus Gallus)
  misc_feature (36): n=a or g
agtgccaaaagaagccttcattttgtcttaagtacnccacagctttgaatattgaaattaatactcagaat

SEQ ID NO: 9397 - DNA, 71 bp, chicken (Gallus Gallus)
  misc_feature (36): n=c or t
aagtggtcatcacctcaaaggtccagggaagattgnccataatatttatagcagtaggtagactctccaaa

SEQ ID NO: 9398 - DNA, 71 bp, chicken (Gallus Gallus)
  misc_feature (36): n=a or g
agagggattgtatctttaagccttctctgttcaggnactattgggaactctggttgggatgacggtctcat

SEQ ID NO: 9399 - DNA, 71 bp, chicken (Gallus Gallus)
  misc_feature (36): n=a or c
ctgaacagtgagtctggatttcagtgcaaggaaacnagtctgctttcgtgcagatctgccatattctgcca

SEQ ID NO: 9400 - DNA, 71 bp, chicken (Gallus Gallus)
  misc_feature (36): n=c or g
gattctaactttgagagtaaatttgtcaaaaaatanagaagggtagaattactcgagaggcgttgttaatg

SEQ ID NO: 9401 - DNA, 71 bp, chicken (Gallus Gallus)
  misc_feature (36): n=a or c
ttatcccataatgaagagaaacactgaactcaaganatctaaatttgggtaaagatgttataaaaacattg

SEQ ID NO: 9402 - DNA, 71 bp, chicken (Gallus Gallus)
  misc_feature (36): n=a or g
gtgttgccctgtgagctggggacagcccacatgtgngttctccagtgtatttaggcaggcacattctttgg

SEQ ID NO: 9403 - DNA, 71 bp, chicken (Gallus Gallus)
  misc_feature (36): n=a or g
tgtctggcatctcaccacagctataatccagatccnaactgatctgggcttctgacctaaaggtgctgatg

SEQ ID NO: 9404 - DNA, 71 bp, chicken (Gallus Gallus)
  misc_feature (36): n=a or g
tgcagatttaagaatgcagaagcatacactcttacngttgagagaaatactggtacataatgtccagatac

SEQ ID NO: 9405 - DNA, 71 bp, chicken (Gallus Gallus)
  misc_feature (36): n=a or t
atttctgtttatgtcaagtgtctctttcaaatgganatagtggcattttagttcatagtatcatagggctg

SEQ ID NO: 9406 - DNA, 71 bp, chicken (Gallus Gallus)
  misc_feature (36): n=a or g
tatgggcaagcttgtttcttaaaatattactaagcnttatcactggaatggatttttatatgcagttttac

SEQ ID NO: 9407 - DNA, 71 bp, chicken (Gallus Gallus)
  misc_feature (36): n=c or t
aatgctttgatattataataaaaggtgaatagatgntatgaaggagcaaatctgtgaaaggtattacaaat

SEQ ID NO: 9408 - DNA, 71 bp, chicken (Gallus Gallus)
  misc_feature (36): n=c or t
ggcgtagcaaccaggccaaaggaggaagctgggggnaggagggagagaacacagttaaagtatgctatctg

SEQ ID NO: 9409 - DNA, 71 bp, chicken (Gallus Gallus)
  misc_feature (36): n=c or t
caaatctagctgtaaccttaccagggtatcaatcantgtgaagactctccaggaaactcaccagtgtaggt

SEQ ID NO: 9410 - DNA, 71 bp, chicken (Gallus Gallus)
  misc_feature (36): n=c or t
agcagaactgagggaggaaggtttttctgacatttngaggttagagtcactgatattgatgaatatcttga

SEQ ID NO: 9411 - DNA, 71 bp, chicken (Gallus Gallus)
  misc_feature (36): n=c or g
aaggaacaggagttttgtattacaactgcacaagcnacatagtcataactcattttagagctcacagattt

SEQ ID NO: 9412 - DNA, 71 bp, chicken (Gallus Gallus)
  misc_feature (36): n=c or t
taaataatttcataagaaaaagaagtttgaaggaanacattttggaagttcccagaaactaagttcaaagt

SEQ ID NO: 9413 - DNA, 71 bp, chicken (Gallus Gallus)
  misc_feature (36): n=c or t
agtgaggaagttagtgctaagtactacaacagatancaaagctgactgctaaaacagcaaaaacaatacca

SEQ ID NO: 9414 - DNA, 71 bp, chicken (Gallus Gallus)
  misc_feature (36): n=a or g
aagtgatgcatcatttttctcttcaggaagactttntcctaaatctttactttctcctaaatcttcaccag

SEQ ID NO: 9415 - DNA, 71 bp, chicken (Gallus Gallus)
  misc_feature (36): n=c or t
cattccagccttcagatctttccactcttacgatanaggagatctgtcttctggcattgggcactgttaac

SEQ ID NO: 9416 - DNA, 71 bp, chicken (Gallus Gallus)
  misc_feature (36): n=a or g
gactaagatctatgtgtgtttaactgggaacagaangtatgcatccgtatttgattgcagattttcttcta

SEQ ID NO: 9417 - DNA, 71 bp, chicken (Gallus Gallus)
  misc_feature (36): n=c or t
aacatatatctcagcctactcaacctttcacatttntattgcttaacgcttgtaatttttagcagaaagcc

SEQ ID NO: 9418 - DNA, 71 bp, chicken (Gallus Gallus)
  misc_feature (36): n=a or c
caggcttcatttcttaagaacgcatgggaatagcanaattctagtactgctatgaaaacacgttaagggtt

SEQ ID NO: 9419 - DNA, 71 bp, chicken (Gallus Gallus)
  misc_feature (36): n=c or g
agaaagccatattttcactcatcttcaacaacaatnaagctttaaggcacataaggttgcatctgagcacg

SEQ ID NO: 9420 - DNA, 71 bp, chicken (Gallus Gallus)
  misc_feature (36): n=c or t
atcatttaattcatgtcatacaggcacagctgaagngcacacagcaggaggtaggcatgtacaacaaatgc

SEQ ID NO: 9421 - DNA, 71 bp, chicken (Gallus Gallus)
  misc_feature (36): n=c or t
cttagtattacatgttgcccatgataaatctgtgangtgttggtaggaaatgaaagcatcatcatcatctt

SEQ ID NO: 9422 - DNA, 71 bp, chicken (Gallus Gallus)
  misc_feature (36): n=c or t
ggcatgctgtggtacattaagcctttgaaggaactntttcagtagttcaagtctgacctcattttaaatgc

SEQ ID NO: 9423 - DNA, 71 bp, chicken (Gallus Gallus)
  misc_feature (36): n=c or t
aaattaaatccaccaaatgcactaaaatacaaaatntccagaaagccatgaacctcagggcttttctcctc

SEQ ID NO: 9424 - DNA, 71 bp, chicken (Gallus Gallus)
  misc_feature (36): n=c or t
gtaactcaaaggcagagatcacctgaatccaaaccnatcctctgaatggttttccaaagcagagcatttct

SEQ ID NO: 9425 - DNA, 71 bp, chicken (Gallus Gallus)
  misc_feature (36): n=a or g
aattttgagccaataatgaaatgagtaacttacacngtaacagaattactttggatgttctcaaagaaact

SEQ ID NO: 9426 - DNA, 71 bp, chicken (Gallus Gallus)
  misc_feature (36): n=c or t
ctcacgttaggttcttgtgaacataccacagcaaanaagggactacattacagagtccagaggagaaaaag

SEQ ID NO: 9427 - DNA, 71 bp, chicken (Gallus Gallus)
  misc_feature (36): n=a or c
gacaggtatggcctcggggaagtctgggaagacagnaactgcactctagattaagagaggcagtgaaatct

SEQ ID NO: 9428 - DNA, 71 bp, chicken (Gallus Gallus)
  misc_feature (36): n=a or g
gaggtagcgtctctggaattacaccactaacagccnagcaaatacagagcataagtgttttttgtgtctac

SEQ ID NO: 9429 - DNA, 71 bp, chicken (Gallus Gallus)
  misc_feature (36): n=a or g
aacattcagatgttgccttgtaaacttggccttggnagggttataatcctaatagcctttccctaatatca

SEQ ID NO: 9430 - DNA, 71 bp, chicken (Gallus Gallus)
  misc_feature (36): n=c or t
ggagtagcagctgttgctgatgcctcagtacctctntcatcaacatccagagcagccttatggataaccta

SEQ ID NO: 9431 - DNA, 71 bp, chicken (Gallus Gallus)
  misc_feature (36): n=c or t
tactttctattacattaaagcattatagtggtgcanggaatcgttagtgttggaaaagactaagaccacct

SEQ ID NO: 9432 - DNA, 71 bp, chicken (Gallus Gallus)
  misc_feature (36): n=g or t
atgataaaaaaccctgggccccagtaaattcagtgnctcactactttgatgaagaagccatactgaccgtc

SEQ ID NO: 9433 - DNA, 71 bp, chicken (Gallus Gallus)
  misc_feature (36): n=a or g
agggaagtccttattatgcacagtaccaggtcctcncagcagagctgacattgcaaatgcactgcaatgac

SEQ ID NO: 9434 - DNA, 71 bp, chicken (Gallus Gallus)
  misc_feature (36): n=a or g
ggtctgtgctaatgtgagactgaagagtataacaantcagtgcatagctgagcacctcacatccagcagga

SEQ ID NO: 9435 - DNA, 71 bp, chicken (Gallus Gallus)
  misc_feature (36): n=a or c
agtcctctgttctccctctgtcagagcatccaaagntagaatcctacaatacaagtggtcttctctgaagg

SEQ ID NO: 9436 - DNA, 71 bp, chicken (Gallus Gallus)
  misc_feature (36): n=c or g
ggaatgaaacctttccctggttatgcataatcaagngaaactcttgcttcacagcttcatttttgatgttt

SEQ ID NO: 9437 - DNA, 71 bp, chicken (Gallus Gallus)
  misc_feature (36): n=c or t
tttacctgcttattctgcagactttcccattttgcnttcctcttctcagcactgcttagtggaagtgcttt

SEQ ID NO: 9438 - DNA, 71 bp, chicken (Gallus Gallus)
  misc_feature (36): n=c or t
gttgtgatgcatatggtctttaggttcatttggatngtgtccattgtggtggctggctgtaagctggccat

SEQ ID NO: 9439 - DNA, 71 bp, chicken (Gallus Gallus)
  misc_feature (36): n=a or g
gctgtcactgagggataacgagtaagtgcaaatacnctccccagagctatactgtaaaaaagttgaagagg

SEQ ID NO: 9440 - DNA, 71 bp, chicken (Gallus Gallus)
  misc_feature (36): n=a or c
agaaggcataggatgcaatgtcttgctttagaaatntgtatgtctcaacatgcgttgtactctgctgattg

SEQ ID NO: 9441 - DNA, 71 bp, chicken (Gallus Gallus)
  misc_feature (36): n=c or t
taaatatggctggctttcatcatattgtactgtgcngagagctataaagcttctgtactctgtagatgaca

SEQ ID NO: 9442 - DNA, 71 bp, chicken (Gallus Gallus)
  misc_feature (36): n=c or t
atttatttatttacttattttttgcaaagtctattntgagccagcacaaggtatatgtaccttaaaataat

SEQ ID NO: 9443 - DNA, 71 bp, chicken (Gallus Gallus)
  misc_feature (36): n=c or t
cacccccaccaaaataaagttaaggacttgaaaggngcccaaggactggttggaacaaaacctgaatacaa

SEQ ID NO: 9444 - DNA, 71 bp, chicken (Gallus Gallus)
  misc_feature (36): n=c or t
tttgactaccttaaaattttgcaggctcactctganaactgcttccaactttttgtttttcccaaagtctg

SEQ ID NO: 9445 - DNA, 71 bp, chicken (Gallus Gallus)
  misc_feature (36): n=g or t
cagttgtgcctcatccctgtttttgtcacaactcangaagcaggtgccctttggtcattcaggtttgtctt

SEQ ID NO: 9446 - DNA, 71 bp, chicken (Gallus Gallus)
  misc_feature (36): n=c or t
gtagtattaaaaagtgctatggcatttcaaatttcngcttgagatgcagttcaagttttaaggaggagtcg

SEQ ID NO: 9447 - DNA, 71 bp, chicken (Gallus Gallus)
  misc_feature (36): n=c or t
attgttaaactccatccccacatgcacttggttaangtgaggagatgatagattcagcaaggttgtggccc

SEQ ID NO: 9448 - DNA, 71 bp, chicken (Gallus Gallus)
  misc_feature (36): n=a or t
gcaacctgttccagggtctcacatccttcacagtanggatttcactgattgttttactatcttttaattac

SEQ ID NO: 9449 - DNA, 71 bp, chicken (Gallus Gallus)
  misc_feature (36): n=a or c
tacattatgaaatgaacaaataatccttgttttagnctctgtaggtgttctctttgtgcatttctatgtgg

SEQ ID NO: 9450 - DNA, 71 bp, chicken (Gallus Gallus)
  misc_feature (36): n=a or g
tgggtcctggcttgctctctctggttattaggctcncaggacactcattttctcagagggtaacagtacag

SEQ ID NO: 9451 - DNA, 71 bp, chicken (Gallus Gallus)
  misc_feature (36): n=a or t
atgctttcacagtcttttaattaaaataaatgaaantggacataagctttgacaggtgggaaggaggaaaa

SEQ ID NO: 9452 - DNA, 71 bp, chicken (Gallus Gallus)
  misc_feature (36): n=a or g
taattaacactaataagccatggttctaacagattnctttagacatgctgatttgaatcaggcttctgaat

SEQ ID NO: 9453 - DNA, 71 bp, chicken (Gallus Gallus)
  misc_feature (36): n=a or g
ttaaatccatcctttcttgtactgtggagcctaganctggacacagcactccaccacgctgtgccagtgct

SEQ ID NO: 9454 - DNA, 71 bp, chicken (Gallus Gallus)
  misc_feature (36): n=g or t
tacccagcattgacttttatcaaccaactaatgcantaaccagaacatgaatgagaacttcatctttccag

SEQ ID NO: 9455 - DNA, 71 bp, chicken (Gallus Gallus)
  misc_feature (36): n=a or c
tcaacataagataacagaaaactgatctttctaagncaagaggtttgctgggagaggaaggtgttagcata

SEQ ID NO: 9456 - DNA, 71 bp, chicken (Gallus Gallus)
  misc_feature (36): n=c or t
gtatcgagtgtcacagaagctgaattttccagagangtatccatatacagtgtacatttctagattttttt

SEQ ID NO: 9457 - DNA, 71 bp, chicken (Gallus Gallus)
  misc_feature (36): n=a or g
cgagacagaaaactaacttggcaagggaagcatggnaaaattgtaaggaaaggcagaaacagaatctgcat

SEQ ID NO: 9458 - DNA, 71 bp, chicken (Gallus Gallus)
  misc_feature (36): n=g or t
gtaaaagccagttaccataacatatcacccataatnacgtatacatttataatatcacacttcagctatgt

SEQ ID NO: 9459 - DNA, 71 bp, chicken (Gallus Gallus)
  misc_feature (36): n=c or t
ctgtggaaatgtcttttttattttgtaactatggantgttttttttgtttgtttgttttgttttttaaaca

SEQ ID NO: 9460 - DNA, 71 bp, chicken (Gallus Gallus)
  misc_feature (36): n=a or t
aaccagcagcatgatcgtgtctttctgcactgacanattcgctctttgctcttcagcaaagtaacaggcag

SEQ ID NO: 9461 - DNA, 71 bp, chicken (Gallus Gallus)
  misc_feature (36): n=a or g
ttctgggtttgtctcccctattctggttattacgcnggtaacaactctaagatcatctaatataatctaaa

SEQ ID NO: 9462 - DNA, 71 bp, chicken (Gallus Gallus)
  misc_feature (36): n=c or t
ccataagaaggctaataaaaattacaattttctttngaaaatgtggacatatgtagtttgtgaagactgca

SEQ ID NO: 9463 - DNA, 71 bp, chicken (Gallus Gallus)
  misc_feature (36): n=g or t
gttcagtccccttgcctgctcagggaaggaagaacngtattcacaaactcaagtactgcctgcccaattgg

SEQ ID NO: 9464 - DNA, 71 bp, chicken (Gallus Gallus)
  misc_feature (36): n=g or t
tcgcttcaattatcagatctcagctgccccaggacncaagctttgccttggatttatggattctttagaaa

SEQ ID NO: 9465 - DNA, 71 bp, chicken (Gallus Gallus)
  misc_feature (36): n=a or g
actgcctgctgtcaaggccaaaaaactgatataacntcaagactgaagaagaaactcattaaagactcatc

SEQ ID NO: 9466 - DNA, 71 bp, chicken (Gallus Gallus)
  misc_feature (36): n=c or t
aaactagaaaggaaatttctaattcactgtctgcangattaactgtcagctgaacagacagcgtctctgca

SEQ ID NO: 9467 - DNA, 71 bp, chicken (Gallus Gallus)
  misc_feature (36): n=a or g
gatgtggaaaagaaaactgtgtttgcatactaaganaaaaatcatgagaagtgacagaaagtcatataagg

SEQ ID NO: 9468 - DNA, 71 bp, chicken (Gallus Gallus)
  misc_feature (36): n=c or t
ctgagaaagctgggtggataaccctctgctctggcngctttgcaataaatggcggagagtggctggtgtgg

SEQ ID NO: 9469 - DNA, 71 bp, chicken (Gallus Gallus)
  misc_feature (36): n=a or g
aatttcaggacgagttactgccaaaaagggggaacnaaaaggattcctgtgaagtatttttcattattatc

SEQ ID NO: 9470 - DNA, 71 bp, chicken (Gallus Gallus)
  misc_feature (36): n=a or c
ttactgggggaggaaggtctcttgccctgtacaacnctgcaagggtcactctctcactaacgtgttccagt

SEQ ID NO: 9471 - DNA, 71 bp, chicken (Gallus Gallus)
  misc_feature (36): n=c or t
agtgcagacagtccatgcacagaactacattgtccnctaatgcagaagaagccttatcaaaacccaggcct

SEQ ID NO: 9472 - DNA, 71 bp, chicken (Gallus Gallus)
  misc_feature (36): n=c or t
ctgtaattctgtgttcccctcaaatgtttcttgttnaagtagcagactgcagcaccgctgtagcacggctc

SEQ ID NO: 9473 - DNA, 71 bp, chicken (Gallus Gallus)
  misc_feature (36): n=c or t
aaaatccacaatgaatgggagagagaacattcaganttgatagtcagctttacagctcaataatatttatt

SEQ ID NO: 9474 - DNA, 71 bp, chicken (Gallus Gallus)
  misc_feature (36): n=g or t
ttagaactatcttttatgtgtatggtaccccaagcnatgctcctgatgctgagatgaagtgcacctgtgcc

SEQ ID NO: 9475 - DNA, 71 bp, chicken (Gallus Gallus)
  misc_feature (36): n=c or t
gaacaaaaccctgtttattgaggaaatcaggcattntaagcccagtaatgatctttgagagatcaacataa

SEQ ID NO: 9476 - DNA, 71 bp, chicken (Gallus Gallus)
  misc_feature (36): n=a or g
tcttctcaactttacccagagaatgtggaagaaagngcacagaatcaggggatggaggagcacaataccac

SEQ ID NO: 9477 - DNA, 71 bp, chicken (Gallus Gallus)
  misc_feature (36): n=a or c
tttgaagcaaggagccagcaaatggaaaccagattntcttgctgctgatcgctgcagagctttgcaacagg

SEQ ID NO: 9478 - DNA, 71 bp, chicken (Gallus Gallus)
  misc_feature (36): n=a or g
gaaagagtcctgctgaaaacccccgtgtttaggaanaagggataaaaaggccaacatctaacctacagaga

SEQ ID NO: 9479 - DNA, 71 bp, chicken (Gallus Gallus)
  misc_feature (36): n=c or g
atgaaatacagctcagcatcttctccattttcttanttctactggaaaactgaagcaatagaaatggcagg

SEQ ID NO: 9480 - DNA, 71 bp, chicken (Gallus Gallus)
  misc_feature (36): n=c or t
ctttgtgttcattttctgtcattctgaaagtgcttngatattttaatgtcctaggatagtctctaagatgg

SEQ ID NO: 9481 - DNA, 71 bp, chicken (Gallus Gallus)
  misc_feature (36): n=c or t
gcctcagacagcttagatattatctgaaatggtcangctggtacatctcaatcttgtctccttttcagtag

SEQ ID NO: 9482 - DNA, 71 bp, chicken (Gallus Gallus)
  misc_feature (36): n=c or t
cagaattctaaaacttttctgtgtttccagaaactnggggtagtcattccagactcatggaatctaaaaag

SEQ ID NO: 9483 - DNA, 71 bp, chicken (Gallus Gallus)
  misc_feature (36): n=a or g
agcaaagaacaaagtgtgaattcatgagagaaatcnaagaaaatctaagcaaaatatggatgaataagtca

SEQ ID NO: 9484 - DNA, 71 bp, chicken (Gallus Gallus)
  misc_feature (36): n=a or g
tttaattttgaaaattgctcaagtaactgtccaggnatggaatgatatcttttgactctagtgcttcatta

SEQ ID NO: 9485 - DNA, 71 bp, chicken (Gallus Gallus)
  misc_feature (36): n=a or g
cgcatagcctaatttattagtgagcatagtctcaanatgtattcataattaaatacttacattgtcttctg

SEQ ID NO: 9486 - DNA, 71 bp, chicken (Gallus Gallus)
  misc_feature (36): n=c or t
gacttcttgcaactgcagttagtttagactaagaantggaatatcttcatcagtacaattcacttgggtag

SEQ ID NO: 9487 - DNA, 71 bp, chicken (Gallus Gallus)
  misc_feature (36): n=a or g
ccaaagtagagtatcaacagggcttttttcccccanccttggattatttatcaggatttaaccctgcttag

SEQ ID NO: 9488 - DNA, 71 bp, chicken (Gallus Gallus)
  misc_feature (36): n=a or t
gcagtgctagcagaagtgattggaatagctgtctgngttgggatgaagaatgtcaaagctctgttccaagc

SEQ ID NO: 9489 - DNA, 71 bp, chicken (Gallus Gallus)
  misc_feature (36): n=a or c
tctaatccaagctgtagaacttgaccctagggaagntgtgtttgaacaataaagatattcaagtcagccag

SEQ ID NO: 9490 - DNA, 71 bp, chicken (Gallus Gallus)
  misc_feature (36): n=c or t
aaattgtgttacatctgtgtaaagaagagtatttgnatataaaacatctgaagaagcaagcagatccatgt

SEQ ID NO: 9491 - DNA, 71 bp, chicken (Gallus Gallus)
  misc_feature (36): n=c or t
agtgttttgaaggggagatagcagattttctggatnttcatgtctatttagttcaggtcagattctaccgt

SEQ ID NO: 9492 - DNA, 71 bp, chicken (Gallus Gallus)
  misc_feature (36): n=c or t
gtcaagctcaattccccaagtgatgtgccacactgnggaatttcaactagctctcaaagcgcagaacctca

SEQ ID NO: 9493 - DNA, 71 bp, chicken (Gallus Gallus)
  misc_feature (36): n=c or t
tgtcttctcctccttctcctcttttcctcctccttntcctcagcttcatcatcactcacctccttatcacg

SEQ ID NO: 9494 - DNA, 71 bp, chicken (Gallus Gallus)
  misc_feature (36): n=c or t
actagaaaccctgggatgcactcagataattccttnccaagggagttagatttctcccatccaaaccactg

SEQ ID NO: 9495 - DNA, 71 bp, chicken (Gallus Gallus)
  misc_feature (36): n=c or t
agcttgatagaaaaatatcttcacatctacatgttnctgcatgttctcttacagttgtttttagaggcatt

SEQ ID NO: 9496 - DNA, 71 bp, chicken (Gallus Gallus)
  misc_feature (36): n=c or t
tcctccattggttggtcctgtgtttgcacagcttcnggcatctgtgaagaaatcaaggtgaaattcaatgg

SEQ ID NO: 9497 - DNA, 71 bp, chicken (Gallus Gallus)
  misc_feature (36): n=c or t
cagctgctggcaaccagttcagggttggacattacnaccataggcatgattgtgataaaggtctgtgagat

SEQ ID NO: 9498 - DNA, 71 bp, chicken (Gallus Gallus)
  misc_feature (36): n=g or t
atatattggagcagttcttggagagccaattgcctncaggatctatgtagaatcaggttgggaaggacaaa

SEQ ID NO: 9499 - DNA, 71 bp, chicken (Gallus Gallus)
  misc_feature (36): n=c or t
tgaaacttaatacagctgtaaacaaaactaactacnagggagtttacctgaatttgtggtgaagagagaca

SEQ ID NO: 9500 - DNA, 71 bp, chicken (Gallus Gallus)
  misc_feature (36): n=a or t
ggtatggtacaacttgatcagtgccttaataacttnttgaagacgcttgtgggaaaaaaaaaaggcaaagt

SEQ ID NO: 9501 - DNA, 71 bp, chicken (Gallus Gallus)
  misc_feature (36): n=c or t
gaaatagtaaaatatatctatttaatgcaaggaaangggtaaaacttgtatgtaaatgcccttaacttgtg

SEQ ID NO: 9502 - DNA, 71 bp, chicken (Gallus Gallus)
  misc_feature (36): n=c or g
acaagaagtatagacaaaaaaaaaagagcaaagaanaagtcaaatcctggtagtttcatgaagcatagttg

SEQ ID NO: 9503 - DNA, 71 bp, chicken (Gallus Gallus)
  misc_feature (36): n=c or t
tttttaccaaggaagttatgggcgtgtttggttaangtaaaaatacacgtcagcttatgacaaagtggcaa

SEQ ID NO: 9504 - DNA, 71 bp, chicken (Gallus Gallus)
  misc_feature (36): n=a or c
agagtgttgatcttcaggatggtcaggttctgggcncacagcggggctttagggctcaaatggtgcagata

SEQ ID NO: 9505 - DNA, 71 bp, chicken (Gallus Gallus)
  misc_feature (36): n=a or c
aagctcaacgcttacttcactttagttgaactcttnccccaaatacaatttctagtcaaatgttaaaatga

SEQ ID NO: 9506 - DNA, 71 bp, chicken (Gallus Gallus)
  misc_feature (36): n=a or g
gagttaggaatgagttccaaacgaatcctctctgcntgtcttttgtgcatagccaaggatttcaatgcatt

SEQ ID NO: 9507 - DNA, 71 bp, chicken (Gallus Gallus)
  misc_feature (36): n=a or g
tccctgctgagaactttcttgttgtttgggttgcantgctcactaggagattccaatctccaccaatgtct

SEQ ID NO: 9508 - DNA, 71 bp, chicken (Gallus Gallus)
  misc_feature (36): n=c or t
aataacagcaagatttggccaagtagaatcagttancttctgtcttcctgtacaacatttctgcagtgaat

SEQ ID NO: 9509 - DNA, 71 bp, chicken (Gallus Gallus)
  misc_feature (36): n=a or g
ccagaacattgcctgtgcacaggcattggaatattnttttccttatccatcaccaatccttcatgctttac

SEQ ID NO: 9510 - DNA, 71 bp, chicken (Gallus Gallus)
  misc_feature (36): n=c or g
cccgatgtgttggaagaagtagacaaaatcaggctngaaaggactttgtgtcttctcttcagttgaggatg

SEQ ID NO: 9511 - DNA, 71 bp, chicken (Gallus Gallus)
  misc_feature (36): n=a or g
tatagctcaggcttgtagtgaggcaacggctaaagntaaggcaaatgtgatctgaagcagttgtagacata

SEQ ID NO: 9512 - DNA, 71 bp, chicken (Gallus Gallus)
  misc_feature (36): n=c or t
gcctttgcttgtatctgattaggcagctaccactgngtttataagctaagactttgcaattagtaggattt

SEQ ID NO: 9513 - DNA, 71 bp, chicken (Gallus Gallus)
  misc_feature (36): n=a or g
ctcccagtttatttttcctcttcgtatgttaagcanttgattcaagggcaggaatcttgtactttcacgtc

SEQ ID NO: 9514 - DNA, 71 bp, chicken (Gallus Gallus)
  misc_feature (36): n=c or t
caacccatgcctgtgactgctctagtctgtgttacnctgtgcaacatctggaacagaagaatgacacttca

SEQ ID NO: 9515 - DNA, 71 bp, chicken (Gallus Gallus)
  misc_feature (36): n=c or t
ttgggtttatgtctttattggacgaaaacggtgagngtgggtcttgaggcggagcgggtgagggcggcggg

SEQ ID NO: 9516 - DNA, 71 bp, chicken (Gallus Gallus)
  misc_feature (36): n=c or t
ttatctgatgtgactgagtgaaccgtgtatgtaacngaagtgcttctaacagcccagctgtttcagatgat

SEQ ID NO: 9517 - DNA, 71 bp, chicken (Gallus Gallus)
  misc_feature (36): n=a or g
agccgaagcctcttgaggacttctccaaacttctcntgcttcccaaggtttggtagcttgatgtgcacacc

SEQ ID NO: 9518 - DNA, 71 bp, chicken (Gallus Gallus)
  misc_feature (36): n=c or t
cttaacaggccaccataatgactggcaatctcatgnttaggtttggcaatccctagctactcaagtagcca

SEQ ID NO: 9519 - DNA, 71 bp, chicken (Gallus Gallus)
  misc_feature (36): n=c or t
cgtcatcatgctacgagccctcagtggctgatgcangagagcactgtgcaaatcagaggcaagatggagag

SEQ ID NO: 9520 - DNA, 71 bp, chicken (Gallus Gallus)
  misc_feature (36): n=a or g
gggaagttttggaggaacttaaaatgtttattcccnattgcagagggggaaaaaaggtctgcaccatgcag

SEQ ID NO: 9521 - DNA, 71 bp, chicken (Gallus Gallus)
  misc_feature (36): n=c or t
atacttgacagtgagtacagtgatttctgggcagangaagcacgttctgagggcacaggcttccactctcc

SEQ ID NO: 9522 - DNA, 71 bp, chicken (Gallus Gallus)
  misc_feature (36): n=a or c
gctctggaaatcagagaaaaggtacagttgcaaaancaaaccaaaacaaaaacacccacagaaaaaagccc

SEQ ID NO: 9523 - DNA, 71 bp, chicken (Gallus Gallus)
  misc_feature (36): n=c or t
agagcacctccttgcctagacgaggtcaacagtttnccctcattgcctgattcaacactttaccttcaaca

SEQ ID NO: 9524 - DNA, 71 bp, chicken (Gallus Gallus)
  misc_feature (36): n=a or g
agcccggctttatctcattagaccatcaaactgcantggaggaagtagccagctccagccaagtcagcatt

SEQ ID NO: 9525 - DNA, 71 bp, chicken (Gallus Gallus)
  misc_feature (36): n=c or t
acttttgcttttagttttgtcttgtttatgtcgtgntttcctatattttatatgtttatttaaaattactg

SEQ ID NO: 9526 - DNA, 71 bp, chicken (Gallus Gallus)
  misc_feature (36): n=c or t
agtgcacgagcgctccagaggtgcccagatgtgcantgctcttccttctgtgtttctgtctatcagagatc

SEQ ID NO: 9527 - DNA, 71 bp, chicken (Gallus Gallus)
  misc_feature (36): n=c or t
agttagaagtcagtgactgcaggtaagatttaaagnttgtattcttgtttctcttttgcaaagctttctgt

SEQ ID NO: 9528 - DNA, 71 bp, chicken (Gallus Gallus)
  misc_feature (36): n=a or t
cgatggttgctcagctggtccaagagccagtatctntcttcccagacttcacctgacctccattttgctgc

SEQ ID NO: 9529 - DNA, 71 bp, chicken (Gallus Gallus)
  misc_feature (36): n=a or g
tagactgaaagtaggtaatttcctcaggctagtcgntaggtttgtggatggagtacaggatgaatgggtta

SEQ ID NO: 9530 - DNA, 71 bp, chicken (Gallus Gallus)
  misc_feature (36): n=g or t
aaaggtcacactgttacttaacagtattgtcttgantgtgaagaggtagaaaagtaatgatctgcaacaca

SEQ ID NO: 9531 - DNA, 71 bp, chicken (Gallus Gallus)
  misc_feature (36): n=a or c
gaaggacatcagttttctttgtgacagcctccagcnctggatccaatggtggtgcagccactctaattgaa

SEQ ID NO: 9532 - DNA, 71 bp, chicken (Gallus Gallus)
  misc_feature (36): n=a or g
atgtccagaaagcttgttacttctactgtttgatcntgtttcttccctcatttttgtgtgtgttgaatttg

SEQ ID NO: 9533 - DNA, 71 bp, chicken (Gallus Gallus)
  misc_feature (36): n=c or t
tgcacatggccatacagcacgcagtgctctaactcngtgagtgctgtcaggtaatggcagtttgggaaata

SEQ ID NO: 9534 - DNA, 71 bp, chicken (Gallus Gallus)
  misc_feature (36): n=a or g
acataatggagatctgaatttctcctttgacaaatntttaaacttgaaaatatcttttcttgagtgaactg

SEQ ID NO: 9535 - DNA, 71 bp, chicken (Gallus Gallus)
  misc_feature (36): n=a or c
gaatttgcatcacaaatgcacatacagctctttacntggcataaattttcaatctgaaccacttgtttact

SEQ ID NO: 9536 - DNA, 71 bp, chicken (Gallus Gallus)
  misc_feature (36): n=c or t
cttcgtaagatctccctccgctcatccatagttctnatggtatgggtgtgacactgaggtagtgatgctat

SEQ ID NO: 9537 - DNA, 71 bp, chicken (Gallus Gallus)
  misc_feature (36): n=a or g
tagctggcgctttgagtcagtggcaaacgttgcagnaggaatagggcacattgtggctttttgtatgtggt

SEQ ID NO: 9538 - DNA, 71 bp, chicken (Gallus Gallus)
  misc_feature (36): n=a or t
ggaggtgagggagcagggtttcctgtagggaagggnatgatcaggagcgctccaccatgttgtttcttggc

SEQ ID NO: 9539 - DNA, 71 bp, chicken (Gallus Gallus)
  misc_feature (36): n=a or g
ctggaaatccctgttctgcttactgaagaaaggaancagtcatatataaaagcagccttgcacatggctag

SEQ ID NO: 9540 - DNA, 71 bp, chicken (Gallus Gallus)
  misc_feature (36): n=g or t
tactcttgtcgtgagcactgcttttaaccagtatgnttttacttatgttggatataggcatagatccaacc

SEQ ID NO: 9541 - DNA, 71 bp, chicken (Gallus Gallus)
  misc_feature (36): n=a or c
ttaatacctaacatagccctctccaaagctatgacntcatagacagttgtctgaaagcctgtatacaatac

SEQ ID NO: 9542 - DNA, 71 bp, chicken (Gallus Gallus)
  misc_feature (36): n=g or t
tgtccagtggaatgaaaagatctatgaaaatcgtgnactgttggtgctgatccgcttctagaaaggaaata

SEQ ID NO: 9543 - DNA, 71 bp, chicken (Gallus Gallus)
  misc_feature (36): n=c or t
tcttcagatgtatgttcagcaaactgttgatgtgcnaagttacaaaccattcttctggagtcatatttcta

SEQ ID NO: 9544 - DNA, 71 bp, chicken (Gallus Gallus)
  misc_feature (36): n=g or t
accctgccatcaggagcggtacaacagagaacaaangttggggtttgttcataggttacctctttgttttt

SEQ ID NO: 9545 - DNA, 71 bp, chicken (Gallus Gallus)
  misc_feature (36): n=c or t
ttgaatcacaatcctgtttcggtgggattgaagcanacctgggtgtcattttacctgcagcctatacatcc

SEQ ID NO: 9546 - DNA, 71 bp, chicken (Gallus Gallus)
  misc_feature (36): n=c or t
gctgttcaactgtgtggctaaatcaataattacacngactacaagatgtaggacggtgctgtataaaacat

SEQ ID NO: 9547 - DNA, 71 bp, chicken (Gallus Gallus)
  misc_feature (36): n=a or g
ccagttgagcttggtgtaatagataaccacttatangccaacttttacagattttgtttccagctttggaa

SEQ ID NO: 9548 - DNA, 71 bp, chicken (Gallus Gallus)
  misc_feature (36): n=a or g
agtgatatgggtcttcctacagtgtgcttatcacantgcacttcaatgaatccagcagacatgaaataata

SEQ ID NO: 9549 - DNA, 71 bp, chicken (Gallus Gallus)
  misc_feature (36): n=a or c
ctatgaagaacaatcccttgcatttttagtatttantgtactttgaagtggtagacctcctttttcttaaa

SEQ ID NO: 9550 - DNA, 71 bp, chicken (Gallus Gallus)
  misc_feature (36): n=a or g
tcagagatggtacagtgactcattcagcctttccantgacagttgctgcaaagctaacacaaaaaagtcaa

SEQ ID NO: 9551 - DNA, 71 bp, chicken (Gallus Gallus)
  misc_feature (36): n=c or t
atgtccaacctgagaattagctaaatacttgatggngattaagtaagccaaagcactctattttttctaga

SEQ ID NO: 9552 - DNA, 71 bp, chicken (Gallus Gallus)
  misc_feature (36): n=a or g
atttggtgaagaaattgggaggttgcaggtaggtgntttgaatacctcttatcttctctgaaaaatgtggg

SEQ ID NO: 9553 - DNA, 71 bp, chicken (Gallus Gallus)
  misc_feature (36): n=c or t
gatggaatatctaccactagaataggctcaagcctngtgtttcaattaaccaacaattaatggcacaactg

SEQ ID NO: 9554 - DNA, 71 bp, chicken (Gallus Gallus)
  misc_feature (36): n=a or g
taatcaaatttgtattaactttgtacattgcctccngacaaaatagggtctttttcagttaaaaataagaa

SEQ ID NO: 9555 - DNA, 71 bp, chicken (Gallus Gallus)
  misc_feature (36): n=c or g
gtatctgtctctgtaattagctcctggggtacccantttccagaacacttcaggtctgaggcaagctactg

SEQ ID NO: 9556 - DNA, 71 bp, chicken (Gallus Gallus)
  misc_feature (36): n=c or g
tataccagaacattaaatgaaattgttggccacaantacttggctaggttttgttggagcttctcattttt

SEQ ID NO: 9557 - DNA, 71 bp, chicken (Gallus Gallus)
  misc_feature (36): n=a or t
gataccacagcaatatattagagcatgtttgtcatnctataattaaactctggaatttgggaattttgata

SEQ ID NO: 9558 - DNA, 71 bp, chicken (Gallus Gallus)
  misc_feature (36): n=a or g
cttcctagcaactgagaagcaccatgtctgacctantgggtccaccagttggtcaaccagacccatcttct

SEQ ID NO: 9559 - DNA, 71 bp, chicken (Gallus Gallus)
  misc_feature (36): n=a or g
gtatatgttttcaaagcagtgtcttttcttagaccnaaagatactcagtaacagcttggaggcagatattt

SEQ ID NO: 9560 - DNA, 71 bp, chicken (Gallus Gallus)
  misc_feature (36): n=a or g
gggggctggatgatctgtgcgctgtttttcatctcnaagattatttctgcttagtgatttcattgtgatat

SEQ ID NO: 9561 - DNA, 71 bp, chicken (Gallus Gallus)
  misc_feature (36): n=a or g
tgtgcctttttgtatgtgtgtttttttgtttgttcntttggtcttcagggtgcgtagcgtggctctgtgta

SEQ ID NO: 9562 - DNA, 71 bp, chicken (Gallus Gallus)
  misc_feature (36): n=c or t
tacacaagaatttgtccctctgtgggaccagcatcnttttcaggatcgtgaggagatgcccagacccagct

SEQ ID NO: 9563 - DNA, 71 bp, chicken (Gallus Gallus)
  misc_feature (36): n=a or g
ttgttagtgatgaaatgcaacctatcttttcttgcnttcgccgcttctgaaatacatacactccatttgca

SEQ ID NO: 9564 - DNA, 71 bp, chicken (Gallus Gallus)
  misc_feature (36): n=a or g
tcctaatgcatgcatatgtctgcatgggataagtcnacatttggaaaagctgggaagaactgctgcaaatc

SEQ ID NO: 9565 - DNA, 71 bp, chicken (Gallus Gallus)
  misc_feature (36): n=a or c
cagctacagtacattagtggtgtaggccttttctcntataagaaaatatctaagctcatttcaagatgagg

SEQ ID NO: 9566 - DNA, 71 bp, chicken (Gallus Gallus)
  misc_feature (36): n=a or g
tcttggtatcttctctttgcttgatcactattaaanaggtagaacgtggtgaaaattataactgggctttg

SEQ ID NO: 9567 - DNA, 71 bp, chicken (Gallus Gallus)
  misc_feature (36): n=c or t
ggataagccctcagtgctttttcatgggtaatagtntttctcttttctctcaaagctttaagaacactttt

SEQ ID NO: 9568 - DNA, 71 bp, chicken (Gallus Gallus)
  misc_feature (36): n=a or g
agtaatgatcatgctgcctgaagttttaaaatacancagcaaaatgatccacgttgttatgctgtccatgg

SEQ ID NO: 9569 - DNA, 71 bp, chicken (Gallus Gallus)
  misc_feature (36): n=a or g
aaccctttgtacaccttgttaatggctaaacccttnagcatctcatctaaaggctgggacacttagagttt

SEQ ID NO: 9570 - DNA, 71 bp, chicken (Gallus Gallus)
  misc_feature (36): n=g or t
tgttccaaaattttcctttatcatagtttgaaaatntgggctttcaactcccctgagagcaaaggaaaaac

SEQ ID NO: 9571 - DNA, 71 bp, chicken (Gallus Gallus)
  misc_feature (36): n=c or t
gagccacaaacactcacactaactcccacctcatanacaaagactgcatactgaaaaggggaaaacatcta

SEQ ID NO: 9572 - DNA, 71 bp, chicken (Gallus Gallus)
  misc_feature (36): n=a or g
gtttcaaagatatgaacaacccataagagtccatgngaagtaagaccctccaaaaaaagagttcatcctca

SEQ ID NO: 9573 - DNA, 71 bp, chicken (Gallus Gallus)
  misc_feature (36): n=c or t
gcaggcaaggtaaataaaaaacagaatgttgccttngggtatctgcaggaagcacaggatccgtcatacat

SEQ ID NO: 9574 - DNA, 71 bp, chicken (Gallus Gallus)
  misc_feature (36): n=c or g
atggcacagcatgggtcaacagtgctaatggccacnacagcggtaataaaaagcaaaaagtgtattaatgc

SEQ ID NO: 9575 - DNA, 71 bp, chicken (Gallus Gallus)
  misc_feature (36): n=a or c
cctatgttggtccttagtccaaggagccatgggagntgattttagaacatttcagaaaggcaacaaaaaag

SEQ ID NO: 9576 - DNA, 71 bp, chicken (Gallus Gallus)
  misc_feature (36): n=c or t
cattgcttcgtctgtgggaaaccattgggcagactncagatctcctctcactgaggtgatggctaatgtgc

SEQ ID NO: 9577 - DNA, 71 bp, chicken (Gallus Gallus)
  misc_feature (36): n=c or g
tatcacaattgctgcagtcaagtgacaccactgtgntcaaaatgctgtatggagcatttctactttaatta

SEQ ID NO: 9578 - DNA, 71 bp, chicken (Gallus Gallus)
  misc_feature (36): n=a or c
cacgtggctttatcgcctactttacaaatgcttatncacaaaaccagtaaataagtaaatgcataaataaa

SEQ ID NO: 9579 - DNA, 71 bp, chicken (Gallus Gallus)
  misc_feature (36): n=g or t
ctttctgctaaaacatagaagctttgtcctgcaatngatggccttaagtgcctccaggcaccggtttcaga

SEQ ID NO: 9580 - DNA, 71 bp, chicken (Gallus Gallus)
  misc_feature (36): n=a or g
tttggcagctgctcaatggagggaggagtggagagnaggcaataacagtgggtaaaacagaacctgcaaat

SEQ ID NO: 9581 - DNA, 71 bp, chicken (Gallus Gallus)
  misc_feature (36): n=c or t
aaacaggtaggcagctggtaccagaatggataaagnccatgcagaggaactgccctaagacacagcaaaag

SEQ ID NO: 9582 - DNA, 71 bp, chicken (Gallus Gallus)
  misc_feature (36): n=a or g
catgaaaatacaatacttggagctcctcgatgcaangggctgtgatgtgatagcgagatacatgttatagg

SEQ ID NO: 9583 - DNA, 71 bp, chicken (Gallus Gallus)
  misc_feature (36): n=a or g
ttcttgggggtattttctgccacaggttacaaacgnatgcagaatacagacatgctgatgctactctgaaa

SEQ ID NO: 9584 - DNA, 71 bp, chicken (Gallus Gallus)
  misc_feature (36): n=c or t
tcggttatttttatttcattgcacacacacacaaanctcaaattaaaaaattaaaaaaaaaaaaacaaaaa

SEQ ID NO: 9585 - DNA, 71 bp, chicken (Gallus Gallus)
  misc_feature (36): n=c or g
agatgcctctctctgttcattgcaggggagttggantagatgacctttgtatgtcccttctaacttaaagg

SEQ ID NO: 9586 - DNA, 71 bp, chicken (Gallus Gallus)
  misc_feature (36): n=a or c
tggcttttcttcagcaaaatccacatggcagccttntaatttcacagtgccgcaagaaagaacatattttg

SEQ ID NO: 9587 - DNA, 71 bp, chicken (Gallus Gallus)
  misc_feature (36): n=a or g
aatcacccagttacattgagctaagcatttactgcntccagactttgctccatcacatgcagcatgtgctg

SEQ ID NO: 9588 - DNA, 71 bp, chicken (Gallus Gallus)
  misc_feature (36): n=a or c
cacctaacacaactggaaagtgcatgcttcagaaanagcatacgtgatgcagtatttttaccaaatggcag

SEQ ID NO: 9589 - DNA, 71 bp, chicken (Gallus Gallus)
  misc_feature (36): n=a or g
cttatccttgcagctagccaaggggaaaacaatacnattcttagggaaaaaaaaaaaaaaaaagaaagagt

SEQ ID NO: 9590 - DNA, 71 bp, chicken (Gallus Gallus)
  misc_feature (36): n=a or g
tgctcttaagagggacctcatcactgagcaaacacnaacacaacctgggatcagcctggctggtttgtagt

SEQ ID NO: 9591 - DNA, 71 bp, chicken (Gallus Gallus)
  misc_feature (36): n=c or g
tacaagacgttcttgtggagctgaagcttgacaggncaatgcaagctcgcagataaacacacatttgtcat

SEQ ID NO: 9592 - DNA, 71 bp, chicken (Gallus Gallus)
  misc_feature (36): n=a or g
gttaaggcaactagccctgtatgtagccctgagagnaaacacgaagcagccatttccatcaataactcccc

SEQ ID NO: 9593 - DNA, 71 bp, chicken (Gallus Gallus)
  misc_feature (36): n=c or t
ctttctcatgtattctttgtgaaattagccctgaangcagttagctggatgcctaaccaagcgcaagatgg

SEQ ID NO: 9594 - DNA, 71 bp, chicken (Gallus Gallus)
  misc_feature (36): n=a or g
gggactgcagtttcatccacagctcagagatatacncaaggaatttccctccctccctttattagtagcac

SEQ ID NO: 9595 - DNA, 71 bp, chicken (Gallus Gallus)
  misc_feature (36): n=c or t
attcacaatttaagaaaactcacccaaaactactcntgatgcttctgaacctcctattttgctacctttaa

SEQ ID NO: 9596 - DNA, 71 bp, chicken (Gallus Gallus)
  misc_feature (36): n=c or t
caaggacaacagcaacacctcatcctgaaagtccangaaagggatgttttgatcacgtattacagaaatga

SEQ ID NO: 9597 - DNA, 71 bp, chicken (Gallus Gallus)
  misc_feature (36): n=c or t
gctgaacgcatggccatgcaatgtctgttgctccangtaagaaatgcaaatcagactcgcatatgattttg

SEQ ID NO: 9598 - DNA, 71 bp, chicken (Gallus Gallus)
  misc_feature (36): n=c or t
agacctgtgtgagcttgccaatcgctcacagtcaanacatggcagaagaggaagctccaggcagacacctc

SEQ ID NO: 9599 - DNA, 71 bp, chicken (Gallus Gallus)
  misc_feature (36): n=a or g
tgaaagttatgggagaaaactaagctgctgtgatgngactgctggagtgtgacctagggcaagtcctcatc

SEQ ID NO: 9600 - DNA, 71 bp, chicken (Gallus Gallus)
  misc_feature (36): n=a or g
catacgcagctcatgtggcacgactggcattcttcncactgcttccctcaaatgcagcgactatgctgtat

SEQ ID NO: 9601 - DNA, 71 bp, chicken (Gallus Gallus)
  misc_feature (36): n=g or t
gcacacctccttaacagagcactttgtatttttctnacagcagtcggcctgtctgggtgttctgtggcagt

SEQ ID NO: 9602 - DNA, 71 bp, chicken (Gallus Gallus)
  misc_feature (36): n=c or t
ctgacaaacaccaatttcagcaatgagactttactnaatcctctgcactcaaagtcttcttggctgaggtg

SEQ ID NO: 9603 - DNA, 71 bp, chicken (Gallus Gallus)
  misc_feature (36): n=a or t
tttaaaataattgaagataactttgtctcttgttancacaaatggagactgaatttggtctcaaagtgttt

SEQ ID NO: 9604 - DNA, 71 bp, chicken (Gallus Gallus)
  misc_feature (36): n=c or t
tgacaggtattgtcagaacaatataatacccatacnaaggtattgtgttgataaagctactgtaattaaaa

SEQ ID NO: 9605 - DNA, 71 bp, chicken (Gallus Gallus)
  misc_feature (36): n=g or t
ttaaatccagagaaggacccatatttaaaatcatcngcttagctttagctcactgggaagaaaaaaaacaa

SEQ ID NO: 9606 - DNA, 71 bp, chicken (Gallus Gallus)
  misc_feature (36): n=g or t
agctaactacatctgataacatccagtgaaaattgnttttttctttcatatttccatcatctttaggaagt

SEQ ID NO: 9607 - DNA, 71 bp, chicken (Gallus Gallus)
  misc_feature (36): n=c or t
gtcaaaattgagagtgaccctcagtgtattaggagnagttgtagttttacaactaaaagttgtagttttac

SEQ ID NO: 9608 - DNA, 71 bp, chicken (Gallus Gallus)
  misc_feature (36): n=c or t
aaatgggtttgttcttggaataagcttagcaggacncactctgctcttctagccggaaggttcaagcccaa

SEQ ID NO: 9609 - DNA, 71 bp, chicken (Gallus Gallus)
  misc_feature (36): n=a or t
acttaattcctacttcaggagataggagtcctaacngacatgttctactatagcagaatagtcaaggccaa

SEQ ID NO: 9610 - DNA, 71 bp, chicken (Gallus Gallus)
  misc_feature (36): n=g or t
ggtgctaaaagcagccgtggatttgattttcagcgntacttgggggatttgctttttaggaatgttgtgaa

SEQ ID NO: 9611 - DNA, 71 bp, chicken (Gallus Gallus)
  misc_feature (36): n=a or g
ctcactggcctgggggagttagagcttgactgtaangttgtgagtgcaggaagggaaaagaagggctgcat

SEQ ID NO: 9612 - DNA, 71 bp, chicken (Gallus Gallus)
  misc_feature (36): n=a or g
tctgtatacaggtctgagataacagaaggaggtgtntgctgcaaaataaatttcagtgtatgtgacaccat

SEQ ID NO: 9613 - DNA, 71 bp, chicken (Gallus Gallus)
  misc_feature (36): n=g or t
gccatttcatagtaacttattcaagctgttgggccntagagtactaagttggctttcctcacctcccaaag

SEQ ID NO: 9614 - DNA, 71 bp, chicken (Gallus Gallus)
  misc_feature (36): n=c or t
cagtggtgcctccataatggggatgtagatttgttnagaggtgttggggagctcgtcctgttagtgagaac

SEQ ID NO: 9615 - DNA, 71 bp, chicken (Gallus Gallus)
  misc_feature (36): n=a or g
ataactgtgtgttaagagattcggtacaaaaacagnatgtctgaaatggagagtaaggaggcagtatgtga

SEQ ID NO: 9616 - DNA, 71 bp, chicken (Gallus Gallus)
  misc_feature (36): n=a or t
ctgtacaaggcatccaggtatctcaggctgtcaggncccacatgagataaggacatgaattccatggtagc

SEQ ID NO: 9617 - DNA, 71 bp, chicken (Gallus Gallus)
  misc_feature (36): n=a or g
tgttgggatattcgtttagcaactcagaaagctgcncaggtatttagtggctatccttccaacgtgtttat

SEQ ID NO: 9618 - DNA, 71 bp, chicken (Gallus Gallus)
  misc_feature (36): n=c or t
gaacagaagggtcagctctattttcatatggataanatgcagattcagtagattcactagaaaaaatagag

SEQ ID NO: 9619 - DNA, 71 bp, chicken (Gallus Gallus)
  misc_feature (36): n=c or t
gaagttctcaggaagctccatgtgtctgctgatctnaaggttttcctaagctataacactctaaaaattta

SEQ ID NO: 9620 - DNA, 71 bp, chicken (Gallus Gallus)
  misc_feature (36): n=g or t
agctttcctgaccattctgtagcttatgagtgctanatctttatttgaacaacaaaaaagagctattcagt

SEQ ID NO: 9621 - DNA, 71 bp, chicken (Gallus Gallus)
  misc_feature (36): n=c or t
gtgattggtggtccttgccaatcagcagttttatgnatgctttgaaataagaatgggtggcaataattcta

SEQ ID NO: 9622 - DNA, 71 bp, chicken (Gallus Gallus)
  misc_feature (36): n=a or g
gggatttcaaatgttttctgaaaaccaaaacgctanaaacttttcactcaaaaaacaaaagtcaaaagaga

SEQ ID NO: 9623 - DNA, 71 bp, chicken (Gallus Gallus)
  misc_feature (36): n=a or t
ttggcatatcctcttaacactacacctgttccaaanaacagggtcaccaggtctctaaatcctctgcctga

SEQ ID NO: 9624 - DNA, 71 bp, chicken (Gallus Gallus)
  misc_feature (36): n=a or c
gacctatcctcagggagtacaggctgattaattaanagacagaaggcaggaactactgcatagaaacagca

SEQ ID NO: 9625 - DNA, 71 bp, chicken (Gallus Gallus)
  misc_feature (36): n=c or t
gagtgtttaagaaatggggttcctttggagaaaagnatctcatcatggtaccctgtgctctgtgactccaa

SEQ ID NO: 9626 - DNA, 71 bp, chicken (Gallus Gallus)
  misc_feature (36): n=a or g
cacgcagtatcacctgccttagtaagtctatgcaanaacagcgtatactgattctctcccaaatactctct

SEQ ID NO: 9627 - DNA, 71 bp, chicken (Gallus Gallus)
  misc_feature (36): n=c or t
acccgacagaaggcagactgggttttggtttccagntcattaggcaggaggtacatgtgtttggggttgac

SEQ ID NO: 9628 - DNA, 71 bp, chicken (Gallus Gallus)
  misc_feature (36): n=c or t
tggtatgtctgtttggagacagctcactgcagacantgctggagggagatgtgataatgtcaatgaatctg

SEQ ID NO: 9629 - DNA, 71 bp, chicken (Gallus Gallus)
  misc_feature (36): n=a or g
tgaccacatgcaacgctgcagtgaaatagctctaancaacactgtgcagattgcacagtcagcgtagcccc

SEQ ID NO: 9630 - DNA, 71 bp, chicken (Gallus Gallus)
  misc_feature (36): n=a or c
cagtgcaaagggagacgtgctttataattaagactnctttggtagtttctctgtctccattttacaaaact

SEQ ID NO: 9631 - DNA, 71 bp, chicken (Gallus Gallus)
  misc_feature (36): n=a or g
tccaagacctagaagaaccctggaaaatgccattantaaccactaaatataaacaaaaaaattattaacaa

SEQ ID NO: 9632 - DNA, 71 bp, chicken (Gallus Gallus)
  misc_feature (36): n=a or g
cttgcttgtagaaaggaatcaaaccaaaagaaagcngtccctgtcccaagagaattagcattcatgtcaga

SEQ ID NO: 9633 - DNA, 71 bp, chicken (Gallus Gallus)
  misc_feature (36): n=c or t
taatgcagtgatttccatagcattacaggaatcagncgtaaaaccgacaccttatttcaagcattttctca

SEQ ID NO: 9634 - DNA, 71 bp, chicken (Gallus Gallus)
  misc_feature (36): n=c or t
gctccttcacagagcccaaacttcacgtgagagaanaaaaataaaagtgaaatttccttgtattattttgg

SEQ ID NO: 9635 - DNA, 71 bp, chicken (Gallus Gallus)
  misc_feature (36): n=a or g
ttaccttggcactggtatccctgcttcccaaacacncccctgttcaaaacaaaacatgaacataatttaac

SEQ ID NO: 9636 - DNA, 71 bp, chicken (Gallus Gallus)
  misc_feature (36): n=a or g
attagaaagccaagtgacttaagacccataataacnaggcatcaaatcttaacaaccctcttttcaaatga

SEQ ID NO: 9637 - DNA, 71 bp, chicken (Gallus Gallus)
  misc_feature (36): n=c or t
tacagcagtaaagcactgtgtaacgtcagggaaatncatctgattgcacaacgaagaacagagccctcaac

SEQ ID NO: 9638 - DNA, 71 bp, chicken (Gallus Gallus)
  misc_feature (36): n=a or g
ggctgtcgcaggtaggtagccatgaatttgtgcccnttcacctgatgcactcgcctccgcatggcccgctg

SEQ ID NO: 9639 - DNA, 71 bp, chicken (Gallus Gallus)
  misc_feature (36): n=a or g
cttctgtaatgctgagttcactcagagattcctgcntgcactcagagcagctcttcgggatgatcctcttt

SEQ ID NO: 9640 - DNA, 71 bp, chicken (Gallus Gallus)
  misc_feature (36): n=a or c
aggggatgggtggtgttgggggtttgcagctgcccnttcaagggcagaaacactctaaaacccatgagttc

SEQ ID NO: 9641 - DNA, 71 bp, chicken (Gallus Gallus)
  misc_feature (36): n=a or g
ttgaagcctcagtgcaattggtaacagcacaataantggctcttcaacaaaaccagtagtgaggagagtac

SEQ ID NO: 9642 - DNA, 71 bp, chicken (Gallus Gallus)
  misc_feature (36): n=c or t
gaattcagaatgaataggataacttgcaactataangtattagtcctgaaatcataacagtatactgagtg

SEQ ID NO: 9643 - DNA, 71 bp, chicken (Gallus Gallus)
  misc_feature (36): n=c or t
aagatatacccaaattatgaacatgctctatagtcntacttctgtttcataaaagaaacacacaattgtca

SEQ ID NO: 9644 - DNA, 71 bp, chicken (Gallus Gallus)
  misc_feature (36): n=c or t
gttagattaaagaaactccaagatataactggtagntgccatcctctctagtaatgagaggtagctgactg

SEQ ID NO: 9645 - DNA, 71 bp, chicken (Gallus Gallus)
  misc_feature (36): n=c or g
atgctgaattttttacaagctttcccagcatacaanagctataatgagcctacatgcaaaaatgcaggatc

SEQ ID NO: 9646 - DNA, 71 bp, chicken (Gallus Gallus)
  misc_feature (36): n=a or g
tactacttcttcatttttataaattccttttacacnaatacattttgtcaaatcatactttcctagcaaag

SEQ ID NO: 9647 - DNA, 71 bp, chicken (Gallus Gallus)
  misc_feature (36): n=a or g
ccatggtaagaattctttgaaagaattaaatagttntatcattaggaaaacaatgaagagatgctgctttc

SEQ ID NO: 9648 - DNA, 71 bp, chicken (Gallus Gallus)
  misc_feature (36): n=c or t
agaaaactgttggttttactgttttaagaagctttngtagcctctaatttttctcttaggagaaaattcaa

SEQ ID NO: 9649 - DNA, 71 bp, chicken (Gallus Gallus)
  misc_feature (36): n=a or g
gcgaccaacaaatagccctcaccgtattccctaagncaaggaatagaacctgacagactgtagtttttaaa

SEQ ID NO: 9650 - DNA, 71 bp, chicken (Gallus Gallus)
  misc_feature (36): n=a or g
ttgaagtcaaaatgagagataaatggggaaagggcnggggctttgtcagtgcattgcacagtcagtgctcg

SEQ ID NO: 9651 - DNA, 71 bp, chicken (Gallus Gallus)
  misc_feature (36): n=c or t
caccattggctttggagactacgtagtaggtaaggntgatttcagagaggaggtgcagcgaagcaccaggg

SEQ ID NO: 9652 - DNA, 71 bp, chicken (Gallus Gallus)
  misc_feature (36): n=c or t
caagctcttattaggacttggtctcgtacgaccttnggggcattccagaatggaggctatgctacaatggc

SEQ ID NO: 9653 - DNA, 71 bp, chicken (Gallus Gallus)
  misc_feature (36): n=c or g
gctctgccaatgtcagttgtgtttagactaaacaanatctcacttgtacgcaaatggcagcctgatttgag

SEQ ID NO: 9654 - DNA, 71 bp, chicken (Gallus Gallus)
  misc_feature (36): n=a or g
tatgttgggctgctgaaaacagactcttattaagcnaggcagagagcaattaatgtcatgtagagagcagt

SEQ ID NO: 9655 - DNA, 71 bp, chicken (Gallus Gallus)
  misc_feature (36): n=a or c
gccatcggtggaggtgttgcactgccctcctctcanatctcctttgctgtggagcaaagaacaaagagggt

SEQ ID NO: 9656 - DNA, 71 bp, chicken (Gallus Gallus)
  misc_feature (36): n=a or c
aagctttggcagaaggataatgcataaaatagatantgtgccatgcttggctcacttcagttgtcccaatt

SEQ ID NO: 9657 - DNA, 71 bp, chicken (Gallus Gallus)
  misc_feature (36): n=c or g
gaactctgtattcatgtgtctacaaatggcattttntgtgtagcagaatacagaacataaactacagaacc

SEQ ID NO: 9658 - DNA, 71 bp, chicken (Gallus Gallus)
  misc_feature (36): n=a or g
gaatcccattcacaaaattcctcttattttttgacntgtcagtgccagagctctgtgcaatgcaggaacgg

SEQ ID NO: 9659 - DNA, 71 bp, chicken (Gallus Gallus)
  misc_feature (36): n=a or g
taagcagttgtttaagaacttggggaaatgatcaanaattttcacagattgagtcattgagaaaaaaacag

SEQ ID NO: 9660 - DNA, 71 bp, chicken (Gallus Gallus)
  misc_feature (36): n=a or g
agctgttcagaacattctgattgtgccacacttganacaagacttgagttaataaatgctctctcctacaa

SEQ ID NO: 9661 - DNA, 71 bp, chicken (Gallus Gallus)
  misc_feature (36): n=c or t
ctgcttacaaccagagctctgactttataagcaagntaatccatgagcaaatatttttcatgaatggctga

SEQ ID NO: 9662 - DNA, 71 bp, chicken (Gallus Gallus)
  misc_feature (36): n=a or c
atctagaatgtatgtacacaaacctgctatagcagnctgctctcctgttctgctgtatatctgtgtggcta

SEQ ID NO: 9663 - DNA, 71 bp, chicken (Gallus Gallus)
  misc_feature (36): n=a or g
tattgggcacttctctgaaaaattggacatagaagnaatgtatatttctgtatgcatttctgaaaacatga

SEQ ID NO: 9664 - DNA, 71 bp, chicken (Gallus Gallus)
  misc_feature (36): n=a or g
ccaaaattattctgaagaagtgtttcattcaccttnttgaaagtgcttatttttccattttgcctcgtgaa

SEQ ID NO: 9665 - DNA, 71 bp, chicken (Gallus Gallus)
  misc_feature (36): n=a or t
cagtttagcctgctgttacttgaattcatgggatgnacacagaggacttcccccctcttcacatagtaaaa

SEQ ID NO: 9666 - DNA, 71 bp, chicken (Gallus Gallus)
  misc_feature (36): n=c or t
aaacctcaagcaggaaactccagttgttaattttantagaatacattgagaagtggctgcactgtcacaac

SEQ ID NO: 9667 - DNA, 71 bp, chicken (Gallus Gallus)
  misc_feature (36): n=c or t
agctctcctggatggaatctgacctccgtgcacacnggtactcctggaagaatgattaacgctttccattt

SEQ ID NO: 9668 - DNA, 71 bp, chicken (Gallus Gallus)
  misc_feature (36): n=c or t
gcacggctgaagtgctgtctaagaccatgcagcccnctcctaacctttttcattagctggagtgctactcc

SEQ ID NO: 9669 - DNA, 71 bp, chicken (Gallus Gallus)
  misc_feature (36): n=a or t
aataaaaaagaatcattatgtgtgtgggggcagttntaatgtgtgaacatttgaatggactatagaatcat

SEQ ID NO: 9670 - DNA, 71 bp, chicken (Gallus Gallus)
  misc_feature (36): n=c or t
gactccccattaagaggatctgatttatctaccccngatacaaacgcaaatctcctttcttctcccctctg

SEQ ID NO: 9671 - DNA, 71 bp, chicken (Gallus Gallus)
  misc_feature (36): n=c or t
caccccaataaataaagggacctctgcatgactggntcatctcagatacccctgctatcactgtctgaagt

SEQ ID NO: 9672 - DNA, 71 bp, chicken (Gallus Gallus)
  misc_feature (36): n=c or t
cctaaaactgcttacaatggtttagcgtatttggtngtcaaagtatggttgtctttttagaaggccctctg

SEQ ID NO: 9673 - DNA, 71 bp, chicken (Gallus Gallus)
  misc_feature (36): n=a or g
cactgctccatttccatgactgctgtttaatgggangagtaggtccccttaatatagatgctaccagctga

SEQ ID NO: 9674 - DNA, 71 bp, chicken (Gallus Gallus)
  misc_feature (36): n=a or t
accatgcaagcaagatacaagcctcacaggttgtantcagcacttcactttttttttttttttttttggca

SEQ ID NO: 9675 - DNA, 71 bp, chicken (Gallus Gallus)
  misc_feature (36): n=a or g
ctcttctgggtctcctctgaccctgacagacttgancactctatgtacatgagtctgcattgcaagggagt

SEQ ID NO: 9676 - DNA, 71 bp, chicken (Gallus Gallus)
  misc_feature (36): n=a or g
gttcatcctaccagggctccatggacaaggtcacgnactgtgtaacggtcagaaagagggagtgatgccaa

SEQ ID NO: 9677 - DNA, 71 bp, chicken (Gallus Gallus)
  misc_feature (36): n=c or t
aactggagggttaaacataaacataagccgtcccanggcatgtccaagcagctgccactcactcttataga

SEQ ID NO: 9678 - DNA, 71 bp, chicken (Gallus Gallus)
  misc_feature (36): n=c or t
caataacaaaagctgaagatgggcaacattcacatnggtgtgaaagtgggttaaatcacatttggtaaatt

SEQ ID NO: 9679 - DNA, 71 bp, chicken (Gallus Gallus)
  misc_feature (36): n=a or g
gcaggtgtgaatgataaagtagtagaaggaaacacnattcagatcaaccacagactcagatttgctaagac

SEQ ID NO: 9680 - DNA, 71 bp, chicken (Gallus Gallus)
  misc_feature (36): n=c or t
caagtccttcactgaagtggtgcgagcaggggctgntataatgcctatttctaagcaggagcagttaatgc

SEQ ID NO: 9681 - DNA, 71 bp, chicken (Gallus Gallus)
  misc_feature (36): n=c or t
gtgttcttttgctgcctgcatccagctatttgagcnggctgttgctgcaagcacgaaggaaatcatcttga

SEQ ID NO: 9682 - DNA, 71 bp, chicken (Gallus Gallus)
  misc_feature (36): n=a or g
tgcatggaacatatctgtaaacgcatatagcatgantgctcttctcaatgcatacacataactgcatatat

SEQ ID NO: 9683 - DNA, 71 bp, chicken (Gallus Gallus)
  misc_feature (36): n=c or g
ttccctctgctgtgtattggaggactgtttttcacnaggatctctatttcatagattcacattagtaaatt

SEQ ID NO: 9684 - DNA, 71 bp, chicken (Gallus Gallus)
  misc_feature (36): n=a or g
tggaagcattcaaaacacagtttttaagcaatctcnctgccatatgtgcatattagaaatcaaggggcagg

SEQ ID NO: 9685 - DNA, 71 bp, chicken (Gallus Gallus)
  misc_feature (36): n=a or g
cctttgtttatcttggtttggagagagtgccatcanctgctgcactcctgaaaatcaacttctgcaaaacc

SEQ ID NO: 9686 - DNA, 71 bp, chicken (Gallus Gallus)
  misc_feature (36): n=a or g
caaagaccccccaaaggcaaagccagccttgctgcnctttcactgcttttgaagcccaaaatagcttgatt

SEQ ID NO: 9687 - DNA, 71 bp, chicken (Gallus Gallus)
  misc_feature (36): n=a or c
ccaaagaactgttccagcagcagcacccttccaagnttattcaaccacctcatttcactgactggttctca

SEQ ID NO: 9688 - DNA, 71 bp, chicken (Gallus Gallus)
  misc_feature (36): n=g or t
ggaaatttggactgagaacaaaaagttccagtttgncattgcctactcctggatttgaggtagagtgatct

SEQ ID NO: 9689 - DNA, 71 bp, chicken (Gallus Gallus)
  misc_feature (36): n=c or t
ttctgctttacagctatcccatcgtgctgctttccnttcagagcttcgttcctgcgcaggtgagagcctac

SEQ ID NO: 9690 - DNA, 71 bp, chicken (Gallus Gallus)
  misc_feature (36): n=c or t
ttacaatacggcatccaaaatacctaactctggaanggagctcaactccaactttcaacaaattgaagata

SEQ ID NO: 9691 - DNA, 71 bp, chicken (Gallus Gallus)
  misc_feature (36): n=a or g
ttgaaaatttggtaacatttctgccatgagcagtantgcagtcactgtgcactgtaaatattgctgtgcag

SEQ ID NO: 9692 - DNA, 71 bp, chicken (Gallus Gallus)
  misc_feature (36): n=a or g
ccttggatcccccccttcccttctatcaatgagaanaaaagcaggtccctaattcctgtcctatatttagg

SEQ ID NO: 9693 - DNA, 71 bp, chicken (Gallus Gallus)
  misc_feature (36): n=c or t
gaaggaagcgacgacaccaaaatgtggtttctatgntgttctcgggccataggaggagcagaggagggaat

SEQ ID NO: 9694 - DNA, 71 bp, chicken (Gallus Gallus)
  misc_feature (36): n=a or g
cgtgtgctttggagaaacctcccaagcactgagtcngtcctgctcatatactggtctgctaaatgcctggg

SEQ ID NO: 9695 - DNA, 71 bp, chicken (Gallus Gallus)
  misc_feature (36): n=a or g
ggaacagtcaatgagctgctttttctgcagaagacntgagttgtctccccgagctgctgaaaagcggcagc

SEQ ID NO: 9696 - DNA, 71 bp, chicken (Gallus Gallus)
  misc_feature (36): n=a or t
aaaggaaaattccaaacggaaagcgtagaagactangtctcttcaaaagcaacactgagcaacacagaggt

SEQ ID NO: 9697 - DNA, 71 bp, chicken (Gallus Gallus)
  misc_feature (36): n=c or t
aattaactcctccctgctcaccaggtgggctttagntggcagacagagttgtcatctcctggagaacatgg

SEQ ID NO: 9698 - DNA, 71 bp, chicken (Gallus Gallus)
  misc_feature (36): n=a or g
agcatttgaattcagactaataataaccccataatnaagcaagtctcagaagaagtagcagaactaatcgt

SEQ ID NO: 9699 - DNA, 71 bp, chicken (Gallus Gallus)
  misc_feature (36): n=a or g
gatttatttatattaacaaagcactgagcgaatacngtctgacatttgctttgtgactgtgctcgtttcct

SEQ ID NO: 9700 - DNA, 71 bp, chicken (Gallus Gallus)
  misc_feature (36): n=c or t
accccatttctcattctggcaggactttatgtgagngtgggaggtgttttgggttgctctacccgtctgca

SEQ ID NO: 9701 - DNA, 71 bp, chicken (Gallus Gallus)
  misc_feature (36): n=a or t
tgagctacatgagggggagatgattccatgcaatgnggtgctctgttttatttagagcattgctgggttgt

SEQ ID NO: 9702 - DNA, 71 bp, chicken (Gallus Gallus)
  misc_feature (36): n=a or g
gctgctcaaaggatgatagaataatgtgcatccttngagaagttttgtttacagaaacaatgaaatgcctc

SEQ ID NO: 9703 - DNA, 71 bp, chicken (Gallus Gallus)
  misc_feature (36): n=a or g
tgcttctggaatggagctggaaagcctctgcagacntgaggagtgtgcacactgtttacccttctgtgata

SEQ ID NO: 9704 - DNA, 71 bp, chicken (Gallus Gallus)
  misc_feature (36): n=g or t
tgtgcatgctgctagcccattagctgcttttctaanatttcagactataactattggatttgcaccataat

SEQ ID NO: 9705 - DNA, 71 bp, chicken (Gallus Gallus)
  misc_feature (36): n=a or g
gctccgtgcagactctgaatgataattcagccaaangcttcattacatttaggaagaggtagagccatcag

SEQ ID NO: 9706 - DNA, 71 bp, chicken (Gallus Gallus)
  misc_feature (36): n=c or t
tcagcagagcccaaataaggttctgtcatggccagngtaggtctgccataaaacacagttgcaattttctg

SEQ ID NO: 9707 - DNA, 71 bp, chicken (Gallus Gallus)
  misc_feature (36): n=c or t
ggagtcttccaaggtcaatacaacccaacgtttgcnattcaagcaagagtaaagggaaggaagtgaaggtg

SEQ ID NO: 9708 - DNA, 71 bp, chicken (Gallus Gallus)
  misc_feature (36): n=c or g
tggtcagcaatctgagctgggataagggccgtgcantgtgtgtgtccatctggaaacagactcgtttgtta

SEQ ID NO: 9709 - DNA, 71 bp, chicken (Gallus Gallus)
  misc_feature (36): n=a or g
ctaagacagcaagtgttaacatgctgcacatgatcngttctgattcagtgccagagatcacagaatttact

SEQ ID NO: 9710 - DNA, 71 bp, chicken (Gallus Gallus)
  misc_feature (36): n=g or t
ttaatttgtcaacattacaggaatttctcatgactngatccaactatacttccagcaagtgctccctgtgc

SEQ ID NO: 9711 - DNA, 71 bp, chicken (Gallus Gallus)
  misc_feature (36): n=c or t
ccgagagctgccaaatggctgttacctacaatggcnaccagccttgactacaaagtcaatgacagagcttc

SEQ ID NO: 9712 - DNA, 71 bp, chicken (Gallus Gallus)
  misc_feature (36): n=c or g
gcagagggctcagctggctcctgctgacctccccanaactcagtgccttgacatgatccagccagcaatgc

SEQ ID NO: 9713 - DNA, 71 bp, chicken (Gallus Gallus)
  misc_feature (36): n=a or g
tttcagatttcctgctttccaatcagaaattcagangaagctgaaggcaactccttgaaataacgtgaaat

SEQ ID NO: 9714 - DNA, 71 bp, chicken (Gallus Gallus)
  misc_feature (36): n=g or t
gacaaaggctgctccatttccaacctactaaagganccaggagagctctccattaacctcccaggtgattc

SEQ ID NO: 9715 - DNA, 71 bp, chicken (Gallus Gallus)
  misc_feature (36): n=a or c
atcagagactttacaaaattcatcaaggccaatgcntgttatcctgactgctccttggtctcacccagtgt

SEQ ID NO: 9716 - DNA, 71 bp, chicken (Gallus Gallus)
  misc_feature (36): n=c or g
acattcatccaggagattctcctgttgcatgatgangctgagtggaccccttgcttccaaaacctccttga

SEQ ID NO: 9717 - DNA, 71 bp, chicken (Gallus Gallus)
  misc_feature (36): n=a or g
taaatgcttctcctcttaatagtaatatataggtancgtgtactttgcctggtcatggaaaatatatttgt

SEQ ID NO: 9718 - DNA, 71 bp, chicken (Gallus Gallus)
  misc_feature (36): n=a or g
ttggtgattgatctgaagattttcctcgaatgtcangtctttaggtatgatttgggatttcagagactttt

SEQ ID NO: 9719 - DNA, 71 bp, chicken (Gallus Gallus)
  misc_feature (36): n=a or g
cccctgtatattctccaaaaaagaaaaaggaaaggnaaactttaaaactttcaagagcactttttgtgtca

SEQ ID NO: 9720 - DNA, 71 bp, chicken (Gallus Gallus)
  misc_feature (36): n=c or g
ttgactgtgagtatcacgaatggaaatcttgtctgnccagatttctggcaccaaccccagcaagcagagaa

SEQ ID NO: 9721 - DNA, 71 bp, chicken (Gallus Gallus)
  misc_feature (36): n=c or t
gaacaggtggaagcacagtttgtggtgggaggaganagtgaatgtacataattaagacaggctggaaatgt

SEQ ID NO: 9722 - DNA, 71 bp, chicken (Gallus Gallus)
  misc_feature (36): n=a or g
caggagtggtcaagaatgcccatgcacagagagtcngctaaagagcaatgtgccaacacagagttatctgg

SEQ ID NO: 9723 - DNA, 71 bp, chicken (Gallus Gallus)
  misc_feature (36): n=a or g
ctgctggggacacttctcaagaggtggacataaggnaaggacctttgggtcttcgttgtaggttgaaaatc

SEQ ID NO: 9724 - DNA, 71 bp, chicken (Gallus Gallus)
  misc_feature (36): n=a or g
caatcgatctcaatgcgtgagatactgaaaagtgantcagccaaacaaacagaaaaatccaaggtcttcac

SEQ ID NO: 9725 - DNA, 71 bp, chicken (Gallus Gallus)
  misc_feature (36): n=a or c
ttatccatggcaacccactgccatgtgtaagattanagcatcttcctgccttggggaaggaaagatctcac

SEQ ID NO: 9726 - DNA, 71 bp, chicken (Gallus Gallus)
  misc_feature (36): n=g or t
gtaccaactatttaagcagtagatcctgattacctntattgattgcacctgtaccatgtggcagtcagagt

SEQ ID NO: 9727 - DNA, 71 bp, chicken (Gallus Gallus)
  misc_feature (36): n=a or g
cagtgagttccaggaacacacaactccatcccctcngctcacaacctttcattacatcatttttttttcct

SEQ ID NO: 9728 - DNA, 71 bp, chicken (Gallus Gallus)
  misc_feature (36): n=a or g
gcctactgatgccttgcttctaagaaaaccccaccncctgtaagaggagtcattacccatcacgaactgtg

SEQ ID NO: 9729 - DNA, 71 bp, chicken (Gallus Gallus)
  misc_feature (36): n=c or t
tgttggatctgggttattcagaggggtttgttttgnatgccgtttattcttaaatactgtaaacagcacat

SEQ ID NO: 9730 - DNA, 71 bp, chicken (Gallus Gallus)
  misc_feature (36): n=a or g
caggcctggcttactgcttaaatttaagttagaatnggttgctgatgaatgaaatccttcctaacctctgt

SEQ ID NO: 9731 - DNA, 71 bp, chicken (Gallus Gallus)
  misc_feature (36): n=c or t
ggctgcctgccagcctgatgtaaccccatttagtangacattttgagatcgactcatcagccaattgctca

SEQ ID NO: 9732 - DNA, 71 bp, chicken (Gallus Gallus)
  misc_feature (36): n=a or g
ttagagaacgctgtagattgaaatgagttgtatccncaggatgagggcaccataacagaatgttcttgccc

SEQ ID NO: 9733 - DNA, 71 bp, chicken (Gallus Gallus)
  misc_feature (36): n=a or t
acagtttaccgagaaggtatggatgcagctgaaaanattcttttttttcccagcttattacgtattttcaa

SEQ ID NO: 9734 - DNA, 71 bp, chicken (Gallus Gallus)
  misc_feature (36): n=c or t
gaaacacagcattttcaaaaatcgaagtattttcangagaaaggggtgggggggattgaatattctgcccc

SEQ ID NO: 9735 - DNA, 71 bp, chicken (Gallus Gallus)
  misc_feature (36): n=g or t
tacgagaagatcccagagccattaataaaacagcangaagaataaatcagcatttcagcaagaacggggct

SEQ ID NO: 9736 - DNA, 71 bp, chicken (Gallus Gallus)
  misc_feature (36): n=c or t
agaatgtgacttgatggagaaacaccaacgcaatgnaacactgtcacctcttgcaaaaaaccaagccgttt

SEQ ID NO: 9737 - DNA, 71 bp, chicken (Gallus Gallus)
  misc_feature (36): n=g or t
ataggatgggagccagggtattaggaccaatttatnaggctaagaggagggtgagagggactggttcctaa

SEQ ID NO: 9738 - DNA, 71 bp, chicken (Gallus Gallus)
  misc_feature (36): n=g or t
ctggagtgaaacacagtctgtcgctggtttgcttcngggtcagctctgcgagagtccgggacctcacatgg

SEQ ID NO: 9739 - DNA, 71 bp, chicken (Gallus Gallus)
  misc_feature (36): n=c or t
gtcagggctccattcagcatgaacttcatgttcccngtgcccgacgcctcggtgcccgccgtggagatctg

SEQ ID NO: 9740 - DNA, 71 bp, chicken (Gallus Gallus)
  misc_feature (36): n=c or g
tggtcagactgggaatttggtggctgatcagactgnaaagtggcagttcagcagtttgggtccctcagctg

SEQ ID NO: 9741 - DNA, 71 bp, chicken (Gallus Gallus)
  misc_feature (36): n=a or g
ctttttagtgcagtaattcctagaggtagtggtaanttagaggctgtggggctggaagatcctatctgccc

SEQ ID NO: 9742 - DNA, 71 bp, chicken (Gallus Gallus)
  misc_feature (36): n=a or t
tctacaattcatttatttgtgtcttcacaggtaatngaattgccacttacgaacccagaactgtttcagcg

SEQ ID NO: 9743 - DNA, 71 bp, chicken (Gallus Gallus)
  misc_feature (36): n=c or t
aggcacaccccacaacatgcagctccccaaactatncccaaaccagaatgaattgaaaatatccaatccag

SEQ ID NO: 9744 - DNA, 71 bp, chicken (Gallus Gallus)
  misc_feature (36): n=c or g
ggcacctcagctgacagagaaattcagaggactctnatggaggtgagtgcccaaactctggttacataccc

SEQ ID NO: 9745 - DNA, 71 bp, chicken (Gallus Gallus)
  misc_feature (36): n=c or g
gagcagcccacagtgattccaatactttgcagcctnatacctcaagaagggtgcttgcagtttaagacaca

SEQ ID NO: 9746 - DNA, 71 bp, chicken (Gallus Gallus)
  misc_feature (36): n=c or t
tttattaatttaaattggaggaattaatcaggaaangcctattttaacacagttggatacactttttctaa

SEQ ID NO: 9747 - DNA, 71 bp, chicken (Gallus Gallus)
  misc_feature (36): n=c or t
gcaactggagatccttcttaaatttgtggcagtggngtccacactcatattattctgctgatggaaatcaa

SEQ ID NO: 9748 - DNA, 71 bp, chicken (Gallus Gallus)
  misc_feature (36): n=c or t
caccttctcagcttttctttttcttttccatctccngatgtctaataagggttgagtctagatttccctgt

SEQ ID NO: 9749 - DNA, 71 bp, chicken (Gallus Gallus)
  misc_feature (36): n=c or t
accaagaatctgtaggatctcagttggagccacaangggttacagcactttgctgagatgttctcctcatt

SEQ ID NO: 9750 - DNA, 71 bp, chicken (Gallus Gallus)
  misc_feature (36): n=a or g
tttatctccttcaatatttgcaagctgagactctcnaactgttgagcaagatgccccacatcagctgaacc

SEQ ID NO: 9751 - DNA, 71 bp, chicken (Gallus Gallus)
  misc_feature (36): n=a or g
gaaatgatatgaaattctagcaatttacagagccanttagcaagttatctacttcacgagactagaagtaa

SEQ ID NO: 9752 - DNA, 71 bp, chicken (Gallus Gallus)
  misc_feature (36): n=a or c
agtgatgtgtacaccaaagggttcctgctgccatcnagagggacctaggacaggctgggatgtgggctagg

SEQ ID NO: 9753 - DNA, 71 bp, chicken (Gallus Gallus)
  misc_feature (36): n=c or g
tatatagcaagggcaggtagagaaaaaaatccatgnatttaacaaatcctttcccagccctccagtgctgc

SEQ ID NO: 9754 - DNA, 71 bp, chicken (Gallus Gallus)
  misc_feature (36): n=a or c
agtacggaaagaaaaaatccttgtcgagcgctcccnaagatttttattgttggtttcatctgtagcagcag

SEQ ID NO: 9755 - DNA, 71 bp, chicken (Gallus Gallus)
  misc_feature (36): n=c or t
cgctcgcttatatactccgggagcaacttggtgagngggcgggctgcccgagcccgggccgtgcctcagga

SEQ ID NO: 9756 - DNA, 71 bp, chicken (Gallus Gallus)
  misc_feature (36): n=a or g
tttaatctctattattttcctaaatacatataagcntatgcttttaacatacacttatttatatattaggt

SEQ ID NO: 9757 - DNA, 71 bp, chicken (Gallus Gallus)
  misc_feature (36): n=a or t
taactttaacctcgagaagagaccagaaaggcagancagccctaatactcactgaaatctgagggaaaaag

SEQ ID NO: 9758 - DNA, 71 bp, chicken (Gallus Gallus)
  misc_feature (36): n=a or t
ccatactgcaattccaccacagtatacattcattcnttcattctagtggtgaattattgtgttatcacgtt

SEQ ID NO: 9759 - DNA, 71 bp, chicken (Gallus Gallus)
  misc_feature (36): n=a or c
aagcacttatttcattcagcagaactcagcaaaaanacaaagcaaaacaaaattaattccagcattgctgt

SEQ ID NO: 9760 - DNA, 71 bp, chicken (Gallus Gallus)
  misc_feature (36): n=a or c
atgaatccagtccccacggcacatctcttgccccantacactgccatgagtctctgctccagagcactgct

SEQ ID NO: 9761 - DNA, 71 bp, chicken (Gallus Gallus)
  misc_feature (36): n=a or g
caggtaatcctgcagtaactcattcactgagtatcnagtaatgctacgttaaacccatccagcacacactc

SEQ ID NO: 9762 - DNA, 71 bp, chicken (Gallus Gallus)
  misc_feature (36): n=c or t
ttccccagtttcaaatgatttttgaactgttgtttncagaattaccgtgcattcggattcctcagaaccag

SEQ ID NO: 9763 - DNA, 71 bp, chicken (Gallus Gallus)
  misc_feature (36): n=c or t
gcacgataaaaaaataattagttatccagttgaaangtgaacagacccaataaatgcaagaatttcaaggg

SEQ ID NO: 9764 - DNA, 71 bp, chicken (Gallus Gallus)
  misc_feature (36): n=a or g
gacatggaaagtatcattactgggagaaaagcaccnttcatgtatttctgtatgcagatcactgtgtgtta

SEQ ID NO: 9765 - DNA, 71 bp, chicken (Gallus Gallus)
  misc_feature (36): n=a or g
agaaggacggaatgaaggtgatggagaaatctggcnagattgagctgggggaggcagcagtgagggtctct

SEQ ID NO: 9766 - DNA, 71 bp, chicken (Gallus Gallus)
  misc_feature (36): n=a or g
tgtatgactgtcttcatctcatctgatagagggacnggagcaggcagcacagtttccttcactgtctgtct

SEQ ID NO: 9767 - DNA, 71 bp, chicken (Gallus Gallus)
  misc_feature (36): n=c or t
atcagagattaagcaagaacgtgatttaaacaacgngcttatcttgcactgggctcaaacaaaggcaggag

SEQ ID NO: 9768 - DNA, 71 bp, chicken (Gallus Gallus)
  misc_feature (36): n=c or t
ggtgttggtgtctgaggtgtgcccaagtgtgataangccccaggagttgtctgtcaccactatgtgggtgg

SEQ ID NO: 9769 - DNA, 71 bp, chicken (Gallus Gallus)
  misc_feature (36): n=a or g
ttgagtattttctacacatttgttcctttcacttcntagcagcagtataacattaaaggttgctttttata

SEQ ID NO: 9770 - DNA, 71 bp, chicken (Gallus Gallus)
  misc_feature (36): n=a or c
tttacttatttgcagaatgttattactttttcttanaatctttaggtcgtataatcataattcatagaatc

SEQ ID NO: 9771 - DNA, 71 bp, chicken (Gallus Gallus)
  misc_feature (36): n=a or g
ttaacgctccgatccttcatgggctgggctttctgncattcaaaacactgtcttctaatgtggagagaagg

SEQ ID NO: 9772 - DNA, 71 bp, chicken (Gallus Gallus)
  misc_feature (36): n=c or t
tcttctctcatgtgcagaaatctaaatgtgaaaaanaatgttctgaaccattgctggtattttttacaggg

SEQ ID NO: 9773 - DNA, 71 bp, chicken (Gallus Gallus)
  misc_feature (36): n=c or t
atctgatcttaatgtactctgatgagcagcacctgnaggagagctgtggcttcagaggaggcagccttggt

SEQ ID NO: 9774 - DNA, 71 bp, chicken (Gallus Gallus)
  misc_feature (36): n=g or t
acacctatacatcacaagttagatcactgcatgagntgtttgagcaccaagcagtccatgacacaggcttc

SEQ ID NO: 9775 - DNA, 71 bp, chicken (Gallus Gallus)
  misc_feature (36): n=c or t
cactgctgaaccactctgtgccagacacatcacacnactgattgattttaaagtcagcaacaactgttggt

SEQ ID NO: 9776 - DNA, 71 bp, chicken (Gallus Gallus)
  misc_feature (36): n=a or c
tgcacatagggtacaaaacaacctcataatggaagngagttggaaaaattccaagtaaggtgtttcattca

SEQ ID NO: 9777 - DNA, 71 bp, chicken (Gallus Gallus)
  misc_feature (36): n=c or g
cttcagctgggatcagcagggctgccttctccagcntttgcttctaacacggagccactgcatcccctcct

SEQ ID NO: 9778 - DNA, 71 bp, chicken (Gallus Gallus)
  misc_feature (36): n=c or g
gagctgcagctgggcacaggattgcccctcctcccngtgctgctctggtcactaataagtaaagcacatgc

SEQ ID NO: 9779 - DNA, 71 bp, chicken (Gallus Gallus)
  misc_feature (36): n=c or t
gagaaaaatatgttgaacttccttcaggatggctgngtggaaggagccctgtggtactcagaagggcagct

SEQ ID NO: 9780 - DNA, 71 bp, chicken (Gallus Gallus)
  misc_feature (36): n=c or t
catgggaattcctcagaccatgtttctctgcttaangttgccagctgtgtctggcttattgcagaaatgat

SEQ ID NO: 9781 - DNA, 71 bp, chicken (Gallus Gallus)
  misc_feature (36): n=c or t
gccctgagcacagtataaatatgtgggtgctgacanacacagatgcctcaatagttctgaatcacattcac

SEQ ID NO: 9782 - DNA, 71 bp, chicken (Gallus Gallus)
  misc_feature (36): n=a or t
tatggtgagaatcccttaattatatccttgcctagnctgtggcaccttcctgaaattactcctctgttcac

SEQ ID NO: 9783 - DNA, 71 bp, chicken (Gallus Gallus)
  misc_feature (36): n=a or g
tcagtaatgttatatcaacttatatggaaggaacantgtcccttcttgcactaaatgcagttatttgcagg

SEQ ID NO: 9784 - DNA, 71 bp, chicken (Gallus Gallus)
  misc_feature (36): n=a or t
gaaacatacattggtattgactactcagatgagganctgtctctctttgggtttcattttcatattcatat

SEQ ID NO: 9785 - DNA, 71 bp, chicken (Gallus Gallus)
  misc_feature (36): n=a or g
ctgccgtgagcaggagagtagaacttgcagagtggnggaactgagtactccatgttgatgaatcaggtagc

SEQ ID NO: 9786 - DNA, 71 bp, chicken (Gallus Gallus)
  misc_feature (36): n=a or c
tggactgctggtgttaacctctctttggtggagagnagtttctcttccacttctatttcattcccttgcac

SEQ ID NO: 9787 - DNA, 71 bp, chicken (Gallus Gallus)
  misc_feature (36): n=a or g
tccctttccttgtattttatcagttcctgcagcacngccacagaatcctttctcataaattagctatggtc

SEQ ID NO: 9788 - DNA, 71 bp, chicken (Gallus Gallus)
  misc_feature (36): n=c or t
gtccttgctccttcaaaaatttcagtaatcagtttnctcagcttcactactatcatttagtaacagataca

SEQ ID NO: 9789 - DNA, 71 bp, chicken (Gallus Gallus)
  misc_feature (36): n=a or t
gaaaagaggctcattttaaaaaccattaaaaaaaanaatctatttactacatcttccaattcataccaagt

SEQ ID NO: 9790 - DNA, 71 bp, chicken (Gallus Gallus)
  misc_feature (36): n=a or g
caaaagtttattgaatttgttacctagtgggtaacncttcctcatcagacctcggctctgaaaaaacagtt

SEQ ID NO: 9791 - DNA, 71 bp, chicken (Gallus Gallus)
  misc_feature (36): n=a or g
tacttggctgtgtatgtctcttgctccccttttggncagattttatagcaaggaaaaattaagtgctgatc

SEQ ID NO: 9792 - DNA, 71 bp, chicken (Gallus Gallus)
  misc_feature (36): n=c or t
gaagtcatactgatcattctcttggcacgtgtgggnttagtgctaatgatttatgatacttaataccatga

SEQ ID NO: 9793 - DNA, 71 bp, chicken (Gallus Gallus)
  misc_feature (36): n=a or g
atgtacagttgggctgggctgctggtttgctggcantggtagtacttgaattggtcagttcaacaagaaaa

SEQ ID NO: 9794 - DNA, 71 bp, chicken (Gallus Gallus)
  misc_feature (36): n=c or t
ttagcttgtgaaagcatgttgaggaggtgaaattcnatcactgcgggtgtaggctaggtaaaaatcttagg

SEQ ID NO: 9795 - DNA, 71 bp, chicken (Gallus Gallus)
  misc_feature (36): n=c or t
gctatcctggacagcaggatgaattttctggtctcntgttgacaggtagtcagcaacccaaactgggcagt

SEQ ID NO: 9796 - DNA, 71 bp, chicken (Gallus Gallus)
  misc_feature (36): n=a or g
ctgatggcttgttaccggaggtccaacttttacaantgaaaaccagtgttggacctcattttgaatgtcca

SEQ ID NO: 9797 - DNA, 71 bp, chicken (Gallus Gallus)
  misc_feature (36): n=a or g
tagcgtgactgtagtagcttattattgttattactnacctgtagtagctgctcccacagttaacacctttc

SEQ ID NO: 9798 - DNA, 71 bp, chicken (Gallus Gallus)
  misc_feature (36): n=c or t
cctcctaggggcagaataagatgctaaaaggattangggtttaattaaccccaggtaatgaggttaattaa

SEQ ID NO: 9799 - DNA, 71 bp, chicken (Gallus Gallus)
  misc_feature (36): n=a or g
cagtgagagatgtgagaggaaaaccaaaaagaccanctgaccctgcggataatatagttgcctaagaatga

SEQ ID NO: 9800 - DNA, 71 bp, chicken (Gallus Gallus)
  misc_feature (36): n=a or g
tcttgactgaaccacaaaggataaaatgaacatcantaggatttgccttccagaaaggaagggttgtgaca

SEQ ID NO: 9801 - DNA, 71 bp, chicken (Gallus Gallus)
  misc_feature (36): n=c or t
ctgctgtgttcacagtcattttggctttctttccanattggtgcgtgtgttgtctgtgtggctgcaagctt

SEQ ID NO: 9802 - DNA, 71 bp, chicken (Gallus Gallus)
  misc_feature (36): n=c or t
gcaagtgatattctaataagtgtaagagatgaatcncttccacatgagcctggcgatgtgggacagtacag

SEQ ID NO: 9803 - DNA, 71 bp, chicken (Gallus Gallus)
  misc_feature (36): n=c or t
tcaattgattgtgttctgcctgaaagcatatgctangcagtgttttttcctcttgtctttctgttttcaga

SEQ ID NO: 9804 - DNA, 71 bp, chicken (Gallus Gallus)
  misc_feature (36): n=a or g
gtttgattatttttctagcacatccttaaaaaaaangaaagaacctgacaaagagagtcagctataattta

SEQ ID NO: 9805 - DNA, 71 bp, chicken (Gallus Gallus)
  misc_feature (36): n=a or g
tccttcaaccagtgatctctaagcacaatacaaaanttagtaatgaataaggaaagagagctgaatcactc

SEQ ID NO: 9806 - DNA, 71 bp, chicken (Gallus Gallus)
  misc_feature (36): n=c or t
tatttctaacttctgttaccagtactcacaaatcantaccagcactttaaacaaaggaattaccttctaaa

SEQ ID NO: 9807 - DNA, 71 bp, chicken (Gallus Gallus)
  misc_feature (36): n=c or t
gcagaaagctttctttctaaaatccattcaacctcngtactggtatcttatgctatgactctttgctttct

SEQ ID NO: 9808 - DNA, 71 bp, chicken (Gallus Gallus)
  misc_feature (36): n=a or c
tacacttgaggctaatggaagctgtttgattgagantgacttgtctcggtgatggtccttcattatgaaag

SEQ ID NO: 9809 - DNA, 71 bp, chicken (Gallus Gallus)
  misc_feature (36): n=a or c
attgctcactatgcatctcaagaatttggcacagcnagtcctctcagtctgaggaaagtttagcagaagat

SEQ ID NO: 9810 - DNA, 71 bp, chicken (Gallus Gallus)
  misc_feature (36): n=c or t
ttattgaaatgtccaattcttgagagaaggtaaacntccagagtagaatgcactggagcctctctcccatc

SEQ ID NO: 9811 - DNA, 71 bp, chicken (Gallus Gallus)
  misc_feature (36): n=c or t
aactttcaatgagcagcttcaaaggcagacttctancacaaaatagcccagagatgtgatgcactgttagt

SEQ ID NO: 9812 - DNA, 71 bp, chicken (Gallus Gallus)
  misc_feature (36): n=a or g
ttctcatttcatgtttcgctactgaaatccttgatngattaaaagagactaacaattgtaatccaaggatg

SEQ ID NO: 9813 - DNA, 71 bp, chicken (Gallus Gallus)
  misc_feature (36): n=c or t
ctcattcacagagagtctcctgggcctcctacttgncttgaccaaatgtgcagcatgtgacaatacatttg

SEQ ID NO: 9814 - DNA, 71 bp, chicken (Gallus Gallus)
  misc_feature (36): n=a or g
gccaggaaattgagtaaagtattcaggaccattttnaagtcctcccagaagaacaccttggtatgccttaa

SEQ ID NO: 9815 - DNA, 71 bp, chicken (Gallus Gallus)
  misc_feature (36): n=a or g
tcaaattactactctacacatttctcacttgactcnccagttctgagagaatgaatataaaaaagccccag

SEQ ID NO: 9816 - DNA, 71 bp, chicken (Gallus Gallus)
  misc_feature (36): n=c or t
tgatttagcatcgtcccaagggccacacatacacanacttgagcagcctgcttgattcgcagatccttaat

SEQ ID NO: 9817 - DNA, 71 bp, chicken (Gallus Gallus)
  misc_feature (36): n=a or g
cactgaccatacagcatacataacatcagcccaatnttaatgaggcagaacaacaagattggcaggctcaa

SEQ ID NO: 9818 - DNA, 71 bp, chicken (Gallus Gallus)
  misc_feature (36): n=c or g
gatgggtttgcccaagacttattcctttttcgactnagtcaaacagcattattttaaggggttttttttca

SEQ ID NO: 9819 - DNA, 71 bp, chicken (Gallus Gallus)
  misc_feature (36): n=c or g
tgacaagatctataaccattggttctatttcttaangtttctgttcttatgtctctatttccatttatttt

SEQ ID NO: 9820 - DNA, 71 bp, chicken (Gallus Gallus)
  misc_feature (36): n=a or g
tttctgtctcccacatctgcatttaaatacttagantaattcttcaccatttttttctttttttttctgaa

SEQ ID NO: 9821 - DNA, 71 bp, chicken (Gallus Gallus)
  misc_feature (36): n=a or t
gaaaacattttagggctaagctcatttcagaatgtnagggcttagatgtatcagtaaaaacaattaggttc

SEQ ID NO: 9822 - DNA, 71 bp, chicken (Gallus Gallus)
  misc_feature (36): n=a or g
cttccctgcacgaggacttagcctgttatcctcacnctgcactttgcaaccctgcctccctcataaccaaa

SEQ ID NO: 9823 - DNA, 71 bp, chicken (Gallus Gallus)
  misc_feature (36): n=c or t
tatagatagcccttatatcctccttcctcactgttnactagaacgaggttagagaacctggactgcagaaa

SEQ ID NO: 9824 - DNA, 71 bp, chicken (Gallus Gallus)
  misc_feature (36): n=a or g
tctgatacagagtctgttggttttccagcgtgggantcccaagaatcaggtaagtccttggcttcaatttt

SEQ ID NO: 9825 - DNA, 71 bp, chicken (Gallus Gallus)
  misc_feature (36): n=a or g
agcagccaaagcaaggaaacggtgattctgagttcntgtcaacttcttctgaagttcatactattaagatc

SEQ ID NO: 9826 - DNA, 71 bp, chicken (Gallus Gallus)
  misc_feature (36): n=c or t
gtgagggtgatggtgcagctctagttcgttttttgntagccttcctttctgctatctgccactcttcgtct

SEQ ID NO: 9827 - DNA, 71 bp, chicken (Gallus Gallus)
  misc_feature (36): n=a or g
acttctcagcaaacaatctaacataacttgagctanaagaaacctcatgatgtacctcttattccatcatt

SEQ ID NO: 9828 - DNA, 71 bp, chicken (Gallus Gallus)
  misc_feature (36): n=a or g
attatgcatgaaattgatgatttcatgtcaattctntgtgtgacattctcacagagcagtggagttagaag

SEQ ID NO: 9829 - DNA, 71 bp, chicken (Gallus Gallus)
  misc_feature (36): n=c or t
acgtccctatataaatcttagaaaagttatctcaangcacacagcacagttgctgctttatttccatttgt

SEQ ID NO: 9830 - DNA, 71 bp, chicken (Gallus Gallus)
  misc_feature (36): n=c or t
aagaacatgtcaatagcagcttccactatttcatcngctctctcatctcagtctaggtatatctataaaga

SEQ ID NO: 9831 - DNA, 71 bp, chicken (Gallus Gallus)
  misc_feature (36): n=c or t
aacgatcagtctgctgcatatttgttaactaatganacaccatgccagagctgcactgccggttatgacac

SEQ ID NO: 9832 - DNA, 71 bp, chicken (Gallus Gallus)
  misc_feature (36): n=g or t
cataagaaaacattagacagaatggctgaaagacanaaaacacttagtgatggtaaaacagcagaaaaaaa

SEQ ID NO: 9833 - DNA, 71 bp, chicken (Gallus Gallus)
  misc_feature (36): n=a or c
aatatttagctatgatttctgtataccatgctgatnatttttgtctcagaaatttctttttgcatctggct

SEQ ID NO: 9834 - DNA, 71 bp, chicken (Gallus Gallus)
  misc_feature (36): n=a or c
ctgcccaggatgaagcaatgtgccatttaggtgagncactgtccgtgaagccctcgtacaaaggctgccgt

SEQ ID NO: 9835 - DNA, 71 bp, chicken (Gallus Gallus)
  misc_feature (36): n=a or g
agttaaactgattgacacttgatgaaaccttggtancttccattgtgactaaagcacgcaattaatgttta

SEQ ID NO: 9836 - DNA, 71 bp, chicken (Gallus Gallus)
  misc_feature (36): n=a or g
aaaaatcacatactgaaatttcttccggaggtaatncattaaattcctttgcttctcttttgcagccttca

SEQ ID NO: 9837 - DNA, 71 bp, chicken (Gallus Gallus)
  misc_feature (36): n=a or g
aaagatgccataaagaaaaaacaaaatgcactcttnctcttttaggtcaccgactaaagaacacctttgca

SEQ ID NO: 9838 - DNA, 71 bp, chicken (Gallus Gallus)
  misc_feature (36): n=c or g
tgccttgggagggatccagcgagctttaaatgcctnttgtgagttctgcctgaaggtcactgggaggggag

SEQ ID NO: 9839 - DNA, 71 bp, chicken (Gallus Gallus)
  misc_feature (36): n=a or g
ctgtatagtgcttgaaacaatgttcttagaggcatngactgcctgagtcatctcacttacagtagagtggg

SEQ ID NO: 9840 - DNA, 71 bp, chicken (Gallus Gallus)
  misc_feature (36): n=a or g
tcaggttcaggaagatcaagttatgctgttctgcanttccttccttcttatttttatgttgaacctgttaa

SEQ ID NO: 9841 - DNA, 71 bp, chicken (Gallus Gallus)
  misc_feature (36): n=a or g
gtaagctttctcaaatgtgactatagttttatcaanaataattggagatgtcaggcagatacattcatatt

SEQ ID NO: 9842 - DNA, 71 bp, chicken (Gallus Gallus)
  misc_feature (36): n=a or g
gtgtaataagttagaaaaccaaagacacttgttccnttcatttttcaagtattttgctactctgtacagtt

SEQ ID NO: 9843 - DNA, 71 bp, chicken (Gallus Gallus)
  misc_feature (36): n=c or g
ccacaggtcaaactccagtcccaccaaagtttcaantaagtagctgaattccttccaaatttaaacgcatg

SEQ ID NO: 9844 - DNA, 71 bp, chicken (Gallus Gallus)
  misc_feature (36): n=c or t
aaacccactggcttcattctgtcttaccaatgccangcaagtggatcacaaagactgtacaaattataatc

SEQ ID NO: 9845 - DNA, 71 bp, chicken (Gallus Gallus)
  misc_feature (36): n=a or g
tttcaacgaaaaatgcatgcaaggctttctctatcntgactagacactcatttctctaacaacaaccctaa

SEQ ID NO: 9846 - DNA, 71 bp, chicken (Gallus Gallus)
  misc_feature (36): n=c or t
catgcaaacaaactaaaataaaaagaactcagaagngctcctgtgggagtcctgtgggtcttcaaagagca

SEQ ID NO: 9847 - DNA, 71 bp, chicken (Gallus Gallus)
  misc_feature (36): n=a or t
ctactttgtcactgcagatacatattttgcctttcngaaagtaaagaaggtaaccgtttcaatcgtatcct

SEQ ID NO: 9848 - DNA, 71 bp, chicken (Gallus Gallus)
  misc_feature (36): n=c or t
ataaacctgttggtagcagttttgcttaaaccatgntggggagggcaacctcatgaggctctttcagaaaa

SEQ ID NO: 9849 - DNA, 71 bp, chicken (Gallus Gallus)
  misc_feature (36): n=c or g
actcctcgcaatcagcaacagctgctgagtagacantgaatcctcaagtcttttcaatggatagcatctaa

SEQ ID NO: 9850 - DNA, 71 bp, chicken (Gallus Gallus)
  misc_feature (36): n=a or c
ggtccccactgtagagtgacctttctcactcccacnataattttttaatataaggatgtttacccttggaa

SEQ ID NO: 9851 - DNA, 71 bp, chicken (Gallus Gallus)
  misc_feature (36): n=c or g
gctgttacgaacatccaagcctgcacacctgtatanctctggaaataagcagtagagctattctgtacaga

SEQ ID NO: 9852 - DNA, 71 bp, chicken (Gallus Gallus)
  misc_feature (36): n=a or t
tgaaaacagtctcatttaaactcatttattttcttnatggtctcacttgaaatgagatggcacagagaagg

SEQ ID NO: 9853 - DNA, 71 bp, chicken (Gallus Gallus)
  misc_feature (36): n=c or t
tcctaccctgatagtcttaaagccaggagaaaactnttctgtttttaagaactgttgagcagacagctact

SEQ ID NO: 9854 - DNA, 71 bp, chicken (Gallus Gallus)
  misc_feature (36): n=c or t
agggcattagtgtagaagtgtctatttctgagcganactgaaattttctttcagcaattctgtttcataaa

SEQ ID NO: 9855 - DNA, 71 bp, chicken (Gallus Gallus)
  misc_feature (36): n=a or g
attccaaagtgtgcatgtagtgtataggtgcatgcntatcgatgaggataactaaatgcacctattccaca

SEQ ID NO: 9856 - DNA, 71 bp, chicken (Gallus Gallus)
  misc_feature (36): n=c or t
acatacaggtccccaggtactcattacaacaaaggnaggatctctgctgggagcatttaacagcaattttt

SEQ ID NO: 9857 - DNA, 71 bp, chicken (Gallus Gallus)
  misc_feature (36): n=c or t
tttgtcaaacaagaagtttgacattatccatctacntctctttttgttcaaattctttgactctagaatta

SEQ ID NO: 9858 - DNA, 71 bp, chicken (Gallus Gallus)
  misc_feature (36): n=a or t
cgctgggatctaggactggtcagtgctgagtgcccncaatttccacttgtaatgatgaaggcattggagaa

SEQ ID NO: 9859 - DNA, 71 bp, chicken (Gallus Gallus)
  misc_feature (36): n=c or t
attaggaagcatttttaattgccaagttagaatcanagaatggtttgggttggaagggacctttaagatca

SEQ ID NO: 9860 - DNA, 71 bp, chicken (Gallus Gallus)
  misc_feature (36): n=c or t
atataccacatggatttttcaaaaagaatctgggtngaatcaagccagttatctttcttgacaatttagct

SEQ ID NO: 9861 - DNA, 71 bp, chicken (Gallus Gallus)
  misc_feature (36): n=a or g
aacttgtggtttagttaacactttgcaattagactntgacaggagtatctcaccccttgtgcaaattcctc

SEQ ID NO: 9862 - DNA, 71 bp, chicken (Gallus Gallus)
  misc_feature (36): n=a or g
aactgcctctatttcattgcagtcaaagggagctangtgacagctgaatgtagaagtgtggtttttaagtt

SEQ ID NO: 9863 - DNA, 71 bp, chicken (Gallus Gallus)
  misc_feature (36): n=c or t
aatttttgagactgcagatgaaatcgactcatatcntctctcaaaggtcccagatggataggttcccattc

SEQ ID NO: 9864 - DNA, 71 bp, chicken (Gallus Gallus)
  misc_feature (36): n=a or g
cctaaaagttcagcaagaactgctgaacgccagtgngtgccctttttttccagcaccaagtaattcagtga

SEQ ID NO: 9865 - DNA, 71 bp, chicken (Gallus Gallus)
  misc_feature (36): n=c or t
atgcacttcatgaactctgctgcttattttatcaangcttattaactttaggtacaaaatccctatatatt

SEQ ID NO: 9866 - DNA, 71 bp, chicken (Gallus Gallus)
  misc_feature (36): n=a or g
cccaggttctatacagctccatacacctcagtgagncagctaaggctcagatccacaagagatcttccctc

SEQ ID NO: 9867 - DNA, 71 bp, chicken (Gallus Gallus)
  misc_feature (36): n=c or g
tactgtgacatcaataaaatgccttcctttttgctnccatttgctgacattcaatagcgagttactttctg

SEQ ID NO: 9868 - DNA, 71 bp, chicken (Gallus Gallus)
  misc_feature (36): n=c or t
agagaaaggtcagtgctgatgaggaccgagatacangggcagcacaacacagcgacagatctacacttagc

SEQ ID NO: 9869 - DNA, 71 bp, chicken (Gallus Gallus)
  misc_feature (36): n=c or t
aatgaagagattctgcataacctttctgaagctaanggtggacagacatgcaagtctcatagcctcatatt

SEQ ID NO: 9870 - DNA, 71 bp, chicken (Gallus Gallus)
  misc_feature (36): n=c or t
aaataaacccaaagaactaacaaacactttgaacanctgcaatttaagtaccccagaaataccagaaaaac

SEQ ID NO: 9871 - DNA, 71 bp, chicken (Gallus Gallus)
  misc_feature (36): n=a or c
cttatctcctttggtaggtctgccaaaaagatacangaaaaaaaactggaggtgactttatatgaagactg

SEQ ID NO: 9872 - DNA, 71 bp, chicken (Gallus Gallus)
  misc_feature (36): n=a or g
tatcactcaaagcaagtttcctctggtagccgttcncagttctctccctcgggtgcaattctctatgtgaa

SEQ ID NO: 9873 - DNA, 71 bp, chicken (Gallus Gallus)
  misc_feature (36): n=a or g
tttgagatatcttcattagaatacaaacctagccantgtctgaggctctactttgctgaaacatttaaacc

SEQ ID NO: 9874 - DNA, 71 bp, chicken (Gallus Gallus)
  misc_feature (36): n=c or t
aacactgataactaaaaccaaaaaaactgatatacngccaatatactcgttcatgggaaatccatttccag

SEQ ID NO: 9875 - DNA, 71 bp, chicken (Gallus Gallus)
  misc_feature (36): n=c or t
gcctttcacttctggtttcagtacatatttcgatgncatgtaacccactattttctaaaataatggaatta

SEQ ID NO: 9876 - DNA, 71 bp, chicken (Gallus Gallus)
  misc_feature (36): n=g or t
cagaaatggaattcagctaaccacatatttgtgganctaactgcgcagtagcatttctacacagtgaataa

SEQ ID NO: 9877 - DNA, 71 bp, chicken (Gallus Gallus)
  misc_feature (36): n=a or g
acaaagagaagtgggagctagaaggcaggaaagaanaagtatcagaagaatacataaaggtaatcaatatt

SEQ ID NO: 9878 - DNA, 71 bp, chicken (Gallus Gallus)
  misc_feature (36): n=c or t
aacagcaaggttctatagaattacttgaattgcttncccattaaatgtaaatgcccttttcctttccttat

SEQ ID NO: 9879 - DNA, 71 bp, chicken (Gallus Gallus)
  misc_feature (36): n=c or t
ttaaaccaataaaatcctaaagaattgacttacagnatactgtactgctaataatacttataatttaagga

SEQ ID NO: 9880 - DNA, 71 bp, chicken (Gallus Gallus)
  misc_feature (36): n=a or g
tctcaaaagaataataatttgtaatatacatcatgnacagcaaagaatcaagaaatagagtatggccagaa

SEQ ID NO: 9881 - DNA, 71 bp, chicken (Gallus Gallus)
  misc_feature (36): n=a or g
ctgctcctcccacatcccaaagataagctgacaacngtaacaacgttcagtaccatatccaggtaccgggc

SEQ ID NO: 9882 - DNA, 71 bp, chicken (Gallus Gallus)
  misc_feature (36): n=a or g
cttccatgaccttttcggctaagaactgggttaganaaacaaaacaccaccactgtgaaaagcatctgggt

SEQ ID NO: 9883 - DNA, 71 bp, chicken (Gallus Gallus)
  misc_feature (36): n=a or g
ccacgatggcatgggctgcactgagagctgggtccngccacaggtcagacacacctggactagattatctt

SEQ ID NO: 9884 - DNA, 71 bp, chicken (Gallus Gallus)
  misc_feature (36): n=c or t
ccaacacctctgaataactcttactctgaccattgntattagaatgctaaggcattcaaagccatctaaaa

SEQ ID NO: 9885 - DNA, 71 bp, chicken (Gallus Gallus)
  misc_feature (36): n=c or t
ttcccaacttctactttgtcatttgtgtggggacantttaaagtcaatatggctaaataggctgttcttaa

SEQ ID NO: 9886 - DNA, 71 bp, chicken (Gallus Gallus)
  misc_feature (36): n=c or t
gtcaagatagagaaaatgaacttttactttcaactngcacaagctgtttcaacaacgtactgttctttcat

SEQ ID NO: 9887 - DNA, 71 bp, chicken (Gallus Gallus)
  misc_feature (36): n=c or t
catgcttttccctcaacagaatagaactatttcacngtgccaatactttatcttgaataagagtacgtagc

SEQ ID NO: 9888 - DNA, 71 bp, chicken (Gallus Gallus)
  misc_feature (36): n=a or g
aaacccctccatacacacacacacacatttccttgncaagatgtgtaatgaaagcttgagacccaacacca

SEQ ID NO: 9889 - DNA, 71 bp, chicken (Gallus Gallus)
  misc_feature (36): n=c or t
gctttagcgcatttgggccaaactagagagaaaggngagaggagcccgggtgcacacccaggaactctgac

SEQ ID NO: 9890 - DNA, 71 bp, chicken (Gallus Gallus)
  misc_feature (36): n=c or t
atcataacatttatcctgtattattcaccaaacttntaaccaaatgtgacatcaaggattttacagccctt

SEQ ID NO: 9891 - DNA, 71 bp, chicken (Gallus Gallus)
  misc_feature (36): n=c or t
tgtattttttcatcttgtttggaccaaatacatcantattttatttaattgtattgtaataggccacacaa

SEQ ID NO: 9892 - DNA, 71 bp, chicken (Gallus Gallus)
  misc_feature (36): n=a or g
ttttctgtaggtgtgatctgtttcagttcccagagngaaatatgtgagctgcaaaaatatcttgtcagcct

SEQ ID NO: 9893 - DNA, 71 bp, chicken (Gallus Gallus)
  misc_feature (36): n=a or g
gataattcccatttattttcacctaatgagccattnctactcacatgcaattaataagccacttcctgttt

SEQ ID NO: 9894 - DNA, 71 bp, chicken (Gallus Gallus)
  misc_feature (36): n=c or g
cgctatccattcttcctattaaagacttgcacgggngttcacatttaagtatttgtgcctatactgtgacc

SEQ ID NO: 9895 - DNA, 71 bp, chicken (Gallus Gallus)
  misc_feature (36): n=a or t
ttgaaacccctggttacacttcttataccttaaccntctgggatagatatagcatactgatgtccaccttc

SEQ ID NO: 9896 - DNA, 71 bp, chicken (Gallus Gallus)
  misc_feature (36): n=c or t
aatatgttagacaagagtacacttgaaaaaaaaatnatagtcattccttaagatagtaactcaatcagcac

SEQ ID NO: 9897 - DNA, 71 bp, chicken (Gallus Gallus)
  misc_feature (36): n=c or t
tcagcatggctgtgccacagctgccattccattgcnacaggaataccccccagctactatctggatgagca

SEQ ID NO: 9898 - DNA, 71 bp, chicken (Gallus Gallus)
  misc_feature (36): n=c or t
acaagaaaatgcatgagcagatgcaaaagcgagacngaaacatataaaaatcatttttccaagctttcttc

SEQ ID NO: 9899 - DNA, 71 bp, chicken (Gallus Gallus)
  misc_feature (36): n=a or g
aagtctgaaactctaacctcgaatgtcaacagcacntaagaaattagttacaagtcctatatataattgga

SEQ ID NO: 9900 - DNA, 71 bp, chicken (Gallus Gallus)
  misc_feature (36): n=c or t
gctttctggtgcatgtggaagggtgcagggtgaagntgttgtgtctcgaggatgtgacagtgctgtgtgct

SEQ ID NO: 9901 - DNA, 71 bp, chicken (Gallus Gallus)
  misc_feature (36): n=a or g
cagaccagctcctcagcttgtcttttccttacagancacattacgtattttgagtttcctcatatcacagt

SEQ ID NO: 9902 - DNA, 71 bp, chicken (Gallus Gallus)
  misc_feature (36): n=a or g
atcaacacacaacaaactacagacaactgcgggacncaaatatttttcaaagaaagcccttctgtctgcaa

SEQ ID NO: 9903 - DNA, 71 bp, chicken (Gallus Gallus)
  misc_feature (36): n=c or t
tggatgacaaacgcccaggctccagttccgtcctcncaaacaaagcatggccaaatcgccctcctctggag

SEQ ID NO: 9904 - DNA, 71 bp, chicken (Gallus Gallus)
  misc_feature (36): n=c or t
caccgctaacccaggttttgtttttccaacagatangtatctgaaactggaagacgtgacccgtaaattta

SEQ ID NO: 9905 - DNA, 71 bp, chicken (Gallus Gallus)
  misc_feature (36): n=a or c
actctgactgttgcgacagcgttcttctggagctgngagagtatctgccaaaatacttcggtgtctggtca

SEQ ID NO: 9906 - DNA, 71 bp, chicken (Gallus Gallus)
  misc_feature (36): n=c or t
cggaatgaaggcagaagttgtcataactaaatgatntcttcagacttgactaaggagtttgagccatctgt

SEQ ID NO: 9907 - DNA, 71 bp, chicken (Gallus Gallus)
  misc_feature (36): n=c or t
gcaggtttaccacgtctcttccgacagctacgagangcaaaaccagcactatgggaggagcttgaccaagg

SEQ ID NO: 9908 - DNA, 71 bp, chicken (Gallus Gallus)
  misc_feature (36): n=c or t
gattggaatagcatgcttggtgagcttgggggacanttgggacagacagctttgaaaaatattctttgtca

SEQ ID NO: 9909 - DNA, 71 bp, chicken (Gallus Gallus)
  misc_feature (36): n=c or t
ccttgtctggtttatcagcttcctacttcaatagcngagcatggtgtacacacagtgcaatttttctctgt

SEQ ID NO: 9910 - DNA, 71 bp, chicken (Gallus Gallus)
  misc_feature (36): n=a or g
aggtctctgtatggagaccacatggtatagtcttgncttcagcatcctacccaaatggctgtaaatagtaa

SEQ ID NO: 9911 - DNA, 71 bp, chicken (Gallus Gallus)
  misc_feature (36): n=c or t
acctggcaaggacatttgtacttgtagtgccagtantgtcacaaggttgtgcccatacctaatttttttgc

SEQ ID NO: 9912 - DNA, 71 bp, chicken (Gallus Gallus)
  misc_feature (36): n=a or g
tgtgaaacagtaatgagatctctaagtataatttgnggttgttgcattgctcaccaatagtgacctcaagg

SEQ ID NO: 9913 - DNA, 71 bp, chicken (Gallus Gallus)
  misc_feature (36): n=c or t
tcaagttcaggctggaggaagtgtgaagtacagacngcaggcacaaacacaatttcctaagctctgttcag

SEQ ID NO: 9914 - DNA, 71 bp, chicken (Gallus Gallus)
  misc_feature (36): n=a or g
tagatactgctctgttaccgtgagaagttttagtcnctgttagtgattcatagggtcaaaattgttcttag

SEQ ID NO: 9915 - DNA, 71 bp, chicken (Gallus Gallus)
  misc_feature (36): n=a or t
ctaatgaatttagtatgtgaggctttttggtcccgntgtatgttttaatgcatttgccctacaagttcttg

SEQ ID NO: 9916 - DNA, 71 bp, chicken (Gallus Gallus)
  misc_feature (36): n=a or g
tttctgaggacatagcagctgcaggggaatgagatntgtttgcagagcgcatgcataaaaagatatttgtg

SEQ ID NO: 9917 - DNA, 71 bp, chicken (Gallus Gallus)
  misc_feature (36): n=c or t
acaatgaaagaattctttgtgaggcacataaacgangtaggtggatggtgtcttaatgtaatgaaaacaca

SEQ ID NO: 9918 - DNA, 71 bp, chicken (Gallus Gallus)
  misc_feature (36): n=c or t
gcttattgtcttgtaacccgttttcaaggaccttcntgttttctctgaggtcattacctgtcagtaccagt

SEQ ID NO: 9919 - DNA, 71 bp, chicken (Gallus Gallus)
  misc_feature (36): n=a or g
ttaataaataagatgaaaggtcatttgtggaataantgcctgtaagaaaaaaacaacttttgttattctgc

SEQ ID NO: 9920 - DNA, 71 bp, chicken (Gallus Gallus)
  misc_feature (36): n=a or t
attgctaataacttctaaaagcaatttttttttccnactaacttctacttcctactgcaggaaaagctaag

SEQ ID NO: 9921 - DNA, 71 bp, chicken (Gallus Gallus)
  misc_feature (36): n=a or c
agatgggtgtgagccagaagttttctgaagaagtgntgatgattagcagtacccctgaaaacttaagatgc

SEQ ID NO: 9922 - DNA, 71 bp, chicken (Gallus Gallus)
  misc_feature (36): n=c or t
tggaatttagcatttaattccatgtatttgcaaccncaaactgtcctttggccttgcagcaactgagtttc

SEQ ID NO: 9923 - DNA, 71 bp, chicken (Gallus Gallus)
  misc_feature (36): n=g or t
atttggaataagtcacaccaaagaaggcctctgcanccagtttaaaagttctgattggtatttctcacttc

SEQ ID NO: 9924 - DNA, 71 bp, chicken (Gallus Gallus)
  misc_feature (36): n=c or g
atgctgttcctttaataccaatcgtttccttgtcantgcagcagcacgatgccatgcatattcataacaac

SEQ ID NO: 9925 - DNA, 71 bp, chicken (Gallus Gallus)
  misc_feature (36): n=a or g
ttttaagacattaagaatactataagctgcaaagcncagtaaatcaataatgtttattaatcttgaattct

SEQ ID NO: 9926 - DNA, 71 bp, chicken (Gallus Gallus)
  misc_feature (36): n=c or t
atgttgagtattgtgtgcaggaaagctaactatcanaggaagtctgggctctgaactgtctgttatcactc

SEQ ID NO: 9927 - DNA, 71 bp, chicken (Gallus Gallus)
  misc_feature (36): n=c or t
tgaaaaggacctcaaagatcatctagtttcaactcncctgccatctgtaatgatataccaaccaattaaca

SEQ ID NO: 9928 - DNA, 71 bp, chicken (Gallus Gallus)
  misc_feature (36): n=a or g
aaaaaaagagaaatttaaaaataaaatcagactgcntatttgaagcgtgaaaggaaatgttctcaggatcc

SEQ ID NO: 9929 - DNA, 71 bp, chicken (Gallus Gallus)
  misc_feature (36): n=g or t
actgagacagctattcttggtgagatgaaagtgccnggtatcccagccagctgcaccagaactggatgagt

SEQ ID NO: 9930 - DNA, 71 bp, chicken (Gallus Gallus)
  misc_feature (36): n=a or g
ctgccattatatttaagtattcttttcctaacttcngtgttcatttttgcttttactcagatcagctttga

SEQ ID NO: 9931 - DNA, 71 bp, chicken (Gallus Gallus)
  misc_feature (36): n=c or t
cttgctccaagctgaagtgctaacaagctgatgagngaaacacactgcacttccagcgctcctggccccca

SEQ ID NO: 9932 - DNA, 71 bp, chicken (Gallus Gallus)
  misc_feature (36): n=c or t
tcagataaaggatacaatgtgccgcctgaggggttnggatacgggggcgggggatgagacatcgaatatcc

SEQ ID NO: 9933 - DNA, 71 bp, chicken (Gallus Gallus)
  misc_feature (36): n=a or g
tggtgcattgagaagaagttatgtctttgatcgganctcttttccagtatgacaattgcaggttagaattc

SEQ ID NO: 9934 - DNA, 71 bp, chicken (Gallus Gallus)
  misc_feature (36): n=a or t
tgaatacaactgactttcccatgaaggaaaagcagncttcactttgtcttgtattgagcactgatatctga

SEQ ID NO: 9935 - DNA, 71 bp, chicken (Gallus Gallus)
  misc_feature (36): n=c or t
ggtaacagaactgagtggcatcaagtcaacagtttngataggttcatattttgttctccaatatctagctg

SEQ ID NO: 9936 - DNA, 71 bp, chicken (Gallus Gallus)
  misc_feature (36): n=c or t
ctgtgtccagtgcatgcataaaaatcaatggaaaanggaaaaaattgaattatctgagactaccttctgtt

SEQ ID NO: 9937 - DNA, 71 bp, chicken (Gallus Gallus)
  misc_feature (36): n=c or t
tgatgatgcagaggatggctgatctttctgaggcanagagcaggtgtgggtatcctgtgtgttctgctgct

SEQ ID NO: 9938 - DNA, 71 bp, chicken (Gallus Gallus)
  misc_feature (36): n=a or c
ctgcaaggagttgcctttgcctcaactaaactggtnaaaatcttaaaatcagaagtcttttcagttgttcc

SEQ ID NO: 9939 - DNA, 71 bp, chicken (Gallus Gallus)
  misc_feature (36): n=a or t
agctgataaagtatcccggccttcctcttccattanaagaagattgaggccaggctcagatcaggcatcag

SEQ ID NO: 9940 - DNA, 71 bp, chicken (Gallus Gallus)
  misc_feature (36): n=g or t
catgtactgaaaacagtttttttttttaaaaaaagnatattgggatccagttgtgtgaatccgagttaagt

SEQ ID NO: 9941 - DNA, 71 bp, chicken (Gallus Gallus)
  misc_feature (36): n=c or g
tgagtattttaacacatcccaatctcaacttgagtnattctctcctgttaatcaagtccttactccaatga

SEQ ID NO: 9942 - DNA, 71 bp, chicken (Gallus Gallus)
  misc_feature (36): n=c or t
acagtcctggcctagcccttcagtctgctttcattnttgatactgtgcttcccattgtcagagggtctatc

SEQ ID NO: 9943 - DNA, 71 bp, chicken (Gallus Gallus)
  misc_feature (36): n=a or g
gaaatagcattcaaatgggtatggatctcatgcaancatcaggagatggcccataatagtaaaaacttatt

SEQ ID NO: 9944 - DNA, 71 bp, chicken (Gallus Gallus)
  misc_feature (36): n=a or g
gcgtgtgcaaaacaccattctaaagacagcttatgntttctttaatcctctgtactcacctaatgtttagg

SEQ ID NO: 9945 - DNA, 71 bp, chicken (Gallus Gallus)
  misc_feature (36): n=a or g
tacatacttgtttggagtgtgattacatcaaatacngagctggctgttaggaacaaagcagcaagatttct

SEQ ID NO: 9946 - DNA, 71 bp, chicken (Gallus Gallus)
  misc_feature (36): n=a or g
catttgtaaaggaaggtgagggttattttaactccntcataagtcctactttcacatgcctttccatgaag

SEQ ID NO: 9947 - DNA, 71 bp, chicken (Gallus Gallus)
  misc_feature (36): n=g or t
ttttattccatatttttgcaaaaacacagcttgccnaatctgtccctgtgagatgcaactgttggtcatta

SEQ ID NO: 9948 - DNA, 71 bp, chicken (Gallus Gallus)
  misc_feature (36): n=a or g
ttctgcaagtgtttcgtacgttgggtgacggtgatntatcttaagttaacctcatttaaacatgtatgttg

SEQ ID NO: 9949 - DNA, 71 bp, chicken (Gallus Gallus)
  misc_feature (36): n=c or t
caaaatctgtaccaatggaggtgacctgctgtttcnactgctgaaacgtaccactcactgacatccactgt

SEQ ID NO: 9950 - DNA, 71 bp, chicken (Gallus Gallus)
  misc_feature (36): n=a or c
ggtttctgtacccagagatacttttgtgtccacttnaaaggaactcattctgcattttttctttgtggtct

SEQ ID NO: 9951 - DNA, 71 bp, chicken (Gallus Gallus)
  misc_feature (36): n=a or t
atttttaaagttgagtttgacttccttatcagtttntaatctcttcagatttctcttagaatgttactgaa

SEQ ID NO: 9952 - DNA, 71 bp, chicken (Gallus Gallus)
  misc_feature (36): n=a or g
tgttgatcctgctactactctccagtctggtgttgntatatacatagaattcacagaatatctgtgggatg

SEQ ID NO: 9953 - DNA, 71 bp, chicken (Gallus Gallus)
  misc_feature (36): n=a or g
tttttttttaagtattgacttcttaaagaaatctcntatttatgttgaagaaaaatgtatagaggcaaagc

SEQ ID NO: 9954 - DNA, 71 bp, chicken (Gallus Gallus)
  misc_feature (36): n=a or t
ggatgacaacctctcagtgtaggtataaggtgagcncagataaaaggagctacagataatgcaaatgagct

SEQ ID NO: 9955 - DNA, 71 bp, chicken (Gallus Gallus)
  misc_feature (36): n=a or g
ctcccttctagcaggtcagcccctaaattgtactgntgtgtgtggttatgcttctccaggtgatagggata

SEQ ID NO: 9956 - DNA, 71 bp, chicken (Gallus Gallus)
  misc_feature (36): n=c or t
cacagaaccacggagcagtatgccctgaatgacttnactgatctcatgtattattttgcaaatccctgccc

SEQ ID NO: 9957 - DNA, 71 bp, chicken (Gallus Gallus)
  misc_feature (36): n=c or g
acttccatgagaaagacaggcagttttaattagttntgtgaatgtggatttggtatattaaagtagaagga

SEQ ID NO: 9958 - DNA, 71 bp, chicken (Gallus Gallus)
  misc_feature (36): n=c or g
gctcaggttcctaaactcagatggggtgaaattaantctgaatcttcatctagttcagacgtagtacaaaa

SEQ ID NO: 9959 - DNA, 71 bp, chicken (Gallus Gallus)
  misc_feature (36): n=a or t
cagtttctgttgtgtgagaagagaatcctcaacaanttctcagattgtaatataaataaaaataccaacta

SEQ ID NO: 9960 - DNA, 71 bp, chicken (Gallus Gallus)
  misc_feature (36): n=a or g
atttcactccatatcacaaacagatgcagaaggaanttgctcaaagtaatcacaaatgctgtgtcaaacca

SEQ ID NO: 9961 - DNA, 71 bp, chicken (Gallus Gallus)
  misc_feature (36): n=a or g
aatttacatcagtgaaattctacacttaagtgcacngtacacaaaacaacaaatagcaatttgctttgcta

SEQ ID NO: 9962 - DNA, 71 bp, chicken (Gallus Gallus)
  misc_feature (36): n=c or t
attactaaaacatttttgcaggtagccagcatgtgntgttaccgtattacttcacaacacagaagccaggt

SEQ ID NO: 9963 - DNA, 71 bp, chicken (Gallus Gallus)
  misc_feature (36): n=c or t
gccatcctacatgttggatataatacggagccttgntttttttttttttttttttttttaatttatcaaca

SEQ ID NO: 9964 - DNA, 71 bp, chicken (Gallus Gallus)
  misc_feature (36): n=c or t
agattgctgcagccagtggaaacataattagtacantccaagaaccatatatttcagtgatatagtagttt

SEQ ID NO: 9965 - DNA, 71 bp, chicken (Gallus Gallus)
  misc_feature (36): n=a or g
attgtaaggactgagctctcccacagcactactgcngttatctgtgccagcagatattttaatgccctttg

SEQ ID NO: 9966 - DNA, 71 bp, chicken (Gallus Gallus)
  misc_feature (36): n=c or t
gagacaaaagcataaaaaatgcctcttgcaagttanaaccaacataaggaatgcagcagctcctcaagtct

SEQ ID NO: 9967 - DNA, 71 bp, chicken (Gallus Gallus)
  misc_feature (36): n=c or t
aatctatgagacaaggtttgccctttcctcagccanccatgctgtcagttaatgctgctagagttatgtca

SEQ ID NO: 9968 - DNA, 71 bp, chicken (Gallus Gallus)
  misc_feature (36): n=c or t
ggaagattaggttttataaaaacactcttcctggcngcgttccctgtgtacgtacaagtagctttagttta

SEQ ID NO: 9969 - DNA, 71 bp, chicken (Gallus Gallus)
  misc_feature (36): n=c or t
agtgtaaccacataaccacactccagagttatacanaagtgcatttcaatagggtagtccacaagacagat

SEQ ID NO: 9970 - DNA, 71 bp, chicken (Gallus Gallus)
  misc_feature (36): n=c or g
ctctgctgatttctcttactggcagctttggagatntgtacgattgggcacacccccctgtgtcctttgtt

SEQ ID NO: 9971 - DNA, 71 bp, chicken (Gallus Gallus)
  misc_feature (36): n=g or t
taaatctggccttagagcacagctctgtgtttccantgtaagggccggtgcctgtgaatggcataatgcag

SEQ ID NO: 9972 - DNA, 71 bp, chicken (Gallus Gallus)
  misc_feature (36): n=a or g
ttcagcactggagatatttcctggtagccctacacntgctctttcaacagtgtgtagccaagcatgattca

SEQ ID NO: 9973 - DNA, 71 bp, chicken (Gallus Gallus)
  misc_feature (36): n=a or g
acccatcacagctcatgtgggcatcccaggcagccntgcacaaatgcaaataaattcttgtcttaaccatg

SEQ ID NO: 9974 - DNA, 71 bp, chicken (Gallus Gallus)
  misc_feature (36): n=a or g
tctgctgacggatgaacgcagaacttcaggcgtacnctgtgtaataacaccattagtataaatttgttttt

SEQ ID NO: 9975 - DNA, 71 bp, chicken (Gallus Gallus)
  misc_feature (36): n=c or t
tcttttgtctcgaggctgatgactgaaattctggangtctaggaagtaagtgatttcccagtcagcattct

SEQ ID NO: 9976 - DNA, 71 bp, chicken (Gallus Gallus)
  misc_feature (36): n=g or t
gcagctgctgcgaagtcagtagtgggatttcccgcntaagtccttcatgcgatgattcttttccctttact

SEQ ID NO: 9977 - DNA, 71 bp, chicken (Gallus Gallus)
  misc_feature (36): n=c or t
tttggtacctactagtccatgtatttctacacaganccctatacatctctttctttcttctgaggtagtgc

SEQ ID NO: 9978 - DNA, 71 bp, chicken (Gallus Gallus)
  misc_feature (36): n=a or g
gattttggggaattccaggtgatggggaaatatacntggtcccatcttcatctttctgcacacttctttca

SEQ ID NO: 9979 - DNA, 71 bp, chicken (Gallus Gallus)
  misc_feature (36): n=a or c
ctcagatacaggtacataagcactctttttctggcnttgccctgcctgtgacactcagcacatcgtgtgcc

SEQ ID NO: 9980 - DNA, 71 bp, chicken (Gallus Gallus)
  misc_feature (36): n=c or t
gagaagggtcataggtaagttaactctaagttctgnggtgtctgccttctcctcagggtaaagaagtcctc

SEQ ID NO: 9981 - DNA, 71 bp, chicken (Gallus Gallus)
  misc_feature (36): n=a or g
tagaaatgggtatttggcccttgaggttgtgccatngacactgtcagattgctcttattatattccaaaat

SEQ ID NO: 9982 - DNA, 71 bp, chicken (Gallus Gallus)
  misc_feature (36): n=a or g
tgaaatgttaactgagcaggacacagtagctgggcnggaaaaaagagaagagggaagagcttatggctatg

SEQ ID NO: 9983 - DNA, 71 bp, chicken (Gallus Gallus)
  misc_feature (36): n=c or t
gagtttcatctgtcaacatcttcctgaagaccaagnactatgtttccatcttgccttgcaccaccagatcc

SEQ ID NO: 9984 - DNA, 71 bp, chicken (Gallus Gallus)
  misc_feature (36): n=c or g
gtttgatactgattttattagcaagcaagcatgagncacatactagctcacagagaaagcctatcgattaa

SEQ ID NO: 9985 - DNA, 71 bp, chicken (Gallus Gallus)
  misc_feature (36): n=g or t
ggaggggtgggcataaaaggaaaaaggaaagttganagcacttattagtttctaagtgtgagtgcaatgaa

SEQ ID NO: 9986 - DNA, 71 bp, chicken (Gallus Gallus)
  misc_feature (36): n=c or t
tgaatattcaacattgcaatctctcccagggaatgnaagcccatctccctctcacagcagtgagaactgag

SEQ ID NO: 9987 - DNA, 71 bp, chicken (Gallus Gallus)
  misc_feature (36): n=c or t
gatcacttaaggtagcatgctggcaaatttcagctntaaatcagaagccgatctgccttcatattaaaaaa

SEQ ID NO: 9988 - DNA, 71 bp, chicken (Gallus Gallus)
  misc_feature (36): n=g or t
acagggaaaataaaggtcaactgaaatccctgaaanggcactgcttcagatcagggacggccaagaattgg

SEQ ID NO: 9989 - DNA, 71 bp, chicken (Gallus Gallus)
  misc_feature (36): n=c or t
aatattagaatctgcatattcttaaaatacaagtgngcaaatatcccaggaatctggaaatcactgtcaag

SEQ ID NO: 9990 - DNA, 71 bp, chicken (Gallus Gallus)
  misc_feature (36): n=g or t
aacggttatttgctttcaggacttattcaaaatctnaaaacatcaccaacttactaacaccttttctttct

SEQ ID NO: 9991 - DNA, 71 bp, chicken (Gallus Gallus)
  misc_feature (36): n=c or t
ttgaagaggaaaacaaatcattttaaaaatacttgnagttaaaaaccactttattaaaatgattggaaagc

SEQ ID NO: 9992 - DNA, 71 bp, chicken (Gallus Gallus)
  misc_feature (36): n=c or t
ttagaatgaataaccagaggacaaatatttcttaanattatgagctattctagagtcagctggtatctgca

SEQ ID NO: 9993 - DNA, 71 bp, chicken (Gallus Gallus)
  misc_feature (36): n=a or g
tttggctaccaaaaactgcaagttactttcccccancccaaagcacacaggtaattaagttgctacagtat

SEQ ID NO: 9994 - DNA, 71 bp, chicken (Gallus Gallus)
  misc_feature (36): n=c or t
atttatgtgtgatctgcgggaccgtaactcccaacnacctctgctttggaaaacagtgcctttttttccca

SEQ ID NO: 9995 - DNA, 71 bp, chicken (Gallus Gallus)
  misc_feature (36): n=a or g
agctttgtgcatattgtatacacacagaggtacacntgcattcatcttttcctctgtggttaaacgttcct

SEQ ID NO: 9996 - DNA, 71 bp, chicken (Gallus Gallus)
  misc_feature (36): n=g or t
ctgtagaggaatataaaaggagagcaaatttcagtnaacaacaaagctacttagttactaatgtctgcatt

SEQ ID NO: 9997 - DNA, 71 bp, chicken (Gallus Gallus)
  misc_feature (36): n=g or t
gatcttggatggtatgtgcaaaatatctggaaattntctcgaaattcagctttatagagagtatttaaaaa

SEQ ID NO: 9998 - DNA, 71 bp, chicken (Gallus Gallus)
  misc_feature (36): n=c or g
ggtcaaaattggctgactggtatgaattttcagtgnctgttctgagacaagtcctgatgcagatgacatga

SEQ ID NO: 9999 - DNA, 71 bp, chicken (Gallus Gallus)
  misc_feature (36): n=a or c
tattatcatgatggaacaattattgagcctacatgntggaagccagtgcaaacttgctgattctggttagt

SEQ ID NO: 10000 - DNA, 71 bp, chicken (Gallus Gallus)
  misc_feature (36): n=a or g
tttatagccattcatgattgtactacgtccttgtcntctcccccattctgtagcttaaggtcatagaggag

SEQ ID NO: 10001 - DNA, 71 bp, chicken (Gallus Gallus)
  misc_feature (36): n=a or g
taaatataataaactatatttgtaaatcaagacagnttcacgattaaggcctgattgtattttgtacataa

SEQ ID NO: 10002 - DNA, 71 bp, chicken (Gallus Gallus)
  misc_feature (36): n=a or g
atagtattttaaatgatttggtggttcagtgccacnttcttgattatcaaatatactaccggattaataca

SEQ ID NO: 10003 - DNA, 71 bp, chicken (Gallus Gallus)
  misc_feature (36): n=a or g
gattttgtaaagctctgctggaattatttccatttnactcacctgatacacagaataataataaaaattct

SEQ ID NO: 10004 - DNA, 71 bp, chicken (Gallus Gallus)
  misc_feature (36): n=c or t
aaaatgattccaaatccaaaaccctagtcaactcangtagatggcactgaagcacacacttctacctttca

SEQ ID NO: 10005 - DNA, 71 bp, chicken (Gallus Gallus)
  misc_feature (36): n=c or g
attgttgtatatttttcctctcttttcaagaccatnagcaggcctcagaagcagcccttctggagctggag

SEQ ID NO: 10006 - DNA, 71 bp, chicken (Gallus Gallus)
  misc_feature (36): n=a or g
caatacaaaattaaaaaacacagacctttggggacncatcacaggtctgtagagataaagtgtgacttgct

SEQ ID NO: 10007 - DNA, 71 bp, chicken (Gallus Gallus)
  misc_feature (36): n=c or t
gtatcaagcattaactaagcgagtcgtgccaaaggnagaattacactcgtggtcctcattcacatttcttc

SEQ ID NO: 10008 - DNA, 71 bp, chicken (Gallus Gallus)
  misc_feature (36): n=a or g
gatgagagagcccagatttgtccacaatctcacgancacagccaaaaatgcttccttcctatgggctgcac

SEQ ID NO: 10009 - DNA, 71 bp, chicken (Gallus Gallus)
  misc_feature (36): n=c or t
tggaccacgctattccatataacgaacagcatgtangctccattacatttccctacaactcattcctttat

SEQ ID NO: 10010 - DNA, 71 bp, chicken (Gallus Gallus)
  misc_feature (36): n=c or t
taggaaaccctttcactgaaggactgattctgatcngatgtcccataaatccacttgctctgcttgttcag

SEQ ID NO: 10011 - DNA, 71 bp, chicken (Gallus Gallus)
  misc_feature (36): n=c or t
cagcatatcctacagtctatcctctctctcaagtangttattttagacggcaaccgtcttcattctggttc

SEQ ID NO: 10012 - DNA, 71 bp, chicken (Gallus Gallus)
  misc_feature (36): n=c or t
tgcttcattctgtttaaaacagccggttagtccagngtgctcctcagcctgcagagagctgccccaggctg

SEQ ID NO: 10013 - DNA, 71 bp, chicken (Gallus Gallus)
  misc_feature (36): n=c or t
attttcattttccttttgtgagacaggtgtatgttntggggagtcatttgcatagttttggggtttagttt

SEQ ID NO: 10014 - DNA, 71 bp, chicken (Gallus Gallus)
  misc_feature (36): n=c or t
ctgacttacaacgttcatgaatgtctcaggatttanactctttggacacgtggtgacatcatctgagtttg

SEQ ID NO: 10015 - DNA, 71 bp, chicken (Gallus Gallus)
  misc_feature (36): n=a or g
catattaccattcaaagagaacaaagaaagatcatncaaagctgaaccaggatacagagaaataaaactga

SEQ ID NO: 10016 - DNA, 71 bp, chicken (Gallus Gallus)
  misc_feature (36): n=a or g
agagtaaatgtctttaaagtggacttgatgtgttcnctgtgagactgttccaagttaaggcacgctgtcag

SEQ ID NO: 10017 - DNA, 71 bp, chicken (Gallus Gallus)
  misc_feature (36): n=a or g
gcagctgagcaggtgctcagccatgcaatggcaacngtgctgcacgactgctctcctttcactgtttattt

SEQ ID NO: 10018 - DNA, 71 bp, chicken (Gallus Gallus)
  misc_feature (36): n=c or t
tccatggatgaaggctgctagttagtactggaaagnggagagagtgaagaacagctcactcctctctccaa

SEQ ID NO: 10019 - DNA, 71 bp, chicken (Gallus Gallus)
  misc_feature (36): n=a or g
cttatcacaaaaataaagctctttatttggacttgnacaacttcccaagtatgccattttagcacaactca

SEQ ID NO: 10020 - DNA, 71 bp, chicken (Gallus Gallus)
  misc_feature (36): n=c or t
tacacaacggtgtaactgctcccatcatcaggctgngtctcatccctagggtctcttaattcttcattaag

SEQ ID NO: 10021 - DNA, 71 bp, chicken (Gallus Gallus)
  misc_feature (36): n=a or g
ggtggctcctcaagggtgctacacgtgcagcacacncacagctcatttacacttcctctttctaattcaca

SEQ ID NO: 10022 - DNA, 71 bp, chicken (Gallus Gallus)
  misc_feature (36): n=a or g
tttgggttttgaacacaactgctgtcccatacatcnttttcttggttaaatacattttaacagggcatcct

SEQ ID NO: 10023 - DNA, 71 bp, chicken (Gallus Gallus)
  misc_feature (36): n=a or g
cttcacgtttgagagggctggaggcacacggccccnggcaccagtttatgcagcagcactggatcatcaaa

SEQ ID NO: 10024 - DNA, 71 bp, chicken (Gallus Gallus)
  misc_feature (36): n=a or g
tttaattttgtttttattaaagcaacagaaggcacntttgagatcttcaaaaagctgttgcacgtgaacac

SEQ ID NO: 10025 - DNA, 71 bp, chicken (Gallus Gallus)
  misc_feature (36): n=c or t
atgcgctcttcattaatcttccttttaaagaagcancctattagaaggaatagtatgagatgaaacttcaa

SEQ ID NO: 10026 - DNA, 71 bp, chicken (Gallus Gallus)
  misc_feature (36): n=c or t
ggctgtagataacacctcacgcacatatgtttaatngggaaatagcttcgttcctatgctgtacaagagct

SEQ ID NO: 10027 - DNA, 71 bp, chicken (Gallus Gallus)
  misc_feature (36): n=c or t
tttctaaatgcatataaaaaagaaaaaggaaacatnttagccctttgtaaaaactgcccatttggtccttc

SEQ ID NO: 10028 - DNA, 71 bp, chicken (Gallus Gallus)
  misc_feature (36): n=c or g
ttaaatccatttctgatttgtagttgaaaatgaccnaaagaggctttgtaaagtcagtttcacatgaaact

SEQ ID NO: 10029 - DNA, 71 bp, chicken (Gallus Gallus)
  misc_feature (36): n=c or t
gaatggattacctttccctacaacattaactgggcngtactatgactgttggccgcaatctaggctgccct

SEQ ID NO: 10030 - DNA, 71 bp, chicken (Gallus Gallus)
  misc_feature (36): n=a or g
ttttgaagcatcagcgtcccatgaccagagctcccncattactggcagtgttgtctgaaggatttggcatt

SEQ ID NO: 10031 - DNA, 71 bp, chicken (Gallus Gallus)
  misc_feature (36): n=a or g
tatttgccttctggagatgtcagaggaaggtgcacntgtatgttaatctccattaaatgatcgatattgct

SEQ ID NO: 10032 - DNA, 71 bp, chicken (Gallus Gallus)
  misc_feature (36): n=a or g
gaggaggcagacattgagttaccatttgaagttagncttgtttctgcgggaagatatttgaactttcacag

SEQ ID NO: 10033 - DNA, 71 bp, chicken (Gallus Gallus)
  misc_feature (36): n=a or g
tcaatgatttttgcttgaatctgaataccagccccntttctccccagttcctcagtggtgtgacattccct

SEQ ID NO: 10034 - DNA, 71 bp, chicken (Gallus Gallus)
  misc_feature (36): n=c or t
tgaaaatggctttctctaaactttgatttctcaacnggcacttatttcacctttagattcatttcaaagca

SEQ ID NO: 10035 - DNA, 71 bp, chicken (Gallus Gallus)
  misc_feature (36): n=a or g
attcctattaaaaaaaaaaatctgtttgcaataagngatctggctcagaatcttgtaattctacttcccgt

SEQ ID NO: 10036 - DNA, 71 bp, chicken (Gallus Gallus)
  misc_feature (36): n=c or t
tttgcaggggtaggaaaaattccttctgcaggtttntaaaggagaagaggttgtttcatagacatttgtta

SEQ ID NO: 10037 - DNA, 71 bp, chicken (Gallus Gallus)
  misc_feature (36): n=a or g
gcactgctgcaggtattaaaaccaagaggtaccacngagctgaatgctgtcatcccacatgctgaaatgga

SEQ ID NO: 10038 - DNA, 71 bp, chicken (Gallus Gallus)
  misc_feature (36): n=a or t
ctcaatttccaaactccgagcagctatttcattccnaccattgcgggcagaagggagcccatgtttcggct

SEQ ID NO: 10039 - DNA, 71 bp, chicken (Gallus Gallus)
  misc_feature (36): n=a or g
atttctctctgtgtaatgacggtacaattgacctcnagtttacagttggcattctgaaggcaaagagtcaa

SEQ ID NO: 10040 - DNA, 71 bp, chicken (Gallus Gallus)
  misc_feature (36): n=c or t
tgaactggagatgggccttcacaagtattgtaaatngtgtttttattgacttcagtagtttgttgttattt

SEQ ID NO: 10041 - DNA, 71 bp, chicken (Gallus Gallus)
  misc_feature (36): n=c or t
tgctctgggcagtaaccggccggatacagacaacancatttcagcatccaggagatggacggcaaaaagca

SEQ ID NO: 10042 - DNA, 71 bp, chicken (Gallus Gallus)
  misc_feature (36): n=c or t
tttgcatttattttcttcttcagcagcatgggcacngctctgatgataattcccagctggcaacaatcctg

SEQ ID NO: 10043 - DNA, 71 bp, chicken (Gallus Gallus)
  misc_feature (36): n=c or t
gttttgcaggttctcctctctccactcatttcttcntacaggacccattcctgaagcttctcaaggatgag

SEQ ID NO: 10044 - DNA, 71 bp, chicken (Gallus Gallus)
  misc_feature (36): n=a or g
ccctttttcccctttgattgagctttcttgttctcngatttatcctacaattaaatgaagtaaattcatat

SEQ ID NO: 10045 - DNA, 71 bp, chicken (Gallus Gallus)
  misc_feature (36): n=a or c
agatttcttttggaagaagaaagcctatatacagantgaatgtaggcatctgaactctgtaggcatctttt

SEQ ID NO: 10046 - DNA, 71 bp, chicken (Gallus Gallus)
  misc_feature (36): n=a or c
agttagggaagtgaattttatgatttgggtaattanttctggatttaaggactgttcagatcacttattgc

SEQ ID NO: 10047 - DNA, 71 bp, chicken (Gallus Gallus)
  misc_feature (36): n=g or t
gcataaacttagagaagcgtgtgtctagagtcttanagtcctgtcttatcattagaattttctgtttaact

SEQ ID NO: 10048 - DNA, 71 bp, chicken (Gallus Gallus)
  misc_feature (36): n=a or g
cactctgggttggaaaaggtgggaaagcaaatgtgnggactgagcaaagctgtaaatggctcagacccaga

SEQ ID NO: 10049 - DNA, 71 bp, chicken (Gallus Gallus)
  misc_feature (36): n=a or g
gtgttactagaaaataaaatacttacaattttcctncaacaacaaaatggctgctagaatagggcttatgc

SEQ ID NO: 10050 - DNA, 71 bp, chicken (Gallus Gallus)
  misc_feature (36): n=c or t
tacagtggcggttatggaactcctgatggcttgggnggctacagtaagtagatattctcttttaaatggac

SEQ ID NO: 10051 - DNA, 71 bp, chicken (Gallus Gallus)
  misc_feature (36): n=a or g
agcacctttcacatgtccgtaagagtgactgcagcntgagcttcaacctgcaacagaagcgaggaaaagct

SEQ ID NO: 10052 - DNA, 71 bp, chicken (Gallus Gallus)
  misc_feature (36): n=a or g
ggaatatacatatttatattccttctgtgcggagcngtcagaaaacttgaatgtatttctcacaaattctg

SEQ ID NO: 10053 - DNA, 71 bp, chicken (Gallus Gallus)
  misc_feature (36): n=a or g
tttgagtatggtttgcacattcgtacgttgccatgngccttgttttaggaagacgaggtgggaaacctgta

SEQ ID NO: 10054 - DNA, 71 bp, chicken (Gallus Gallus)
  misc_feature (36): n=a or g
aaagtctacttcatgtgattaggaggacattctctnatgttttccaaacactgctgccacctgttctccac

SEQ ID NO: 10055 - DNA, 71 bp, chicken (Gallus Gallus)
  misc_feature (36): n=c or t
actaccatatagttgctactcaagctcattctgganataaatgtagatgacaaaatcctcacactgttagg

SEQ ID NO: 10056 - DNA, 71 bp, chicken (Gallus Gallus)
  misc_feature (36): n=a or g
agcaaagggcttgtttctggaaactcccaacagtcncaccagcagaagtgtccttcctcttcacagtctgc

SEQ ID NO: 10057 - DNA, 71 bp, chicken (Gallus Gallus)
  misc_feature (36): n=a or g
cagcacctgtgtatttttggttgatcactctgcacngagcagtcttactgcatccgtgggttggaagtgac

SEQ ID NO: 10058 - DNA, 71 bp, chicken (Gallus Gallus)
  misc_feature (36): n=c or g
attactgtggatcgaatacaggatagctcttgtcanagatggtctttttccacaagaaaaattttcaagta

SEQ ID NO: 10059 - DNA, 71 bp, chicken (Gallus Gallus)
  misc_feature (36): n=a or g
atctcaagcttaggatcaaatacaccagtaataccncagtcagtcatgagtataagcatgtttttaatata

SEQ ID NO: 10060 - DNA, 71 bp, chicken (Gallus Gallus)
  misc_feature (36): n=c or t
tgggtaagcttgatagtgttgacaattaacttttgntcatgggtagataggactattgacaatagttttta

SEQ ID NO: 10061 - DNA, 71 bp, chicken (Gallus Gallus)
  misc_feature (36): n=a or g
ttttctgcctgcttcttgttacatatttaccatgcnctgggacatgagagactactattttattaaatgtt

SEQ ID NO: 10062 - DNA, 71 bp, chicken (Gallus Gallus)
  misc_feature (36): n=c or g
tgccacgtgtgaattgactgaaaagctgtaggcctnttaaggtatagcaaaaacattgtcttgagtgctgc

SEQ ID NO: 10063 - DNA, 71 bp, chicken (Gallus Gallus)
  misc_feature (36): n=a or g
tgcaaatgcagtgctggaaaaaggtctgtgccagcngagtttggctttacgtgtgctaagctgcttgagat

SEQ ID NO: 10064 - DNA, 71 bp, chicken (Gallus Gallus)
  misc_feature (36): n=a or g
agcttattccaaggactaaagcaacgacaaagaccntgtacacttggtgcatcctgccctctgtcgagttg

SEQ ID NO: 10065 - DNA, 71 bp, chicken (Gallus Gallus)
  misc_feature (36): n=a or g
agctctgcttaagctgcacgtgggatctaagaagcntagtgtctcatattgtctgtattaatctaaaaata

SEQ ID NO: 10066 - DNA, 71 bp, chicken (Gallus Gallus)
  misc_feature (36): n=c or t
tgtgaaatgatgctttcctacaaatgatcccagtgngggtttccctttgttacgccttgaaggtgagtttt

SEQ ID NO: 10067 - DNA, 71 bp, chicken (Gallus Gallus)
  misc_feature (36): n=a or g
ctctaaagattcgctgctttcaatctgtgctttttngaaaagagcacaggaatgaccggagcatctcaaca

SEQ ID NO: 10068 - DNA, 71 bp, chicken (Gallus Gallus)
  misc_feature (36): n=a or g
ttaaaaaataaagatagaacaagcccaattcccgcntctcccttaatttagcactgctagacgttatgttg

SEQ ID NO: 10069 - DNA, 71 bp, chicken (Gallus Gallus)
  misc_feature (36): n=g or t
taaaggttacatcaattctttggattattcatcttntttttgtcctagtgagtctgggagcccaaggcagc

SEQ ID NO: 10070 - DNA, 71 bp, chicken (Gallus Gallus)
  misc_feature (36): n=c or t
taaaggggcactctgcttctgttgccagagatgatngtgatggtcttgaggatgcagtgtggaacctgagt

SEQ ID NO: 10071 - DNA, 71 bp, chicken (Gallus Gallus)
  misc_feature (36): n=a or g
cagcattttgtatctacgagtactcatgtgcttttnttggatcacacaggtgcagctgtcagtgtttttat

SEQ ID NO: 10072 - DNA, 71 bp, chicken (Gallus Gallus)
  misc_feature (36): n=a or t
gaactcttctcctgttaaagccactcagcacataancctaatccttcacacctaatcctttcctccaagct

SEQ ID NO: 10073 - DNA, 71 bp, chicken (Gallus Gallus)
  misc_feature (36): n=c or t
acctgatgcagatatctgcaggttagttagtttttngttatctcactgtgagcacattctgttaccctggc

SEQ ID NO: 10074 - DNA, 71 bp, chicken (Gallus Gallus)
  misc_feature (36): n=a or g
taccacactgagctctggatggagcaagctctgaancagctggatgagggagaagtgtcttctgcagataa

SEQ ID NO: 10075 - DNA, 71 bp, chicken (Gallus Gallus)
  misc_feature (36): n=c or t
tgaaatcagcagaccctcctcagtgagctgacactnaccttgctcgtggccacccagatcaaaagtggtga

SEQ ID NO: 10076 - DNA, 71 bp, chicken (Gallus Gallus)
  misc_feature (36): n=g or t
ccaatgtagaaagcactggaaacttaatgctgtctncagtcccatcagatatggagctgggagggaaaggc

SEQ ID NO: 10077 - DNA, 71 bp, chicken (Gallus Gallus)
  misc_feature (36): n=a or g
cattatttatttggctgctctctgaaatcagagccnaggtgcttttaaaacccctaattgattctgtactg

SEQ ID NO: 10078 - DNA, 71 bp, chicken (Gallus Gallus)
  misc_feature (36): n=c or t
gccatcctgccctgtcccattacacagcctgaaaanagtctgtgctggctggtgagcagggatggggagga

SEQ ID NO: 10079 - DNA, 71 bp, chicken (Gallus Gallus)
  misc_feature (36): n=a or g
ttgtagggatctaggcaaatgcaagaacatgggatnttctgtatccttgttgggcttttctatgggtcttc

SEQ ID NO: 10080 - DNA, 71 bp, chicken (Gallus Gallus)
  misc_feature (36): n=a or g
actcctccagcagccagggctgctgtgcggagctgnatgtgacatggatgcgctctagcctggtgttgtgc

SEQ ID NO: 10081 - DNA, 71 bp, chicken (Gallus Gallus)
  misc_feature (36): n=c or t
aaatttttgaggttttaggaagcatgaaaccaaagnaaaacatcttcttgaatgttttttcttaaatgtta

SEQ ID NO: 10082 - DNA, 71 bp, chicken (Gallus Gallus)
  misc_feature (36): n=g or t
cctggctgtatttgctcatagttcctaattttttanctgtgtttggcactgggggaagtgatgcattggag

SEQ ID NO: 10083 - DNA, 71 bp, chicken (Gallus Gallus)
  misc_feature (36): n=a or g
aagttctgacagttcctgtaactccaccacgtacanatctgcccagtagcacctctgtcctgaaaagatgc

SEQ ID NO: 10084 - DNA, 71 bp, chicken (Gallus Gallus)
  misc_feature (36): n=a or g
acctcccttggccctctctgagcttgttgatttacngtccccatgtaagatagatgcagaacacccatgga

SEQ ID NO: 10085 - DNA, 71 bp, chicken (Gallus Gallus)
  misc_feature (36): n=a or g
ggagtttagagctaacaatgatgggagagctgagangaagagaaatacagagggaatatttgaaggcagtt

SEQ ID NO: 10086 - DNA, 71 bp, chicken (Gallus Gallus)
  misc_feature (36): n=c or t
aatagtatcgtttcattctttgttcactgagaacangtgcgacagaaactgtgcgaagtaagaaagcttaa

SEQ ID NO: 10087 - DNA, 71 bp, chicken (Gallus Gallus)
  misc_feature (36): n=a or g
atatcgagacgcgcggttccactttgtccagtggtncctaaaagtgaactggcttcaatcacaatgagagc

SEQ ID NO: 10088 - DNA, 71 bp, chicken (Gallus Gallus)
  misc_feature (36): n=a or g
actgatcctactctatgaaggaagacaagtggaaantacaaacacgttagctctcacatggtattacacaa

SEQ ID NO: 10089 - DNA, 71 bp, chicken (Gallus Gallus)
  misc_feature (36): n=a or c
ccgttctgcaaggacaaaaacacaacagttggctcncttcaaacgcaccatacatgcacaaagcgagcttg

SEQ ID NO: 10090 - DNA, 71 bp, chicken (Gallus Gallus)
  misc_feature (36): n=c or t
tctcttgttggaaagcccaggtgtctaaaccactangattttaaatcactccctattttaaacacagaaaa

SEQ ID NO: 10091 - DNA, 71 bp, chicken (Gallus Gallus)
  misc_feature (36): n=a or g
ctgaggaggttcacagggcaatccagaatagtgcantataccaaactacaaagtatcacagcgtgacctct

SEQ ID NO: 10092 - DNA, 71 bp, chicken (Gallus Gallus)
  misc_feature (36): n=c or g
acaagggaagagaggaccaccaggaattatacagtncagtgcaatatagcagcagaaggcagtaagaaaag

SEQ ID NO: 10093 - DNA, 71 bp, chicken (Gallus Gallus)
  misc_feature (36): n=g or t
acatacacatccactgttgtatgacacaaaggacancactggcaacaaggggcaaaatttaggaagtcttg

SEQ ID NO: 10094 - DNA, 71 bp, chicken (Gallus Gallus)
  misc_feature (36): n=a or g
aaggaaagacaggacagtctgaaatccaaatactgnaagagctctcttcatctttatctgtgcagggcaca

SEQ ID NO: 10095 - DNA, 71 bp, chicken (Gallus Gallus)
  misc_feature (36): n=a or t
ctgccttgctcctggactcagaccccagcccctctncaagatcctatatacacatcaggttgtgctaaagc

SEQ ID NO: 10096 - DNA, 71 bp, chicken (Gallus Gallus)
  misc_feature (36): n=a or g
tgagaaagtgactgagttgggtctggctgtgatganacacgggtttgcaaagaaccaccagtagaatggct

SEQ ID NO: 10097 - DNA, 71 bp, chicken (Gallus Gallus)
  misc_feature (36): n=a or g
aaacacagacatagcagacaaacacacatacacccntctcatgtctaattcaagacagtcatttcacagtc

SEQ ID NO: 10098 - DNA, 71 bp, chicken (Gallus Gallus)
  misc_feature (36): n=c or g
actaccctgaaatcatttcattcactatgttagcanagctgtccatgatgtggatatcagacagatagcag

SEQ ID NO: 10099 - DNA, 71 bp, chicken (Gallus Gallus)
  misc_feature (36): n=a or c
aaactaaagtagttgtgaaaccgaccatttaagatnactggtaatacattagtaatatatgtgtctgagaa

SEQ ID NO: 10100 - DNA, 71 bp, chicken (Gallus Gallus)
  misc_feature (36): n=a or g
ttgttgccatatggtcagaagaaagttagcaaactnggttgaatcttgctactactgaagttttaaaatat

SEQ ID NO: 10101 - DNA, 71 bp, chicken (Gallus Gallus)
  misc_feature (36): n=c or t
cagccttatcccctgtgaatatagaagactgcaacncaagtgtgtatgttagggagaacaggctaggaagt

SEQ ID NO: 10102 - DNA, 71 bp, chicken (Gallus Gallus)
  misc_feature (36): n=a or t
ttaatatattattgcatggtacagaacatcaaagcnttatttacaatttaaaaaattaaggaagttatcat

SEQ ID NO: 10103 - DNA, 71 bp, chicken (Gallus Gallus)
  misc_feature (36): n=a or g
tttttacactctttgggtaataattcatacagtttnaactgatactcactgaaccagcacttccacttcct

SEQ ID NO: 10104 - DNA, 71 bp, chicken (Gallus Gallus)
  misc_feature (36): n=a or c
aagacttaatataaacaaactaagttaaaactcagnctcttttcataattgaagtgagtggcacagcccat

SEQ ID NO: 10105 - DNA, 71 bp, chicken (Gallus Gallus)
  misc_feature (36): n=c or g
atcactgctttgactgctttcacttccccagcaaancatcagtgccatttgtattcacccagttgatgcaa

SEQ ID NO: 10106 - DNA, 71 bp, chicken (Gallus Gallus)
  misc_feature (36): n=a or t
atttctctcactgggcaatcttatgctggcaaaggnataaatactgttctaactgggatctgcgcgcctgc

SEQ ID NO: 10107 - DNA, 71 bp, chicken (Gallus Gallus)
  misc_feature (36): n=a or g
gtaataaagatgcttgtctgttatttggctacaacncattcatttttcacctctatattctctggcttaag

SEQ ID NO: 10108 - DNA, 71 bp, chicken (Gallus Gallus)
  misc_feature (36): n=c or g
ttcagcatagccatggtgcagagctttctcctggtnctgcctatgaacaaagcaagaaagggattttttga

SEQ ID NO: 10109 - DNA, 71 bp, chicken (Gallus Gallus)
  misc_feature (36): n=a or g
gcttcagggcaactgtgtagctgttttttaaaacgnaactggtgtatatcttttgatctggaatatttgta

SEQ ID NO: 10110 - DNA, 71 bp, chicken (Gallus Gallus)
  misc_feature (36): n=c or t
caggataactgttgcaaactccaattttcttagacntctgcaagttctctttctttttgcatactgttatt

SEQ ID NO: 10111 - DNA, 71 bp, chicken (Gallus Gallus)
  misc_feature (36): n=c or g
caggatatctgacattctatttatttttatagttanagtgcttcgttttacaaccatttgtattctttctc

SEQ ID NO: 10112 - DNA, 71 bp, chicken (Gallus Gallus)
  misc_feature (36): n=a or g
caaaccagaactgcagccttttgaacaaacttatcnagagcaatgattgtcctgctttgttctcactggaa

SEQ ID NO: 10113 - DNA, 71 bp, chicken (Gallus Gallus)
  misc_feature (36): n=a or g
gattttcccttagattaacagtaagtagcatgaagntaaggaaactggccataacgtaagggttagcttta

SEQ ID NO: 10114 - DNA, 71 bp, chicken (Gallus Gallus)
  misc_feature (36): n=c or t
tcccatcatgaaaatttaccttcagcatgcaggaangtttaagcctcttcacaccttacaacattaacatt

SEQ ID NO: 10115 - DNA, 71 bp, chicken (Gallus Gallus)
  misc_feature (36): n=a or t
acaaaacatgaagaacacgatttcaaagtaactgcngtcatttttatatctgcttagaagagttagaagtt

SEQ ID NO: 10116 - DNA, 71 bp, chicken (Gallus Gallus)
  misc_feature (36): n=a or t
aagtgttgcctctttgaacggggtggtggatggaangtgtcatagtctgtggtaaggaagtgatagagctt

SEQ ID NO: 10117 - DNA, 71 bp, chicken (Gallus Gallus)
  misc_feature (36): n=c or g
gtatgaggacagcatgttgatatataataaggggancgtgatcaacccagtcttctctgctgatttgagag

SEQ ID NO: 10118 - DNA, 71 bp, chicken (Gallus Gallus)
  misc_feature (36): n=c or t
ggctacagaagataccactgataagatgtggtgcangtttaatgtgtaacagaagtatgctgcaaaactaa

SEQ ID NO: 10119 - DNA, 71 bp, chicken (Gallus Gallus)
  misc_feature (36): n=a or c
ctcccaccccaaactcagaaccagaactaggacacncaagacatacaacatattattaatctaatccagat

SEQ ID NO: 10120 - DNA, 71 bp, chicken (Gallus Gallus)
  misc_feature (36): n=c or g
atcgtaaatattaacagctttgttttccagtcaatnttttaagccattcatcacaccaagatctcatgcgt

SEQ ID NO: 10121 - DNA, 71 bp, chicken (Gallus Gallus)
  misc_feature (36): n=a or t
gtcattcttctttccagttgtcccacttatgccttnaccgtgaagtacattgctttttcttaaagcatgaa

SEQ ID NO: 10122 - DNA, 71 bp, chicken (Gallus Gallus)
  misc_feature (36): n=a or g
atacgctttcatctggattctgtttatgttttcttnaaaacagctttcaagacatttatacagatgaatat

SEQ ID NO: 10123 - DNA, 71 bp, chicken (Gallus Gallus)
  misc_feature (36): n=c or t
tgcaaagcaagcaaaatgcacaacttgaatgtttcngaactgaaaaacaaatctcacaggatcattctttg

SEQ ID NO: 10124 - DNA, 71 bp, chicken (Gallus Gallus)
  misc_feature (36): n=a or g
cagcatctggtcttgctttgggtttgcctggtcctngggatctacgaaggtccttcccttggagatgtgct

SEQ ID NO: 10125 - DNA, 71 bp, chicken (Gallus Gallus)
  misc_feature (36): n=c or t
ctggttgttttagtctgacatggtgagaggtgatcnctgttagtccttggcgtcgtcacaattttgttaca

SEQ ID NO: 10126 - DNA, 71 bp, chicken (Gallus Gallus)
  misc_feature (36): n=c or t
gtacactgtcctatctcaaagctaatctgaaaccangtgagcctctgaggaagccagaaagtaattgcaat

SEQ ID NO: 10127 - DNA, 71 bp, chicken (Gallus Gallus)
  misc_feature (36): n=a or g
agcaataatattcagccacgttcccattctgtggcngatcacaggccaaatcataactgtgtatctcatcc

SEQ ID NO: 10128 - DNA, 71 bp, chicken (Gallus Gallus)
  misc_feature (36): n=a or c
ttcaaagtcctcaaactctttccatggtactacacntgttcttttactcagagtcatagtatgggaagctt

SEQ ID NO: 10129 - DNA, 71 bp, chicken (Gallus Gallus)
  misc_feature (36): n=c or t
tgcaaatagtaaaccatcatcatagtgccactgtangacagaatatgacaggagagcatagaaattggaat

SEQ ID NO: 10130 - DNA, 71 bp, chicken (Gallus Gallus)
  misc_feature (36): n=a or g
acagtatgtgcattcctcaggaaatttaacccactngaaacactgaaaacttcttcactgtctgcacagac

SEQ ID NO: 10131 - DNA, 71 bp, chicken (Gallus Gallus)
  misc_feature (36): n=a or c
gacaggaggactgtaactgtggcactttctgtgttnctaaggatgttttcctgaagtttctacacagggag

SEQ ID NO: 10132 - DNA, 71 bp, chicken (Gallus Gallus)
  misc_feature (36): n=a or g
ctagataagatgacaggattcaatacacacttttangtaagccattctgctgtaaagttttaatcaagttt

SEQ ID NO: 10133 - DNA, 71 bp, chicken (Gallus Gallus)
  misc_feature (36): n=c or t
ctattatttccgcttgatggctttggttttatctanggattactcagtttgggaataatgggagatttaca

SEQ ID NO: 10134 - DNA, 71 bp, chicken (Gallus Gallus)
  misc_feature (36): n=a or g
ataaaaagacaatttaagtctgctactcaatatccntttctcatgcatttttataatccctttaccaaaaa

SEQ ID NO: 10135 - DNA, 71 bp, chicken (Gallus Gallus)
  misc_feature (36): n=g or t
caaggaatgatctccagagcaaaatccttcctcagnggcagtcagcccttaaatggagtctgggagaggtg

SEQ ID NO: 10136 - DNA, 71 bp, chicken (Gallus Gallus)
  misc_feature (36): n=a or g
tcacagcgattttatgggaaccgttaaaatgtgccnctaaattcaaattagtattatgacaaataattgag

SEQ ID NO: 10137 - DNA, 71 bp, chicken (Gallus Gallus)
  misc_feature (36): n=c or t
tacagctctccttcctatgcacgtataatctgatgngtaacagcaggaaacataaaaggagctactacatg

SEQ ID NO: 10138 - DNA, 71 bp, chicken (Gallus Gallus)
  misc_feature (36): n=c or t
gcctggcttatcttccatggtctttctttctgtttnggcagaaagggaaaaaacagtgtatggaagggaaa

SEQ ID NO: 10139 - DNA, 71 bp, chicken (Gallus Gallus)
  misc_feature (36): n=c or t
cagtagtatttccttacaggactttgccaagtatangcaatgtattaaaaagtactgaacacctacccata

SEQ ID NO: 10140 - DNA, 71 bp, chicken (Gallus Gallus)
  misc_feature (36): n=c or t
agtttctcagcatttaatctcctggaagtggtccangctaaacactgacctcactaaaaccgtcagggtcc

SEQ ID NO: 10141 - DNA, 71 bp, chicken (Gallus Gallus)
  misc_feature (36): n=a or g
tttgattagtcatcttcttttgtactaacacacacnctcagaaactaaaaaggtgctctgtttagcataac

SEQ ID NO: 10142 - DNA, 71 bp, chicken (Gallus Gallus)
  misc_feature (36): n=c or t
atttctatttcaataagaatttagcaagtttgtttnccacttttagactggataatgggagataaaaaagc

SEQ ID NO: 10143 - DNA, 71 bp, chicken (Gallus Gallus)
  misc_feature (36): n=a or g
aaatgatgtgctattgaaatttttagaagtactgcngattgccaagaaaaaaaatctttagaatatttaat

SEQ ID NO: 10144 - DNA, 71 bp, chicken (Gallus Gallus)
  misc_feature (36): n=c or t
ttttagggtattgctgaagaagatctttccaaatanttaaagaaaggtatcaagagtagcatgtggtgtta

SEQ ID NO: 10145 - DNA, 71 bp, chicken (Gallus Gallus)
  misc_feature (36): n=a or c
gctgtttcagaagaatgcttcatgaaaaacagctcngcttctgctaacacaggttctattccaataccacc

SEQ ID NO: 10146 - DNA, 71 bp, chicken (Gallus Gallus)
  misc_feature (36): n=c or t
gtctgtgtgccaatcccaaacactcctttccttccntataaaacatactgatcacattcagcttgaatatg

SEQ ID NO: 10147 - DNA, 71 bp, chicken (Gallus Gallus)
  misc_feature (36): n=c or t
ataattaaagcagaattacactggtagtattcttgntgtatcacaactggctcgattaggataaaataatt

SEQ ID NO: 10148 - DNA, 71 bp, chicken (Gallus Gallus)
  misc_feature (36): n=a or g
tgggaatgaagggggacagagaaaaaagggagagantggttaggttttgaagtgtaccagcttgtcatgga

SEQ ID NO: 10149 - DNA, 71 bp, chicken (Gallus Gallus)
  misc_feature (36): n=a or t
gttacaccttgcaatggaatcaaccctaagagttgncactgaataaaatacacaccttcactcagggcaaa

SEQ ID NO: 10150 - DNA, 71 bp, chicken (Gallus Gallus)
  misc_feature (36): n=c or g
atcaagcattctctagaaagttcttccaagccatanttagaataaaataattgtgtgactttactatgaga

SEQ ID NO: 10151 - DNA, 71 bp, chicken (Gallus Gallus)
  misc_feature (36): n=c or t
ggtttgtccaagtgtcatatcttaacattatatacnaaagtatgtgcagtgaaaagtgcttgcaaatgtgt

SEQ ID NO: 10152 - DNA, 71 bp, chicken (Gallus Gallus)
  misc_feature (36): n=a or g
tagtcatcttctattatccaaattcacaagcttagnattttcttatttacatttttctgtattttgggatg

SEQ ID NO: 10153 - DNA, 71 bp, chicken (Gallus Gallus)
  misc_feature (36): n=c or t
cttttcttttcttttctttctttctttttttttttnttttttgaaagattactggccacaatcacctttta

SEQ ID NO: 10154 - DNA, 71 bp, chicken (Gallus Gallus)
  misc_feature (36): n=a or c
ttaatttaacagtacttccgaatggagacagagaangagcttatccatactcacaatacaaccattacact

SEQ ID NO: 10155 - DNA, 71 bp, chicken (Gallus Gallus)
  misc_feature (36): n=c or t
tcatatttattggtcctacccaaatttcacaaatcnttcaacaattatgaccagattacatttgtagcttc

SEQ ID NO: 10156 - DNA, 71 bp, chicken (Gallus Gallus)
  misc_feature (36): n=c or t
agtttttcagccggagagaaaaactaaaaggaggangtggagatgtgagaaactgagctcttaattttgta

SEQ ID NO: 10157 - DNA, 71 bp, chicken (Gallus Gallus)
  misc_feature (36): n=c or t
cgtgaagagtaggccaagaggaaaacttatcaatgnctgtaaatatccaaaagggcaggacccaagaggat

SEQ ID NO: 10158 - DNA, 71 bp, chicken (Gallus Gallus)
  misc_feature (36): n=c or t
cattacacttgcatgtttttcatataggcatagaangctgtgatcattctaaccccaaagaagtcctgagc

SEQ ID NO: 10159 - DNA, 71 bp, chicken (Gallus Gallus)
  misc_feature (36): n=a or g
ctaggacagaaagacaatggggtgcattgtttttcntagcataaccagagttttctttaaagttatttcgg

SEQ ID NO: 10160 - DNA, 71 bp, chicken (Gallus Gallus)
  misc_feature (36): n=c or g
tgctctacacaaagcagtacattacaaaaacaaaancacttacttgcaccagcagtactaattttgccact

SEQ ID NO: 10161 - DNA, 71 bp, chicken (Gallus Gallus)
  misc_feature (36): n=a or g
gctttcaacaaaaaaactcaggcaatctccatacantctgtcttcaatttcttgctttttgtcttcctttg

SEQ ID NO: 10162 - DNA, 71 bp, chicken (Gallus Gallus)
  misc_feature (36): n=a or g
gcaggccagtgtgtgactgagtgaacccaaaacacncacatttggcacaagttccatgtgtctcagactgt

SEQ ID NO: 10163 - DNA, 71 bp, chicken (Gallus Gallus)
  misc_feature (36): n=c or t
ttctgtaacatggaattctactctcttttctctttncctaggatcactttcagaagttcatcccaccagga

SEQ ID NO: 10164 - DNA, 71 bp, chicken (Gallus Gallus)
  misc_feature (36): n=a or c
gctaagcagcagcgccaagcaggacacctcctgagntacaatcattaaggattccctttacaagtcatacc

SEQ ID NO: 10165 - DNA, 71 bp, chicken (Gallus Gallus)
  misc_feature (36): n=c or t
tgctgctctgcaagcactaaatttgttttgtttttnatcaacgcagtgcttgctgtacatgggcagatgca

SEQ ID NO: 10166 - DNA, 71 bp, chicken (Gallus Gallus)
  misc_feature (36): n=a or g
ctaggctaagaagcaagaaagtaattctgcttgtcncattcagaacaagaacaggtccaagtcagtgccaa

SEQ ID NO: 10167 - DNA, 71 bp, chicken (Gallus Gallus)
  misc_feature (36): n=c or t
acaacaggcaattgaacagcagttgaaggttatgantcttcttaacatatctattcttaccatatttagcc

SEQ ID NO: 10168 - DNA, 71 bp, chicken (Gallus Gallus)
  misc_feature (36): n=c or g
aaaattattatccagtttgcaaatggatagcaacangagttttgtgtagcttgctttttattgtttgcatt

SEQ ID NO: 10169 - DNA, 71 bp, chicken (Gallus Gallus)
  misc_feature (36): n=c or t
atctgttttcctaaatttttctataagcacgctttnatggagatttgcaaatgacattttaggtctgcttt

SEQ ID NO: 10170 - DNA, 71 bp, chicken (Gallus Gallus)
  misc_feature (36): n=c or t
gtcttatggcaaaattgagagtgcaaaggtttgaantgagatcatctgaagttcacaggcactatttatgg

SEQ ID NO: 10171 - DNA, 71 bp, chicken (Gallus Gallus)
  misc_feature (36): n=g or t
ttatgtatttctctaacttttctaagcacatagtanacccagagagaacaagggaatcagttgtaactgta

SEQ ID NO: 10172 - DNA, 71 bp, chicken (Gallus Gallus)
  misc_feature (36): n=c or t
ccatagatgtacgaatatgttttttgaaaaagaatngaagattatttccagttagctttaatgtactagga

SEQ ID NO: 10173 - DNA, 71 bp, chicken (Gallus Gallus)
  misc_feature (36): n=a or t
cattttttttttaattgttatttctcatgtattgantatctgagcatcttctatctgccagtctccattgc

SEQ ID NO: 10174 - DNA, 71 bp, chicken (Gallus Gallus)
  misc_feature (36): n=a or g
ggctgtttcgacagtcaaggcagatatctgatttangggttatggtgtgttctctgtaagtaagaagctga

SEQ ID NO: 10175 - DNA, 71 bp, chicken (Gallus Gallus)
  misc_feature (36): n=a or g
ctctcaggttcggtctgagctgaaagtgacttaaanggatgtctcttggagaaggcctgggcaggagtaga

SEQ ID NO: 10176 - DNA, 71 bp, chicken (Gallus Gallus)
  misc_feature (36): n=a or g
ctacatagaaatagggaaacaaaagtgctctgcgcntcctatgcagtgcaggtgtgacgctggttcctgct

SEQ ID NO: 10177 - DNA, 71 bp, chicken (Gallus Gallus)
  misc_feature (36): n=a or g
tgcttcaatcggggtcagtgagaattggcaccaggnatgcctcatgctagaaatcagctgaagtgtttaat

SEQ ID NO: 10178 - DNA, 71 bp, chicken (Gallus Gallus)
  misc_feature (36): n=a or g
ccatctagcagaagctggatgtggttactttgaggngactgaggaactttgccttcagaaaaggactaagc

SEQ ID NO: 10179 - DNA, 71 bp, chicken (Gallus Gallus)
  misc_feature (36): n=c or g
tagttattgtccatatatccctggtgtcatttaaanaaggagtagaagtagattttgccaggtctgttctg

SEQ ID NO: 10180 - DNA, 71 bp, chicken (Gallus Gallus)
  misc_feature (36): n=a or t
gtaagagaatatggatctgcgactaatataaaatgnctttctccaactgagggtgacagactgctctaagg

SEQ ID NO: 10181 - DNA, 71 bp, chicken (Gallus Gallus)
  misc_feature (36): n=a or g
agagcaaagtaaactcaagttcaataaagcctcacngtgtgcccttggctaagggagggtcctgaatattc

SEQ ID NO: 10182 - DNA, 71 bp, chicken (Gallus Gallus)
  misc_feature (36): n=c or t
tgattgcaaccagtgcagtagctcactgttctgganagccatcggttcttggccaacaagaaagggaatga

SEQ ID NO: 10183 - DNA, 71 bp, chicken (Gallus Gallus)
  misc_feature (36): n=a or t
ttcttgcaaaaagaatcagattttggaagtatgatntggcgatgcccagctccgctaagaagtgttgcata

SEQ ID NO: 10184 - DNA, 71 bp, chicken (Gallus Gallus)
  misc_feature (36): n=c or t
tccctgcagatgttttgaaaagaatccatctgcatntaagtcaagtactttgagagcgtcttctaagtatt

SEQ ID NO: 10185 - DNA, 71 bp, chicken (Gallus Gallus)
  misc_feature (36): n=c or t
ggagcctgggtaccttgacgcttaagccttagtgcnacttactgcatcttcctctcgggcatcgcgtctca

SEQ ID NO: 10186 - DNA, 71 bp, chicken (Gallus Gallus)
  misc_feature (36): n=a or g
ctgaagctggaaggtgatggtccaatgttgaagttngctttggtatgctgtctgctagccaagtagggtcc

SEQ ID NO: 10187 - DNA, 71 bp, chicken (Gallus Gallus)
  misc_feature (36): n=a or g
ccgcttctccagctgcagtgattctaccattactgngaggagatggtgcaatacttgtttggaatgaagtt

SEQ ID NO: 10188 - DNA, 71 bp, chicken (Gallus Gallus)
  misc_feature (36): n=c or t
agtaatgagggcagccataaaaacttccattacatnttctgagctaacacacacatttcagaggaatattt

SEQ ID NO: 10189 - DNA, 71 bp, chicken (Gallus Gallus)
  misc_feature (36): n=c or t
ctcccaggggctaaaaatcctgccccaacttacacnctccacctgtacagacactaaggaatgtgaatcag

SEQ ID NO: 10190 - DNA, 71 bp, chicken (Gallus Gallus)
  misc_feature (36): n=a or g
ttaccaagctatttctggcctagaaaatcaaccttntaaagtggagacaatgaggacaggagcctgagagg

SEQ ID NO: 10191 - DNA, 71 bp, chicken (Gallus Gallus)
  misc_feature (36): n=a or g
ttaagtgcacacaacagcaccttaataggattaaanaagcttacagtagtatctgccactattaaaggtgc

SEQ ID NO: 10192 - DNA, 71 bp, chicken (Gallus Gallus)
  misc_feature (36): n=a or g
ccacgagtttagaaaagaaatcaagcaagttggccncataagacaccagcactgtcccaggcatgtgtcga

SEQ ID NO: 10193 - DNA, 71 bp, chicken (Gallus Gallus)
  misc_feature (36): n=a or g
ccagccattactgctccagagcttgaaatgcccacntattcaggcctattatcactagaaacactgagaag

SEQ ID NO: 10194 - DNA, 71 bp, chicken (Gallus Gallus)
  misc_feature (36): n=c or t
ccaaagacagaggtttaccagcacaaacaccagccnggtcttgaactcgagaagaggactgtgtgatctcc

SEQ ID NO: 10195 - DNA, 71 bp, chicken (Gallus Gallus)
  misc_feature (36): n=c or t
agaaggcagcctgggccctaagaacaaagtgtaggnactgcacacggagggaaaaccctaaggttattcat

SEQ ID NO: 10196 - DNA, 71 bp, chicken (Gallus Gallus)
  misc_feature (36): n=c or t
tggaaatgttcattattattcagaataatacttagnacttcggtagaattttctttctgggatcttaaagt

SEQ ID NO: 10197 - DNA, 71 bp, chicken (Gallus Gallus)
  misc_feature (36): n=a or g
ataagttgatggcatcagtgtgtgtgtggcacctcngcatcacatgcggtcccctggcccaggcagagccc

SEQ ID NO: 10198 - DNA, 71 bp, chicken (Gallus Gallus)
  misc_feature (36): n=a or g
tactctctgaaactcactaggtagcctttgagagcngacctgatacactgatctgtttctgaatcagacca

SEQ ID NO: 10199 - DNA, 71 bp, chicken (Gallus Gallus)
  misc_feature (36): n=a or g
caagatgcaattgcagtgtttcctccattcaggctnttgctgccatttatgtgtccttgatgcactgatca

SEQ ID NO: 10200 - DNA, 71 bp, chicken (Gallus Gallus)
  misc_feature (36): n=a or g
cagtacctactgtagcagcatgtggtgttttgtggnggatctgtttgtatgccttccccatcccccggata

SEQ ID NO: 10201 - DNA, 71 bp, chicken (Gallus Gallus)
  misc_feature (36): n=a or c
acaaatacaaactatttacagaaatagacaaccttntcacaggcaagaacagccaatatatgcatataaaa

SEQ ID NO: 10202 - DNA, 71 bp, chicken (Gallus Gallus)
  misc_feature (36): n=a or g
tggccttttttgatgttttatttaattaaatggggnaaaaaaaaaaagatgctcaccaaaacacacttaaa

SEQ ID NO: 10203 - DNA, 71 bp, chicken (Gallus Gallus)
  misc_feature (36): n=c or t
ctattgaatttgaagaggaaatgtaaatacctgtgntatatggagatcggtcaaagtgattataacctcat

SEQ ID NO: 10204 - DNA, 71 bp, chicken (Gallus Gallus)
  misc_feature (36): n=a or g
tccatttgcttagtgaatacgtaaggaaagtccttnggcattttgaggtaatttaacaaacctggtagttt

SEQ ID NO: 10205 - DNA, 71 bp, chicken (Gallus Gallus)
  misc_feature (36): n=a or g
actgcaggtaggacaacagctcatcttcttcccttnctttgcaaaaagcaaaataagttccattctctact

SEQ ID NO: 10206 - DNA, 71 bp, chicken (Gallus Gallus)
  misc_feature (36): n=c or t
gtttcatcaaagagatcatctaccatgcctcgttcngctgccacgtcgtcatgattgagtaagtccttctc

SEQ ID NO: 10207 - DNA, 71 bp, chicken (Gallus Gallus)
  misc_feature (36): n=a or g
agttcctgtgatatatgtagatttggaaatgaaggnagaaattatcatctacttatttctctgcttaattt

SEQ ID NO: 10208 - DNA, 71 bp, chicken (Gallus Gallus)
  misc_feature (36): n=g or t
gctgcttctactgtaaaaccaggcagctgctcttanagcactaaaccaatgctactgaacagtttgaaaca

SEQ ID NO: 10209 - DNA, 71 bp, chicken (Gallus Gallus)
  misc_feature (36): n=a or g
ttgatctcgttgagagtaactattgaaagaaaaaanctcaagaggaatggtactgaatttccagtaaaact

SEQ ID NO: 10210 - DNA, 71 bp, chicken (Gallus Gallus)
  misc_feature (36): n=g or t
tgatggatttgaagatgcagccaattcagcacatcngcatgcatctgtacagagtgtgttttttaaaatgg

SEQ ID NO: 10211 - DNA, 71 bp, chicken (Gallus Gallus)
  misc_feature (36): n=a or g
ttctcacacacagcgtggcagcactcagcttgaaancagtgtgatttctgtgatttcttttttttgactgg

SEQ ID NO: 10212 - DNA, 71 bp, chicken (Gallus Gallus)
  misc_feature (36): n=a or g
tctcacaaatttaaaaaaagctgaagaacgcatccntagagtcaagtccactcagaagcttcctgtgtgat

SEQ ID NO: 10213 - DNA, 71 bp, chicken (Gallus Gallus)
  misc_feature (36): n=c or t
gaagtagtggagaaagccgaccactcaaaaacatgngaagtacatgaatgggtgggctaacaaaggagtgg

SEQ ID NO: 10214 - DNA, 71 bp, chicken (Gallus Gallus)
  misc_feature (36): n=a or t
actagtataaaaaaaagaatcaaattaagtctcagnctgtgctcctcatggacttgaacttttaaattaca

SEQ ID NO: 10215 - DNA, 71 bp, chicken (Gallus Gallus)
  misc_feature (36): n=a or g
aaagcgtttgaagtaattcagaggggaacagcaacnctaataactaacacactggactagaattttagaca

SEQ ID NO: 10216 - DNA, 71 bp, chicken (Gallus Gallus)
  misc_feature (36): n=c or t
cacagctcccacctggctttgtcacaatggcttcangtggtaaccaggcccctcaaaatcaatgtccacat

SEQ ID NO: 10217 - DNA, 71 bp, chicken (Gallus Gallus)
  misc_feature (36): n=a or g
agtgggcagcaggttctcttgaaaacttatggcagnactctaaaaccctttttacattccttccaaaatca

SEQ ID NO: 10218 - DNA, 71 bp, chicken (Gallus Gallus)
  misc_feature (36): n=c or t
cattgaaggcaaaagcacaaggctgggtgtaattangtctgcatggatgttgaaagacatttcatttgttg

SEQ ID NO: 10219 - DNA, 71 bp, chicken (Gallus Gallus)
  misc_feature (36): n=a or g
gtgccacatgtaagttctatctttgattttacacgnggcatcatgctctcacaaatagccagaacacaaat

SEQ ID NO: 10220 - DNA, 71 bp, chicken (Gallus Gallus)
  misc_feature (36): n=c or t
ggaggcttagtgccactctgcaccgaggacgataancaaataaaagtaaagcgggtttacgtgctaagtgg

SEQ ID NO: 10221 - DNA, 71 bp, chicken (Gallus Gallus)
  misc_feature (36): n=c or t
tcaaactatctgaaagagttaacagcatatgtacantaaaatttccttacttatgtattaccattttcatc

SEQ ID NO: 10222 - DNA, 71 bp, chicken (Gallus Gallus)
  misc_feature (36): n=a or g
attaagctctttcagaaatggtaccaaaaacatggnatgggaggagcctacgaaaccttaatatgcagcct

SEQ ID NO: 10223 - DNA, 71 bp, chicken (Gallus Gallus)
  misc_feature (36): n=c or t
aatgtttctctgtgaaaaagcagaacagttttcacngctgaaatatggttctgtggtataacactcaatat

SEQ ID NO: 10224 - DNA, 71 bp, chicken (Gallus Gallus)
  misc_feature (36): n=c or g
tgataaaattgagagaaaactgaaggcagctgtttncagccaccaggaaaggagagaatcctataatgaca

SEQ ID NO: 10225 - DNA, 71 bp, chicken (Gallus Gallus)
  misc_feature (36): n=c or g
tgcattgggcacagctttgctctgcatcaaagatgnctctctgcagagtctaggagaaagaacatcagcag

SEQ ID NO: 10226 - DNA, 71 bp, chicken (Gallus Gallus)
  misc_feature (36): n=c or t
ttgattcacaagattcaaagtaatattgtgaagtgncatgtacttcgtggagacttctaggccagcaacat

SEQ ID NO: 10227 - DNA, 71 bp, chicken (Gallus Gallus)
  misc_feature (36): n=g or t
atgtaagaattttattttcataacaaataactgtanttgatttagaaataagatatagctttgaaggacag

SEQ ID NO: 10228 - DNA, 71 bp, chicken (Gallus Gallus)
  misc_feature (36): n=g or t
aacaaatttagattactaggtagagtctatgttgtngaccagtgactgtaaagagagcaatactgtcaaaa

SEQ ID NO: 10229 - DNA, 71 bp, chicken (Gallus Gallus)
  misc_feature (36): n=a or g
tgctatgaaagtatgggagaagtgttacttagattngagctttgttacaattactgaattttacttgagcc

SEQ ID NO: 10230 - DNA, 71 bp, chicken (Gallus Gallus)
  misc_feature (36): n=a or g
acccactgccaacgctaactgagcttgagagcagcngcagtttccaaaaatttatattcctacaagtccat

SEQ ID NO: 10231 - DNA, 71 bp, chicken (Gallus Gallus)
  misc_feature (36): n=a or g
gggttgatctggtcttgtcttcctccttttttgccntgtctctagagcacatttgctttctactcctatct

SEQ ID NO: 10232 - DNA, 71 bp, chicken (Gallus Gallus)
  misc_feature (36): n=c or t
cctgaaatgcaatgtcatgactctgtcagcagccanggtgctaagagtattcttgctctgttggaaccgca

SEQ ID NO: 10233 - DNA, 71 bp, chicken (Gallus Gallus)
  misc_feature (36): n=c or t
catgagcagttccccgtatcaccttataggcagggnatagctgagcagtcattccctcaggcagtatagct

SEQ ID NO: 10234 - DNA, 71 bp, chicken (Gallus Gallus)
  misc_feature (36): n=a or g
ccatcccttggaaatgccagtaagcaggcttaaganaactctcccctagataatgcttttttttttttttt

SEQ ID NO: 10235 - DNA, 71 bp, chicken (Gallus Gallus)
  misc_feature (36): n=g or t
ttttttttaagaggatgggtgagcttttatctaccntgttcattttctacaggcaagggcagcatgtgctc

SEQ ID NO: 10236 - DNA, 71 bp, chicken (Gallus Gallus)
  misc_feature (36): n=c or t
ctctttaaaatagaacaacctgtatctaaagcaaangtcagtcaagctagtttacagttttaattttgatg

SEQ ID NO: 10237 - DNA, 71 bp, chicken (Gallus Gallus)
  misc_feature (36): n=a or g
ctcaatcactgtgtaggacgcaacattttcttctgngagatgctgtctgttgatttatgtagttacaatca

SEQ ID NO: 10238 - DNA, 71 bp, chicken (Gallus Gallus)
  misc_feature (36): n=c or g
tagtgtaagctgttagaaagcttacaatcaagactntgaactatatctataaaaatacagttcttcgttct

SEQ ID NO: 10239 - DNA, 71 bp, chicken (Gallus Gallus)
  misc_feature (36): n=c or t
atggtttttgtgtgtagcactgatgcacaagacctntgacttctaatgtgtttcctggcaagtttttagta

SEQ ID NO: 10240 - DNA, 71 bp, chicken (Gallus Gallus)
  misc_feature (36): n=c or t
caggaatagccaacaatgctgcctacaagtaataanacagcatgacagagaaatttattaacactgttaat

SEQ ID NO: 10241 - DNA, 71 bp, chicken (Gallus Gallus)
  misc_feature (36): n=a or g
aacacttgagagtcatggagacacttcaggatagtncaaacagagtatttcttgaaactctcttattagtg

SEQ ID NO: 10242 - DNA, 71 bp, chicken (Gallus Gallus)
  misc_feature (36): n=a or t
gacatcagctgaatttaaactgacagatttccttcncgtttgttcttgttcgaaacagtagtccttattag

SEQ ID NO: 10243 - DNA, 71 bp, chicken (Gallus Gallus)
  misc_feature (36): n=a or t
attagttagagcagtttctttggcaaagggcaagtnatggagagaaaccattctggtctttctaagggacc

SEQ ID NO: 10244 - DNA, 71 bp, chicken (Gallus Gallus)
  misc_feature (36): n=a or c
tgagcacttgaatttcactgacattctatctgaagngctcagctggtgattcctaaattgtaaaactgaat

SEQ ID NO: 10245 - DNA, 71 bp, chicken (Gallus Gallus)
  misc_feature (36): n=a or t
ggaaagttcttattgatggaccatttagaagaaganaccatcttgtctctcttttatttcatggttctccc

SEQ ID NO: 10246 - DNA, 71 bp, chicken (Gallus Gallus)
  misc_feature (36): n=a or c
agttatattacaagaaagaattccaagttactgaanaagcatcattaatattgctactacttgatgcatcc

SEQ ID NO: 10247 - DNA, 71 bp, chicken (Gallus Gallus)
  misc_feature (36): n=g or t
agaagttccagatatggtgtcgatttcctcctccantactcctagatttacctgaatgtactgttaacaga

SEQ ID NO: 10248 - DNA, 71 bp, chicken (Gallus Gallus)
  misc_feature (36): n=a or g
cagtatctaaagctggggaaaaaaggaggaagggangatattctgcaatctggtatgtcttcccaagtaac

SEQ ID NO: 10249 - DNA, 71 bp, chicken (Gallus Gallus)
  misc_feature (36): n=a or g
attcatttactggatgttcctgctctctgtgaaaancctaatgtcagacttggtctagtagggaagaggat

SEQ ID NO: 10250 - DNA, 71 bp, chicken (Gallus Gallus)
  misc_feature (36): n=c or g
gtcgagtctgagtgcccaacgtgaatgtatacagcncttacacaaggctgctgcgtcaatatttactgctc

SEQ ID NO: 10251 - DNA, 71 bp, chicken (Gallus Gallus)
  misc_feature (36): n=c or g
gatgcaatccaccaaaatcagcattaaaacaaaganatagtacaaaactgagaactgaacccagcccttat

SEQ ID NO: 10252 - DNA, 71 bp, chicken (Gallus Gallus)
  misc_feature (36): n=a or g
tcaatctctgtagaattcctccacattttcaaaagnttgtacccagatacatggatggcatcgaggaatgg

SEQ ID NO: 10253 - DNA, 71 bp, chicken (Gallus Gallus)
  misc_feature (36): n=c or g
ggatcatttcaacagtctgagctagagcacaaccanggcagcaatctgtatgacagacaggaaaagaacag

SEQ ID NO: 10254 - DNA, 71 bp, chicken (Gallus Gallus)
  misc_feature (36): n=a or g
gatacatttcagacatattaggcctgcttttcctcnccataggttagcataagaactgcactaacttcagg

SEQ ID NO: 10255 - DNA, 71 bp, chicken (Gallus Gallus)
  misc_feature (36): n=a or t
ctcagaaaatatctttttaaagccacctcaatacanaccaaaactgagtagatgtgcaaacatctatagac

SEQ ID NO: 10256 - DNA, 71 bp, chicken (Gallus Gallus)
  misc_feature (36): n=c or t
tgcttctgaagagtggtactaaaggttttctgctgntgtgcctgttttgaaagtagcaccaattgagaggg

SEQ ID NO: 10257 - DNA, 71 bp, chicken (Gallus Gallus)
  misc_feature (36): n=c or t
cagcactcaggccagtacagtcatttttctgcgtgnatctgatttatcttggtaggaaatttgttggcaaa

SEQ ID NO: 10258 - DNA, 71 bp, chicken (Gallus Gallus)
  misc_feature (36): n=c or t
gaggcccaggcaaagtggcaattcagaagagactgntgcaatacacaactctaaaagcaacttacctgaag

SEQ ID NO: 10259 - DNA, 71 bp, chicken (Gallus Gallus)
  misc_feature (36): n=c or t
tacttcctccacattgctatcatattttagtcttcnaaaaagtccggaagccctgtgtttagaattaatat

SEQ ID NO: 10260 - DNA, 71 bp, chicken (Gallus Gallus)
  misc_feature (36): n=a or g
ggtctatttatctctcagaataaaatgcatcacttngtaaaggtctaattctgcaatccaaatcaaataca

SEQ ID NO: 10261 - DNA, 71 bp, chicken (Gallus Gallus)
  misc_feature (36): n=g or t
ccaaattagccacgttgattttattctgagtcatgnccttaagccatttgtaaacaggagatctaagacag

SEQ ID NO: 10262 - DNA, 71 bp, chicken (Gallus Gallus)
  misc_feature (36): n=c or t
cctcagtttcttgtgaggggcagcaagggagttatnaaccaaaaatgaagaaatggttttaagccctaagg

SEQ ID NO: 10263 - DNA, 71 bp, chicken (Gallus Gallus)
  misc_feature (36): n=c or t
ttttgtcacaagctggttatttacatggttatttanacttttcacataaattatcagattaacttcaacct

SEQ ID NO: 10264 - DNA, 71 bp, chicken (Gallus Gallus)
  misc_feature (36): n=a or g
aatcttgatatattgcttttttagacatgaggtganaccaaggaagcttcagttgacttttttttttttca

SEQ ID NO: 10265 - DNA, 71 bp, chicken (Gallus Gallus)
  misc_feature (36): n=a or g
tgcatgacaatgtttggggcctttgtgtgtgccctntttggaacagcaactcatgctaaaacttctgtgta

SEQ ID NO: 10266 - DNA, 71 bp, chicken (Gallus Gallus)
  misc_feature (36): n=c or t
atgtcagggctttttcctttttgcttgcagaattanagcaacctgctcccacctgtgctgacacactgaca

SEQ ID NO: 10267 - DNA, 71 bp, chicken (Gallus Gallus)
  misc_feature (36): n=a or g
cctgctttaatccctttttaattaaatgtagagggntgtgatggtatcaggagggtgggagggtggtggcc

SEQ ID NO: 10268 - DNA, 71 bp, chicken (Gallus Gallus)
  misc_feature (36): n=a or g
ttcttgcttcccaccttaaaattatcttacatactngagaaggtacaggagaaagggaaaggatgattcaa

SEQ ID NO: 10269 - DNA, 71 bp, chicken (Gallus Gallus)
  misc_feature (36): n=a or g
ctgtgtctagtaaggattatggagcacatcctcccnaaggccctactaaagcacagggaaaataaagttga

SEQ ID NO: 10270 - DNA, 71 bp, chicken (Gallus Gallus)
  misc_feature (36): n=g or t
gaactgtgtagaacacatagtataaaacatgttcantttctgttttttgtaatgggatggttttaaactgt

SEQ ID NO: 10271 - DNA, 71 bp, chicken (Gallus Gallus)
  misc_feature (36): n=a or c
ctgaatgcatgttaatttgtcagaagcttttggganaaggtgattcctctttggcttctgacagattaaat

SEQ ID NO: 10272 - DNA, 71 bp, chicken (Gallus Gallus)
  misc_feature (36): n=c or t
cattccagcacctgactactctttcagaaaagtagnctttttcataacatctagcctgaacctcccctggc

SEQ ID NO: 10273 - DNA, 71 bp, chicken (Gallus Gallus)
  misc_feature (36): n=g or t
cccctattctggaggaggttgtactgcggttaccantcctccatctcgctcgccgaggcacgaattcacgc

SEQ ID NO: 10274 - DNA, 71 bp, chicken (Gallus Gallus)
  misc_feature (36): n=a or g
cccagtggggatgggaaccaaggagcggtgtcctcncatcaccagcccatacccatctctcacacaggaca

SEQ ID NO: 10275 - DNA, 71 bp, chicken (Gallus Gallus)
  misc_feature (36): n=a or g
taaatgcttctgccgaacttaatgcagctgctctcnagtgttttaatgccttgttattcctgagagaactt

SEQ ID NO: 10276 - DNA, 71 bp, chicken (Gallus Gallus)
  misc_feature (36): n=a or g
atccaattagtcctattaaggccgctagctaacccnaactctgccataagagaggctgtgagctgcatgga

SEQ ID NO: 10277 - DNA, 71 bp, chicken (Gallus Gallus)
  misc_feature (36): n=c or t
ggcacagaccctactccagatgagtggaagcagatngctgctgttatgaaggtatgggcttctgaccgggc

SEQ ID NO: 10278 - DNA, 71 bp, chicken (Gallus Gallus)
  misc_feature (36): n=a or g
tattgcagggatccctatcctctgtggaaacacacnaccgttcccttctctctgaaacacatctgagaagt

SEQ ID NO: 10279 - DNA, 71 bp, chicken (Gallus Gallus)
  misc_feature (36): n=g or t
ccagcatcttccgtgcagctccacacttgagagacnggaacagcaggatggattttgtatttgtgctgtag

SEQ ID NO: 10280 - DNA, 71 bp, chicken (Gallus Gallus)
  misc_feature (36): n=a or t
aaatttctacattccctgaaatccgtaagtgaaacntcaggagcgttagaccttggaggagcctcaacaca

SEQ ID NO: 10281 - DNA, 71 bp, chicken (Gallus Gallus)
  misc_feature (36): n=a or t
gctatgcttctgggaaaaaacccagcttttgcagtnggagctctcctgctccctgcctccacgtgcagaaa

SEQ ID NO: 10282 - DNA, 71 bp, chicken (Gallus Gallus)
  misc_feature (36): n=c or t
gcagtgttgatgtgcaacttcaacctcctactcagntttgagagctgagtttctgtcaactcaccataaaa

SEQ ID NO: 10283 - DNA, 71 bp, chicken (Gallus Gallus)
  misc_feature (36): n=c or t
tgcagggacttagagaacaggtcaaaacccaaaagngttacaaaggtctgagcaaagagatccacatggat

SEQ ID NO: 10284 - DNA, 71 bp, chicken (Gallus Gallus)
  misc_feature (36): n=a or c
aaacatggcatacttttctgtgctgtgtgcacctanaggattttgcacgtactgttagcaaagcaaagcgt

SEQ ID NO: 10285 - DNA, 71 bp, chicken (Gallus Gallus)
  misc_feature (36): n=c or t
tcgccgcgacacgccggaggggctcttggctttagngatgtctaacctcacgtctgtctgctctccccagc

SEQ ID NO: 10286 - DNA, 71 bp, chicken (Gallus Gallus)
  misc_feature (36): n=a or g
ggccaagttatccctgagggagaagagggataagangagaatggaaaaaaaggagctggcgtaaaagctct

SEQ ID NO: 10287 - DNA, 71 bp, chicken (Gallus Gallus)
  misc_feature (36): n=a or g
aggccagcagatagtctctgttccttctctgtgtgnggatctaacgtgcttcgtggtgatgagtgtgcaca

SEQ ID NO: 10288 - DNA, 71 bp, chicken (Gallus Gallus)
  misc_feature (36): n=c or t
tttgaaaaggtggtgatgagtggcttctgaagccgntcttaattaacactaagtacttcccttcagtagct

SEQ ID NO: 10289 - DNA, 71 bp, chicken (Gallus Gallus)
  misc_feature (36): n=c or t
aacctcagcaacaacaaagtgtcggagatcgagganggggcattcgaaggggctgcatccgtcagtgaact

SEQ ID NO: 10290 - DNA, 71 bp, chicken (Gallus Gallus)
  misc_feature (36): n=a or g
agcgctacctgatacaaaatgctttgttctttcctngcgctgcaggcggtggggttaagagttaaaacctt

SEQ ID NO: 10291 - DNA, 71 bp, chicken (Gallus Gallus)
  misc_feature (36): n=a or g
agatctactcgagccctctgctccccgtgctgtgtnctggagcaggatattgccttcccattcgcatgttc

SEQ ID NO: 10292 - DNA, 71 bp, chicken (Gallus Gallus)
  misc_feature (36): n=a or g
atctttccaggagcgaggctgtaatctctacatgcnatttcaggaactgtgaccagcctggtcttgacaca

SEQ ID NO: 10293 - DNA, 71 bp, chicken (Gallus Gallus)
  misc_feature (36): n=a or g
cctggcagtgcagtgatgaagtccctctgtaacatnggcttgaggtacgagtttatatgtccgtgctggta

SEQ ID NO: 10294 - DNA, 71 bp, chicken (Gallus Gallus)
  misc_feature (36): n=c or t
ttcgtaagtgcagcttttctggctttaggcatctcnttcagctgttacgctttgaattgttcccagtttcc

SEQ ID NO: 10295 - DNA, 71 bp, chicken (Gallus Gallus)
  misc_feature (36): n=a or g
gcccatcagccctgcactcgtccctaacattctccnttgctccagcctctatgcaccctgaaacatacaaa

SEQ ID NO: 10296 - DNA, 71 bp, chicken (Gallus Gallus)
  misc_feature (36): n=a or g
tacttgtcatcaaagtccactacgttgacagcagcncggtgccctacgagcaccctccgcagggtgatgtc

SEQ ID NO: 10297 - DNA, 71 bp, chicken (Gallus Gallus)
  misc_feature (36): n=c or t
ttgagtgctttatagtgttacacctcatatgataangcccttcctgaagacaaaagaaaaaaagcaggcag

SEQ ID NO: 10298 - DNA, 71 bp, chicken (Gallus Gallus)
  misc_feature (36): n=a or g
cagaatagatcgtagcattttgtcatttttataccntatgctgcttggcacattaattaataggaaaaata

SEQ ID NO: 10299 - DNA, 71 bp, chicken (Gallus Gallus)
  misc_feature (36): n=c or t
ctgagcactgttaatatcttatcagaaaggctcagntcaaagaagagtttcagggacaatacagaacactg

SEQ ID NO: 10300 - DNA, 71 bp, chicken (Gallus Gallus)
  misc_feature (36): n=c or t
gggtgatgaatttgcaacagctatgtttgcagacangttttaacgtttacgtgacaggctccatcctgatt

SEQ ID NO: 10301 - DNA, 71 bp, chicken (Gallus Gallus)
  misc_feature (36): n=a or g
ctgacttctctggacaagtgcatccctgagctctcngaagcattaagagcccatctgtactgtcaattgga

SEQ ID NO: 10302 - DNA, 71 bp, chicken (Gallus Gallus)
  misc_feature (36): n=c or t
gatacagaccaagcatgatatatgtacttttccccntaaactatctgaaacctttcttccttctgaaattt

SEQ ID NO: 10303 - DNA, 71 bp, chicken (Gallus Gallus)
  misc_feature (36): n=a or g
cccattttcccctagcctggacacagtgctgctggntggaatcctgggcttcagctcatgtgttgctcctg

SEQ ID NO: 10304 - DNA, 71 bp, chicken (Gallus Gallus)
  misc_feature (36): n=c or t
tgtcatctcagggcagcctctctctaccacagcctnctgcttccagccaaacccgatcttctcaacctcag

SEQ ID NO: 10305 - DNA, 71 bp, chicken (Gallus Gallus)
  misc_feature (36): n=c or t
atgccacactacaggatttggaaatatttttattantagagaaaaatatcaacaaacacacactgatttat

SEQ ID NO: 10306 - DNA, 71 bp, chicken (Gallus Gallus)
  misc_feature (36): n=a or g
aaagaaacaaacctgtaggttgaaatgggaataacncattggttactgctgtaactcaactcccaggaatg

SEQ ID NO: 10307 - DNA, 71 bp, chicken (Gallus Gallus)
  misc_feature (36): n=a or g
agataagttgtaagtaaatcagtctttacagcagcnttattacattagaaaacagggagtgggaaattaat

SEQ ID NO: 10308 - DNA, 71 bp, chicken (Gallus Gallus)
  misc_feature (36): n=a or g
gtctaataatctgaatcttaaaacatgcagacgttnttgcctataaaggggtctaagtggagttgaactat

SEQ ID NO: 10309 - DNA, 71 bp, chicken (Gallus Gallus)
  misc_feature (36): n=c or t
ggaggtaatgcaaagctgagcatataactttctgtntttgcccttcacatcaatctagatttcccttggtt

SEQ ID NO: 10310 - DNA, 71 bp, chicken (Gallus Gallus)
  misc_feature (36): n=a or g
aggtggtgactttctggctcatgcattatcaatcanttttgcaataggaacttaatgtctcaattgggctg

SEQ ID NO: 10311 - DNA, 71 bp, chicken (Gallus Gallus)
  misc_feature (36): n=a or g
cagtgaggctccaattcctctcctcagtgaacactncttcccgtcaaataatctgtttctacacttgagca

SEQ ID NO: 10312 - DNA, 71 bp, chicken (Gallus Gallus)
  misc_feature (36): n=g or t
tctccttcctttgtctgcggggtcatgcacatatanaaccaagccagcctctgaacctgaagcagcatcca

SEQ ID NO: 10313 - DNA, 71 bp, chicken (Gallus Gallus)
  misc_feature (36): n=a or g
ctccagggttacgtggagaaccttggtgatgttggnctggctgatgagagctatgatattgtcatgtaggt

SEQ ID NO: 10314 - DNA, 71 bp, chicken (Gallus Gallus)
  misc_feature (36): n=a or g
agaacaagacacttcccctctgcacttattcactcngatgagcactgaaataatttaaacgtcagcattaa

SEQ ID NO: 10315 - DNA, 71 bp, chicken (Gallus Gallus)
  misc_feature (36): n=a or g
ctgcagtgctgactaactgcaggtgggtggaaaagnatggagtggtgagggccccctttctccacccaacc

SEQ ID NO: 10316 - DNA, 71 bp, chicken (Gallus Gallus)
  misc_feature (36): n=c or t
aagtttctacttgaaatgatgtccacgtcacagctnccattggctcagtagtgaagacaatttcttacaac

SEQ ID NO: 10317 - DNA, 71 bp, chicken (Gallus Gallus)
  misc_feature (36): n=c or t
gctgtggggttgatccctattagtgttgctgtctgnttgttttttctccctatatatccctctctaaatta

SEQ ID NO: 10318 - DNA, 71 bp, chicken (Gallus Gallus)
  misc_feature (36): n=c or t
gcttagagcatgcatcagtcggggagagtgaccttnggcatgagctgaaatgttaaatcctagtgaaaatg

SEQ ID NO: 10319 - DNA, 71 bp, chicken (Gallus Gallus)
  misc_feature (36): n=a or g
atttgcttctcactgcaagttgtagaaatgcatccnaaactcttgggtattccacgtatggacaagaatga

SEQ ID NO: 10320 - DNA, 71 bp, chicken (Gallus Gallus)
  misc_feature (36): n=c or t
actagagtagctgaagctctgctcagtcactgcagnaaagaggtctgcctgcctgcagctattcaccctct

SEQ ID NO: 10321 - DNA, 71 bp, chicken (Gallus Gallus)
  misc_feature (36): n=a or t
ccttggctgttaccaagctggaggagctcccaaacntactaacaccatgcaaaaacaggagtgatatggag

SEQ ID NO: 10322 - DNA, 71 bp, chicken (Gallus Gallus)
  misc_feature (36): n=a or c
cccaaatccttccttttaaatgcatgctcaataagnctggtgggcagataaaacacctttgtcatcctctt

SEQ ID NO: 10323 - DNA, 71 bp, chicken (Gallus Gallus)
  misc_feature (36): n=a or t
gaagccctagcttagaactggattaagatctatgangatgatctaaaagcctgcagcagctgacgctggct

SEQ ID NO: 10324 - DNA, 71 bp, chicken (Gallus Gallus)
  misc_feature (36): n=a or g
gagtgagtatgctcatgtctgctgtttgtgttcagncagataggtcactctggagtggctcacttcagagt

SEQ ID NO: 10325 - DNA, 71 bp, chicken (Gallus Gallus)
  misc_feature (36): n=a or g
gatcttggtcagcagcagtccctaggagaaaaagtnaggctgatgaaacaagtgaaagagaaggaagaact

SEQ ID NO: 10326 - DNA, 71 bp, chicken (Gallus Gallus)
  misc_feature (36): n=g or t
ttaaagtactaaatgagactcctgaattatgacttntatcattattatagataaaaattcttctaaatttc

SEQ ID NO: 10327 - DNA, 71 bp, chicken (Gallus Gallus)
  misc_feature (36): n=a or t
atagctaaattacaagaagagcttatttcttctgtnctcattttgtgaggcttgcttagctcttgcaactc

SEQ ID NO: 10328 - DNA, 71 bp, chicken (Gallus Gallus)
  misc_feature (36): n=c or t
aataggtgaaagaaattagggagaaaccctctgtgnctgagaggacatgttgctcggaattaaacccaagt

SEQ ID NO: 10329 - DNA, 71 bp, chicken (Gallus Gallus)
  misc_feature (36): n=a or g
atgcatctattatttgtctgctaaagtcttgggccngttgatggttctttgatggcgacacaagtatggtg

SEQ ID NO: 10330 - DNA, 71 bp, chicken (Gallus Gallus)
  misc_feature (36): n=a or g
ttctctgctggtaacaaacacatgccacagtgactntgtagggaggatatttggatttgtcatcggcttca

SEQ ID NO: 10331 - DNA, 71 bp, chicken (Gallus Gallus)
  misc_feature (36): n=a or c
atgtctcctgtgttttattgctgtccttaaaaaggnagctaattcaccatgcctttctcagaggctctctc

SEQ ID NO: 10332 - DNA, 71 bp, chicken (Gallus Gallus)
  misc_feature (36): n=c or t
aaaatgggtaatctctgagcatgagagaagtgcttnttgctttctgagatgggacaaagtattttatttga

SEQ ID NO: 10333 - DNA, 71 bp, chicken (Gallus Gallus)
  misc_feature (36): n=a or g
cagttgcgcagatgatcctttggaacagaactacanaatcttgtttaggcatttttaaatctttttatttt

SEQ ID NO: 10334 - DNA, 71 bp, chicken (Gallus Gallus)
  misc_feature (36): n=g or t
ccctgatgggctgaaaaatatgtcccctagtgaggntagttgtgtaccagcagaatagactgcccagagaa

SEQ ID NO: 10335 - DNA, 71 bp, chicken (Gallus Gallus)
  misc_feature (36): n=a or t
cttcctctcatctttttactttggggagtgtctggnaagggaggctaggtggaagggatggggcacaaggc

SEQ ID NO: 10336 - DNA, 71 bp, chicken (Gallus Gallus)
  misc_feature (36): n=a or c
gtgagtgtgtacttgcctgctgtagattggctatgnagtctgaagcaaaacaattgatgtgtctgttactc

SEQ ID NO: 10337 - DNA, 71 bp, chicken (Gallus Gallus)
  misc_feature (36): n=c or t
tactttaacattaaaaaacttttgttttcattcatntacaaaaatggcactgcaaagatcatatttgtata

SEQ ID NO: 10338 - DNA, 71 bp, chicken (Gallus Gallus)
  misc_feature (36): n=c or t
tgtgtatgtggaagtaacattgttaaaagcagacangatagaatacagtctctcacataacagatgcagac

SEQ ID NO: 10339 - DNA, 71 bp, chicken (Gallus Gallus)
  misc_feature (36): n=c or t
aggtaattcctcccctctcctgccccagtgaagcanggtgctgccagcatagttaatacatctcactgaaa

SEQ ID NO: 10340 - DNA, 71 bp, chicken (Gallus Gallus)
  misc_feature (36): n=a or g
aggcttgtcatacactgaagtaagttacaagaaagnaaagcactatgtattttacgtacacttgaaaaaaa

SEQ ID NO: 10341 - DNA, 71 bp, chicken (Gallus Gallus)
  misc_feature (36): n=c or t
ctggtagaagaccactgatatatcccacctccaggnaggagaaaatgaatatgatgctgtggataaggata

SEQ ID NO: 10342 - DNA, 71 bp, chicken (Gallus Gallus)
  misc_feature (36): n=a or c
gtgaatcagattggaatccccaaagtcaaattctcntagttcacattctgggtcagctccatgagttaatg

SEQ ID NO: 10343 - DNA, 71 bp, chicken (Gallus Gallus)
  misc_feature (36): n=c or t
agatcaagaggcactggtggccgtttctgtaatatntttagtaattatttctctagttagctgacttcctc

SEQ ID NO: 10344 - DNA, 71 bp, chicken (Gallus Gallus)
  misc_feature (36): n=a or t
atagcccactgttcttctaaaatatgagtcatctcnccagtttggttcagctacagatctcacatatcaga

SEQ ID NO: 10345 - DNA, 71 bp, chicken (Gallus Gallus)
  misc_feature (36): n=a or c
gattaccattcagaaatttactaaagcttcaccttntagtccagttactgtcttacctctctctgatctcc

SEQ ID NO: 10346 - DNA, 71 bp, chicken (Gallus Gallus)
  misc_feature (36): n=a or g
ttgtactttcacacgaaagtccagttatctcagggnaggcaggaagctctttcctgttacatcattaaccc

SEQ ID NO: 10347 - DNA, 71 bp, chicken (Gallus Gallus)
  misc_feature (36): n=a or c
ctgcatgccaaagtctggtttacagttgatgcttcngcaacatctccttttccacattcagctccatggac

SEQ ID NO: 10348 - DNA, 71 bp, chicken (Gallus Gallus)
  misc_feature (36): n=a or t
ataactggaagtcagtattatgccttcagtctgatnaatctctgcatatcataataatttctcaaaaaaca

SEQ ID NO: 10349 - DNA, 71 bp, chicken (Gallus Gallus)
  misc_feature (36): n=a or g
ttaattgttgctttccagaccaagattcctggtcanttcaatttttccttctatataaatctctccatata

SEQ ID NO: 10350 - DNA, 71 bp, chicken (Gallus Gallus)
  misc_feature (36): n=a or g
aagaaactgtctattactgcagataagcagaatggntgccagctatccggatggaatgaggaacgaggctg

SEQ ID NO: 10351 - DNA, 71 bp, chicken (Gallus Gallus)
  misc_feature (36): n=c or g
caaagttacatgcaaacatgtaacacaacagatgantccccttacctctgttcaagggccttaaatgcaga

SEQ ID NO: 10352 - DNA, 71 bp, chicken (Gallus Gallus)
  misc_feature (36): n=c or t
tactgaaagtggattttggaataaaggtggtggcanggtcactttctaagaagtatggccaaacgataaga

SEQ ID NO: 10353 - DNA, 71 bp, chicken (Gallus Gallus)
  misc_feature (36): n=c or t
aataacccatgtttctctggctaggtcgcagtgtangagaggatgcagcattcagtccaaactggaaataa

SEQ ID NO: 10354 - DNA, 71 bp, chicken (Gallus Gallus)
  misc_feature (36): n=a or c
gtctccctccccatccttaacaacaacaacaacaanaaattagtgttggagaatagttttaaaggtttttg

SEQ ID NO: 10355 - DNA, 71 bp, chicken (Gallus Gallus)
  misc_feature (36): n=a or g
acaaaaaacccaaagaacgactcaacttgtaaaaanaatgaagccaatcactacaggattttttttttttt

SEQ ID NO: 10356 - DNA, 71 bp, chicken (Gallus Gallus)
  misc_feature (36): n=a or t
tgcatacacaaaggaaagatgaatacacggagagcnttaaggaaagatttaatgagaaaatataagaacat

SEQ ID NO: 10357 - DNA, 71 bp, chicken (Gallus Gallus)
  misc_feature (36): n=c or t
ctccacccccagtgggcccaggtgggatcagggctncaacagaggacatgcaaggagaaaaaccatcttta

SEQ ID NO: 10358 - DNA, 71 bp, chicken (Gallus Gallus)
  misc_feature (36): n=c or g
catgcattacactggagtgtctgtggctcagttcantctcttttggcaatagaaaggaaggaaaaaaaaaa

SEQ ID NO: 10359 - DNA, 71 bp, chicken (Gallus Gallus)
  misc_feature (36): n=a or g
ttaaaaaaactggttacagtggaacagccaccctgnaatgcaatggctgaacttcatactatcctctagtt

SEQ ID NO: 10360 - DNA, 71 bp, chicken (Gallus Gallus)
  misc_feature (36): n=c or t
aaagtacttatgcgcttgcccagctcttggtatctngggaccatcctgtatgtcagcatgactagttggtc

SEQ ID NO: 10361 - DNA, 71 bp, chicken (Gallus Gallus)
  misc_feature (36): n=c or g
gaaaacacacccaaacccttcagttgctttcatctntaagaaaatgggagaaagaaacagcacactgacct

SEQ ID NO: 10362 - DNA, 71 bp, chicken (Gallus Gallus)
  misc_feature (36): n=a or c
atctggatctacccagtcttttgatgcgtgcgttcnctcatgttaaatcctgaagcagtaaagggtgagac

SEQ ID NO: 10363 - DNA, 71 bp, chicken (Gallus Gallus)
  misc_feature (36): n=a or g
agaattttgggtgcttgtcccttctctgaagtgtgnacctctgctatttatagacaccggttttaatgctg

SEQ ID NO: 10364 - DNA, 71 bp, chicken (Gallus Gallus)
  misc_feature (36): n=c or t
ggtctgttgctgtgatgcagctgctgtaaaaacaangaagcataacaggcatgaaaaccaaacagggacat

SEQ ID NO: 10365 - DNA, 71 bp, chicken (Gallus Gallus)
  misc_feature (36): n=c or t
atcaacttcactcaaatcccttgaaaatgaaagttnagtcagagcccagtgagtcaaaacctggtctgtac

SEQ ID NO: 10366 - DNA, 71 bp, chicken (Gallus Gallus)
  misc_feature (36): n=c or t
attttgatgtgttggtttatctcttttgtttgccanactgttgattttttcttttttttttcttttttttt

SEQ ID NO: 10367 - DNA, 71 bp, chicken (Gallus Gallus)
  misc_feature (36): n=c or t
aaggatgccgatgggctatggattcccttattcatncacttgttactgcaaccaaagccttgcattaatgc

SEQ ID NO: 10368 - DNA, 71 bp, chicken (Gallus Gallus)
  misc_feature (36): n=a or g
cgaattggtaaccagatcatacctttttgtattgtnatttttgaccataggttttgtgtttctgtacccct

SEQ ID NO: 10369 - DNA, 71 bp, chicken (Gallus Gallus)
  misc_feature (36): n=g or t
aaagcaccccagatcagctgctcagctgttgtgaancagtacagagctagtgaaaaacgcccagcatgagg

SEQ ID NO: 10370 - DNA, 71 bp, chicken (Gallus Gallus)
  misc_feature (36): n=c or t
gcacaccagcacgctgttacatagaaaaaagtgcanaacccttgtttgctgtagtacattggcaatatgag

SEQ ID NO: 10371 - DNA, 71 bp, chicken (Gallus Gallus)
  misc_feature (36): n=a or t
aacaccaagcaaaagattatttcaagatatctaggntgatactaatttaatctaacagttttaaatcctga

SEQ ID NO: 10372 - DNA, 71 bp, chicken (Gallus Gallus)
  misc_feature (36): n=g or t
gtgagcactttttaaaggtcaggaaatatcatcctntctttcctcttgtcagtcagaagggctggattgct

SEQ ID NO: 10373 - DNA, 71 bp, chicken (Gallus Gallus)
  misc_feature (36): n=g or t
ccaaattcaaggtcattgcctttctctttcctctcnttgtagatggaagttacctatctgtatttttcctc

SEQ ID NO: 10374 - DNA, 71 bp, chicken (Gallus Gallus)
  misc_feature (36): n=a or g
aaagtcctgttctagctagctccaagtatactgtcntaactgcaggatgatcagtccttttttcagttttt

SEQ ID NO: 10375 - DNA, 71 bp, chicken (Gallus Gallus)
  misc_feature (36): n=c or t
tctgaaggagaaaggattcaactttttctgctgttnctgtgctagtggtggggctgctcagacacagatgt

SEQ ID NO: 10376 - DNA, 71 bp, chicken (Gallus Gallus)
  misc_feature (36): n=c or t
ttttgggttgagtttgtctttagatgcattgtgganctcattcctctcaaaaggacacagaaagcagctgt

SEQ ID NO: 10377 - DNA, 71 bp, chicken (Gallus Gallus)
  misc_feature (36): n=c or t
aaaaccatctgctctatttaaagcatagcagaattnttaattgcgagttaaagattgttttgctgtagaaa

SEQ ID NO: 10378 - DNA, 71 bp, chicken (Gallus Gallus)
  misc_feature (36): n=c or t
gcagagcacttgcagaggactgggctcctattgtgntttttgctatcttgagcattgggtgcttcatcaaa

SEQ ID NO: 10379 - DNA, 71 bp, chicken (Gallus Gallus)
  misc_feature (36): n=a or g
ggtgaagctgatctgagcaagctttttcaggcatgngggaaatcctttgccagctttgtgtgtgatgttgg

SEQ ID NO: 10380 - DNA, 71 bp, chicken (Gallus Gallus)
  misc_feature (36): n=a or g
agtgtttggttatctcttgtgctcgcatgagcttcnccaggcatactagattgaaaaaaaaaaaattagca

SEQ ID NO: 10381 - DNA, 71 bp, chicken (Gallus Gallus)
  misc_feature (36): n=a or g
taattagaatgcaagaagcctgaggaaagaagcacntcagaactggtcaaattaacacaactgttattgtt

SEQ ID NO: 10382 - DNA, 71 bp, chicken (Gallus Gallus)
  misc_feature (36): n=c or t
ggggagacttcacaaacctgtccttatcatcaaagnaagtcctgcccttctgggcatgctggaaagctgag

SEQ ID NO: 10383 - DNA, 71 bp, chicken (Gallus Gallus)
  misc_feature (36): n=a or g
tgaatatgaattcaagttttattttatttgcatacnatttgacaaaaggcaaatagcatggaagtgaagtc

SEQ ID NO: 10384 - DNA, 71 bp, chicken (Gallus Gallus)
  misc_feature (36): n=c or t
agaaatatttatggctggcgtgttaagatttcagtntcgatgcgacaatattaattctttgctaatcttta

SEQ ID NO: 10385 - DNA, 71 bp, chicken (Gallus Gallus)
  misc_feature (36): n=a or g
ttatttgtaaacatacagactcctttgagctgtacnctcaaatcccagcctggtcaaccaaagtgctttta

SEQ ID NO: 10386 - DNA, 71 bp, chicken (Gallus Gallus)
  misc_feature (36): n=c or t
caacaaccagcagtgagaaaatattggtaatggacngggtaaatagtggtaaaaaaaaatccctttatgaa

SEQ ID NO: 10387 - DNA, 71 bp, chicken (Gallus Gallus)
  misc_feature (36): n=a or g
ccatttttttttttattttttttttctgcatggagnaatttaatgtcacacctttccttcatacacacttc

SEQ ID NO: 10388 - DNA, 71 bp, chicken (Gallus Gallus)
  misc_feature (36): n=c or g
aggacatcttgaacccacgtcagcttcttttttttnttctttcctgcttgcaaggcctggctgaagtaaaa

SEQ ID NO: 10389 - DNA, 71 bp, chicken (Gallus Gallus)
  misc_feature (36): n=c or t
gagcgactgctcgcttaagacttggactgttagacngcatactgcgtaggtgggctttgggacacctcaga

SEQ ID NO: 10390 - DNA, 71 bp, chicken (Gallus Gallus)
  misc_feature (36): n=a or t
atttcaacaatgaaaacatgcacaaaacacatttcnatctcatgaagtgggttgttcctcgctggaaagca

SEQ ID NO: 10391 - DNA, 71 bp, chicken (Gallus Gallus)
  misc_feature (36): n=a or g
ctattttgttgaattaccttcctttgaagatcctgntgatacaacaactcaacatgtaggcagtgttcatt

SEQ ID NO: 10392 - DNA, 71 bp, chicken (Gallus Gallus)
  misc_feature (36): n=a or t
tgagtcaggggcacaacagtcattccttcaacaaantcagcctacatttcatctttggataaatttgcagg

SEQ ID NO: 10393 - DNA, 71 bp, chicken (Gallus Gallus)
  misc_feature (36): n=a or t
ttacttagataagtctgtgtaaatatgtaactgtgntaacattccaaacagacttgcttaatgcaactctg

SEQ ID NO: 10394 - DNA, 71 bp, chicken (Gallus Gallus)
  misc_feature (36): n=c or t
tagggatagaattttgaaaatcaaaaccaatccagntggatctggtgatcagaaagactaaggaaaacatg

SEQ ID NO: 10395 - DNA, 71 bp, chicken (Gallus Gallus)
  misc_feature (36): n=a or g
gttgtgcttatctctttggccagacaatagcggtcnggctgggaaacttctacctcaaactgtgcatattg

SEQ ID NO: 10396 - DNA, 71 bp, chicken (Gallus Gallus)
  misc_feature (36): n=c or t
catttcagtgtgaaagaagggagcagaaagaatcanactggtaatcttaaataaatactggcactgaattt

SEQ ID NO: 10397 - DNA, 71 bp, chicken (Gallus Gallus)
  misc_feature (36): n=a or c
aaagtgaaatggaggtttaatcaacaccaagcctgnaagtgatttctggttttgtctgatctgttatggtt

SEQ ID NO: 10398 - DNA, 71 bp, chicken (Gallus Gallus)
  misc_feature (36): n=a or c
cttccttttctctgcctgtcactgcagtattactgngctctatcagagagttgcagtgcagtagctgtatt

SEQ ID NO: 10399 - DNA, 71 bp, chicken (Gallus Gallus)
  misc_feature (36): n=a or t
cacacacgcaaattaaaagtgaaatggaggtttaancaacaccaagcctgcaagtgatttctggttttgtc

SEQ ID NO: 10400 - DNA, 71 bp, chicken (Gallus Gallus)
  misc_feature (36): n=c or t
gttgataattagatgctgttgcttttcctttagctngggaatattctctagcacagcatgttgttcattca

SEQ ID NO: 10401 - DNA, 71 bp, chicken (Gallus Gallus)
  misc_feature (36): n=g or t
aagacgctttatagggagttgggtgaggtctcagantctctccccattgttcttgtggagtacttcaactt

SEQ ID NO: 10402 - DNA, 71 bp, chicken (Gallus Gallus)
  misc_feature (36): n=c or t
agaaaatccatatggcagggagctcctagctgaatnaacaaagcttgtcaggcttgtctgtctgatgagca

SEQ ID NO: 10403 - DNA, 71 bp, chicken (Gallus Gallus)
  misc_feature (36): n=a or g
gagttgcatcaaatcagggtggcaaggctgcaaacntgcattatggagtctgactcaggtccaagagaacc

SEQ ID NO: 10404 - DNA, 71 bp, chicken (Gallus Gallus)
  misc_feature (36): n=a or g
gtttttccagaatgcaatctcttcagatgaaattantaccgtgatttccatctgcttcctcctcaacacaa

SEQ ID NO: 10405 - DNA, 71 bp, chicken (Gallus Gallus)
  misc_feature (36): n=a or t
tcctctaacattgtcctctttttaatacttaagccngtgtaactatacatgggaaaactggaatctatcaa

SEQ ID NO: 10406 - DNA, 71 bp, chicken (Gallus Gallus)
  misc_feature (36): n=c or t
tgcccacgcaaaatgggtaatgggagcctgagacangctgctgaacctcccagcaacaggggcacttcagc

SEQ ID NO: 10407 - DNA, 71 bp, chicken (Gallus Gallus)
  misc_feature (36): n=a or g
agccacaagtctgtcctggaaatcactggacacaanccaaattcggcagtgccctacctacaaaacacagc

SEQ ID NO: 10408 - DNA, 71 bp, chicken (Gallus Gallus)
  misc_feature (36): n=a or g
ctttattttttattttattttagaataaatggtgcnattttactatagcattatttttccagcctgtgttc

SEQ ID NO: 10409 - DNA, 71 bp, chicken (Gallus Gallus)
  misc_feature (36): n=a or g
ctcaaccagagtattaaaaacacactcatacagatncacagagagatgtaagcactgacacagcatctggt

SEQ ID NO: 10410 - DNA, 71 bp, chicken (Gallus Gallus)
  misc_feature (36): n=a or g
ggcctgagtcatcaacagaaatggctgagctatttntgctttttgaaggcaagattgcccagagataaagc

SEQ ID NO: 10411 - DNA, 71 bp, chicken (Gallus Gallus)
  misc_feature (36): n=c or t
aaaatcagtaaattggatgtaaataggatactgtangtaacagtttaatgatacttgagtgtgcagaaata

SEQ ID NO: 10412 - DNA, 71 bp, chicken (Gallus Gallus)
  misc_feature (36): n=a or g
gattagtggctgctatttcatgatgcaggtagattngagaagagctagaggtgggaggtctggaaaatgag

SEQ ID NO: 10413 - DNA, 71 bp, chicken (Gallus Gallus)
  misc_feature (36): n=c or t
gattagcttcagaaatggctgtgatgcttgtgttangctttttgtcacggatgtgggctttttgcaattat

SEQ ID NO: 10414 - DNA, 71 bp, chicken (Gallus Gallus)
  misc_feature (36): n=a or g
gctctttaaggtacaatgtaaatcatatctgtgtcntatttctccatagaactatcagtggtcatccttat

SEQ ID NO: 10415 - DNA, 71 bp, chicken (Gallus Gallus)
  misc_feature (36): n=c or t
cccacaaatgtcatcgcttacatctgcttatactgnagagtgtcctacctgaaacctctcacaaagttttt

SEQ ID NO: 10416 - DNA, 71 bp, chicken (Gallus Gallus)
  misc_feature (36): n=c or g
tcctcttcagttatcccaatctatcagtctctcaanaatgtctgttactgtccagcaaagagaaagtacac

SEQ ID NO: 10417 - DNA, 71 bp, chicken (Gallus Gallus)
  misc_feature (36): n=c or t
ttctcctaatcctgtagctgagttctgcaggtgcanagatgtatctgcagaactcagagggctgaaatttt

SEQ ID NO: 10418 - DNA, 71 bp, chicken (Gallus Gallus)
  misc_feature (36): n=a or g
aattcttgttcatacttttaaaagcaaatttcatgntatttaaatgttaacatttgtttgacctcagtcag

SEQ ID NO: 10419 - DNA, 71 bp, chicken (Gallus Gallus)
  misc_feature (36): n=a or g
ttacggcactgtcagtgtcttcaaataaccatgacnaattcaaatataaagtctgacatttggaaggcaaa

SEQ ID NO: 10420 - DNA, 71 bp, chicken (Gallus Gallus)
  misc_feature (36): n=a or c
tgattacttataaaatgctgctctgtaaagggagantctggcctggggaactcattaaaaagaaatacttt

SEQ ID NO: 10421 - DNA, 71 bp, chicken (Gallus Gallus)
  misc_feature (36): n=c or t
attagaaagttgactaaaatgtaagctgtcagttgnctgttttttttcatatttattacagcttgcaatac

SEQ ID NO: 10422 - DNA, 71 bp, chicken (Gallus Gallus)
  misc_feature (36): n=c or t
tccttttttgttggtgcatgttgtaggttttctttnaataaagactgtgaattacgttcccacttcagaac

SEQ ID NO: 10423 - DNA, 71 bp, chicken (Gallus Gallus)
  misc_feature (36): n=a or t
ttcactatacagaaagtataataaatgcttacaganagtatattaaaatgcttttactgtattataattca

SEQ ID NO: 10424 - DNA, 71 bp, chicken (Gallus Gallus)
  misc_feature (36): n=c or t
ccatcagtgacgttaacaataaaaaataaatagaangtttctctgtgaggggaaaagacattttattacac

SEQ ID NO: 10425 - DNA, 71 bp, chicken (Gallus Gallus)
  misc_feature (36): n=c or t
gctcctgctgcacagcagaggtgacccagtccagtnatagcctgcaatacgcttgctgcatacgaagctga

SEQ ID NO: 10426 - DNA, 71 bp, chicken (Gallus Gallus)
  misc_feature (36): n=c or t
gcacacaagcacaggttatcctccatcccatcacangtgctccagcacctgaacctgccagctgttcttct

SEQ ID NO: 10427 - DNA, 71 bp, chicken (Gallus Gallus)
  misc_feature (36): n=c or t
ttgtcaatacttatttgaatttgaatacttatatgnagtattcattagcctctggatgccatcctttctat

SEQ ID NO: 10428 - DNA, 71 bp, chicken (Gallus Gallus)
  misc_feature (36): n=c or t
ttggtgaataggtataggtaaattattataggtagnagagttaaatcagaagcagggtatatatattaaat

SEQ ID NO: 10429 - DNA, 71 bp, chicken (Gallus Gallus)
  misc_feature (36): n=c or t
aactttctccaaaatattgatcatgtaactgaaaangtgacatccatattctgtctcagtctccctccaag

SEQ ID NO: 10430 - DNA, 71 bp, chicken (Gallus Gallus)
  misc_feature (36): n=c or t
gtctcactaaaatataactgagaaactgtctgttcnttttgcagttccaataataaccagatcaggtcttt

SEQ ID NO: 10431 - DNA, 71 bp, chicken (Gallus Gallus)
  misc_feature (36): n=a or g
ctacttttgttaattgcaggctaaaacaaagttccnactcataagactgagcatatcagaattttttttaa

SEQ ID NO: 10432 - DNA, 71 bp, chicken (Gallus Gallus)
  misc_feature (36): n=a or g
aagagtaggggggaactgggaaatccttggtccacncattgtattaataacatcttgtaatagcaggatca

SEQ ID NO: 10433 - DNA, 71 bp, chicken (Gallus Gallus)
  misc_feature (36): n=a or c
ggttcagatccttgtgtacagagcccgactgggaangaagtgctgtcatttcccattaacagtgatgcagc

SEQ ID NO: 10434 - DNA, 71 bp, chicken (Gallus Gallus)
  misc_feature (36): n=g or t
ctcctccttccatctgagcatggtttctttctcagngagttaaatttggaattgcgtgccccatactagag

SEQ ID NO: 10435 - DNA, 71 bp, chicken (Gallus Gallus)
  misc_feature (36): n=a or g
ctggagatctaatggccagttagttttgtcattctntttcttactccagtttaatttaacagcccagattc

SEQ ID NO: 10436 - DNA, 71 bp, chicken (Gallus Gallus)
  misc_feature (36): n=c or t
aagcatctaatgatgagaaatcagggtaatgatgtnatctaacaacactgagtcattgcattatctgcttc

SEQ ID NO: 10437 - DNA, 71 bp, chicken (Gallus Gallus)
  misc_feature (36): n=g or t
ctgggagttgtacccccctgagagccacaggaccanatgccatgtgatgtacctgtgaaatagtcctcaga

SEQ ID NO: 10438 - DNA, 71 bp, chicken (Gallus Gallus)
  misc_feature (36): n=a or g
catgtacctgcatgggaagccaaattccaacccccntagctttcttcagcccagcagaatgcagctctgag

SEQ ID NO: 10439 - DNA, 71 bp, chicken (Gallus Gallus)
  misc_feature (36): n=c or g
gctgtgttttgtttcatgccgtgtggcttccacagngcacatccctgcgcgtttcggtgctggggagcgcg

SEQ ID NO: 10440 - DNA, 71 bp, chicken (Gallus Gallus)
  misc_feature (36): n=c or t
cccaacctgtattgggaagaacacataattctgtangtttgatgtcttactatgcatttatggcacagagg

SEQ ID NO: 10441 - DNA, 71 bp, chicken (Gallus Gallus)
  misc_feature (36): n=a or g
gcagaatcctcatttctgtacatcttttgaagagcntaagtatgttttccaccactcagtcgagttccctc

SEQ ID NO: 10442 - DNA, 71 bp, chicken (Gallus Gallus)
  misc_feature (36): n=c or g
gaggttctctacaaggaatctcccagttctgctttnttgtcagatagaagaaagtgaatgttacagagctc

SEQ ID NO: 10443 - DNA, 71 bp, chicken (Gallus Gallus)
  misc_feature (36): n=a or g
ttcttttttttttaaatctgattcacagaattacanatttcagagcttataaactgtatgcatttagaaat

SEQ ID NO: 10444 - DNA, 71 bp, chicken (Gallus Gallus)
  misc_feature (36): n=c or t
tagtgttaaaaagtaaaataccagaatttgggattntctgtagcatgagaatgcctttccagagcagcctg

SEQ ID NO: 10445 - DNA, 71 bp, chicken (Gallus Gallus)
  misc_feature (36): n=a or c
tacccctctcggaagcagaactcccacccgcccacntctaggggtgttgcttgaaagcacttgtgtgaggc

SEQ ID NO: 10446 - DNA, 71 bp, chicken (Gallus Gallus)
  misc_feature (36): n=a or c
ataaacagggtggagttagagggcaataacttccanaggagtgctgacgaaacaagtaacactgtagctag

SEQ ID NO: 10447 - DNA, 71 bp, chicken (Gallus Gallus)
  misc_feature (36): n=c or t
cacagaggtgccccaaatttgtggggttcaggtacnataaaaacactcatggtttgggcctccctgagagg

SEQ ID NO: 10448 - DNA, 71 bp, chicken (Gallus Gallus)
  misc_feature (36): n=a or g
ttacaaaactcttcgcatatctgcaggcactcagangttgtttagaaaaatacactacagacagtaggaga

SEQ ID NO: 10449 - DNA, 71 bp, chicken (Gallus Gallus)
  misc_feature (36): n=g or t
tctgtggctgaggaactctgcttccagcctgtctanaggtgaggtctctgctcagcataatagcagagctg

SEQ ID NO: 10450 - DNA, 71 bp, chicken (Gallus Gallus)
  misc_feature (36): n=c or t
atatatatacatatatatgtatgaaagcaagggctngtaattcaagtagcttgtctggaggaaagatttgt

SEQ ID NO: 10451 - DNA, 71 bp, chicken (Gallus Gallus)
  misc_feature (36): n=a or g
taatcatcacaagtctttcgttctgatgcatgatcngcaagaactatgaatgctaacatatgctgaaagtt

SEQ ID NO: 10452 - DNA, 71 bp, chicken (Gallus Gallus)
  misc_feature (36): n=c or t
ctatctgcgtgctgtgctccgagcatctaatttacnttctgcttggcagccgtgcttcttatctgttcatt

SEQ ID NO: 10453 - DNA, 71 bp, chicken (Gallus Gallus)
  misc_feature (36): n=g or t
gacttcaaaacagttttgcaagcaaaataatgttanttttgcaagagattcctggtttttaagtgcccttc

SEQ ID NO: 10454 - DNA, 71 bp, chicken (Gallus Gallus)
  misc_feature (36): n=c or t
gtaattatcataacaaattgactcatttaaatacanagttattaggattgtatggtcaattcgactattta

SEQ ID NO: 10455 - DNA, 71 bp, chicken (Gallus Gallus)
  misc_feature (36): n=a or t
gaaggatgtagcaaaccacataattaatgtagaganttttaacctcatttgttgagaggtgatagaaaccg

SEQ ID NO: 10456 - DNA, 71 bp, chicken (Gallus Gallus)
  misc_feature (36): n=a or g
gctccttaaccggggtaacgggagtgtagacctacnaaggtgtgaaaagatgctgctaagggggatattga

SEQ ID NO: 10457 - DNA, 71 bp, chicken (Gallus Gallus)
  misc_feature (36): n=a or g
caattttacgaactgtgagaacatgaagacaccacntcatttttttttatgaaaaggatttgaacagcgct

SEQ ID NO: 10458 - DNA, 71 bp, chicken (Gallus Gallus)
  misc_feature (36): n=a or c
atctttttcttgtgattttaggagttcagaggaaangccagagcgccccatgaacaaaatggcagtacaga

SEQ ID NO: 10459 - DNA, 71 bp, chicken (Gallus Gallus)
  misc_feature (36): n=a or g
gtttatgtggaaatatttttaaaatcactgaaacantttggtactatgtgagcgaatctaatgaaccctac

SEQ ID NO: 10460 - DNA, 71 bp, chicken (Gallus Gallus)
  misc_feature (36): n=a or g
gaatattcctaaacaaaaggttgttactgggatgantacagacacatttaaaggctggacagaagcaattc

SEQ ID NO: 10461 - DNA, 71 bp, chicken (Gallus Gallus)
  misc_feature (36): n=a or g
gaaattcttcctaatgtccagtctaaacctcccctngcacaacttgagaatgtttcttcgtgtcctatcac

SEQ ID NO: 10462 - DNA, 71 bp, chicken (Gallus Gallus)
  misc_feature (36): n=c or t
ctctgtgttctgctcattgtgagttattgcacggcngctcaagtcagccagactgacagcaattatttgtc

SEQ ID NO: 10463 - DNA, 71 bp, chicken (Gallus Gallus)
  misc_feature (36): n=g or t
aataaagtacatacctgagcagcttatctccatttntaagcagatactaaactgagatattaaatcatgac

SEQ ID NO: 10464 - DNA, 71 bp, chicken (Gallus Gallus)
  misc_feature (36): n=a or g
gtttcacgttcttccccacgttcctctctcctatcntctgcacgccgccatgagcttgctacaaaaagaca

SEQ ID NO: 10465 - DNA, 71 bp, chicken (Gallus Gallus)
  misc_feature (36): n=c or t
ttccagagacatctgtcatttgcctctgagccaaantgaaaaacaccgggagccaccggtattcaggggct

SEQ ID NO: 10466 - DNA, 71 bp, chicken (Gallus Gallus)
  misc_feature (36): n=g or t
ctcatacaagcactatgacgtaccatatcattaatnagactaccacgtgtaggaggggcctgcagacccaa

SEQ ID NO: 10467 - DNA, 71 bp, chicken (Gallus Gallus)
  misc_feature (36): n=a or g
cttgtttcccatacagagaagagcaccactgtgtgncatcacacgggatatttactatctgccattcccca

SEQ ID NO: 10468 - DNA, 71 bp, chicken (Gallus Gallus)
  misc_feature (36): n=a or g
agttcctctttttcacgctgaatgttcaaactttcnaggcgctcttttctttcctctatggtttgacggcg

SEQ ID NO: 10469 - DNA, 71 bp, chicken (Gallus Gallus)
  misc_feature (36): n=c or g
ctgaatagcagcaggtgcttgcagaaaggcatatanagaatgacccttccccaagcctcttttttatcctt

SEQ ID NO: 10470 - DNA, 71 bp, chicken (Gallus Gallus)
  misc_feature (36): n=c or t
tgggagctcaccttttgtcattatcagcaagccaangttttaaagcagtcagcccctccaagttggtgtga

SEQ ID NO: 10471 - DNA, 71 bp, chicken (Gallus Gallus)
  misc_feature (36): n=c or g
aaatgagattccagttggaacaatcacggaaagctnttaaacttcccatgggcacaaattgtgcaatttct

SEQ ID NO: 10472 - DNA, 71 bp, chicken (Gallus Gallus)
  misc_feature (36): n=a or g
agtattagtgtgagaacacatatgcttaggaccagnctgtgcaaggaaaactcaccaatgaaagccacgtg

SEQ ID NO: 10473 - DNA, 71 bp, chicken (Gallus Gallus)
  misc_feature (36): n=a or t
cactttttttcttatgttcttcctagagaagtgttnaagccattctacaggtagtagagaacaattcctag

SEQ ID NO: 10474 - DNA, 71 bp, chicken (Gallus Gallus)
  misc_feature (36): n=c or t
tcagctttacggactttctggagctctgcttcacgntgctccagttcctctttttcacgctgaatgttcaa

SEQ ID NO: 10475 - DNA, 71 bp, chicken (Gallus Gallus)
  misc_feature (36): n=c or g
caatatgattaaaaatgaatctactgcacatccctntgatgaatgtagtaagaattcattctgcactttcc

SEQ ID NO: 10476 - DNA, 71 bp, chicken (Gallus Gallus)
  misc_feature (36): n=c or t
ggtctgcatgtccactccagagcaagtaatgttccngttagtccttcttatggcacgcaaacattattttc

SEQ ID NO: 10477 - DNA, 71 bp, chicken (Gallus Gallus)
  misc_feature (36): n=a or t
ctggtaatgggaatggaagtgcctggtctgtgaganaatgggcaaagttactgagaattcagttgcaactg

SEQ ID NO: 10478 - DNA, 71 bp, chicken (Gallus Gallus)
  misc_feature (36): n=g or t
ttatactctaatctattgcagattttcatactacancaaacaaatctgtccaagttgttaatacacctcag

SEQ ID NO: 10479 - DNA, 71 bp, chicken (Gallus Gallus)
  misc_feature (36): n=c or t
ttttttaaacatcattttgggtcccatgaccttganctcagtctctttcactccctgttttgttttgtttt

SEQ ID NO: 10480 - DNA, 71 bp, chicken (Gallus Gallus)
  misc_feature (36): n=a or g
taaacaatacatatacattgcatatgtacataaatntcattacttggtgttaccaaattgcacctaggggc

SEQ ID NO: 10481 - DNA, 71 bp, chicken (Gallus Gallus)
  misc_feature (36): n=c or t
aactgagtttgtgcaatccttacagtttttaagtgnaggtctggaaagtagcactgcgtgagtggctctca

SEQ ID NO: 10482 - DNA, 71 bp, chicken (Gallus Gallus)
  misc_feature (36): n=c or t
tattcgttctctgcagttttctcagcaactggtttnaaagagatactgtaagagaggggcaatattcggtc

SEQ ID NO: 10483 - DNA, 71 bp, chicken (Gallus Gallus)
  misc_feature (36): n=c or t
ttttagatctgtttcatacctttttaaagtttgttnttctttagtaaggtctgataaggaatatgctattt

SEQ ID NO: 10484 - DNA, 71 bp, chicken (Gallus Gallus)
  misc_feature (36): n=a or g
gtatgcacccttatcagtttgtttttcttatgtggnttgattaagacctgagtaaaacgttactgtcaagt

SEQ ID NO: 10485 - DNA, 71 bp, chicken (Gallus Gallus)
  misc_feature (36): n=g or t
gttgtgctctcaataaactggcatgctctcaggacntaattgcaggtatgagcttatcctacaggaggatg

SEQ ID NO: 10486 - DNA, 71 bp, chicken (Gallus Gallus)
  misc_feature (36): n=a or t
gtgttctctttgtgcaagaagttaaggaccaactcngattgttgttaagttaaagtgtaagtgaaggtgtc

SEQ ID NO: 10487 - DNA, 71 bp, chicken (Gallus Gallus)
  misc_feature (36): n=a or g
tctagcagctgttgatgactggaagatagaatcacntgaaatgctttgagaggtaaattattagaaacatc

SEQ ID NO: 10488 - DNA, 71 bp, chicken (Gallus Gallus)
  misc_feature (36): n=a or t
gaatgcgttcatgtatgtttgtcctgtatttgtggngtgtcttgctgtgtcactaaaaaaagccccaaaca

SEQ ID NO: 10489 - DNA, 71 bp, chicken (Gallus Gallus)
  misc_feature (36): n=a or c
aaccctttcttttattgcatctgctttcttcattgntgttacgagagaaaagaggggattgaattcatcct

SEQ ID NO: 10490 - DNA, 71 bp, chicken (Gallus Gallus)
  misc_feature (36): n=c or t
cattggcttcattacctctcttcaactctgtaaacnttttaattaaaatctagcatagcatttctgagaac

SEQ ID NO: 10491 - DNA, 71 bp, chicken (Gallus Gallus)
  misc_feature (36): n=a or g
atattgtgtgggactgcattaaaggccttccgcggnttgaggcagatgacatcacttcctctttccttgtc

SEQ ID NO: 10492 - DNA, 71 bp, chicken (Gallus Gallus)
  misc_feature (36): n=a or g
taactggggttcatcccccagataagcagcattccncagcaatcagcagtcactcggcaagcaatgcacgt

SEQ ID NO: 10493 - DNA, 71 bp, chicken (Gallus Gallus)
  misc_feature (36): n=c or g
ttaggtgaattaaagtcttgggggtgtctgactgtnagaaatctgtaagactgcatcttatgcaataataa

SEQ ID NO: 10494 - DNA, 71 bp, chicken (Gallus Gallus)
  misc_feature (36): n=c or t
aaagagtgttaaatgggctcctctttccaactacantcacatgaaagatgaaaaggaggactgccagcaat

SEQ ID NO: 10495 - DNA, 71 bp, chicken (Gallus Gallus)
  misc_feature (36): n=a or g
ggcttctaactcagcatcagcaatgccacagtagtngaaataacacaggccagccttcctgccccgtcctt

SEQ ID NO: 10496 - DNA, 71 bp, chicken (Gallus Gallus)
  misc_feature (36): n=c or t
cgcaacaggacaagacctatatttatatagctttcnatcaaaggttacaatttttaccatccacattgcaa

SEQ ID NO: 10497 - DNA, 71 bp, chicken (Gallus Gallus)
  misc_feature (36): n=c or t
tcctcccctgctggtaacgtattgatcaggggcatngtggcatcatctgcataatactgcattttatttac

SEQ ID NO: 10498 - DNA, 71 bp, chicken (Gallus Gallus)
  misc_feature (36): n=c or t
ccaagacctccagcccaaaattacagcccctctccncagctcccccttttggtgctatgcatcaaaacaat

SEQ ID NO: 10499 - DNA, 71 bp, chicken (Gallus Gallus)
  misc_feature (36): n=c or t
gttaagttctcaattgaatgttttgaacttcatggngtatatcaatgccttgcatgtctttagggttttct

SEQ ID NO: 10500 - DNA, 71 bp, chicken (Gallus Gallus)
  misc_feature (36): n=a or g
aacacttggcaagataggcaactagtgagcaatacntacacaatttcatcaatacagagctcaatatttca

SEQ ID NO: 10501 - DNA, 71 bp, chicken (Gallus Gallus)
  misc_feature (36): n=a or t
cttttgtttgccatgatagtttcgagggggaacatnaaacctgcctgaacaaaaaaattaacatctggaga

SEQ ID NO: 10502 - DNA, 71 bp, chicken (Gallus Gallus)
  misc_feature (36): n=a or c
gtaaaaaacttaagtattaatatcttttcttccaanacccaataaaaagtagaggttaatgttatgcaggt

SEQ ID NO: 10503 - DNA, 71 bp, chicken (Gallus Gallus)
  misc_feature (36): n=a or g
catgcaaagtggaaacactgctgagggagctcttcntggcactccttattgcagcagtccatggagggttc

SEQ ID NO: 10504 - DNA, 71 bp, chicken (Gallus Gallus)
  misc_feature (36): n=a or g
tcacacatttctctgcaattcctccatatgcataangaactcatgcactgtagctttagtttgatgtatta

SEQ ID NO: 10505 - DNA, 71 bp, chicken (Gallus Gallus)
  misc_feature (36): n=a or g
tgcttttcagaattgttttcccatgctacatctgcnccagggttctagatgaagatatatcaaggttgtac

SEQ ID NO: 10506 - DNA, 71 bp, chicken (Gallus Gallus)
  misc_feature (36): n=c or t
tgatgcatatcttagtttcatcaaaagaaaaaaacntttgtcctaacaggagagctcttctatcctgaaag

SEQ ID NO: 10507 - DNA, 71 bp, chicken (Gallus Gallus)
  misc_feature (36): n=a or c
aaaatgtaatgaaagccttacttgtcctgtgctagnatatttaatggtactgtgtttaaactttgagagtt

SEQ ID NO: 10508 - DNA, 71 bp, chicken (Gallus Gallus)
  misc_feature (36): n=a or g
cagcaacaatgttcttggacacagatatcttatacngggtagggtgatgattaattcaattgatgagtatg

SEQ ID NO: 10509 - DNA, 71 bp, chicken (Gallus Gallus)
  misc_feature (36): n=c or t
atcattttaaggccacagtaaacagatacactcctnagtgtatgtgagcatgaaaacagatgtaaaaaatg

SEQ ID NO: 10510 - DNA, 71 bp, chicken (Gallus Gallus)
  misc_feature (36): n=a or c
caattattctatttgaagatgcacaaaattgcaganaatacaggaaacagaggtggttccattcttgacat

SEQ ID NO: 10511 - DNA, 71 bp, chicken (Gallus Gallus)
  misc_feature (36): n=a or g
gtcagtcctctctgagctaaaaagttgggtcagcancttatcaaaacccattagttcctgcagtctaatta

SEQ ID NO: 10512 - DNA, 71 bp, chicken (Gallus Gallus)
  misc_feature (36): n=g or t
tacttctgcttttctgttgagctgagagctcactgnggtggctgtttgggtgcatacttcaagatggtccc

SEQ ID NO: 10513 - DNA, 71 bp, chicken (Gallus Gallus)
  misc_feature (36): n=c or g
ttttgtccaaatcctcgggggtttcaactctccgangaaacgtggacattttctgtggaaatatcatctca

SEQ ID NO: 10514 - DNA, 71 bp, chicken (Gallus Gallus)
  misc_feature (36): n=c or t
gttgttgcaaaagttaaagcctgcaaagccatggcnaatgatctgacccagtcattgatttccaaaattcg

SEQ ID NO: 10515 - DNA, 71 bp, chicken (Gallus Gallus)
  misc_feature (36): n=a or t
tttggtgctgattgtggacatgcagctagagacagncaaggagcagccttgtggtttagttcacccttgtc

SEQ ID NO: 10516 - DNA, 71 bp, chicken (Gallus Gallus)
  misc_feature (36): n=g or t
aaagaccttcatcagatcataacacagaaaacctgncattgtggtggtggcaaaacctatgcatgccaatg

SEQ ID NO: 10517 - DNA, 71 bp, chicken (Gallus Gallus)
  misc_feature (36): n=c or t
ttctacaataagaacataattgtagctattaaaaanaagcattgagacttggaataccattaacaagtaaa

SEQ ID NO: 10518 - DNA, 71 bp, chicken (Gallus Gallus)
  misc_feature (36): n=c or t
cactctgtcctctgaccctccagagctgcctggganttttccctgtgtttttctacatgcatgtggcttgc

SEQ ID NO: 10519 - DNA, 71 bp, chicken (Gallus Gallus)
  misc_feature (36): n=c or t
tctaggcaacactagtcaacaggaatacaaagtttnttcagtgccaaatacttctcagaattatgccaaag

SEQ ID NO: 10520 - DNA, 71 bp, chicken (Gallus Gallus)
  misc_feature (36): n=a or g
tagaagagcaagcaatctcttctcaatcagaggganaaaatgcttacccagcacttttttccccaggcttt

SEQ ID NO: 10521 - DNA, 71 bp, chicken (Gallus Gallus)
  misc_feature (36): n=c or t
cttcccaagtggagctacttccttctacacatccanaggctaagaggaaaacctccaaaaaagcacaaata

SEQ ID NO: 10522 - DNA, 71 bp, chicken (Gallus Gallus)
  misc_feature (36): n=c or t
gagggctggctttacttgcctttacttttataaaangcttgccagtaatttattccacctgtggaatgcat

SEQ ID NO: 10523 - DNA, 71 bp, chicken (Gallus Gallus)
  misc_feature (36): n=c or t
tccactcactcaggtcactgtgcaaccctaccagcnatgagcacgtgtgcctttattcccagctgctcacc

SEQ ID NO: 10524 - DNA, 71 bp, chicken (Gallus Gallus)
  misc_feature (36): n=a or g
aagccttgctcatgaaggagtccgaggtccatgcanaagaggtccatccccatccgcagtgattcccactg

SEQ ID NO: 10525 - DNA, 71 bp, chicken (Gallus Gallus)
  misc_feature (36): n=a or g
tctaatagggacccaacactcacttggtgttagtgnctgaacagattgatctgagacactcccgcacaatc

SEQ ID NO: 10526 - DNA, 71 bp, chicken (Gallus Gallus)
  misc_feature (36): n=c or g
ggctcggcatgcaccagggtgtgctgaaaagcaaanaagttccctgcacgacgagcgctgtccttggcccc

SEQ ID NO: 10527 - DNA, 71 bp, chicken (Gallus Gallus)
  misc_feature (36): n=a or g
aaattgcaggaagggtttctgctaggagaggtaagncaagaagagacctttagcatcagtgactcccagat

SEQ ID NO: 10528 - DNA, 71 bp, chicken (Gallus Gallus)
  misc_feature (36): n=c or t
tttcttttaatggtaggaatgaaagcaatcaaaaangaaacaaaacaaaactgtgtttccaggaaagtcat

SEQ ID NO: 10529 - DNA, 71 bp, chicken (Gallus Gallus)
  misc_feature (36): n=a or g
agttattaaacatcagtaggagttacatgaggaacnggcagcctctgtcactattctaatgatgtcaataa

SEQ ID NO: 10530 - DNA, 71 bp, chicken (Gallus Gallus)
  misc_feature (36): n=c or t
aacttttatcattcgaacttatgccttgtataaacnttaccataaagtactgtcctgtcttctgtcacctt

SEQ ID NO: 10531 - DNA, 71 bp, chicken (Gallus Gallus)
  misc_feature (36): n=a or g
acaggaaggttttaaagtgtaatatgttttccaagnagacgtgatggaaatcacataattttactttaata

SEQ ID NO: 10532 - DNA, 71 bp, chicken (Gallus Gallus)
  misc_feature (36): n=c or g
cttactttttgcacgtttgcattttgtggcttcatnatgagatttttactgagagatgtggtacgaacgtg

SEQ ID NO: 10533 - DNA, 71 bp, chicken (Gallus Gallus)
  misc_feature (36): n=a or g
cagtctttgcccttacactgcagactatatttacanagtaccacacaaatacataacattcataaaatcta

SEQ ID NO: 10534 - DNA, 71 bp, chicken (Gallus Gallus)
  misc_feature (36): n=a or c
ttatgtttggaagggccgttcccatgggggctgagnactgttgggagtgcagttttttggacagcctggat

SEQ ID NO: 10535 - DNA, 71 bp, chicken (Gallus Gallus)
  misc_feature (36): n=c or t
gggctctgcgtgcgcaggagggcacgaggctcaccntgagctaaagctaaacaactcatgacaggtggaga

SEQ ID NO: 10536 - DNA, 71 bp, chicken (Gallus Gallus)
  misc_feature (36): n=a or g
actttgtgggcaaattgtacatagaggaagcattcngtcctttgactcgtttcattttcttgcaataaata

SEQ ID NO: 10537 - DNA, 71 bp, chicken (Gallus Gallus)
  misc_feature (36): n=c or t
ttaagaggtattggcaccagctatttaaagtgttangttaataaacatattagggcttcactttttctttt

SEQ ID NO: 10538 - DNA, 71 bp, chicken (Gallus Gallus)
  misc_feature (36): n=a or g
aatgcactcaatctagccacattcccctttcccccntcaattctgccaactgtcagtctgccattttgtta

SEQ ID NO: 10539 - DNA, 71 bp, chicken (Gallus Gallus)
  misc_feature (36): n=a or g
tgcagaatacctaattgtacccagggggaattaaantatagtatgaactgatgctcttcttcactactgtc

SEQ ID NO: 10540 - DNA, 71 bp, chicken (Gallus Gallus)
  misc_feature (36): n=c or t
tcctgtcatcccctacttttaaaggagatggagacngtgtgttacagttttctaaatctgatctattatag

SEQ ID NO: 10541 - DNA, 71 bp, chicken (Gallus Gallus)
  misc_feature (36): n=a or t
acaaacttttccatttacttaggttaccatgcaganacttctgtggatgatccagaaggatcgtgttttcc

SEQ ID NO: 10542 - DNA, 71 bp, chicken (Gallus Gallus)
  misc_feature (36): n=a or g
attcatcaattccttgtttccctaagtatcatctanaaaaaatgcaatttagtactttttgtaattcgtgg

SEQ ID NO: 10543 - DNA, 71 bp, chicken (Gallus Gallus)
  misc_feature (36): n=a or g
tttagctttctccagtccagaaactcatggaggctngtgaaagggtcttgagagatagagcacttatccat

SEQ ID NO: 10544 - DNA, 71 bp, chicken (Gallus Gallus)
  misc_feature (36): n=c or t
tctattgctgtcttctcttgcataatgctaagctcnccctcctgctcatttcactggcttctctatcaggg

SEQ ID NO: 10545 - DNA, 71 bp, chicken (Gallus Gallus)
  misc_feature (36): n=a or g
tagatctgctgtaaaacaaacagatatacatatgtncatatatatataatgaaagttttatttgcatacag

SEQ ID NO: 10546 - DNA, 71 bp, chicken (Gallus Gallus)
  misc_feature (36): n=c or t
taacacaacattctcctgttggtaagagaccattcntttctctactaaaaagtaaatcagtgtcactgtgc

SEQ ID NO: 10547 - DNA, 71 bp, chicken (Gallus Gallus)
  misc_feature (36): n=g or t
ctttttctcttcttcctatgttttcacctgaagctnttatttatttattactctatggagatttttttttt

SEQ ID NO: 10548 - DNA, 71 bp, chicken (Gallus Gallus)
  misc_feature (36): n=a or g
tgttacagatgtgtatattacattacacatcaaaanggtagataaacacaaaaatatgatcaaaggtgtta

SEQ ID NO: 10549 - DNA, 71 bp, chicken (Gallus Gallus)
  misc_feature (36): n=a or g
tccctgctgggatgaacgtttgggtcctggcacacntgtggtgacagccctattgactcctttttaaataa

SEQ ID NO: 10550 - DNA, 71 bp, chicken (Gallus Gallus)
  misc_feature (36): n=c or t
accctctggctgcagcaaaataatttgaaggcacanctgcttgcaggcccctttgatttctgtgtgcgtat

SEQ ID NO: 10551 - DNA, 71 bp, chicken (Gallus Gallus)
  misc_feature (36): n=c or t
cctggatggggtggtccggcggtgttgtgggattgngatcatacaaagatgaaggtagatgtataggtacc

SEQ ID NO: 10552 - DNA, 71 bp, chicken (Gallus Gallus)
  misc_feature (36): n=a or g
tggacttctaatgtcttccatacaggaatctttgcnttttctgttagaataaacctactcctgctgctctg

SEQ ID NO: 10553 - DNA, 71 bp, chicken (Gallus Gallus)
  misc_feature (36): n=a or g
gtgctacttactatgctaaaatatttactctagatntaaagcattaaatcacttcagtcattcagtcaagt

SEQ ID NO: 10554 - DNA, 71 bp, chicken (Gallus Gallus)
  misc_feature (36): n=a or g
ttttctgttacctggatgtgcatttaatggaataanttttcatgtctttcaccaaatacttagggaagatg

SEQ ID NO: 10555 - DNA, 71 bp, chicken (Gallus Gallus)
  misc_feature (36): n=c or t
gattataggatgtgttgtctgtgatagaaaggaccncggcatgaacacccaaccagcctgttccagccctg

SEQ ID NO: 10556 - DNA, 71 bp, chicken (Gallus Gallus)
  misc_feature (36): n=a or g
ggtactatgagtactttcttgtcccactcacacatngattttgagaaatctcactttgaatttgttgtttg

SEQ ID NO: 10557 - DNA, 71 bp, chicken (Gallus Gallus)
  misc_feature (36): n=c or g
atacatattgcagtgtattacacatcattgccaagnacgctaggattgccttacatattttgttgctgttc

SEQ ID NO: 10558 - DNA, 71 bp, chicken (Gallus Gallus)
  misc_feature (36): n=c or t
cctgttttttaaggcagatcaaaacgttcaactgcnatcaaacttcttgaaattgtcttttggtgcttaag

SEQ ID NO: 10559 - DNA, 71 bp, chicken (Gallus Gallus)
  misc_feature (36): n=a or g
aatacacaggccacgtgctcttccttttctaaaacntaaagacatatgccttccttttccataagatatac

SEQ ID NO: 10560 - DNA, 71 bp, chicken (Gallus Gallus)
  misc_feature (36): n=c or t
ttctctggaggttctttcttctgtaagcagtgcganagaacaaggaacaaggatctgttatttgtttcctc

SEQ ID NO: 10561 - DNA, 71 bp, chicken (Gallus Gallus)
  misc_feature (36): n=a or g
gatacctttctgaattatatttgttacaaagagtanaaaaatcattttttttgtcctctttttcttttttc

SEQ ID NO: 10562 - DNA, 71 bp, chicken (Gallus Gallus)
  misc_feature (36): n=g or t
acactcacccagcctaggtgagtaattttgaaatanttgcatttcaacagagagatttagttcctcatcta

SEQ ID NO: 10563 - DNA, 71 bp, chicken (Gallus Gallus)
  misc_feature (36): n=a or g
atggtgcagtgactttggaagcaatagtcaacactnataactttgatgtaagttgtgctgttctgctccca

SEQ ID NO: 10564 - DNA, 71 bp, chicken (Gallus Gallus)
  misc_feature (36): n=a or g
cacaggtcccacacagtcccatttgtttgttcttgnatgaaccgccactgtaaagcggtactgacttttgg

SEQ ID NO: 10565 - DNA, 71 bp, chicken (Gallus Gallus)
  misc_feature (36): n=c or t
ggcgttgctggaataatctttgtgtctttgagttangcaagtagctacagtgtcttcattctgtgcctgtc

SEQ ID NO: 10566 - DNA, 71 bp, chicken (Gallus Gallus)
  misc_feature (36): n=c or t
tagttagaaatctcacactggacaattgtctaaaanacagtacttacaggcaaggccatctttcaggcagg

SEQ ID NO: 10567 - DNA, 71 bp, chicken (Gallus Gallus)
  misc_feature (36): n=a or t
agatcatgttaagataggaaagagatgtagccacanccccttaaatttcaaccacccttgaattcatgaca

SEQ ID NO: 10568 - DNA, 71 bp, chicken (Gallus Gallus)
  misc_feature (36): n=c or t
cactttgactcaagccaactgacaacgtccctttanactaccttgtcctccatgaccactttgctcttgcg

SEQ ID NO: 10569 - DNA, 71 bp, chicken (Gallus Gallus)
  misc_feature (36): n=a or g
gctaaatttcttagtttaattcattaaaaatgtatnaagtagcaggaaaccaagaacctgtgagaatgtct

SEQ ID NO: 10570 - DNA, 71 bp, chicken (Gallus Gallus)
  misc_feature (36): n=g or t
atagctgactgctcacggtgcagccttactccctcncatgcaaaactatacaagagagtattatcttagtt

SEQ ID NO: 10571 - DNA, 71 bp, chicken (Gallus Gallus)
  misc_feature (36): n=a or c
gccagcttccagtcaactggaacctcaacatattancaagattgtcgagaaagacaaatcagtccagccac

SEQ ID NO: 10572 - DNA, 71 bp, chicken (Gallus Gallus)
  misc_feature (36): n=a or g
cactcagaaaggctcagatgtgatttcaggtcactnttctgatatcagtaattccgcgataagcatttgaa

SEQ ID NO: 10573 - DNA, 71 bp, chicken (Gallus Gallus)
  misc_feature (36): n=c or t
actagataataatggaggtaatcactgtctacactngacaatctgtcatacaatgtctttcacattttata

SEQ ID NO: 10574 - DNA, 71 bp, chicken (Gallus Gallus)
  misc_feature (36): n=c or t
tttcctttataaccagcacattatgaacgtcacatnaacgatcacttgttaagatacacatcgactctttc

SEQ ID NO: 10575 - DNA, 71 bp, chicken (Gallus Gallus)
  misc_feature (36): n=a or g
ttcccaagttcaatctgcaaaacgtggctgaggagnagagttcagaagataccccggaaaagttcttggtg

SEQ ID NO: 10576 - DNA, 71 bp, chicken (Gallus Gallus)
  misc_feature (36): n=c or t
ttctcagagcatctctccatggggcggtgcgtggcngccatgtgctcttccaaaacttccaccttcggatc

SEQ ID NO: 10577 - DNA, 71 bp, chicken (Gallus Gallus)
  misc_feature (36): n=c or g
tcttaagtaatacttcctaaaggaaaacaaacagantgcgttatgtttcactgaaggcagccattgctcca

SEQ ID NO: 10578 - DNA, 71 bp, chicken (Gallus Gallus)
  misc_feature (36): n=a or g
tgcagcacaggcagctgcatctgagaaacgttaatnatgtgctccaacacattaatgcctgcattccccca

SEQ ID NO: 10579 - DNA, 71 bp, chicken (Gallus Gallus)
  misc_feature (36): n=a or g
tgccactaatcgctattacaaagcctgcaactgccnctgtcttaaagcagatctctgcacagagtccaaga

SEQ ID NO: 10580 - DNA, 71 bp, chicken (Gallus Gallus)
  misc_feature (36): n=c or t
aaacaagttggggaaaaaaaagaatcacagaaaagnccgaacttgcaaatgttgttaagcagtgaagccaa

SEQ ID NO: 10581 - DNA, 71 bp, chicken (Gallus Gallus)
  misc_feature (36): n=a or c
ccctctgttgtatgcttgctgggtaccccacccccnaaaacttctattcctaacaaattcctgcttgagta

SEQ ID NO: 10582 - DNA, 71 bp, chicken (Gallus Gallus)
  misc_feature (36): n=c or t
attgctaaccttgaaattaaaatattttatgattcngcaattacaaataggcagagaattatcaaaacccc

SEQ ID NO: 10583 - DNA, 71 bp, chicken (Gallus Gallus)
  misc_feature (36): n=a or g
gatgaaggaaaccaggcagctgcaaagaaaccttcntgcagatggtgacaagacagaagatcacagagctc

SEQ ID NO: 10584 - DNA, 71 bp, chicken (Gallus Gallus)
  misc_feature (36): n=a or g
tcttcatgtaagtaaaacaaggtgttgtgctatttngacatcaatttcttatcattgttgctgtgaaaact

SEQ ID NO: 10585 - DNA, 71 bp, chicken (Gallus Gallus)
  misc_feature (36): n=g or t
ataaactgtactgtcaggatatgggaatttgctcangcactactatcatttcaactgagcatatgttcctt

SEQ ID NO: 10586 - DNA, 71 bp, chicken (Gallus Gallus)
  misc_feature (36): n=c or t
tctggggaaagaaatctctgatttccttgttgctgnatttgtgacgtttgctctgcctccaggataatatc

SEQ ID NO: 10587 - DNA, 71 bp, chicken (Gallus Gallus)
  misc_feature (36): n=a or g
agccactcagcttctacccagacatgttcatcctcnctggcaagccaaaaagcagaaaaacccaacaaaca

SEQ ID NO: 10588 - DNA, 71 bp, chicken (Gallus Gallus)
  misc_feature (36): n=a or c
gtataactgaaaataatacttggtctaattaccatnaaatatatttcctgttggaagttaacataatgagt

SEQ ID NO: 10589 - DNA, 71 bp, chicken (Gallus Gallus)
  misc_feature (36): n=a or g
acttgatgctgatctgtaatttacaccaaaagagtntagggttgtgtctggccaagttcctgatgttgaag

SEQ ID NO: 10590 - DNA, 71 bp, chicken (Gallus Gallus)
  misc_feature (36): n=a or c
actgctatcagctgtgctcatggctggcactgctgncgggagctcatcttatcctccttttaaagtctgta

SEQ ID NO: 10591 - DNA, 71 bp, chicken (Gallus Gallus)
  misc_feature (36): n=c or t
ctcattatctgagacatttttcctccttccaccacngaaaccagtagagatgctccttctgctgaagacag

SEQ ID NO: 10592 - DNA, 71 bp, chicken (Gallus Gallus)
  misc_feature (36): n=a or g
tagcagcacctacacaggtggtgggaaagcagctgnatattaggctgttcttcaggcttccaaattaaatc

SEQ ID NO: 10593 - DNA, 71 bp, chicken (Gallus Gallus)
  misc_feature (36): n=a or g
cagaacagaagactcacacagcagtcagggatgctncagtgccccccaggtagcacacacagtgccaggca

SEQ ID NO: 10594 - DNA, 71 bp, chicken (Gallus Gallus)
  misc_feature (36): n=a or g
tatgtccatattatgttcattaggggaatgagtttngtgaagtgcagaaaatacacacatcaattttgtgg

SEQ ID NO: 10595 - DNA, 71 bp, chicken (Gallus Gallus)
  misc_feature (36): n=c or t
gagcagctgctgggctcgtgctccttccagcgtgcntctattcacagttttgccctttgctttcttgttcc

SEQ ID NO: 10596 - DNA, 71 bp, chicken (Gallus Gallus)
  misc_feature (36): n=a or g
ttaaaatacattaaaacctgtgatcagcatgagaangaccaactaaaggaaacaaggaagcttgttaaatg

SEQ ID NO: 10597 - DNA, 71 bp, chicken (Gallus Gallus)
  misc_feature (36): n=a or g
gtactgtaggacttcacactgccattttgcaggacncgtgcaatcagtttcaattatttagctctgggttt

SEQ ID NO: 10598 - DNA, 71 bp, chicken (Gallus Gallus)
  misc_feature (36): n=c or g
tgcagacagaatagtaatgctggctgctacagagcncgtctgagcacttatgcataatttagcacaggttc

SEQ ID NO: 10599 - DNA, 71 bp, chicken (Gallus Gallus)
  misc_feature (36): n=a or g
caacagcaaaagaacaactcacatatttcttgtgcncatattcttactgagatggcaacagggagtagttt

SEQ ID NO: 10600 - DNA, 71 bp, chicken (Gallus Gallus)
  misc_feature (36): n=a or g
atcccggtgcgttttacaccagtgagccgacagacngaggtttggctgagatctcttcagggagttcgggt

SEQ ID NO: 10601 - DNA, 71 bp, chicken (Gallus Gallus)
  misc_feature (36): n=c or t
ccggggagtggctctgtgctgagcaatgtgtgttgnatgttgcatttgtctgctgtctgctaacctgggtc

SEQ ID NO: 10602 - DNA, 71 bp, chicken (Gallus Gallus)
  misc_feature (36): n=a or c
gtatttttaaaggaggaaaagaataacgaagagacnacactctacaaagcaattgctgagcctcagtgggc

SEQ ID NO: 10603 - DNA, 71 bp, chicken (Gallus Gallus)
  misc_feature (36): n=a or g
ttggtcaaagggcggtagccgttaatctggttgagntggtcagcctacgcaggggcactgctggaagcacc

SEQ ID NO: 10604 - DNA, 71 bp, chicken (Gallus Gallus)
  misc_feature (36): n=c or t
atcatggttaagattttgatggactcctttacttangactgtcctccccagttgccttgtctgtattcaaa

SEQ ID NO: 10605 - DNA, 71 bp, chicken (Gallus Gallus)
  misc_feature (36): n=c or t
atacctggtgtgcgaggataaacaatcagaatcacngaggttggaaaagacctccgagaccatccagtcca

SEQ ID NO: 10606 - DNA, 71 bp, chicken (Gallus Gallus)
  misc_feature (36): n=c or t
acaccacataacattcagcagtatatgaggaaggancgtaatgaaaattgctctgtgattgtaaaaacaaa

SEQ ID NO: 10607 - DNA, 71 bp, chicken (Gallus Gallus)
  misc_feature (36): n=c or t
gtcactgttttcccataaaactcacagtaacacagngtcttcaaaacctctgtatccctcattttggggtt

SEQ ID NO: 10608 - DNA, 71 bp, chicken (Gallus Gallus)
  misc_feature (36): n=c or g
tgggaactaattctttttgatgcctctgtattgtanttctgctggttgcaagtgtggaggtgggtcggtct

SEQ ID NO: 10609 - DNA, 71 bp, chicken (Gallus Gallus)
  misc_feature (36): n=c or t
gagtacacccaaagtcagttttgcatctgggtttgnatccaagaaaagtaaaatccatttctcaggagaga

SEQ ID NO: 10610 - DNA, 71 bp, chicken (Gallus Gallus)
  misc_feature (36): n=a or g
gcaccttgcacgcaggactgcagataaggtacaganaactgtagatttgggctgccccctttggtaatttt

SEQ ID NO: 10611 - DNA, 71 bp, chicken (Gallus Gallus)
  misc_feature (36): n=a or c
gtctttcaattacaatccaattctgccatgtgcaantcttatcaggtttaataacattatgctggtatttc

SEQ ID NO: 10612 - DNA, 71 bp, chicken (Gallus Gallus)
  misc_feature (36): n=a or g
tccaggggcaccagggggaccaggaggaccctaganagtgacgaaaattgttaggaaggaaaaccaaagaa

SEQ ID NO: 10613 - DNA, 71 bp, chicken (Gallus Gallus)
  misc_feature (36): n=c or t
aagtactttcttgaacgtctccacaagcagactaanggaaaaggctgtgtgggcaaccagctcatcaggaa

SEQ ID NO: 10614 - DNA, 71 bp, chicken (Gallus Gallus)
  misc_feature (36): n=c or t
atagctattcacacctcttgcagacagaaatctctnggacaggatcatctgaatctggcattgtctttctt

SEQ ID NO: 10615 - DNA, 71 bp, chicken (Gallus Gallus)
  misc_feature (36): n=c or t
cttaaagcttgagggaacatactttttccagcacgntgatcagattatttgttagtcatttaagaccatca

SEQ ID NO: 10616 - DNA, 71 bp, chicken (Gallus Gallus)
  misc_feature (36): n=c or t
tcttcattattcagctaatgctagtagtattcatgntatattggggtcacagggttttgggccgttacccc

SEQ ID NO: 10617 - DNA, 71 bp, chicken (Gallus Gallus)
  misc_feature (36): n=a or g
acttccttcaactggtcgcactgcgcctatctcagnggcaatgaaaacgaaacagcagtttggtaggagtg

SEQ ID NO: 10618 - DNA, 71 bp, chicken (Gallus Gallus)
  misc_feature (36): n=a or g
gtgagtgtgactgttaccattttcagtgattacacnaaatatgcatttctgttgtgtatgctcactacaca

SEQ ID NO: 10619 - DNA, 71 bp, chicken (Gallus Gallus)
  misc_feature (36): n=a or g
ttaaccctaacaaagctcactgctaaggaagaaggngagcaccctggcagctttggaaatgcccttttgac

SEQ ID NO: 10620 - DNA, 71 bp, chicken (Gallus Gallus)
  misc_feature (36): n=a or c
cagaactgacacttcagatatagtcataggaggganagggcacagcagaatgctgcatgtgtatcatcttg

SEQ ID NO: 10621 - DNA, 71 bp, chicken (Gallus Gallus)
  misc_feature (36): n=a or t
aatcttaggaaagattttaggattttttttttattnttatctgttagtaaagaagaatacagtttaagcgg

SEQ ID NO: 10622 - DNA, 71 bp, chicken (Gallus Gallus)
  misc_feature (36): n=a or g
agaggaaactcgacctgaacaaaacctttcattgcngaagcattccactttgaataaaattgcatgctgcc

SEQ ID NO: 10623 - DNA, 71 bp, chicken (Gallus Gallus)
  misc_feature (36): n=c or t
gttgcatacctgtattaaaagcaagcagtggctacnactagtgtctaagaatatttgagtttctggatcta

SEQ ID NO: 10624 - DNA, 71 bp, chicken (Gallus Gallus)
  misc_feature (36): n=c or t
ccttctggctttgtgggcacaggtctacttcacttntgtttgtataattccttgtgaaatggtatgattat

SEQ ID NO: 10625 - DNA, 71 bp, chicken (Gallus Gallus)
  misc_feature (36): n=a or g
aacattgcaaaagaatgcaaaagaatgttagaattnctgtggctagtgactggcttgaatacctattttat

SEQ ID NO: 10626 - DNA, 71 bp, chicken (Gallus Gallus)
  misc_feature (36): n=a or g
atcagtgttactgatagatgatcccttctgacagcntttcagtgaattatcttttttcttgttttggttaa

SEQ ID NO: 10627 - DNA, 71 bp, chicken (Gallus Gallus)
  misc_feature (36): n=a or g
tccatgttgttttgcacaaaactgactacctgagcntacggtgtgtgtggcaaggtggagaagggcgttat

SEQ ID NO: 10628 - DNA, 71 bp, chicken (Gallus Gallus)
  misc_feature (36): n=c or t
agacacagagcatcgggattgctgtgtcaggttaangtgagcattgacaatgactgctgtcatttgcccca

SEQ ID NO: 10629 - DNA, 71 bp, chicken (Gallus Gallus)
  misc_feature (36): n=c or t
ctgccagggaaccagacctgattatccttggtgcgncttccagatcaatgttcataattcccctgctgttc

SEQ ID NO: 10630 - DNA, 71 bp, chicken (Gallus Gallus)
  misc_feature (36): n=c or t
acatctagccctcacaattacagttggtaaaaaccngaaacagtttagatgaaaataaatacgaagataat

SEQ ID NO: 10631 - DNA, 71 bp, chicken (Gallus Gallus)
  misc_feature (36): n=c or t
aaacaatccttctgagaattttcctgaacaaaggcngagaattgaacattttctacagtgatgcgacagct

SEQ ID NO: 10632 - DNA, 71 bp, chicken (Gallus Gallus)
  misc_feature (36): n=c or g
tctccaccttcccctcaaaaaaattcttcaaaactnggctcaggacttagaagaaccaagaggttcttctg

SEQ ID NO: 10633 - DNA, 71 bp, chicken (Gallus Gallus)
  misc_feature (36): n=c or t
ttggtttattttaaagtgctgtcgtgtacatgaaangaggaaatacctgtacaactgcttgcttcagatat

SEQ ID NO: 10634 - DNA, 71 bp, chicken (Gallus Gallus)
  misc_feature (36): n=c or t
agcatgagatgcaagctggaggccagagtctggttncttgtttgtaccctgaggtgtacaatgactactct

SEQ ID NO: 10635 - DNA, 71 bp, chicken (Gallus Gallus)
  misc_feature (36): n=a or t
tgacactcccagtctggtttatttcttacttagtcnatggaaagcaattccattttttgtctccatggcaa

SEQ ID NO: 10636 - DNA, 71 bp, chicken (Gallus Gallus)
  misc_feature (36): n=a or t
gctatcaatatttaatgatgaaatggcatacactcngaactgtatgaatgtgttaaaacgttgaataacaa

SEQ ID NO: 10637 - DNA, 71 bp, chicken (Gallus Gallus)
  misc_feature (36): n=c or t
gtattgttcctaagtgtggaggatgatgtaaacttngtgctattagtgagttaatcctaggaatttcattt

SEQ ID NO: 10638 - DNA, 71 bp, chicken (Gallus Gallus)
  misc_feature (36): n=c or t
agcaatcgcaccaagaacacaaacacggagcaaacnccctcctctccaatgtgttacaccaagagaaggaa

SEQ ID NO: 10639 - DNA, 71 bp, chicken (Gallus Gallus)
  misc_feature (36): n=c or t
ctccctttcacacatgcatctgaaacaagttatctnttctaagcgaaatacacacataataaaacctatct

SEQ ID NO: 10640 - DNA, 71 bp, chicken (Gallus Gallus)
  misc_feature (36): n=a or g
catccattttcagacactatgctttggtttagtccntagtttcctgatctttgttctttttgtacgtgctc

SEQ ID NO: 10641 - DNA, 71 bp, chicken (Gallus Gallus)
  misc_feature (36): n=a or g
cagagcactgagctgaactgtatttgtattctcttnggttttgcttgtgatatataaacgaagatatcgcc

SEQ ID NO: 10642 - DNA, 71 bp, chicken (Gallus Gallus)
  misc_feature (36): n=g or t
ttggcaggcaaaattttgtaagatatttctttgagnagcttgtgagagagttcttttttcctcttttccag

SEQ ID NO: 10643 - DNA, 71 bp, chicken (Gallus Gallus)
  misc_feature (36): n=a or g
atgattatcttggcgtgtgacacatgtaaaacaacnaagtacatttaatgttatgtgcaacaattaaaatc

SEQ ID NO: 10644 - DNA, 71 bp, chicken (Gallus Gallus)
  misc_feature (36): n=a or c
tgtgttaaaataaacatagatttgctatttttttcntttggtctgaggagagttcagatgggtaacagaaa

SEQ ID NO: 10645 - DNA, 71 bp, chicken (Gallus Gallus)
  misc_feature (36): n=a or c
ggttatttctcaaataacagcatatggtatccttgnaatgaaggaagaggctgggctgtattcaacatgga

SEQ ID NO: 10646 - DNA, 71 bp, chicken (Gallus Gallus)
  misc_feature (36): n=a or c
attttacagtagttcaagttaaaaattacaagtagngaaacttacagagataatctgatgcaacgtagcaa

SEQ ID NO: 10647 - DNA, 71 bp, chicken (Gallus Gallus)
  misc_feature (36): n=c or g
actccagtaagagatgtgctggcagccacgtgtcanactgaaactatttggcaaaacattagaggatgatt

SEQ ID NO: 10648 - DNA, 71 bp, chicken (Gallus Gallus)
  misc_feature (36): n=a or g
tgattaattgtacttaatattgcttatagatgctcngtttaagattggttcagaagtttttatgatgtaaa

SEQ ID NO: 10649 - DNA, 71 bp, chicken (Gallus Gallus)
  misc_feature (36): n=a or g
agcgctgtagaaggaagcagaagtactcttctggangtgtttttttctttctattaactcgtatttcgaga

SEQ ID NO: 10650 - DNA, 71 bp, chicken (Gallus Gallus)
  misc_feature (36): n=c or t
ctatacttgtaaagctgagctattaactctacttantgttgaggttaatcattacagcattattcttttcg

SEQ ID NO: 10651 - DNA, 71 bp, chicken (Gallus Gallus)
  misc_feature (36): n=c or t
catcatccaaagtctgataaggacagaagcattccnggcattgcagcctctctgcagctagaaggaaagct

SEQ ID NO: 10652 - DNA, 71 bp, chicken (Gallus Gallus)
  misc_feature (36): n=c or t
ttcaacaacctagataggctcacagcacattcctgntctacacacattgttaccttctccactgctgatta

SEQ ID NO: 10653 - DNA, 71 bp, chicken (Gallus Gallus)
  misc_feature (36): n=a or g
acatgtggaaagaaaaccttccactgaactcagtgntgaatcttgcattgtcttttcctatgttacacagg

SEQ ID NO: 10654 - DNA, 71 bp, chicken (Gallus Gallus)
  misc_feature (36): n=c or t
gacatgggtcacctaacatgtaatggaaaatctgtntgccaattgtcagcccagaaaggtgactctgatca

SEQ ID NO: 10655 - DNA, 71 bp, chicken (Gallus Gallus)
  misc_feature (36): n=a or c
tgaccagaatggaaagcatcatgtggaagcactgantgtaaccaaaaatcaggatttctggagaggaaaag

SEQ ID NO: 10656 - DNA, 71 bp, chicken (Gallus Gallus)
  misc_feature (36): n=a or g
ttgttatggtgataatgggagtagctgtgtagcttncttgtgatgtttttatgttaatgcactggtcaaag

SEQ ID NO: 10657 - DNA, 71 bp, chicken (Gallus Gallus)
  misc_feature (36): n=c or t
gatgcattggcagttagactgagttatcacagaggncttttccaacctcagtgggtctatgattctaggag

SEQ ID NO: 10658 - DNA, 71 bp, chicken (Gallus Gallus)
  misc_feature (36): n=a or g
agaagtattttcattgccaccagtcaggggcatccnagaccttgcagttaaattggtcaaaagccctgctt

SEQ ID NO: 10659 - DNA, 71 bp, chicken (Gallus Gallus)
  misc_feature (36): n=a or g
ggtaagaacagaaaagacaaatacaatgggcagctnagagtaattaggctcagtgaatttcagactgcagt

SEQ ID NO: 10660 - DNA, 71 bp, chicken (Gallus Gallus)
  misc_feature (36): n=a or g
tgagatcatttcagtgttttacatcatgacaaccantgttgcaaccatgactcttcaaagccagctccatg

SEQ ID NO: 10661 - DNA, 71 bp, chicken (Gallus Gallus)
  misc_feature (36): n=a or g
caacaaatgaattgtgagtttaaaatattctatttntaaggttaatacagaacagtaaccaaagcttttgt

SEQ ID NO: 10662 - DNA, 71 bp, chicken (Gallus Gallus)
  misc_feature (36): n=c or t
tagatatggaaagtgcatgataaggaagtcctgtantttacatgtagtagccaactggaagcaatgagctc

SEQ ID NO: 10663 - DNA, 71 bp, chicken (Gallus Gallus)
  misc_feature (36): n=a or g
ttttgaggttttgttttcattcaaatcactggctgnggtaactgagaggaatgagcaccccagaactctga

SEQ ID NO: 10664 - DNA, 71 bp, chicken (Gallus Gallus)
  misc_feature (36): n=c or t
ctgtgccaggcgagtcactgcttcgctctgtgatgngctcatgttttttctccccctctattgacttgtta

SEQ ID NO: 10665 - DNA, 71 bp, chicken (Gallus Gallus)
  misc_feature (36): n=c or g
acactgtactgtacatcgtatgcccacgacagtaantcagatcttaggagcgcagttgctatctctccaaa

SEQ ID NO: 10666 - DNA, 71 bp, chicken (Gallus Gallus)
  misc_feature (36): n=a or g
aaatgactaactgagaaggaagctagtagagtgttngcaaggcttttagaattgttatcaaggttttcacc

SEQ ID NO: 10667 - DNA, 71 bp, chicken (Gallus Gallus)
  misc_feature (36): n=a or g
tgcacagatctgtaacaaatctgtgtaattaaattngacattagaagctgaaatgccagctgaacgcattt

SEQ ID NO: 10668 - DNA, 71 bp, chicken (Gallus Gallus)
  misc_feature (36): n=a or g
ggcatagtagtttacagaggacactcacagctgacnaggtttattgaccatccaaaagccagaagagatgg

SEQ ID NO: 10669 - DNA, 71 bp, chicken (Gallus Gallus)
  misc_feature (36): n=a or g
gaaccctgcctcggagccttgcagtctgctttgganccttcaccccagcttgaaattctgttctgtggcag

SEQ ID NO: 10670 - DNA, 71 bp, chicken (Gallus Gallus)
  misc_feature (36): n=c or g
actcagacagtggcaggaatgagaggcagtcagctnccctctttcttttctcaaatttcctgcaaagcctc

SEQ ID NO: 10671 - DNA, 71 bp, chicken (Gallus Gallus)
  misc_feature (36): n=a or g
aagctgttggtttaaggtagacagcatatcctgccncaccagaattgactggaaccagaaacgcgtttgaa

SEQ ID NO: 10672 - DNA, 71 bp, chicken (Gallus Gallus)
  misc_feature (36): n=c or t
aggatcctgtctgaaacccaagttagggagaacccnccacagacggtgttttacagtgcagcacatacgcg

SEQ ID NO: 10673 - DNA, 71 bp, chicken (Gallus Gallus)
  misc_feature (36): n=a or g
tcataacttgaatcaaactcttcctgaagtgcctcntacttactgctcctcccagaccacggctgaggaga

SEQ ID NO: 10674 - DNA, 71 bp, chicken (Gallus Gallus)
  misc_feature (36): n=c or t
taaattatttcataggcaatctagcttgtgttcccnttcatctctgagatgagcaaaatgtgaagtctaat

SEQ ID NO: 10675 - DNA, 71 bp, chicken (Gallus Gallus)
  misc_feature (36): n=c or t
ggctccgggcgcttcgtgccgtgctgctcggctggngcaggactgagaaagacaagcgaacatctgcttgg

SEQ ID NO: 10676 - DNA, 71 bp, chicken (Gallus Gallus)
  misc_feature (36): n=c or t
agtactgcaatctcgcatccagcacagcagctaagngaaatagaaaaaagctgttgttaatcctccatata

SEQ ID NO: 10677 - DNA, 71 bp, chicken (Gallus Gallus)
  misc_feature (36): n=c or t
tactatcaaagcgttctggaaggttccccaggcagncaacacctgccctagttgtcaccaacaatttctct

SEQ ID NO: 10678 - DNA, 71 bp, chicken (Gallus Gallus)
  misc_feature (36): n=a or g
cttcacactgagaagacttctgtatttgctactgcntttttgacaggtgtctaaatctacattatttaata

SEQ ID NO: 10679 - DNA, 71 bp, chicken (Gallus Gallus)
  misc_feature (36): n=a or g
gaaacaacatggaaagagatgcttgggatggatgantgctggacagtggcagtttttccatctaactctcc

SEQ ID NO: 10680 - DNA, 71 bp, chicken (Gallus Gallus)
  misc_feature (36): n=a or g
cagccggatctgtgtgccaggaagtgtgccagagtngaatcatggcttgccttggaaaggagactttttac

SEQ ID NO: 10681 - DNA, 71 bp, chicken (Gallus Gallus)
  misc_feature (36): n=a or g
ataggggcaggaaagaagcagttttattctggtgcnatcttactgtgctgtgagtgagaggtgggtgcaga

SEQ ID NO: 10682 - DNA, 71 bp, chicken (Gallus Gallus)
  misc_feature (36): n=c or t
catcagaattccaaattcggataaggaacacagttnagttctcgaagagtgtcattgtcatctgacagtct

SEQ ID NO: 10683 - DNA, 71 bp, chicken (Gallus Gallus)
  misc_feature (36): n=a or g
tgctgaatggaggagttaaggactcctgccttgtgnagtcattattccccagtcatcaaaccaccctgaaa

SEQ ID NO: 10684 - DNA, 71 bp, chicken (Gallus Gallus)
  misc_feature (36): n=c or t
aatggggtaataggcaaatatattcagaattaatgnattcatataaatattgtacagtaatttatttgcca

SEQ ID NO: 10685 - DNA, 71 bp, chicken (Gallus Gallus)
  misc_feature (36): n=c or t
aatcccaacattgcttcagtgcagaccaatgagacnggcttaaagcaggctgatgctgtgtatttcctccc

SEQ ID NO: 10686 - DNA, 71 bp, chicken (Gallus Gallus)
  misc_feature (36): n=a or g
atacagattgacacgctggcagcagaatacccggcngtaactaattacctctatgtcacgtacaacggcca

SEQ ID NO: 10687 - DNA, 71 bp, chicken (Gallus Gallus)
  misc_feature (36): n=c or t
cctggtaggcaacagacgtggtgtcaagaggggaangccagaagcttgttttctaagggctgtgttatcag

SEQ ID NO: 10688 - DNA, 71 bp, chicken (Gallus Gallus)
  misc_feature (36): n=a or g
agtctggttttgaagctctccaacttctgactgtcnttttgtgaaggtgaatgttaggaaaaggagccatt

SEQ ID NO: 10689 - DNA, 71 bp, chicken (Gallus Gallus)
  misc_feature (36): n=g or t
ttatgctgtgctaaggaatagccacgctgtggtganaatggcactgcttattaatgcacagtgtaagtgct

SEQ ID NO: 10690 - DNA, 71 bp, chicken (Gallus Gallus)
  misc_feature (36): n=a or g
aatagaagaaggaagcaaaaacccctggggaagctntgcatacatagcaaaggaggagcaatgggcttgca

SEQ ID NO: 10691 - DNA, 71 bp, chicken (Gallus Gallus)
  misc_feature (36): n=c or t
aattcagtaatggtaaacctgtttttttcccttaangttaggtgctcacacgtgtgtgctttgctcccatc

SEQ ID NO: 10692 - DNA, 71 bp, chicken (Gallus Gallus)
  misc_feature (36): n=c or t
ggttcagccatcattctcctcttggatgccacgctngcattacctccctctctctcaaactgcttaggtgg

SEQ ID NO: 10693 - DNA, 71 bp, chicken (Gallus Gallus)
  misc_feature (36): n=a or c
gtcagggaacagtatgaagcaggggaggttcctccngtgtcaagttagggttaagataagactcagaactc

SEQ ID NO: 10694 - DNA, 71 bp, chicken (Gallus Gallus)
  misc_feature (36): n=a or g
cttcctttccccagcagatcaactgccctgaacccnatctgctctccactacaacgcagtagaccaagaga

SEQ ID NO: 10695 - DNA, 71 bp, chicken (Gallus Gallus)
  misc_feature (36): n=c or t
gtgcgacttccaggataatctccagctatcagaganctgcacagaggtgaccccatggacattccgtcaca

SEQ ID NO: 10696 - DNA, 71 bp, chicken (Gallus Gallus)
  misc_feature (36): n=c or t
acgttttgatcaccactgcctgccacaaaagctctntgtgaatgcaggaaggacaggcaaaatcacccaaa

SEQ ID NO: 10697 - DNA, 71 bp, chicken (Gallus Gallus)
  misc_feature (36): n=c or t
caacagctgcttgactacacctcagccaccacctancactgcatccacaccattccatatcatagaatgta

SEQ ID NO: 10698 - DNA, 71 bp, chicken (Gallus Gallus)
  misc_feature (36): n=g or t
acccacttcttactttccctgctcctaagatgcagnaacaataatttacccagttttcagaaccaagagtt

SEQ ID NO: 10699 - DNA, 71 bp, chicken (Gallus Gallus)
  misc_feature (36): n=c or t
gaatcaaactaaactccaacagtctaacaactgaangctaccagcctttaaatgccagtaaatttaagttc

SEQ ID NO: 10700 - DNA, 71 bp, chicken (Gallus Gallus)
  misc_feature (36): n=c or t
gcccagcagacatttgggttctaattgattaaaccntgcagaagcacaggagctcaggacctggcatgtct

SEQ ID NO: 10701 - DNA, 71 bp, chicken (Gallus Gallus)
  misc_feature (36): n=a or c
caaatctgaaagaacagatatatcacttaaacatancacaacttaatgaatttcctctctagcagtacaac

SEQ ID NO: 10702 - DNA, 71 bp, chicken (Gallus Gallus)
  misc_feature (36): n=a or g
ccttagagagcctgaaaaaattttcgagcgattacncagtaatttatgcagattgctatgttaattttgaa

SEQ ID NO: 10703 - DNA, 71 bp, chicken (Gallus Gallus)
  misc_feature (36): n=a or g
gtcaaaccacaaggttaatttcacaccacggtgatnaagttgttacagatggggcaatgcctctacctcaa

SEQ ID NO: 10704 - DNA, 71 bp, chicken (Gallus Gallus)
  misc_feature (36): n=a or g
gcaagcccgaaggttgtaagaaactgaccagtaacnttactggtacactcatatttcatttggaataatct

SEQ ID NO: 10705 - DNA, 71 bp, chicken (Gallus Gallus)
  misc_feature (36): n=a or g
gatgcacagagcagcaccgtgagaccaagtacacanatacaaccatattgtagcacacgaaaggagaggaa

SEQ ID NO: 10706 - DNA, 71 bp, chicken (Gallus Gallus)
  misc_feature (36): n=c or t
tcatgtattcacatgcacccctgcccaaagcacacntactgaaggtttctagttcctccttgtagttgcac

SEQ ID NO: 10707 - DNA, 71 bp, chicken (Gallus Gallus)
  misc_feature (36): n=c or t
gctatttcccatcagcctttcaggccgactggaaanagaagagaaatccaaattcccatggtgtaggagtg

SEQ ID NO: 10708 - DNA, 71 bp, chicken (Gallus Gallus)
  misc_feature (36): n=a or c
agcgactctccatccacacgttgcaatgctgtgccntctgcttgctttctgcagtttgtccaccaaaatgc

SEQ ID NO: 10709 - DNA, 71 bp, chicken (Gallus Gallus)
  misc_feature (36): n=c or t
ggggctgccacctacaaaatccaaacatgcctcttncttttctgccaccaggtaatggcagtcagtgatga

SEQ ID NO: 10710 - DNA, 71 bp, chicken (Gallus Gallus)
  misc_feature (36): n=c or t
tttgatgttcatatcgtgtacaaaactttgagaaangcttctgaaccctggccaacaaccagcttattttc

SEQ ID NO: 10711 - DNA, 71 bp, chicken (Gallus Gallus)
  misc_feature (36): n=c or t
gtgcatacaattactgtgagtatatgcatcagttancaccttaaaggtcgcattttcacctcatttcagag

SEQ ID NO: 10712 - DNA, 71 bp, chicken (Gallus Gallus)
  misc_feature (36): n=a or c
aggtaaaactgcagaagaacagcaaaaggtgagagncaggattctcctacgtgaacgttcaatgggcaatg

SEQ ID NO: 10713 - DNA, 71 bp, chicken (Gallus Gallus)
  misc_feature (36): n=a or g
tcaagattcaccccgttctctctcctcctatatacnggcaagcaacaaagcaactctgactaaacacattt

SEQ ID NO: 10714 - DNA, 71 bp, chicken (Gallus Gallus)
  misc_feature (36): n=g or t
ttgatgttcaacaaatggtaaagcataacaataatntaaatcaaataaccaaatctatatgaaatatgcac

SEQ ID NO: 10715 - DNA, 71 bp, chicken (Gallus Gallus)
  misc_feature (36): n=a or g
attgctgtctgtggctaagagtcctggtgaaaaatntgtgtgaattacgtgcatgcattgtaggtatgaag

SEQ ID NO: 10716 - DNA, 71 bp, chicken (Gallus Gallus)
  misc_feature (36): n=c or t
tctccaagctgtgaggtgtgctgaacaaagcattgngtcggtatgtggttaaaccaatccagcaacaacac

SEQ ID NO: 10717 - DNA, 71 bp, chicken (Gallus Gallus)
  misc_feature (36): n=a or g
ccatctgcgctctgtacttaatatggagcttgttcnggctcttcagtgaaatatgggaaataatgactgtg

SEQ ID NO: 10718 - DNA, 71 bp, chicken (Gallus Gallus)
  misc_feature (36): n=c or g
gacttgtccctcctttttctgccttcttgattttgntcccaaatcaagccattaaatccaaagtttaacaa

SEQ ID NO: 10719 - DNA, 71 bp, chicken (Gallus Gallus)
  misc_feature (36): n=a or g
aacaaaggagacccagggcagtgtcacaaattaganggcattccaggcctttttttctgcatattgtcccc

SEQ ID NO: 10720 - DNA, 71 bp, chicken (Gallus Gallus)
  misc_feature (36): n=a or g
aagaaaagaaacagggtcatgctctatcaccaactncagtttgacgtaagtcaaaattcaaaagatttcat

SEQ ID NO: 10721 - DNA, 71 bp, chicken (Gallus Gallus)
  misc_feature (36): n=c or g
gggggctcccctggtttattctttctagataaactntaggatgtactcatcccattggtacctgggattgc

SEQ ID NO: 10722 - DNA, 71 bp, chicken (Gallus Gallus)
  misc_feature (36): n=c or g
actacctcatatcagtgaatttctaatgaaagttgnctaactattgctgaaaaccagagcagtgggaggtt

SEQ ID NO: 10723 - DNA, 71 bp, chicken (Gallus Gallus)
  misc_feature (36): n=c or t
atataaccaggttaatctgaaattgtttcaggtttntacactttcctttactattaagtcacagtgagctg

SEQ ID NO: 10724 - DNA, 71 bp, chicken (Gallus Gallus)
  misc_feature (36): n=a or c
caagcagtaaaacccaccagctgttctctgttgagncggcctctttgtgggccaccttggatttcatactt

SEQ ID NO: 10725 - DNA, 71 bp, chicken (Gallus Gallus)
  misc_feature (36): n=g or t
atgcgtgtgactactttaggcttgatctacaagaantaaactttcaggtccaccatttgttgtctaagctg

SEQ ID NO: 10726 - DNA, 71 bp, chicken (Gallus Gallus)
  misc_feature (36): n=c or t
ctgctttaaagcattgtcttaacactaccttctatnggcagttgagtgaacctagttttaactcagtatcc

SEQ ID NO: 10727 - DNA, 71 bp, chicken (Gallus Gallus)
  misc_feature (36): n=c or t
taaagaaatactctatttgtgatggttttaaacagngctgaggctttttttctaattaggtagcagtgaca

SEQ ID NO: 10728 - DNA, 71 bp, chicken (Gallus Gallus)
  misc_feature (36): n=c or t
acatcctcaaagatatggttccattgttctaggaanagaggtgtcctgtgtgtgcttgagtgcctggatca

SEQ ID NO: 10729 - DNA, 71 bp, chicken (Gallus Gallus)
  misc_feature (36): n=c or t
atccatcctcgctgccttttggaacggttcagctcnctggtcactgcagtgggaactcccaacctcactgg

SEQ ID NO: 10730 - DNA, 71 bp, chicken (Gallus Gallus)
  misc_feature (36): n=g or t
acataacaggctttactgacatttcgcgttgagaanccccaccggtgagcgagcatcgtgccataaatctc

SEQ ID NO: 10731 - DNA, 71 bp, chicken (Gallus Gallus)
  misc_feature (36): n=c or t
ttgctgtcatcaaaagaactaaaaaccaaggataangtgctagaatgtcaaatatatgcagaaccagaacc

SEQ ID NO: 10732 - DNA, 71 bp, chicken (Gallus Gallus)
  misc_feature (36): n=c or t
ctctagggaggggtcccttccaatctcaaccattcngggattctgttaggtgtcagcatgtcatttctgtg

SEQ ID NO: 10733 - DNA, 71 bp, chicken (Gallus Gallus)
  misc_feature (36): n=c or t
agactgctccatggtctcaccagctgtggcactgantgctgtatgatgctggacatgtcacatgtacaact

SEQ ID NO: 10734 - DNA, 71 bp, chicken (Gallus Gallus)
  misc_feature (36): n=c or g
agggcagtttggtttttcagtcctctaatccctctncttatctctgcctttgttcagagtggagttcagtt

SEQ ID NO: 10735 - DNA, 71 bp, chicken (Gallus Gallus)
  misc_feature (36): n=a or g
tctagcaactcagagcaacatgaagctcagtgacanaagcaaataaaaacaataccactattgctctacag

SEQ ID NO: 10736 - DNA, 71 bp, chicken (Gallus Gallus)
  misc_feature (36): n=c or t
ctgtacgtcgtccttcacgtttagaattgacctganatctcagcacagctgccaaagctttctcacaaaag

SEQ ID NO: 10737 - DNA, 71 bp, chicken (Gallus Gallus)
  misc_feature (36): n=a or c
cccaaggtttctggtctatgtaaatgactaaactgntgagcaaaaggcacctatgtttttaacaaccgagc

SEQ ID NO: 10738 - DNA, 71 bp, chicken (Gallus Gallus)
  misc_feature (36): n=g or t
ttcagaggtgagaaaaaatgagtattctaaatatcnacaccgtgtctttctaagttaatttaacaaccaca

SEQ ID NO: 10739 - DNA, 71 bp, chicken (Gallus Gallus)
  misc_feature (36): n=c or g
gggcaattttgagctagaattgtgactgaggctgcnttaatacttcagtcatgctgtcactgaggattatt

SEQ ID NO: 10740 - DNA, 71 bp, chicken (Gallus Gallus)
  misc_feature (36): n=c or t
ccatatttagtttgctgcacaaacaaaacaccttgnatttgtttgccacagagcttccaaaggctgctgag

SEQ ID NO: 10741 - DNA, 71 bp, chicken (Gallus Gallus)
  misc_feature (36): n=c or t
tttggggagctggaccaagcatttttttcctacagncccactgcccatcctcgtcatgctgcttttgggct

SEQ ID NO: 10742 - DNA, 71 bp, chicken (Gallus Gallus)
  misc_feature (36): n=g or t
gacactaaaatcattttagcacagtgtctgaaaaantattcctctccacaccacagaggactggcaggctg

SEQ ID NO: 10743 - DNA, 71 bp, chicken (Gallus Gallus)
  misc_feature (36): n=a or g
gcctgtaacacccaagatttaacagccatagtcccntttctatatacaaacagctctcccatcagttttta

SEQ ID NO: 10744 - DNA, 71 bp, chicken (Gallus Gallus)
  misc_feature (36): n=a or g
agagccagagcactgcaggtgcacggcgatgcgacngggagcacagaattgaattaaactcacttaaaccc

SEQ ID NO: 10745 - DNA, 71 bp, chicken (Gallus Gallus)
  misc_feature (36): n=c or t
gtccctgttttttctttcttttgccttctggctctnctagctgtacattcctctaaggacagctactcaat

SEQ ID NO: 10746 - DNA, 71 bp, chicken (Gallus Gallus)
  misc_feature (36): n=a or g
ttataaacagatgtctgctcagtaattcccttactntggtgtaactccgtaacatgatggaaaacacagaa

SEQ ID NO: 10747 - DNA, 71 bp, chicken (Gallus Gallus)
  misc_feature (36): n=c or t
ataggctagcagttgccaagtatttcaaccatcccntcgcttttaagcacagcagagcattattttaagct

SEQ ID NO: 10748 - DNA, 71 bp, chicken (Gallus Gallus)
  misc_feature (36): n=c or t
gtaatcacctacattagccaagaagcaaagccgcgntcccaaatatctccaattcacatgcctctatattc

SEQ ID NO: 10749 - DNA, 71 bp, chicken (Gallus Gallus)
  misc_feature (36): n=c or t
ctatgttttcctttttaaattcctccccccatcagngtgtaaagaaagcagccacctaagacataacatct

SEQ ID NO: 10750 - DNA, 71 bp, chicken (Gallus Gallus)
  misc_feature (36): n=c or t
tttcaccaactgtttactggctactgcaaaaatgtngtgttcacagcctcgttacttctacctatacactg

SEQ ID NO: 10751 - DNA, 71 bp, chicken (Gallus Gallus)
  misc_feature (36): n=a or c
tccaagacatgaggatctccattgtaggaaatactncttctctgaaagggtggtcaggcactggaatgggc

SEQ ID NO: 10752 - DNA, 71 bp, chicken (Gallus Gallus)
  misc_feature (36): n=a or g
gtctagaagaaagcaaacttgtcagtaaactcatcntagtaccagttaaattgccaggaaacaggcccaag

SEQ ID NO: 10753 - DNA, 71 bp, chicken (Gallus Gallus)
  misc_feature (36): n=a or g
tgatgtaagattaaatggcataatccttgcactgantagcaacataattttgtcagtgtttttttttcccc

SEQ ID NO: 10754 - DNA, 71 bp, chicken (Gallus Gallus)
  misc_feature (36): n=c or t
aggaatgggaacaggaagagcatgtaaaagtaatanttaaagctcgaaatcatttatctgaatctcacact

SEQ ID NO: 10755 - DNA, 71 bp, chicken (Gallus Gallus)
  misc_feature (36): n=a or g
attagaaggaagaatcaatagatatggattaagcantctacttcatacgcatttattccaaaactacacag

SEQ ID NO: 10756 - DNA, 71 bp, chicken (Gallus Gallus)
  misc_feature (36): n=a or g
atgatgagtcagttgtttcccagaccatggctcccntgtgctcggtgtggtatgaagaagatcacctctgt

SEQ ID NO: 10757 - DNA, 71 bp, chicken (Gallus Gallus)
  misc_feature (36): n=c or t
gtgtatggtacccaaagtctaagattcacccctgcnttacaaggactggtagcattcaaatctttgccgtg

SEQ ID NO: 10758 - DNA, 71 bp, chicken (Gallus Gallus)
  misc_feature (36): n=g or t
ctgtctaccttgccccagtgcctctcttgcagtacngttttgtgttaatgaaatcagggttcttgaacata

SEQ ID NO: 10759 - DNA, 71 bp, chicken (Gallus Gallus)
  misc_feature (36): n=c or t
ttccaatagtaagatgcatcttaatgcagcactgtnattagtcacatgtacttatgattccgtgatatctg

SEQ ID NO: 10760 - DNA, 71 bp, chicken (Gallus Gallus)
  misc_feature (36): n=c or t
caccttgctaggaagcgtgttccagtgtttgaccanacctgggccatatccctataatcttcccagtataa

SEQ ID NO: 10761 - DNA, 71 bp, chicken (Gallus Gallus)
  misc_feature (36): n=a or g
ctgctggaggatgtgcaaccagtgagcgtgaggaanactacactgggttgcatacagaggcacggaagcca

SEQ ID NO: 10762 - DNA, 71 bp, chicken (Gallus Gallus)
  misc_feature (36): n=c or t
taatccagctgaatgcttgtaagagtttagatccangcttattgcaagtgaggaggaaaaacaaaaaggaa

SEQ ID NO: 10763 - DNA, 71 bp, chicken (Gallus Gallus)
  misc_feature (36): n=a or g
tacaagaaataacaggtgaaaaattatgcctgcctncattgcctataagcatgcaaaagctttgaacacag

SEQ ID NO: 10764 - DNA, 71 bp, chicken (Gallus Gallus)
  misc_feature (36): n=a or c
ccccaagcacaggacttggaaatgaaatacctgatntaagattaggttaatttgcagggaaaataggtaac

SEQ ID NO: 10765 - DNA, 71 bp, chicken (Gallus Gallus)
  misc_feature (36): n=a or g
agcaagaaagcccagaggccagcttttgctctcagngtttcatggcaaagcattcagacagagtaaatgca

SEQ ID NO: 10766 - DNA, 71 bp, chicken (Gallus Gallus)
  misc_feature (36): n=a or g
ctgctacatcagcaggagcatttctgtgtggctcangaggaggaccacgtgctgttaaggaggacactgat

SEQ ID NO: 10767 - DNA, 71 bp, chicken (Gallus Gallus)
  misc_feature (36): n=a or g
gcacttttcccttccttaaatccgctctctcagagncccaccccagcataactcataaaccaactccggcc

SEQ ID NO: 10768 - DNA, 71 bp, chicken (Gallus Gallus)
  misc_feature (36): n=a or g
ctcagctgttacctttgacacgctactgacttcatncagaaaaaaatatgggggaggtcactctagatagg

SEQ ID NO: 10769 - DNA, 71 bp, chicken (Gallus Gallus)
  misc_feature (36): n=a or g
aagatgggagggggggacagcaaaatgaaggaaggnacagtcagcatttgacttgttatttgcttgtgaaa

SEQ ID NO: 10770 - DNA, 71 bp, chicken (Gallus Gallus)
  misc_feature (36): n=c or t
cttgggaattaaaaagggaaggaaacaagagatttncagcctgagtgtggggagggcttcaagcttactag

SEQ ID NO: 10771 - DNA, 71 bp, chicken (Gallus Gallus)
  misc_feature (36): n=a or g
gtggagaaataatggcctttgccatgcttatgttgntgaagatatttttactaactggggcaatatattga

SEQ ID NO: 10772 - DNA, 71 bp, chicken (Gallus Gallus)
  misc_feature (36): n=a or g
aagggctggggtgtgaatctgacagaatgctctgcngagaggggaaattcattgctactgataagtttttg

SEQ ID NO: 10773 - DNA, 71 bp, chicken (Gallus Gallus)
  misc_feature (36): n=c or g
gtatacttctgtgccttactatagttgtaactaggnaataaaacaagacaattttaatcagagcgagctca

SEQ ID NO: 10774 - DNA, 71 bp, chicken (Gallus Gallus)
  misc_feature (36): n=c or t
ggaaagccaggagcaagtttgggttggcgttaaagnggagctcctgcaatgcatattgttcctatgcaaaa

SEQ ID NO: 10775 - DNA, 71 bp, chicken (Gallus Gallus)
  misc_feature (36): n=a or g
gttctggatgggcagctggagccacatgtactcacntacctcaaactacacacctgcataacccaaggaaa

SEQ ID NO: 10776 - DNA, 71 bp, chicken (Gallus Gallus)
  misc_feature (36): n=c or t
aatcttcaaaggaaaacattaccttttttccttaangtgtcatttttctttacaattacagaggcactgtt

SEQ ID NO: 10777 - DNA, 71 bp, chicken (Gallus Gallus)
  misc_feature (36): n=a or g
tgcattcatgatattaaactaatggaagtcttaacnatctagaaaggagggaattaattagcctaggaaag

SEQ ID NO: 10778 - DNA, 71 bp, chicken (Gallus Gallus)
  misc_feature (36): n=c or t
gccctaaattaaaactagcactaatttgaaaatctntgatgagaatatacactgtccatgttgacatacca

SEQ ID NO: 10779 - DNA, 71 bp, chicken (Gallus Gallus)
  misc_feature (36): n=a or g
ctgcagaaagagcagaggtgagcgtggtcagggaangtctggtttatctctcgagacagatctgtttctag

SEQ ID NO: 10780 - DNA, 71 bp, chicken (Gallus Gallus)
  misc_feature (36): n=a or g
cgaaaggcacaggatgaaaaaaaagatcaggcacanaaacaaaggtgttactataattaactttttctttt

SEQ ID NO: 10781 - DNA, 71 bp, chicken (Gallus Gallus)
  misc_feature (36): n=a or c
agcatcacaataaatctccaagcatagagtgtgcangaggcattttgctgtgcttccctgcagcttggcag

SEQ ID NO: 10782 - DNA, 71 bp, chicken (Gallus Gallus)
  misc_feature (36): n=a or g
ttttgaccactgttgttttcaagtctgaaatcagcnagctgaggagaaccaggttcctttcatcgctgtac

SEQ ID NO: 10783 - DNA, 71 bp, chicken (Gallus Gallus)
  misc_feature (36): n=c or t
tatctgaacatccattgctccttttcatctttgcangaaaagagccatgtaccaaccaaagacattaccag

SEQ ID NO: 10784 - DNA, 71 bp, chicken (Gallus Gallus)
  misc_feature (36): n=c or t
cctgctcactcaatggcccaaattctagctgcaggncctcctggcagctcatggtgccaagcagagaagcg

SEQ ID NO: 10785 - DNA, 71 bp, chicken (Gallus Gallus)
  misc_feature (36): n=c or t
tgggaagttcaaaaacgcacttcagcctctaaaggnaggtagcagagcactgtttaacagtaccaacaaag

SEQ ID NO: 10786 - DNA, 71 bp, chicken (Gallus Gallus)
  misc_feature (36): n=a or g
aattcgtaatagattttatcatattcagtgcctccnattgtgatttctggaatgaactgagggatagctac

SEQ ID NO: 10787 - DNA, 71 bp, chicken (Gallus Gallus)
  misc_feature (36): n=a or c
tatttctaagcctacatggcttttccaagaaggttntctcatagaagacaagaaaaaaatccacaaaaaaa

SEQ ID NO: 10788 - DNA, 71 bp, chicken (Gallus Gallus)
  misc_feature (36): n=c or g
gactacagccaccacaacacgtaagcaagatttccnttattgctccagcaaatgaggcaatacaggtttac

SEQ ID NO: 10789 - DNA, 71 bp, chicken (Gallus Gallus)
  misc_feature (36): n=a or g
gcttggcaaggtgtgaattgatctccataggccttncaaacgcttccccctgaaaaacctcgagttccact

SEQ ID NO: 10790 - DNA, 71 bp, chicken (Gallus Gallus)
  misc_feature (36): n=c or t
atgctgccacaagacaggacagagcgtgcttagcanctgagtattttacatcccttggctaccttttttac

SEQ ID NO: 10791 - DNA, 71 bp, chicken (Gallus Gallus)
  misc_feature (36): n=a or g
tttgaaaaaggcttaatgcagaaatgcttaatttgnagccagaggagatatttcattcagtttctctaggg

SEQ ID NO: 10792 - DNA, 71 bp, chicken (Gallus Gallus)
  misc_feature (36): n=g or t
aaaaaggaaggaatgtaatggacagccctgaagggntatcctctggaacaaaccacagtgcttgtcttact

SEQ ID NO: 10793 - DNA, 71 bp, chicken (Gallus Gallus)
  misc_feature (36): n=c or t
ggaatactgaagaaaaatcacatttcagtcttgcancagcatatgttgataaagccccttcttgggtgctt

SEQ ID NO: 10794 - DNA, 71 bp, chicken (Gallus Gallus)
  misc_feature (36): n=c or g
cagccaagcttgcagcctgtaagagtgtccatcagngcattttggatcattgtaaaatctctctaggttac

SEQ ID NO: 10795 - DNA, 71 bp, chicken (Gallus Gallus)
  misc_feature (36): n=a or g
ttccatcacttttctaggccagcacctagtctccancaaatgcattagcctgcagtacaccttttccttag

SEQ ID NO: 10796 - DNA, 71 bp, chicken (Gallus Gallus)
  misc_feature (36): n=c or t
tgtggtcccgggtggttggtttgcaacaggaatgcnatggggcagcaggagtcccagcagcccctggaagg

SEQ ID NO: 10797 - DNA, 71 bp, chicken (Gallus Gallus)
  misc_feature (36): n=a or g
ctttgaaggtggctggctggagtttttgcattgatncaattggtgactcgtccaattttgaaggaccacat

SEQ ID NO: 10798 - DNA, 71 bp, chicken (Gallus Gallus)
  misc_feature (36): n=c or t
agatttttctcaattcatactccagtgcttaaagangcaaattacttccaaatatacctgagcagccctgc

SEQ ID NO: 10799 - DNA, 71 bp, chicken (Gallus Gallus)
  misc_feature (36): n=c or t
cgcagggatacaaatgccacatttgactgagaccantagacaaaagaactctggcatgattagatatggaa

SEQ ID NO: 10800 - DNA, 71 bp, chicken (Gallus Gallus)
  misc_feature (36): n=c or t
tactcaatttgcactgcagaaaagctagtgcctctntccatgatgcacatacatgaggcagtctgctgtgg

SEQ ID NO: 10801 - DNA, 71 bp, chicken (Gallus Gallus)
  misc_feature (36): n=c or t
aataaagcctaactgtgatctgtggcaacttgtctngctgcgtggacgcttggggagtgatcagcagttgt

SEQ ID NO: 10802 - DNA, 71 bp, chicken (Gallus Gallus)
  misc_feature (36): n=a or g
agtaagacaggaatagtcagacaaagtttttgaacncaagaggtaatactttcaattgtgatttctgggag

SEQ ID NO: 10803 - DNA, 71 bp, chicken (Gallus Gallus)
  misc_feature (36): n=c or t
aacaatacttcttaattaaaaagaaacccaaaaaanaatgtagagacataagatgctttcttgcctcatat

SEQ ID NO: 10804 - DNA, 71 bp, chicken (Gallus Gallus)
  misc_feature (36): n=c or t
gatcgccagtgaaagaacggtgaaggctaaaggtgntccagcccagccagctgccctgctcctcaggcatg

SEQ ID NO: 10805 - DNA, 71 bp, chicken (Gallus Gallus)
  misc_feature (36): n=c or t
acttttaatcttcaaatagaaataagccttccttgnggaaacaggctgctttttcagatgttctcagaaat

SEQ ID NO: 10806 - DNA, 71 bp, chicken (Gallus Gallus)
  misc_feature (36): n=c or t
agaaagccagagagatcttttatgtaaactcctacngctaggttaggtgaatcccctagcttctgtgtatt

SEQ ID NO: 10807 - DNA, 71 bp, chicken (Gallus Gallus)
  misc_feature (36): n=a or t
agtattatcaaaataatttaagatctactgtgtttncaaaggcacaacactgcagtttctagaaaaaagaa

SEQ ID NO: 10808 - DNA, 71 bp, chicken (Gallus Gallus)
  misc_feature (36): n=c or t
ctatttttgtgatattgcttatcaaaaggagggtantttcagtcctctatgttacgaacaggttcacaaac

SEQ ID NO: 10809 - DNA, 71 bp, chicken (Gallus Gallus)
  misc_feature (36): n=a or g
tgagcaaagatgtgtacgtgcgtgtagagctctgcnacctcttagcaatacatcaacgtgataacattttt

SEQ ID NO: 10810 - DNA, 71 bp, chicken (Gallus Gallus)
  misc_feature (36): n=a or g
gtcaaatgactaattggtgatgaacatcacatgacngaatgaatctatttgacaataactgtcagcatgat

SEQ ID NO: 10811 - DNA, 71 bp, chicken (Gallus Gallus)
  misc_feature (36): n=a or g
caaacgagagtgtagctcaatgttgtacatcatttnctactagacgttttaataggcacaattacctgaaa

SEQ ID NO: 10812 - DNA, 71 bp, chicken (Gallus Gallus)
  misc_feature (36): n=c or g
tatgctagaagcagatgagttgcattgtattgaagnaatgctgtttctctaagctacaggctgctacagcc

SEQ ID NO: 10813 - DNA, 71 bp, chicken (Gallus Gallus)
  misc_feature (36): n=c or t
gaaaggcgatgccatagtgtgtgagaagtaaaaacngtggtgactcttactgtatgtgactgctcttgtgt

SEQ ID NO: 10814 - DNA, 71 bp, chicken (Gallus Gallus)
  misc_feature (36): n=c or t
tgagatgttttcaaagtctgtgtgaaacctggaatnaaatatatattttttccatttgctaatagtctaag

SEQ ID NO: 10815 - DNA, 71 bp, chicken (Gallus Gallus)
  misc_feature (36): n=a or g
tactgtatcagaggttaaaagcaagtacatgtgttnactttttcctctaagatgacatatcaagtactttc

SEQ ID NO: 10816 - DNA, 71 bp, chicken (Gallus Gallus)
  misc_feature (36): n=a or g
gtttttttttttttttctaactcatcacagagctgntagcaggaaatagaaaagaaagaaaccatgagaat

SEQ ID NO: 10817 - DNA, 71 bp, chicken (Gallus Gallus)
  misc_feature (36): n=a or g
gttattgtacaatttcattgtcttggttctttaacnctattgtgtaagtgttctcaaggtcctacatgcac

SEQ ID NO: 10818 - DNA, 71 bp, chicken (Gallus Gallus)
  misc_feature (36): n=c or t
gtggcctttgctagacaattatgctgagcctaacantgtgaccctgtgctgcaggaagcagtgattcaggg

SEQ ID NO: 10819 - DNA, 71 bp, chicken (Gallus Gallus)
  misc_feature (36): n=c or g
atcacaaaaacagctttgtcaaaagtaactagggancagatgcgtctttataattacctgtgacacctttt

SEQ ID NO: 10820 - DNA, 71 bp, chicken (Gallus Gallus)
  misc_feature (36): n=g or t
atacatcatttccaaaaaacaggtacaaagaaacanatttttagcatatttataacagataaatgataaca

SEQ ID NO: 10821 - DNA, 71 bp, chicken (Gallus Gallus)
  misc_feature (36): n=c or t
gctgtgtgcagatttgcaataaaggtggattattangaatcgattaaacatttctggtaagaaaaaaacat

SEQ ID NO: 10822 - DNA, 71 bp, chicken (Gallus Gallus)
  misc_feature (36): n=a or c
tattacaattattttcagctgctttaaatacttcantgacttccttgttattttatgctctatgaggactg

SEQ ID NO: 10823 - DNA, 71 bp, chicken (Gallus Gallus)
  misc_feature (36): n=c or g
tttcactgataaataaataagcatcacaagactggntaccccagatatctgtaaggatctcttcgctgtct

SEQ ID NO: 10824 - DNA, 71 bp, chicken (Gallus Gallus)
  misc_feature (36): n=c or t
tgaaatgattttctcacatttatattggaatactgnggtggtacaggaggccattcctcatgttccttccc

SEQ ID NO: 10825 - DNA, 71 bp, chicken (Gallus Gallus)
  misc_feature (36): n=c or t
ttgtgaggcttttagaaatggtgaaccaattaattnctgagaatgacttccctttacaagtaacaccacta

SEQ ID NO: 10826 - DNA, 71 bp, chicken (Gallus Gallus)
  misc_feature (36): n=a or g
tttcccctagaaatgtgaatattctagaaatacggnaaagtgcatccagactctatcttaggaaaatgctg

SEQ ID NO: 10827 - DNA, 71 bp, chicken (Gallus Gallus)
  misc_feature (36): n=a or g
agaaatgtaagggaagataaaggtccagactgcatngtaggattggcagaatgggagaaaaagtctgcaca

SEQ ID NO: 10828 - DNA, 71 bp, chicken (Gallus Gallus)
  misc_feature (36): n=c or t
ttatccatattattctgtgattgcaatggggaaaangtcatgctaattgaataggtgcttgtggtgctctc

SEQ ID NO: 10829 - DNA, 71 bp, chicken (Gallus Gallus)
  misc_feature (36): n=c or t
ataactcttgtaccaaacctgtcaatactaagaagntcataatcctgccttaggctcttcctaaacactca

SEQ ID NO: 10830 - DNA, 71 bp, chicken (Gallus Gallus)
  misc_feature (36): n=a or g
catgtgtttctatggctttcttaggcaatcctatcntcatttttccctaatttaaataccttgctagtgtt

SEQ ID NO: 10831 - DNA, 71 bp, chicken (Gallus Gallus)
  misc_feature (36): n=a or g
actggctataaacacagaattaaaaatccccctgcntttgagttgttccccttgcttgctaaactcatacg

SEQ ID NO: 10832 - DNA, 71 bp, chicken (Gallus Gallus)
  misc_feature (36): n=c or t
ttattttgcattctcttgcagatttgtagtaatgcntctgttcattaatggcataactacgtgttgaatga

SEQ ID NO: 10833 - DNA, 71 bp, chicken (Gallus Gallus)
  misc_feature (36): n=g or t
ttcattgtcttccatcatttatgaacatagtttatntttgctctattttttatttagattctctcactgcc

SEQ ID NO: 10834 - DNA, 71 bp, chicken (Gallus Gallus)
  misc_feature (36): n=c or t
cacttttaaatttgtttgttgaaagctgctaatatnaactgatttgttccctggcactgtcagacactttt

SEQ ID NO: 10835 - DNA, 71 bp, chicken (Gallus Gallus)
  misc_feature (36): n=c or t
tgcactttttagctcattataacaggctcatggaanctaactttaaataaaggctgttgctggactaaatt

SEQ ID NO: 10836 - DNA, 71 bp, chicken (Gallus Gallus)
  misc_feature (36): n=a or g
agcacaacgcaatcaaagcctcgtttcgtgatccangtctcgcagacacgctcaactggattccaggcacg

SEQ ID NO: 10837 - DNA, 71 bp, chicken (Gallus Gallus)
  misc_feature (36): n=c or t
gatgttactgcatatatagcttttctgtttagggtnaaaatgtggaatcaggtctgattccactccagtcc

SEQ ID NO: 10838 - DNA, 71 bp, chicken (Gallus Gallus)
  misc_feature (36): n=a or g
gcgctattaaatacttcacagctctaaggagacttngattaaatgaactatttggctccaggcttagccta

SEQ ID NO: 10839 - DNA, 71 bp, chicken (Gallus Gallus)
  misc_feature (36): n=c or t
agaagtatgaaaagatgctttaacagctgggcctcngtaacacatataatttagctttagcctcttggtca

SEQ ID NO: 10840 - DNA, 71 bp, chicken (Gallus Gallus)
  misc_feature (36): n=a or g
tttatatcacctgaggcctcactccctttctgtgangtcagtaagcaaattagcactttcaaacgtagtgt

SEQ ID NO: 10841 - DNA, 71 bp, chicken (Gallus Gallus)
  misc_feature (36): n=c or g
cagacatggaacattggctacactgctatctatcanatgctgtatcttgtctagaacaaaacagaacttta

SEQ ID NO: 10842 - DNA, 71 bp, chicken (Gallus Gallus)
  misc_feature (36): n=g or t
tctatatacaaatgaaagtacagtgaacgtacaaanacaatccttttttttttttccttttttcaaaaggc

SEQ ID NO: 10843 - DNA, 71 bp, chicken (Gallus Gallus)
  misc_feature (36): n=a or g
gcacttcaaaagcactatgagcgtgcacatgtacantaaggtgcttcagctgatgtgtggccacttccaga

SEQ ID NO: 10844 - DNA, 71 bp, chicken (Gallus Gallus)
  misc_feature (36): n=a or c
tgacacggctaagaaccttccttgtaagtgttaacnaaataatcttaaaatgcaaagctagactgtttaaa

SEQ ID NO: 10845 - DNA, 71 bp, chicken (Gallus Gallus)
  misc_feature (36): n=a or t
agcggttgaaaaaagagcagtgtcttccgtggaagnaaaccaatccagcaaggaagcagccgttagcttcg

SEQ ID NO: 10846 - DNA, 71 bp, chicken (Gallus Gallus)
  misc_feature (36): n=c or t
agtagaagtgaaaacaggacataaaccagcacatantctgcagcacaaaatgtgcttgaagtaacaatccc

SEQ ID NO: 10847 - DNA, 71 bp, chicken (Gallus Gallus)
  misc_feature (36): n=a or g
aaatagcaagcgacagttgcctcactactcacatcntttcatttttggcactgggctctgcactcactggt

SEQ ID NO: 10848 - DNA, 71 bp, chicken (Gallus Gallus)
  misc_feature (36): n=a or g
caaagatatgcagtatgcaaccttgttagaagaacntgcttctaaatggtttggccacgcaccacctcact

SEQ ID NO: 10849 - DNA, 71 bp, chicken (Gallus Gallus)
  misc_feature (36): n=c or t
aagatactaatgctgaattcatagtaaaaacaccangtaactgtaacattcgtatctttattccagttatt

SEQ ID NO: 10850 - DNA, 71 bp, chicken (Gallus Gallus)
  misc_feature (36): n=a or g
cagcgtccctcccttaagcagaaacctcatttcatnttgtatgactttgcagaatacagcatctcattttc

SEQ ID NO: 10851 - DNA, 71 bp, chicken (Gallus Gallus)
  misc_feature (36): n=c or t
actgtgacggataaaaatgatgttctttactttagntaacaccagcttagtcaagtagttacaagcttcca

SEQ ID NO: 10852 - DNA, 71 bp, chicken (Gallus Gallus)
  misc_feature (36): n=a or c
tttattcactatgaacagagggatgttatttaagcnatttacttaaagtatcctttaaactagaccttcac

SEQ ID NO: 10853 - DNA, 71 bp, chicken (Gallus Gallus)
  misc_feature (36): n=g or t
aacatagaacaactgagagtagcatacccacaccanaactacaacacaatggctactggcttcagggcagc

SEQ ID NO: 10854 - DNA, 71 bp, chicken (Gallus Gallus)
  misc_feature (36): n=c or g
gcaaattctcaggttcagatatctgctttcaaacantaccgtgccatttaatttaatcaatcaccttaaca

SEQ ID NO: 10855 - DNA, 71 bp, chicken (Gallus Gallus)
  misc_feature (36): n=a or g
tgcagcttttcaccagcccattccagcccccagacnaagtccgccactcctaaggaacccaggaaagttag

SEQ ID NO: 10856 - DNA, 71 bp, chicken (Gallus Gallus)
  misc_feature (36): n=c or t
cattcaggtggaaaaatgctgatcagttataccctngtgatgtttcaattgagtttgaccgtcttatttcc

SEQ ID NO: 10857 - DNA, 71 bp, chicken (Gallus Gallus)
  misc_feature (36): n=a or g
cccgtactgcagagctgcacaaagttggcacgtgtngggagcatccacctctgttcctccgtgccatcact

SEQ ID NO: 10858 - DNA, 71 bp, chicken (Gallus Gallus)
  misc_feature (36): n=c or t
agtggtaaacttctcatatagtgtacaaactctganggggaagaaaaaaaccggagtacaaaagagtcaac

SEQ ID NO: 10859 - DNA, 71 bp, chicken (Gallus Gallus)
  misc_feature (36): n=a or g
ccaggtgcctggcgcagagaaccatcccaaaggagnctgcacaaatacatgtctgtctcagatgctttttc

SEQ ID NO: 10860 - DNA, 71 bp, chicken (Gallus Gallus)
  misc_feature (36): n=c or t
aatcatttttggctacatttctgcgtattctctgtnaggacattgctctctggtgaagaaggcggccatga

SEQ ID NO: 10861 - DNA, 71 bp, chicken (Gallus Gallus)
  misc_feature (36): n=a or c
actgataaacagagaaaagcttccaccacgtacagncttcgaaacaaccagatgctactgctgccgttgca

SEQ ID NO: 10862 - DNA, 71 bp, chicken (Gallus Gallus)
  misc_feature (36): n=a or c
ttaggtgaaatgcctactgctacatgccgtgtgtangctatagactaaaacagctcttaagaaatgtggtt

SEQ ID NO: 10863 - DNA, 71 bp, chicken (Gallus Gallus)
  misc_feature (36): n=a or g
gcaaagctccagtcaccatacatctaccaagccccngtaaatgtgtaggtgactactgaatggctcttggc

SEQ ID NO: 10864 - DNA, 71 bp, chicken (Gallus Gallus)
  misc_feature (36): n=a or g
gaaggtgctttcactgaacgttatgtttgccagttnctattaccatgcagccaacaaaagcctcagtgctt

SEQ ID NO: 10865 - DNA, 71 bp, chicken (Gallus Gallus)
  misc_feature (36): n=c or t
cacacgaattacttttaagtgaactgaggaacaagntgccctgtcctgacccaaacacacctctgaattct

SEQ ID NO: 10866 - DNA, 71 bp, chicken (Gallus Gallus)
  misc_feature (36): n=c or t
aggcgaagaatgaagtttggaagcagccatgtcacngtggctgggccctccccaagttacatcaagctttt

SEQ ID NO: 10867 - DNA, 71 bp, chicken (Gallus Gallus)
  misc_feature (36): n=a or t
tcttttcggtgatatacgttgtaaccaagaaaagcnatgggagcgcccaagaattatcgcttttcattttg

SEQ ID NO: 10868 - DNA, 71 bp, chicken (Gallus Gallus)
  misc_feature (36): n=a or t
atgagggcatctgaaaaggaggcacacaccttttcntgatgactaaataacaaccagttccccagactttt

SEQ ID NO: 10869 - DNA, 71 bp, chicken (Gallus Gallus)
  misc_feature (36): n=c or t
gacaactaaagcttttaccattctagatggaaacanggcatcatacttcccatagtcacagactctgccgt

SEQ ID NO: 10870 - DNA, 71 bp, chicken (Gallus Gallus)
  misc_feature (36): n=c or t
atctgcttgcactgttatagagctgaccttaaatanactgatttggtacccagctctctttccctttcttt

SEQ ID NO: 10871 - DNA, 71 bp, chicken (Gallus Gallus)
  misc_feature (36): n=a or g
gcacttttctgccaaacatctttctttcagtcaaanattttgaccgagtgatgggtattgcctaaatgaat

SEQ ID NO: 10872 - DNA, 71 bp, chicken (Gallus Gallus)
  misc_feature (36): n=a or g
agagtgagcaggaactgttaccagacttgaaaagancagtttcctcttataccctagatgagcccacagca

SEQ ID NO: 10873 - DNA, 71 bp, chicken (Gallus Gallus)
  misc_feature (36): n=c or t
atggaacagttttggtgggaaagaagtcagaaaccnacagatcaaacagactgcatgggaatcatgctgat

SEQ ID NO: 10874 - DNA, 71 bp, chicken (Gallus Gallus)
  misc_feature (36): n=a or g
agtttttaagagaaaacacaagattacaatgtcttnaactgcatttcgcatgttctttgagctctctcgta

SEQ ID NO: 10875 - DNA, 71 bp, chicken (Gallus Gallus)
  misc_feature (36): n=g or t
agtttcttcaacacgtttcttgttctcagagcctancaagagagcatctttgtagtgcaatacagttctct

SEQ ID NO: 10876 - DNA, 71 bp, chicken (Gallus Gallus)
  misc_feature (36): n=c or g
tcctcttcatcatttgttaatgtatggtacacaganacctcttatttatcatttggaagataaagctttgg

SEQ ID NO: 10877 - DNA, 71 bp, chicken (Gallus Gallus)
  misc_feature (36): n=c or t
caccatggaaatacgagcatgtggatgaacagatangtctttctgagttggctttaattgtatttgcccat

SEQ ID NO: 10878 - DNA, 71 bp, chicken (Gallus Gallus)
  misc_feature (36): n=a or t
ctctctaattcactctagtcaatagcttgatccatnacctaccagctgatcttgaataagagagttttaag

SEQ ID NO: 10879 - DNA, 71 bp, chicken (Gallus Gallus)
  misc_feature (36): n=c or g
tgcatcccttttgcccattgtagtgtgaagggcatnattcttgatccagcaaggggagctgtaaagcttaa

SEQ ID NO: 10880 - DNA, 71 bp, chicken (Gallus Gallus)
  misc_feature (36): n=a or g
tcaaactttcactgttcggtcgtttaagagttactncagaatgtgaagtgttgcaagcagctacctttaat

SEQ ID NO: 10881 - DNA, 71 bp, chicken (Gallus Gallus)
  misc_feature (36): n=c or t
gtaacagcacgtaaatgtgtgaaactctgtaacaanatgagagagtgcgactgctcagcatgaagaaagct

SEQ ID NO: 10882 - DNA, 71 bp, chicken (Gallus Gallus)
  misc_feature (36): n=g or t
aatcttagacctgtttgttttgtagctgctgagatngtattagcccacaggctcatacaacgtccatctag

SEQ ID NO: 10883 - DNA, 71 bp, chicken (Gallus Gallus)
  misc_feature (36): n=c or t
atccagcagtcggtctgaccagcctctaaagaatgngtcacgactgtcggtggtcacagggcaaaagggtt

SEQ ID NO: 10884 - DNA, 71 bp, chicken (Gallus Gallus)
  misc_feature (36): n=a or g
caaatcagtgtaattatgccagtgcttcacaccatncacccagaaagatgccagctatgtcccacatacac

SEQ ID NO: 10885 - DNA, 71 bp, chicken (Gallus Gallus)
  misc_feature (36): n=c or t
atctttctgatagtcctcactgatggcaggatggcnaaggcacagagaacatgcaaaaaggattcaacagt

SEQ ID NO: 10886 - DNA, 71 bp, chicken (Gallus Gallus)
  misc_feature (36): n=a or t
tgccagctgagaggaactgggcaatgttgcttggancaggaagaacttgggtgctcatcttctgcaggagt

SEQ ID NO: 10887 - DNA, 71 bp, chicken (Gallus Gallus)
  misc_feature (36): n=a or g
atagaccaaaaaaaaacccaaaaacccacaaccaancagcaccacaatcaatacttcataattatacgcat

SEQ ID NO: 10888 - DNA, 71 bp, chicken (Gallus Gallus)
  misc_feature (36): n=c or t
tgtaaccatgtgtaacctgtgtaacagcacgtaaangtgtgaaactctgtaacaacatgagagagtgcgac

SEQ ID NO: 10889 - DNA, 71 bp, chicken (Gallus Gallus)
  misc_feature (36): n=c or t
ttaagacactagaaggaactgaattcacagcttctntcagtcaggtatcaagtacactggagatgactgca

SEQ ID NO: 10890 - DNA, 71 bp, chicken (Gallus Gallus)
  misc_feature (36): n=a or t
tcgtctgaatttgagttttcttctggactaagctanccttttgggcatgaataaatgcttagctctttata

SEQ ID NO: 10891 - DNA, 71 bp, chicken (Gallus Gallus)
  misc_feature (36): n=a or c
cacattctatggggtcttaaaataagaggtaatagngtaaaaaggctgttccacttcctgtgaacatggaa

SEQ ID NO: 10892 - DNA, 71 bp, chicken (Gallus Gallus)
  misc_feature (36): n=a or g
gcacgctcacatatcatcgttctgttgcatgggaanatgaaacccattctgtcctagctaaactggcatat

SEQ ID NO: 10893 - DNA, 71 bp, chicken (Gallus Gallus)
  misc_feature (36): n=g or t
ggacctttcaaatgtagcaggactcagaacactttnctaaaatagaaatcaccaaacatcagcattaaatt

SEQ ID NO: 10894 - DNA, 71 bp, chicken (Gallus Gallus)
  misc_feature (36): n=a or g
gtaagatgaagctgtggttgaaaggaacatgttgcnttgtcagcagagaactgtgtgcaacctgactatgg

SEQ ID NO: 10895 - DNA, 71 bp, chicken (Gallus Gallus)
  misc_feature (36): n=a or g
tcctgagatgccttctaaactgagtttccctataanccaaacatcctaagttgttaactgcctaaacagat

SEQ ID NO: 10896 - DNA, 71 bp, chicken (Gallus Gallus)
  misc_feature (36): n=c or t
acagtaaatttcacaagcagagattattttctctcnttttctccaacatacaaaggagactttgatatcca

SEQ ID NO: 10897 - DNA, 71 bp, chicken (Gallus Gallus)
  misc_feature (36): n=c or t
ttcatgacgcatctttgtccagtccttggccatctnccctttcccattgctgcaacttctttttttctgtg

SEQ ID NO: 10898 - DNA, 71 bp, chicken (Gallus Gallus)
  misc_feature (36): n=a or g
agcaggtcatggtgttgtgtacaactgtaccattangaacactgtaaatagggccagtagagaattggtaa

SEQ ID NO: 10899 - DNA, 71 bp, chicken (Gallus Gallus)
  misc_feature (36): n=g or t
taaaccctctatgaagaacgttcattaaaaaccttntagttctatagagcagagactggaaatatggttta

SEQ ID NO: 10900 - DNA, 71 bp, chicken (Gallus Gallus)
  misc_feature (36): n=a or g
ttccctgcctctgtcctctgtggcacttgggtgtcnggctatgtagcaactgagtagcttcctcatctcag

SEQ ID NO: 10901 - DNA, 71 bp, chicken (Gallus Gallus)
  misc_feature (36): n=c or t
ttggctctcctgtactgtactgtagggtaggaaagntagggctgagattagggtttcgggggtagggtcct

SEQ ID NO: 10902 - DNA, 71 bp, chicken (Gallus Gallus)
  misc_feature (36): n=a or g
tccagacaagatggctgcagaaacttgataaacccntatttttaagctgtcttcactgctttttgttaagt

SEQ ID NO: 10903 - DNA, 71 bp, chicken (Gallus Gallus)
  misc_feature (36): n=g or t
gcaatactcgtgaagctgaagtcttggacttccagngtcagggtagatgagaagacagcctttcccttgca

SEQ ID NO: 10904 - DNA, 71 bp, chicken (Gallus Gallus)
  misc_feature (36): n=c or t
tttactgtggctgtaggaatctcagtttacctgcantttgttcagtaagagaaaacaacagctacctgctt

SEQ ID NO: 10905 - DNA, 71 bp, chicken (Gallus Gallus)
  misc_feature (36): n=a or t
aactgcttattaacaagtgaaagaggtgagctaagntaagttgctttcactctggtaagtcacagaacaaa

SEQ ID NO: 10906 - DNA, 71 bp, chicken (Gallus Gallus)
  misc_feature (36): n=c or t
tgctatcctgagaaaggcaccgccttgcctgcttcnctctgtaagatgggattaaggaggacagcagcaag

SEQ ID NO: 10907 - DNA, 71 bp, chicken (Gallus Gallus)
  misc_feature (36): n=c or t
acattaacagtatttgattctttgtagggagctggntttccgaaaggtggcagaactagaatatagccctt

SEQ ID NO: 10908 - DNA, 71 bp, chicken (Gallus Gallus)
  misc_feature (36): n=c or t
tgtatgatgcaaactcttgtgtaaactttgcataantttccagacagttcctgtctttcagatgcacctga

SEQ ID NO: 10909 - DNA, 71 bp, chicken (Gallus Gallus)
  misc_feature (36): n=c or t
aagttcttcaaagctgtcctttttcagcagctgatngagtgcaagatgaggaagatatcctaagatgcaaa

SEQ ID NO: 10910 - DNA, 71 bp, chicken (Gallus Gallus)
  misc_feature (36): n=a or t
gtaagatatttttctcactgtaatccagcttgaagngcgctcacattcttgtcttcatccatcccagctaa

SEQ ID NO: 10911 - DNA, 71 bp, chicken (Gallus Gallus)
  misc_feature (36): n=c or g
tggtgaactgctgcatttttctcctttttcatctcntgctgctgctgcctcgccttgcacctctgagctca

SEQ ID NO: 10912 - DNA, 71 bp, chicken (Gallus Gallus)
  misc_feature (36): n=a or g
aaaaaaaacccatgaaaaacacaaaaacaaaaccancccaacacataatgcacaaaatacgtatgggtttc

SEQ ID NO: 10913 - DNA, 71 bp, chicken (Gallus Gallus)
  misc_feature (36): n=a or c
gagcttttgtgtttggatttatgctctgcaactcgnactgtgtgagtctgtagttctcttcagattatgta

SEQ ID NO: 10914 - DNA, 71 bp, chicken (Gallus Gallus)
  misc_feature (36): n=a or g
agctgttctgagcaatgaagtctgaacatacaaatntgtaatgtgttctacaacaagctgtatcagtacaa

SEQ ID NO: 10915 - DNA, 71 bp, chicken (Gallus Gallus)
  misc_feature (36): n=g or t
aaatttcctttgataaaacaatgccttgattgtaangcaaagtgctaaacatttagtactgctaacaatgg

SEQ ID NO: 10916 - DNA, 71 bp, chicken (Gallus Gallus)
  misc_feature (36): n=c or t
tcaacttgacagcatctcatgctggaggggaaacangcaccgcacccactgagccacatactatttaactc

SEQ ID NO: 10917 - DNA, 71 bp, chicken (Gallus Gallus)
  misc_feature (36): n=a or t
ctcatcagaccctaaatcaatatctaagcatcactnatttattttaatttataagaaaaactagtgtgaag

SEQ ID NO: 10918 - DNA, 71 bp, chicken (Gallus Gallus)
  misc_feature (36): n=c or t
atacggaagcgtttagaagaggtatctcctaatctngtccgatatgatgatgtggaggaggcgaactactt

SEQ ID NO: 10919 - DNA, 71 bp, chicken (Gallus Gallus)
  misc_feature (36): n=a or g
aagtatttgttattccatcctctgtagtgtggctgngaaaatgttaaaacccttatgcttcacaggggacc

SEQ ID NO: 10920 - DNA, 71 bp, chicken (Gallus Gallus)
  misc_feature (36): n=a or g
acctcttcatcatcagatccaaaaagatcaatgtcntcatcatctttgctatctgtggctgcgcctgttgt

SEQ ID NO: 10921 - DNA, 71 bp, chicken (Gallus Gallus)
  misc_feature (36): n=a or g
gtgtaggtatgtcacaaaatgaacgcaggtttcatntgagaagctaatgtgagccttgaagtatatgaaat

SEQ ID NO: 10922 - DNA, 71 bp, chicken (Gallus Gallus)
  misc_feature (36): n=c or t
tcaggcacccctagttctaacgtcgtgtgtcttgtnattgaccgttctgtagtcacttatcccctgccatt

SEQ ID NO: 10923 - DNA, 71 bp, chicken (Gallus Gallus)
  misc_feature (36): n=a or g
ataggagtgggcaagtagtggcagcagaagtaactngccttcattctgcatgaggaatggggcgcaaagct

SEQ ID NO: 10924 - DNA, 71 bp, chicken (Gallus Gallus)
  misc_feature (36): n=c or t
attgctaataacattactgtaagctttccaggaatnggacccatatacaggagcaaatgggaagataagcc

SEQ ID NO: 10925 - DNA, 71 bp, chicken (Gallus Gallus)
  misc_feature (36): n=a or c
taaagccatgtaaatgttaagcctagacatatggcnattttcaactctctctttgctctggcgctaggtac

SEQ ID NO: 10926 - DNA, 71 bp, chicken (Gallus Gallus)
  misc_feature (36): n=a or g
aagagcttgtgcatatctgtaactctcacagcctcngcagaggggcccttaactcagccatggagcaagag

SEQ ID NO: 10927 - DNA, 71 bp, chicken (Gallus Gallus)
  misc_feature (36): n=c or t
atcaaaagccaagcagaaatgcatatgaggctacantgagcttcaacatgctgaagaggtgtgtaagagat

SEQ ID NO: 10928 - DNA, 71 bp, chicken (Gallus Gallus)
  misc_feature (36): n=c or t
ccctcacacgtgcctttgcaagaggccttctccacnggagggtcagtcagaatccggtttttccagggaga

SEQ ID NO: 10929 - DNA, 71 bp, chicken (Gallus Gallus)
  misc_feature (36): n=a or g
ggcctcctgccatgtaccagcaattggggtctgctngtgtgttttggtggtatgtgtgactggcaggtgct

SEQ ID NO: 10930 - DNA, 71 bp, chicken (Gallus Gallus)
  misc_feature (36): n=a or g
cccctgccttgcacaaggccctgcacctcaattccntgctttcatcccaccacagaggatttctgcatcgt

SEQ ID NO: 10931 - DNA, 71 bp, chicken (Gallus Gallus)
  misc_feature (36): n=c or g
atatttcagctgtttattgcattcctttacaggcantctgctgcagcaggacgtacacccaaggatttttc

SEQ ID NO: 10932 - DNA, 71 bp, chicken (Gallus Gallus)
  misc_feature (36): n=c or t
acaataggcaagaaggcagatgcctctaataacagnggaattgtttttgttttttaatttatttacatagg

SEQ ID NO: 10933 - DNA, 71 bp, chicken (Gallus Gallus)
  misc_feature (36): n=g or t
tatttacaacccttttcaagttaagttgcagaaaanaaattattctccatcacatccccaaagatcaagat

SEQ ID NO: 10934 - DNA, 71 bp, chicken (Gallus Gallus)
  misc_feature (36): n=a or g
tgtgggttggtgcacttaccatacttaagtgtctcnattttttaaagtttatttaaggaacatatgaatat

SEQ ID NO: 10935 - DNA, 71 bp, chicken (Gallus Gallus)
  misc_feature (36): n=a or t
ttcacctctgggaagctggatttaatagaaattcantggagggagaaaaatacaagctcagctcggcccct

SEQ ID NO: 10936 - DNA, 71 bp, chicken (Gallus Gallus)
  misc_feature (36): n=c or t
actgaacaggtaccacaggcagtggtgatagcaagnggagtgcctacatcaccaatgtctacaacagaata

SEQ ID NO: 10937 - DNA, 71 bp, chicken (Gallus Gallus)
  misc_feature (36): n=c or t
acttgaccacttactggagcaatgacctgtgagctncactttccttcttaacacacacttttagatgtaca

SEQ ID NO: 10938 - DNA, 71 bp, chicken (Gallus Gallus)
  misc_feature (36): n=c or t
gatattagaaatctcagcagttatttgttcccaaanagtaagcaacttgaccacttactggagcaatgacc

SEQ ID NO: 10939 - DNA, 71 bp, chicken (Gallus Gallus)
  misc_feature (36): n=c or t
ttagtatctaatctttaatctaatcatagcactttncccatggctaaacctaataattccccagaaacatc

SEQ ID NO: 10940 - DNA, 71 bp, chicken (Gallus Gallus)
  misc_feature (36): n=a or g
cacagtacaagttaaatgtttcagggctgagcaagnggcagatgtgacctaggagcagtttcctgccttgt

SEQ ID NO: 10941 - DNA, 71 bp, chicken (Gallus Gallus)
  misc_feature (36): n=c or t
cagtggcacactgcttactgccttaaaaactacagngctaagccacaaagattaatggtggcaaacaccaa

SEQ ID NO: 10942 - DNA, 71 bp, chicken (Gallus Gallus)
  misc_feature (36): n=c or t
caaaatctagctgtatagcagtgccactgtattacntgtattaactgtattacctattaactgtattacca

SEQ ID NO: 10943 - DNA, 71 bp, chicken (Gallus Gallus)
  misc_feature (36): n=a or g
ttgatacaaaattagatgcctaacaggaaaagcccnagctgaagctgtttcctaaagtatttgtgagcaat

SEQ ID NO: 10944 - DNA, 71 bp, chicken (Gallus Gallus)
  misc_feature (36): n=c or t
cagaggaacagaaaaatcactagctaaaccatcctnggaaacaatataagttctgaaacaagaatataagc

SEQ ID NO: 10945 - DNA, 71 bp, chicken (Gallus Gallus)
  misc_feature (36): n=a or t
ataacataggacaaaaggcttgtttcaggtttgcantgagttttgtacaaagatcaaacttcatgtttatt

SEQ ID NO: 10946 - DNA, 71 bp, chicken (Gallus Gallus)
  misc_feature (36): n=g or t
tgtgctctgggctcagagggaagcattttggttttngttttttttttttttttttttttttggattttttt

SEQ ID NO: 10947 - DNA, 71 bp, chicken (Gallus Gallus)
  misc_feature (36): n=a or g
ttcatgtccttaagataggaaaggagagcttggtcntctgctgccctccagggccccagtccatccctgga

SEQ ID NO: 10948 - DNA, 71 bp, chicken (Gallus Gallus)
  misc_feature (36): n=a or t
taaaattaagcagcatttttttggatgaactataancagatctggagatcccagtaacaatgctttatttt

SEQ ID NO: 10949 - DNA, 71 bp, chicken (Gallus Gallus)
  misc_feature (36): n=c or t
tagataggagcacagaagcaaattctgatgtagaangcacttgccagagaatgcaatggggacttttgctc

SEQ ID NO: 10950 - DNA, 71 bp, chicken (Gallus Gallus)
  misc_feature (36): n=a or g
catacctttggtgtgtaatgcagcaacaccttactngggagatctgctacttcaggctcttgagatttcca

SEQ ID NO: 10951 - DNA, 71 bp, chicken (Gallus Gallus)
  misc_feature (36): n=g or t
cgcagtcgagatctgtaaagcaacaaatcctcattnactcaactgtaatcacttgggtagtttggagacat

SEQ ID NO: 10952 - DNA, 71 bp, chicken (Gallus Gallus)
  misc_feature (36): n=c or t
aaaaaaacctctataaatacaactaagcactacagntgatatagacacagattatacttacctgagggaag

SEQ ID NO: 10953 - DNA, 71 bp, chicken (Gallus Gallus)
  misc_feature (36): n=c or t
aaaacatttttaaatactaacaaatgaagtcactcngtattaataaataaatataaaattaagacaaagtc

SEQ ID NO: 10954 - DNA, 71 bp, chicken (Gallus Gallus)
  misc_feature (36): n=c or t
ccctccatttcatgaggtataaactgattgttaganctgcaggtggctgcactgatgagaaatgctcttgg

SEQ ID NO: 10955 - DNA, 71 bp, chicken (Gallus Gallus)
  misc_feature (36): n=c or t
ctttaatttgcatgcacactaaaattaggcagatgngttcatttgagatctctgaaacatttcctgcattt

SEQ ID NO: 10956 - DNA, 71 bp, chicken (Gallus Gallus)
  misc_feature (36): n=a or c
ctgctttttacttgcattcagatcattttgccaggntcctaaccagcagtgaacatttttcttcaacgctt

SEQ ID NO: 10957 - DNA, 71 bp, chicken (Gallus Gallus)
  misc_feature (36): n=a or g
agaagttttaaagtgccaagtattcagagtgcttcntggcttctaagtagaaagctttcccctccctctaa

SEQ ID NO: 10958 - DNA, 71 bp, chicken (Gallus Gallus)
  misc_feature (36): n=c or t
tgtttgtattggagtacctagcctggatttcccaanggctgagaatcaggtgaatgctctgtatcacagta

SEQ ID NO: 10959 - DNA, 71 bp, chicken (Gallus Gallus)
  misc_feature (36): n=a or t
agagatggggagctactaccattcattgcctatagncccttctgaaaggaggattgatgtttttaagtagg

SEQ ID NO: 10960 - DNA, 71 bp, chicken (Gallus Gallus)
  misc_feature (36): n=a or g
gttgagcagccgctactatcggcctgctgtgcaccncaaagattaagcttggacaaggtcttcattaaccg

SEQ ID NO: 10961 - DNA, 71 bp, chicken (Gallus Gallus)
  misc_feature (36): n=c or t
gcaggctccttgctcttgtgcgtgcattagttcaancttgcagtactcctgcactgttggtgcagcctctg

SEQ ID NO: 10962 - DNA, 71 bp, chicken (Gallus Gallus)
  misc_feature (36): n=a or g
gtatgtgtgttctgcagttcataaaatttacaaganaaagaaatgagaagctataattattgtctagttat

SEQ ID NO: 10963 - DNA, 71 bp, chicken (Gallus Gallus)
  misc_feature (36): n=a or g
gctatctcctcctttaccgtagccagaaaagagggngagtctttctttttggagaattttggcaacttaga

SEQ ID NO: 10964 - DNA, 71 bp, chicken (Gallus Gallus)
  misc_feature (36): n=c or t
tattaacatataatatatatatataacataacatanaatgacagctatttacctatgctaagccttttcta

SEQ ID NO: 10965 - DNA, 71 bp, chicken (Gallus Gallus)
  misc_feature (36): n=c or g
gagaagaataactacctgcccctgcccctgacaggntgcagtaagcaaacagagaagcagcagaattcaga

SEQ ID NO: 10966 - DNA, 71 bp, chicken (Gallus Gallus)
  misc_feature (36): n=a or g
tttcacccacacaatagggatagtgagcagtaaatntaagccagatcttcagctggcataaactgcactgt

SEQ ID NO: 10967 - DNA, 71 bp, chicken (Gallus Gallus)
  misc_feature (36): n=g or t
ttggtcaccattttactgctgcagtcagggttaagngaagagcctggcactgtgcaaaatccaagctgtga

SEQ ID NO: 10968 - DNA, 71 bp, chicken (Gallus Gallus)
  misc_feature (36): n=a or c
gaagacatgcagaaattggtcttcgcttttattcancaagagagattctatagtaattattttagaaatta

SEQ ID NO: 10969 - DNA, 71 bp, chicken (Gallus Gallus)
  misc_feature (36): n=g or t
agatggaattttgactaacacatcttaatcatgtcncataaagaaaagcaaacatttataacaaatgagta

SEQ ID NO: 10970 - DNA, 71 bp, chicken (Gallus Gallus)
  misc_feature (36): n=a or g
gtcttgacctgaaatattttctggaagcctgtgggntaggaaatggtaaccccatgtggtaatggcagtta

SEQ ID NO: 10971 - DNA, 71 bp, chicken (Gallus Gallus)
  misc_feature (36): n=a or g
tgtggagaagggagagggagggacaagatgtgaaangtcagagactgagaatacaacttcttaacaaatcc

SEQ ID NO: 10972 - DNA, 71 bp, chicken (Gallus Gallus)
  misc_feature (36): n=a or g
tgtatggtgactatagtgtggcacctctttcatatnccagcccagcattagcagtgatctcatctctattt

SEQ ID NO: 10973 - DNA, 71 bp, chicken (Gallus Gallus)
  misc_feature (36): n=c or g
tttgaagggggaagggaaaagatgatgttacaggangggctcagctacactcagtaagcacctttaataac

SEQ ID NO: 10974 - DNA, 71 bp, chicken (Gallus Gallus)
  misc_feature (36): n=a or g
ctgcatacaaagccttctattttcagtccctctacnagagtctaagattactttcttgtacagttaagata

SEQ ID NO: 10975 - DNA, 71 bp, chicken (Gallus Gallus)
  misc_feature (36): n=c or t
gtgtaaaacgcacagattctcttgagggataaaacncctctttgtattgcagctccagagagtgcgcgtgg

SEQ ID NO: 10976 - DNA, 71 bp, chicken (Gallus Gallus)
  misc_feature (36): n=c or g
acaaaaagttacagttcaaagttgagttcaaaaagngaagatgtgactttacttcccaagctgcatttgtg

SEQ ID NO: 10977 - DNA, 71 bp, chicken (Gallus Gallus)
  misc_feature (36): n=c or t
ggagagctgagaactcccagagacagacacatcagnaacattgtgttactcctatgaacccttgtctcttt

SEQ ID NO: 10978 - DNA, 71 bp, chicken (Gallus Gallus)
  misc_feature (36): n=c or g
ctgtaactgagatcttcacagtacaaaaattgtctncctgtggtatctcggggtagattaatttctaacac

SEQ ID NO: 10979 - DNA, 71 bp, chicken (Gallus Gallus)
  misc_feature (36): n=c or t
cgtatacatatatttgttagaagcaaaaagcactcnattctactcaccatccattttactgatggtggaag

SEQ ID NO: 10980 - DNA, 71 bp, chicken (Gallus Gallus)
  misc_feature (36): n=c or t
tacacttggcacttcacacttttctttcatttcagngttcttccagaacaaacacacattcacaaaaattg

SEQ ID NO: 10981 - DNA, 71 bp, chicken (Gallus Gallus)
  misc_feature (36): n=a or c
cagtaagaggtaggcactggtgggacttccctgacnttgaatcaacagaaacttctttgttttcgtaccac

SEQ ID NO: 10982 - DNA, 71 bp, chicken (Gallus Gallus)
  misc_feature (36): n=c or t
gtgatttttttatttactgctcagataagaagtccngctcttgactatggtgcttgctggttcttgatatg

SEQ ID NO: 10983 - DNA, 71 bp, chicken (Gallus Gallus)
  misc_feature (36): n=a or g
ttcggtttgtgttactgtgtttcacatagcatttcnggcagcggtgttctcagttgcatggaggatgcttt

SEQ ID NO: 10984 - DNA, 71 bp, chicken (Gallus Gallus)
  misc_feature (36): n=c or t
tgtgctatttgagcattgtgaccggtaagatcctgntctgagacgatctgcttgagcttctccttctctat

SEQ ID NO: 10985 - DNA, 71 bp, chicken (Gallus Gallus)
  misc_feature (36): n=a or g
tgataaatgtgttcttctgtatcaagatctattctncgagccttctttttaatggacataactgataagcc

SEQ ID NO: 10986 - DNA, 71 bp, chicken (Gallus Gallus)
  misc_feature (36): n=c or t
ctggatctccagctgggaagtgatgcaagacatggntctaccatccaaaactttgcactcacagcagacct

SEQ ID NO: 10987 - DNA, 71 bp, chicken (Gallus Gallus)
  misc_feature (36): n=a or g
gaacgaagctgttaattttgaaggcttgcaattcanaagttgattttaaaagttcaaaacttcggcctata

SEQ ID NO: 10988 - DNA, 71 bp, chicken (Gallus Gallus)
  misc_feature (36): n=c or t
ggatcatgcccttttcctgctgtgctccactagctnctggattttgttagaataagtacaaacacttggac

SEQ ID NO: 10989 - DNA, 71 bp, chicken (Gallus Gallus)
  misc_feature (36): n=a or g
ctcgcaaactagctgagcttgcaatcaaatcaagancatacctgggaaagggactgtctgaggtgtgctat

SEQ ID NO: 10990 - DNA, 71 bp, chicken (Gallus Gallus)
  misc_feature (36): n=c or t
actaaagatctgattataaaaaacagattttggtangtgctcaagtacaaaaaaccccgtgcacttattta

SEQ ID NO: 10991 - DNA, 71 bp, chicken (Gallus Gallus)
  misc_feature (36): n=c or t
caactaacagaagattttggaggaactctcacctangatcacatggattggttgaataagaggctggttag

SEQ ID NO: 10992 - DNA, 71 bp, chicken (Gallus Gallus)
  misc_feature (36): n=c or t
ctactcaaatcctaatcaaatcaaataatagtcttnctgcctttcttaataaaatatctgagaggggagga

SEQ ID NO: 10993 - DNA, 71 bp, chicken (Gallus Gallus)
  misc_feature (36): n=a or g
tgcagtaatagaatactgcttaggttaacagtgctntctcacatcttgctcttatattaattttgatgcta

SEQ ID NO: 10994 - DNA, 71 bp, chicken (Gallus Gallus)
  misc_feature (36): n=c or t
cgactggaaaagcgtcttttaatactgggagctgcngtgtgaaatggacctataaaacaccatgagaagaa

SEQ ID NO: 10995 - DNA, 71 bp, chicken (Gallus Gallus)
  misc_feature (36): n=g or t
atgttcaaattcctcttggattgtgggcacattacnctcaggatcaccaccacaccttgagactctcagta

SEQ ID NO: 10996 - DNA, 71 bp, chicken (Gallus Gallus)
  misc_feature (36): n=a or g
cattgtatattttaaaagaaaagacaacactgaacntgttgcagagaaacttaaggttctggggttcattt

SEQ ID NO: 10997 - DNA, 71 bp, chicken (Gallus Gallus)
  misc_feature (36): n=c or t
cacaaagtcattggttttattccaataccttttttncccctgagtctgcatacgattgaatttggcattca

SEQ ID NO: 10998 - DNA, 71 bp, chicken (Gallus Gallus)
  misc_feature (36): n=c or g
gggggaccttggacaataaggctatttgcagtccanaagatatttccttctgaagcagaactatctgggag

SEQ ID NO: 10999 - DNA, 71 bp, chicken (Gallus Gallus)
  misc_feature (36): n=c or t
tttaggcatgagaaagttatgtcaatatggacaatntcagctgtagccaaaaatcttaagtgataagctaa

SEQ ID NO: 11000 - DNA, 71 bp, chicken (Gallus Gallus)
  misc_feature (36): n=a or g
aacaggagcatccctgcacccctatccccaattgcntgtctccaaaaccaaaaccttattccgtaatcctc

SEQ ID NO: 11001 - DNA, 71 bp, chicken (Gallus Gallus)
  misc_feature (36): n=a or g
catgcctactctacctctgtacaagacaagggcacnctgtcatatttgttcatttttcctgtcactgaaat

SEQ ID NO: 11002 - DNA, 71 bp, chicken (Gallus Gallus)
  misc_feature (36): n=a or g
gagcgggctactgataggactgtgaatgggaacaanaaacctcactgacaactgacacagcacaagagtta

SEQ ID NO: 11003 - DNA, 71 bp, chicken (Gallus Gallus)
  misc_feature (36): n=c or t
tgtcttcaatcccactaaaaacaagaccgtgaaganaggaaagaatcgagttcctgtcagtattctgagga

SEQ ID NO: 11004 - DNA, 71 bp, chicken (Gallus Gallus)
  misc_feature (36): n=c or t
tcttttacagaacattatgtgcatgtgtttatggtnctgttcatgataatatgtggttgacgtatggaaat

SEQ ID NO: 11005 - DNA, 71 bp, chicken (Gallus Gallus)
  misc_feature (36): n=a or g
taaaataaacaaaattcctcgccgcccgtcgtttcngaggtgctatttctgccgtggggagagcgcggcag

SEQ ID NO: 11006 - DNA, 71 bp, chicken (Gallus Gallus)
  misc_feature (36): n=a or g
caaaatctggtcttctgttgaaagaaggaagaaaanaaaaatcacaattacaacaactagtgtctatttcc

SEQ ID NO: 11007 - DNA, 71 bp, chicken (Gallus Gallus)
  misc_feature (36): n=a or g
aattctgcactgggtgaaattgtgctctcagaacantccttaagatttactctctctggtatctgcagggc

SEQ ID NO: 11008 - DNA, 71 bp, chicken (Gallus Gallus)
  misc_feature (36): n=a or t
acacagtctactgttcatctcagaacataacttcangtgatcatttgcttactattttacactgattttca

SEQ ID NO: 11009 - DNA, 71 bp, chicken (Gallus Gallus)
  misc_feature (36): n=c or g
tctttctcataggtatgcatgatcttgctcacactncctaatgctccttaatctctccaccttctccttga

SEQ ID NO: 11010 - DNA, 71 bp, chicken (Gallus Gallus)
  misc_feature (36): n=c or t
actggaagtcaaacctactatggaattcttatgggngctagaaatctcacaaaaccccccaaaatgtaaaa

SEQ ID NO: 11011 - DNA, 71 bp, chicken (Gallus Gallus)
  misc_feature (36): n=a or g
cacaaccacccacttctaggtctgcaaccaaaatgncacaactggaatattttataggaatgttgataggt

SEQ ID NO: 11012 - DNA, 71 bp, chicken (Gallus Gallus)
  misc_feature (36): n=a or g
tacagcggtgcagtagtgaagtactaaaaaaggccntaaagaacatgaagtaattttcagtttttccacag

SEQ ID NO: 11013 - DNA, 71 bp, chicken (Gallus Gallus)
  misc_feature (36): n=a or g
agggctgttgaaatgccttagcttagaaactttggnaacaaacaccatgtatctacctgtagaaaatggtc

SEQ ID NO: 11014 - DNA, 71 bp, chicken (Gallus Gallus)
  misc_feature (36): n=a or g
acctcctcttgtgcagcttgaaaccattgtatcgcntcctgtcacttgtcacctaagagaccaatatcctc

SEQ ID NO: 11015 - DNA, 71 bp, chicken (Gallus Gallus)
  misc_feature (36): n=c or t
ttcattccattttctacctgctttctggaagtgtantgaaaaagctcaaacttgccatgctttgtgttttg

SEQ ID NO: 11016 - DNA, 71 bp, chicken (Gallus Gallus)
  misc_feature (36): n=a or g
tgatatgtttaaattcacagttggttttagagatcntcaacttggtttttctgttatgcaggcttaatttc

SEQ ID NO: 11017 - DNA, 71 bp, chicken (Gallus Gallus)
  misc_feature (36): n=c or t
tgcatacacaaaaacgaaacagctatgtaagcaatngtccagcgcgtagagcaatcaaattcatagctcaa

SEQ ID NO: 11018 - DNA, 71 bp, chicken (Gallus Gallus)
  misc_feature (36): n=a or g
ttcatgctgtattttgcacagttccttgctctgganaactgcagagaaatgtgcattgtatctctaccatc

SEQ ID NO: 11019 - DNA, 71 bp, chicken (Gallus Gallus)
  misc_feature (36): n=a or g
gctactattcacatccgtaggtctgtttgatttgcngcgttaagcagtttatgttgcatggcggtgtttgt

SEQ ID NO: 11020 - DNA, 71 bp, chicken (Gallus Gallus)
  misc_feature (36): n=a or g
gtccagttacataacgaaacaaataaaaaaacaggntagactgcttcaattaactggagaacagaagacaa

SEQ ID NO: 11021 - DNA, 71 bp, chicken (Gallus Gallus)
  misc_feature (36): n=a or g
catgagagtaggttaggtattgttcctaagcaagtntaagcactagcatcaatcagcaaccgtcttttgtg

SEQ ID NO: 11022 - DNA, 71 bp, chicken (Gallus Gallus)
  misc_feature (36): n=a or g
tgtttgtttcagctgcagttaaaacatgcagtaacngtagctgaagtgaatcaactgaaggagaaggtaag

SEQ ID NO: 11023 - DNA, 71 bp, chicken (Gallus Gallus)
  misc_feature (36): n=c or g
atcatgctttgagctgtaattaaagagatagctttnaatgaggttttgaggtaaggctagataacccgaaa

SEQ ID NO: 11024 - DNA, 71 bp, chicken (Gallus Gallus)
  misc_feature (36): n=a or c
tttaaaatagattgatctgaattctcgtgccacccntgagaagctaccacgttcatgtaaactattgcaga

SEQ ID NO: 11025 - DNA, 71 bp, chicken (Gallus Gallus)
  misc_feature (36): n=c or g
gacgcaggctgtgattaaaaaaaaaaaaaaaaatcnagtctttctgaggattatgcagtaacggaacgagg

SEQ ID NO: 11026 - DNA, 71 bp, chicken (Gallus Gallus)
  misc_feature (36): n=c or g
ctggcattcttcaaagcactgcagttcttaaggttnttcgtctagctgcaaaagaaacagtgtcccttcac

SEQ ID NO: 11027 - DNA, 71 bp, chicken (Gallus Gallus)
  misc_feature (36): n=c or t
cttctgcaagctagtgaaatggtgttactatgaagnaaaacatcgctcacagtatcagaaaagtcactttc

SEQ ID NO: 11028 - DNA, 71 bp, chicken (Gallus Gallus)
  misc_feature (36): n=c or g
tatgtagttgttcagcttgcatgtgctttttacttnaaatttagtagtaaaatcaattcccacaatcaaat

SEQ ID NO: 11029 - DNA, 71 bp, chicken (Gallus Gallus)
  misc_feature (36): n=c or t
gtctctccctagggaaaaagcagttatcttccttangctaaatctagctcctctccaaagcaatcatgtaa

SEQ ID NO: 11030 - DNA, 71 bp, chicken (Gallus Gallus)
  misc_feature (36): n=a or g
attgcaattgtaaatacctcggtagttcaaaaaccntatggctaggtgaagggctaagctataaaggaaga

SEQ ID NO: 11031 - DNA, 71 bp, chicken (Gallus Gallus)
  misc_feature (36): n=c or t
ctttgcataatgcaaataacagatctaagcaagacngtaaaatgtgcatgccatccagcatttgttttttc

SEQ ID NO: 11032 - DNA, 71 bp, chicken (Gallus Gallus)
  misc_feature (36): n=a or g
tatatgatgaatagtacataaaagaaaaaaaaaaangggatgctggattaagctgagtaataaaatctttc

SEQ ID NO: 11033 - DNA, 71 bp, chicken (Gallus Gallus)
  misc_feature (36): n=c or t
atctacctttatatgtaaaacacaccacttttaagngagctctgtttgctgaagctaacatttaactttga

SEQ ID NO: 11034 - DNA, 71 bp, chicken (Gallus Gallus)
  misc_feature (36): n=c or t
ctcctgaagaggtgactccaaattctcctcaagggnataccaagaatgttaagcaaaaagaagtaaaaggg

SEQ ID NO: 11035 - DNA, 71 bp, chicken (Gallus Gallus)
  misc_feature (36): n=g or t
ctcagcaggcgcagcagaactggatcttttttctancttcaactaaaatatactgtagtctgtggcagcag

SEQ ID NO: 11036 - DNA, 71 bp, chicken (Gallus Gallus)
  misc_feature (36): n=c or t
gacagaagcccggggtggtgccaagcactctaatgntcccatgttttaaaaaaagttatttagttgttggt

SEQ ID NO: 11037 - DNA, 71 bp, chicken (Gallus Gallus)
  misc_feature (36): n=c or t
gaaagatgatttaatacttgaacaattttagtttcntgtagggatacaaatattgtttctatgaacacatc

SEQ ID NO: 11038 - DNA, 71 bp, chicken (Gallus Gallus)
  misc_feature (36): n=c or t
ggatgggagcaagggataatgctccctgcattgcanagtaatgggttggttgcagctccaacccacgtctg

SEQ ID NO: 11039 - DNA, 71 bp, chicken (Gallus Gallus)
  misc_feature (36): n=a or c
aaatgcagaaattttttgcagtgtgatctttttgcntacatccattacaggattcaaacataaaatgagag

SEQ ID NO: 11040 - DNA, 71 bp, chicken (Gallus Gallus)
  misc_feature (36): n=g or t
gagcaaatagcaaggggttttttgtttgtttgtttnttttaagagagagagaaactacttttgtaaactgt

SEQ ID NO: 11041 - DNA, 71 bp, chicken (Gallus Gallus)
  misc_feature (36): n=c or t
atcccaaatctattacatcctgtagctgaatgacgngaatcacgtcttctcttcagattcccaagaaggca

SEQ ID NO: 11042 - DNA, 71 bp, chicken (Gallus Gallus)
  misc_feature (36): n=c or t
gctcagagcaaaggaagaagcttacttacaacatanacagatctgtttttaattgcagccttgtactggtc

SEQ ID NO: 11043 - DNA, 71 bp, chicken (Gallus Gallus)
  misc_feature (36): n=a or g
tagctgctggagctggaaacagcatgtaaaacagcntgtcagataaatagctcggggcataggaaaggaac

SEQ ID NO: 11044 - DNA, 71 bp, chicken (Gallus Gallus)
  misc_feature (36): n=a or g
ctgcaacaggtcttttctgagcaaacataataagcntgctatcaaataccaagaataagaaaaatggaaat

SEQ ID NO: 11045 - DNA, 71 bp, chicken (Gallus Gallus)
  misc_feature (36): n=a or g
ctatatgcagattgaacatttgcatctacagtcctntgtacatatcttcatgatttggatgcataagcatt

SEQ ID NO: 11046 - DNA, 71 bp, chicken (Gallus Gallus)
  misc_feature (36): n=c or g
cctgggctctgagcaggacattcccacttaggggtncacgagaaatacagcccaaggaacctgaggcctag

SEQ ID NO: 11047 - DNA, 71 bp, chicken (Gallus Gallus)
  misc_feature (36): n=c or t
caccttgctgagacattgctcctgtccttagttgtnctacagaggagcagtcatctctggggctgctgtcc

SEQ ID NO: 11048 - DNA, 71 bp, chicken (Gallus Gallus)
  misc_feature (36): n=a or g
gctacagagcgaacacatggagccctcagcttgacntagcagtacccttccagtaaaaccaattaagcagg

SEQ ID NO: 11049 - DNA, 71 bp, chicken (Gallus Gallus)
  misc_feature (36): n=c or t
gagtactcaaaattatgaagcacagcactgaattcngtagctgtgggcgctgttctcaagaattccatact

SEQ ID NO: 11050 - DNA, 71 bp, chicken (Gallus Gallus)
  misc_feature (36): n=a or g
cttaatccctagtaggtcaagtgggatagaatgacngcaggctagcttttgatcagccataaatgtctaaa

SEQ ID NO: 11051 - DNA, 71 bp, chicken (Gallus Gallus)
  misc_feature (36): n=a or g
aagatagcattaggttgagctttctgtggtccgttngcttggactttaaggcctaaggcacatggtttagc

SEQ ID NO: 11052 - DNA, 71 bp, chicken (Gallus Gallus)
  misc_feature (36): n=a or g
cctcctctgcatcagttctaatgctcttcagactcncaagcaagctctctgcctcagcaaaacactgccta

SEQ ID NO: 11053 - DNA, 71 bp, chicken (Gallus Gallus)
  misc_feature (36): n=c or t
agggattgtttttacttttaaatctcctctcacatnatgccaagtcgtacaagagtcattgttaaactctt

SEQ ID NO: 11054 - DNA, 71 bp, chicken (Gallus Gallus)
  misc_feature (36): n=c or t
gagaatgccaaagcagtgctgaaataattgcccaangatcacgccagactaatttgacgagcattttgtat

SEQ ID NO: 11055 - DNA, 71 bp, chicken (Gallus Gallus)
  misc_feature (36): n=g or t
ggtgtccttgaagaacccataatagcaacaattctnaaggaggttttggaaggtttagactatctgcacag

SEQ ID NO: 11056 - DNA, 71 bp, chicken (Gallus Gallus)
  misc_feature (36): n=a or g
tcaggtatacctttgacatatttggtaacttctaangcttttttcttttttttccttcaagtcaagtaggc

SEQ ID NO: 11057 - DNA, 71 bp, chicken (Gallus Gallus)
  misc_feature (36): n=c or t
tttatgcattacacatcttagtaataagaaaactantggacttgattacatgctatttgcagttaatcttt

SEQ ID NO: 11058 - DNA, 71 bp, chicken (Gallus Gallus)
  misc_feature (36): n=c or t
tcctgaaacagctaggcctctgcagataatgggacngtgtgctcagtccagctttcaaaaagcagtctttt

SEQ ID NO: 11059 - DNA, 71 bp, chicken (Gallus Gallus)
  misc_feature (36): n=g or t
agctgtctatatccaattttgtttatatgcacactngtgttttaagggctgcaggtctataagaataccaa

SEQ ID NO: 11060 - DNA, 71 bp, chicken (Gallus Gallus)
  misc_feature (36): n=c or t
ttcctagcaatccctccatcttttgtatctcttttncccacctttgcttctgaatggacaagttatatagt

SEQ ID NO: 11061 - DNA, 71 bp, chicken (Gallus Gallus)
  misc_feature (36): n=c or g
taccaactatctaagtggtggaaagctcatcagaanaagttaaatccttgcactgaagtatgctgagcatg

SEQ ID NO: 11062 - DNA, 71 bp, chicken (Gallus Gallus)
  misc_feature (36): n=c or t
aacatcactttgctctctgatgttttaaaactttcnttggtttttaattaagcataatttcaacagcaatc

SEQ ID NO: 11063 - DNA, 71 bp, chicken (Gallus Gallus)
  misc_feature (36): n=a or g
ttttattttgacagaagtctcctgcgacacattaanagttatacaaagtatgtcatgcctgactacagtat

SEQ ID NO: 11064 - DNA, 71 bp, chicken (Gallus Gallus)
  misc_feature (36): n=c or t
ttgtgctgatcctgctcagctcctctgtcttcatcncacttctagctagaagttctcttttcggcaaggtc

SEQ ID NO: 11065 - DNA, 71 bp, chicken (Gallus Gallus)
  misc_feature (36): n=c or t
acttgatcccttcatttctgtgacataaacaattcncactgtactgtgagataggaatccaagcaaagtgc

SEQ ID NO: 11066 - DNA, 71 bp, chicken (Gallus Gallus)
  misc_feature (36): n=c or t
actacttcttactactctaagtatagcaaaggtaancataaatatttgtgattttttttttctactaagca

SEQ ID NO: 11067 - DNA, 71 bp, chicken (Gallus Gallus)
  misc_feature (36): n=c or t
tgcgttaaagtcatttgtaatgtgatgcttgtactngcaaaaagaactggtctccagtacttcaatgagta

SEQ ID NO: 11068 - DNA, 71 bp, chicken (Gallus Gallus)
  misc_feature (36): n=c or t
tttcccatagaatacagattgtgtgtctgtgcgaangagagaatggactcaccaactgttaattaaccaga

SEQ ID NO: 11069 - DNA, 71 bp, chicken (Gallus Gallus)
  misc_feature (36): n=g or t
ccagaccatcttacctgcacctatcagtctttcacntgaagctcatccatttgatgaatcactcaggttca

SEQ ID NO: 11070 - DNA, 71 bp, chicken (Gallus Gallus)
  misc_feature (36): n=a or g
acaaaaatacttttcttttaaatttatttttttccnaaggaataaggtgaaaaatcccctgaaactgtgca

SEQ ID NO: 11071 - DNA, 71 bp, chicken (Gallus Gallus)
  misc_feature (36): n=a or g
tatggttttcattcttgttgacatctcactttccanagactccaggaattccctgaaatagcttcttgaat

SEQ ID NO: 11072 - DNA, 71 bp, chicken (Gallus Gallus)
  misc_feature (36): n=a or g
attaacgaattaacgggactgataagaaaagttatntaaaaagagttgggaaaagcacaggaaaaaaaaat

SEQ ID NO: 11073 - DNA, 71 bp, chicken (Gallus Gallus)
  misc_feature (36): n=a or g
ttgaatgaattatgttcccaaaggaaagaaaaaaantgttcttgacatatttaactttggattttatttaa

SEQ ID NO: 11074 - DNA, 71 bp, chicken (Gallus Gallus)
  misc_feature (36): n=c or t
cctgctagattacttctttttccttagttatgcagnagctggatgctggaaaaacattaactctctgaact

SEQ ID NO: 11075 - DNA, 71 bp, chicken (Gallus Gallus)
  misc_feature (36): n=c or t
tttcccatgacgatatttttgattctatacctatgngtatgtgcaattttttaagaaacaaaacaaaaact

SEQ ID NO: 11076 - DNA, 71 bp, chicken (Gallus Gallus)
  misc_feature (36): n=c or t
cagtattactgatggaagaagcatggaagaagtagncttaattaaaaaagaccagcaacaaacacaaaaaa

SEQ ID NO: 11077 - DNA, 71 bp, chicken (Gallus Gallus)
  misc_feature (36): n=c or t
tagcaagcattgggcaagcagatagaaggtttctangtatgaaagacagtgccagattcccgttatgcttc

SEQ ID NO: 11078 - DNA, 71 bp, chicken (Gallus Gallus)
  misc_feature (36): n=g or t
agttatttatttaaaaaaagtcatggtaggggcagngattatggggaaggtccgtggttcagagaaaggaa

SEQ ID NO: 11079 - DNA, 71 bp, chicken (Gallus Gallus)
  misc_feature (36): n=a or g
cttaaaataaattcaacaacttaggagaatagacantacccatacaatgaaagctactaagaacaagttca

SEQ ID NO: 11080 - DNA, 71 bp, chicken (Gallus Gallus)
  misc_feature (36): n=c or t
gctaaggtacgatgaaggaatgaaaccatttaatangacttcttattgatatagatgcttctatttttttt

SEQ ID NO: 11081 - DNA, 71 bp, chicken (Gallus Gallus)
  misc_feature (36): n=a or g
ttattacttttcttttttcctcctttaaccctctgntgctcacaatgtttctcttttgctgcttattctag

SEQ ID NO: 11082 - DNA, 71 bp, chicken (Gallus Gallus)
  misc_feature (36): n=c or g
ccattcattctgaaagatgtgtcagcacacaggatntggagccacctcagcagctcaatggggatctgaac

SEQ ID NO: 11083 - DNA, 71 bp, chicken (Gallus Gallus)
  misc_feature (36): n=a or g
tcttatgcctggtgtagaaaagataagaggacatgnccagcggcctggctgaaactaactttctgtctttg

SEQ ID NO: 11084 - DNA, 71 bp, chicken (Gallus Gallus)
  misc_feature (36): n=a or g
tacgaggattattgcaggatttgttttaaagtagcntttcctttctgagagtacaggttacgtgagttcag

SEQ ID NO: 11085 - DNA, 71 bp, chicken (Gallus Gallus)
  misc_feature (36): n=a or c
tgccgttcgttgagatgcggaagctccaagtttagngagggaaagtaaagcttattcaaattaagagtgaa

SEQ ID NO: 11086 - DNA, 71 bp, chicken (Gallus Gallus)
  misc_feature (36): n=a or t
aaaaaaaaacttgttttgaatattactatttaattncttctattacgtataatcatatctaacaatctgtt

SEQ ID NO: 11087 - DNA, 71 bp, chicken (Gallus Gallus)
  misc_feature (36): n=a or g
cagagggtcaaaccagaccaggaagttctttagtantgtctctgaccccggcccggagaggcggcacactt

SEQ ID NO: 11088 - DNA, 71 bp, chicken (Gallus Gallus)
  misc_feature (36): n=a or g
aaaggatgttttcatttacagtgagatagttatttntgtatttttaagggagaatgagcctccataaatca

SEQ ID NO: 11089 - DNA, 71 bp, chicken (Gallus Gallus)
  misc_feature (36): n=c or t
actaggcaattggcctgtcagtgaaaatcctcagantcctgtgtcagaatctagaagagcagcaaatgttg

SEQ ID NO: 11090 - DNA, 71 bp, chicken (Gallus Gallus)
  misc_feature (36): n=g or t
cagaattgcagaacagcatctacttaagcttagttnaattatcatgaagcctgatcacagtagtgaaacag

SEQ ID NO: 11091 - DNA, 71 bp, chicken (Gallus Gallus)
  misc_feature (36): n=g or t
gtgatgtaaaaaaatgaaatgaaaactcacagattnctccatgtagttggttccccatgaagaaaacatag

SEQ ID NO: 11092 - DNA, 71 bp, chicken (Gallus Gallus)
  misc_feature (36): n=a or g
aggaattggtggtatggtcgtatattacagagcagnaacaagcttctcattatgacactctcttaaacaga

SEQ ID NO: 11093 - DNA, 71 bp, chicken (Gallus Gallus)
  misc_feature (36): n=c or t
tgcctgatcagtgtaggtatctaagaacagaaattngttttagcttcatacgatagatcgtgagcaccaat

SEQ ID NO: 11094 - DNA, 71 bp, chicken (Gallus Gallus)
  misc_feature (36): n=c or t
atagttctttttctagtttgctttgttgctttttcnaatttacttcagaacgaccaatggagacatggaga

SEQ ID NO: 11095 - DNA, 71 bp, chicken (Gallus Gallus)
  misc_feature (36): n=a or t
tggaagatattccgtattagcttttcagcttgcagngtaaatcttttgaaagagagttgctgctcctaaaa

SEQ ID NO: 11096 - DNA, 71 bp, chicken (Gallus Gallus)
  misc_feature (36): n=c or t
aagtttgctgatggaggacagaaaaagagacagaancagaataaatacatacagaatggaagagcatggca

SEQ ID NO: 11097 - DNA, 71 bp, chicken (Gallus Gallus)
  misc_feature (36): n=a or g
ctcagtctcttgtaataataaacccagtgtaatganatggtggcatacccttcctacagaccatttatata

SEQ ID NO: 11098 - DNA, 71 bp, chicken (Gallus Gallus)
  misc_feature (36): n=c or t
cactatgccaccccgcacagccccccagagcatccncctaagacactgctttgcctaggacagcaccacag

SEQ ID NO: 11099 - DNA, 71 bp, chicken (Gallus Gallus)
  misc_feature (36): n=a or g
actctttcttcttcctcagttcctgcagaacctttnttgtgcaagtttgctgatggaggacagaaaaagag

SEQ ID NO: 11100 - DNA, 71 bp, chicken (Gallus Gallus)
  misc_feature (36): n=c or t
acgtagggcaatccttcccttggaaatctgtgccangctcaccacggggccaacaggaggagaggatggga

SEQ ID NO: 11101 - DNA, 71 bp, chicken (Gallus Gallus)
  misc_feature (36): n=a or g
tcacaacacagccaaagatttccactttctctccantgatgaattgattttgtctcagattgagcccacag

SEQ ID NO: 11102 - DNA, 71 bp, chicken (Gallus Gallus)
  misc_feature (36): n=c or t
ctgtgaagatattccctttcaagtctctccggcatntggaagtaagtacaggaggcagagctggctttcag

SEQ ID NO: 11103 - DNA, 71 bp, chicken (Gallus Gallus)
  misc_feature (36): n=c or t
actgggtgatatttatactccctccaaaactgtccngctttctgctgtatttatgacatgtcccacctttg

SEQ ID NO: 11104 - DNA, 71 bp, chicken (Gallus Gallus)
  misc_feature (36): n=a or g
attgtatccacaaaggctattttggataagacaacnaacaagtgcaaaggtatgtttgcttttatattaca

SEQ ID NO: 11105 - DNA, 71 bp, chicken (Gallus Gallus)
  misc_feature (36): n=c or t
ctatttctgtcctgctgtttgccaaatagcagcagnagaaacagttcagggaccctgggaaagacagctct

SEQ ID NO: 11106 - DNA, 71 bp, chicken (Gallus Gallus)
  misc_feature (36): n=a or c
tgcccaggaggaggtggctctggccaaggggagagnagcgggtaaccctacactgcatcatcttgcgatcg

SEQ ID NO: 11107 - DNA, 71 bp, chicken (Gallus Gallus)
  misc_feature (36): n=g or t
catctatttccaaaccttcacaagtcattctcatgngcctgaaaacacagaaaggtcacctaccgctgtcc

SEQ ID NO: 11108 - DNA, 71 bp, chicken (Gallus Gallus)
  misc_feature (36): n=c or t
agtgggaagacacttcccttcttagctcagtaaatnattcctctgctgtctgcctcaacttcccaatttat

SEQ ID NO: 11109 - DNA, 71 bp, chicken (Gallus Gallus)
  misc_feature (36): n=c or t
tggttaaacattgacctgctcctgaatcagcttagngtagtccaagtgtgattcagcacacaaacccaagg

SEQ ID NO: 11110 - DNA, 71 bp, chicken (Gallus Gallus)
  misc_feature (36): n=c or t
gacgagggtgcattcttgggctgtgcgcagccccgngctgtctgggagcatcgctaattgcttcattacaa

SEQ ID NO: 11111 - DNA, 71 bp, chicken (Gallus Gallus)
  misc_feature (36): n=c or t
cattgctcttggaggcaggcagttcttcatgaattnccattttctacacagcttcagtagaaacctcaagg

SEQ ID NO: 11112 - DNA, 71 bp, chicken (Gallus Gallus)
  misc_feature (36): n=a or g
ggactccctccttccatagttctgtcagtcaggccnaaggaacagggatgtgtgtctgtcctgatggcact

SEQ ID NO: 11113 - DNA, 71 bp, chicken (Gallus Gallus)
  misc_feature (36): n=a or g
cagcagcaggtgccagccaggaaaatgacaccatangggaggccgcaggccaccttgagaggtcatgttca

SEQ ID NO: 11114 - DNA, 71 bp, chicken (Gallus Gallus)
  misc_feature (36): n=c or t
ttgcttttagctgccagactagacaagtaaaatganattttttttttctgtgtgtatttgaaaggagagag

SEQ ID NO: 11115 - DNA, 71 bp, chicken (Gallus Gallus)
  misc_feature (36): n=c or g
ccaaaaatacaccaccttcctttgctgtgctactanataggaagaagctaaataactagatcaccttggtt

SEQ ID NO: 11116 - DNA, 71 bp, chicken (Gallus Gallus)
  misc_feature (36): n=a or g
cagtgtaaatgctttctatctatactgtgttctctnctgatatactgtttttgaaaaacaccttttttcat

SEQ ID NO: 11117 - DNA, 71 bp, chicken (Gallus Gallus)
  misc_feature (36): n=a or g
ctgtgtcacttgttactgctgttcttgcctactacntcagtgctggcctccagcttccacagctcttccgt

SEQ ID NO: 11118 - DNA, 71 bp, chicken (Gallus Gallus)
  misc_feature (36): n=c or t
gctgtcgtggttatttgaaagcgttctttaagttgngtggctttgtgtgacatgcagcagcagacctaaat

SEQ ID NO: 11119 - DNA, 71 bp, chicken (Gallus Gallus)
  misc_feature (36): n=a or g
ctgaggcaaaaaattctgaaacccaaagatgtggcngtttactctggaggagtcaatgaagttatcacaga

SEQ ID NO: 11120 - DNA, 71 bp, chicken (Gallus Gallus)
  misc_feature (36): n=a or g
aacgttaatagaagacactccatcaaccttgatgangcaagacaagtcctacgaagttccttagtcttatg

SEQ ID NO: 11121 - DNA, 71 bp, chicken (Gallus Gallus)
  misc_feature (36): n=c or t
ctctaacagaagtatgataaaaggagaaaatacacnaaactttcataatgagataaacatcagatttcctt

SEQ ID NO: 11122 - DNA, 71 bp, chicken (Gallus Gallus)
  misc_feature (36): n=c or t
ctggatcatctctgagccaaccatgagcatggcttngatgtgccgtgacatctccttggcctgcactctaa

SEQ ID NO: 11123 - DNA, 71 bp, chicken (Gallus Gallus)
  misc_feature (36): n=a or g
tttgcttttcgaggcaagtacaaattgaggcttaancaagttgacaacattccttttacgtatcctctttc

SEQ ID NO: 11124 - DNA, 71 bp, chicken (Gallus Gallus)
  misc_feature (36): n=c or t
atatgctcattatctgttcatgtgtactaattatcnatttactactagcttatcaggagcatgaaagacat

SEQ ID NO: 11125 - DNA, 71 bp, chicken (Gallus Gallus)
  misc_feature (36): n=c or g
gttaggaaataaagttcagctagaacaggcttcagnagagctagtttgagttcctcagagtggctgtgtga

SEQ ID NO: 11126 - DNA, 71 bp, chicken (Gallus Gallus)
  misc_feature (36): n=c or t
gtttggtggggtggggaataaaacagtctgtctttngtaacttgaagaatgggagtgcaaaaagtactggg

SEQ ID NO: 11127 - DNA, 71 bp, chicken (Gallus Gallus)
  misc_feature (36): n=a or c
ctctcttgtaattgataattacacatttgaagatanatgctaaaacagttccttcttgcactgggattctc

SEQ ID NO: 11128 - DNA, 71 bp, chicken (Gallus Gallus)
  misc_feature (36): n=c or g
ctaggggagacagtggtgtgtagaggcagaaaagantgggaaatatgattgttttagtggctgtgttggga

SEQ ID NO: 11129 - DNA, 71 bp, chicken (Gallus Gallus)
  misc_feature (36): n=a or c
tcaggggatgaaatgtaggagctgacatacaggganggcaggaaaatccacctaggagtgccctggctact

SEQ ID NO: 11130 - DNA, 71 bp, chicken (Gallus Gallus)
  misc_feature (36): n=a or g
tgagtgttcagccagctttgatgcttaaataaatanagaaacagaacccaattacttgtagctaaaagacc

SEQ ID NO: 11131 - DNA, 71 bp, chicken (Gallus Gallus)
  misc_feature (36): n=a or t
ttactgacattctgctttttcttggttaagatcacntgtagtagctgcatggcaaaatgcaatgggactaa

SEQ ID NO: 11132 - DNA, 71 bp, chicken (Gallus Gallus)
  misc_feature (36): n=c or t
gcagggattttggtgcttgtgcagtctgatcttggnaataaccccaattccagcaggaggtaggtctaggc

SEQ ID NO: 11133 - DNA, 71 bp, chicken (Gallus Gallus)
  misc_feature (36): n=a or t
gaaataaccgtgttctccttaatggtgttatctatnaggaaaagaggaaactgtctgaagaaatacaacag

SEQ ID NO: 11134 - DNA, 71 bp, chicken (Gallus Gallus)
  misc_feature (36): n=a or g
tttggcctttttttggatgtagaaagtacctatccnagtcagaggttgccaccagcttctccctggaaaca

SEQ ID NO: 11135 - DNA, 71 bp, chicken (Gallus Gallus)
  misc_feature (36): n=a or g
tcaatatcagcttcaacaattccgttttgagatcantttcatttctcagaattcatttttacctgcagtga

SEQ ID NO: 11136 - DNA, 71 bp, chicken (Gallus Gallus)
  misc_feature (36): n=g or t
ggtttacaaagtataatcacctaaactgtaatttanctaactgcatggactagacataactcaagaaatat

SEQ ID NO: 11137 - DNA, 71 bp, chicken (Gallus Gallus)
  misc_feature (36): n=a or g
atcttcaaagttgcacaattctcctgtacctaatanctccaaataattaatctcagggctgtgagataatg

SEQ ID NO: 11138 - DNA, 71 bp, chicken (Gallus Gallus)
  misc_feature (36): n=c or g
acgtgcagcaattttctgtgtcaattgccctccaanagatagatagggttaattagaagcagagtgagaaa

SEQ ID NO: 11139 - DNA, 71 bp, chicken (Gallus Gallus)
  misc_feature (36): n=a or c
attgtctatagcagggatgcttagtgccgctctctnaagttttccttatttctctgtttggcatagattga

SEQ ID NO: 11140 - DNA, 71 bp, chicken (Gallus Gallus)
  misc_feature (36): n=c or t
gttgttctactcccgcctacaattgatggagaggantctgactaactgaaagatctagttaaactaaaaga

SEQ ID NO: 11141 - DNA, 71 bp, chicken (Gallus Gallus)
  misc_feature (36): n=c or t
tgaagatggatgtgttcagctccccttgttgtgggngctgacgtggcaagcaattctttggtgatttttgt

SEQ ID NO: 11142 - DNA, 71 bp, chicken (Gallus Gallus)
  misc_feature (36): n=a or t
atttaattattcaatatcagtatttcatcttaacanttttcattccaatgtttagagctatacattttatg

SEQ ID NO: 11143 - DNA, 71 bp, chicken (Gallus Gallus)
  misc_feature (36): n=g or t
tgtttttgcatgttggccatatctgcatctaccttngcatccaaataagctccatcttagcctctagggtt

SEQ ID NO: 11144 - DNA, 71 bp, chicken (Gallus Gallus)
  misc_feature (36): n=c or t
gaggatatttttcagaactggtagcaggaattaagngatttggattttgtctgtaactcctgagactttca

SEQ ID NO: 11145 - DNA, 71 bp, chicken (Gallus Gallus)
  misc_feature (36): n=c or t
gcaaagaacactactactcgtattttgaatgagaangtctgtttcatcaggagactaacattcatgtcagt

SEQ ID NO: 11146 - DNA, 71 bp, chicken (Gallus Gallus)
  misc_feature (36): n=c or t
gagcaaagcctgtggctttgcaggcagagagagccntgggaccccgaggcaccatactatctttaggcttc

SEQ ID NO: 11147 - DNA, 71 bp, chicken (Gallus Gallus)
  misc_feature (36): n=c or t
tgctgttggatcaagtcaagtggaaaacagccagcnttcagaacacaagtcacagccttgcctgtttcaca

SEQ ID NO: 11148 - DNA, 71 bp, chicken (Gallus Gallus)
  misc_feature (36): n=a or g
gctcaattttaaatagttcaaaggagttggagaagntgtataggtgtggtttggatataagctttgtgtgt

SEQ ID NO: 11149 - DNA, 71 bp, chicken (Gallus Gallus)
  misc_feature (36): n=a or t
ttatttttaaaattttaaagccatctgtattatctnccttaaatatattatcttaagagaagttagagtac

SEQ ID NO: 11150 - DNA, 71 bp, chicken (Gallus Gallus)
  misc_feature (36): n=a or g
agcaagcacgagtctattgtgagcatccaacatacntaggaggtggcgtttacagttttcacatattttca

SEQ ID NO: 11151 - DNA, 71 bp, chicken (Gallus Gallus)
  misc_feature (36): n=c or g
acttcttctgcagatattgagcaactgaattaaagnacaaccactactgacacagtcagtgggaataaaaa

SEQ ID NO: 11152 - DNA, 71 bp, chicken (Gallus Gallus)
  misc_feature (36): n=c or t
gccttctatgcattaagtacagttgaaatattcaantgggttatgacgccctattcactctgaaacaccac

SEQ ID NO: 11153 - DNA, 71 bp, chicken (Gallus Gallus)
  misc_feature (36): n=a or g
aatatttattgcacacttcaatcacctcaaaaaggnagttgcctcataaggcctgtttttctgtatttgag

SEQ ID NO: 11154 - DNA, 71 bp, chicken (Gallus Gallus)
  misc_feature (36): n=c or t
agagtcctaggcacaagttatctcctgcatcacttncagacattataccaacagtttcacactactcaaat

SEQ ID NO: 11155 - DNA, 71 bp, chicken (Gallus Gallus)
  misc_feature (36): n=a or g
ataaaaattaacaacatagtcctaaactacacatangattcaactagaaacaacatcaaaacctatagaaa

SEQ ID NO: 11156 - DNA, 71 bp, chicken (Gallus Gallus)
  misc_feature (36): n=c or t
tccaaccagattgccctgaaccaaagctgacacagntgtcagcaccactcagaccctatgcttttcatggc

SEQ ID NO: 11157 - DNA, 71 bp, chicken (Gallus Gallus)
  misc_feature (36): n=c or t
gagtatgacaccatttatgtgatcaactgatcctgnctgcattgcatgatacgaatgcatcaggctctatt

SEQ ID NO: 11158 - DNA, 71 bp, chicken (Gallus Gallus)
  misc_feature (36): n=g or t
gtttattacaattttactaagtcagaactgctcctnctcttccacattatgtctagcatgggtccaactaa

SEQ ID NO: 11159 - DNA, 71 bp, chicken (Gallus Gallus)
  misc_feature (36): n=a or c
catataaataaaataaaataaaaataaataaaatcnagactgagctcttcgaattccatagttatttgaag

SEQ ID NO: 11160 - DNA, 71 bp, chicken (Gallus Gallus)
  misc_feature (36): n=a or g
ctgattagctctatttggaggcagaaagatctggtntcacaccaggtctggccacagcaaagtggtttaag

SEQ ID NO: 11161 - DNA, 71 bp, chicken (Gallus Gallus)
  misc_feature (36): n=c or g
acatgaagcagagccacacttgacaattttagcacnatctttggaacaacgtccccctaaagaaaggcagc

SEQ ID NO: 11162 - DNA, 71 bp, chicken (Gallus Gallus)
  misc_feature (36): n=c or t
gtgcccccagcagcatagattctgtttaaacacttncaattttcttagcttcacaatcaagttagctctct

SEQ ID NO: 11163 - DNA, 71 bp, chicken (Gallus Gallus)
  misc_feature (36): n=c or t
tttttcctcatggaggaacacacacagtgacaaacntttccttcacatgcagttccatatcagacaccatt

SEQ ID NO: 11164 - DNA, 71 bp, chicken (Gallus Gallus)
  misc_feature (36): n=a or g
taagacataaaccacattttgggacctagatcaatncacattactgtatggcccagcttcatccctgatga

SEQ ID NO: 11165 - DNA, 71 bp, chicken (Gallus Gallus)
  misc_feature (36): n=c or t
cataaattaccacagcttggttggcaggtcctgagngagtaataagggttttggcacaaacacacaccaca

SEQ ID NO: 11166 - DNA, 71 bp, chicken (Gallus Gallus)
  misc_feature (36): n=a or g
aaagtaattaggacctacttgtaccttcgtaagtcnttacagggctgaaaaagaagattcacttgctaaat

SEQ ID NO: 11167 - DNA, 71 bp, chicken (Gallus Gallus)
  misc_feature (36): n=a or g
agaattccaaaccatgcacctcaataatgttccagnaaaaaaaaaaaaaaaaaaaaaaaacaagtgagaac

SEQ ID NO: 11168 - DNA, 71 bp, chicken (Gallus Gallus)
  misc_feature (36): n=a or c
tttcttactgaaaaaaaagaaggaaaattatgatgnagagcttttcaaattcacttctatttgtcttctag

SEQ ID NO: 11169 - DNA, 71 bp, chicken (Gallus Gallus)
  misc_feature (36): n=a or g
gcatggggacaaatgtccaatggtccagtgggtcanatcctgaatgcttgtatccaatgtacatccagagc

SEQ ID NO: 11170 - DNA, 71 bp, chicken (Gallus Gallus)
  misc_feature (36): n=c or t
aataaatgtgtcttcaggatatacctttaagactgnaagctttgtcagagattaattcagtctctctgaag

SEQ ID NO: 11171 - DNA, 71 bp, chicken (Gallus Gallus)
  misc_feature (36): n=a or g
ctctgtcacgtgctgtcatcctccaatcctcctccngcatcacttgcaaagatctgctgccgctcacaatg

SEQ ID NO: 11172 - DNA, 71 bp, chicken (Gallus Gallus)
  misc_feature (36): n=c or t
cttaggggagtgagagaccttgctggcaagccggangtctgctgtagaagaaagagaagacttgaatctgc

SEQ ID NO: 11173 - DNA, 71 bp, chicken (Gallus Gallus)
  misc_feature (36): n=g or t
atgttttttataccttgtaatgacaaattgtccgcntctcagtccttcctttaaaagcaggaactgtgtaa

SEQ ID NO: 11174 - DNA, 71 bp, chicken (Gallus Gallus)
  misc_feature (36): n=c or t
ggacctgtgcaaaatgtcttttcagtgcttggcaantatatggctacaactgaatgtttacatatcccatt

SEQ ID NO: 11175 - DNA, 71 bp, chicken (Gallus Gallus)
  misc_feature (36): n=g or t
gcacacatcccatgtttcaagggtttttggtagctnccagtccaagggactgcctccaggatgcaaagctg

SEQ ID NO: 11176 - DNA, 71 bp, chicken (Gallus Gallus)
  misc_feature (36): n=c or t
tctgataacaagttgtgtaaaggagtgtatttttgngttgaactctaagcagtgaaagggaagcagtaatg

SEQ ID NO: 11177 - DNA, 71 bp, chicken (Gallus Gallus)
  misc_feature (36): n=c or t
atgaagtatctgggttctttctttagagaagctttnccttctgtgttcagagatgggtgtcagctcctgag

SEQ ID NO: 11178 - DNA, 71 bp, chicken (Gallus Gallus)
  misc_feature (36): n=g or t
attgagaagagtgaaaaaatgctgctctgatgcagnccatcttaaagtaaagccttgggtcatcgttcccc

SEQ ID NO: 11179 - DNA, 71 bp, chicken (Gallus Gallus)
  misc_feature (36): n=c or g
gagatgagtagaggcatcctcttgaaaacagccatnttccagttgcactagctcttttttttttttgtccc

SEQ ID NO: 11180 - DNA, 71 bp, chicken (Gallus Gallus)
  misc_feature (36): n=a or g
tcttaaaccagcgagatggggcagtgcgagcgccgnccctttcaagatgctgtcgtgatgtccctgcagct

SEQ ID NO: 11181 - DNA, 71 bp, chicken (Gallus Gallus)
  misc_feature (36): n=a or t
agtgtagaagcgcagtgatgaattccacatctccgnacagggaagcacagttgaagctactgggatccttc

SEQ ID NO: 11182 - DNA, 71 bp, chicken (Gallus Gallus)
  misc_feature (36): n=a or g
cttcctattacaaaggagtagacagacttgaagtantgactgtaccttgctttttaaccagatgcttaaag

SEQ ID NO: 11183 - DNA, 71 bp, chicken (Gallus Gallus)
  misc_feature (36): n=a or g
attcctaggtgaaggatgcagttcttaataactccntttcttaatgctcagtcttctatctgttgcccaga

SEQ ID NO: 11184 - DNA, 71 bp, chicken (Gallus Gallus)
  misc_feature (36): n=c or t
caaaaaatacttctgtcgctgttgtagaatgtaacngtctcttctgtttgtggagtctctcaatgaattat

SEQ ID NO: 11185 - DNA, 71 bp, chicken (Gallus Gallus)
  misc_feature (36): n=c or t
gcacagaacgatctcccacttttctgtgaccttggngaggacctgaatatcttgcattgctaattggagcc

SEQ ID NO: 11186 - DNA, 71 bp, chicken (Gallus Gallus)
  misc_feature (36): n=a or g
tgataatgacagcaacaaggtcttggcatgcttcanagaagcatcatctggcctcttcaggtagcagacac

SEQ ID NO: 11187 - DNA, 71 bp, chicken (Gallus Gallus)
  misc_feature (36): n=a or g
cacctgtgcttaatttgccatttgtaatgggggtanagctgcagctgattttcctttggtgaggagtgaaa

SEQ ID NO: 11188 - DNA, 71 bp, chicken (Gallus Gallus)
  misc_feature (36): n=a or c
tgaacatctaggtcaaagcatttacataaaaaaaancagaacaacatactagcattcctctttgctttaag

SEQ ID NO: 11189 - DNA, 71 bp, chicken (Gallus Gallus)
  misc_feature (36): n=a or g
ttaacaggcattctgcctactgaactcttcatgacnttctggagacagctatacacaaaggtctgggttat

SEQ ID NO: 11190 - DNA, 71 bp, chicken (Gallus Gallus)
  misc_feature (36): n=c or t
aaatcatctgttatgtttttgatgacatctatatangcagtgcctctgcctgcttctcagaaatgctgctt

SEQ ID NO: 11191 - DNA, 71 bp, chicken (Gallus Gallus)
  misc_feature (36): n=g or t
gcctgggagggcagagcctgggggatgctccgaggnggagattttgaacagcattcagctcccagaccctt

SEQ ID NO: 11192 - DNA, 71 bp, chicken (Gallus Gallus)
  misc_feature (36): n=g or t
tgagtttgacatttcaagaaaactgtgtgtaaactnatgtttatatgcaatagaccacaaagacaaaacaa

SEQ ID NO: 11193 - DNA, 71 bp, chicken (Gallus Gallus)
  misc_feature (36): n=a or c
tgttaatccctcatctcacttggaaatgaggaagcntggttgcagtgagttggagattcaggagatggagg

SEQ ID NO: 11194 - DNA, 71 bp, chicken (Gallus Gallus)
  misc_feature (36): n=c or t
gctctgcctgctcggtggttggtacggccattcctnactgcttcagctacggtcataaagctttgctaact

SEQ ID NO: 11195 - DNA, 71 bp, chicken (Gallus Gallus)
  misc_feature (36): n=c or t
aaacacattctccaaatgagtccatggtggctctantgccatcgctcaagcagttcgagcttaagccaaca

SEQ ID NO: 11196 - DNA, 71 bp, chicken (Gallus Gallus)
  misc_feature (36): n=c or g
cccccactttattactgtctgcaaagtacaattgantgtagatggttcttcagagtcctgattaaatgaag

SEQ ID NO: 11197 - DNA, 71 bp, chicken (Gallus Gallus)
  misc_feature (36): n=c or g
aaatcctaagtacacattttctgatgtgtgacaggngactgatctgtgctacttagaatcatagaatcgta

SEQ ID NO: 11198 - DNA, 71 bp, chicken (Gallus Gallus)
  misc_feature (36): n=c or t
ttgataaataaatctcacctcttccaaaaatctatntgccttgttcaccattctgaatatgacttaccgag

SEQ ID NO: 11199 - DNA, 71 bp, chicken (Gallus Gallus)
  misc_feature (36): n=c or t
tgggtcttgtttatcccagtctttagtttactgcanctcctgtactgtccttttttactaaaaaatcttag

SEQ ID NO: 11200 - DNA, 71 bp, chicken (Gallus Gallus)
  misc_feature (36): n=c or t
cttctctgggcaacctgtgccagtgctccaccaccnttatggtgaattatttattcctttcatctactcta

SEQ ID NO: 11201 - DNA, 71 bp, chicken (Gallus Gallus)
  misc_feature (36): n=g or t
ccttgtgtcctcatcagttatcctgcctaaatcatnctacctctacccatggcaccattcactttctcttc

SEQ ID NO: 11202 - DNA, 71 bp, chicken (Gallus Gallus)
  misc_feature (36): n=g or t
cgcattcgtttgcctcaggccttaatgccagtcagngccagcgcccagaaaagaaggcaggatgcctgcct

SEQ ID NO: 11203 - DNA, 71 bp, chicken (Gallus Gallus)
  misc_feature (36): n=c or t
gaaatgcctacagaatttctgcctagatctcaacancccctcccatctaggaccacaaaccaagttaaagg

SEQ ID NO: 11204 - DNA, 71 bp, chicken (Gallus Gallus)
  misc_feature (36): n=a or g
gaaactttcacataacatcactgtccagcctggaanctgcttggagcgtgtctcatgttaatagacactgt

SEQ ID NO: 11205 - DNA, 71 bp, chicken (Gallus Gallus)
  misc_feature (36): n=c or g
cacctaacttcctgtcttcctttttttctgtgtcantaacaatgctagcaggataactttctgctgagggt

SEQ ID NO: 11206 - DNA, 71 bp, chicken (Gallus Gallus)
  misc_feature (36): n=c or t
attactgcttatttttctaactaccataacatgtantgcaactcgcattgtatattcagcctggtctagca

SEQ ID NO: 11207 - DNA, 71 bp, chicken (Gallus Gallus)
  misc_feature (36): n=c or t
ctgcttggtcgttgagctgaaataaaagaaaatggnagtctaatcatcaaactgaatgatggcaaggagag

SEQ ID NO: 11208 - DNA, 71 bp, chicken (Gallus Gallus)
  misc_feature (36): n=a or g
atcctaggcagttctttaatccggcagacaatggtntaacaagatcaaagtgctagaaggtgagatcagac

SEQ ID NO: 11209 - DNA, 71 bp, chicken (Gallus Gallus)
  misc_feature (36): n=c or t
agagtcatacttttcctttgcgtaagtcatagtgtnccttttgtggtacagatggccgagggttttgattt

SEQ ID NO: 11210 - DNA, 71 bp, chicken (Gallus Gallus)
  misc_feature (36): n=a or g
cagccagctgtgagaggtatacaaacacatgaaacncagtttcaacgtagcacaagacctcaggaaactgt

SEQ ID NO: 11211 - DNA, 71 bp, chicken (Gallus Gallus)
  misc_feature (36): n=c or t
taaatccttgtaggaatggtttccatgctacagatnacctgtatacttatgcagaaagtgttagaccctac

SEQ ID NO: 11212 - DNA, 71 bp, chicken (Gallus Gallus)
  misc_feature (36): n=c or t
ataggagaaaggaatttcagaaataaggttactgangcaggtagcattaagtgttgttttgctcttcagct

SEQ ID NO: 11213 - DNA, 71 bp, chicken (Gallus Gallus)
  misc_feature (36): n=a or g
catcccctatagacttcagctcttacaactgtaccngtgagtgactgcagggagcccgctggtatagaaga

SEQ ID NO: 11214 - DNA, 71 bp, chicken (Gallus Gallus)
  misc_feature (36): n=a or g
ggtgtttgcatctgagtgcttcaggtcaggtaacangttgagcctggcagcatctttgttgtgtgttgagc

SEQ ID NO: 11215 - DNA, 71 bp, chicken (Gallus Gallus)
  misc_feature (36): n=c or t
aagacgagttaatccacccctaccaaatactgtgcngctgttctacagtttctgtaaattagtgctttaaa

SEQ ID NO: 11216 - DNA, 71 bp, chicken (Gallus Gallus)
  misc_feature (36): n=a or g
tgttagggtcttcagtatttgcactgatgtaaatgngccaaaagcatttgcagtattttgcagagcactga

SEQ ID NO: 11217 - DNA, 71 bp, chicken (Gallus Gallus)
  misc_feature (36): n=a or g
ctgtgaaaacattcaccaaagacagtatcaactcantatcagtatcaacgcctccccagccactaccacaa

SEQ ID NO: 11218 - DNA, 71 bp, chicken (Gallus Gallus)
  misc_feature (36): n=g or t
attcctaaattttccaatcagaggaaataataaatnaattgaatttaatatgtgaagtgtgtggtaggatt

SEQ ID NO: 11219 - DNA, 71 bp, chicken (Gallus Gallus)
  misc_feature (36): n=a or g
aacaacagagggaatacaaaaaatcccagcactcantgagttccgagctggataagcagctgaatatcgtg

SEQ ID NO: 11220 - DNA, 71 bp, chicken (Gallus Gallus)
  misc_feature (36): n=c or g
agaaaaactgaagtgtcactgatattttcaggtaantgtcagccccatgtagaattctttgctgaaaataa

SEQ ID NO: 11221 - DNA, 71 bp, chicken (Gallus Gallus)
  misc_feature (36): n=c or t
gaaaggaggcaatttagtaaaaaaaagaacctcagnttttttcaggattagagctgttgttgacccatgca

SEQ ID NO: 11222 - DNA, 71 bp, chicken (Gallus Gallus)
  misc_feature (36): n=a or g
ttttttcagccagcgatggctgatacagagggtgtntatgtcctgcaacacaagcaacaggcagtgcgaga

SEQ ID NO: 11223 - DNA, 71 bp, chicken (Gallus Gallus)
  misc_feature (36): n=a or g
tgatgaaaacattcagaggtttctaaaataacaagnacggctgaagaagcctctgtaacctctgggtgatt

SEQ ID NO: 11224 - DNA, 71 bp, chicken (Gallus Gallus)
  misc_feature (36): n=c or t
ctgggtgcttgtgaattttccctcacagcattcctngtaggctggaatatgagtgcaaacctccccccaac

SEQ ID NO: 11225 - DNA, 71 bp, chicken (Gallus Gallus)
  misc_feature (36): n=a or g
aattaaatgtaatgataaattttagcactctaaacngttaccagaagcgcttaatcaaaactaaggtactc

SEQ ID NO: 11226 - DNA, 71 bp, chicken (Gallus Gallus)
  misc_feature (36): n=a or g
tttaaaaatgctaagaataaacaaatctaaaacacntaccaatcttgaccttagtggaacgaatatcatat

SEQ ID NO: 11227 - DNA, 71 bp, chicken (Gallus Gallus)
  misc_feature (36): n=a or g
tgctctgtcacttgtgtagcaacctcaggctctggnagagaggtggtcaggaaagctgtctgcattgatgg

SEQ ID NO: 11228 - DNA, 71 bp, chicken (Gallus Gallus)
  misc_feature (36): n=a or g
tgtccaaaactggtttgcacagaggagagcacaagnctgctaccagctcattactttgcatgcttttctgc

SEQ ID NO: 11229 - DNA, 71 bp, chicken (Gallus Gallus)
  misc_feature (36): n=c or t
tcatctgtgagctcaattgagccctggatcaagtangttattcccagagtgcttatacctgctgacttcag

SEQ ID NO: 11230 - DNA, 71 bp, chicken (Gallus Gallus)
  misc_feature (36): n=a or g
gtcccttccaacctaagccatgctgtgactgcaggnaaggttgtttactgcagcattttgagactttcctt

SEQ ID NO: 11231 - DNA, 71 bp, chicken (Gallus Gallus)
  misc_feature (36): n=c or t
ggttggctctggaagaaacctgacatttcttcatgnaggctcttcaaaatgttgtaaataatgcaagcgtt

SEQ ID NO: 11232 - DNA, 71 bp, chicken (Gallus Gallus)
  misc_feature (36): n=c or t
agacagggaagagatgctgacttgccaggagagggntttgtgtgtgtccgtgtgtgtccgtgtctgtctct

SEQ ID NO: 11233 - DNA, 71 bp, chicken (Gallus Gallus)
  misc_feature (36): n=g or t
caaattacgggaaggtaatttctttctcagcaatcncattccttgaaataaccaatcctttgatcttctgc

SEQ ID NO: 11234 - DNA, 71 bp, chicken (Gallus Gallus)
  misc_feature (36): n=a or g
atatatctgaagactcaggctccaaatcctgcaaanacctttcagtatccctcatatgcaccatcataatt

SEQ ID NO: 11235 - DNA, 71 bp, chicken (Gallus Gallus)
  misc_feature (36): n=a or g
actcacacaaattcaagttatagaggtgggaattgngcaaggaaagctgtttactcttagcagagggcaac

SEQ ID NO: 11236 - DNA, 71 bp, chicken (Gallus Gallus)
  misc_feature (36): n=a or g
cttttgttaaaaacgtgatagagctccattgttctnaacattctgctcaacatcagtgtgctagagcttgc

SEQ ID NO: 11237 - DNA, 71 bp, chicken (Gallus Gallus)
  misc_feature (36): n=c or t
gcagcttttgtaaggaaactacaccagcttccagancccaatatctgtttatttgggaaagttgatgtctt

SEQ ID NO: 11238 - DNA, 71 bp, chicken (Gallus Gallus)
  misc_feature (36): n=c or t
gtgatctggctgcagaataggacctctttttccagngggcaatctgtgatgcccaacattgaaaaaggaaa

SEQ ID NO: 11239 - DNA, 71 bp, chicken (Gallus Gallus)
  misc_feature (36): n=c or t
ttcccttcaaagacaatttggtgattccgttcattnatacctgtcaaaaaataaaaaatatcttgtgaatt

SEQ ID NO: 11240 - DNA, 71 bp, chicken (Gallus Gallus)
  misc_feature (36): n=c or t
ccgtagttgccgtgaactttatagacgccatacagncggtctgctaccctctaaaacatttaaggttagtt

SEQ ID NO: 11241 - DNA, 71 bp, chicken (Gallus Gallus)
  misc_feature (36): n=g or t
tggcaggagtagacctgcttctcaaagtacacccanagccccggagatgggaattcactcccaagatgaac

SEQ ID NO: 11242 - DNA, 71 bp, chicken (Gallus Gallus)
  misc_feature (36): n=a or g
gtcctcagcattatcagcttttttttttttcttatnacatgtaagatgaaaaaccaaaacctacagtccat

SEQ ID NO: 11243 - DNA, 71 bp, chicken (Gallus Gallus)
  misc_feature (36): n=a or g
acaaatgagcagaacctcatttgacaggattaaccntgttactctctctttttattttcccactggagtct

SEQ ID NO: 11244 - DNA, 71 bp, chicken (Gallus Gallus)
  misc_feature (36): n=c or t
gtagcagggatggtttccttggtgaccttactaggnattgtagtggtgggatccacaggttttgtgctttc

SEQ ID NO: 11245 - DNA, 71 bp, chicken (Gallus Gallus)
  misc_feature (36): n=c or t
tgttcaatacagaaaaaaatgatatcagcaggttcncaagtccatgggagacccaaaacttcggcagcagg

SEQ ID NO: 11246 - DNA, 71 bp, chicken (Gallus Gallus)
  misc_feature (36): n=g or t
cttcctttccttagccttctgcaccttccctctatngttacacaccttccaggcagcttctagtagtttat

SEQ ID NO: 11247 - DNA, 71 bp, chicken (Gallus Gallus)
  misc_feature (36): n=a or g
agtttatactgctccccgctggcagcattgactgtnaaggtgtgcgagtcttcatcactgggtgaaattac

SEQ ID NO: 11248 - DNA, 71 bp, chicken (Gallus Gallus)
  misc_feature (36): n=a or g
tattaataacaaggaattattgagatgagagccacnagggcagctctaggccctgtgatggcagctggcct

SEQ ID NO: 11249 - DNA, 71 bp, chicken (Gallus Gallus)
  misc_feature (36): n=c or t
tggcatctttttcagtatctcagcctgcacctgtgnaattacactacataaaggatccccgagcctttgtt

SEQ ID NO: 11250 - DNA, 71 bp, chicken (Gallus Gallus)
  misc_feature (36): n=c or t
ctgatctggctaaagttatgttgttggtgaaagttngtgaaaatctgagtaatgcagggaaaaaaagaaag

SEQ ID NO: 11251 - DNA, 71 bp, chicken (Gallus Gallus)
  misc_feature (36): n=a or g
tgttgcattcttctcagactgtgacaaaacatggtncagacctgagttgggaacatctgagtaatttgtat

SEQ ID NO: 11252 - DNA, 71 bp, chicken (Gallus Gallus)
  misc_feature (36): n=c or t
gaacactagtttaattgctgataataccatactttnaccacaagagccctcgaaagcccagatgttagctt

SEQ ID NO: 11253 - DNA, 71 bp, chicken (Gallus Gallus)
  misc_feature (36): n=g or t
tagtgttggctcttttgaactgttggttgttatttntattattattttatattctgcaattacagtgtctt

SEQ ID NO: 11254 - DNA, 71 bp, chicken (Gallus Gallus)
  misc_feature (36): n=c or t
ctgctctttccgacctcccctccaattcgtcccagnctttcatgagcccctctctcaaacatttcccctgt

SEQ ID NO: 11255 - DNA, 71 bp, chicken (Gallus Gallus)
  misc_feature (36): n=a or g
agaaaaaaaataatttgactttgcaccattaggaanatcccctttggcatggaggcacctgctatgagccc

SEQ ID NO: 11256 - DNA, 71 bp, chicken (Gallus Gallus)
  misc_feature (36): n=c or t
gtagctagatggaaacctaccaggttgagcaaatanctaattacatttccattaataacttagtaacttat

SEQ ID NO: 11257 - DNA, 71 bp, chicken (Gallus Gallus)
  misc_feature (36): n=a or g
aacttgtgcttttatgttgactttgcttgatgatgnaacagaagagaagcttgctgaatccaattttccct

SEQ ID NO: 11258 - DNA, 71 bp, chicken (Gallus Gallus)
  misc_feature (36): n=a or g
gttatgaatatgtcagtgtgagatattaaaaacccnttttttcttgttggtttatccttgaaaggctttaa

SEQ ID NO: 11259 - DNA, 71 bp, chicken (Gallus Gallus)
  misc_feature (36): n=a or g
acataaaaatacccagacctttctgtcagcatcagngtgtggatgggacaccacagcattgaaaggagggt

SEQ ID NO: 11260 - DNA, 71 bp, chicken (Gallus Gallus)
  misc_feature (36): n=c or t
acagacttcctgtcacatttgaatcttgtctccttnagcctgaaattcaggagtcttcttttgacctctgt

SEQ ID NO: 11261 - DNA, 71 bp, chicken (Gallus Gallus)
  misc_feature (36): n=a or g
taataggaaagaacttatttctaatctagctcttcnggaagataaataatctggattgaaagcaaatagga

SEQ ID NO: 11262 - DNA, 71 bp, chicken (Gallus Gallus)
  misc_feature (36): n=a or g
gtgaactccaccactggacggtcactaacagcccangcagtccccaaatctactgtcaccaatcattttgt

SEQ ID NO: 11263 - DNA, 71 bp, chicken (Gallus Gallus)
  misc_feature (36): n=a or g
ggtagcaaatgacactcggaggtcctcggattgagnaggaacctccacaaggagctaatataacaaatgta

SEQ ID NO: 11264 - DNA, 71 bp, chicken (Gallus Gallus)
  misc_feature (36): n=c or t
aacacaatcctctgtttctttttattcaatcagtgngatattaacagtgacttatatatgagatcatacat

SEQ ID NO: 11265 - DNA, 71 bp, chicken (Gallus Gallus)
  misc_feature (36): n=c or t
gaccctgcagggataggtgtagggcctgtccctttngggaccatgtgctggtacagtgagacatctgtccc

SEQ ID NO: 11266 - DNA, 71 bp, chicken (Gallus Gallus)
  misc_feature (36): n=g or t
tacagcaaagagcacaaagaaaggacctctaaaatngcaaaagacttatgttaaaaaaaaaaaaaaaaaga

SEQ ID NO: 11267 - DNA, 71 bp, chicken (Gallus Gallus)
  misc_feature (36): n=a or g
tcggatccaagaagagatgagaagtggaggggaaanaaaactgatggactttcagagcattttcacaccac

SEQ ID NO: 11268 - DNA, 71 bp, chicken (Gallus Gallus)
  misc_feature (36): n=g or t
tataatataacgcagtattgctgtatcctacagcantcaagctgtgatagagctgtaaaaaattagttata

SEQ ID NO: 11269 - DNA, 71 bp, chicken (Gallus Gallus)
  misc_feature (36): n=a or t
gataaaaaaaaaaaaaaaggggaatacttctgtcantaaacacttatgggaagtaaccctgctggaagcat

SEQ ID NO: 11270 - DNA, 71 bp, chicken (Gallus Gallus)
  misc_feature (36): n=a or g
gagcctgctgtaaatgaagccttggctctcaagagntttacctgcagagcacatggcacaatgaagatctc

SEQ ID NO: 11271 - DNA, 71 bp, chicken (Gallus Gallus)
  misc_feature (36): n=a or t
ctttgaagaagaccagggatgatctgtgagaaagcncttgtgtagtatcacagatctatcaaaaccaacag

SEQ ID NO: 11272 - DNA, 71 bp, chicken (Gallus Gallus)
  misc_feature (36): n=c or t
gagaaatatagacttcatctccttgatttaatcttngttaaaagcctgctgtttccctcccttcctcaaac

SEQ ID NO: 11273 - DNA, 71 bp, chicken (Gallus Gallus)
  misc_feature (36): n=a or g
atttgttcatattttgagaactgttccgtgcattcngtgacatgcttttcagttgaatagttatattttct

SEQ ID NO: 11274 - DNA, 71 bp, chicken (Gallus Gallus)
  misc_feature (36): n=g or t
ccgtattagaagcacaactactccaagggcattacncttctaaggagccaatattttcttatcaacgtcaa

SEQ ID NO: 11275 - DNA, 71 bp, chicken (Gallus Gallus)
  misc_feature (36): n=a or g
ggagccgggctgcacatcaagggggctcatttatcnttaaattcagcccatggatgcaaagtagttttgcc

SEQ ID NO: 11276 - DNA, 71 bp, chicken (Gallus Gallus)
  misc_feature (36): n=c or t
aggaatctctcatagccaacatcaatggtaaattcnttctttgagatagcattaattccagtatactgttt

SEQ ID NO: 11277 - DNA, 71 bp, chicken (Gallus Gallus)
  misc_feature (36): n=c or t
aacagagtacacgtggtccaaaatgatatgaaatgnaatagcaataggaccctttcattacagttttggca

SEQ ID NO: 11278 - DNA, 71 bp, chicken (Gallus Gallus)
  misc_feature (36): n=a or t
cagtgttaccggcatatccgagcttcgtatacctgntaagacaagaaaagcttcggttataatatgtaata

SEQ ID NO: 11279 - DNA, 71 bp, chicken (Gallus Gallus)
  misc_feature (36): n=a or c
tcttaagccactggattccattccagactttgcacnaggtctccatacccaggaattcactcagcttcatg

SEQ ID NO: 11280 - DNA, 71 bp, chicken (Gallus Gallus)
  misc_feature (36): n=c or t
tgtcactaccttacctcctaaatattctatctcagnttatattttaattgcactgaaatgaaatagaaatc

SEQ ID NO: 11281 - DNA, 71 bp, chicken (Gallus Gallus)
  misc_feature (36): n=a or g
gtatatattggtggcactggaagtagcctctcactnaattctacagtgttacaccattggtctgcagattt

SEQ ID NO: 11282 - DNA, 71 bp, chicken (Gallus Gallus)
  misc_feature (36): n=c or t
aaaaggaggttgactatcagtagttttccaggtggnctcagttcttactctttgagatttaatagttgaac

SEQ ID NO: 11283 - DNA, 71 bp, chicken (Gallus Gallus)
  misc_feature (36): n=c or t
gtgccactggagatgagctcaaagcctcgcccagangcacagaatggcctttgtgaacgtgaagtatgact

SEQ ID NO: 11284 - DNA, 71 bp, chicken (Gallus Gallus)
  misc_feature (36): n=a or g
gtagtgtctggtgtagccgtaagcaaggtaatgatngaagaagtgcaaacaagacctgagcgcagccatca

SEQ ID NO: 11285 - DNA, 71 bp, chicken (Gallus Gallus)
  misc_feature (36): n=c or t
acagaaaataccatttacattaaacctctcttccangggatgcaatacttccaaacccagacaagccgaac

SEQ ID NO: 11286 - DNA, 71 bp, chicken (Gallus Gallus)
  misc_feature (36): n=c or g
cagaacaaaggttactcagcttgacacgaacatagntttcctttatgattcatacttgaaaactcttgcaa

SEQ ID NO: 11287 - DNA, 71 bp, chicken (Gallus Gallus)
  misc_feature (36): n=c or t
gatgccagatggcttggaggtggccaggagctgtanggttgtgcagactgtgcaggcttgttccttgttgc

SEQ ID NO: 11288 - DNA, 71 bp, chicken (Gallus Gallus)
  misc_feature (36): n=a or g
agttgtagatgaaactaagattactaaatggttggnaagtaaataattccgtcaaacagaaccatacatgg

SEQ ID NO: 11289 - DNA, 71 bp, chicken (Gallus Gallus)
  misc_feature (36): n=a or c
aaaacgtcattctgcccagcaaggctgtagttcccncacacacttgccaaacgtttccagagctctctgct

SEQ ID NO: 11290 - DNA, 71 bp, chicken (Gallus Gallus)
  misc_feature (36): n=c or t
cttataaattattgggcacacatcaagacaaattgnagagatttgtccagccgattcaaactcattttatt

SEQ ID NO: 11291 - DNA, 71 bp, chicken (Gallus Gallus)
  misc_feature (36): n=a or c
tcttcgtgatctccgtttcattctcactgctgcaanaactcctcaccagctgaggtgtctgagtaatttct

SEQ ID NO: 11292 - DNA, 71 bp, chicken (Gallus Gallus)
  misc_feature (36): n=c or t
tagatcatgctgttttttctatcattgcaaagctangtacagttgttaggtaggactctaacacttaagtg

SEQ ID NO: 11293 - DNA, 71 bp, chicken (Gallus Gallus)
  misc_feature (36): n=a or g
caacttcactgtatgcatgaccattttacttcttgngtgaaaggctgggaagttgcctcttctgacaccaa

SEQ ID NO: 11294 - DNA, 71 bp, chicken (Gallus Gallus)
  misc_feature (36): n=c or t
agctgaacaccaactgaacacacacttttaaaatgngtatgtttgtaagaattctccatttggccacgttt

SEQ ID NO: 11295 - DNA, 71 bp, chicken (Gallus Gallus)
  misc_feature (36): n=a or t
caaaagctgtacatccagccatcagacatcagtttngtgttccccagcacaatccatttcacacagtacac

SEQ ID NO: 11296 - DNA, 71 bp, chicken (Gallus Gallus)
  misc_feature (36): n=a or g
tattgagttgagtgtttcatctgatagataagagcnaacatgcataaagaattcacatctccaggttctgt

SEQ ID NO: 11297 - DNA, 71 bp, chicken (Gallus Gallus)
  misc_feature (36): n=c or t
aatcagacaaaaatctactgtcaggctttagttctnaatctctctttcttgagacttcatcacaattattt

SEQ ID NO: 11298 - DNA, 71 bp, chicken (Gallus Gallus)
  misc_feature (36): n=c or t
actgtattatgcaatggaaagaggctgttacagaantacctacattttcattaataatacacaagtactgg

SEQ ID NO: 11299 - DNA, 71 bp, chicken (Gallus Gallus)
  misc_feature (36): n=a or g
aacagtctccaccatcaccaataggcaaacttttcnaaacccagacagaaaaatgctatttatatacaatt

SEQ ID NO: 11300 - DNA, 71 bp, chicken (Gallus Gallus)
  misc_feature (36): n=a or c
cttcgaggaatgctgcctcggggcagctcagcctgngtctcttgaatgcgaacctgaggaggtacagaaca

SEQ ID NO: 11301 - DNA, 71 bp, chicken (Gallus Gallus)
  misc_feature (36): n=a or t
cggtaattctgcagctccgaagttccttctcattanggagatggggtcacggagaaacagagaggatgccc

SEQ ID NO: 11302 - DNA, 71 bp, chicken (Gallus Gallus)
  misc_feature (36): n=g or t
gactgactcggagaggggaggaggaaaagtcttgcnactcaatgaagcagttgcacaaatctgagctgtat

SEQ ID NO: 11303 - DNA, 71 bp, chicken (Gallus Gallus)
  misc_feature (36): n=a or g
tgtagagggagtcggggttcggctaaactgatcacntagatctgaaagcgagataggaacaaaaatagcat

SEQ ID NO: 11304 - DNA, 71 bp, chicken (Gallus Gallus)
  misc_feature (36): n=a or g
tccttgcttgcaggaacatttccatggtctctagcnaaagtccttactgctcggcaaagataagggtaaac

SEQ ID NO: 11305 - DNA, 71 bp, chicken (Gallus Gallus)
  misc_feature (36): n=c or g
gttactgtagatattgagaaacatcctccaaggcanctacttgccccgcctggctctccggatgatggggc

SEQ ID NO: 11306 - DNA, 71 bp, chicken (Gallus Gallus)
  misc_feature (36): n=c or t
atcctagtgtttgctacagggtgaaccaggatgcanactgttagggtgctagcaggctgtgtgctggggct

SEQ ID NO: 11307 - DNA, 71 bp, chicken (Gallus Gallus)
  misc_feature (36): n=c or t
ctgtacctccaacatgtggtatttaatctagatttntaaccattagttattctaactgctacatttgattc

SEQ ID NO: 11308 - DNA, 71 bp, chicken (Gallus Gallus)
  misc_feature (36): n=a or g
gcaatccagatttctatccttgtgcttataattgcntcttgggctgcctcgttacagactctgttctgtaa

SEQ ID NO: 11309 - DNA, 71 bp, chicken (Gallus Gallus)
  misc_feature (36): n=g or t
aaattaaaatcagcaaacgtatagtttaaagagaantggttccattttatccccttcccacctgtgctgtg

SEQ ID NO: 11310 - DNA, 71 bp, chicken (Gallus Gallus)
  misc_feature (36): n=a or g
atagttatttactaccccaaacttctcagcatctcntaatatagacgtcttaacatttttttccacctttt

SEQ ID NO: 11311 - DNA, 71 bp, chicken (Gallus Gallus)
  misc_feature (36): n=c or t
cattgagtgtaggtattcacaacacttctgggcaanttgttgaaaagcctaattagtccattaaataattt

SEQ ID NO: 11312 - DNA, 71 bp, chicken (Gallus Gallus)
  misc_feature (36): n=c or t
aggagtgaacattgcaaaatattttttattaccttngtatgttgaatgcattctaggacctaagagagagt

SEQ ID NO: 11313 - DNA, 71 bp, chicken (Gallus Gallus)
  misc_feature (36): n=a or g
aaaatataataggatgggtttttttcctaatatacngaggctaaagacaccggggagaaaaaaagcagttt

SEQ ID NO: 11314 - DNA, 71 bp, chicken (Gallus Gallus)
  misc_feature (36): n=c or t
gagagggaaataagggtacagttggtgtgactctcnctaacctaaatttccagccaacactccaaatcact

SEQ ID NO: 11315 - DNA, 71 bp, chicken (Gallus Gallus)
  misc_feature (36): n=c or t
aatatattatttaccagacttcccattaaacttagnaagtcagaaagcagaatgctttccaatctaaacat

SEQ ID NO: 11316 - DNA, 71 bp, chicken (Gallus Gallus)
  misc_feature (36): n=a or g
tggtttgcaagaagcacaacatgtagcccagacaanagcaggtgaactttcacagcagggaaaggcttctt

SEQ ID NO: 11317 - DNA, 71 bp, chicken (Gallus Gallus)
  misc_feature (36): n=a or g
ttcttctgaagagacaacgggcatttgttgtccatngtttttgcagagccaggtttcagcaggactggcac

SEQ ID NO: 11318 - DNA, 71 bp, chicken (Gallus Gallus)
  misc_feature (36): n=c or t
cttcctcagtcttactacataatcccttttaatgcnttggataacctctctccccgaacctctttgaattt

SEQ ID NO: 11319 - DNA, 71 bp, chicken (Gallus Gallus)
  misc_feature (36): n=c or t
tcctaagagagtcattccatactgttgtctccgtgnttgccactcctgattcgcagctctccagtgtttca

SEQ ID NO: 11320 - DNA, 71 bp, chicken (Gallus Gallus)
  misc_feature (36): n=c or t
cacagaaatgtataaaagcattgtaatgaaagctantgagtcctaaaagaaataacaactaaaatataaaa

SEQ ID NO: 11321 - DNA, 71 bp, chicken (Gallus Gallus)
  misc_feature (36): n=a or c
ctaagttgcatttcatcagtttatcttcttgctttntttcaatggtcctgttgttggctaagttgcttttt

SEQ ID NO: 11322 - DNA, 71 bp, chicken (Gallus Gallus)
  misc_feature (36): n=g or t
tttatttttctcctgcagcactaaaatcaagacaanatgtcattacgttcggtattactcaaacatccgaa

SEQ ID NO: 11323 - DNA, 71 bp, chicken (Gallus Gallus)
  misc_feature (36): n=c or t
aaataagtcacctgaactgatgacagtactttgccngtgcatgggaattgccaggtcattgcctaaactaa

SEQ ID NO: 11324 - DNA, 71 bp, chicken (Gallus Gallus)
  misc_feature (36): n=c or t
taagcaccttcagctgaagtgcctccagaaaaatantgaagtatccagatgtgaaaactttaccctaaatc

SEQ ID NO: 11325 - DNA, 71 bp, chicken (Gallus Gallus)
  misc_feature (36): n=a or g
gtcatctctggtgcacgtgtattggtgggaaaagcntcgcaaccttttgctgtgatgactgagtggaacag

SEQ ID NO: 11326 - DNA, 71 bp, chicken (Gallus Gallus)
  misc_feature (36): n=a or g
gctgatatgtgcacagagggaagggagctctgcagnctgaagtgaaatgcagtgagaatatcagctacgag

SEQ ID NO: 11327 - DNA, 71 bp, chicken (Gallus Gallus)
  misc_feature (36): n=c or t
tcaaagagttttataaacatgccctaattaatgttngcaacacctttttgtggcaggtaagcactcattag

SEQ ID NO: 11328 - DNA, 71 bp, chicken (Gallus Gallus)
  misc_feature (36): n=a or c
aaagcaagttataatcaataggtattaattaatagnaaaattgaaaagcagctttatattccaacatatca

SEQ ID NO: 11329 - DNA, 71 bp, chicken (Gallus Gallus)
  misc_feature (36): n=g or t
agaaagtatgtttctaatatgtgagttttctgactnatcatgaaaaattcagatgaaaatttggaataata

SEQ ID NO: 11330 - DNA, 71 bp, chicken (Gallus Gallus)
  misc_feature (36): n=a or g
tcaccagtcactctgttctgttcaagctaaggtagntgtgatgtgatcccacattcacattcttcctattg

SEQ ID NO: 11331 - DNA, 71 bp, chicken (Gallus Gallus)
  misc_feature (36): n=c or t
tccaaatcagtgcatgtcagctgtggtcccacatgngcacccgactatcatgtctcttacagtacccactg

SEQ ID NO: 11332 - DNA, 71 bp, chicken (Gallus Gallus)
  misc_feature (36): n=g or t
cctttctactcagctgttaaaatgagtttttgctgnaagtaaagacacatccattctgatatgtatatata

SEQ ID NO: 11333 - DNA, 71 bp, chicken (Gallus Gallus)
  misc_feature (36): n=c or t
tcaggaagcgtactgtcctttttccctagagaatangtagcagtcagagttgttacttaattttggaggat

SEQ ID NO: 11334 - DNA, 71 bp, chicken (Gallus Gallus)
  misc_feature (36): n=c or g
gggccccatccaacctggtcttgaatacctccaagnatgggctttcacaatttaagtcactatcctttgaa

SEQ ID NO: 11335 - DNA, 71 bp, chicken (Gallus Gallus)
  misc_feature (36): n=c or g
ttgtgtctgaaataggcctttgtcctaactccatanaacagcagcctggaccagatgatgcaaacagtgtt

SEQ ID NO: 11336 - DNA, 71 bp, chicken (Gallus Gallus)
  misc_feature (36): n=c or t
ccaaagccatttgcttggccttgctgccacaaagangagttgaacagcttggctgtgccacaaggagcaca

SEQ ID NO: 11337 - DNA, 71 bp, chicken (Gallus Gallus)
  misc_feature (36): n=c or t
tgcatggctgtactgctattcactctcaacttgccnctccaaacatttatgtctatttggcaaggttagct

SEQ ID NO: 11338 - DNA, 71 bp, chicken (Gallus Gallus)
  misc_feature (36): n=c or g
ttgatgctgaaatatcatcatcatacaattatgagntatctccctcacatatttctccactgtttgatgca

SEQ ID NO: 11339 - DNA, 71 bp, chicken (Gallus Gallus)
  misc_feature (36): n=a or g
ttcatatatgatgtaaaacattactgcacaatgctnaagaatcctagggttattatttttatttttccagt

SEQ ID NO: 11340 - DNA, 71 bp, chicken (Gallus Gallus)
  misc_feature (36): n=c or t
gctgtgattttaacacagacaagaccttccaaagcncaaagtatagtattgtatgtcttgctcagataata

SEQ ID NO: 11341 - DNA, 71 bp, chicken (Gallus Gallus)
  misc_feature (36): n=c or t
cagctaagtccggaagatatggaggcttgtgtatgngggcagaccaaatattctgtcgctgatgcgattca

SEQ ID NO: 11342 - DNA, 71 bp, chicken (Gallus Gallus)
  misc_feature (36): n=c or g
ctctgtctctgtcttgcacagttaacacacaaagancaacctacagaccagaaatacgctccaggtaatac

SEQ ID NO: 11343 - DNA, 71 bp, chicken (Gallus Gallus)
  misc_feature (36): n=c or t
attaataaagtccttataggatttaattaatgaacntcctccaccttcaccaccatttaattcccttatgt

SEQ ID NO: 11344 - DNA, 71 bp, chicken (Gallus Gallus)
  misc_feature (36): n=c or t
gtacgacgtccgttcctgcagaaatggggactctgngagtccagagtgctaaagttctctaaacaatgagc

SEQ ID NO: 11345 - DNA, 71 bp, chicken (Gallus Gallus)
  misc_feature (36): n=a or g
caaacagatgccatgtgcacatatcatttgaaaagncttttaagaaaacaagattgctggtccttggatag

SEQ ID NO: 11346 - DNA, 71 bp, chicken (Gallus Gallus)
  misc_feature (36): n=c or g
aatatgtgagtaatacattgttttatatatataatnttttccaactatccttcattaagattttgactttt

SEQ ID NO: 11347 - DNA, 71 bp, chicken (Gallus Gallus)
  misc_feature (36): n=g or t
tgcagttctctccttcctcgttggtttgatggtgtnttctttccaagttaatgatagaaagtcacttccac

SEQ ID NO: 11348 - DNA, 71 bp, chicken (Gallus Gallus)
  misc_feature (36): n=a or g
gagctggatcaaggccaaatcttgtcctatttactntagcttccttgggctcagtctgtgggaagagagaa

SEQ ID NO: 11349 - DNA, 71 bp, chicken (Gallus Gallus)
  misc_feature (36): n=a or g
tgaccatacaaaacatattcagccttctgtattatncaatgaaacaagtaatatcaagtgcctaactgcta

SEQ ID NO: 11350 - DNA, 71 bp, chicken (Gallus Gallus)
  misc_feature (36): n=a or t
aaatttgatccttgagtcaccaaggtgttttgctgnggaagcaaatgaaaatttcacttcagacactttcc

SEQ ID NO: 11351 - DNA, 71 bp, chicken (Gallus Gallus)
  misc_feature (36): n=a or t
tttttttctgtctcttcctcatgccatggttacacnggttacagagatgattccacagaaatggaggaaca

SEQ ID NO: 11352 - DNA, 71 bp, chicken (Gallus Gallus)
  misc_feature (36): n=c or t
agctgcaaatgaaaggagctgaaatacccgtgcatntggaacagtgagggtccccaggtgaaaagagatgg

SEQ ID NO: 11353 - DNA, 71 bp, chicken (Gallus Gallus)
  misc_feature (36): n=c or t
gttctatcacaacagatcctgctgaagagtctgacncttctttcttacagtcccccgttagattctgaaat

SEQ ID NO: 11354 - DNA, 71 bp, chicken (Gallus Gallus)
  misc_feature (36): n=c or t
cgttttagaacttcatattaaggccagtttatactnatttattcttgtgccaacattgttcttcagtttaa

SEQ ID NO: 11355 - DNA, 71 bp, chicken (Gallus Gallus)
  misc_feature (36): n=a or g
ctgaccatcggcccttcaggccagaaagtggctggncacatccatttccaaatcctaaacatgtctaaatc

SEQ ID NO: 11356 - DNA, 71 bp, chicken (Gallus Gallus)
  misc_feature (36): n=c or t
aacttatttcctcccagaacagtcacgagtcatgcnaagaagtgcataatgcccaatggcaatgctgggct

SEQ ID NO: 11357 - DNA, 71 bp, chicken (Gallus Gallus)
  misc_feature (36): n=c or t
tgcaagaggcaaaaaagcaatgtttcctttcagtanaccttttactagaactgggtacaatggggtgtaat

SEQ ID NO: 11358 - DNA, 71 bp, chicken (Gallus Gallus)
  misc_feature (36): n=c or t
caagcacataataagggaggtttttaaattgtttcntacacggccccatctaagtcatgctttgaattgcc

SEQ ID NO: 11359 - DNA, 71 bp, chicken (Gallus Gallus)
  misc_feature (36): n=c or t
aagctctggaggcaagctttggcttcattgactttntctaacgtatagtcaataatacttttagtggcacc

SEQ ID NO: 11360 - DNA, 71 bp, chicken (Gallus Gallus)
  misc_feature (36): n=c or t
cttctcagtgcttccagaactgaaaacaacgggcangagatgctctcctgtttgtttctttgctggcataa

SEQ ID NO: 11361 - DNA, 71 bp, chicken (Gallus Gallus)
  misc_feature (36): n=c or t
tatcaactgatcaaattatccttacaattccaaagngttttgacattcaaaactatatggccctaaggaaa

SEQ ID NO: 11362 - DNA, 71 bp, chicken (Gallus Gallus)
  misc_feature (36): n=c or t
cagttgagctagccgctcgctggaagttgtggctgngaatttgcacgtcacatacgggataggctgagtgg

SEQ ID NO: 11363 - DNA, 71 bp, chicken (Gallus Gallus)
  misc_feature (36): n=c or t
ccatcccagggggaaactgtggtttggaagaacagngtacatttaatttcactcggagaacttattggagt

SEQ ID NO: 11364 - DNA, 71 bp, chicken (Gallus Gallus)
  misc_feature (36): n=a or t
gagatagaaatgagcatgggaacaagaggagcacanatgcatgctcacacaagcccaaggccaggtgtctg

SEQ ID NO: 11365 - DNA, 71 bp, chicken (Gallus Gallus)
  misc_feature (36): n=a or t
gaaaaaaaaaaagaaaaaaacatcattgctgtgttntaataacattcaggtgtgtcttgctcatctagagc

SEQ ID NO: 11366 - DNA, 71 bp, chicken (Gallus Gallus)
  misc_feature (36): n=a or g
taatggcaaaattctgaagctacttatttagagggnaaaaaaaaaacctcttcaaaatgtacaaaagtttc

SEQ ID NO: 11367 - DNA, 71 bp, chicken (Gallus Gallus)
  misc_feature (36): n=c or g
gcatgtgttattcggggtaatagctgcatattctgncaatataggggaaaaaatgcaatttcaagtgttgg

SEQ ID NO: 11368 - DNA, 71 bp, chicken (Gallus Gallus)
  misc_feature (36): n=a or g
ttacctgtaccattgtttccagtggtctgaattgcngcttcaggccccatagtgtcataatcttccttcat

SEQ ID NO: 11369 - DNA, 71 bp, chicken (Gallus Gallus)
  misc_feature (36): n=a or g
gtagccctccaacattactgaaacatttagtacagngaaaaggaaatggttgctgtgacatttcttactgc

SEQ ID NO: 11370 - DNA, 71 bp, chicken (Gallus Gallus)
  misc_feature (36): n=a or g
gggccagattctcagctccacttcagacaccactcngcaggacagcctccatgcccccagaacccctctcc

SEQ ID NO: 11371 - DNA, 71 bp, chicken (Gallus Gallus)
  misc_feature (36): n=a or c
tttaaattacaacaaaaattatggggagaggagganaataaatacaaacttttccttcgctgcacctcccg

SEQ ID NO: 11372 - DNA, 71 bp, chicken (Gallus Gallus)
  misc_feature (36): n=c or g
atttccttagcaagcacaggttgacacaggtacctnccagcctgagggcatcatgctctcaagtgtcccag

SEQ ID NO: 11373 - DNA, 71 bp, chicken (Gallus Gallus)
  misc_feature (36): n=a or g
gtttgacaaaacattttctttcccctctccagttcnagttaacagcaaaacatagagcagccttaagacca

SEQ ID NO: 11374 - DNA, 71 bp, chicken (Gallus Gallus)
  misc_feature (36): n=c or t
cttttgcttttatagcttggcattcaaccatacatngagatgtctgaagcccagcaccaaactactgagca

SEQ ID NO: 11375 - DNA, 71 bp, chicken (Gallus Gallus)
  misc_feature (36): n=a or c
ttctttccaagccagaagatgttgatgtcctgaccnaagatgctgatgtcctccaaagtcagagggagctc

SEQ ID NO: 11376 - DNA, 71 bp, chicken (Gallus Gallus)
  misc_feature (36): n=a or g
tgtaatcaacgccctataatctgctaatactgaacntcttaccaaccgtaaatcttctgcgttatgacaaa

SEQ ID NO: 11377 - DNA, 71 bp, chicken (Gallus Gallus)
  misc_feature (36): n=a or g
gccacaagtaaccacacagaaaacagcaagcagctnagtggtaagatggagaaaaacactagaaggaaaac

SEQ ID NO: 11378 - DNA, 71 bp, chicken (Gallus Gallus)
  misc_feature (36): n=c or t
aagaaatatccaatcacttatccacgtggctggcanagtagttctttaggtggtaaccagctccatgaagg

SEQ ID NO: 11379 - DNA, 71 bp, chicken (Gallus Gallus)
  misc_feature (36): n=c or t
ttacaacagctctttagtctgccttctcctattgcnctatgcaaatagcccattattagccattttctggc

SEQ ID NO: 11380 - DNA, 71 bp, chicken (Gallus Gallus)
  misc_feature (36): n=a or g
aagtacatttccacctggttggagggtatggagaanacaagcaaacttgtgctggtgctgcacagggagag

SEQ ID NO: 11381 - DNA, 71 bp, chicken (Gallus Gallus)
  misc_feature (36): n=g or t
gagcattgtggtccttttcaacccaggccattctgngattctatgcttattctgctccttgcagctggctg

SEQ ID NO: 11382 - DNA, 71 bp, chicken (Gallus Gallus)
  misc_feature (36): n=c or t
acaggcagtctgttggcaggggtttgttcgtggcgngtctataaatacctcctacaaagcactcctgccag

SEQ ID NO: 11383 - DNA, 71 bp, chicken (Gallus Gallus)
  misc_feature (36): n=c or t
tgtaagtatgttctgcatgtgtttatacactgttcngtagtaacattcgtgtaggcaccaataacgggcac

SEQ ID NO: 11384 - DNA, 71 bp, chicken (Gallus Gallus)
  misc_feature (36): n=a or g
gtgtctctatatcaactatagtgattcttcaagatnaagaggtaatcatgtacatccaatatcagtgtaaa

SEQ ID NO: 11385 - DNA, 71 bp, chicken (Gallus Gallus)
  misc_feature (36): n=g or t
tttaaatatattattcttctcttagcttactgtatncaaggattggacagcagaagactgtccggtaatag

SEQ ID NO: 11386 - DNA, 71 bp, chicken (Gallus Gallus)
  misc_feature (36): n=a or g
aacattaattaccaatgtgtaggtttggttttgtgngaaatccaggagaatgagaacctgatgtgattcta

SEQ ID NO: 11387 - DNA, 71 bp, chicken (Gallus Gallus)
  misc_feature (36): n=a or g
gagctgtgcatatattctagtcccttcccatagcanaaggattattcaaacatttaatcctagcataggat

SEQ ID NO: 11388 - DNA, 71 bp, chicken (Gallus Gallus)
  misc_feature (36): n=a or g
gtggtctttgcagtaggtatataccctatgggtctnttgtttccagactccactatctccttgcacccgta

SEQ ID NO: 11389 - DNA, 71 bp, chicken (Gallus Gallus)
  misc_feature (36): n=a or g
ttgcagacttacataaagggttctgagagctgatcntactgatccagaaggatcaggaactgtttgtttaa

SEQ ID NO: 11390 - DNA, 71 bp, chicken (Gallus Gallus)
  misc_feature (36): n=c or t
tcaaatgaatgtcggtgctcagaacttctcttcgcngagcagttttggctgtaaaaggaacgaggtgtcag

SEQ ID NO: 11391 - DNA, 71 bp, chicken (Gallus Gallus)
  misc_feature (36): n=c or g
ttcagtcagtgctgtcatacttgcccctttcacacnagctcctccagttttttcttctaaggaaaggttaa

SEQ ID NO: 11392 - DNA, 71 bp, chicken (Gallus Gallus)
  misc_feature (36): n=a or g
tctgttataatggggggagagtggatttagatgtanaaggatggactaaagcccttccaagtgtcttccat

SEQ ID NO: 11393 - DNA, 71 bp, chicken (Gallus Gallus)
  misc_feature (36): n=g or t
tcctacagtcctgtctactgccagactccaaaagtngtggtttcttcctctagtttcatatgttacctgct

SEQ ID NO: 11394 - DNA, 71 bp, chicken (Gallus Gallus)
  misc_feature (36): n=c or g
gctcggggctgggaagggtctgggcttcagcaccantgaaacccgctgtgtttcatgctcacagtctataa

SEQ ID NO: 11395 - DNA, 71 bp, chicken (Gallus Gallus)
  misc_feature (36): n=a or g
cggcttattttcgtcaaaccttttttcctttctgcntgctctccccatcctgactgtctcagcctttcata

SEQ ID NO: 11396 - DNA, 71 bp, chicken (Gallus Gallus)
  misc_feature (36): n=c or t
acaggcatgcataagaacagagcaggatgatgagtngattccggccctctcgacaagatccttacagagac

SEQ ID NO: 11397 - DNA, 71 bp, chicken (Gallus Gallus)
  misc_feature (36): n=a or g
tgattggagtttatcaagaacggtgagccatgagcngaggacgtgcagcagacgtgaagagtttcaggtgg

SEQ ID NO: 11398 - DNA, 71 bp, chicken (Gallus Gallus)
  misc_feature (36): n=c or t
ttacatccaatgcaaggaacgtttctcctgtgacangcttttacagcatctctatcttttataccacagaa

SEQ ID NO: 11399 - DNA, 71 bp, chicken (Gallus Gallus)
  misc_feature (36): n=a or t
actggtattggtatccagtggtgttccattcacagngtggtctttttaatgaaaagagttttgaaaaggaa

SEQ ID NO: 11400 - DNA, 71 bp, chicken (Gallus Gallus)
  misc_feature (36): n=a or g
cctactgtgagcatccctgctgcatgcatcccagcntgcaaagcagtgatgcttcttaaggccaagacctg

SEQ ID NO: 11401 - DNA, 71 bp, chicken (Gallus Gallus)
  misc_feature (36): n=a or g
ttatggggttaaccacgattatgggagagttcttgnagcatttttgaatgtaatgcttttatttaatgttt

SEQ ID NO: 11402 - DNA, 71 bp, chicken (Gallus Gallus)
  misc_feature (36): n=a or g
tgggtgtttttttgctgtttttttactggttacatnaaagcatctgtgctcctgttgtagtagtgctaaaa

SEQ ID NO: 11403 - DNA, 71 bp, chicken (Gallus Gallus)
  misc_feature (36): n=c or t
aagtaaggatctggaaaccaagactggagcactgancggcctccttcctgctttattctcaccttgcctcc

SEQ ID NO: 11404 - DNA, 71 bp, chicken (Gallus Gallus)
  misc_feature (36): n=a or g
tgtaatgttttggaaggagggaaaatttcctgcccntctttaatcacgtttttatgtgctctctatcctat

SEQ ID NO: 11405 - DNA, 71 bp, chicken (Gallus Gallus)
  misc_feature (36): n=g or t
ataatcctctggaggatgtgaaagagaagtctgctnatcacatagagaagaattcaaacagcgaagaagag

SEQ ID NO: 11406 - DNA, 71 bp, chicken (Gallus Gallus)
  misc_feature (36): n=a or g
ggatcagcacttaaacatcaatgctttccataaacntgagccaaaaataaggaattacattatcactaaac

SEQ ID NO: 11407 - DNA, 71 bp, chicken (Gallus Gallus)
  misc_feature (36): n=a or t
ccctaacaaaaagcctttgttactcagctgagttangtgatttaagtcctctcattcccagtcagcacatg

SEQ ID NO: 11408 - DNA, 71 bp, chicken (Gallus Gallus)
  misc_feature (36): n=a or g
aatgaaagtttattctatactaaggaacagtatacnttatttgagcataatttaactgtacatagaatata

SEQ ID NO: 11409 - DNA, 71 bp, chicken (Gallus Gallus)
  misc_feature (36): n=c or t
tatcctgttaatttggtcagagaatctgaccttttnaaaaaaaaaaaaaaaaaaattaacactagaaatac

SEQ ID NO: 11410 - DNA, 71 bp, chicken (Gallus Gallus)
  misc_feature (36): n=a or t
aacatcaatacaagttttgcagttcaattaattacngacaggattaatggcatacacaagatgcaaaaaat

SEQ ID NO: 11411 - DNA, 71 bp, chicken (Gallus Gallus)
  misc_feature (36): n=a or g
gggcagctgcttcctttgaaacaaatttacccaggnttaatccctggctttacacttctgaagaacacaaa

SEQ ID NO: 11412 - DNA, 71 bp, chicken (Gallus Gallus)
  misc_feature (36): n=a or g
gcaagtggtttttaattccagcccgataccattganctggctcactcggagccaaacacccagtaacagat

SEQ ID NO: 11413 - DNA, 71 bp, chicken (Gallus Gallus)
  misc_feature (36): n=c or t
acaagccaagttccagcactgcacgcactcctccanttccattaccttgccagcctacaccaatgaggaaa

SEQ ID NO: 11414 - DNA, 71 bp, chicken (Gallus Gallus)
  misc_feature (36): n=c or g
tttgttccttttgtaatgaactgtagctattcactntgcagtaaaaaaaaaaaaaagcactaatttgtttc

SEQ ID NO: 11415 - DNA, 71 bp, chicken (Gallus Gallus)
  misc_feature (36): n=a or g
ttcttcaggagcacttgctaggatttttttcttccnttctgttccctgccatagttgtttgtcaacaccat

SEQ ID NO: 11416 - DNA, 71 bp, chicken (Gallus Gallus)
  misc_feature (36): n=c or t
ccctcctgtcccagcccagatggcaggttttcatanggctttgccaacttgcctgcacttgcagtttacat

SEQ ID NO: 11417 - DNA, 71 bp, chicken (Gallus Gallus)
  misc_feature (36): n=a or g
gcattcggcctctgcacccttcttgtatgtgtgtgnctgttagaacagcaaaaagggtactagaaaagtac

SEQ ID NO: 11418 - DNA, 71 bp, chicken (Gallus Gallus)
  misc_feature (36): n=a or g
gtatttatcttaagacctcgatgtaatgaattgcantactcaaagttaataagcttgggtacctagctcat

SEQ ID NO: 11419 - DNA, 71 bp, chicken (Gallus Gallus)
  misc_feature (36): n=a or c
cgttcagggtatctgacaaagcagtaataatacagnaaatgcatcatcctaaaaaaagtaagaaatgggag

SEQ ID NO: 11420 - DNA, 71 bp, chicken (Gallus Gallus)
  misc_feature (36): n=a or g
tttttttttttttttctttggattgcagagactatngtgcaaaaactcaaggccctgaatgctcagctgtt

SEQ ID NO: 11421 - DNA, 71 bp, chicken (Gallus Gallus)
  misc_feature (36): n=g or t
gacagggtctgatggccatgggccccttccctcccnaccttctcactgcactacttcaaagcttcccagag

SEQ ID NO: 11422 - DNA, 71 bp, chicken (Gallus Gallus)
  misc_feature (36): n=a or g
attttttttcctttaaaagggatgagtttttttcanttttattaatgtcatattccaaaaactgaagatgg

SEQ ID NO: 11423 - DNA, 71 bp, chicken (Gallus Gallus)
  misc_feature (36): n=a or c
aatgcaaagcattttttcaaggtcaagatgagaatnaagattatctctgtaaatttgtgattactctaact

SEQ ID NO: 11424 - DNA, 71 bp, chicken (Gallus Gallus)
  misc_feature (36): n=a or g
tgatcatctctttggctctgataagtctccattccnttttctttaagaaaacttctgtgattggtagctac

SEQ ID NO: 11425 - DNA, 71 bp, chicken (Gallus Gallus)
  misc_feature (36): n=a or t
gttttcaaagtatcagatgataaagttactatttanttcccagttgcacactaaagatgaagaaatgtaag

SEQ ID NO: 11426 - DNA, 71 bp, chicken (Gallus Gallus)
  misc_feature (36): n=a or g
atcgccttgtgtaactcaaatgaatagacaaattcnatagcaccaaggatttggcaataaaaaccctcctg

SEQ ID NO: 11427 - DNA, 71 bp, chicken (Gallus Gallus)
  misc_feature (36): n=c or t
ggcagcagcatgcaagggcacttgaaattctcagtngtgaagctgaagacagagctacaggcgatagcaat

SEQ ID NO: 11428 - DNA, 71 bp, chicken (Gallus Gallus)
  misc_feature (36): n=a or c
taagtctgtagcatcaccactgaagaggggctgttntacaaaaaagtgaacttacagaagaagaacactga

SEQ ID NO: 11429 - DNA, 71 bp, chicken (Gallus Gallus)
  misc_feature (36): n=c or g
acacacgtgttccttgtatgttctttctttctgagnacagttgggtggctgtaggaagacatacatgttgg

SEQ ID NO: 11430 - DNA, 71 bp, chicken (Gallus Gallus)
  misc_feature (36): n=c or t
aaagatgacccaacgtaattagacaaataatgaaanggtacatttctgatgacatttttgcattcagagat

SEQ ID NO: 11431 - DNA, 71 bp, chicken (Gallus Gallus)
  misc_feature (36): n=a or g
tgcacctacctgcatcattacttttagacgatctanaggtgctgtacctgttcgtgagacagcaccagcca

SEQ ID NO: 11432 - DNA, 71 bp, chicken (Gallus Gallus)
  misc_feature (36): n=c or t
ttatctaactttttttaggcagtttctcagtttccnttaacttgtatacagattgcacgttagtgaggcgc

SEQ ID NO: 11433 - DNA, 71 bp, chicken (Gallus Gallus)
  misc_feature (36): n=a or t
aaaaatgtgaggggaaaaacgagagtgttagctgtngcaaaagtgaacagtcttgttcttttctctgctta

SEQ ID NO: 11434 - DNA, 71 bp, chicken (Gallus Gallus)
  misc_feature (36): n=a or g
taatgtttgagcttggtatttctgctgtgttggtcncttcttggctgcatctagctgatgccctaggtcgt

SEQ ID NO: 11435 - DNA, 71 bp, chicken (Gallus Gallus)
  misc_feature (36): n=a or g
acagttgatgaaaaataaagctgcaatttcatgcanaaacttattttggaagtaacatgctgttcaaaagc

SEQ ID NO: 11436 - DNA, 71 bp, chicken (Gallus Gallus)
  misc_feature (36): n=c or g
tgaaatacagatgtgtcatgcgttgcatgctccaanagtaatgcttgtccagtgtttgttgcacctattct

SEQ ID NO: 11437 - DNA, 71 bp, chicken (Gallus Gallus)
  misc_feature (36): n=a or g
tgattttttggttcactccacctcccatcagcaacnaccaacaacttcatgaaaaatgtactatgcataag

SEQ ID NO: 11438 - DNA, 71 bp, chicken (Gallus Gallus)
  misc_feature (36): n=a or g
tatagatacctaaataaaaagcaaccaccaccaagngctggcaaggaagaattcactgaatattccattaa

SEQ ID NO: 11439 - DNA, 71 bp, chicken (Gallus Gallus)
  misc_feature (36): n=a or t
acatctctaacagtctttcagaagtgttctgtaaanttaagagactctgacatgcactggaattacaacag

SEQ ID NO: 11440 - DNA, 71 bp, chicken (Gallus Gallus)
  misc_feature (36): n=a or g
ttggatcccaaaagtatggctgcttcaatacagatngtcaggacagatagatgtattgcttctgtgtttta

SEQ ID NO: 11441 - DNA, 71 bp, chicken (Gallus Gallus)
  misc_feature (36): n=c or t
tttctctgctgttattgcttgcttgaaatggaatantcttccgattgggagagtattgcatgtgggcagat

SEQ ID NO: 11442 - DNA, 71 bp, chicken (Gallus Gallus)
  misc_feature (36): n=a or g
aaatgttatgtgctcattaaactaaatgttaagtancaaaaataactgagggaagaatgagaaataccagc

SEQ ID NO: 11443 - DNA, 71 bp, chicken (Gallus Gallus)
  misc_feature (36): n=a or g
cccagggtatgctatttttggtgtttggaattagcngtcccaaactgcttccgattaaaagagaaacaacc

SEQ ID NO: 11444 - DNA, 71 bp, chicken (Gallus Gallus)
  misc_feature (36): n=a or g
attccggtagctgtgcaacagaccacatgcaattantgctggctgttattgttttagttaaatgctaaaac

SEQ ID NO: 11445 - DNA, 71 bp, chicken (Gallus Gallus)
  misc_feature (36): n=a or g
tctacctgaaagatgtatagaagatttgctgagggnaagagaaattgcctttattaggaccaataacaagt

SEQ ID NO: 11446 - DNA, 71 bp, chicken (Gallus Gallus)
  misc_feature (36): n=c or t
ccattagctctgtttggttaagttttgaattactcnatcaggtgactgatgagttgattttcttttttttc

SEQ ID NO: 11447 - DNA, 71 bp, chicken (Gallus Gallus)
  misc_feature (36): n=a or g
gattctgttagtattagctttctaataacaagagtngatttcagtagcaggttatcgtggtcatctctcta

SEQ ID NO: 11448 - DNA, 71 bp, chicken (Gallus Gallus)
  misc_feature (36): n=c or t
actaaaatgtgggaatggatgtgcacacaaaacagnttctgtatataaatcaatataatttgttgcagttg

SEQ ID NO: 11449 - DNA, 71 bp, chicken (Gallus Gallus)
  misc_feature (36): n=a or g
tcaactctaactttgtaagtcaagctttttatatcngtgtctttttctggcttcttgtgtattgtaaatag

SEQ ID NO: 11450 - DNA, 71 bp, chicken (Gallus Gallus)
  misc_feature (36): n=a or g
tttatcttcggtcacttctgttattttcttaacatntttgtgcttttgataatttttcctctgagaaaagt

SEQ ID NO: 11451 - DNA, 71 bp, chicken (Gallus Gallus)
  misc_feature (36): n=c or t
actccatactaaactcaagaagtaaagatgctgtangtttttacttacatctggtatatatttcctcacat

SEQ ID NO: 11452 - DNA, 71 bp, chicken (Gallus Gallus)
  misc_feature (36): n=a or g
tcattttcattttttagggccagcgatctctatttntaacaaaacctcatgtcatctcaaactctaaaact

SEQ ID NO: 11453 - DNA, 71 bp, chicken (Gallus Gallus)
  misc_feature (36): n=a or g
gtgagctgtaagtcaacacagttgcctcaaaatacntattaattctatgatataagaggcaatatagagaa

SEQ ID NO: 11454 - DNA, 71 bp, chicken (Gallus Gallus)
  misc_feature (36): n=c or t
aaagtcatgccatcaattttgaaagctcttatttcntccaatctagacattaagcatttagaaattcatta

SEQ ID NO: 11455 - DNA, 71 bp, chicken (Gallus Gallus)
  misc_feature (36): n=a or g
tgcagattcaagaatttaaaggcatttcagaatacntgtattaaatgtccatgttggagataatatctacg

SEQ ID NO: 11456 - DNA, 71 bp, chicken (Gallus Gallus)
  misc_feature (36): n=a or t
gttccccaagcacagaaaatgacccctgttaaaacngatataatattgattatccaactttcagttataat

SEQ ID NO: 11457 - DNA, 71 bp, chicken (Gallus Gallus)
  misc_feature (36): n=c or t
cctcatcagtacgtagagacacttcacagcaaccgnctgcttaatttggctacctatgtgcactcaccagc

SEQ ID NO: 11458 - DNA, 71 bp, chicken (Gallus Gallus)
  misc_feature (36): n=a or t
aataagagagaacgtattttaataagatggaaaaanttgtttaaatttatttagttcaacctattaacttt

SEQ ID NO: 11459 - DNA, 71 bp, chicken (Gallus Gallus)
  misc_feature (36): n=c or t
tattccactgtttatcactggtgaggccacttcttncattgcttaagccattttaagccattgcttaaaag

SEQ ID NO: 11460 - DNA, 71 bp, chicken (Gallus Gallus)
  misc_feature (36): n=a or g
tcttgacggtaacaggcaggaaaaactaacaggctngaaaacctttgggattcctttgatcagtagctgac

SEQ ID NO: 11461 - DNA, 71 bp, chicken (Gallus Gallus)
  misc_feature (36): n=a or g
gggagctataattggaaaagttagatacccacacangtatgcacaatgcatctgatgggggggggggggga

SEQ ID NO: 11462 - DNA, 71 bp, chicken (Gallus Gallus)
  misc_feature (36): n=c or t
ttcttacccttttctggtcctgaaaatctttctttntaggctttcgtactacattttttttttcctgtagc

SEQ ID NO: 11463 - DNA, 71 bp, chicken (Gallus Gallus)
  misc_feature (36): n=a or g
cttatacacttggactttttaaatatttatgaacancgatacttaatctacatttgagaattacataattc

SEQ ID NO: 11464 - DNA, 71 bp, chicken (Gallus Gallus)
  misc_feature (36): n=c or t
gaagcatttttcatgtcagtgaccccttgcagacangttagatatttcaaattagaattactgaatttcga

SEQ ID NO: 11465 - DNA, 71 bp, chicken (Gallus Gallus)
  misc_feature (36): n=c or t
caaatcaagaatagaaatcaataacaggaaatacangcactgaactatttcagaagtcaagaagataatta

SEQ ID NO: 11466 - DNA, 71 bp, chicken (Gallus Gallus)
  misc_feature (36): n=c or t
agctatgctggataacagacatggggtatttagctnacatgaaacttagcattaacatagatggactgctt

SEQ ID NO: 11467 - DNA, 71 bp, chicken (Gallus Gallus)
  misc_feature (36): n=c or t
cctgaacagttcaacaaaataggtacttctggaagngattatgttctcacaagaactgtgaaaaacagggg

SEQ ID NO: 11468 - DNA, 71 bp, chicken (Gallus Gallus)
  misc_feature (36): n=g or t
tcctttcacagcagtctaatggtgtagtgatgaatnaattgtgtctgggtggaaaatatgtatgtttgcac

SEQ ID NO: 11469 - DNA, 71 bp, chicken (Gallus Gallus)
  misc_feature (36): n=a or g
ccagtttttttgcaaggcactctagtaaaatactanaagagaattttgagcacgtttacttgataatgtcc

SEQ ID NO: 11470 - DNA, 71 bp, chicken (Gallus Gallus)
  misc_feature (36): n=c or t
ttctccatccacctcaaaaggaaaggacacaatagngttgaaacgttgccagcaacctgcaagccagttgc

SEQ ID NO: 11471 - DNA, 71 bp, chicken (Gallus Gallus)
  misc_feature (36): n=g or t
ggaatatagctcacatcacatattgataactagaantcaagcctttttcatttcttgtctctgtggatcac

SEQ ID NO: 11472 - DNA, 71 bp, chicken (Gallus Gallus)
  misc_feature (36): n=a or g
ggaactgtattttcgaagaagtctcaggcttctcangactgcaatactcaaggcttcactgcttcaaaaca

SEQ ID NO: 11473 - DNA, 71 bp, chicken (Gallus Gallus)
  misc_feature (36): n=c or t
cactactaatactctcacagaagctgcacatcctgntctcacctcactaagctgctctatgttttctttat

SEQ ID NO: 11474 - DNA, 71 bp, chicken (Gallus Gallus)
  misc_feature (36): n=c or g
caatgttactgaacctgagtaactaccgaaccaganagaaatgaagtctccattgaagagagaggggggag

SEQ ID NO: 11475 - DNA, 71 bp, chicken (Gallus Gallus)
  misc_feature (36): n=a or c
gagtaatgtttttttcttgttttccaaatgcatttntttcttttgcgtcaatttgttccttgaaattgagt

SEQ ID NO: 11476 - DNA, 71 bp, chicken (Gallus Gallus)
  misc_feature (36): n=c or t
tttaatacatactctaacagcaaaactcagtgtcangacaatttggcagtatctaattccctgggaacttt

SEQ ID NO: 11477 - DNA, 71 bp, chicken (Gallus Gallus)
  misc_feature (36): n=c or g
ggatggattaagggaaggaccaattgatttaggtantatttcgttttctgaacatcctttgttttaacagt

SEQ ID NO: 11478 - DNA, 71 bp, chicken (Gallus Gallus)
  misc_feature (36): n=g or t
atgttgatgtaactacttggtacagtcccagcatgnctgctccagagaaactgctagataatactgttttg

SEQ ID NO: 11479 - DNA, 71 bp, chicken (Gallus Gallus)
  misc_feature (36): n=a or g
gcactcttgccacatacttgtgctctgtaatgcgtngcaaagtgtccttctaactttgaaagtgaaaaaga

SEQ ID NO: 11480 - DNA, 71 bp, chicken (Gallus Gallus)
  misc_feature (36): n=a or g
ggggcatgatgtggaatgaaagggtgattgtctacntgggacgccccactctagataaccaaggctatgtc

SEQ ID NO: 11481 - DNA, 71 bp, chicken (Gallus Gallus)
  misc_feature (36): n=a or g
aatttcatatgagcaaatatgatatgaaggacaacntccatacacagttgtattggcagtttaagatatat

SEQ ID NO: 11482 - DNA, 71 bp, chicken (Gallus Gallus)
  misc_feature (36): n=g or t
tctagaagacgagatttctagatgagagtgctgagnttggagattgtgcggtcaatttctggtaactacca

SEQ ID NO: 11483 - DNA, 71 bp, chicken (Gallus Gallus)
  misc_feature (36): n=g or t
gcacagctcctgatagaactccgattccagaaaccntgggtacgagttgttctccatgaggctgtacactc

SEQ ID NO: 11484 - DNA, 71 bp, chicken (Gallus Gallus)
  misc_feature (36): n=c or t
aataaatcattaatctgtcaacatagctgtgtttantcagtgcaaggcactcacccggctcacatcacttt

SEQ ID NO: 11485 - DNA, 71 bp, chicken (Gallus Gallus)
  misc_feature (36): n=a or g
atcctgaaagtaagaagttaacaactgtgtcctganggagatataattcagagtgcccaaaccttgcccag

SEQ ID NO: 11486 - DNA, 71 bp, chicken (Gallus Gallus)
  misc_feature (36): n=c or t
tctgtatttctgactgtggcagggacttgtttcctnagctaccatacattttccatgcaataccaccacca

SEQ ID NO: 11487 - DNA, 71 bp, chicken (Gallus Gallus)
  misc_feature (36): n=c or t
ttctttctttgcactttataagtaggccttctaatntctggatccaactagagaggcaagtaggtgttgcc

SEQ ID NO: 11488 - DNA, 71 bp, chicken (Gallus Gallus)
  misc_feature (36): n=c or g
aatatgggtgaaaaggattccctgggttttgcaagncaagctcagagagcagctttgcaagctgtgcagta

SEQ ID NO: 11489 - DNA, 71 bp, chicken (Gallus Gallus)
  misc_feature (36): n=g or t
gggtgcctgctgggtgcaagaggagcccttgctctntgcagactcagtttgtcccaaagcagccaagccac

SEQ ID NO: 11490 - DNA, 71 bp, chicken (Gallus Gallus)
  misc_feature (36): n=c or t
gggatggctcgtgttttccagctatccaaaaagcanctgtcctcacagcggaggcaaaggggtgccattcc

SEQ ID NO: 11491 - DNA, 71 bp, chicken (Gallus Gallus)
  misc_feature (36): n=c or t
ccccctgcacgtttcagagttgacaaagcctgctangtttcccaagtccacatctcaccttgtgggaggtc

SEQ ID NO: 11492 - DNA, 71 bp, chicken (Gallus Gallus)
  misc_feature (36): n=c or g
ctgccaaagacattgtagcatgggagcaaaaagccnaggcagagattgcaccagggatcagggcagaagag

SEQ ID NO: 11493 - DNA, 71 bp, chicken (Gallus Gallus)
  misc_feature (36): n=g or t
ttgtgggcgaatctttcagaattcatttaaaatcanccatgctctaccacatcccggagtccatctgcacc

SEQ ID NO: 11494 - DNA, 71 bp, chicken (Gallus Gallus)
  misc_feature (36): n=c or g
agccctaaaggagccccaaagaggtctcataggacncccaaaggagctccaaataagacttataggaacct

SEQ ID NO: 11495 - DNA, 71 bp, chicken (Gallus Gallus)
  misc_feature (36): n=a or g
gctgtctgcagggttcatgcagccatttagcaaagnctgtcctctgtcaaatgagagctgtgtaaagtgga

SEQ ID NO: 11496 - DNA, 71 bp, chicken (Gallus Gallus)
  misc_feature (36): n=a or c
aactccgtcctccaagaatctgtttcacagccatgntatccaccttcctcatgggtactccatcactgggt

SEQ ID NO: 11497 - DNA, 71 bp, chicken (Gallus Gallus)
  misc_feature (36): n=a or g
ggcacacgcttagcttggaagtctcctcagttgtangagttaagaaacataagtgtagtcaatactctgct

SEQ ID NO: 11498 - DNA, 71 bp, chicken (Gallus Gallus)
  misc_feature (36): n=c or g
aaagaggggagagatcccatgaaactcctttaacgngaggagaaaatctcatccaaagagcagagaaaacc

SEQ ID NO: 11499 - DNA, 71 bp, chicken (Gallus Gallus)
  misc_feature (36): n=c or t
ttaaatgcttcaaattgcctctgacttttcgctgtngttctgcctttcaggattcagtggtgcagtgtgtc

SEQ ID NO: 11500 - DNA, 71 bp, chicken (Gallus Gallus)
  misc_feature (36): n=c or t
taatggatagtgatcttgagaggcacaaacagcagnattacatgcacactggttagaaaaggctgactgtc

SEQ ID NO: 11501 - DNA, 71 bp, chicken (Gallus Gallus)
  misc_feature (36): n=c or t
catcccatggagctgcaggaggctgtcgaggaaagncagaccatgacaaacgtgcaccttctctccagagt

SEQ ID NO: 11502 - DNA, 71 bp, chicken (Gallus Gallus)
  misc_feature (36): n=c or t
ggtggccatagctgaggatatcgttgcagagtgtgngagacatgcacatgtgtgttgatgcagtgagctca

SEQ ID NO: 11503 - DNA, 71 bp, chicken (Gallus Gallus)
  misc_feature (36): n=a or g
ggcatgttttcccatcactgatggctgaagaaaatnccctatttttagtcagttcatttaaattcgccaca

SEQ ID NO: 11504 - DNA, 71 bp, chicken (Gallus Gallus)
  misc_feature (36): n=a or g
gtttcccatcaaagagatcaggaaaaagtctaatantcactagtcacctacagatactgggaaactgctta

SEQ ID NO: 11505 - DNA, 71 bp, chicken (Gallus Gallus)
  misc_feature (36): n=c or t
cacagcagtgcgggatcacaagtagcagggctctgnctaccctgaatcctctctatgatgttctttctttc

SEQ ID NO: 11506 - DNA, 71 bp, chicken (Gallus Gallus)
  misc_feature (36): n=a or c
ccccctcttctcccaccttgttcttgactgctgtgngcaggccttgtggttttttatctcaaggctgtgga

SEQ ID NO: 11507 - DNA, 71 bp, chicken (Gallus Gallus)
  misc_feature (36): n=c or g
ggcaagaagcaaataaggcacagaggaaagcccatngtctggaaccacaggctgtatttcagggtgcaact

SEQ ID NO: 11508 - DNA, 71 bp, chicken (Gallus Gallus)
  misc_feature (36): n=c or g
ctgaaaacttcagttgctgctgctcctttgctccangtagtaaatgaacacaccaaagacaactgtgggtt

SEQ ID NO: 11509 - DNA, 71 bp, chicken (Gallus Gallus)
  misc_feature (36): n=a or g
attcctcctacataaacacagctgtacagagcactntaacttcgggctgcaggcaatcgcaaaagcaggct

SEQ ID NO: 11510 - DNA, 71 bp, chicken (Gallus Gallus)
  misc_feature (36): n=a or g
agttaaccttctaacctaacaacgtaggtatgcacntaacgaaaactgcctacaagagaatgttgtaggct

SEQ ID NO: 11511 - DNA, 71 bp, chicken (Gallus Gallus)
  misc_feature (36): n=a or g
ggccctgatctagagccttgatgtctgacacaggtngactgtggcacggtcccacagctcctaaagccctg

SEQ ID NO: 11512 - DNA, 71 bp, chicken (Gallus Gallus)
  misc_feature (36): n=c or t
aatgtcactcatgccgctcgggctccgggggagcangacatttaagaagttaatggagttatttcaaccaa

SEQ ID NO: 11513 - DNA, 71 bp, chicken (Gallus Gallus)
  misc_feature (36): n=a or t
aattatttacaaggtccttctgactttgtttacatnaagtgcatcttttcctcctatttctcatagccagt

SEQ ID NO: 11514 - DNA, 71 bp, chicken (Gallus Gallus)
  misc_feature (36): n=a or g
attatgacatgggtgaaagacagcagaaagccaacnacatcacagcaatacgacactgcgttataaggcag

SEQ ID NO: 11515 - DNA, 71 bp, chicken (Gallus Gallus)
  misc_feature (36): n=c or t
aaattgtctgtctcttcttttgacaagccactacangaccatttttcactctgggagcacaactcagacct

SEQ ID NO: 11516 - DNA, 71 bp, chicken (Gallus Gallus)
  misc_feature (36): n=a or g
agttacctggcctggacacagcccccggcccactcngttgcaaggaagcaaaacaagctggcattcacaac

SEQ ID NO: 11517 - DNA, 71 bp, chicken (Gallus Gallus)
  misc_feature (36): n=a or g
ggttggcaatactgttggccatattcatgccctgcnccgggctggcgttggtacacgtggtggagtaggtg

SEQ ID NO: 11518 - DNA, 71 bp, chicken (Gallus Gallus)
  misc_feature (36): n=c or t
cagccagatttaagttcttgaaggtcattagagtangttaaacagatttctgcatcactggaggcccttgc

SEQ ID NO: 11519 - DNA, 71 bp, chicken (Gallus Gallus)
  misc_feature (36): n=a or g
aggtttattctcatccccaagttaggagaatccagntgtctttttttttctacgtattcacaactgaagag

SEQ ID NO: 11520 - DNA, 71 bp, chicken (Gallus Gallus)
  misc_feature (36): n=a or g
tttaaggactacagttactacatggataattaaagnaggcccagtgctcctaaactcctggaccaaagatt

SEQ ID NO: 11521 - DNA, 71 bp, chicken (Gallus Gallus)
  misc_feature (36): n=c or t
cctgagaagtccctgttccgttccaaggtcttgctnagtttaacaatgccaaaataactcagctatgttta

SEQ ID NO: 11522 - DNA, 71 bp, chicken (Gallus Gallus)
  misc_feature (36): n=c or t
tttcctttttcagaccatcatcatgcacttatgttnagtttccccattacaacacctgtcctccaaactgg

SEQ ID NO: 11523 - DNA, 71 bp, chicken (Gallus Gallus)
  misc_feature (36): n=a or g
gtactttatgaaacaaaaaaatgttactgaagaatnagaatgagggaatgttcagtttttgctggggcctc

SEQ ID NO: 11524 - DNA, 71 bp, chicken (Gallus Gallus)
  misc_feature (36): n=c or t
aggaactgtgtctcagacctttacagggttaatttncatactatttgatggcagataaatacaggtcgaag

SEQ ID NO: 11525 - DNA, 71 bp, chicken (Gallus Gallus)
  misc_feature (36): n=c or t
cactccaggctccctaccatcactgtttgggtgcangttgcaccagtgcaaaaatgcacagggatggagcc

SEQ ID NO: 11526 - DNA, 71 bp, chicken (Gallus Gallus)
  misc_feature (36): n=a or g
tagtgtgtcctctcaaagaccctctctagtgcctgnagctggctgctgttgaaggtagtcctgttccttct

SEQ ID NO: 11527 - DNA, 71 bp, chicken (Gallus Gallus)
  misc_feature (36): n=a or g
ttatttctcagagttccctttaaactcaaataatcntgattgctcagttcatgttgcaactactgtgtgat

SEQ ID NO: 11528 - DNA, 71 bp, chicken (Gallus Gallus)
  misc_feature (36): n=a or g
agctcctgtgcttacgtggcactaataaagagcccntcacattttgtgagctttctagctgctactgcttc

SEQ ID NO: 11529 - DNA, 71 bp, chicken (Gallus Gallus)
  misc_feature (36): n=c or t
aatgagtgctgcctgggtgtaaagagctgctttttngtcccttagccgtgcaggaggagaggcagcggagc

SEQ ID NO: 11530 - DNA, 71 bp, chicken (Gallus Gallus)
  misc_feature (36): n=c or t
gatggaaagtcctggagagctgcaccttccagtagnaagtcgttaatgaaaattactgtcttagtaatggt

SEQ ID NO: 11531 - DNA, 71 bp, chicken (Gallus Gallus)
  misc_feature (36): n=c or t
cacacccagtctgcagaacagccttctaaatagcangagccaagaggggaggtgttgtacctattttgtag

SEQ ID NO: 11532 - DNA, 71 bp, chicken (Gallus Gallus)
  misc_feature (36): n=a or g
gttctctaacacctccagggatggtgactccaaacncttcccccaaggatctcacacaggcaatttcgcca

SEQ ID NO: 11533 - DNA, 71 bp, chicken (Gallus Gallus)
  misc_feature (36): n=a or g
tggatatccttgcctgaggccttccaaaggtaagcngattccttcctttgtttctatatccatgactgctg

SEQ ID NO: 11534 - DNA, 71 bp, chicken (Gallus Gallus)
  misc_feature (36): n=c or t
gaagcatcagttgctccagcactccctaaacatcangtttgggcagcttgcatcacaacccaaattcagat

SEQ ID NO: 11535 - DNA, 71 bp, chicken (Gallus Gallus)
  misc_feature (36): n=g or t
tgaccacatccaagcaccatccctttccatacccanagctcccttgagggagaggtgcatgggtttgcctt

SEQ ID NO: 11536 - DNA, 71 bp, chicken (Gallus Gallus)
  misc_feature (36): n=a or g
gattggtgtttcctgctgcttcttggatgaaaatgnaggcatcttgatgtgtagcaggctgggcacttctc

SEQ ID NO: 11537 - DNA, 71 bp, chicken (Gallus Gallus)
  misc_feature (36): n=a or g
cagtttgcctggaggggctctcctgtaggggctgcncacgtttgggaacgcttccattgtttgtaacccca

SEQ ID NO: 11538 - DNA, 71 bp, chicken (Gallus Gallus)
  misc_feature (36): n=a or g
ttgacctgagaaatgtaaaaatatgctctgtccacnatcttttgtagaaagaactttaggacgtggcatgg

SEQ ID NO: 11539 - DNA, 71 bp, chicken (Gallus Gallus)
  misc_feature (36): n=c or t
attcacgaattatcattcaatatcttcaacagaagntcctcaaaaataaaattcaatttaaccaaaattag

SEQ ID NO: 11540 - DNA, 71 bp, chicken (Gallus Gallus)
  misc_feature (36): n=c or t
ttgttttattattccattatcttgactgtattactnatcctatttgcttgaaggattgcacccaaagtttt

SEQ ID NO: 11541 - DNA, 71 bp, chicken (Gallus Gallus)
  misc_feature (36): n=a or g
ctcttatagttcttaggaagtgggaaaagtggaggnataaaacaacccaaagtcaataatgttacattcat

SEQ ID NO: 11542 - DNA, 71 bp, chicken (Gallus Gallus)
  misc_feature (36): n=a or t
aatcataataaaaacctcatggagaaaatgactaantatgaagattaccagaaacagtcaagatccagtgt

SEQ ID NO: 11543 - DNA, 71 bp, chicken (Gallus Gallus)
  misc_feature (36): n=c or t
gcaggaaaattaaacacaacaaaatgcatgtcttancattgggtgtgaggaggatctttcttttttagaga

SEQ ID NO: 11544 - DNA, 71 bp, chicken (Gallus Gallus)
  misc_feature (36): n=a or g
ttttgaatacttgtagtaaataatatgatcctgtgnttctatgattagccttatttaaatttaaattaaaa

SEQ ID NO: 11545 - DNA, 71 bp, chicken (Gallus Gallus)
  misc_feature (36): n=c or g
ggaggtgtcaaaagatgctcacgtaggcttcacccncagccccgtgcctccgcttcagccacgtaggggag

SEQ ID NO: 11546 - DNA, 71 bp, chicken (Gallus Gallus)
  misc_feature (36): n=a or g
atgggccataaatcaacacgaacccttggccagcanttagtcctctgggctgaggatctggctctccaggg

SEQ ID NO: 11547 - DNA, 71 bp, chicken (Gallus Gallus)
  misc_feature (36): n=a or c
cacaacacattcctaagtacaggaatgcagatctgntccctgatctggaaactcctttgatgaatcaaatc

SEQ ID NO: 11548 - DNA, 71 bp, chicken (Gallus Gallus)
  misc_feature (36): n=c or t
ggctcaaacctgatgtttcatgatgcaggcagcacngggctcctgctgatcttgcctgggttgggctttct

SEQ ID NO: 11549 - DNA, 71 bp, chicken (Gallus Gallus)
  misc_feature (36): n=c or t
ccccttcaaggaccgtgtcctcattggtcccttgcnctgtagagaaccctaaaccctggcctgcagcatcc

SEQ ID NO: 11550 - DNA, 71 bp, chicken (Gallus Gallus)
  misc_feature (36): n=c or t
ctccaatgcctcttacacggagagaaggcgttcaantgccatgctgagatgcacacctccatttttcctct

SEQ ID NO: 11551 - DNA, 71 bp, chicken (Gallus Gallus)
  misc_feature (36): n=c or t
gagcgatcaatgaaacatcagaatcttccccgtctntaggatgggaagtaattatggtagttcttttggca

SEQ ID NO: 11552 - DNA, 71 bp, chicken (Gallus Gallus)
  misc_feature (36): n=c or g
ataacaatttccgagcaaacccaggatgtttgttancctcctgtatatggagctgaaaaaaaaagaataac

SEQ ID NO: 11553 - DNA, 71 bp, chicken (Gallus Gallus)
  misc_feature (36): n=a or c
atccagtctggagcttgatgcttcattatctgcacntagagaatcctgctgcaaacaaaggtctggctcca

SEQ ID NO: 11554 - DNA, 71 bp, chicken (Gallus Gallus)
  misc_feature (36): n=a or c
aaacagcagagctgaaatatcccatgtgatcgctgntgtaaggcaagggcagtgtttggcctgaaagattt

SEQ ID NO: 11555 - DNA, 71 bp, chicken (Gallus Gallus)
  misc_feature (36): n=c or t
gaccctgattctcactgtagcctcttatctagtaangtgtgaattaagattcctgccttgaaacagatgag

SEQ ID NO: 11556 - DNA, 71 bp, chicken (Gallus Gallus)
  misc_feature (36): n=c or t
acatcccatggcacaacataaggctcttgtcccatnactagttatctaggagaagagacctatctgcatct

SEQ ID NO: 11557 - DNA, 71 bp, chicken (Gallus Gallus)
  misc_feature (36): n=a or g
actgtgttttaaacagcatcttgttactgaatttcnccctcacttctccagtttatggaagtaacagtagt

SEQ ID NO: 11558 - DNA, 71 bp, chicken (Gallus Gallus)
  misc_feature (36): n=c or t
cctgctgaggctccatggcttcttacctctctgctncaacactgtagtcttcacttgcacatgactggaga

SEQ ID NO: 11559 - DNA, 71 bp, chicken (Gallus Gallus)
  misc_feature (36): n=c or t
aaagaaaagaaagggagagagcaaaacctttggagnatctttcacctagtgtggtatagtatttcatattt

SEQ ID NO: 11560 - DNA, 71 bp, chicken (Gallus Gallus)
  misc_feature (36): n=g or t
cttgaatgcaagaaaatttgcaatacctgtcttctncaaacatgcaactgtactgaatctaacaatgttat

SEQ ID NO: 11561 - DNA, 71 bp, chicken (Gallus Gallus)
  misc_feature (36): n=a or g
gttggtagctgtttttaggaaaaaagaaaagacatncatggaaaacacccgggttttttcctagctggaag

SEQ ID NO: 11562 - DNA, 71 bp, chicken (Gallus Gallus)
  misc_feature (36): n=c or t
gtctttggcagttgttttatatacattttgcagtgntgatgctctttctgctgtgagtatcctacactgct

SEQ ID NO: 11563 - DNA, 71 bp, chicken (Gallus Gallus)
  misc_feature (36): n=a or g
caggtagtacaggtgaggctgcttagtgacttgccnagttcacattcacccacctgcatttcaggaaagcc

SEQ ID NO: 11564 - DNA, 71 bp, chicken (Gallus Gallus)
  misc_feature (36): n=g or t
cctttgtatcccacgtcagcttttatgattttcttngtcgacatggcatgcataacagctcccagctcggg

SEQ ID NO: 11565 - DNA, 71 bp, chicken (Gallus Gallus)
  misc_feature (36): n=a or g
tgctgaaggtacatgaggctttggagaacataaggnctttgtgttttttatgttctccatccccactcttt

SEQ ID NO: 11566 - DNA, 71 bp, chicken (Gallus Gallus)
  misc_feature (36): n=c or t
tgtcagttactttaatataattagtcttgcttgtanaggttgcaatacaaactattctaaaaatcatcagg

SEQ ID NO: 11567 - DNA, 71 bp, chicken (Gallus Gallus)
  misc_feature (36): n=g or t
attaagcaagtgatagagctgtttggccaaagagtntgtttgcttttgttcatgctttccttgtgttttaa

SEQ ID NO: 11568 - DNA, 71 bp, chicken (Gallus Gallus)
  misc_feature (36): n=a or g
atcctgatccatcttttgtgtcattctataatacgntcagtcagagagtgactcgtctccctgtggaagac

SEQ ID NO: 11569 - DNA, 71 bp, chicken (Gallus Gallus)
  misc_feature (36): n=c or t
atcaacataacagctgctcctacagtaacaatgcangaactgctttcaggtagggtccaggatgaataaat

SEQ ID NO: 11570 - DNA, 71 bp, chicken (Gallus Gallus)
  misc_feature (36): n=c or g
gcactgtgttaatcacttccctctaggcaatagganttacaacagaaaacataatttaagtaagcaactga

SEQ ID NO: 11571 - DNA, 71 bp, chicken (Gallus Gallus)
  misc_feature (36): n=c or t
tgaggtgagtctgtgttgtggccaagtctgaaagangtctagaagaacataaaagccaatttcaggaaaac

SEQ ID NO: 11572 - DNA, 71 bp, chicken (Gallus Gallus)
  misc_feature (36): n=c or t
acagttcatatcagtactgtgaaagattcaactaanactgctcaaattttggaaaaatatgaactgtaaat

SEQ ID NO: 11573 - DNA, 71 bp, chicken (Gallus Gallus)
  misc_feature (36): n=c or t
tcagctccgtggctctgcagcagagcagtgagctgnacttagcatgagcacgttaaaagacaaaccgctaa

SEQ ID NO: 11574 - DNA, 71 bp, chicken (Gallus Gallus)
  misc_feature (36): n=c or g
gacaagtgcacatcccaccctgaatgtggacagagngtttaataaaccagaaatattgcctatgtaatcta

SEQ ID NO: 11575 - DNA, 71 bp, chicken (Gallus Gallus)
  misc_feature (36): n=a or g
tggtatatctttatatcttttgtgctactctgccangatattagaaacatgatttcactggtaagtaaaaa

SEQ ID NO: 11576 - DNA, 71 bp, chicken (Gallus Gallus)
  misc_feature (36): n=a or g
acaaaaacaaagcaacaaaaacaacagcaatgcacncgcacaaaagcaaccagctaattggcttcctgaaa

SEQ ID NO: 11577 - DNA, 71 bp, chicken (Gallus Gallus)
  misc_feature (36): n=a or g
ctgatcaaatcaagaatgacttacatttcttcactncagttttctggtctctccattctgtagcctgtttt

SEQ ID NO: 11578 - DNA, 71 bp, chicken (Gallus Gallus)
  misc_feature (36): n=a or g
tgaacaatccctagcaggagactgaagcaaaggagnataaaatttgtactattggaagtgcaaagggacgg

SEQ ID NO: 11579 - DNA, 71 bp, chicken (Gallus Gallus)
  misc_feature (36): n=g or t
tgaatgaaggcaaaactgttgggatgtctcagatgngcctggttttgccaccagaagaagccttttatgac

SEQ ID NO: 11580 - DNA, 71 bp, chicken (Gallus Gallus)
  misc_feature (36): n=c or g
acgccaacgtcactggagaaaggcttctgtgtgagnccagctgaaaaggacaccagagaggccgcagcagc

SEQ ID NO: 11581 - DNA, 71 bp, chicken (Gallus Gallus)
  misc_feature (36): n=a or c
tcaactgtagtgttatggtaaaaacaacatttttgnttctattgaatgtcaggaaaatagcttttgtatag

SEQ ID NO: 11582 - DNA, 71 bp, chicken (Gallus Gallus)
  misc_feature (36): n=g or t
catatacgttctgttctgtcagtttgcattgtattnacttcataatgtagtgaatgtagttatttgatttt

SEQ ID NO: 11583 - DNA, 71 bp, chicken (Gallus Gallus)
  misc_feature (36): n=c or g
aagaatacaaattcaggtgaagatgcacagcagggngacagaggaggtttcgcctgagccttcctcagttt

SEQ ID NO: 11584 - DNA, 71 bp, chicken (Gallus Gallus)
  misc_feature (36): n=a or t
actgactagcctgcatctctttggatcttccttgcnatctttcttgaagagaagtatgatgtcacctcaaa

SEQ ID NO: 11585 - DNA, 71 bp, chicken (Gallus Gallus)
  misc_feature (36): n=g or t
ggaattcagaagcaacattacacaaaactcttgtgncagacctttttttgggactacctcccaaaccccag

SEQ ID NO: 11586 - DNA, 71 bp, chicken (Gallus Gallus)
  misc_feature (36): n=c or t
tgagctccgtttagtcattagttgtagaatatcatntctgtcttttgctctgaattactcattctatcccc

SEQ ID NO: 11587 - DNA, 71 bp, chicken (Gallus Gallus)
  misc_feature (36): n=c or g
ataatgtattaggaccagattttgctcagctcaagncagccaaagactgcacacctattgaatacccgaag

SEQ ID NO: 11588 - DNA, 71 bp, chicken (Gallus Gallus)
  misc_feature (36): n=c or t
gccacaggtagtaatgtgatgctgttagctcttgtnggggacacagggctcaagcaaaaggcaggagaaat

SEQ ID NO: 11589 - DNA, 71 bp, chicken (Gallus Gallus)
  misc_feature (36): n=c or g
catcaaaagcagctccatttctgcctctgtgttttnttctggttcattcccattgtttgaaaacgaaattt

SEQ ID NO: 11590 - DNA, 71 bp, chicken (Gallus Gallus)
  misc_feature (36): n=c or t
cagctcctctaggacacctttgcatgtatgtctgtntgtatgtctgaactgctgccttctgaaagtcttag

SEQ ID NO: 11591 - DNA, 71 bp, chicken (Gallus Gallus)
  misc_feature (36): n=a or g
ccttgggaagagcccttctccaacacactccttggnaagacacagactgtgctgagcaagatgctgctttc

SEQ ID NO: 11592 - DNA, 71 bp, chicken (Gallus Gallus)
  misc_feature (36): n=c or t
ctaagctaggtcaattttttttttctgctttttaanatagggagtctcagtatcaacggatagcatcacct

SEQ ID NO: 11593 - DNA, 71 bp, chicken (Gallus Gallus)
  misc_feature (36): n=c or t
tgaatgttgcctgaattataatgaaggggatgaagnaagggggtggacatcgctcatttgtgagtaaattt

SEQ ID NO: 11594 - DNA, 71 bp, chicken (Gallus Gallus)
  misc_feature (36): n=c or t
tcagtatctccttgacttgtgctcttttatcatgtngcaagtagttgtatgtgcaggaaaaacacacagag

SEQ ID NO: 11595 - DNA, 71 bp, chicken (Gallus Gallus)
  misc_feature (36): n=c or g
acttttcacattcgaactgctggtagtttttccacnctgggcttcgggcaaaggcagctgtgaggaattgc

SEQ ID NO: 11596 - DNA, 71 bp, chicken (Gallus Gallus)
  misc_feature (36): n=c or t
gaagaaaaagaggtgctgcggggatacagcggtctngtttagccacaaaacccatcaaattctttgcctga

SEQ ID NO: 11597 - DNA, 71 bp, chicken (Gallus Gallus)
  misc_feature (36): n=a or c
cctaggcttaaccttccctttctcaatgaatatgcnctttcccacgctcctcagtcgcagcagcaacggag

SEQ ID NO: 11598 - DNA, 71 bp, chicken (Gallus Gallus)
  misc_feature (36): n=g or t
ggtggtgtttggaccttgtgccgtaacattttatgncagtacagcaatttggttggtcattatttggttgg

SEQ ID NO: 11599 - DNA, 71 bp, chicken (Gallus Gallus)
  misc_feature (36): n=a or g
gtgtaaccagcaattaattttttattcaactacttngtgtaatggagatagcaactattctgatacccatc

SEQ ID NO: 11600 - DNA, 71 bp, chicken (Gallus Gallus)
  misc_feature (36): n=a or g
gaattattcttttgtggactgctccacttgcatcanttctgtgctaagtagtaaataagagaacttccttc

SEQ ID NO: 11601 - DNA, 71 bp, chicken (Gallus Gallus)
  misc_feature (36): n=c or t
tttgctgacctctagaatgaatactgctttacagcngtgccctctcttaacagggggctggaggccacgca

SEQ ID NO: 11602 - DNA, 71 bp, chicken (Gallus Gallus)
  misc_feature (36): n=c or t
tacttcccctaagcatgcacagagatgtatttatgngccatgctgtagctgctgcagaggattaattggga

SEQ ID NO: 11603 - DNA, 71 bp, chicken (Gallus Gallus)
  misc_feature (36): n=c or t
atacttctcagaggtttgcactgcaggatctctgantgatagctgattgggtacgtaacagaatgtacaca

SEQ ID NO: 11604 - DNA, 71 bp, chicken (Gallus Gallus)
  misc_feature (36): n=a or g
caggaacaatcacagaatatcttattttggaaaggncccacagggatcatcgagtcccactcctggttcag

SEQ ID NO: 11605 - DNA, 71 bp, chicken (Gallus Gallus)
  misc_feature (36): n=a or c
ctccatgctgcatgtggatattgaatgctgtgtggnatcagagcaggggtttggtcccatgattctggagt

SEQ ID NO: 11606 - DNA, 71 bp, chicken (Gallus Gallus)
  misc_feature (36): n=c or t
cgctatcgttcaatttacgcacacggttctgactgncatgctcccaaaaggtgcctgtgcatttgcagctc

SEQ ID NO: 11607 - DNA, 71 bp, chicken (Gallus Gallus)
  misc_feature (36): n=c or t
ctccttaggcatttttaaatgccttacaacatttanaggtctggggtggagatgttccctgtgggaggaca

SEQ ID NO: 11608 - DNA, 71 bp, chicken (Gallus Gallus)
  misc_feature (36): n=a or t
atttcctacagtgacctttacatctcggtccatacncattctgacataatttagacataaggaaaaaaaca

SEQ ID NO: 11609 - DNA, 71 bp, chicken (Gallus Gallus)
  misc_feature (36): n=c or g
gagacctaaagtaacatctggaggcagaagatgaanactactgaagggattctagccactttacagagctg

SEQ ID NO: 11610 - DNA, 71 bp, chicken (Gallus Gallus)
  misc_feature (36): n=a or g
atgcctgcagaatgctgattactagcaggacgtgtngcaaaaatatcacaagagtaattaatttgcccttt

SEQ ID NO: 11611 - DNA, 71 bp, chicken (Gallus Gallus)
  misc_feature (36): n=a or g
aaaagggagcgaacttcagtgaacccagaactcacnggacccatgagctcctccaaaatggatgtgaggaa

SEQ ID NO: 11612 - DNA, 71 bp, chicken (Gallus Gallus)
  misc_feature (36): n=c or t
tctggcagatacgatctttataatggagagggtgtncaagaagccataagttaatttgacttttcaggcta

SEQ ID NO: 11613 - DNA, 71 bp, chicken (Gallus Gallus)
  misc_feature (36): n=c or t
ttgtgtctctttgtgcaatatgcctgttctaagggntgccatactatcacagaaatagtccttatgtatca

SEQ ID NO: 11614 - DNA, 71 bp, chicken (Gallus Gallus)
  misc_feature (36): n=a or g
caatagagtggcctttagaaaaaaaaaaaaaaaacncaaagatggttctggtgtcaatacacctgctactc

SEQ ID NO: 11615 - DNA, 71 bp, chicken (Gallus Gallus)
  misc_feature (36): n=a or g
agggtcctgaggaaattttctcaggaatattgtgtngttttgttaaagaaaaatgattttaaatctgaaat

SEQ ID NO: 11616 - DNA, 71 bp, chicken (Gallus Gallus)
  misc_feature (36): n=a or g
accccatcttgcccaatgtatacatcacatggtctncatgatcactttgcttactgatcttgggaggcaca

SEQ ID NO: 11617 - DNA, 71 bp, chicken (Gallus Gallus)
  misc_feature (36): n=c or t
ccacaactttgcttcatatgcctttccatacccaangccattctgtcagactgcccctccactgtcaattg

SEQ ID NO: 11618 - DNA, 71 bp, chicken (Gallus Gallus)
  misc_feature (36): n=a or g
ctcattccctctcctcagaaaaaggaagaaaatacnataaaaacaatctgaaacgggttgttataaaaaat

SEQ ID NO: 11619 - DNA, 71 bp, chicken (Gallus Gallus)
  misc_feature (36): n=a or t
tttgctgttctcacagactggaacaagtcctgtctntaagaatttccgtgattctggatcgaagctgtatg

SEQ ID NO: 11620 - DNA, 71 bp, chicken (Gallus Gallus)
  misc_feature (36): n=a or g
tctgcttctgtttgttggtgaagataagtggcctcnaattcttcatttcctgaggaatgagcagagttcag

SEQ ID NO: 11621 - DNA, 71 bp, chicken (Gallus Gallus)
  misc_feature (36): n=c or t
agaagaaataagaatttctgcgagtattttttcttnttcttgttctgtttgcactgagcacctactcaagt

SEQ ID NO: 11622 - DNA, 71 bp, chicken (Gallus Gallus)
  misc_feature (36): n=c or t
cggatgcactcccacacaacagagggtggacagccnatgctgttgcactacagcagcctcaccttgcttcc

SEQ ID NO: 11623 - DNA, 71 bp, chicken (Gallus Gallus)
  misc_feature (36): n=c or t
agaaattatcatcttctgtcatgttactgtctcagnttctatagtatttgcataccaccagcaccttgcat

SEQ ID NO: 11624 - DNA, 71 bp, chicken (Gallus Gallus)
  misc_feature (36): n=c or t
tatttctttatatgttgggatgctagggctgaactnagtagccctatctatcatgaaaatcccttactttt

SEQ ID NO: 11625 - DNA, 71 bp, chicken (Gallus Gallus)
  misc_feature (36): n=a or g
tccatgctgtttttcatgacatggtaaaagctgtcntccatttgcaaatataaaattgagattaccccagc

SEQ ID NO: 11626 - DNA, 71 bp, chicken (Gallus Gallus)
  misc_feature (36): n=g or t
ggtagacgacttcattattttccacattatattttntttgctttataatcattataattacattgtgattt

SEQ ID NO: 11627 - DNA, 71 bp, chicken (Gallus Gallus)
  misc_feature (36): n=c or t
atctagcatggatcttttccctggttagctggaaangtaaaacagctgcttgatcatgtgaagtctttaaa

SEQ ID NO: 11628 - DNA, 71 bp, chicken (Gallus Gallus)
  misc_feature (36): n=a or c
cccagaaaaaaaaccacattcactgaggcaacaatnatgtaatgcactagacaaataagctgcttatataa

SEQ ID NO: 11629 - DNA, 71 bp, chicken (Gallus Gallus)
  misc_feature (36): n=a or g
tgtctgtgtctgtataaatgactgagagacaacaanaagtggaaagatggatgggaacacaattcctactt

SEQ ID NO: 11630 - DNA, 71 bp, chicken (Gallus Gallus)
  misc_feature (36): n=a or c
caaagagcaggtgatcctgaataaattgtctctctntatatatttttaaataccggatgtttgatattatc

SEQ ID NO: 11631 - DNA, 71 bp, chicken (Gallus Gallus)
  misc_feature (36): n=c or t
ggtttggttaatattttgtggagagcttctgagaangctgatcttcaaaatgaaatgctgctgttatgtaa

SEQ ID NO: 11632 - DNA, 71 bp, chicken (Gallus Gallus)
  misc_feature (36): n=a or g
tcaaaccagtttccaggcttccctctcagtttgtcncacacttttcaaataccgagccagtgctcattctt

SEQ ID NO: 11633 - DNA, 71 bp, chicken (Gallus Gallus)
  misc_feature (36): n=a or g
aaatttattaacatatttcaggaagcaaatattgantacctttcatataagtttatactagcatatacata

SEQ ID NO: 11634 - DNA, 71 bp, chicken (Gallus Gallus)
  misc_feature (36): n=g or t
gtgtctaaaatgtcagacaccagaaaagagtgcatntgaaaaacctctgtgaattatgaaagttatgtcca

SEQ ID NO: 11635 - DNA, 71 bp, chicken (Gallus Gallus)
  misc_feature (36): n=a or g
gggtagactgtgagtcagtcactgtgaatttaaagncagcaggtgccctgagatgcatcactgcttagcct

SEQ ID NO: 11636 - DNA, 71 bp, chicken (Gallus Gallus)
  misc_feature (36): n=c or t
taagccaacacacaggctaaagaggtagcagtgcanccccggagcatttgcctccagcagtttgtagaata

SEQ ID NO: 11637 - DNA, 71 bp, chicken (Gallus Gallus)
  misc_feature (36): n=c or t
gcaaaggctctctacgaatatctgacaggtcagatnaacagcatggcattgtcagtgaatctttggaaagt

SEQ ID NO: 11638 - DNA, 71 bp, chicken (Gallus Gallus)
  misc_feature (36): n=c or t
tgtgcttctcctgtctctctaggttctaaggtcaangatacctgtccccttctggaggaaggaaggggagg

SEQ ID NO: 11639 - DNA, 71 bp, chicken (Gallus Gallus)
  misc_feature (36): n=a or g
ggaattgttaagttgtcctttttgtggagaacttgntcatttattccactgctaataggaaattaagtctt

SEQ ID NO: 11640 - DNA, 71 bp, chicken (Gallus Gallus)
  misc_feature (36): n=c or t
tagttcctatgcctaatgttttcaaactagacgatntaatttaggattccttccaagtcaagtcattccat

SEQ ID NO: 11641 - DNA, 71 bp, chicken (Gallus Gallus)
  misc_feature (36): n=c or t
agccttgctgggtggatgctaagactgaagacatgnaagagagaaatttactcattgacttgagcaggaga

SEQ ID NO: 11642 - DNA, 71 bp, chicken (Gallus Gallus)
  misc_feature (36): n=a or t
ccttgcaagaaggaaatcctactgaaattagtgagngtatttcagaagtgaagtaaaatttagcatacaat

SEQ ID NO: 11643 - DNA, 71 bp, chicken (Gallus Gallus)
  misc_feature (36): n=c or g
gagatgagataagggatcccttggacttcagcctgntttcatatggcacttggctctctattccaggcatg

SEQ ID NO: 11644 - DNA, 71 bp, chicken (Gallus Gallus)
  misc_feature (36): n=a or c
tattttcatcttactcagtaaaatcacacaagcacnttttactaagtaagaatatgttcaaagctatacat

SEQ ID NO: 11645 - DNA, 71 bp, chicken (Gallus Gallus)
  misc_feature (36): n=a or g
accacgcaagtccctgcatggaaggagcttccaggnctgatgcaagagtctccaggagcatcacagcaaca

SEQ ID NO: 11646 - DNA, 71 bp, chicken (Gallus Gallus)
  misc_feature (36): n=c or t
tgtcctaaaatagcaaaaaatgtagcttgtcttcangttctgaatgctcttatttttattttaaaggttga

SEQ ID NO: 11647 - DNA, 71 bp, chicken (Gallus Gallus)
  misc_feature (36): n=a or g
ctgggaaatcaacatggtgagctgcaagtgatccangagactcctgaagtccatgaatgacaactttctgg

SEQ ID NO: 11648 - DNA, 71 bp, chicken (Gallus Gallus)
  misc_feature (36): n=a or g
ttctctatgtatgcatacactttactcaccatcagnaggagatgaaactgcattgatatttgcaataacaa

SEQ ID NO: 11649 - DNA, 71 bp, chicken (Gallus Gallus)
  misc_feature (36): n=a or t
cttttaccattttaatgagtaaaaaattgtgtttantaacaactgtccatcgtgagtaattgccaaataac

SEQ ID NO: 11650 - DNA, 71 bp, chicken (Gallus Gallus)
  misc_feature (36): n=g or t
ataacacctttgaaaactgagattgtctacagtcanagaaaaagagatgggactacatgatgaatatcatg

SEQ ID NO: 11651 - DNA, 71 bp, chicken (Gallus Gallus)
  misc_feature (36): n=a or g
tactgtgctgagggtaaatcatccatgtgcaagagngcatccagagctgtaaacaggagaggcgccgcggc

SEQ ID NO: 11652 - DNA, 71 bp, chicken (Gallus Gallus)
  misc_feature (36): n=c or t
gggccctgttgtcactcttcaacactttttcaacanagtcagtaccattagctatgctttttcaccagcca

SEQ ID NO: 11653 - DNA, 71 bp, chicken (Gallus Gallus)
  misc_feature (36): n=a or g
tatagttcatagttgaagcgtgggccttcgttgcantaattattagcactacactgcacttagtacattta

SEQ ID NO: 11654 - DNA, 71 bp, chicken (Gallus Gallus)
  misc_feature (36): n=c or t
tatttcttgaattaggtcaaccttagttcttactcntctgtttcgttctccctgaatgtgaaagagctcca

SEQ ID NO: 11655 - DNA, 71 bp, chicken (Gallus Gallus)
  misc_feature (36): n=c or t
tgcactgtttgtcattgtaattatttcactcagtanctgtatttttaataatatgaagaagccttccccag

SEQ ID NO: 11656 - DNA, 71 bp, chicken (Gallus Gallus)
  misc_feature (36): n=a or t
ataccagactctggcacagccttacgtaaaaaaaantaaaaataataaataaataaataaataaataaata

SEQ ID NO: 11657 - DNA, 71 bp, chicken (Gallus Gallus)
  misc_feature (36): n=c or t
ataaaaaccaccgacgtgacttttattccactgtcngcattctcatttagctttcccgtgtaattatagtg

SEQ ID NO: 11658 - DNA, 71 bp, chicken (Gallus Gallus)
  misc_feature (36): n=c or t
taagtttgtacatagtgtataaattgttgcaaatangtttaactgaatatcagtttgtaaaattacagtct

SEQ ID NO: 11659 - DNA, 71 bp, chicken (Gallus Gallus)
  misc_feature (36): n=g or t
agcagagtacccaagcagctctaccttctctagctntcttgtttaactgtgttctctctcatatcttgtaa

SEQ ID NO: 11660 - DNA, 71 bp, chicken (Gallus Gallus)
  misc_feature (36): n=c or g
acaaatcaagtaataatgaatacattttcattacancagacgtctctaaaattacaaaacaaagtttgtgt

SEQ ID NO: 11661 - DNA, 71 bp, chicken (Gallus Gallus)
  misc_feature (36): n=c or g
agctgctcacagaataaaactggcatcatgtggcanaactgtccaatcgcagcaagacagtgcatttttaa

SEQ ID NO: 11662 - DNA, 71 bp, chicken (Gallus Gallus)
  misc_feature (36): n=c or t
gcaaattatgtcaattttgtaaaactttactaaaangcaatctttctgtagattgaagagcatataccacc

SEQ ID NO: 11663 - DNA, 71 bp, chicken (Gallus Gallus)
  misc_feature (36): n=c or g
ttaccctcataccagctgtgtagagcgggctgtgtncagtaatgctgggtttccaggaaataaatgacttt

SEQ ID NO: 11664 - DNA, 71 bp, chicken (Gallus Gallus)
  misc_feature (36): n=a or g
accatatgatagcaaatgaaatttttttgtgctttnagcagtatttcagaatttaaattgaagggaaggct

SEQ ID NO: 11665 - DNA, 71 bp, chicken (Gallus Gallus)
  misc_feature (36): n=a or g
ccagtaattagcaaaagaagccacaccaagaatacnagtcatacaacagagcaagcaagaatacaatcatt

SEQ ID NO: 11666 - DNA, 71 bp, chicken (Gallus Gallus)
  misc_feature (36): n=a or g
catgaagcaaagaagctatgtagagaggtgcctgtntattctctactggtatagttggtataagatccagc

SEQ ID NO: 11667 - DNA, 71 bp, chicken (Gallus Gallus)
  misc_feature (36): n=g or t
gaaaaagctagaaagagctgatgtatgtccttgagntgtgcttacaccatccaacaacccctgtttcaacg

SEQ ID NO: 11668 - DNA, 71 bp, chicken (Gallus Gallus)
  misc_feature (36): n=a or t
ggaagtctggtacagaagtctttttggccagaaatnggtggagaatcacactgtctgtagtggcctcacct

SEQ ID NO: 11669 - DNA, 71 bp, chicken (Gallus Gallus)
  misc_feature (36): n=c or t
aaatctgagtgtacagaaagtcagtaacatgagatntgtctatttgtggaacgagcctaaaaatttattct

SEQ ID NO: 11670 - DNA, 71 bp, chicken (Gallus Gallus)
  misc_feature (36): n=c or t
ggttttgctgatatctggaatgtatgtttatgtaangcttcttcatgttggaataaatgagaactgagcat

SEQ ID NO: 11671 - DNA, 71 bp, chicken (Gallus Gallus)
  misc_feature (36): n=a or g
ctcagggcagtctccatggagactcaaagtggggtnacatcctacaaaccgacagtgatagaaaactgcat

SEQ ID NO: 11672 - DNA, 71 bp, chicken (Gallus Gallus)
  misc_feature (36): n=a or g
tagagtcattcataaatatttgtctatcaggaaggngaatttatgtcttcagtagttatcaggaagaattt

SEQ ID NO: 11673 - DNA, 71 bp, chicken (Gallus Gallus)
  misc_feature (36): n=a or g
ttcttgcttttgcagccagttttcttcagcaacacntactgagtgagaggaacctttatggctttcttccc

SEQ ID NO: 11674 - DNA, 71 bp, chicken (Gallus Gallus)
  misc_feature (36): n=a or t
caaaattttaattgaaattttacaaaaagcttgganttaaattaggctcaaagcagagctgccagtagagc

SEQ ID NO: 11675 - DNA, 71 bp, chicken (Gallus Gallus)
  misc_feature (36): n=c or t
gcagtacttgctcagtgtcagggccctcctgttttngccctttgctttacagcaaacaggcaagatatgac

SEQ ID NO: 11676 - DNA, 71 bp, chicken (Gallus Gallus)
  misc_feature (36): n=c or t
taacatgaaggaataattacctcattgttctgcaangcttgttttccacttcttttactgaaaaagaaaaa

SEQ ID NO: 11677 - DNA, 71 bp, chicken (Gallus Gallus)
  misc_feature (36): n=c or t
cattattgccttttaagacccttgccctgattcagngaaaggcatatagctatagccatttaaatgtttgg

SEQ ID NO: 11678 - DNA, 71 bp, chicken (Gallus Gallus)
  misc_feature (36): n=a or g
aagtacctaataaatagtaggtaattgaacaaaacnccgctcctcagcattcggaaacatgatcaggcaaa

SEQ ID NO: 11679 - DNA, 71 bp, chicken (Gallus Gallus)
  misc_feature (36): n=c or t
tgcttgttgggctggtaaggaacgtctgcttacccnttatctcccaagttcttcctttgcccttactcccc

SEQ ID NO: 11680 - DNA, 71 bp, chicken (Gallus Gallus)
  misc_feature (36): n=c or t
tccttgtagctgctgtcagaaatacttgtgttttantgatataaaatgttactgacaattctctctgagga

SEQ ID NO: 11681 - DNA, 71 bp, chicken (Gallus Gallus)
  misc_feature (36): n=a or t
agtacaactagaagagcatgctgtgttcctcaaaantcttgcagtcacccattaggaaaacgagcttagct

SEQ ID NO: 11682 - DNA, 71 bp, chicken (Gallus Gallus)
  misc_feature (36): n=a or t
ccagaactgccaaacacttacaggaactttctctgnggcttttggtgtctttactgctcaaatttcctagt

SEQ ID NO: 11683 - DNA, 71 bp, chicken (Gallus Gallus)
  misc_feature (36): n=a or g
ggacaggtggctacttcttcagtggcccttcactgnttgaatgcagcttggtggcactgatggatgctttc

SEQ ID NO: 11684 - DNA, 71 bp, chicken (Gallus Gallus)
  misc_feature (36): n=g or t
aaaagacaaaaacaaacaaccctactcacaccattnctaccattccccattttaactttgtctgaaaataa

SEQ ID NO: 11685 - DNA, 71 bp, chicken (Gallus Gallus)
  misc_feature (36): n=c or t
ctctgcacttcttgcatgtcagcaggtgtttcatangtattgtttccttccagaaattaaatgagaagtga

SEQ ID NO: 11686 - DNA, 71 bp, chicken (Gallus Gallus)
  misc_feature (36): n=c or t
ggcccacagtgtgtgcgtgcccctcacaagggacangtgtcagcgtggtgttggaagcagtacagaaggag

SEQ ID NO: 11687 - DNA, 71 bp, chicken (Gallus Gallus)
  misc_feature (36): n=c or t
tacctgacaaagccaactgacttacctccaaaagtntgatacccaacatcatacgcatctcttgtaaagtc

SEQ ID NO: 11688 - DNA, 71 bp, chicken (Gallus Gallus)
  misc_feature (36): n=a or g
cccaaacacttgctaaaaggaatccagagaccacangagaccatagtgcagacttaagcagacctgattgt

SEQ ID NO: 11689 - DNA, 71 bp, chicken (Gallus Gallus)
  misc_feature (36): n=a or g
cagtgttcctgtcttcgtgaggttctaattgtaagnaagaaaaagaaataaagaaaaaaggaaagccagat

SEQ ID NO: 11690 - DNA, 71 bp, chicken (Gallus Gallus)
  misc_feature (36): n=a or g
ctgagttgaagtttgttttgtgtatttccactgcantctacgtgttagtcaattagactggttatgtactg

SEQ ID NO: 11691 - DNA, 71 bp, chicken (Gallus Gallus)
  misc_feature (36): n=g or t
gcattgcaccatggttacagatggccttactgtcantgggggatgcaatatttcacactacacctgtaaca

SEQ ID NO: 11692 - DNA, 71 bp, chicken (Gallus Gallus)
  misc_feature (36): n=a or g
aggagactttaagtgctgctgaacagaactgtgcantgcaggaacatatacactgcaagcactgcagtgaa

SEQ ID NO: 11693 - DNA, 71 bp, chicken (Gallus Gallus)
  misc_feature (36): n=a or g
aaacaagggtgagacttgtaaactggacaaatgtgntagggatggcagaggtgggcaacaattacagaagc

SEQ ID NO: 11694 - DNA, 71 bp, chicken (Gallus Gallus)
  misc_feature (36): n=a or g
aaaagcaagcattccatgttgcaaaagagggaagancattccctggacaagcatcacaaatatttctgtgc

SEQ ID NO: 11695 - DNA, 71 bp, chicken (Gallus Gallus)
  misc_feature (36): n=a or g
catcccgtcacaccgaagggatcaaatggttctcancacaccggtgtgggggaaaattacaacctcacacc

SEQ ID NO: 11696 - DNA, 71 bp, chicken (Gallus Gallus)
  misc_feature (36): n=c or t
tcttgcagctagcaaaattaagaacctctgcttggnctatgattttccctattccagaaaaaaacattagt

SEQ ID NO: 11697 - DNA, 71 bp, chicken (Gallus Gallus)
  misc_feature (36): n=c or g
agctgagtggtaaagctgaaaaccagaatgcaacanagaacagcgtgtttttgcacagtggactgcagagg

SEQ ID NO: 11698 - DNA, 71 bp, chicken (Gallus Gallus)
  misc_feature (36): n=c or t
aggcattttttgaaaggtaaagaatactgggaggcnccatttgaaatctgtgacctaagcatctcctagtt

SEQ ID NO: 11699 - DNA, 71 bp, chicken (Gallus Gallus)
  misc_feature (36): n=a or g
agaggagcctgactgcacactgtagtattattactntatgtatattgaataggaagaccaagcacaggcag

SEQ ID NO: 11700 - DNA, 71 bp, chicken (Gallus Gallus)
  misc_feature (36): n=a or g
cagccccagctctctcagcctgtcctctcaggagangtgttctctcccttaggtcattcctgtggctctcc

SEQ ID NO: 11701 - DNA, 71 bp, chicken (Gallus Gallus)
  misc_feature (36): n=a or t
gtttttattataacaatgtgaaataaggactcagtngtgctagccaggaagaaacattgattctaggggat

SEQ ID NO: 11702 - DNA, 71 bp, chicken (Gallus Gallus)
  misc_feature (36): n=c or g
tttgtacataataatcttgtgtttttgcatgtcttnttgagcataagcagactgcttaattgccctcccag

SEQ ID NO: 11703 - DNA, 71 bp, chicken (Gallus Gallus)
  misc_feature (36): n=c or t
ctttcactggctgtaggcacagtgagaaagcagcantaaaactcctatttctggaagcatagcatatgagc

SEQ ID NO: 11704 - DNA, 71 bp, chicken (Gallus Gallus)
  misc_feature (36): n=c or t
cacacttaactgcaatctgaactgtcgtgtatttgntgttaccagaagcaaaaatctcaatggaaactgaa

SEQ ID NO: 11705 - DNA, 71 bp, chicken (Gallus Gallus)
  misc_feature (36): n=a or g
ttgtgaaataccacccaacgagagccaaataccacnctcctaactcgcataaaatttctgcttatgtcaat

SEQ ID NO: 11706 - DNA, 71 bp, chicken (Gallus Gallus)
  misc_feature (36): n=a or g
ttcatgtttacaattaatcagtataaattggtgagnaaaaggtctgcgagatggaaattagcattatgaga

SEQ ID NO: 11707 - DNA, 71 bp, chicken (Gallus Gallus)
  misc_feature (36): n=a or g
aaattacttacaaagtgcacgtaggaggtgggaagngaacccacagactgcactagttcattgtgtgaaaa

SEQ ID NO: 11708 - DNA, 71 bp, chicken (Gallus Gallus)
  misc_feature (36): n=c or t
tatcttgtctaaaaaagtgcatgaatgcttgggttngccttcacactgatgggaagtctcacctgtgtgct

SEQ ID NO: 11709 - DNA, 71 bp, chicken (Gallus Gallus)
  misc_feature (36): n=c or t
caaattaaagaagtcaaggttttaaaaatgccagcntgaatgttttgaaaagctataacaataatattatc

SEQ ID NO: 11710 - DNA, 71 bp, chicken (Gallus Gallus)
  misc_feature (36): n=g or t
cacagatagtgctgtcagatatttcattgctttgtntctttccctactgatgggtttgcttactgtcccag

SEQ ID NO: 11711 - DNA, 71 bp, chicken (Gallus Gallus)
  misc_feature (36): n=a or g
ttctctgaagttatcttgagctacaaagccggtttnttttgatagcctggtcaagcagctggccagttttt

SEQ ID NO: 11712 - DNA, 71 bp, chicken (Gallus Gallus)
  misc_feature (36): n=a or g
ctgtgacttaaaaacagtgacctatagataggggangtgccccagtggggaccagccaccaggtgtccctc

SEQ ID NO: 11713 - DNA, 71 bp, chicken (Gallus Gallus)
  misc_feature (36): n=c or t
gagggaaagatgacgccgcctttaaccggagatttnagactttctcagttgcttgaatccaccatgcagat

SEQ ID NO: 11714 - DNA, 71 bp, chicken (Gallus Gallus)
  misc_feature (36): n=c or t
gatgacatatttgtatttccaaaagaaagaagttgnctttagggaacgttttggattactgctagtgggat

SEQ ID NO: 11715 - DNA, 71 bp, chicken (Gallus Gallus)
  misc_feature (36): n=a or g
gcagctgccagaataattactgaggtaaacccagantctgaggaagaggatgaatcatctccatatgagga

SEQ ID NO: 11716 - DNA, 71 bp, chicken (Gallus Gallus)
  misc_feature (36): n=a or g
aagaatgggaggatgtgtgcattgctcatggcagcnagctgaagatctgactcgttgtgtgtaaaagatga

SEQ ID NO: 11717 - DNA, 71 bp, chicken (Gallus Gallus)
  misc_feature (36): n=a or g
tgcctggcagcaatgtcctgtctctaatgactacantttgatgacttctaaatggtgaacactgagaacca

SEQ ID NO: 11718 - DNA, 71 bp, chicken (Gallus Gallus)
  misc_feature (36): n=c or t
agctcgcttgatggtgaacgtgctgaaagggtttgngtgtccagcgtttgagttctgtgtgatgggctaca

SEQ ID NO: 11719 - DNA, 71 bp, chicken (Gallus Gallus)
  misc_feature (36): n=a or c
gcatgaattctcttagcaccgctttcactttgctgnaaggctttctatcagagtggatgcagaactatctg

SEQ ID NO: 11720 - DNA, 71 bp, chicken (Gallus Gallus)
  misc_feature (36): n=a or g
caagtatgacaggaattcgggatttcaggggaaggnctcaaatcgggaggcgtgcaggatggagcgtggat

SEQ ID NO: 11721 - DNA, 71 bp, chicken (Gallus Gallus)
  misc_feature (36): n=c or t
cagccacacaggacatctcctgcaagttcaggtcgngttttgctgctaatgctctgtcttacacttcggtg

SEQ ID NO: 11722 - DNA, 71 bp, chicken (Gallus Gallus)
  misc_feature (36): n=a or t
taaatttgaaatgtttttttttactgttcctttccntgaagattcaagttcctttatggatggcagggaaa

SEQ ID NO: 11723 - DNA, 71 bp, chicken (Gallus Gallus)
  misc_feature (36): n=c or t
tcaaacgagtaggctcaccatgggcagagccagaantgaaagaaacctgtatttttaacaacatggatcct

SEQ ID NO: 11724 - DNA, 71 bp, chicken (Gallus Gallus)
  misc_feature (36): n=c or g
accgaatgacatgctgcttgctctgcctgaccacantgggtgccagacgggcttcctaattttccttctga

SEQ ID NO: 11725 - DNA, 71 bp, chicken (Gallus Gallus)
  misc_feature (36): n=a or g
gtagataaatattttctgtgtgttattaaagccacnatataagctctaattaaacccaattaaaaagacta

SEQ ID NO: 11726 - DNA, 71 bp, chicken (Gallus Gallus)
  misc_feature (36): n=c or t
gcaatccaatctgtagttgcaaaccacttgtggttntttatgtcatttacaccattcttgagatttccata

SEQ ID NO: 11727 - DNA, 71 bp, chicken (Gallus Gallus)
  misc_feature (36): n=a or g
ggaattactccctctcttgagactgtaagctttccntggtacagtctggctatggcaattgacctactgcc

SEQ ID NO: 11728 - DNA, 71 bp, chicken (Gallus Gallus)
  misc_feature (36): n=c or t
acagtgcaacgtagttgccttttgaagaacagacanagccttacttacaccaggaaacaatggcaattctc

SEQ ID NO: 11729 - DNA, 71 bp, chicken (Gallus Gallus)
  misc_feature (36): n=a or c
tgaattttggtcagtctccaggaagaaacatttttnagttaatttagcagacatttatatggcgataaata

SEQ ID NO: 11730 - DNA, 71 bp, chicken (Gallus Gallus)
  misc_feature (36): n=a or g
cagtctgttatgtagctgttgtaaaatattactgtngtaattgggtttaaagagagagacttgtatttttc

SEQ ID NO: 11731 - DNA, 71 bp, chicken (Gallus Gallus)
  misc_feature (36): n=a or g
accagagggaatagacattaagaaagaaaagaatanttctctgaataaattgcacttgatttactagttca

SEQ ID NO: 11732 - DNA, 71 bp, chicken (Gallus Gallus)
  misc_feature (36): n=a or g
cctacagtgcaagaatttctttgcatcttggttctnaagcaaattttttactggttcatcctccatcttat

SEQ ID NO: 11733 - DNA, 71 bp, chicken (Gallus Gallus)
  misc_feature (36): n=a or g
gaaattatgaaggttactttaactgttcaagctacntgtttataaagtgcatatgtattaggatgcatgtt

SEQ ID NO: 11734 - DNA, 71 bp, chicken (Gallus Gallus)
  misc_feature (36): n=c or t
ttctgtgctgaatgttaataatgagtgctgataaangagtctttagtatccctacaaaaatgacattagca

SEQ ID NO: 11735 - DNA, 71 bp, chicken (Gallus Gallus)
  misc_feature (36): n=c or t
actcatatgaaaacggttgtttacacagtagtggtntatattctcaagtatccgtctgttaaaaaaataaa

SEQ ID NO: 11736 - DNA, 71 bp, chicken (Gallus Gallus)
  misc_feature (36): n=g or t
taagaagagtaaaggacaaataactacgtttcaggnagaacattatccatttactaatgagattacatcac

SEQ ID NO: 11737 - DNA, 71 bp, chicken (Gallus Gallus)
  misc_feature (36): n=c or t
caggacaaaaagcacttgttttatttggacttatcntgcctgacaagtaaaagttcgtaaattttgcagag

SEQ ID NO: 11738 - DNA, 71 bp, chicken (Gallus Gallus)
  misc_feature (36): n=c or g
ctgttattaaaggcaggactgaagaatatattaaancttaccgttttataaatgaaaaaaggctgctatac

SEQ ID NO: 11739 - DNA, 71 bp, chicken (Gallus Gallus)
  misc_feature (36): n=a or g
aatacagagaggctaaatgatttcctctgcacagcnatgtttgtgaagcggggcagatcatcagaaaaggc

SEQ ID NO: 11740 - DNA, 71 bp, chicken (Gallus Gallus)
  misc_feature (36): n=c or t
gcatccaagtctgtgacgtcccagtacaagaaaaangtggaactgttggaatgagtccagagcagaaccac

SEQ ID NO: 11741 - DNA, 71 bp, chicken (Gallus Gallus)
  misc_feature (36): n=c or t
cctcagaccttctggtagacccaggtctgcagaaanattcctgaaacataagcaacattactattttttct

SEQ ID NO: 11742 - DNA, 71 bp, chicken (Gallus Gallus)
  misc_feature (36): n=a or t
aagtctcagcatattgagatctataaatatgtgggntaactttggcaacgtccaaaataatgttatatcat

SEQ ID NO: 11743 - DNA, 71 bp, chicken (Gallus Gallus)
  misc_feature (36): n=a or c
aaggaggagaagtaagtaatttcttcagtagatgangaaactcttgaaaatgtttccacattattagagag

SEQ ID NO: 11744 - DNA, 71 bp, chicken (Gallus Gallus)
  misc_feature (36): n=g or t
ctgaaggtgacttaggacaggctgaagctacagatntggctcctttgggtgcatttcccattaggagcccc

SEQ ID NO: 11745 - DNA, 71 bp, chicken (Gallus Gallus)
  misc_feature (36): n=c or t
catttcgtaggtgagttgtttatttcatctaggaangtttctaagatgaacacttgaaatcaggagaacca

SEQ ID NO: 11746 - DNA, 71 bp, chicken (Gallus Gallus)
  misc_feature (36): n=a or g
gttcccatacaaatctttagctattcttcccactgnctgtgagccaaataatatatcataccccattccat

SEQ ID NO: 11747 - DNA, 71 bp, chicken (Gallus Gallus)
  misc_feature (36): n=a or g
aaatatgcagggttttaggctgaagcatagtgtgtnttgaacttcacatacttgctagagtaccagttttc

SEQ ID NO: 11748 - DNA, 71 bp, chicken (Gallus Gallus)
  misc_feature (36): n=a or g
tcagatcactcagtgctaacagcgttgtgtaggacntttccccacaacagtacaacaacgtgaccagatga

SEQ ID NO: 11749 - DNA, 71 bp, chicken (Gallus Gallus)
  misc_feature (36): n=a or t
actctcattgaaacgtttgaataatatatatatatntttcctttctataggcccaaatatgctatacattg

SEQ ID NO: 11750 - DNA, 71 bp, chicken (Gallus Gallus)
  misc_feature (36): n=g or t
ctttttttatgacattttcattgtaatttaaaagtntcatgtgtgtttttcttctgcgtgcccaagtggaa

SEQ ID NO: 11751 - DNA, 71 bp, chicken (Gallus Gallus)
  misc_feature (36): n=a or g
cctgcagaccagaagcattagaagcagtggtcatcntgcaccatctctgaatctatcaacagccccttgca

SEQ ID NO: 11752 - DNA, 71 bp, chicken (Gallus Gallus)
  misc_feature (36): n=a or g
tcttagcttatgaggctatgcccctatctagagatntcccgtctctccctgaaatgtgatctttgcctgta

SEQ ID NO: 11753 - DNA, 71 bp, chicken (Gallus Gallus)
  misc_feature (36): n=a or g
aattatttcagtttagttttgctgtaatcacacctngctgattctctgcactcagatcatctaacaagtaa

SEQ ID NO: 11754 - DNA, 71 bp, chicken (Gallus Gallus)
  misc_feature (36): n=a or c
caagagtagtttggctccatcatctttatttcttcncatcagatatgtaatacacacaggtaaaatcccca

SEQ ID NO: 11755 - DNA, 71 bp, chicken (Gallus Gallus)
  misc_feature (36): n=a or g
ttgctcttggatggtgccccacctgtttactgaatntgtctaccgagcagcaaattatttagaagggcaaa

SEQ ID NO: 11756 - DNA, 71 bp, chicken (Gallus Gallus)
  misc_feature (36): n=c or t
gttgccatacttttgttggattctaaagaagcaaanttaaatgtcaacttagatggctaactggcatttaa

SEQ ID NO: 11757 - DNA, 71 bp, chicken (Gallus Gallus)
  misc_feature (36): n=a or g
tggtagcatgattcattatcagaaattcagtcccanaaacaaatcaaatcatttatcatggccacttacca

SEQ ID NO: 11758 - DNA, 71 bp, chicken (Gallus Gallus)
  misc_feature (36): n=c or t
ctggtacaacttgaggccattccctctcatcctatntcatgtactcagtttatactaaacatgtttaaatg

SEQ ID NO: 11759 - DNA, 71 bp, chicken (Gallus Gallus)
  misc_feature (36): n=a or g
gaaaaaaactgggagacaagctctgatagcggtgtncctgcctttatatgtccacccatggaagggaatgc

SEQ ID NO: 11760 - DNA, 71 bp, chicken (Gallus Gallus)
  misc_feature (36): n=a or g
ccatctcctcctttattctgctcaggcacgtgcacnatctctctcttttccttccattttgtctcccagat

SEQ ID NO: 11761 - DNA, 71 bp, chicken (Gallus Gallus)
  misc_feature (36): n=a or g
tctcctgcactgtttctgactatcactgacattcantgttctgcatctaagctctctggcagtctcacagt

SEQ ID NO: 11762 - DNA, 71 bp, chicken (Gallus Gallus)
  misc_feature (36): n=c or t
cactaacacgtatcgtcttgtatttctctaccttgntgaagttgactgtaacaaaaaagcacagctcctta

SEQ ID NO: 11763 - DNA, 71 bp, chicken (Gallus Gallus)
  misc_feature (36): n=a or g
tacaatgatgatgtggtctgaaatgttaaattgcangtaaacctgaatttgtatggagggctgagaaatac

SEQ ID NO: 11764 - DNA, 71 bp, chicken (Gallus Gallus)
  misc_feature (36): n=a or g
tggcttctattttctgttctgtatggccacttgcangccatagaatatcctgagttgaaagggactcataa

SEQ ID NO: 11765 - DNA, 71 bp, chicken (Gallus Gallus)
  misc_feature (36): n=a or g
tgacagcttgatccatatgccatcctcaatggcatncccctaggactgtcgggtttgagcttactggaaaa

SEQ ID NO: 11766 - DNA, 71 bp, chicken (Gallus Gallus)
  misc_feature (36): n=a or t
tttttaactcagtaaagtctttgtttccttgccttntcttcctaaggaatccaaccacagattttaagggt

SEQ ID NO: 11767 - DNA, 71 bp, chicken (Gallus Gallus)
  misc_feature (36): n=a or g
gatgaatgaatggaaatagcagtgattttgctgtangtttttaatcagtaaaatgtattttagagagtcat

SEQ ID NO: 11768 - DNA, 71 bp, chicken (Gallus Gallus)
  misc_feature (36): n=a or g
gtgctagcacctgcttggttgctgcttgtgttacantatgttggcatggtgcaagtggctgatacccaact

SEQ ID NO: 11769 - DNA, 71 bp, chicken (Gallus Gallus)
  misc_feature (36): n=g or t
aaacagttggatgcaagttctcctgtggaaagaaanaaagaattggaaaatcttttcagaattggtgatag

SEQ ID NO: 11770 - DNA, 71 bp, chicken (Gallus Gallus)
  misc_feature (36): n=a or c
ctgaaatatcctctgatgctcggatgttagaagtanagttaggttatcttgaatgctattccctgcctggc

SEQ ID NO: 11771 - DNA, 71 bp, chicken (Gallus Gallus)
  misc_feature (36): n=a or g
atgacagtgctatggaaatagcattggaggaaagtnaaaatgaaactctgtagggattttgtggatttctc

SEQ ID NO: 11772 - DNA, 71 bp, chicken (Gallus Gallus)
  misc_feature (36): n=c or t
cactccaggagggcagaagttgaattaacacgctgngctcttgacacatgcatatgtatacacttacttgc

SEQ ID NO: 11773 - DNA, 71 bp, chicken (Gallus Gallus)
  misc_feature (36): n=a or g
ggttgcttattacagctctacccacgggaccttgcntgcattgccaccatgctgacatttgaatacatcag

SEQ ID NO: 11774 - DNA, 71 bp, chicken (Gallus Gallus)
  misc_feature (36): n=a or g
caaggctcacaaaattttgtctcacagagatgaagnacaacatcttccttctgttctccattctcccagta

SEQ ID NO: 11775 - DNA, 71 bp, chicken (Gallus Gallus)
  misc_feature (36): n=c or t
cagctttgtatactgtgtgttgggaggctcagtgantgcaccactgcactgcagccctgtatgctatggac

SEQ ID NO: 11776 - DNA, 71 bp, chicken (Gallus Gallus)
  misc_feature (36): n=c or t
ctgagcttcagagtttctcaaagtaagcaccaaagngtttttcaggtctcccacatgctatcatgtataag

SEQ ID NO: 11777 - DNA, 71 bp, chicken (Gallus Gallus)
  misc_feature (36): n=a or g
cttgtatcacctgcacaaagacaggcacagcttttncatcccctgattgtttttggatggaaatgataaat

SEQ ID NO: 11778 - DNA, 71 bp, chicken (Gallus Gallus)
  misc_feature (36): n=a or g
tataaccattgctacagcttaactcaacacccacanctgaaaaccactgagagccagaatacaccaaatat

SEQ ID NO: 11779 - DNA, 71 bp, chicken (Gallus Gallus)
  misc_feature (36): n=a or g
ttatctccacaggtgcagattgatcacttaaagccnagtctaccgcttctcccacttgtcacatatagaga

SEQ ID NO: 11780 - DNA, 71 bp, chicken (Gallus Gallus)
  misc_feature (36): n=a or c
aggctttcattgggcaggaagtggcatcttttacantaggatgtatttttatgtataatttaggccggcat

SEQ ID NO: 11781 - DNA, 71 bp, chicken (Gallus Gallus)
  misc_feature (36): n=g or t
ggaaagaaattttgtcttctagaacacctgcagatncaaagaatgtttaaaaaaaaagatagaaagaaaga

SEQ ID NO: 11782 - DNA, 71 bp, chicken (Gallus Gallus)
  misc_feature (36): n=c or t
agtcagagccgtggtcagagaacagggtgaaaatangatattttctgaagcatcttgtgctgttaaggatg

SEQ ID NO: 11783 - DNA, 71 bp, chicken (Gallus Gallus)
  misc_feature (36): n=c or t
ccagtagtaatgcaaggaaaggcattgctttctctngtaggaactttttggaccagctgttggaacaacat

SEQ ID NO: 11784 - DNA, 71 bp, chicken (Gallus Gallus)
  misc_feature (36): n=c or t
ccctcctttcccgagcttggttttcagtttctgcangcggtctgcatgctggctttgggctccaggcacct

SEQ ID NO: 11785 - DNA, 71 bp, chicken (Gallus Gallus)
  misc_feature (36): n=c or t
acagtgcacctctgaatatctatggtcaagatcagngctttaatctccttacccataaggaaaataccttt

SEQ ID NO: 11786 - DNA, 71 bp, chicken (Gallus Gallus)
  misc_feature (36): n=a or g
ttttaacctactctgcagttaggccttcttgcacanagcagagcaattcttggtcgtgaattaccattgct

SEQ ID NO: 11787 - DNA, 71 bp, chicken (Gallus Gallus)
  misc_feature (36): n=g or t
cttgtgagcagagttcccttcttccaggcaatcctnaccagcagagtctgagcacttggaggcactttaag

SEQ ID NO: 11788 - DNA, 71 bp, chicken (Gallus Gallus)
  misc_feature (36): n=c or t
cagcatttcaaaggtcttaaggaagaaaagctcttnaaaagtgaccttgtagaaggaaagaagcagggcag

SEQ ID NO: 11789 - DNA, 71 bp, chicken (Gallus Gallus)
  misc_feature (36): n=a or g
ttccagggattgcctgcattaaacttaatggtaagntggtttcattgagtgagaagctatgcaagatcttt

SEQ ID NO: 11790 - DNA, 71 bp, chicken (Gallus Gallus)
  misc_feature (36): n=c or t
tttatctgtatgcagtcctaggtgtgggggaaaaancgagtgagcagtcaccagtgagggtgatgggtgca

SEQ ID NO: 11791 - DNA, 71 bp, chicken (Gallus Gallus)
  misc_feature (36): n=c or g
cagctgttggagatttccatcacaccaggcctgcancacggagctacagagatcccccagtgcttggagcc

SEQ ID NO: 11792 - DNA, 71 bp, chicken (Gallus Gallus)
  misc_feature (36): n=c or t
caaggggaagcactgacaggtcatctggggagctgntaggagggcttggaggattctcagtaagcccattg

SEQ ID NO: 11793 - DNA, 71 bp, chicken (Gallus Gallus)
  misc_feature (36): n=g or t
tctcagctttgggaagtgcactgttcctgtctgtgnatattgttaattaacatttctctgcttgggcacgt

SEQ ID NO: 11794 - DNA, 71 bp, chicken (Gallus Gallus)
  misc_feature (36): n=a or g
ggctgtatctgcttttggtcagagaaggtccttggnctgcaaggactcttctggtggcaccggggcctgtc

SEQ ID NO: 11795 - DNA, 71 bp, chicken (Gallus Gallus)
  misc_feature (36): n=a or g
taatcctaaacactggaaaactgctctctcaatccntctttgcatacttttgtgtgtttctgggatggtag

SEQ ID NO: 11796 - DNA, 71 bp, chicken (Gallus Gallus)
  misc_feature (36): n=a or g
gaactttattaagattgagggtacatcccaccatgntgctgaacacatttgctctgtcctggctcagtgcc

SEQ ID NO: 11797 - DNA, 71 bp, chicken (Gallus Gallus)
  misc_feature (36): n=a or g
acaccacagctggggctgctcctggggctgcctatntttcccaaacccctgcaaaaagcagtacaagatat

SEQ ID NO: 11798 - DNA, 71 bp, chicken (Gallus Gallus)
  misc_feature (36): n=c or t
ttgtgcccatgaaattcagtgctcatgtgttaaaangtttacctgcaatcttctgctcaggtgcagagaca

SEQ ID NO: 11799 - DNA, 71 bp, chicken (Gallus Gallus)
  misc_feature (36): n=a or c
tcaactattctcctgaaagagccaataaacatgcgngtctcctgtaataaatgggtcgtgtgcttatttgt

SEQ ID NO: 11800 - DNA, 71 bp, chicken (Gallus Gallus)
  misc_feature (36): n=c or t
tgctgatacatctgctgtgccccagcctggccttgnaaattctatgctgcagcccatcagcaagcagtaaa

SEQ ID NO: 11801 - DNA, 71 bp, chicken (Gallus Gallus)
  misc_feature (36): n=a or g
cctacagatcttcataaatgcagcttgtatgctgancagcttattgacaagctcactgtttcttagtgatg

SEQ ID NO: 11802 - DNA, 71 bp, chicken (Gallus Gallus)
  misc_feature (36): n=c or t
catggtggcaatgggttggtgttggactagacaatngtggaggtcttttccaaccttcatgattctaccac

SEQ ID NO: 11803 - DNA, 71 bp, chicken (Gallus Gallus)
  misc_feature (36): n=a or g
gctgcaccagaggaatctggtcatgtggctgcccancagattaatgaacctttgtgcttttcagtctcccg

SEQ ID NO: 11804 - DNA, 71 bp, chicken (Gallus Gallus)
  misc_feature (36): n=c or g
tgaagtgtgccacaaggtaacaaaggaattgaccgntattccccattctgttcagaagcacttggaatgac

SEQ ID NO: 11805 - DNA, 71 bp, chicken (Gallus Gallus)
  misc_feature (36): n=c or t
cccacagtctatcacagtatttgtcatgaaaatctnttgttctaagtctgctatcatggtacctgcagaga

SEQ ID NO: 11806 - DNA, 71 bp, chicken (Gallus Gallus)
  misc_feature (36): n=c or t
tcatattgctacacaaagctgtgattcaaagacctntatgaaccctgcctgcatggcacaaagtccattcc

SEQ ID NO: 11807 - DNA, 71 bp, chicken (Gallus Gallus)
  misc_feature (36): n=a or c
taagggtattaacaaagacttgctgcaaccacagtngctctcttcatagaggatcaataatccccctttta

SEQ ID NO: 11808 - DNA, 71 bp, chicken (Gallus Gallus)
  misc_feature (36): n=c or t
cagctttcacctaactcgcggcatacctgtcagaanattcaagaggaaagccctccgcacttaaagcaaat

SEQ ID NO: 11809 - DNA, 71 bp, chicken (Gallus Gallus)
  misc_feature (36): n=c or t
agtggaaatggagaactggacttgaaaaatagcagngccagtcctagtgtgtagccatgctaagctgtctc

SEQ ID NO: 11810 - DNA, 71 bp, chicken (Gallus Gallus)
  misc_feature (36): n=g or t
tctcaccgaagtcattttacatgctgcaaaagaatnacctggcatggagacacaagcctctgaaaggttac

SEQ ID NO: 11811 - DNA, 71 bp, chicken (Gallus Gallus)
  misc_feature (36): n=a or t
agagcagctcagactcatggtgaatccatggcacangtcaaactattcacccatacatccaggagagccca

SEQ ID NO: 11812 - DNA, 71 bp, chicken (Gallus Gallus)
  misc_feature (36): n=c or t
catgtaagccttcctagccgctcctgcttaatgttntacacagacactaatgcacgctagcaacaactcat

SEQ ID NO: 11813 - DNA, 71 bp, chicken (Gallus Gallus)
  misc_feature (36): n=c or t
ccattgttctggctcctggtttaagcgctcatcccngggtacccgctggcagggaacgaagttactccgga

SEQ ID NO: 11814 - DNA, 71 bp, chicken (Gallus Gallus)
  misc_feature (36): n=c or t
gctgtgacctccttaatgcttttccactctaacttntttgtgctgtcatcaactaacctggaaatgttcag

SEQ ID NO: 11815 - DNA, 71 bp, chicken (Gallus Gallus)
  misc_feature (36): n=c or t
gctaagacatacgttctcttaaaagcatatattaangaaaacgtttttttacttggcatgagtaaccactg

SEQ ID NO: 11816 - DNA, 71 bp, chicken (Gallus Gallus)
  misc_feature (36): n=c or t
cttctccacttcagtgctgtatgcaattaattcagnatttctaaagttaattacattcttctgcaagtctc

SEQ ID NO: 11817 - DNA, 71 bp, chicken (Gallus Gallus)
  misc_feature (36): n=a or g
aaagctgagtatctcctgtttggggtgtgaaaaganctagttttgctgtgagttgtgttcatgggcgtggg

SEQ ID NO: 11818 - DNA, 71 bp, chicken (Gallus Gallus)
  misc_feature (36): n=a or g
cttctgcctgtttattgccaatgtgaagtacaaacnaagtggcttcctggcagtgactgagcaccagaatg

SEQ ID NO: 11819 - DNA, 71 bp, chicken (Gallus Gallus)
  misc_feature (36): n=a or g
tccttaagaattctctgccattctcccatggtagcnttcatcacctgcctggtcctggcttctttttctcc

SEQ ID NO: 11820 - DNA, 71 bp, chicken (Gallus Gallus)
  misc_feature (36): n=c or t
accttgcatggaagtttgttgaaattccactgaaanaggaacattgtgcaacatgtggctacagttcccta

SEQ ID NO: 11821 - DNA, 71 bp, chicken (Gallus Gallus)
  misc_feature (36): n=c or t
tccttctttagctatattttcttttttcctcagatncgagatattgtaaaggttggttggtgaggggagtg

SEQ ID NO: 11822 - DNA, 71 bp, chicken (Gallus Gallus)
  misc_feature (36): n=c or t
gctcctctttccagccccctcagttgtcccctgctnacgtcccctgggtgattgctgtctttatgtcagga

SEQ ID NO: 11823 - DNA, 71 bp, chicken (Gallus Gallus)
  misc_feature (36): n=a or g
aaatattccttgctgaggagtttcatagcttattcncatgctctgtgtttgttttggatcactgtttgtta

SEQ ID NO: 11824 - DNA, 71 bp, chicken (Gallus Gallus)
  misc_feature (36): n=a or c
gtaagaacaagccatatagctacaagccgtgtatcntctccattacacaaccaccttattctttgctcacc

SEQ ID NO: 11825 - DNA, 71 bp, chicken (Gallus Gallus)
  misc_feature (36): n=a or g
gctctccctccttttcagatgtgagtggcaactctnaagttgcttcatcctgtggttatatgaagccagca

SEQ ID NO: 11826 - DNA, 71 bp, chicken (Gallus Gallus)
  misc_feature (36): n=a or g
cccaccttccacctacagaaagcctcactgtggaancagttaacaacgaatgcacagaaaactacacaagt

SEQ ID NO: 11827 - DNA, 71 bp, chicken (Gallus Gallus)
  misc_feature (36): n=c or t
ggtgatttttggtgtgtccactcctggatggctgcngacaagctggatttcatcttcctctcccaccccct

SEQ ID NO: 11828 - DNA, 71 bp, chicken (Gallus Gallus)
  misc_feature (36): n=c or t
ttgtgggcagggatgctgaggttggcctctgacagngttagcaagtttgggtcacactcgctgtttctaaa

SEQ ID NO: 11829 - DNA, 71 bp, chicken (Gallus Gallus)
  misc_feature (36): n=a or g
gacagtcaattagtccttttcttctgcagggcaatngaaataactgtggcattctcagtgtgacactgtgc

SEQ ID NO: 11830 - DNA, 71 bp, chicken (Gallus Gallus)
  misc_feature (36): n=c or t
aggtttgaaaaatacgatgctgaggcacacatttancccacgtcccaccacctctgatttactgtagaggt

SEQ ID NO: 11831 - DNA, 71 bp, chicken (Gallus Gallus)
  misc_feature (36): n=a or t
aaaagttagtttgacctcaacggaaagaattaaaangtctaaacaaatttttagatcaaacgtactgtcaa

SEQ ID NO: 11832 - DNA, 71 bp, chicken (Gallus Gallus)
  misc_feature (36): n=a or t
acactttcaaaactgtctttacatggcgaagtgaantattaccactgaaaacaacaacaccttccagaaga

SEQ ID NO: 11833 - DNA, 71 bp, chicken (Gallus Gallus)
  misc_feature (36): n=a or c
acctggtactaaagacaatagtaattaattcagcanatatgtcttgaattaagcaaggatcctgtcttaca

SEQ ID NO: 11834 - DNA, 71 bp, chicken (Gallus Gallus)
  misc_feature (36): n=a or g
tgttctatttaaaaacaaacaaacaaacaaacaaanaacccaagaaataaagctgttgcctctagttacaa

SEQ ID NO: 11835 - DNA, 71 bp, chicken (Gallus Gallus)
  misc_feature (36): n=a or g
tgtactaaattccagctggtctgaaagcacagaagngcctgcactaatccaagaagctccccaaagaggtg

SEQ ID NO: 11836 - DNA, 71 bp, chicken (Gallus Gallus)
  misc_feature (36): n=a or g
agagaactaagttgtgtgtgtgctacctctgctgcntatggtgttttggagcattgttttctcattagagt

SEQ ID NO: 11837 - DNA, 71 bp, chicken (Gallus Gallus)
  misc_feature (36): n=a or g
aacaatgagggctcagcaggaagccagagttcaccnggccctaacattaaagtgttactttcaaggcaaca

SEQ ID NO: 11838 - DNA, 71 bp, chicken (Gallus Gallus)
  misc_feature (36): n=a or g
tccccttcaaaaaagtcactgcatctgagacaggantctgtgaacacttatcaaataaaaagatgaggtaa

SEQ ID NO: 11839 - DNA, 71 bp, chicken (Gallus Gallus)
  misc_feature (36): n=a or t
ctcaggctgctcaaggtgggccaagatgatgcaggnatttccaaaggtcctatggagaaggtgagcaattc

SEQ ID NO: 11840 - DNA, 71 bp, chicken (Gallus Gallus)
  misc_feature (36): n=c or t
gtgtattcttcttttatggacgtggctttcttaaangtgaaatgcaactggtgccctttggtgcttttaat

SEQ ID NO: 11841 - DNA, 71 bp, chicken (Gallus Gallus)
  misc_feature (36): n=c or t
ctgagtcaaacctagagacaatgtccttttgtacangtttcagatggagactgaagtttgctcttctgcat

SEQ ID NO: 11842 - DNA, 71 bp, chicken (Gallus Gallus)
  misc_feature (36): n=a or g
atccccacaaagatgtctctaagaatgagctgtccntaagagttctctctgtggaattaaggtctgctgaa

SEQ ID NO: 11843 - DNA, 71 bp, chicken (Gallus Gallus)
  misc_feature (36): n=c or t
tctttcatcactttcctatttttatcagatgtcccngtgtcctcgaattatgtggcagagcagatacaagt

SEQ ID NO: 11844 - DNA, 71 bp, chicken (Gallus Gallus)
  misc_feature (36): n=c or t
catgtgaaacaaatgaagaaacaggtgagagcgaangtttggttgccaaacttggccgcagataaaacatg

SEQ ID NO: 11845 - DNA, 71 bp, chicken (Gallus Gallus)
  misc_feature (36): n=c or t
tcacctctttccaacaccagttatggtgtgagaggntcctgtccaccacactgtaggggtgctcacactta

SEQ ID NO: 11846 - DNA, 71 bp, chicken (Gallus Gallus)
  misc_feature (36): n=c or t
gacattggcaaggttcttttgttagagatgtgaacngttttgaaatgcaccaaaagctgttttttagagcc

SEQ ID NO: 11847 - DNA, 71 bp, chicken (Gallus Gallus)
  misc_feature (36): n=c or t
aaactgacttctctcagtcctcagtgacaccttcanagtcatcaaagttgagctggtttccaccagcctga

SEQ ID NO: 11848 - DNA, 71 bp, chicken (Gallus Gallus)
  misc_feature (36): n=a or c
actgcagccccagctgtgtcgggggcacagggcagntaaggtttctcaccatgagttattcaggacagact

SEQ ID NO: 11849 - DNA, 71 bp, chicken (Gallus Gallus)
  misc_feature (36): n=c or t
atgggccaattgttggagcaagaactgctgccccanaccctcaacaattgtctgagcccagaagacctcgg

SEQ ID NO: 11850 - DNA, 71 bp, chicken (Gallus Gallus)
  misc_feature (36): n=g or t
agttaaaaaaatgttctctttctatctggaaagttngcttaagggaaaaaatccacccagaatttcaattt

SEQ ID NO: 11851 - DNA, 71 bp, chicken (Gallus Gallus)
  misc_feature (36): n=a or g
ttgacagaagatgccagggacagacttctctccttntctagcacttggctgaactgagcctctttgataaa

SEQ ID NO: 11852 - DNA, 71 bp, chicken (Gallus Gallus)
  misc_feature (36): n=a or g
gcaaggagaccagagctgcttggatgtgagctttgngaaaagtgatgtaccccaaagatacctgcttaatg

SEQ ID NO: 11853 - DNA, 71 bp, chicken (Gallus Gallus)
  misc_feature (36): n=c or g
tagaaacccagtctaagggtcccccctcccagaatnatgttctcctggatttgagagcaaatgccaaggca

SEQ ID NO: 11854 - DNA, 71 bp, chicken (Gallus Gallus)
  misc_feature (36): n=a or g
tgaacttatacatcaccattaaggctgcaaagtcangcagcaagaggaggaattaccagaataaaggctgt

SEQ ID NO: 11855 - DNA, 71 bp, chicken (Gallus Gallus)
  misc_feature (36): n=c or t
acatcatcacctcccagttaccttttctcttctgcntgttttatcactctgctttttctcttctctgattt

SEQ ID NO: 11856 - DNA, 71 bp, chicken (Gallus Gallus)
  misc_feature (36): n=a or g
agcactgtttcaaacctttatgctgggataggtganggatacaggctgtacctcactcagccactgtagag

SEQ ID NO: 11857 - DNA, 71 bp, chicken (Gallus Gallus)
  misc_feature (36): n=a or g
ctctgctgttacactggcactatagcccacagcacnctgataagaaagcacacaaggaaaaccatcgtcag

SEQ ID NO: 11858 - DNA, 71 bp, chicken (Gallus Gallus)
  misc_feature (36): n=a or c
tccctctttcccaaagcaggctggttatatcaacantcacacttgccctcccctctctgaacacttactgc

SEQ ID NO: 11859 - DNA, 71 bp, chicken (Gallus Gallus)
  misc_feature (36): n=c or t
gcatatcctcaaggtatgtagaacgcagaattaacnggtatcagcttaagcatgagaaactagcaaaacac

SEQ ID NO: 11860 - DNA, 71 bp, chicken (Gallus Gallus)
  misc_feature (36): n=a or g
caagtctgacttagtaccaaaactgtcaagaaggcntgctctgttctgatgagatggcaaacagtaaagca

SEQ ID NO: 11861 - DNA, 71 bp, chicken (Gallus Gallus)
  misc_feature (36): n=c or g
gctccccttaacgatcactgataacatgggctttgntttgataaagaaattacttttaatcgaaacatcac

SEQ ID NO: 11862 - DNA, 71 bp, chicken (Gallus Gallus)
  misc_feature (36): n=a or c
ctagaaacgctccctgtcccagcagctttcactctntacaaagggctagaaataaaatattcagatggaag

SEQ ID NO: 11863 - DNA, 71 bp, chicken (Gallus Gallus)
  misc_feature (36): n=a or g
ctatttattttatcctcagtgagaaagagcagttancatgccatctcaagaactgccttacagtgcagctc

SEQ ID NO: 11864 - DNA, 71 bp, chicken (Gallus Gallus)
  misc_feature (36): n=c or t
gaaaaacaaaagatgaacttgaagagggagctttanagcatcaataatttccaggtatccaggtatctatc

SEQ ID NO: 11865 - DNA, 71 bp, chicken (Gallus Gallus)
  misc_feature (36): n=a or g
acaagcggtgcagagctctgctgggtatatgcacantcaccgggtcacttagggtaaaaatcctgactcac

SEQ ID NO: 11866 - DNA, 71 bp, chicken (Gallus Gallus)
  misc_feature (36): n=a or t
tttttttcccctttagtacttcaaggtcattacacngcacagaaagtaataatcacttatcaggctctcca

SEQ ID NO: 11867 - DNA, 71 bp, chicken (Gallus Gallus)
  misc_feature (36): n=c or t
agaaggagaaaaataatctgtacgaaatctgtacgngcatacaaaataaataaataaatagctgattatat

SEQ ID NO: 11868 - DNA, 71 bp, chicken (Gallus Gallus)
  misc_feature (36): n=c or t
gatcctgaatgctgtggacattatggagcactggtngtccttgctgattcacacagtatgcagtaggaaaa

SEQ ID NO: 11869 - DNA, 71 bp, chicken (Gallus Gallus)
  misc_feature (36): n=g or t
gttaacttcctaaagtccagatgtttataggaaacngtgctgttatcctctgctgcagtggtgaaactaaa

SEQ ID NO: 11870 - DNA, 71 bp, chicken (Gallus Gallus)
  misc_feature (36): n=a or g
agttcttcgctttcacaactgaaaacctcagcatcngtagcacagactgatcttactgtatggtatgtttt

SEQ ID NO: 11871 - DNA, 71 bp, chicken (Gallus Gallus)
  misc_feature (36): n=c or t
tttttgagaaatcatattttatttttgacattctcngtctatttttcctgcccgtcacccctgctttctct

SEQ ID NO: 11872 - DNA, 71 bp, chicken (Gallus Gallus)
  misc_feature (36): n=a or c
ctaacctgcatttggatctcaagtgtgcgtatctgnatgctataccaaatggctcctccagttcttctcta

SEQ ID NO: 11873 - DNA, 71 bp, chicken (Gallus Gallus)
  misc_feature (36): n=a or g
tgaaaataagggagcaaaaagaactaaggcaggagnagacaaagttattgcagattttgtgagtaaattcc

SEQ ID NO: 11874 - DNA, 71 bp, chicken (Gallus Gallus)
  misc_feature (36): n=a or g
taatgaagctgggcacaaggtagcaatactggaatncgtcagctgaaattaagtctgcactcttgtgctct

SEQ ID NO: 11875 - DNA, 71 bp, chicken (Gallus Gallus)
  misc_feature (36): n=c or t
atattcagcttacacaaattatatgaacaagacttngcctaaagtaattagattttaatacattatattta

SEQ ID NO: 11876 - DNA, 71 bp, chicken (Gallus Gallus)
  misc_feature (36): n=c or g
tgcagatgaggagaaagtgtgcagacaaaactctanaaaggagtgttatattagagtgtgtaatggtaaaa

SEQ ID NO: 11877 - DNA, 71 bp, chicken (Gallus Gallus)
  misc_feature (36): n=c or t
gagatggacctctcagattacagagtttatatggtnggagcctctacaagctgactgcaggagatggtaaa

SEQ ID NO: 11878 - DNA, 71 bp, chicken (Gallus Gallus)
  misc_feature (36): n=c or t
tagaacatcctgcaaaactcctggtctaaaaaaacncaaaaaccagactttggtacattcttaaatgtacc

SEQ ID NO: 11879 - DNA, 71 bp, chicken (Gallus Gallus)
  misc_feature (36): n=c or t
cagcatccaggctgggaaatacagatgtggatcaanttttagaggagttacccagcagtgccattacaaca

SEQ ID NO: 11880 - DNA, 71 bp, chicken (Gallus Gallus)
  misc_feature (36): n=a or g
gaggcactgattaatgtacaataatggtacatctcnctggaaagataagcttatagaagatcaattaaaca

SEQ ID NO: 11881 - DNA, 71 bp, chicken (Gallus Gallus)
  misc_feature (36): n=c or t
ctgaggaagccccagatcaagctcctagcttggagnaaaactcagccaaatgctgaagcaggatctgatag

SEQ ID NO: 11882 - DNA, 71 bp, chicken (Gallus Gallus)
  misc_feature (36): n=c or g
ttccaacactccaaggttcttatttcccacatatancaggaattgaaaatatacatttccacctggtagca

SEQ ID NO: 11883 - DNA, 71 bp, chicken (Gallus Gallus)
  misc_feature (36): n=g or t
gcattgtaaccaatattaagtatagtttttaagtanttttttcaataatctaagatatcattggaaacaac

SEQ ID NO: 11884 - DNA, 71 bp, chicken (Gallus Gallus)
  misc_feature (36): n=g or t
gcacacagatgggagtaatgaaaaacaaaggagatnttaatggaaagaacataacagagtcctggagatgc

SEQ ID NO: 11885 - DNA, 71 bp, chicken (Gallus Gallus)
  misc_feature (36): n=c or t
gcccttctagtctaaggcttcctttgcccttcatanatatgaaaatgtgccatctaccatgaaacagccag

SEQ ID NO: 11886 - DNA, 71 bp, chicken (Gallus Gallus)
  misc_feature (36): n=c or t
aggcactgtcacaatgctgtagaagtaataatgcangtaaacaagtattccttaaataaaaatagttctaa

SEQ ID NO: 11887 - DNA, 71 bp, chicken (Gallus Gallus)
  misc_feature (36): n=c or t
gttattcttgtaacaactttcaggcaactcaccatncaaatcaaagtctctttttggggaaaaaagtgaat

SEQ ID NO: 11888 - DNA, 71 bp, chicken (Gallus Gallus)
  misc_feature (36): n=a or g
taaagccattttttgtactgtagtctgtgtgtaatntgtgagataattctacaattttaatgctagaaata

SEQ ID NO: 11889 - DNA, 71 bp, chicken (Gallus Gallus)
  misc_feature (36): n=c or g
acagtgaggatggtcaaacccagagcagaagctttncaagtaaagttcccactcttggagatttcaaaacc

SEQ ID NO: 11890 - DNA, 71 bp, chicken (Gallus Gallus)
  misc_feature (36): n=a or g
attaacgtaagcagtctgaataccaggactattctnaagtgtcaaacgccttcaatgcatgtttagtttat

SEQ ID NO: 11891 - DNA, 71 bp, chicken (Gallus Gallus)
  misc_feature (36): n=a or g
taacattaaaattgtctttatatacaattacgaacntatagtttgcagatgaaatacaactgacgttatct

SEQ ID NO: 11892 - DNA, 71 bp, chicken (Gallus Gallus)
  misc_feature (36): n=c or t
caggatgcaggattccatacagcatacagtgtcctnccatacagaagggcactgaatttaagctagtcact

SEQ ID NO: 11893 - DNA, 71 bp, chicken (Gallus Gallus)
  misc_feature (36): n=a or c
gaaagatgcaaagcagaagcaaggcaactacttgtntttctctttaggaaagagacctttatgtaatacag

SEQ ID NO: 11894 - DNA, 71 bp, chicken (Gallus Gallus)
  misc_feature (36): n=c or g
tttgtttcttacataaataacacttcacgtggcttnttcagtaaataattacttcaattactactatacgt

SEQ ID NO: 11895 - DNA, 71 bp, chicken (Gallus Gallus)
  misc_feature (36): n=a or g
ttcatattattataaccataatcagaaaatctcatnctaataagatacaagatttaaatgcaaagaatgtg

SEQ ID NO: 11896 - DNA, 71 bp, chicken (Gallus Gallus)
  misc_feature (36): n=a or t
aatttatcttaaaaataagcagaactcatctcctcnacgaaacaagtataaaccgtaaaggtaacacccac

SEQ ID NO: 11897 - DNA, 71 bp, chicken (Gallus Gallus)
  misc_feature (36): n=c or t
aagaccaggtactttaaactatgggttattcttccntgatagaaagtattttcttttttttcctttgcact

SEQ ID NO: 11898 - DNA, 71 bp, chicken (Gallus Gallus)
  misc_feature (36): n=g or t
actatcagatatacaaaaagatgcaagattagagangaatttctctgccacaagcagaggtgtgctccaca

SEQ ID NO: 11899 - DNA, 71 bp, chicken (Gallus Gallus)
  misc_feature (36): n=a or t
ggagaaaaaggtggcaagtgagacgttttgctcaanctagtacagacgaggaacctggtgaaactgtttaa

SEQ ID NO: 11900 - DNA, 71 bp, chicken (Gallus Gallus)
  misc_feature (36): n=a or g
tcagaatgaccctgatatctcagactcataaacacntagatagaataaacagcaaaaattaaaagtttcta

SEQ ID NO: 11901 - DNA, 71 bp, chicken (Gallus Gallus)
  misc_feature (36): n=a or g
aattgtacaggatgactgaaactgttggacaccacnttgtcatcttacagttggcattcacatcaccacta

SEQ ID NO: 11902 - DNA, 71 bp, chicken (Gallus Gallus)
  misc_feature (36): n=a or g
gccctccgggagggggttttgctgccgatcggggcnattccttctattttacggtatcgttaccgctgcca

SEQ ID NO: 11903 - DNA, 71 bp, chicken (Gallus Gallus)
  misc_feature (36): n=c or t
aaggagaaaagtgagttccttgtcttttcttgtgancttctaatgataaccataatatggcattctctaaa

SEQ ID NO: 11904 - DNA, 71 bp, chicken (Gallus Gallus)
  misc_feature (36): n=a or g
cagtaattggaaaaaaaaattggaactaatatagcnttagcagccatcacttattttaccctttttccccc

SEQ ID NO: 11905 - DNA, 71 bp, chicken (Gallus Gallus)
  misc_feature (36): n=c or t
ctactaattgctcctcctcattcaaagctactcagnctacatggagctacagcaactacatgcactgaagc

SEQ ID NO: 11906 - DNA, 71 bp, chicken (Gallus Gallus)
  misc_feature (36): n=a or g
tcacacgttaactccagtttaatttattttactccngccacatacacactgaattgttttaatatttattt

SEQ ID NO: 11907 - DNA, 71 bp, chicken (Gallus Gallus)
  misc_feature (36): n=c or t
tccttgtggcctgggctcaggttttgagtcgtgtgncttgatctcagggacgcacacttcgtgtcagactg

SEQ ID NO: 11908 - DNA, 71 bp, chicken (Gallus Gallus)
  misc_feature (36): n=c or t
atgcgtttggcacatttttattagtagaactgggantggggaacaggcaattgaatcctataagagttcct

SEQ ID NO: 11909 - DNA, 71 bp, chicken (Gallus Gallus)
  misc_feature (36): n=a or g
tgatgttattgcaggaaaatataacataaaagaccngtatcatccttctcctcaatccttcactatacttt

SEQ ID NO: 11910 - DNA, 71 bp, chicken (Gallus Gallus)
  misc_feature (36): n=a or c
gcctcctgcagcaagcagcactgtgccaaacctatnttcaggggagagctgtcaccaaggcttctgaacag

SEQ ID NO: 11911 - DNA, 71 bp, chicken (Gallus Gallus)
  misc_feature (36): n=a or t
tacagtgatacttgcctgggtttataagaaggaganttaaactaaaacaaagtgctgcccaaaactgtagt

SEQ ID NO: 11912 - DNA, 71 bp, chicken (Gallus Gallus)
  misc_feature (36): n=c or t
aagagaaataaacgccagtccgagtcaaacttcganacagaacacagagcagctgctgctgaagaggtgaa

SEQ ID NO: 11913 - DNA, 71 bp, chicken (Gallus Gallus)
  misc_feature (36): n=a or t
caactctttaatgagaatgaaacaaaagtacaaaanttataaatttcacttgcttgcttcccccccccccc

SEQ ID NO: 11914 - DNA, 71 bp, chicken (Gallus Gallus)
  misc_feature (36): n=a or g
aaataggaattacagaacacaattaaaaggtactcngaagattgctaaataactaaactcacaatctgagc

SEQ ID NO: 11915 - DNA, 71 bp, chicken (Gallus Gallus)
  misc_feature (36): n=a or g
gagcaaacaggcaccagtttgcaaaactgactggcntttttcctacaagctgaacttcgttgaaagaatct

SEQ ID NO: 11916 - DNA, 71 bp, chicken (Gallus Gallus)
  misc_feature (36): n=a or g
attaccagttcttccatgtcatcaaagaaaaaggcnttccatccatctaccattctctgtggaatctgctt

SEQ ID NO: 11917 - DNA, 71 bp, chicken (Gallus Gallus)
  misc_feature (36): n=a or g
cctttttggtttaaaacatcactgtcatctgcatcnctcatatgtgacagaacacattatctacaccaagt

SEQ ID NO: 11918 - DNA, 71 bp, chicken (Gallus Gallus)
  misc_feature (36): n=c or t
agaaatggaaaagaatgtatccacggcctaacccanaacacagctttgctccaatgggagctccaggtggg

SEQ ID NO: 11919 - DNA, 71 bp, chicken (Gallus Gallus)
  misc_feature (36): n=c or t
tttctaaatattgctccaccaggaaaagcgtgtganctgattgacagaggagacaatacctacgggggaaa

SEQ ID NO: 11920 - DNA, 71 bp, chicken (Gallus Gallus)
  misc_feature (36): n=a or g
caagaattaaattatactgcaggttaatcacaccanaactctggaaatagggagtttaaccctttgtcagt

SEQ ID NO: 11921 - DNA, 71 bp, chicken (Gallus Gallus)
  misc_feature (36): n=c or t
gcaagcgctccaataacaccgcagatgtttgcaaangctggcaaagaacatatggagaaatacggtatagt

SEQ ID NO: 11922 - DNA, 71 bp, chicken (Gallus Gallus)
  misc_feature (36): n=c or t
caagcccatatgtgacccagctcacagcccttcagngagtacttcaaagcccggttcatgtccttagggac

SEQ ID NO: 11923 - DNA, 71 bp, chicken (Gallus Gallus)
  misc_feature (36): n=a or c
tctgcatgcaggaggcagacttggaggaaactctangttcagtgagttgaatattccctatcctccaatat

SEQ ID NO: 11924 - DNA, 71 bp, chicken (Gallus Gallus)
  misc_feature (36): n=c or t
tccaccccttgttactaaccattaatcaaaccaacngattaaattaaatcaagtctgaaaagaaagcatga

SEQ ID NO: 11925 - DNA, 71 bp, chicken (Gallus Gallus)
  misc_feature (36): n=c or t
tcttctgtcagctgtgtcactcccctcccacagctngtgtccagctgccttttgtttctttctaattgcca

SEQ ID NO: 11926 - DNA, 71 bp, chicken (Gallus Gallus)
  misc_feature (36): n=c or t
ttttcctgggaagagaggacctagaattcatattancacttgcctctgatttgtatcgcatgtgttgaaga

SEQ ID NO: 11927 - DNA, 71 bp, chicken (Gallus Gallus)
  misc_feature (36): n=a or g
agtcatgcacaccaacacagagaaggaacgttaccncattgtttttctgtgcagggcagagggggtgacat

SEQ ID NO: 11928 - DNA, 71 bp, chicken (Gallus Gallus)
  misc_feature (36): n=g or t
ggcacaggcagggagcagttaattaatatatcagcnctctgtcattttcctccttctctttttcaagtcca

SEQ ID NO: 11929 - DNA, 71 bp, chicken (Gallus Gallus)
  misc_feature (36): n=a or g
ttataaggagactatgtatggaacctatttaattcncagcatttctgataggtaggatacatcattatgat

SEQ ID NO: 11930 - DNA, 71 bp, chicken (Gallus Gallus)
  misc_feature (36): n=a or g
cacagcagtactaaataattccattctatcctatgncagcgactttcaaagatgttgtgaatactcacata

SEQ ID NO: 11931 - DNA, 71 bp, chicken (Gallus Gallus)
  misc_feature (36): n=c or t
tgctggccaaggaaacttcatcctcagagcctgcanatcagcactgccctcaacacatccatccacatcta

SEQ ID NO: 11932 - DNA, 71 bp, chicken (Gallus Gallus)
  misc_feature (36): n=c or t
aattcaaatcacattttctggagataagtgtcacancctcagctgccaatgagcagcaagctggacagcag

SEQ ID NO: 11933 - DNA, 71 bp, chicken (Gallus Gallus)
  misc_feature (36): n=a or g
cagtttggaaggcaccacctttgaagccttattcangcgtattgaaagccgttgtttgtctacattaatca

SEQ ID NO: 11934 - DNA, 71 bp, chicken (Gallus Gallus)
  misc_feature (36): n=a or g
tgattctgagctgtgcaaacctttgaaccaacagcngactcctgaatatgtaattatatccctgttggata

SEQ ID NO: 11935 - DNA, 71 bp, chicken (Gallus Gallus)
  misc_feature (36): n=a or g
ttcaaaggcataatacaacaagcaggcttttaagcnaactacagcaaaaagaaaaaaaagtactgctacag

SEQ ID NO: 11936 - DNA, 71 bp, chicken (Gallus Gallus)
  misc_feature (36): n=c or t
tagctcagaacacgcacctcgcgtatgacaaaaacnggccacagagacaaaaacatattttaacaactcaa

SEQ ID NO: 11937 - DNA, 71 bp, chicken (Gallus Gallus)
  misc_feature (36): n=a or c
tgggtgatttgtccaatctggaaaatagcagccagnaaaggggagggggaaggtaatatgggtaaagcata

SEQ ID NO: 11938 - DNA, 71 bp, chicken (Gallus Gallus)
  misc_feature (36): n=a or g
actgttcaggccggcagctgatgccacagtaaacgngagctttcaggtatactttgcgttctaggagccca

SEQ ID NO: 11939 - DNA, 71 bp, chicken (Gallus Gallus)
  misc_feature (36): n=c or t
agctggaagagtcatttccctcaacacaatcaactnggccaagcatgcagagcttgcccagctccacacgt

SEQ ID NO: 11940 - DNA, 71 bp, chicken (Gallus Gallus)
  misc_feature (36): n=g or t
cctttaagaacacaaatccttctcctttttagattntcagcatcccataaaacatcctacagatggattac

SEQ ID NO: 11941 - DNA, 71 bp, chicken (Gallus Gallus)
  misc_feature (36): n=c or t
tcaccatttcttagtaatttgactcctgatccttgnaagagatggaagttttcagctctgttgggttccta

SEQ ID NO: 11942 - DNA, 71 bp, chicken (Gallus Gallus)
  misc_feature (36): n=c or t
aaatcacagggagcctcagctggtgctgctatgcantgctacagctgctttaacctcagctcattgctgtc

SEQ ID NO: 11943 - DNA, 71 bp, chicken (Gallus Gallus)
  misc_feature (36): n=c or t
gttatgagctcaggcaagtttaggaagggcgcatcntcagccacaattacaccttcatgtttttatcactg

SEQ ID NO: 11944 - DNA, 71 bp, chicken (Gallus Gallus)
  misc_feature (36): n=a or g
taacagtagtgcagatttaacaggggggaaaaaaantagagggataagctttccttggccacccatttgaa

SEQ ID NO: 11945 - DNA, 71 bp, chicken (Gallus Gallus)
  misc_feature (36): n=a or g
gaggtattgtctcatctttgatttgagctggatgtntctgtcttaagagctgcccatatctgcaggtggaa

SEQ ID NO: 11946 - DNA, 71 bp, chicken (Gallus Gallus)
  misc_feature (36): n=a or g
gtcccagtttgatctactgtcttttttagccatganctcactgctttcagtagcagtttttaagttttatt

SEQ ID NO: 11947 - DNA, 71 bp, chicken (Gallus Gallus)
  misc_feature (36): n=c or t
cgctggcacgctgccctgacatgtttaccagcaaangttcctccccgatggcttaaatgagaagatggcac

SEQ ID NO: 11948 - DNA, 71 bp, chicken (Gallus Gallus)
  misc_feature (36): n=c or t
ttcctttatttgcttgagttttttagaactgaatgntttgtaacaacagccaaaataagcatttgttattc

SEQ ID NO: 11949 - DNA, 71 bp, chicken (Gallus Gallus)
  misc_feature (36): n=a or g
atgtttgcagtaattgtaccattcagtttagagacnaattttactaattacactcaacttctctacaaata

SEQ ID NO: 11950 - DNA, 71 bp, chicken (Gallus Gallus)
  misc_feature (36): n=a or g
acgcaagcagtggtgaatacccaagtcagcagaacntagaatcatagaatcacataactatagaattgtat

SEQ ID NO: 11951 - DNA, 71 bp, chicken (Gallus Gallus)
  misc_feature (36): n=c or t
tgtactgctatttgcagatcttggtaaatctccatntgatgcaactctaatttcagtatcaatatagttgg

SEQ ID NO: 11952 - DNA, 71 bp, chicken (Gallus Gallus)
  misc_feature (36): n=c or t
ttcaggttactaatttatttgtggtataattactcnttctcataaattgagcatttatattactagctaca

SEQ ID NO: 11953 - DNA, 71 bp, chicken (Gallus Gallus)
  misc_feature (36): n=g or t
cctgaaagtcctgaagaaatgtatgcagtctgaatnttctgcccagacacaatttttgaatggagaaagaa

SEQ ID NO: 11954 - DNA, 71 bp, chicken (Gallus Gallus)
  misc_feature (36): n=c or t
aaagaaatattatttactgaatgctctggcaatgtngtggttaatacagacactactggtggggaattgcc

SEQ ID NO: 11955 - DNA, 71 bp, chicken (Gallus Gallus)
  misc_feature (36): n=c or t
gttactcggtaacttttcttgccagtgcttcagaangtggaactggagagagaaaacttctaactgcagtg

SEQ ID NO: 11956 - DNA, 71 bp, chicken (Gallus Gallus)
  misc_feature (36): n=c or t
aatacgggggtttcttaatagagcagttcttagatngaagagcaagctgctgtccaagttcacaatgggat

SEQ ID NO: 11957 - DNA, 71 bp, chicken (Gallus Gallus)
  misc_feature (36): n=a or t
gctttcacttgatttcaggtgattttatattctgcnctggacagttatgcctacaggaagctgccaggctc

SEQ ID NO: 11958 - DNA, 71 bp, chicken (Gallus Gallus)
  misc_feature (36): n=c or t
gtccaaggtcatgttgccttcccggaattacagtcnaaagctgcagccaggtcactgttcttatttcttta

SEQ ID NO: 11959 - DNA, 71 bp, chicken (Gallus Gallus)
  misc_feature (36): n=c or t
caacctacttttcagtttcaagcaaataagcaaganggggtgttgataaaaaggaaccctgtcttgtaaaa

SEQ ID NO: 11960 - DNA, 71 bp, chicken (Gallus Gallus)
  misc_feature (36): n=c or t
ttcttcatccaacatgaatgactccaagggtttctnggttgggcgtttcagttcaccatagaactgtttga

SEQ ID NO: 11961 - DNA, 71 bp, chicken (Gallus Gallus)
  misc_feature (36): n=g or t
agtgttttcaaagccctgatgaacagtataactganagcagtctgtcctctctcatccttcccatcaatgg

SEQ ID NO: 11962 - DNA, 71 bp, chicken (Gallus Gallus)
  misc_feature (36): n=g or t
tagttggctacactgcaggcttcccttccctttgcnctttgttgctattcacgttctgcctccagaacagg

SEQ ID NO: 11963 - DNA, 71 bp, chicken (Gallus Gallus)
  misc_feature (36): n=a or t
tgaaaagggaagatgttatattcattatattcagcngtgataaaatctaggagcagaacagcaagcttcat

SEQ ID NO: 11964 - DNA, 71 bp, chicken (Gallus Gallus)
  misc_feature (36): n=a or g
tggccataaagcactcgtcatgggtccagtccttcngcctgtcccaaagctgcctttcccaaagctgtgcc

SEQ ID NO: 11965 - DNA, 71 bp, chicken (Gallus Gallus)
  misc_feature (36): n=c or t
atacttgtgttttgttgttagttttatctctctctnctgcctctttaatcaaaagctatgaatttaaaggg

SEQ ID NO: 11966 - DNA, 71 bp, chicken (Gallus Gallus)
  misc_feature (36): n=a or g
agctactgtttgtcagcatattaacccattcatacncactacagtgcatgtgtctcgtgggtaagatcata

SEQ ID NO: 11967 - DNA, 71 bp, chicken (Gallus Gallus)
  misc_feature (36): n=a or g
ttaatattctgaagtcaagtaatgtattggtatagnaagacttaagtactctcaaagcagtggttaataga

SEQ ID NO: 11968 - DNA, 71 bp, chicken (Gallus Gallus)
  misc_feature (36): n=c or g
atagttttctctcacctatttggcaccaacgctgtnattaaaagatgttggactaggaattgagttagcca

SEQ ID NO: 11969 - DNA, 71 bp, chicken (Gallus Gallus)
  misc_feature (36): n=a or g
ggcttagaagagcacctggactggagggtttgagangcatgcttgggtctgtgctcttcagtatggcactg

SEQ ID NO: 11970 - DNA, 71 bp, chicken (Gallus Gallus)
  misc_feature (36): n=c or t
gccgcttcccttaacttcagagagaagttcagcatncaagatgagaaccaagcaaaactggtaaccacatg

SEQ ID NO: 11971 - DNA, 71 bp, chicken (Gallus Gallus)
  misc_feature (36): n=a or t
gtcacagtctccaggaagcaagaaagcacctcaccnttgctagctgctagtcccagctttattagaagcct

SEQ ID NO: 11972 - DNA, 71 bp, chicken (Gallus Gallus)
  misc_feature (36): n=a or g
tttaaaaagaaatctgtaatgctgtgtttttgtgcnaggacacatctgtaactccttaaggttctgaaaat

SEQ ID NO: 11973 - DNA, 71 bp, chicken (Gallus Gallus)
  misc_feature (36): n=c or t
cgttttgttaaatgtttgctggtgatcttgtagagngttctgtatcttttacacattaggagaccttccca

SEQ ID NO: 11974 - DNA, 71 bp, chicken (Gallus Gallus)
  misc_feature (36): n=a or c
aaagctcccaagtgtgcctggttaacaaaattgctncatgaactttacaggcttgctgtcccctgcaattt

SEQ ID NO: 11975 - DNA, 71 bp, chicken (Gallus Gallus)
  misc_feature (36): n=g or t
gctttgagtggcactcaagcaagcagcaaacaattnctccatcactgaagcatcatggaaaggtctcaccc

SEQ ID NO: 11976 - DNA, 71 bp, chicken (Gallus Gallus)
  misc_feature (36): n=c or t
aaaaaataacaaaatccatctcaagagtgtttcttnatcaaaaaaaaacttccctttttccataaagtatt

SEQ ID NO: 11977 - DNA, 71 bp, chicken (Gallus Gallus)
  misc_feature (36): n=a or g
ttacaggtttgtataaatggaaagattaccattgcngaaaaagataataaaaaatgaattctcacccatgt

SEQ ID NO: 11978 - DNA, 71 bp, chicken (Gallus Gallus)
  misc_feature (36): n=a or g
aaactgagagattttgcagtgctgcaaattgcttgnaggtgtttcgaatgccaggcgctgctttgcatgct

SEQ ID NO: 11979 - DNA, 71 bp, chicken (Gallus Gallus)
  misc_feature (36): n=a or g
aggaaattcaaaatggcttcacttcaggagaatagnaaaaaaaagaatttgcattctctgcccaaagtgcc

SEQ ID NO: 11980 - DNA, 71 bp, chicken (Gallus Gallus)
  misc_feature (36): n=a or g
cactagcaacaagagcagcatgattcctagcagctnctacaactcgttattgtttaattaagcagtgagta

SEQ ID NO: 11981 - DNA, 71 bp, chicken (Gallus Gallus)
  misc_feature (36): n=c or g
aagtagaaggttgggttatatctttttatttttctnagaactgttgttgtgatgtgactatgctaataaga

SEQ ID NO: 11982 - DNA, 71 bp, chicken (Gallus Gallus)
  misc_feature (36): n=a or g
tacgttctaattatttcaaatgccccgcatgacacnactgagataacactaagtggttgtagtttactttt

SEQ ID NO: 11983 - DNA, 71 bp, chicken (Gallus Gallus)
  misc_feature (36): n=c or t
tctgcctgtgtcaggtcatggcattcgtccttgttncaacttgctgggcagggatggctctgaagctcagt

SEQ ID NO: 11984 - DNA, 71 bp, chicken (Gallus Gallus)
  misc_feature (36): n=a or g
ttacgaagcaattaagacattttggcaatagctgangcgcagatttcctccctcttgatagatcgttcctg

SEQ ID NO: 11985 - DNA, 71 bp, chicken (Gallus Gallus)
  misc_feature (36): n=c or t
ggcaaaggagtgccaagttgtaactgtgattgcatngttcacagaatggccagcagccctgggagtaatgc

SEQ ID NO: 11986 - DNA, 71 bp, chicken (Gallus Gallus)
  misc_feature (36): n=a or g
ctgatacaaaacggatgtatgtgttcttattgcagngaaagtgccacgtttctcatctgtacttggtaatt

SEQ ID NO: 11987 - DNA, 71 bp, chicken (Gallus Gallus)
  misc_feature (36): n=g or t
ccctttcatctgaagtcccaagcttttgggaggtcntcccttgtggttttccacctcagggatgctgggtt

SEQ ID NO: 11988 - DNA, 71 bp, chicken (Gallus Gallus)
  misc_feature (36): n=c or t
agcctttctgtagagcgctgatgttgcttttttttncccatgttttgtctcttgtttgatttaggagatga

SEQ ID NO: 11989 - DNA, 71 bp, chicken (Gallus Gallus)
  misc_feature (36): n=c or t
gaaacagattatcttcacgctctccaagggtaactngtgtctggctggagaaaaaaaaagtcaggaattag

SEQ ID NO: 11990 - DNA, 71 bp, chicken (Gallus Gallus)
  misc_feature (36): n=a or g
tcagtggaaatagatatcagtttcatttcagtgcanaaataggccaagtaggtcctggcaatgagggcatg

SEQ ID NO: 11991 - DNA, 71 bp, chicken (Gallus Gallus)
  misc_feature (36): n=g or t
aagctcagagctgttgccactttgagctgtgcattnctgcactgatgccccagggctggctggggtgggtg

SEQ ID NO: 11992 - DNA, 71 bp, chicken (Gallus Gallus)
  misc_feature (36): n=a or g
tttatattttgacacaccattgaagtactgacagtntaaaaactgaattacatcttgctcataatcgtttc

SEQ ID NO: 11993 - DNA, 71 bp, chicken (Gallus Gallus)
  misc_feature (36): n=g or t
aaatagctaagtgtgattagactgggggagtaatgnaggcatttccaaaggaaacctacagaaattgcttt

SEQ ID NO: 11994 - DNA, 71 bp, chicken (Gallus Gallus)
  misc_feature (36): n=c or t
acacacctgcatttatgtgtctgtctgatcctcaangcaactgaaacagattatcttcacgctctccaagg

SEQ ID NO: 11995 - DNA, 71 bp, chicken (Gallus Gallus)
  misc_feature (36): n=a or g
gaattctgctaaatgagcaagtaattatatttctcngtgtggttcggtggatttattgttttggctgatgt

SEQ ID NO: 11996 - DNA, 71 bp, chicken (Gallus Gallus)
  misc_feature (36): n=a or g
tatgtctgtaataatatcagttgtctgcatctctgnaagctgccattaattaatttttaaaaaggtgaaat

SEQ ID NO: 11997 - DNA, 71 bp, chicken (Gallus Gallus)
  misc_feature (36): n=a or g
gctggctttcccccacaaggacccactttgggaacnccaatacgtgcaagttcctggtgtgacgcagagcg

SEQ ID NO: 11998 - DNA, 71 bp, chicken (Gallus Gallus)
  misc_feature (36): n=a or g
agttagttactgttttgagatgtgaaatactttagnaatccttgtgatgcttctaagcaaagctttctttg

SEQ ID NO: 11999 - DNA, 71 bp, chicken (Gallus Gallus)
  misc_feature (36): n=c or t
acatccatatgcctgtgtttcaacagagggcacttnattccaggagaggatttcacagcctgtccttgttt

SEQ ID NO: 12000 - DNA, 71 bp, chicken (Gallus Gallus)
  misc_feature (36): n=a or t
tacacatgcagttccagcattttccaaactggaaancagtcctctaatacttaatcaagccaaagccctag

SEQ ID NO: 12001 - DNA, 71 bp, chicken (Gallus Gallus)
  misc_feature (36): n=g or t
ctattacaatgtggatatgctcaagtaccaggtatngtgttctgtcaggttgaattctgccaaaagcatgt

SEQ ID NO: 12002 - DNA, 71 bp, chicken (Gallus Gallus)
  misc_feature (36): n=a or g
ttactcacactgaaaacttcacctcctgtattattngatgacaattggaggtagcaagcactatttttttc

SEQ ID NO: 12003 - DNA, 71 bp, chicken (Gallus Gallus)
  misc_feature (36): n=c or t
gttaatttatattatacccaatgctaaattacaaangtttgtttcaaaaaaaaaaaaaaaaaaaaaaaaaa

SEQ ID NO: 12004 - DNA, 71 bp, chicken (Gallus Gallus)
  misc_feature (36): n=c or t
ctactctaaattacccgagtcctcatcccagcgtgncataacgcaccgatacactgcttccttgaggctgg

SEQ ID NO: 12005 - DNA, 71 bp, chicken (Gallus Gallus)
  misc_feature (36): n=c or t
accccacatagggcacaagtttgctttgtacctcangtgttacaatgtaatttctgtgctttttttttttt

SEQ ID NO: 12006 - DNA, 71 bp, chicken (Gallus Gallus)
  misc_feature (36): n=a or g
gcatctgctgaaatttgtcagcaactcacactgccntgcagcacccacaccccccccggctccacgcctgc

SEQ ID NO: 12007 - DNA, 71 bp, chicken (Gallus Gallus)
  misc_feature (36): n=a or c
cagctgcttctgatgagtatttatgcacagtagagnagtccaaaaggaatgcctttcatcctgtccagaat

SEQ ID NO: 12008 - DNA, 71 bp, chicken (Gallus Gallus)
  misc_feature (36): n=a or g
acattggaggcacacaaaggaaccataagccaactngtgtccctacacacagacagtatacaccaacaagc

SEQ ID NO: 12009 - DNA, 71 bp, chicken (Gallus Gallus)
  misc_feature (36): n=c or t
actgtcttctcaaagcaaaaggcagtcatgacacangcaacattttgtcttatcttgaacaaaaagaagac

SEQ ID NO: 12010 - DNA, 71 bp, chicken (Gallus Gallus)
  misc_feature (36): n=c or t
gttggggtccccagggagcagggcgggttgaacagnccttccagcagcattatctctgctttttaagcaaa

SEQ ID NO: 12011 - DNA, 71 bp, chicken (Gallus Gallus)
  misc_feature (36): n=c or g
gtacccaactgtgcatggccaggtttgcaagcagtntacccagctacatgcaggctttgcacatagaaagc

SEQ ID NO: 12012 - DNA, 71 bp, chicken (Gallus Gallus)
  misc_feature (36): n=a or g
aaccagagtagggatctccaaagtgatgttctttantcgtggaatgccctgggttgaaaagcaccacaacg

SEQ ID NO: 12013 - DNA, 71 bp, chicken (Gallus Gallus)
  misc_feature (36): n=a or t
acactaaaatccatgcaagaccttagcttattttgncatccgtaaatataaaaactatcgcagatgagcat

SEQ ID NO: 12014 - DNA, 71 bp, chicken (Gallus Gallus)
  misc_feature (36): n=c or t
gtaacattgctgccttcgttcacaacgatgtcactngaaatacgaaatatcttcggagaaactgaaaggaa

SEQ ID NO: 12015 - DNA, 71 bp, chicken (Gallus Gallus)
  misc_feature (36): n=c or g
ggggaaccgcatggtttttaaaagtaagcatgcttngcctttgtttcttgtttttgttagtagaagacaga

SEQ ID NO: 12016 - DNA, 71 bp, chicken (Gallus Gallus)
  misc_feature (36): n=g or t
tcactgcttggcactgctcggtacaccagagaaggntttcatcttccattggtcattgaagcttgattcaa

SEQ ID NO: 12017 - DNA, 71 bp, chicken (Gallus Gallus)
  misc_feature (36): n=a or t
gcctcaaacccatttgctgcagttctctccatggcnccagatgtcttaaacgtttaggccacgactcatca

SEQ ID NO: 12018 - DNA, 71 bp, chicken (Gallus Gallus)
  misc_feature (36): n=c or t
agcccagctcgaaccagaaaaccacctcgtgcaaanaaatgtacttttctaattaacgacaggcaatactt

SEQ ID NO: 12019 - DNA, 71 bp, chicken (Gallus Gallus)
  misc_feature (36): n=a or g
aatcctatcagtataggaaatggtggctttcctgcnccaggctttgtagaagcctgggggaagtgagtttg

SEQ ID NO: 12020 - DNA, 71 bp, chicken (Gallus Gallus)
  misc_feature (36): n=c or g
tctccttttcttttataagggaatacaaagaaacantgtatggaaaggatgttactatgacactgctgaga

SEQ ID NO: 12021 - DNA, 71 bp, chicken (Gallus Gallus)
  misc_feature (36): n=a or g
tgcccctaagagggaatcattggcaaacagagcacnttggggtcaccagagcaccacagcccttgggagac

SEQ ID NO: 12022 - DNA, 71 bp, chicken (Gallus Gallus)
  misc_feature (36): n=a or c
acctggaaagtgtcagtcctgctcctcaaagactgntcatttaaaaacaattagcattcccgttatgaaca

SEQ ID NO: 12023 - DNA, 71 bp, chicken (Gallus Gallus)
  misc_feature (36): n=c or t
atcctctttttaattttactaagtgccagaatgaangatcacattttacacaggatgaaatactttgtagc

SEQ ID NO: 12024 - DNA, 71 bp, chicken (Gallus Gallus)
  misc_feature (36): n=g or t
cttccagccccttctctgcagccttacagggtcagngatttgcaggaatgtgcctcggatggccatgttct

SEQ ID NO: 12025 - DNA, 71 bp, chicken (Gallus Gallus)
  misc_feature (36): n=c or t
tatacacgcacctccccccagtctttgttcagtctntccattccagggtacataaggatgtggaggggttt

SEQ ID NO: 12026 - DNA, 71 bp, chicken (Gallus Gallus)
  misc_feature (36): n=c or t
tgagtctttgtgttcttccagtggcatttcagctgntttgagtacgttgttaccttggcaaggctgactgc

SEQ ID NO: 12027 - DNA, 71 bp, chicken (Gallus Gallus)
  misc_feature (36): n=a or g
ctgaaacccgaatctagccctggagatggatttggngttgaggacccagatgtggggtgcagatttgtgat

SEQ ID NO: 12028 - DNA, 71 bp, chicken (Gallus Gallus)
  misc_feature (36): n=a or g
cagttaagggagattacaaatttaggcattagtccnaaataagctttcttcaattttgaaagtgccataaa

SEQ ID NO: 12029 - DNA, 71 bp, chicken (Gallus Gallus)
  misc_feature (36): n=c or t
cagtcactagttcagttggaaactgtacgcctttantttacattatttaagtccaaaagtgaaccactaat

SEQ ID NO: 12030 - DNA, 71 bp, chicken (Gallus Gallus)
  misc_feature (36): n=a or g
gcacacagtgctaggatgacatttaactacactctnttttttctttactgcttttctacgccatggccaaa

SEQ ID NO: 12031 - DNA, 71 bp, chicken (Gallus Gallus)
  misc_feature (36): n=c or t
cagctgcgagagcaggctgggctgcaaggtttcagngcccagcactttgtatacacttacaaagaaggctg

SEQ ID NO: 12032 - DNA, 71 bp, chicken (Gallus Gallus)
  misc_feature (36): n=a or g
tagtgaggaactggctggttataaatatagctaatncagacagtatgctagagaagagcagaagaaaatag

SEQ ID NO: 12033 - DNA, 71 bp, chicken (Gallus Gallus)
  misc_feature (36): n=a or g
ctgaagatgcagaggatgagagatgagataaactcnaatgtcacatgatagagatctgaagttctgtcatg

SEQ ID NO: 12034 - DNA, 71 bp, chicken (Gallus Gallus)
  misc_feature (36): n=c or t
atttgtcaggcttttaaatgtttcttttaagacctngatattctctgcagtattcttatgctagaagccgg

SEQ ID NO: 12035 - DNA, 71 bp, chicken (Gallus Gallus)
  misc_feature (36): n=a or g
ttccctggaaatacttcccagaaaaatttctttccntgctctactgccacctctagacacaaattctgcaa

SEQ ID NO: 12036 - DNA, 71 bp, chicken (Gallus Gallus)
  misc_feature (36): n=c or t
gtacctgaaagttactgcagccttttgtagggaganaggattgacctggagaaagttatgctcctttgatc

SEQ ID NO: 12037 - DNA, 71 bp, chicken (Gallus Gallus)
  misc_feature (36): n=c or t
gcttgtgaaaagtctgcttctggccttaacgtaaangttgtttctctacagctagagttttggagcaagta

SEQ ID NO: 12038 - DNA, 71 bp, chicken (Gallus Gallus)
  misc_feature (36): n=a or g
cagaaaaggaggaaaatccgcagcgttcacagagcntgaacttaaaaagagagtaagctgctgtggcttga

SEQ ID NO: 12039 - DNA, 71 bp, chicken (Gallus Gallus)
  misc_feature (36): n=a or g
tctgaacaaacagctgagtaggtcaaggcaaaaaanaagggatgtgctagagatgtgtcatattctgcaag

SEQ ID NO: 12040 - DNA, 71 bp, chicken (Gallus Gallus)
  misc_feature (36): n=c or t
tatctcaatgcaacgtccaaatacagtttcagcctngtagtgaatttgcttagcaaataattaaaccaaca

SEQ ID NO: 12041 - DNA, 71 bp, chicken (Gallus Gallus)
  misc_feature (36): n=a or g
tttcttcatcctggaactccttcaactcacctgctntttgtaagcctgcagatggaatggcataaagcatc

SEQ ID NO: 12042 - DNA, 71 bp, chicken (Gallus Gallus)
  misc_feature (36): n=a or g
agttaagatcgtatggaaacttatgacaataataangcagagcagctgaaggaaaatcaaatcaggaaagc

SEQ ID NO: 12043 - DNA, 71 bp, chicken (Gallus Gallus)
  misc_feature (36): n=c or g
cttctgctgcaaaccactgtgcaaaaaggtgagaanttcagaaaaccccatgttgtggctgtcccctctgc

SEQ ID NO: 12044 - DNA, 71 bp, chicken (Gallus Gallus)
  misc_feature (36): n=c or t
actggtattttacaatcattttgctaataaagatgncagaatggacactgtatctgaatcaagactgaacc

SEQ ID NO: 12045 - DNA, 71 bp, chicken (Gallus Gallus)
  misc_feature (36): n=a or c
tttaggaatcttcaccagcaagatcgaaggacttantacctaaaaataaagaggtcagaaaagggaacaca

SEQ ID NO: 12046 - DNA, 71 bp, chicken (Gallus Gallus)
  misc_feature (36): n=a or t
gccacaaagcttctcaatacaaagattgtcataggnctgacctgagtccaggagacaacagtgaaaaccaa

SEQ ID NO: 12047 - DNA, 71 bp, chicken (Gallus Gallus)
  misc_feature (36): n=a or c
ttcccaagtcatcagggccgctgggctgaaaatctnagcaatgagtgggtgcagctgaggtctcagtgcaa

SEQ ID NO: 12048 - DNA, 71 bp, chicken (Gallus Gallus)
  misc_feature (36): n=a or g
aaggcagcagctctgccaaagattatttgatgtgtnctgctggaacacactacagtgttttccccattaca

SEQ ID NO: 12049 - DNA, 71 bp, chicken (Gallus Gallus)
  misc_feature (36): n=g or t
caggatgaggagggcaaaaagcagttggagaagganttcaatagcatgaagaagtactgccaggttattag

SEQ ID NO: 12050 - DNA, 71 bp, chicken (Gallus Gallus)
  misc_feature (36): n=a or g
aatgttcaggctaatgaactgcacaaaattcctccnaaaaggaagaggcctgaggaaagtgccatgacttt

SEQ ID NO: 12051 - DNA, 71 bp, chicken (Gallus Gallus)
  misc_feature (36): n=c or t
agacatatttgccaaaactagataggagagtacttngaaatgtcaaagagaagcactgaaacttcagtttg

SEQ ID NO: 12052 - DNA, 71 bp, chicken (Gallus Gallus)
  misc_feature (36): n=g or t
tttactgactagatcaatagcctgctcaatacctanttttttttctgccaaggtcacagggatttggctgg

SEQ ID NO: 12053 - DNA, 71 bp, chicken (Gallus Gallus)
  misc_feature (36): n=a or g
tcatgtcttggtgtgaccttcaaaatctgtgtgccntgttttaacaggtcttcagacactttataaaatta

SEQ ID NO: 12054 - DNA, 71 bp, chicken (Gallus Gallus)
  misc_feature (36): n=g or t
ctaccaataggttaaataaaaaaaaaaaaagggggnttatatatagttttcttgatgacaatgaatatttt

SEQ ID NO: 12055 - DNA, 71 bp, chicken (Gallus Gallus)
  misc_feature (36): n=a or c
gtgcaaattccaaaagtaaagcaaaagataggactngtcattagttttgcatgaaacaaaatttttgatga

SEQ ID NO: 12056 - DNA, 71 bp, chicken (Gallus Gallus)
  misc_feature (36): n=a or g
atggccaacataggtagagacacactgagctcttgngggtgttagaaaatgtcgtgaaacatgacggcatt

SEQ ID NO: 12057 - DNA, 71 bp, chicken (Gallus Gallus)
  misc_feature (36): n=g or t
ctctctgttctcagatggtagtgctccatggtattngccctcaagctcatgttttagcctgtgctaaagaa

SEQ ID NO: 12058 - DNA, 71 bp, chicken (Gallus Gallus)
  misc_feature (36): n=g or t
aatgatgatgaggatttatgtgtataataatcatcnccagttattaaagttttgcaataccctttttcaga

SEQ ID NO: 12059 - DNA, 71 bp, chicken (Gallus Gallus)
  misc_feature (36): n=a or g
tgactctctagaactgtaaaagatggttgtggtgangtgggtttcagcctcttcttcagtataactggtga

SEQ ID NO: 12060 - DNA, 71 bp, chicken (Gallus Gallus)
  misc_feature (36): n=g or t
tcattctgtttgtaattttaatgtgtaacttatttngtggagaatatagaggtaaggaaatgcaagaaagc

SEQ ID NO: 12061 - DNA, 71 bp, chicken (Gallus Gallus)
  misc_feature (36): n=a or t
gcactgtccccgtgcaaaggtcttactcaccagttngtgatttgtggaatacagtttcctattttgatagc

SEQ ID NO: 12062 - DNA, 71 bp, chicken (Gallus Gallus)
  misc_feature (36): n=c or t
acatctgaagtgaggggcccagggccaaatatggangcctaagcatgggtgagttaacaaaaatcagggag

SEQ ID NO: 12063 - DNA, 71 bp, chicken (Gallus Gallus)
  misc_feature (36): n=a or g
tgagctggagcagctgggaaggagctgttctgcacnacgcagtttaatgcaatttccagccatccaggtgc

SEQ ID NO: 12064 - DNA, 71 bp, chicken (Gallus Gallus)
  misc_feature (36): n=a or g
ttcaaacacaacagatccaggagaaggaaaaggatnagttttcactccttcaacttgtgaaaagactgctg

SEQ ID NO: 12065 - DNA, 71 bp, chicken (Gallus Gallus)
  misc_feature (36): n=a or g
aaaaccccaacaccattctttccactggtgtttatnttaacagtctgttcacaaggttactgctgactgtg

SEQ ID NO: 12066 - DNA, 71 bp, chicken (Gallus Gallus)
  misc_feature (36): n=c or t
gctgtgagaagcaacacatgtggaagaggaagatancatgttaattgcatcaaactgatgaaaaagtggct

SEQ ID NO: 12067 - DNA, 71 bp, chicken (Gallus Gallus)
  misc_feature (36): n=a or c
ttaatcacaaagctaacctccaggacagactcagancaagctgcaatgccagttctgtaccgctgtcctac

SEQ ID NO: 12068 - DNA, 71 bp, chicken (Gallus Gallus)
  misc_feature (36): n=a or g
ctgactttcaacataaagatttgaatgcttgccacntgaaaaatcctaattattgtctacgtccagcctgg

SEQ ID NO: 12069 - DNA, 71 bp, chicken (Gallus Gallus)
  misc_feature (36): n=g or t
tcgtcctcagaatgggtccagcaaccaacctaacanagatgacagttaccactctgtttagtcagccctgt

SEQ ID NO: 12070 - DNA, 71 bp, chicken (Gallus Gallus)
  misc_feature (36): n=c or t
actcgagcactacggtggtggtgagatgccctcacnatttgaccagtcacagcctggcaacacaacacatc

SEQ ID NO: 12071 - DNA, 71 bp, chicken (Gallus Gallus)
  misc_feature (36): n=c or t
atcttatcttaggataactctaaactgactgcacangtgtaaatgactttgccaggctgcattcagccaga

SEQ ID NO: 12072 - DNA, 71 bp, chicken (Gallus Gallus)
  misc_feature (36): n=c or t
agaaattgtaagttatctttcaataaattccttagnaggtatccaattctctctttcctccctccgtcacc

SEQ ID NO: 12073 - DNA, 71 bp, chicken (Gallus Gallus)
  misc_feature (36): n=a or g
acctttcaggagccgggcagtcatcctgccaggagngcagtgacagctaacagttggcttgctgtggtcag

SEQ ID NO: 12074 - DNA, 71 bp, chicken (Gallus Gallus)
  misc_feature (36): n=a or t
aaaagcaggggaagaaaaagcctggagactcttacnagagccatgctattttcttgggccgagttcccatt

SEQ ID NO: 12075 - DNA, 71 bp, chicken (Gallus Gallus)
  misc_feature (36): n=a or g
cgcaggccatggtgctccttccagccgcaggctgcncactgagcaatgctttactgatgtggaagctgccc

SEQ ID NO: 12076 - DNA, 71 bp, chicken (Gallus Gallus)
  misc_feature (36): n=a or g
gatttgtcattcttttggggtttgctaaatctcaanctgctaaaacctcttttgtcatccactgcttatac

SEQ ID NO: 12077 - DNA, 71 bp, chicken (Gallus Gallus)
  misc_feature (36): n=a or g
agtactttgtatagctgtcacaataagactaaacgnattgaacactattgttggattaaagacattaaagg

SEQ ID NO: 12078 - DNA, 71 bp, chicken (Gallus Gallus)
  misc_feature (36): n=a or g
tcagtgactgcttgcactttggaaacaagatccaanggcgcatggcttttcatggccacctcttctcttac

SEQ ID NO: 12079 - DNA, 71 bp, chicken (Gallus Gallus)
  misc_feature (36): n=a or g
agaaaccatagtttgcatcagtctttgaatatgtcnacatgcttacctaatctcataacgtgcacttactt

SEQ ID NO: 12080 - DNA, 71 bp, chicken (Gallus Gallus)
  misc_feature (36): n=a or g
catctaaatggtagcaactgctttctatctcataanagacttttttccatccatcttgacttctccattaa

SEQ ID NO: 12081 - DNA, 71 bp, chicken (Gallus Gallus)
  misc_feature (36): n=c or t
ggccacatccgccagctgtcaggcaccactctgctngcacttcgtatcaaatttcatataaacattacaag

SEQ ID NO: 12082 - DNA, 71 bp, chicken (Gallus Gallus)
  misc_feature (36): n=a or t
tatggattaattctcaggtgtggagaacaggaagantttttttgtgaaaccagcgttaatggcgttttcgt

SEQ ID NO: 12083 - DNA, 71 bp, chicken (Gallus Gallus)
  misc_feature (36): n=c or t
agagcggctgctgtgtgctatgtagagaacttcctngagaaatatgattctgtggaaaccctctttcatac

SEQ ID NO: 12084 - DNA, 71 bp, chicken (Gallus Gallus)
  misc_feature (36): n=a or g
atgcacaatcattatttacaaaaaattgctgtaatnggcatgtttattgttgctctgtgactagaaggggt

SEQ ID NO: 12085 - DNA, 71 bp, chicken (Gallus Gallus)
  misc_feature (36): n=a or t
atttccttctgggaaaattttccaatgaagacatcncacacaatgaagtcttttcaagtgagtaatttgtc

SEQ ID NO: 12086 - DNA, 71 bp, chicken (Gallus Gallus)
  misc_feature (36): n=a or c
atggtttgaagcatagcacacacaagatgattttcnccttgaagacacatgcttagctcatttagaagagc

SEQ ID NO: 12087 - DNA, 71 bp, chicken (Gallus Gallus)
  misc_feature (36): n=c or t
ctgaagtatggtcaactaccctaaaactatttaggntataatccagaatcagacctgggtacacaaaacca

SEQ ID NO: 12088 - DNA, 71 bp, chicken (Gallus Gallus)
  misc_feature (36): n=a or g
tccctctcaaacagggaagtgtttgtcagaaggaanatgccccaaatgatcatcactaaccacaactgctg

SEQ ID NO: 12089 - DNA, 71 bp, chicken (Gallus Gallus)
  misc_feature (36): n=c or t
cttaagaattcaaaaggtctcactatacagtaaatngtggaacatattctacctcaatagctcttcttcaa

SEQ ID NO: 12090 - DNA, 71 bp, chicken (Gallus Gallus)
  misc_feature (36): n=a or c
catggacacacaaagacctagagataattccgtganaccatagctagagcaaaaggacagatatagaatca

SEQ ID NO: 12091 - DNA, 71 bp, chicken (Gallus Gallus)
  misc_feature (36): n=a or g
tgtgccagcacctcaccattctctctgtaaaaaacncattttgagacacagacctgcgtaagaaagtatcg

SEQ ID NO: 12092 - DNA, 71 bp, chicken (Gallus Gallus)
  misc_feature (36): n=a or g
cccagaccagctggatctcccagatcctggcctacntctgttttccaatttgttcagaccttccttctccc

SEQ ID NO: 12093 - DNA, 71 bp, chicken (Gallus Gallus)
  misc_feature (36): n=a or g
tagctctttttggtttgttcttgcgttgtgatcttnaagcatcctgtagtatactggtgttgactgttggt

SEQ ID NO: 12094 - DNA, 71 bp, chicken (Gallus Gallus)
  misc_feature (36): n=a or g
agtctggggagccgctgagtgccttcagcacctggnagtaacccaattgtgacttcaggtaagcccatccg

SEQ ID NO: 12095 - DNA, 71 bp, chicken (Gallus Gallus)
  misc_feature (36): n=c or t
gaagcaatggcttcaatcttataaatcttctgaaangggaggatgtgatggaaatcaggcatgtggacaga

SEQ ID NO: 12096 - DNA, 71 bp, chicken (Gallus Gallus)
  misc_feature (36): n=a or g
ttccctcacttcatttttcttcctacttaaacaacnttttctaatactcccaaacccaaagctttccttgc

SEQ ID NO: 12097 - DNA, 71 bp, chicken (Gallus Gallus)
  misc_feature (36): n=c or t
tctggtgccaggcacccttgggcccgtttcttcacnttcacgagagcctcactgagaaatgcttccatgtt

SEQ ID NO: 12098 - DNA, 71 bp, chicken (Gallus Gallus)
  misc_feature (36): n=a or g
ccctcgctttccagttcttttccattgggtttggcngatgttttcagcaaggtgatgcctgtgggcaggct

SEQ ID NO: 12099 - DNA, 71 bp, chicken (Gallus Gallus)
  misc_feature (36): n=c or t
aggagtttttgttgtgctttctcagaagcagagccnggcactgtgcccttggtgcaatctggcttccagaa

SEQ ID NO: 12100 - DNA, 71 bp, chicken (Gallus Gallus)
  misc_feature (36): n=g or t
aggctgttctccttccattgacgttagtaccagggntgtaagggagcacagtgtttgttttccaaactcag

SEQ ID NO: 12101 - DNA, 71 bp, chicken (Gallus Gallus)
  misc_feature (36): n=c or t
ttttatttcttcagaggcgcttgtgaaccaaacctnaatgagtcaaagggacttgtggacctttctaccaa

SEQ ID NO: 12102 - DNA, 71 bp, chicken (Gallus Gallus)
  misc_feature (36): n=g or t
agaggttgtggagtctcatcctatgaagatattctngatgcctacatgtgtgacccattgtagggtacctg

SEQ ID NO: 12103 - DNA, 71 bp, chicken (Gallus Gallus)
  misc_feature (36): n=c or t
ctgcctcctaactttgaggtccccaatttttccagnaagttggttactggtttcctaggtttccccagatt

SEQ ID NO: 12104 - DNA, 71 bp, chicken (Gallus Gallus)
  misc_feature (36): n=c or t
gtctctttgatccagccccctccctgcccagcatcnccagattagcatgagcaggcaagccaagaaatggg

SEQ ID NO: 12105 - DNA, 71 bp, chicken (Gallus Gallus)
  misc_feature (36): n=a or g
attcagctctgctgtcagcagggctctgctcatgcnccttgctgtctcctctactgatgaggtttacagca

SEQ ID NO: 12106 - DNA, 71 bp, chicken (Gallus Gallus)
  misc_feature (36): n=c or t
gcatttacttcccatttctcatcctacgctgtcatngccttccaagattaattaagggaagaggacaggac

SEQ ID NO: 12107 - DNA, 71 bp, chicken (Gallus Gallus)
  misc_feature (36): n=c or t
caccagctgataacttaaaaggcataaagtttgacngaaaatgaaaaggtcttgtgaaatcatattgactc

SEQ ID NO: 12108 - DNA, 71 bp, chicken (Gallus Gallus)
  misc_feature (36): n=a or g
cactccactgtctttagctacaggttgatgcttccntttgccatccaaatgtacttcactgcatccagctg

SEQ ID NO: 12109 - DNA, 71 bp, chicken (Gallus Gallus)
  misc_feature (36): n=c or t
aaatccaacacaaatagcagataaacaaagatagangagaaagaacattggaaaaaaataaggcagtgttg

SEQ ID NO: 12110 - DNA, 71 bp, chicken (Gallus Gallus)
  misc_feature (36): n=g or t
ctttgccagtttggtactgaagatttcccaggatcnccacgagatagcacaggttgcccagagaagtcgtg

SEQ ID NO: 12111 - DNA, 71 bp, chicken (Gallus Gallus)
  misc_feature (36): n=a or g
tttcttgagtgcctgtcatgtttgcgaagagttttntatcttattccttggtgcttggtttttaaacacgt

SEQ ID NO: 12112 - DNA, 71 bp, chicken (Gallus Gallus)
  misc_feature (36): n=a or c
tccaaagctttctgaattaattctgttatttctgcnaccttaacagctgttattttactgcatctcagaac

SEQ ID NO: 12113 - DNA, 71 bp, chicken (Gallus Gallus)
  misc_feature (36): n=c or g
ctcagattcagagctgcaaagggtattccagttcanaaaccgagcacaatggaagtcccacagaatgggct

SEQ ID NO: 12114 - DNA, 71 bp, chicken (Gallus Gallus)
  misc_feature (36): n=a or c
atgaaatcatttaataaatatttctcgtattcatanttcagttttcatccatctcatgcttgtgcctttct

SEQ ID NO: 12115 - DNA, 71 bp, chicken (Gallus Gallus)
  misc_feature (36): n=a or g
ataaaggtttctcattttgggaagagatacaaacantggtaactgtctatgccaaaagctcatagatgagg

SEQ ID NO: 12116 - DNA, 71 bp, chicken (Gallus Gallus)
  misc_feature (36): n=c or t
atattaaaagactgatttatattttaaatggattgnttttgtagaaaaatgtatttatcaaatgttctatc

SEQ ID NO: 12117 - DNA, 71 bp, chicken (Gallus Gallus)
  misc_feature (36): n=a or g
tctctcaccaagggagatctttttctgttcgagacntacatgaagattgcatgaacttttatttgcataga

SEQ ID NO: 12118 - DNA, 71 bp, chicken (Gallus Gallus)
  misc_feature (36): n=c or t
tagaaaagagctgcaacatacccaagccatgcagcnagcacacctcagttctagaggatttccaggctaaa

SEQ ID NO: 12119 - DNA, 71 bp, chicken (Gallus Gallus)
  misc_feature (36): n=c or t
aggttgagcatcagttcggtattgtcatggttagtncccccttggtcagtagtgtccttttaaccagggac

SEQ ID NO: 12120 - DNA, 71 bp, chicken (Gallus Gallus)
  misc_feature (36): n=a or g
cctgatgggttgcaggttttgaggctggaaatcacngtataaaatttatctccaaggaactccttgtatgt

SEQ ID NO: 12121 - DNA, 71 bp, chicken (Gallus Gallus)
  misc_feature (36): n=c or t
aattcttactcaaatccatcccttacgtttttggtngtttaatgctgtgtatattcctgtacaccaagaag

SEQ ID NO: 12122 - DNA, 71 bp, chicken (Gallus Gallus)
  misc_feature (36): n=c or g
cagcccgcagacctgcccagccccgtgtggcaggangtcttgccctgcaagtcgttcacggtgaattcggt

SEQ ID NO: 12123 - DNA, 71 bp, chicken (Gallus Gallus)
  misc_feature (36): n=a or g
caaatggatcagagatgcctgccttgccaactaagntgcaacatacccataaccctggaagaaacctacca

SEQ ID NO: 12124 - DNA, 71 bp, chicken (Gallus Gallus)
  misc_feature (36): n=c or t
aacaccatttctcaccgtatcgtttgtttctttaangcagccaagagaaactgagctcgatacccataccg

SEQ ID NO: 12125 - DNA, 71 bp, chicken (Gallus Gallus)
  misc_feature (36): n=a or g
agcacggcgttacccggcagcccgacgccctccccngcactttccctgtgtgcggctgaagaaaagcagga

SEQ ID NO: 12126 - DNA, 71 bp, chicken (Gallus Gallus)
  misc_feature (36): n=c or t
cctgaagcatgttcagcttttcctttcttcccttangctgcattgtagctgcattcttctttagtctcttt

SEQ ID NO: 12127 - DNA, 71 bp, chicken (Gallus Gallus)
  misc_feature (36): n=a or g
gcatagacttcagtcaacgcttgcccaagcttttcnggctcgcctcgcagtatcaccgtctccgagctact

SEQ ID NO: 12128 - DNA, 71 bp, chicken (Gallus Gallus)
  misc_feature (36): n=a or g
cagcagagacaacacagctgcttacctgcatcactnctgctggctggtggaagatcatcgaagagtaaaga

SEQ ID NO: 12129 - DNA, 71 bp, chicken (Gallus Gallus)
  misc_feature (36): n=c or g
ggcagcagcttgtggatgagcccttgagtcaccttnatgggaaagaaacatatctgaaaaacctcctttcc

SEQ ID NO: 12130 - DNA, 71 bp, chicken (Gallus Gallus)
  misc_feature (36): n=a or c
catcacttaagctgctggtgacctccccaccccctnctacggtccatccaccaaagcgtaccccttctgta

SEQ ID NO: 12131 - DNA, 71 bp, chicken (Gallus Gallus)
  misc_feature (36): n=c or t
tcctcgccgatgtcgcggtacacctgcttctgggangcataattgatgtctgcgggctgcagagaggaggc

SEQ ID NO: 12132 - DNA, 71 bp, chicken (Gallus Gallus)
  misc_feature (36): n=a or g
tggtactctggcttcgcacggaggtccaccgtgtanctcttagtttgctgaaagcagtcagatccccatag

SEQ ID NO: 12133 - DNA, 71 bp, chicken (Gallus Gallus)
  misc_feature (36): n=c or t
cacagctctcatgtcactttgaaggaattgcagtgngttgttaggctatgactgtgcaggtaaactgatgt

SEQ ID NO: 12134 - DNA, 71 bp, chicken (Gallus Gallus)
  misc_feature (36): n=c or g
ctctgtgaattcggtaggtgaaggcttcttacatgntgctcgaattttttttgtgtttgctccctcttctg

SEQ ID NO: 12135 - DNA, 71 bp, chicken (Gallus Gallus)
  misc_feature (36): n=c or g
aaggatatcagctgcgatgcagtgctcagcgtacangtgtaggatcgcaaaagacttgagagggtagactt

SEQ ID NO: 12136 - DNA, 71 bp, chicken (Gallus Gallus)
  misc_feature (36): n=c or t
ggccagcccatcttgagagcgaccgtttcatgatgnggccagagtggtgtttgacttagggccccggtttc

SEQ ID NO: 12137 - DNA, 71 bp, chicken (Gallus Gallus)
  misc_feature (36): n=a or g
tcctgcaagaacgatggatcagatctctcatgcacntcttcctgacagatggatcttttccaccttgtgga

SEQ ID NO: 12138 - DNA, 71 bp, chicken (Gallus Gallus)
  misc_feature (36): n=c or t
ggtgggctggggttggacctggggatcccagtggtnttttccaacctctgattctgatacactgataaagc

SEQ ID NO: 12139 - DNA, 71 bp, chicken (Gallus Gallus)
  misc_feature (36): n=a or g
aaaaaggggttacagcagcggatgttctttctggtnggtgctgcctctgctttcctacagtgttgagggcc

SEQ ID NO: 12140 - DNA, 71 bp, chicken (Gallus Gallus)
  misc_feature (36): n=c or t
gtgttcttagaaagaaagtaccattttaggtgtcangagacttgtctggagaaagaggagagcacttctct

SEQ ID NO: 12141 - DNA, 71 bp, chicken (Gallus Gallus)
  misc_feature (36): n=a or g
tctcctttctctgacagtagttggtagcagatgctncggggaaggcatgagaaacagtgagcttatggtga

SEQ ID NO: 12142 - DNA, 71 bp, chicken (Gallus Gallus)
  misc_feature (36): n=c or t
aacaacatcacctcgttgctccaccactccttcaangactcagaccctgttcttttcattacttcttcaac

SEQ ID NO: 12143 - DNA, 71 bp, chicken (Gallus Gallus)
  misc_feature (36): n=c or t
ttgaatcaacgtgtctgaaggaaattaattctgcanacctcaatggtgcttctgtggtgtcacatccagct

SEQ ID NO: 12144 - DNA, 71 bp, chicken (Gallus Gallus)
  misc_feature (36): n=a or g
tcctgtgatgagactactcaggagctgaggatgctntcacagcacgttgtcatccagcatgcaagtgctgg

SEQ ID NO: 12145 - DNA, 71 bp, chicken (Gallus Gallus)
  misc_feature (36): n=c or t
tgctagcagcttatcgcatcaaacaacttcaagtgntcagaaatctgagaagtgagaagagcagccacccc

SEQ ID NO: 12146 - DNA, 71 bp, chicken (Gallus Gallus)
  misc_feature (36): n=c or g
aataaccctgcaaaacctaacagaggaaggaaaagntcaacagccacttttctgatggagtggcaatgaag

SEQ ID NO: 12147 - DNA, 71 bp, chicken (Gallus Gallus)
  misc_feature (36): n=g or t
taggaaattatgtataagcaaaacttgaaatgactntgacttaccataaatttgggttatctgtctcacag

SEQ ID NO: 12148 - DNA, 71 bp, chicken (Gallus Gallus)
  misc_feature (36): n=c or t
atgtcattacgtttcttgaattcagagggaattaantcattcacttgcacaactacatactgagttaacta

SEQ ID NO: 12149 - DNA, 71 bp, chicken (Gallus Gallus)
  misc_feature (36): n=c or t
tgctgtgaactttattaaacctcatctgatccaatngtgtcacacaagaattaaaaatattgattttacgc

SEQ ID NO: 12150 - DNA, 71 bp, chicken (Gallus Gallus)
  misc_feature (36): n=a or c
taacattgaagtacgtacacaagggaaaagattttnagtggagtgctaggactcatacagttgtgcacaag

SEQ ID NO: 12151 - DNA, 71 bp, chicken (Gallus Gallus)
  misc_feature (36): n=c or t
aggagagctttgttatgtgtatcattgttaagatgnaatttctactccgtgtttgtattaagctgataaat

SEQ ID NO: 12152 - DNA, 71 bp, chicken (Gallus Gallus)
  misc_feature (36): n=c or t
tattaaacaaatgacaacactttccttatacttctncccatcccaaataacaaggagttatgctaaaagtt

SEQ ID NO: 12153 - DNA, 71 bp, chicken (Gallus Gallus)
  misc_feature (36): n=a or g
ctcctgtaaccagacgtgcatgggaaagcactgggnatagggaaattattcaaccgagcagcctacaaagg

SEQ ID NO: 12154 - DNA, 71 bp, chicken (Gallus Gallus)
  misc_feature (36): n=a or c
cccatccacttgactcccacccattataaacacgtnagcattgatgaaatcccccgttttctccaggctga

SEQ ID NO: 12155 - DNA, 71 bp, chicken (Gallus Gallus)
  misc_feature (36): n=c or g
ccaaaggtcaatcactagtgtaggcattgagaattnttggatacgaggttttttttaagatatcattaact

SEQ ID NO: 12156 - DNA, 71 bp, chicken (Gallus Gallus)
  misc_feature (36): n=c or t
gaagttacttctgttaaccattgttttcttactatnaatcctgttttctccaaaggttctacaagatgatc

SEQ ID NO: 12157 - DNA, 71 bp, chicken (Gallus Gallus)
  misc_feature (36): n=c or t
gcaccaggcatgcgtgtaggagttacagaaaatcangagtaacagaagccatcaccccgaagccattttcc

SEQ ID NO: 12158 - DNA, 71 bp, chicken (Gallus Gallus)
  misc_feature (36): n=c or t
accctttctacctttgaaaatatcacttatgtgttntaggggtgagaagagaataaaacagaagtagtgtc

SEQ ID NO: 12159 - DNA, 71 bp, chicken (Gallus Gallus)
  misc_feature (36): n=a or g
gctcagaaaacaacccagactcagtgttgagacaanctggctcctcccaacataacaagggcaaacacatg

SEQ ID NO: 12160 - DNA, 71 bp, chicken (Gallus Gallus)
  misc_feature (36): n=c or t
gaaacaagaaactgaattcagtagattaatttaatnggagattatacttactattttcacaagactttata

SEQ ID NO: 12161 - DNA, 71 bp, chicken (Gallus Gallus)
  misc_feature (36): n=a or g
tttttgttgttgtcttgtttccttatttaaagtaanttttattggtccatactacagatcccatttaaaaa

SEQ ID NO: 12162 - DNA, 71 bp, chicken (Gallus Gallus)
  misc_feature (36): n=a or g
taatgtagaacacattctgagaatcacctacagccntatgcatctttgtattgtttttttttccttttttt

SEQ ID NO: 12163 - DNA, 71 bp, chicken (Gallus Gallus)
  misc_feature (36): n=a or g
ctgctgcaccacacgttggccagggacttggttgcntcctgcattctcccggctgaggactgataatctgt

SEQ ID NO: 12164 - DNA, 71 bp, chicken (Gallus Gallus)
  misc_feature (36): n=a or g
ataacagattgttcttactttatttaaggtgtacgnaaaacatcaagagctactgcagtagtttatgacaa

SEQ ID NO: 12165 - DNA, 71 bp, chicken (Gallus Gallus)
  misc_feature (36): n=a or c
aacagttttgaacaaaactttgaaagtgttgtattnatatgagtgctgcctcagtgtgtgtttgcttcatc

SEQ ID NO: 12166 - DNA, 71 bp, chicken (Gallus Gallus)
  misc_feature (36): n=a or g
tagaacattgcaaatctaattctccaaaccctcggncagcctcgagcgtctcagctctaatatattgaaac

SEQ ID NO: 12167 - DNA, 71 bp, chicken (Gallus Gallus)
  misc_feature (36): n=c or t
agaatctaaaatccaattcttacatattgtggaatnatacctttcctaaattcacagatagatccaagttt

SEQ ID NO: 12168 - DNA, 71 bp, chicken (Gallus Gallus)
  misc_feature (36): n=c or t
tatttctttcccttgaatactgattgtcactgagcngccattcggggctgaacggcccttccatctccctg

SEQ ID NO: 12169 - DNA, 71 bp, chicken (Gallus Gallus)
  misc_feature (36): n=c or t
aaagtgatattgttttgaaatgaaggttttgttggnaggtaaaattggatactttttaatcaaaaatattt

SEQ ID NO: 12170 - DNA, 71 bp, chicken (Gallus Gallus)
  misc_feature (36): n=c or t
atgtgactaagttttaagaattgcatctccatatanttggaaagttacaaagaccaatgcaatactaattc

SEQ ID NO: 12171 - DNA, 71 bp, chicken (Gallus Gallus)
  misc_feature (36): n=c or g
ccttaatagtgacactgaagccttgaatggggacangttggtaaaaatgtcccataatgaagtttctctgc

SEQ ID NO: 12172 - DNA, 71 bp, chicken (Gallus Gallus)
  misc_feature (36): n=c or g
caacttaatgcagatactggatgcctataggaaaanttagggcaaattagagccaaggaaagactggcaca

SEQ ID NO: 12173 - DNA, 71 bp, chicken (Gallus Gallus)
  misc_feature (36): n=c or t
cagtttttctgccaacaaaatgagactttctgattncttagtaaaagataatctctttctgaagttattaa

SEQ ID NO: 12174 - DNA, 71 bp, chicken (Gallus Gallus)
  misc_feature (36): n=a or g
aatgttaatttggaaatttagtgtagaaaaattacnttcctgtgaaataatgatacaatagtgtgactctg

SEQ ID NO: 12175 - DNA, 71 bp, chicken (Gallus Gallus)
  misc_feature (36): n=c or g
agctcaatacgctcagcaccgcatcagaaacagaantcagctctatccccatcagcactcctgtcaaacag

SEQ ID NO: 12176 - DNA, 71 bp, chicken (Gallus Gallus)
  misc_feature (36): n=a or g
tggcacaagtcatcacctgacatatagcccctgcanataaaagaattaaaaaagaaccacttaagtacaaa

SEQ ID NO: 12177 - DNA, 71 bp, chicken (Gallus Gallus)
  misc_feature (36): n=a or g
atagctccttccttatcacaaaggcccacagagccntgcatttccaccagctccagccccagctgcccaca

SEQ ID NO: 12178 - DNA, 71 bp, chicken (Gallus Gallus)
  misc_feature (36): n=c or t
tgccagtaacaatgttgttcaatcatcttgtacagnctttgtaaaaaggacggttcttagttttatgtatt

SEQ ID NO: 12179 - DNA, 71 bp, chicken (Gallus Gallus)
  misc_feature (36): n=c or t
tctcagaagagggtgggattttgaactgtattacantgtaggttgccagagagagtgataagaaagacaga

SEQ ID NO: 12180 - DNA, 71 bp, chicken (Gallus Gallus)
  misc_feature (36): n=c or t
cacaagcaagttgatgagattctgattgccagtcantgattacccagcatcacacaagtcaaatgggaaca

SEQ ID NO: 12181 - DNA, 71 bp, chicken (Gallus Gallus)
  misc_feature (36): n=c or t
aggcagcagtgactgagcgaggctcagagcctgtgngatctgacctctctcagatgacatatccactgaac

SEQ ID NO: 12182 - DNA, 71 bp, chicken (Gallus Gallus)
  misc_feature (36): n=a or g
gcagttcaagagattgtttttttctgctgggactgngttgaaaaagttttccagaccccttgcacaatgta

SEQ ID NO: 12183 - DNA, 71 bp, chicken (Gallus Gallus)
  misc_feature (36): n=c or t
ctgtatactatacacaaaggatgcacctacgataanttcccattagcagaaatattttacatagcccatgt

SEQ ID NO: 12184 - DNA, 71 bp, chicken (Gallus Gallus)
  misc_feature (36): n=g or t
tgaaaccagcagttctcttgatattggcttatatgnttgcctgcaattatcactctgcaggtctggcaatt

SEQ ID NO: 12185 - DNA, 71 bp, chicken (Gallus Gallus)
  misc_feature (36): n=a or g
aaaaaattggcttaaatacatatagatattttccanttcacaaatacaacatattcacttatgtccaatgc

SEQ ID NO: 12186 - DNA, 71 bp, chicken (Gallus Gallus)
  misc_feature (36): n=c or t
ctttttgactcttctagcattgtacattagcagtgngtattggcctagtatgcttgctctgcatttgttgt

SEQ ID NO: 12187 - DNA, 71 bp, chicken (Gallus Gallus)
  misc_feature (36): n=c or t
atgtctgtgcctgtacattcaataaatacatttctngtttttaggcttatttttgaatgatctcctaaaac

SEQ ID NO: 12188 - DNA, 71 bp, chicken (Gallus Gallus)
  misc_feature (36): n=a or g
ctaagctgattggaaaggaatgctttaggtttttgnttttttacataaagcttctacatgttcacatcact

SEQ ID NO: 12189 - DNA, 71 bp, chicken (Gallus Gallus)
  misc_feature (36): n=c or t
actcagcatgatggatccatgtattatccataccangattcccacatccctctgcacatccatggcttgtc

SEQ ID NO: 12190 - DNA, 71 bp, chicken (Gallus Gallus)
  misc_feature (36): n=g or t
aaaaggatttgtgaaacctggaaaaagtctgtctcnagtcagaacagtcttctggatccaacagcagcgca

SEQ ID NO: 12191 - DNA, 71 bp, chicken (Gallus Gallus)
  misc_feature (36): n=c or t
ggattctaatgcccttttgaagactatcagcttttnggcttaaaacagaagagaatcatggtttattactt

SEQ ID NO: 12192 - DNA, 71 bp, chicken (Gallus Gallus)
  misc_feature (36): n=a or g
ctcaaatctgagctgggggaaaaaaatcaatttaanggaaatgcaattctggaaagagatttaatagacaa

SEQ ID NO: 12193 - DNA, 71 bp, chicken (Gallus Gallus)
  misc_feature (36): n=a or g
gcaagttcaaatagcaaatctgagagcaaggctgcnaggtgcgttagcagggcaaccacaaacatgtcttc

SEQ ID NO: 12194 - DNA, 71 bp, chicken (Gallus Gallus)
  misc_feature (36): n=a or g
ggaagtagcaggtgtctaatcattctcagcgttgcncatggttgcttcctgaatttcacctggtaattgat

SEQ ID NO: 12195 - DNA, 71 bp, chicken (Gallus Gallus)
  misc_feature (36): n=c or t
taagaatgagagattaaaaaacatctttgctggcanttcatttttagaggcagaattagctatatctgtgc

SEQ ID NO: 12196 - DNA, 71 bp, chicken (Gallus Gallus)
  misc_feature (36): n=c or t
cagtggggcttcttcacctgccaaggatgaaaacanggtggaacaagagtggacttgctgaagtagcggtg

SEQ ID NO: 12197 - DNA, 71 bp, chicken (Gallus Gallus)
  misc_feature (36): n=a or g
tgtagttggaaatatgttcagtttcatgagagagtntgtgtattcgaaagagttgtttataaaccaaaaca

SEQ ID NO: 12198 - DNA, 71 bp, chicken (Gallus Gallus)
  misc_feature (36): n=a or g
ctgtagtagaaattgtaagatccattttgcatttantactcatgttttattattgtatgtgtaaagatgaa

SEQ ID NO: 12199 - DNA, 71 bp, chicken (Gallus Gallus)
  misc_feature (36): n=c or t
acagtcaatgaagacagtcaaaattcaatctactcntagattttcacaagcttttctgctgaaagacaact

SEQ ID NO: 12200 - DNA, 71 bp, chicken (Gallus Gallus)
  misc_feature (36): n=c or g
ccgcattggtcagagagtgctctcagagccgcattnagaagcacctgtctgtgtgaggttgcccacagccc

SEQ ID NO: 12201 - DNA, 71 bp, chicken (Gallus Gallus)
  misc_feature (36): n=c or t
gtcagctgcttctttgtcttgccatcagcacccaantgtaacacccccaacactgatgcaatcccatgagg

SEQ ID NO: 12202 - DNA, 71 bp, chicken (Gallus Gallus)
  misc_feature (36): n=g or t
attcctccatcagctgagcaagatactagctgccgngtcagttgaatgtaacagatagcctgcaccttgtc

SEQ ID NO: 12203 - DNA, 71 bp, chicken (Gallus Gallus)
  misc_feature (36): n=a or g
taattaccatactgtgatatttattcatcactcagncagcaattcatgatgcagaggcatcacaggagagc

SEQ ID NO: 12204 - DNA, 71 bp, chicken (Gallus Gallus)
  misc_feature (36): n=c or g
cataatatgcaatatgcattgcaatgtcagaaaaanagtttaataaaacctctgcagtacaatgcacgctt

SEQ ID NO: 12205 - DNA, 71 bp, chicken (Gallus Gallus)
  misc_feature (36): n=a or t
aattaatcatggtattcaacagtcaatgaagacagncaaaattcaatctactcctagattttcacaagctt

SEQ ID NO: 12206 - DNA, 71 bp, chicken (Gallus Gallus)
  misc_feature (36): n=c or t
tgatgcagtaaccataactatagtctcttcactttncttatcttccatgctgggtgatacaattaaaaaaa

SEQ ID NO: 12207 - DNA, 71 bp, chicken (Gallus Gallus)
  misc_feature (36): n=c or t
agtaaagaaaaaaagtacagaacatcctgacctaanataattctgcatctgggctactattccactttggc

SEQ ID NO: 12208 - DNA, 71 bp, chicken (Gallus Gallus)
  misc_feature (36): n=a or c
gtaaacttcagtaaagcctttataaagaaaacaaancaggccttggaataaatcatgctgaaaccatccca

SEQ ID NO: 12209 - DNA, 71 bp, chicken (Gallus Gallus)
  misc_feature (36): n=c or t
gaagctttggttccatcttcactaacttcaattttngtcttctgcaaaacatgagatacgtgtagaccttc

SEQ ID NO: 12210 - DNA, 71 bp, chicken (Gallus Gallus)
  misc_feature (36): n=a or g
gaaacttctacatgctatttagatagctttttcacnttctttaacaaacaatagaagaaaaactactcagt

SEQ ID NO: 12211 - DNA, 71 bp, chicken (Gallus Gallus)
  misc_feature (36): n=c or t
aacagtgggttttgagatgatgagctgggcctgcangaagtgctgaacaccttcctctgatggacaaaaca

SEQ ID NO: 12212 - DNA, 71 bp, chicken (Gallus Gallus)
  misc_feature (36): n=c or g
gggccgagtctgagggttctgcaaacaacctatttnaccagcaggctttgtccacagccgctgtcctttct

SEQ ID NO: 12213 - DNA, 71 bp, chicken (Gallus Gallus)
  misc_feature (36): n=c or t
taatatcagggattctttactgtcctgtagacttanggcaaggcactagagatgacctaaaaaggtcatgt

SEQ ID NO: 12214 - DNA, 71 bp, chicken (Gallus Gallus)
  misc_feature (36): n=a or g
gacacttaaagactttgaggatttctaccttcctgnataacaaaaagagattatattgccagagacttttt

SEQ ID NO: 12215 - DNA, 71 bp, chicken (Gallus Gallus)
  misc_feature (36): n=c or t
cttatgttttcctgtcttgaaagactccttgtaacnagatagaaggggcaagctttttggtgtgggattaa

SEQ ID NO: 12216 - DNA, 71 bp, chicken (Gallus Gallus)
  misc_feature (36): n=c or t
tttggctgactgtgctttcttgttcccctttacttngctgcctttgggaaaattattttaaataggaaaaa

SEQ ID NO: 12217 - DNA, 71 bp, chicken (Gallus Gallus)
  misc_feature (36): n=g or t
tggccaggaaaatacatactgaaaaaaatgggttangcaccactgtcttcaaaatataaaagcagaccaca

SEQ ID NO: 12218 - DNA, 71 bp, chicken (Gallus Gallus)
  misc_feature (36): n=c or g
acccagtgtccctggttctgggcttcagagcaacangaaacaggatcagatccccaggacataagttgata

SEQ ID NO: 12219 - DNA, 71 bp, chicken (Gallus Gallus)
  misc_feature (36): n=c or t
gcggcccagtgggtgtgcagtccctaagtagggtcngaaatgtaaaggccaattaagctccatgtggaagc

SEQ ID NO: 12220 - DNA, 71 bp, chicken (Gallus Gallus)
  misc_feature (36): n=a or g
tgaaatgaagaaaagactacacagatcatgaagcantgtgaggagttaaagaaaaatgatggtattataac

SEQ ID NO: 12221 - DNA, 71 bp, chicken (Gallus Gallus)
  misc_feature (36): n=a or g
aactaaatgcaaggactaagacaggactaagacacngatgtacatttcaacacctgaaaaatatgtatagg

SEQ ID NO: 12222 - DNA, 71 bp, chicken (Gallus Gallus)
  misc_feature (36): n=g or t
aatctccttgcatattgcattctgtgataattaaanaacatatttctagttaaagaaatgctagaaaaaca

SEQ ID NO: 12223 - DNA, 71 bp, chicken (Gallus Gallus)
  misc_feature (36): n=c or t
tataattgcagaagaatctctgtaatacccttctcntctgtttaataaatgctggttagatttggacaatt

SEQ ID NO: 12224 - DNA, 71 bp, chicken (Gallus Gallus)
  misc_feature (36): n=a or g
ttttactgtagaaagttgactgtcttccgaacaccncaggcagaatactaccatagtgagcatggcaacaa

SEQ ID NO: 12225 - DNA, 71 bp, chicken (Gallus Gallus)
  misc_feature (36): n=c or t
agaccatatccatacacaatgagaggaatttcatgnggacagttttatgactctgtttgatttttgcttgc

SEQ ID NO: 12226 - DNA, 71 bp, chicken (Gallus Gallus)
  misc_feature (36): n=c or t
gccctggtgcacacctccatgacaggcctccctctngcttacctttttgccctctgtgttttgaactgtgg

SEQ ID NO: 12227 - DNA, 71 bp, chicken (Gallus Gallus)
  misc_feature (36): n=c or t
ctgaaaacaaaaataaactctgccattaatgacatncttccaaaatcgaaacccgctctgaaacattgcta

SEQ ID NO: 12228 - DNA, 71 bp, chicken (Gallus Gallus)
  misc_feature (36): n=c or t
atagtatgtgcctgcatgtctgaggcagtttgtgtnggtgcaaaggagaaacaaaaccattcttctgctct

SEQ ID NO: 12229 - DNA, 71 bp, chicken (Gallus Gallus)
  misc_feature (36): n=c or t
ggaattttattttttttaatgtaacttactgatttnatttcagctatagcactaattaaatgttcctcaca

SEQ ID NO: 12230 - DNA, 71 bp, chicken (Gallus Gallus)
  misc_feature (36): n=c or t
attttattgggccaattgtaaaaatgaagctctggncatctcggctgccgttatcttcttcctgatgcgtg

SEQ ID NO: 12231 - DNA, 71 bp, chicken (Gallus Gallus)
  misc_feature (36): n=c or t
gaatggctccagagaagccatactggttggataccnagcacacttgtgagaaacttgtatgttcatccatc

SEQ ID NO: 12232 - DNA, 71 bp, chicken (Gallus Gallus)
  misc_feature (36): n=c or t
ctggcacattcttacatgactcaaaatcctgctttntccccaccgtcagctgctccccattgtggaagttg

SEQ ID NO: 12233 - DNA, 71 bp, chicken (Gallus Gallus)
  misc_feature (36): n=c or t
atgggtttacctgttaacgctgttacatagaaatgnaagcagtactacagataaattgcaagttccttttc

SEQ ID NO: 12234 - DNA, 71 bp, chicken (Gallus Gallus)
  misc_feature (36): n=a or t
tttttgtaactgcagtttgttacatttagcagattnctaaactagtaactaaatgcaaactaaagtagtag

SEQ ID NO: 12235 - DNA, 71 bp, chicken (Gallus Gallus)
  misc_feature (36): n=c or t
ttattctaagacttggaaataaagtaataccaaccngatccaagtcaaatagtctagaatcgtttcataag

SEQ ID NO: 12236 - DNA, 71 bp, chicken (Gallus Gallus)
  misc_feature (36): n=g or t
caaagcagttatttggctgtacttacctcttctgangagaggacactgcttacatactacaataatcttag

SEQ ID NO: 12237 - DNA, 71 bp, chicken (Gallus Gallus)
  misc_feature (36): n=c or t
aaaaggagagaggcaatatagttaatatggcttccntcatcatgtttaattttttgatggggatgaaagcc

SEQ ID NO: 12238 - DNA, 71 bp, chicken (Gallus Gallus)
  misc_feature (36): n=a or g
atactctagggctgaatgtcacagtagctcttagcnagctgtgcataaaaagatggaaggggaatctcgtg

SEQ ID NO: 12239 - DNA, 71 bp, chicken (Gallus Gallus)
  misc_feature (36): n=c or t
tgacataacacagtagaattattttggcataataanggtgcatggaacgtactcttgcattaaaaaagtgt

SEQ ID NO: 12240 - DNA, 71 bp, chicken (Gallus Gallus)
  misc_feature (36): n=c or t
tttctgactggggctaaaagagaagctgtgtaatgnacacctgatctactcattcctttcttaactacaag

SEQ ID NO: 12241 - DNA, 71 bp, chicken (Gallus Gallus)
  misc_feature (36): n=a or g
aaaaaaataaaataaaaaaaaaaaatcatggagccngtgtaactgcaatagttttaatctgtaactgtaac

SEQ ID NO: 12242 - DNA, 71 bp, chicken (Gallus Gallus)
  misc_feature (36): n=c or t
attaattaataaagtgagatttgccagtatacaagnttagagaaatttgcaaattcagtttaaaacacatc

SEQ ID NO: 12243 - DNA, 71 bp, chicken (Gallus Gallus)
  misc_feature (36): n=a or c
tgttttctgggcatagaactaaaacagtgggtatanttgccttgcagtgtccttctacttcacaaaatctt

SEQ ID NO: 12244 - DNA, 71 bp, chicken (Gallus Gallus)
  misc_feature (36): n=a or g
cacaaacatttattttctcaatattttttattatcnctgttatttgtaattattatgcaattgaatttgta

SEQ ID NO: 12245 - DNA, 71 bp, chicken (Gallus Gallus)
  misc_feature (36): n=c or t
ctgcacagaacaggaaggttcctaaaaacacttagnaactcacttacagaaagtgccacagaacattcatt

SEQ ID NO: 12246 - DNA, 71 bp, chicken (Gallus Gallus)
  misc_feature (36): n=c or g
ttcctggtgcatagccagtattggagaattcaggtnctggtgccgggttatttgctgtaagaatgcaacat

SEQ ID NO: 12247 - DNA, 71 bp, chicken (Gallus Gallus)
  misc_feature (36): n=a or g
gaaaggtggtgtcccttatgtcagaggcagtatcantagagtctgcatctggctctgctcccaggtccgct

SEQ ID NO: 12248 - DNA, 71 bp, chicken (Gallus Gallus)
  misc_feature (36): n=c or t
gcacatactggaaatgctgcctgaaagaaggaaaantccactgagaatttgacccaccacttaccatggcc

SEQ ID NO: 12249 - DNA, 71 bp, chicken (Gallus Gallus)
  misc_feature (36): n=c or t
ccagtattcctctaccacatcatccttacttaaagnctcagccaatgattttaaaatactatgccacctgt

SEQ ID NO: 12250 - DNA, 71 bp, chicken (Gallus Gallus)
  misc_feature (36): n=c or t
acatacatggccactgctgaagtggagagagaaaangcttccttgggaaagaagtccttgaaggatacctc

SEQ ID NO: 12251 - DNA, 71 bp, chicken (Gallus Gallus)
  misc_feature (36): n=c or t
ttagagaaagctttcatcagggctcatctcctttgncaaggtcataagctatttcttcttattccctctct

SEQ ID NO: 12252 - DNA, 71 bp, chicken (Gallus Gallus)
  misc_feature (36): n=c or g
tacatgattttgtgaagacaatgttatacagatgcnatacgacactcccttatcaactgctcagcaaattg

SEQ ID NO: 12253 - DNA, 71 bp, chicken (Gallus Gallus)
  misc_feature (36): n=a or g
gcagcacagaaagttaggtaaatgtgtatatgaaangaacgggaaaaaaaataaccactttgctccagttt

SEQ ID NO: 12254 - DNA, 71 bp, chicken (Gallus Gallus)
  misc_feature (36): n=a or g
gcagaggcagtaagaaaagctattgggaagagcacntgagcatgctctctgtggtctccctaacttcctca

SEQ ID NO: 12255 - DNA, 71 bp, chicken (Gallus Gallus)
  misc_feature (36): n=g or t
ataccaagctttggcattaacacttgcaattacgcnaacaggtacgtgtcaaaatctattacattacttgt

SEQ ID NO: 12256 - DNA, 71 bp, chicken (Gallus Gallus)
  misc_feature (36): n=c or t
gcctaggaaattaagttacagaaaattgtgcttccntgtaatagatttaagcagcaatctttagcagtctg

SEQ ID NO: 12257 - DNA, 71 bp, chicken (Gallus Gallus)
  misc_feature (36): n=a or g
atcagattgagaaatacagatatgttgctaaagagntgctgtttcacaatgttcttccttggcaaactctt

SEQ ID NO: 12258 - DNA, 71 bp, chicken (Gallus Gallus)
  misc_feature (36): n=a or g
caacttgcacctctcccccgttcgtagtaggattanaaatgccacgaagtcagcttgtagcactgacaagg

SEQ ID NO: 12259 - DNA, 71 bp, chicken (Gallus Gallus)
  misc_feature (36): n=a or g
gtgttgaggaaacaacaataaatctgcaagaaaacnaggcagctggcaaaaggagcttggctcagttgtcc

SEQ ID NO: 12260 - DNA, 71 bp, chicken (Gallus Gallus)
  misc_feature (36): n=a or g
ttttggcagagagaagcaatgcaaaggttcaaagcngcagaaataggaaaggattcctttcacgtcagcag

SEQ ID NO: 12261 - DNA, 71 bp, chicken (Gallus Gallus)
  misc_feature (36): n=a or g
tccatagaagacaactctacagtgcagggacatgcntgctgctggcagggatcagagcagagctgaatgtg

SEQ ID NO: 12262 - DNA, 71 bp, chicken (Gallus Gallus)
  misc_feature (36): n=c or t
gcacagtctggctttaattcatggcagagcctgganctccagtactgggaaaaggccttggatgtgttctg

SEQ ID NO: 12263 - DNA, 71 bp, chicken (Gallus Gallus)
  misc_feature (36): n=a or g
tgtgcctggtttctctcatggtctccgggtctccantcccaacagttgctttggaggctgaagacagagcc

SEQ ID NO: 12264 - DNA, 71 bp, chicken (Gallus Gallus)
  misc_feature (36): n=a or g
tatcctaatttcccatcactggtgagcttgtacctntttggaaaaagacttgcggcttgtgtagcactgaa

SEQ ID NO: 12265 - DNA, 71 bp, chicken (Gallus Gallus)
  misc_feature (36): n=g or t
ttagaactgatttatttatttatttatttaatatcntttttaattatgctgctattagaaaggtgacttca

SEQ ID NO: 12266 - DNA, 71 bp, chicken (Gallus Gallus)
  misc_feature (36): n=a or c
cacccaagaagtgaagctcagtctgtggattaaatnattaggaatagagtttaaaaatgcaacaaaaaaca

SEQ ID NO: 12267 - DNA, 71 bp, chicken (Gallus Gallus)
  misc_feature (36): n=a or g
tttgttttttaattttattttcctccactgcagagngggagaaggcaaacaaatcagttctccagttccac

SEQ ID NO: 12268 - DNA, 71 bp, chicken (Gallus Gallus)
  misc_feature (36): n=c or t
acagtcagatacagctcatctgccagcaaataatancatgctatagcattttgtacatcaacacaatcaca

SEQ ID NO: 12269 - DNA, 71 bp, chicken (Gallus Gallus)
  misc_feature (36): n=g or t
ctgctgttcgtagggcagaagttggggttgtgtttngaggcataaccaagccttcaaaggtagcctttgaa

SEQ ID NO: 12270 - DNA, 71 bp, chicken (Gallus Gallus)
  misc_feature (36): n=c or t
gattctggaagtgctcatgagttaaaatcaggatgnttctaaaaccagcgcataatattcatctggcatct

SEQ ID NO: 12271 - DNA, 71 bp, chicken (Gallus Gallus)
  misc_feature (36): n=c or t
tttgggaaggggcaaactggcacttcttcctgaaanacaaagctctgttggatagttttttgtttactttt

SEQ ID NO: 12272 - DNA, 71 bp, chicken (Gallus Gallus)
  misc_feature (36): n=c or g
gcatgtgctgataagtcggcgttgtgacctgggacntcagcctagcggtgcccaccactgcatccatcctt

SEQ ID NO: 12273 - DNA, 71 bp, chicken (Gallus Gallus)
  misc_feature (36): n=c or t
aaatcactttctaaggcagcacggacaccagctggngctgatttattcattgcaagcacgtgcttctatag

SEQ ID NO: 12274 - DNA, 71 bp, chicken (Gallus Gallus)
  misc_feature (36): n=c or t
gaaaccggaatgtacattcttactaaagcacagatngaatcttcatttaatttcttgtcttttaacagaaa

SEQ ID NO: 12275 - DNA, 71 bp, chicken (Gallus Gallus)
  misc_feature (36): n=a or g
aaaccacgaccaggtttcccaactacacacaacgtntgcaaaagaagccacgttttctttgaaaaaggaga

SEQ ID NO: 12276 - DNA, 71 bp, chicken (Gallus Gallus)
  misc_feature (36): n=c or t
cgggctaaagcccagttcatctgttcttcacacttntcctacctggggagaacgctgactttagagatatt

SEQ ID NO: 12277 - DNA, 71 bp, chicken (Gallus Gallus)
  misc_feature (36): n=c or t
gaacatctccagaggtggtgacccaatgacttctcngggtagcctgtgccaatacactaacagtgtttctg

SEQ ID NO: 12278 - DNA, 71 bp, chicken (Gallus Gallus)
  misc_feature (36): n=a or g
tggaactggagagaaattagtttgtgtgtgctagcntagtggaaatgctaagtcatggcctgaaccagtga

SEQ ID NO: 12279 - DNA, 71 bp, chicken (Gallus Gallus)
  misc_feature (36): n=c or t
ctgtattccctcctccgccttgcccagcatcgcttncatcaagctgtttgtggagcaggcactcctgcacc

SEQ ID NO: 12280 - DNA, 71 bp, chicken (Gallus Gallus)
  misc_feature (36): n=c or t
taaagctaactgcttggttaaatgctctaaacaaancgctgggaaccctagaaataaatacagcagttaag

SEQ ID NO: 12281 - DNA, 71 bp, chicken (Gallus Gallus)
  misc_feature (36): n=a or g
gagtttgttctgttctctcatctcattgctaacttngatgccaccccctgtgactgcaccacagccaagtc

SEQ ID NO: 12282 - DNA, 71 bp, chicken (Gallus Gallus)
  misc_feature (36): n=a or g
tgtgtggggccactcttggttaaaaacacacatacncaacacatttcttttgatatttgtatttctgatcg

SEQ ID NO: 12283 - DNA, 71 bp, chicken (Gallus Gallus)
  misc_feature (36): n=c or t
caacactggggaccatggaaggaaagcaggattgantcaagccctccagaagtcctattgccaagtcaggc

SEQ ID NO: 12284 - DNA, 71 bp, chicken (Gallus Gallus)
  misc_feature (36): n=a or g
tagaaagactcttctggaaatttctggatgcaccanaaattgtttgttgaaaatcactcatcattaggaaa

SEQ ID NO: 12285 - DNA, 71 bp, chicken (Gallus Gallus)
  misc_feature (36): n=a or g
taggtaaggggatttacaggggaattaagctcacanccactccaaaatccaagacaagatcccaccatcgt

SEQ ID NO: 12286 - DNA, 71 bp, chicken (Gallus Gallus)
  misc_feature (36): n=a or t
tcagtagtataccagggttccttgcagtgcttgtanaatccctgagcttactcttcaaagaggcacctctc

SEQ ID NO: 12287 - DNA, 71 bp, chicken (Gallus Gallus)
  misc_feature (36): n=a or g
agtatttgaaaactagtggttctgtgtgtgcagctnttgctctgcaaggtgctgctcaatgcagatgttca

SEQ ID NO: 12288 - DNA, 71 bp, chicken (Gallus Gallus)
  misc_feature (36): n=a or g
gttgggtaaaagggttaaaacagagaaaagagtgcntaatccagcagtggctctcaggatgccctaggcat

SEQ ID NO: 12289 - DNA, 71 bp, chicken (Gallus Gallus)
  misc_feature (36): n=c or t
gcatgtggccaactgctctgagacaccagtgcgccngtggttgtatattttatactttttgaactttattt

SEQ ID NO: 12290 - DNA, 71 bp, chicken (Gallus Gallus)
  misc_feature (36): n=a or g
taataaaagctttatctcagtctacatccttttacnaggaaggcaaacggcaaataaaagagcagcgtgtg

SEQ ID NO: 12291 - DNA, 71 bp, chicken (Gallus Gallus)
  misc_feature (36): n=c or t
gagggcctgcacccaaacacacagggtgttaatatngtttcaatattcggaagccactgaaaggcatggtg

SEQ ID NO: 12292 - DNA, 71 bp, chicken (Gallus Gallus)
  misc_feature (36): n=a or t
tggaaaagcaaagaccaagccaggtacagcagcaangccaagcagggagggggaagctcccagcagacttg

SEQ ID NO: 12293 - DNA, 71 bp, chicken (Gallus Gallus)
  misc_feature (36): n=c or t
ctgtgggaagaaggcatccaagtgtcccaagttgtntgagcagccagctagaagctttacacaggaagaaa

SEQ ID NO: 12294 - DNA, 71 bp, chicken (Gallus Gallus)
  misc_feature (36): n=a or g
aaaataaaaaggaggaaggctggaacactggaaatnctttcaagaaaacagtcttttgctcatctctggtc

SEQ ID NO: 12295 - DNA, 71 bp, chicken (Gallus Gallus)
  misc_feature (36): n=a or g
agggtgaaactggtgctattctttaaattattcacngctgcaagaccgattttagacgagtacatgtgcat

SEQ ID NO: 12296 - DNA, 71 bp, chicken (Gallus Gallus)
  misc_feature (36): n=c or t
atataaagcttggaaaaagaaccaacagaactctcngtgcacttggatgctgcagagacctggtctaacag

SEQ ID NO: 12297 - DNA, 71 bp, chicken (Gallus Gallus)
  misc_feature (36): n=a or g
gaaaacacctcctatttgaacggtccctttccatcnaggagtcttaattgaacaggcatttgctgcctgat

SEQ ID NO: 12298 - DNA, 71 bp, chicken (Gallus Gallus)
  misc_feature (36): n=a or t
ctgttcattcactctacgacttcacatgcagtgaantcaacttcaccacttgccacaattccttcacctgg

SEQ ID NO: 12299 - DNA, 71 bp, chicken (Gallus Gallus)
  misc_feature (36): n=c or t
tagcttcacagctcagggaccattgctggtgcatcnctggactttccaatatattaaaaaatattttttca

SEQ ID NO: 12300 - DNA, 71 bp, chicken (Gallus Gallus)
  misc_feature (36): n=a or g
aaaagcttttgctttgggctgtttttcagaagaggnaagaatgggagagtggcactggaggagcacaggtc

SEQ ID NO: 12301 - DNA, 71 bp, chicken (Gallus Gallus)
  misc_feature (36): n=c or t
atttattttttttaactaatatcctaccggttatangtatgaaaagacaggggagttttacagcagtgaag

SEQ ID NO: 12302 - DNA, 71 bp, chicken (Gallus Gallus)
  misc_feature (36): n=g or t
atacagtcttgttattgtgattaacaagctcctttngggaaaaaaaaaaaggacttggcttacaggttctc

SEQ ID NO: 12303 - DNA, 71 bp, chicken (Gallus Gallus)
  misc_feature (36): n=a or g
agcctgttgcatgaagctgctagatgcagcagcctntagcatgaagcactttattccccaaacacctagcc

SEQ ID NO: 12304 - DNA, 71 bp, chicken (Gallus Gallus)
  misc_feature (36): n=a or c
ataacgctgatgctcctgaaagctgaaaccttgagntttgggctttgaatagacaaaagtagatgaaagtc

SEQ ID NO: 12305 - DNA, 71 bp, chicken (Gallus Gallus)
  misc_feature (36): n=c or t
tacttggagtctctgtgctgctttttgatatacttnggctgcataagaaacaattacactgatccatattt

SEQ ID NO: 12306 - DNA, 71 bp, chicken (Gallus Gallus)
  misc_feature (36): n=g or t
gtagcacacaagtgctatttccggggtttgtgcaanaattatttcaaatactactgaagtttagagctaga

SEQ ID NO: 12307 - DNA, 71 bp, chicken (Gallus Gallus)
  misc_feature (36): n=c or t
ctggagaaaagtgatgaggagttggcgtgtgaccantactgccacaactacatcggtgggtactactgctc

SEQ ID NO: 12308 - DNA, 71 bp, chicken (Gallus Gallus)
  misc_feature (36): n=a or g
tcaaatccctgtaattggggttgagtcaaatccgcngcgctgctggtttggttgatctggaggatttacac

SEQ ID NO: 12309 - DNA, 71 bp, chicken (Gallus Gallus)
  misc_feature (36): n=c or g
ggctgtgggaaattctacaaatgcatacctatttgnaagaggaagatttcagtcagcttgggaggcacagg

SEQ ID NO: 12310 - DNA, 71 bp, chicken (Gallus Gallus)
  misc_feature (36): n=c or t
agctgatgtggcccacgctttttcaccaccgggttntttaatcgtctccctgtctgagtgctcagccccgg

SEQ ID NO: 12311 - DNA, 71 bp, chicken (Gallus Gallus)
  misc_feature (36): n=c or g
tattcactgctcagcatagacgagtgtgcagatttnaggaagggcaacaactcccacagccctaccgctcc

SEQ ID NO: 12312 - DNA, 71 bp, chicken (Gallus Gallus)
  misc_feature (36): n=a or g
agcctgcagttttgattaactcagataatttcatgntgtttgtgaaaaactaaaggtgacaacaggaagct

SEQ ID NO: 12313 - DNA, 71 bp, chicken (Gallus Gallus)
  misc_feature (36): n=a or t
tattctgtttacttgtatatgtgtaaaaggtagcancggaatgttttcatgttcagatattgctgagacag

SEQ ID NO: 12314 - DNA, 71 bp, chicken (Gallus Gallus)
  misc_feature (36): n=a or g
ttgccctgcaaactccaggagagcaactgcatggcngaacttcgagaacaggccagaaagcaatataattc

SEQ ID NO: 12315 - DNA, 71 bp, chicken (Gallus Gallus)
  misc_feature (36): n=a or g
gtggggagtggcacagctcccatttttgggtaaaanagagggaacgggactcagggatgagctggcacctg

SEQ ID NO: 12316 - DNA, 71 bp, chicken (Gallus Gallus)
  misc_feature (36): n=c or t
agtgtccggacctgctgctgcttcgagagctgatcncttctgcaatgctgttctctcctggctttgggctc

SEQ ID NO: 12317 - DNA, 71 bp, chicken (Gallus Gallus)
  misc_feature (36): n=c or t
atttaaataagtcatcgaatttcaagaaagtgcttnttaaaaggtatttttttttattaaggagcatatgt

SEQ ID NO: 12318 - DNA, 71 bp, chicken (Gallus Gallus)
  misc_feature (36): n=g or t
tccatttagtgaggtcagcgctgctggcagcagcancaaaatccagaggctcagtggtccagagtttgaag

SEQ ID NO: 12319 - DNA, 71 bp, chicken (Gallus Gallus)
  misc_feature (36): n=a or c
aaataccagttattacatcagttctctataaatccnaggaatcaatgactgggttgtgcagtgaagttaag

SEQ ID NO: 12320 - DNA, 71 bp, chicken (Gallus Gallus)
  misc_feature (36): n=a or g
ccaaatttccctcacgctgattacattataagatgnaaaatggcaatttgtcagcaaaagatatgagtaaa

SEQ ID NO: 12321 - DNA, 71 bp, chicken (Gallus Gallus)
  misc_feature (36): n=a or g
tgtttcttaagatcagtttccttcagactgagcccnatagaagcccaagcccagagaatactgcactcagc

SEQ ID NO: 12322 - DNA, 71 bp, chicken (Gallus Gallus)
  misc_feature (36): n=a or g
atcctggattttggctatcctcagaactctgaaacnggggctctgaagaccttcatcactcagcaaggcat

SEQ ID NO: 12323 - DNA, 71 bp, chicken (Gallus Gallus)
  misc_feature (36): n=a or g
aagccactcgttcaagaggagcaaagtgcgttatcncgtactgagggagctacggctcagccaggctgaga

SEQ ID NO: 12324 - DNA, 71 bp, chicken (Gallus Gallus)
  misc_feature (36): n=a or g
aacatctttcctgttttatcagtatcacccagtacngatggtcagtgtcgagtttgctgtggctgccacaa

SEQ ID NO: 12325 - DNA, 71 bp, chicken (Gallus Gallus)
  misc_feature (36): n=c or g
ttacacagcaccaaactatcagcaaagtcactcagntccacaggaagattattctcagcacccatgcgacg

SEQ ID NO: 12326 - DNA, 71 bp, chicken (Gallus Gallus)
  misc_feature (36): n=c or g
gggaaccgtggcaactttccttatagctcagacaanagcaaagaggagggggaaaatgcggaaaaaaaata

SEQ ID NO: 12327 - DNA, 71 bp, chicken (Gallus Gallus)
  misc_feature (36): n=a or g
ggggtcctcaggttgttgtgtagggagagcatcttntcatcatgttccaacttgatttgttgtctttcctt

SEQ ID NO: 12328 - DNA, 71 bp, chicken (Gallus Gallus)
  misc_feature (36): n=a or t
gaatacaaattatttggtgctatacgtacaaagtcnctagcagttctttgcagtggtgctttagctctctg

SEQ ID NO: 12329 - DNA, 71 bp, chicken (Gallus Gallus)
  misc_feature (36): n=a or g
tgggcttctgccagaggaggtggtgggctccctggntcttgccgccttcttatttcttgcaaagtcttcag

SEQ ID NO: 12330 - DNA, 71 bp, chicken (Gallus Gallus)
  misc_feature (36): n=a or g
acaactacccaccaaccctcactcttagctcacctnttctggctacttaaaaaaatgttttagaaatttcc

SEQ ID NO: 12331 - DNA, 71 bp, chicken (Gallus Gallus)
  misc_feature (36): n=c or t
ctccgaccgcactatggcaagctgaaggagatctangagaacatggcccccggggagaacaaggtgagcgc

SEQ ID NO: 12332 - DNA, 71 bp, chicken (Gallus Gallus)
  misc_feature (36): n=c or t
aaattaacatgacttgtggtaaccaggaaattcttntcctccaccaggcaaggaatggcacgagaattgga

SEQ ID NO: 12333 - DNA, 71 bp, chicken (Gallus Gallus)
  misc_feature (36): n=c or t
tgaagggctttaaatccttgcattttgctgccagcngagggaagcaggtcctgctgggaacccaaccccat

SEQ ID NO: 12334 - DNA, 71 bp, chicken (Gallus Gallus)
  misc_feature (36): n=c or t
ctgtgcccctgctatgggacacctatggggctgcanatgtgcatgcatctgtgcaaagccatcagcatggg

SEQ ID NO: 12335 - DNA, 71 bp, chicken (Gallus Gallus)
  misc_feature (36): n=c or t
agctttgcttcctaagcaaaaagcagagcaagcaantgacagtttaagcctgctgtttctagaatggggcc

SEQ ID NO: 12336 - DNA, 71 bp, chicken (Gallus Gallus)
  misc_feature (36): n=c or t
catctcctttcagttatcctgggcaagtcccactangtgctctacgggctggttgcagccatgcagccccg

SEQ ID NO: 12337 - DNA, 71 bp, chicken (Gallus Gallus)
  misc_feature (36): n=c or t
gaggagctagcagtacatgagctagcacactgtacngcagtaccagacattacatgaggatcttactttgc

SEQ ID NO: 12338 - DNA, 71 bp, chicken (Gallus Gallus)
  misc_feature (36): n=c or t
acacagcaatgcagtcactgcttttgttaatggttncagttctcctgattagggtgactagagcagaaact

SEQ ID NO: 12339 - DNA, 71 bp, chicken (Gallus Gallus)
  misc_feature (36): n=c or t
caaagcatttgaaaaaaggcaatgagcagaagttgnctgcgcagcaagagtgcttgttgtgtaagaaactg

SEQ ID NO: 12340 - DNA, 71 bp, chicken (Gallus Gallus)
  misc_feature (36): n=a or t
ttatgacattacaacacatgcactatttatttattncactgagatgcagacaacttagaaaacacaacaaa

SEQ ID NO: 12341 - DNA, 71 bp, chicken (Gallus Gallus)
  misc_feature (36): n=c or t
tggttttgtcttgacttaaagcattatgccaagatngctgtgaaatcctgcttatagtaacatttgtactc

SEQ ID NO: 12342 - DNA, 71 bp, chicken (Gallus Gallus)
  misc_feature (36): n=a or g
acaagagaaaacagaaccactgttagaagaaaaccngtcttaaatgcacttagtctattatcttattaaag

SEQ ID NO: 12343 - DNA, 71 bp, chicken (Gallus Gallus)
  misc_feature (36): n=c or t
aacaaatgctggtctgaactcacttgaatgtgctangaactgtacttgtgttacaactaagtatttttcta

SEQ ID NO: 12344 - DNA, 71 bp, chicken (Gallus Gallus)
  misc_feature (36): n=a or g
aagtttcatggcatcatggtgtctttgtccactagntggaagagagccctcatggcagcctggtagttaag

SEQ ID NO: 12345 - DNA, 71 bp, chicken (Gallus Gallus)
  misc_feature (36): n=a or g
aaaagtaaagattaggagcagggctgtcggttagcntagcaaagagcaagtatcagctccttacagttcac

SEQ ID NO: 12346 - DNA, 71 bp, chicken (Gallus Gallus)
  misc_feature (36): n=a or g
ttcctgacctttgttttttgtacctcatgaactgangagattgtgtgatgctgaacagacaaggtatggat

SEQ ID NO: 12347 - DNA, 71 bp, chicken (Gallus Gallus)
  misc_feature (36): n=c or t
atgcttataactaaaaggactggttttaatgctcantgaagatgtacaggctctactatatgctagctata

SEQ ID NO: 12348 - DNA, 71 bp, chicken (Gallus Gallus)
  misc_feature (36): n=a or t
ggcgatgtccgttttcatttgcttgcatggttctcnttaatttcaggacctctacagatcagacactagag

SEQ ID NO: 12349 - DNA, 71 bp, chicken (Gallus Gallus)
  misc_feature (36): n=c or t
aaatattttaccagcaactttttaaaacttaagacnataaaaactggatatttgtgcctttcactatgttc

SEQ ID NO: 12350 - DNA, 71 bp, chicken (Gallus Gallus)
  misc_feature (36): n=c or g
ttaagttaccacagacctaattcatccatgtgtctnagcagacctaaataaatgatataataaaaggatat

SEQ ID NO: 12351 - DNA, 71 bp, chicken (Gallus Gallus)
  misc_feature (36): n=a or t
tttggcaggtgagagttcctgaaaaacttcagcctntcaagcctgttgttgtacaatacttacttaatgca

SEQ ID NO: 12352 - DNA, 71 bp, chicken (Gallus Gallus)
  misc_feature (36): n=a or g
gaatattctaaaatagaataccttatttacattgtntgtagtactgtatttgtttcttccagacctgctgg

SEQ ID NO: 12353 - DNA, 71 bp, chicken (Gallus Gallus)
  misc_feature (36): n=a or g
gattagttttgatagtttcagcataatgatgttganaagttattccactgtcagctacaaatagtttgaca

SEQ ID NO: 12354 - DNA, 71 bp, chicken (Gallus Gallus)
  misc_feature (36): n=c or g
ttctgtcacctctggcctggtcatgtttgcttcttngtctttcatatagggttgctccctaaactcagtgg

SEQ ID NO: 12355 - DNA, 71 bp, chicken (Gallus Gallus)
  misc_feature (36): n=a or g
ctgaagccatgtctgcttcatgaggcaaagaacacnaagggcatacaacatgttactggttgaaccatctg

SEQ ID NO: 12356 - DNA, 71 bp, chicken (Gallus Gallus)
  misc_feature (36): n=c or t
aggcttccttgtgctcactgcagacagtggaccttnacatttcatttcacccttctcactgcaggtttcaa

SEQ ID NO: 12357 - DNA, 71 bp, chicken (Gallus Gallus)
  misc_feature (36): n=a or g
ttagcactttgcccacacatcttaaggactcgacanctccctttttttcagtcctttagatggcaactttc

SEQ ID NO: 12358 - DNA, 71 bp, chicken (Gallus Gallus)
  misc_feature (36): n=c or t
atgaaatggtcccaaagaacagcattcactccaaanggaaaacaatgactaagtctcctggaaaaactttg

SEQ ID NO: 12359 - DNA, 71 bp, chicken (Gallus Gallus)
  misc_feature (36): n=c or t
cccaaacatctgattctgtccaaaaagaagacagantccatgaaggagcacatcactgatgccaagacatg

SEQ ID NO: 12360 - DNA, 71 bp, chicken (Gallus Gallus)
  misc_feature (36): n=a or c
tttcatttgatttgttctttttttcctcaaagattncttggagattcctttgagtgaggtacgtccctgga

SEQ ID NO: 12361 - DNA, 71 bp, chicken (Gallus Gallus)
  misc_feature (36): n=a or t
atctataccaaggagtctgagaaaaatgaagctgcncaaacggtaaaaacctcccctgtacatctcatcat

SEQ ID NO: 12362 - DNA, 71 bp, chicken (Gallus Gallus)
  misc_feature (36): n=c or t
tctatagtcatgctaaggaataaatgtctaatgaangcacttcaagtctgtaactgctatcactatcattt

SEQ ID NO: 12363 - DNA, 71 bp, chicken (Gallus Gallus)
  misc_feature (36): n=c or t
aaaattttaactcttgaaagagaagtgttaattatnagacagccccatttagaagtagactcacacgtgtc

SEQ ID NO: 12364 - DNA, 71 bp, chicken (Gallus Gallus)
  misc_feature (36): n=c or t
tgaagacagcagccagtgatcaactacagcacctcngctgtagagtggtgagcatatcaaaccacagtgta

SEQ ID NO: 12365 - DNA, 71 bp, chicken (Gallus Gallus)
  misc_feature (36): n=a or g
cctcacgtgcttcagaaagcccaaatgctggatgcnctcaggaagctgtagctggtgcaggagccctaaga

SEQ ID NO: 12366 - DNA, 71 bp, chicken (Gallus Gallus)
  misc_feature (36): n=a or g
aaggctgttgccatggtgatgaaggagattccgagngatgaggctgcagaggaaaagcccctcctcactat

SEQ ID NO: 12367 - DNA, 71 bp, chicken (Gallus Gallus)
  misc_feature (36): n=c or g
caacatatgacacatacaatacacgtgggaaagtanagaaacaaagaaacatggtaacatatatattcttg

SEQ ID NO: 12368 - DNA, 71 bp, chicken (Gallus Gallus)
  misc_feature (36): n=c or t
aggaaggctggtttgctgaatgagcttaaaatcttnttgcatgcatctgccaggactgtgcatttctgtat

SEQ ID NO: 12369 - DNA, 71 bp, chicken (Gallus Gallus)
  misc_feature (36): n=c or t
tttagccatctccggtctgatctgcataaacactanctgaggttgtatttaaaagcaaacaaacaaaaacc

SEQ ID NO: 12370 - DNA, 71 bp, chicken (Gallus Gallus)
  misc_feature (36): n=g or t
gtacgctacttaattttacggtcagaaaaactgctncttttagcaacttgtaatcttgaatctgttggaag

SEQ ID NO: 12371 - DNA, 71 bp, chicken (Gallus Gallus)
  misc_feature (36): n=a or g
ccatcctttcattatttcatcgtgctgattcatctntgttcaagattgttcagagctgagatttgattctg

SEQ ID NO: 12372 - DNA, 71 bp, chicken (Gallus Gallus)
  misc_feature (36): n=c or t
tctgccctgaccttggtgcccccagggctgtttctngttttctcactcttctctcccagctgcaaagcagt

SEQ ID NO: 12373 - DNA, 71 bp, chicken (Gallus Gallus)
  misc_feature (36): n=a or g
ataaacatcagacagggagatcctctgagaggtgcntatccaaatcacacctgatgccagatttgacgtat

SEQ ID NO: 12374 - DNA, 71 bp, chicken (Gallus Gallus)
  misc_feature (36): n=a or g
ggagggtctactccaaactagaaatgtatccctacnacatccaaaacttcattcccaaatattaacggcca

SEQ ID NO: 12375 - DNA, 71 bp, chicken (Gallus Gallus)
  misc_feature (36): n=a or c
tggaaaaaaaaaaaaaaaagaaaaaaaagaatcccnaaagcatttactgcaaatttctaatgaattgtaag

SEQ ID NO: 12376 - DNA, 71 bp, chicken (Gallus Gallus)
  misc_feature (36): n=a or g
tcctctaccaaaagtattgcataaaagccttctgantgaagatagtgacagatccttctctctgtcaaagt

SEQ ID NO: 12377 - DNA, 71 bp, chicken (Gallus Gallus)
  misc_feature (36): n=c or t
caagggattattatgatattcctgcaacgtctgtgngtttgctatgctgctgtgatgccagattaatgcgg

SEQ ID NO: 12378 - DNA, 71 bp, chicken (Gallus Gallus)
  misc_feature (36): n=c or t
gggtgccctgtgtgggagaaggccctgaactgctcntcaacataaggagaggctctaagaggcatatagag

SEQ ID NO: 12379 - DNA, 71 bp, chicken (Gallus Gallus)
  misc_feature (36): n=a or g
attcacactgtataaaagtgatctgaatatgttacntttccataacaccagcaggcagacaaatttccata

SEQ ID NO: 12380 - DNA, 71 bp, chicken (Gallus Gallus)
  misc_feature (36): n=a or g
ctttttttaatattcactccagttgaaattcaccanttgaactcaactagttctacttactgtatactaag

SEQ ID NO: 12381 - DNA, 71 bp, chicken (Gallus Gallus)
  misc_feature (36): n=a or c
tgcgtcccttcgtcacctgagagcttctgcaaaagnaaagcaattcttttaaagtgtctgaggaataccag

SEQ ID NO: 12382 - DNA, 71 bp, chicken (Gallus Gallus)
  misc_feature (36): n=c or t
aaggtgaggcaagtctcctgaaaaggttattatctngagcagacaaatccttcagcaggttgggccttttt

SEQ ID NO: 12383 - DNA, 71 bp, chicken (Gallus Gallus)
  misc_feature (36): n=a or g
agaaagtagagtcacagaagcatgaaggttgggaangacctctgggatcaggcagtctgaccgtccagctg

SEQ ID NO: 12384 - DNA, 71 bp, chicken (Gallus Gallus)
  misc_feature (36): n=c or t
ttttaacatatcctctaaaaccttgatgttgaattncagtaccatgtcagttccattacatcctctggtct

SEQ ID NO: 12385 - DNA, 71 bp, chicken (Gallus Gallus)
  misc_feature (36): n=a or g
ttgggctgcaccattttaattcagggaagaatttgnccccttatgtttaacttgtctctattttctttctt

SEQ ID NO: 12386 - DNA, 71 bp, chicken (Gallus Gallus)
  misc_feature (36): n=c or t
gtgccagttacatgcatctccctctttttttctccntgctaagctccagaagccatataactcaactactg

SEQ ID NO: 12387 - DNA, 71 bp, chicken (Gallus Gallus)
  misc_feature (36): n=a or g
agataacagcttagcacataaggcttttgaagaacntcttaactactcccttgaaaatgcaggtccagact

SEQ ID NO: 12388 - DNA, 71 bp, chicken (Gallus Gallus)
  misc_feature (36): n=c or t
agtccccatctgtagttgatgcaaactggaatactntgtgaatgagacagactacccttactgaatccttt

SEQ ID NO: 12389 - DNA, 71 bp, chicken (Gallus Gallus)
  misc_feature (36): n=c or t
tgactcattctgtgctgtacaatatatatttttttnccagtcatttgtttggacacatttcactttgatat

SEQ ID NO: 12390 - DNA, 71 bp, chicken (Gallus Gallus)
  misc_feature (36): n=a or g
gcctacaattgaaaggtccaggacaatttgctcccnggtctcacataccagctctgttctgcctctggact

SEQ ID NO: 12391 - DNA, 71 bp, chicken (Gallus Gallus)
  misc_feature (36): n=c or t
acgcagagacagacagaaaaatccctgtttgatggntttggtcttctctcttccttccaatcagcctcgca

SEQ ID NO: 12392 - DNA, 71 bp, chicken (Gallus Gallus)
  misc_feature (36): n=c or g
catcagccccgttgatggaggaacaataagagaggngactgaggctctcattccaatggacaatgaaattt

SEQ ID NO: 12393 - DNA, 71 bp, chicken (Gallus Gallus)
  misc_feature (36): n=a or c
aacaaggtagaatggcaaacattaaggaaataaaangattcagttctggcagaccgaggcctacccagctc

SEQ ID NO: 12394 - DNA, 71 bp, chicken (Gallus Gallus)
  misc_feature (36): n=a or g
aaaagtaaacaacaagagataagtatcagctaaaanatgtctatagcaatgtgcactcaaataatatataa

SEQ ID NO: 12395 - DNA, 71 bp, chicken (Gallus Gallus)
  misc_feature (36): n=g or t
atacttcaaaatatttttaagtgcaaacacacattngttaatactggaagcaacttgatgttcaggctgtg

SEQ ID NO: 12396 - DNA, 71 bp, chicken (Gallus Gallus)
  misc_feature (36): n=c or t
aaacttcaggatcagatgaccttaaggctacgttgngtatctcacacccaagttacccaaggcacgggagg

SEQ ID NO: 12397 - DNA, 71 bp, chicken (Gallus Gallus)
  misc_feature (36): n=c or t
ggcaggcacagaacctgtgctcaaactggacaaaangcttgcagcgattctcattacagcacacccatctg

SEQ ID NO: 12398 - DNA, 71 bp, chicken (Gallus Gallus)
  misc_feature (36): n=a or c
cagctcacttgttgctggtgtgtgctggtgtagccnagggattgggtttgggctgaagcatcatgagcgac

SEQ ID NO: 12399 - DNA, 71 bp, chicken (Gallus Gallus)
  misc_feature (36): n=c or t
cattgggatgccacagccacagggatgtgttggganctttgggatgccaatgtctctccaccacagctgct

SEQ ID NO: 12400 - DNA, 71 bp, chicken (Gallus Gallus)
  misc_feature (36): n=c or g
gggggctcagttcccagctcctgggttttgctaggnttgaggtgcagagaaggctggtagttaggtgtgtg

SEQ ID NO: 12401 - DNA, 71 bp, chicken (Gallus Gallus)
  misc_feature (36): n=a or g
gcccttttccaagcccttgctctattatgtatctcnaaccattaaaatcagagcaattggaacaaataaat

SEQ ID NO: 12402 - DNA, 71 bp, chicken (Gallus Gallus)
  misc_feature (36): n=c or t
cctgcaggaaaggagacattccctgaaaaacagaancacgttcagtgagggaagtggagagatgggactcc

SEQ ID NO: 12403 - DNA, 71 bp, chicken (Gallus Gallus)
  misc_feature (36): n=c or t
ctcgtctgctagtaatgtgaagtcataaggtatggngagagctcaccgcctgtgccattcactctgaggtt

SEQ ID NO: 12404 - DNA, 71 bp, chicken (Gallus Gallus)
  misc_feature (36): n=a or g
gtttcatagctcttcagtttcacagaatataatgcnaagcttggcaggagtgttttacttttctcaactgt

SEQ ID NO: 12405 - DNA, 71 bp, chicken (Gallus Gallus)
  misc_feature (36): n=c or t
tagacaaatttaatttggaagagaacacctcccagngtagagaatttacccagacacaaaaccctgaggat

SEQ ID NO: 12406 - DNA, 71 bp, chicken (Gallus Gallus)
  misc_feature (36): n=c or t
ggacagcggcatcctgcaggtggggccgagcccagnaattcctctgctacctttggagctgttgttattgg

SEQ ID NO: 12407 - DNA, 71 bp, chicken (Gallus Gallus)
  misc_feature (36): n=a or g
agaatcctgagaactccgtatcgaccaatctaacanaatttcccaggtggcttaaattaaaaaattagcgc

SEQ ID NO: 12408 - DNA, 71 bp, chicken (Gallus Gallus)
  misc_feature (36): n=a or g
aaaatacagttgtgaacatccctcttggttacagtntgttacacttctcagtttgcaaaggtttgcataat

SEQ ID NO: 12409 - DNA, 71 bp, chicken (Gallus Gallus)
  misc_feature (36): n=a or g
gttttcggaataggtttctaccagtttatcatatangaatattgacactgaggttttatcttttctagaag

SEQ ID NO: 12410 - DNA, 71 bp, chicken (Gallus Gallus)
  misc_feature (36): n=c or g
ttcatgttcaaatgtggcaacagccaaccaccaatnggctctttaagctccccatgcacttagaaaaggat

SEQ ID NO: 12411 - DNA, 71 bp, chicken (Gallus Gallus)
  misc_feature (36): n=a or g
agatatgtaaggactgctaaacatatacagactgcngagagaaggaggatggtcctgtggacagtgtcact

SEQ ID NO: 12412 - DNA, 71 bp, chicken (Gallus Gallus)
  misc_feature (36): n=c or t
tttacactgttcgtagcaatttcagcataacgcatnagaactgggaagatgttttctccaaaagaagcttg

SEQ ID NO: 12413 - DNA, 71 bp, chicken (Gallus Gallus)
  misc_feature (36): n=a or g
ttcttagctggcttgtgcatctgggttgtgttacanagctcaatgatgtactttcgtgttcctcgtgcaac

SEQ ID NO: 12414 - DNA, 71 bp, chicken (Gallus Gallus)
  misc_feature (36): n=a or g
tggtatgtatttgtaataactgaaactcacccagancagatccagagcctgattgaagatctaccaaagcc

SEQ ID NO: 12415 - DNA, 71 bp, chicken (Gallus Gallus)
  misc_feature (36): n=a or c
ctagttaataaaactgaggatttttattgatttgtngtgaggaacagctggcagtcttatcagctggatgg

SEQ ID NO: 12416 - DNA, 71 bp, chicken (Gallus Gallus)
  misc_feature (36): n=a or g
acaccttgacattaaaatcaaagaagctgttaaacnaacatttctcttcatcagtttgtcctaaaaccttt

SEQ ID NO: 12417 - DNA, 71 bp, chicken (Gallus Gallus)
  misc_feature (36): n=c or t
aggcaaacagatttagtccagaagaagaatttgtangtttccgagccaggttgcagggattgtcagcatgg

SEQ ID NO: 12418 - DNA, 71 bp, chicken (Gallus Gallus)
  misc_feature (36): n=c or t
atggttacaacgctgctaactgtaccatcaattatngtgctttacacatcataaaactgccccctaaaaag

SEQ ID NO: 12419 - DNA, 71 bp, chicken (Gallus Gallus)
  misc_feature (36): n=c or t
caactcaattcatttctgtatgcagttcttcgaagnatacacctgaagctggctcctagcccctgtgttat

SEQ ID NO: 12420 - DNA, 71 bp, chicken (Gallus Gallus)
  misc_feature (36): n=a or g
aagtatatggtataaaaggtatcaatagaatatgtntgtatagaagctctgtaacagtatctagatgtgat

SEQ ID NO: 12421 - DNA, 71 bp, chicken (Gallus Gallus)
  misc_feature (36): n=a or g
ggtgacaggcggcagaaagatgcatcagtaagcacngcgggagcagaggtgctttcccttttgactgccca

SEQ ID NO: 12422 - DNA, 71 bp, chicken (Gallus Gallus)
  misc_feature (36): n=a or g
agctacatttcgatgcaaagaatgagtttcacagancagtacaaacgttacaaaacattttctagaaaaaa

SEQ ID NO: 12423 - DNA, 71 bp, chicken (Gallus Gallus)
  misc_feature (36): n=c or t
tcacctaaaagccatcctttattcacaagagccatnatgcaaagtggatctgcaaatgccccttgggctgc

SEQ ID NO: 12424 - DNA, 71 bp, chicken (Gallus Gallus)
  misc_feature (36): n=a or c
gcaaaaaggaaagaaacacaaaaataagttcagctnatttatactttttttatatcttccagttgcaattt

SEQ ID NO: 12425 - DNA, 71 bp, chicken (Gallus Gallus)
  misc_feature (36): n=c or t
acagatgggtgatcaaagtcaagcatcagtgtgttnccttaaggtgtttgccaaagtgttattaattaagt

SEQ ID NO: 12426 - DNA, 71 bp, chicken (Gallus Gallus)
  misc_feature (36): n=a or t
attataaaattgaaatagaagtttggtgttggagtnatagatactcaagatggatctatctatcattgctt

SEQ ID NO: 12427 - DNA, 71 bp, chicken (Gallus Gallus)
  misc_feature (36): n=g or t
tattccagttcttcacttcccagatgctaaattttntttggcagtttctgagatttgtattgcagtttgag

SEQ ID NO: 12428 - DNA, 71 bp, chicken (Gallus Gallus)
  misc_feature (36): n=g or t
taaccctgccatgttttgcttcccacgtcctcaagnaatgagccacaaggcatccgtggccaacttctgta

SEQ ID NO: 12429 - DNA, 71 bp, chicken (Gallus Gallus)
  misc_feature (36): n=a or g
gggagcactgcagcccctgggcctgtgtgccagctntgctcagcaaggagatcactctgaacaccaaatgg

SEQ ID NO: 12430 - DNA, 71 bp, chicken (Gallus Gallus)
  misc_feature (36): n=c or t
aatgagcgctatatcgcagcacttgatcagggtttncccttaagtgttaattgcttcctggcaggtccatt

SEQ ID NO: 12431 - DNA, 71 bp, chicken (Gallus Gallus)
  misc_feature (36): n=c or t
tggaactgctttttaacttcagaaattttcagtagngaagctaagatggaaattactggacatgcctttga

SEQ ID NO: 12432 - DNA, 71 bp, chicken (Gallus Gallus)
  misc_feature (36): n=a or g
tgtgacaaacttttcagttttacaaagcctgctgcntggcattaagttggctctaaagtccacagagaaat

SEQ ID NO: 12433 - DNA, 71 bp, chicken (Gallus Gallus)
  misc_feature (36): n=c or t
ggggatacgctgagtggagaaaaaccgttctctctngtaggtgtgtttatttactgctgtgagcttgggca

SEQ ID NO: 12434 - DNA, 71 bp, chicken (Gallus Gallus)
  misc_feature (36): n=c or g
taggtgtattcttcgttattttgaaacatactttantaggtttgagaaactctcaccatcttcccaggcat

SEQ ID NO: 12435 - DNA, 71 bp, chicken (Gallus Gallus)
  misc_feature (36): n=a or t
ttgcaacattctttgaggtttttcaacaagttgatnttgaagaaatccatatgctccttgcacacatccat

SEQ ID NO: 12436 - DNA, 71 bp, chicken (Gallus Gallus)
  misc_feature (36): n=a or g
tgcagagaagctgaggagctctattttagaactccncgatgctcatgctttttagattttgggggtgggag

SEQ ID NO: 12437 - DNA, 71 bp, chicken (Gallus Gallus)
  misc_feature (36): n=a or g
gcgtgtggtggtgctcagagccgtgctgtaaatctnttgctgtgtttgctttactcacccaccgattgtat

SEQ ID NO: 12438 - DNA, 71 bp, chicken (Gallus Gallus)
  misc_feature (36): n=c or t
ttttcatgtaatcgagatatatgtgaaatcccactnctctgagctccagtatggttctgcctccaaaaaca

SEQ ID NO: 12439 - DNA, 71 bp, chicken (Gallus Gallus)
  misc_feature (36): n=c or t
cccctatagtcagaagttatttactttcacgcattntgctgcattaactccatcaggcttcgaaacccaaa

SEQ ID NO: 12440 - DNA, 71 bp, chicken (Gallus Gallus)
  misc_feature (36): n=c or t
aacagagaaacatgcacacatcttctgtccaccacnatgtttctttggaataataaaataatacagatttt

SEQ ID NO: 12441 - DNA, 71 bp, chicken (Gallus Gallus)
  misc_feature (36): n=c or t
caatgcttacataaataagctgggtgggaatcatgnggtattagcaagacagctgtgggattattctgagt

SEQ ID NO: 12442 - DNA, 71 bp, chicken (Gallus Gallus)
  misc_feature (36): n=a or g
tgaaagcagcagtgcaacacacagtgtgcacagccntggaaatgaacacagcaccatcaacgagcaggtca

SEQ ID NO: 12443 - DNA, 71 bp, chicken (Gallus Gallus)
  misc_feature (36): n=c or t
ttaaagcatcactagactattctgcatacatttacngcactgtttatctcctttagcacttagcagtgaag

SEQ ID NO: 12444 - DNA, 71 bp, chicken (Gallus Gallus)
  misc_feature (36): n=g or t
gtctcctccctcattcttattttttatcagctctantttggatgcagagatggtgctgcttctcatttggt

SEQ ID NO: 12445 - DNA, 71 bp, chicken (Gallus Gallus)
  misc_feature (36): n=c or g
actacaccattactgtaccttgagttctctccacantgtgcacttaaaggatgctccctgattcagatcaa

SEQ ID NO: 12446 - DNA, 71 bp, chicken (Gallus Gallus)
  misc_feature (36): n=c or t
taacattctagctttgcatgcataacaccctttatntccctctttcatcaaaacaattacaagaatgtaaa

SEQ ID NO: 12447 - DNA, 71 bp, chicken (Gallus Gallus)
  misc_feature (36): n=c or t
tgaaacaaggacaaatgggggactggagagctgaangtcccctgctgtcccctgttggagggcttgcacta

SEQ ID NO: 12448 - DNA, 71 bp, chicken (Gallus Gallus)
  misc_feature (36): n=c or t
tcgtgctaatttaatgcatgccctctgcaggttgcnaaagcaggcacagaaagacacaatgggctgaaggt

SEQ ID NO: 12449 - DNA, 71 bp, chicken (Gallus Gallus)
  misc_feature (36): n=a or g
ttactttttatttcttaagatatttaagaaccactntagacaataatgaaaaataaactaatgacaaacca

SEQ ID NO: 12450 - DNA, 71 bp, chicken (Gallus Gallus)
  misc_feature (36): n=c or t
tacttcataaattgatgactttgctatgacttttgnggtgccaagagcgtgacgcattctgaagctttggg

SEQ ID NO: 12451 - DNA, 71 bp, chicken (Gallus Gallus)
  misc_feature (36): n=a or g
tcagttcagactacagaggagatgtgaatgcagtcnattatagagtcctatttcatgctggttttatgtca

SEQ ID NO: 12452 - DNA, 71 bp, chicken (Gallus Gallus)
  misc_feature (36): n=c or t
ccccgtgaactaaaagaagttgaaaaattgaatagntgtagagaatagagcagaacataggggcttatatc

SEQ ID NO: 12453 - DNA, 71 bp, chicken (Gallus Gallus)
  misc_feature (36): n=a or g
acatctgctaccttccaacctgacatatttgtaacntggaggagaaaacagtagctgcaccaggacaaagc

SEQ ID NO: 12454 - DNA, 71 bp, chicken (Gallus Gallus)
  misc_feature (36): n=c or t
agaaaatgaagttgcagactcgagaaaaaattgcangctgtttgtgtttgatgtattgcttcttgaggtag

SEQ ID NO: 12455 - DNA, 71 bp, chicken (Gallus Gallus)
  misc_feature (36): n=c or t
tgaagtatttacattgttggagtaacagacacagtntgatgaagaatgcttaaacttgaaagagaatttcc

SEQ ID NO: 12456 - DNA, 71 bp, chicken (Gallus Gallus)
  misc_feature (36): n=a or t
cgtgattgccagaacattatatacagttctagcagnacaataagattatattatgaaatttttatgtcagc

SEQ ID NO: 12457 - DNA, 71 bp, chicken (Gallus Gallus)
  misc_feature (36): n=c or g
atggtatttcaaccattattttcagtgttctctctntgtttctggtgcttctggcttttacaccaacatta

SEQ ID NO: 12458 - DNA, 71 bp, chicken (Gallus Gallus)
  misc_feature (36): n=c or t
gaggaaccactctgaatgtttaccccgtaccttttncattaatatttatattggagcagctgagaaggcag

SEQ ID NO: 12459 - DNA, 71 bp, chicken (Gallus Gallus)
  misc_feature (36): n=a or g
gaacttcatggtccctctagctttttctccgaggtncaactgctccttttttctctatcagacgtgaacat

SEQ ID NO: 12460 - DNA, 71 bp, chicken (Gallus Gallus)
  misc_feature (36): n=c or t
atttatattcctgaaagtcgtgtttttaatccttcngagctgttccttattgatgttcagaagctcccctg

SEQ ID NO: 12461 - DNA, 71 bp, chicken (Gallus Gallus)
  misc_feature (36): n=c or g
cactttctgctaaggataaaacccctagtgtaatgncttactgactgttacgggggcacaagcaaatgctg

SEQ ID NO: 12462 - DNA, 71 bp, chicken (Gallus Gallus)
  misc_feature (36): n=c or t
acttcaacttagtattttaatttgactgtgtttttntgtgtaggcctggagaaaattgaacagctacaaaa

SEQ ID NO: 12463 - DNA, 71 bp, chicken (Gallus Gallus)
  misc_feature (36): n=c or t
atttgcagatggtagcttaaagaaataccaggttcnatgtaatgtccctactctttaattagtacagctgc

SEQ ID NO: 12464 - DNA, 71 bp, chicken (Gallus Gallus)
  misc_feature (36): n=c or g
ccctgcagcccaagctcaagtagatgacatctggantacaaaccaacgctcagcaatttctccagaggagt

SEQ ID NO: 12465 - DNA, 71 bp, chicken (Gallus Gallus)
  misc_feature (36): n=a or g
ctttcatgcgtataggcagtggaagagccctaactnaggaggtcatcttatatagtgtgctgcacatggtt

SEQ ID NO: 12466 - DNA, 71 bp, chicken (Gallus Gallus)
  misc_feature (36): n=c or t
tcaaaaacaatactgcatatattattgataaagagntgtgttctgagttatagggcagatttcacaatatt

SEQ ID NO: 12467 - DNA, 71 bp, chicken (Gallus Gallus)
  misc_feature (36): n=a or g
gcagcttcccagtatgcaagttggtacattgcttcnaaaatcaagtttaatttttaatcccttccccaagt

SEQ ID NO: 12468 - DNA, 71 bp, chicken (Gallus Gallus)
  misc_feature (36): n=a or g
gcagggcacactgctgctgctcttaccagaggatcngagaaggtgaactgggtaatcagagcctgaattat

SEQ ID NO: 12469 - DNA, 71 bp, chicken (Gallus Gallus)
  misc_feature (36): n=a or g
aggtccccctgcggcgctcgggtcagagcttttctnctgaatttccctaaggcaaacatgtccccagcctc

SEQ ID NO: 12470 - DNA, 71 bp, chicken (Gallus Gallus)
  misc_feature (36): n=c or t
agcacagagagttttttggatctgattttttgtgcncgatacccaaacacaaaaagcatcgcatcaatgac

SEQ ID NO: 12471 - DNA, 71 bp, chicken (Gallus Gallus)
  misc_feature (36): n=c or t
atattttctttctgtgtttccaaatcatttattcgnttctgtaggtcatagctaaaaaaaatccaacaaaa

SEQ ID NO: 12472 - DNA, 71 bp, chicken (Gallus Gallus)
  misc_feature (36): n=a or g
agatcttcaaaagcttgtctaaatctgtctctctcnttggtaatgtcatccaattcagccacacgttttaa

SEQ ID NO: 12473 - DNA, 71 bp, chicken (Gallus Gallus)
  misc_feature (36): n=a or g
cgaacttcagaacttcatggattacctttccaatcnttttgaaaaccttcagatccctctcttggagctct

SEQ ID NO: 12474 - DNA, 71 bp, chicken (Gallus Gallus)
  misc_feature (36): n=a or g
cacccaaattcagggctggtgcctgtgctgctgcantgctattccccaacacatggtaacaaagagacgtc

SEQ ID NO: 12475 - DNA, 71 bp, chicken (Gallus Gallus)
  misc_feature (36): n=c or t
tattacactacattggaagctcatcttatctgaggnaataaactcatttccttaactatatgtaaagtaga

SEQ ID NO: 12476 - DNA, 71 bp, chicken (Gallus Gallus)
  misc_feature (36): n=c or g
actttggaccaactagtttaaagatgccgttttcanagtttcatgtgatatcttgtcgtatttagaagttg

SEQ ID NO: 12477 - DNA, 71 bp, chicken (Gallus Gallus)
  misc_feature (36): n=c or t
aataaatgccataaagacgatggtaaaataggcaangttaatgaaatactgaagccatttttatttttcgt

SEQ ID NO: 12478 - DNA, 71 bp, chicken (Gallus Gallus)
  misc_feature (36): n=c or t
ttcagtgggatccactttctcagttatcaccaatanttcacagaacagaatccattgaatctgtctgatgc

SEQ ID NO: 12479 - DNA, 71 bp, chicken (Gallus Gallus)
  misc_feature (36): n=c or t
tttccataatacgttatcccagagagaaggaaaatnggtacccaagagaccttatcaaatattcaggaggg

SEQ ID NO: 12480 - DNA, 71 bp, chicken (Gallus Gallus)
  misc_feature (36): n=g or t
tggaacagcatgtcatctatgatgtggcttatctgngttcagtcaagataagcatccgtcataaaggtgga

SEQ ID NO: 12481 - DNA, 71 bp, chicken (Gallus Gallus)
  misc_feature (36): n=c or g
gcttcctaaccgtgctcttctgctttgtactcaganatactgctgaagagcactcacagctgaaatcattg

SEQ ID NO: 12482 - DNA, 71 bp, chicken (Gallus Gallus)
  misc_feature (36): n=c or g
caaccccaagcttttacttacaaaatgtattttcanaggttggaagacactggtcaaaaacaccacaaatg

SEQ ID NO: 12483 - DNA, 71 bp, chicken (Gallus Gallus)
  misc_feature (36): n=c or t
cttctgccagctcttcacaaggatgagaaagcagtnccttccctggtctcctacagaccagcatttcccag

SEQ ID NO: 12484 - DNA, 71 bp, chicken (Gallus Gallus)
  misc_feature (36): n=a or g
ttgatcttaagaatactgcagtcacttaagcaccgnatgtactaaatagacctgtttgatacctcaagaat

SEQ ID NO: 12485 - DNA, 71 bp, chicken (Gallus Gallus)
  misc_feature (36): n=c or t
gtttcttatagggtagcacagaagagagaagatgcngtttccaaagaagttactcgcaagctttctgaggc

SEQ ID NO: 12486 - DNA, 71 bp, chicken (Gallus Gallus)
  misc_feature (36): n=c or t
ttcttctggagctcttcgtgatctctctgatatttngtgatcagttcttgctgcttttgtctttcagtgtc

SEQ ID NO: 12487 - DNA, 71 bp, chicken (Gallus Gallus)
  misc_feature (36): n=a or g
gcagacagatagaaacaggaaagtaatttaagaacntggctatacactgagatcaaggggaaacattatct

SEQ ID NO: 12488 - DNA, 71 bp, chicken (Gallus Gallus)
  misc_feature (36): n=c or g
agggccacacacgtcctacaccccgcctttcctaangcacgttgaaacccaatgcctcagcatttcccagc

SEQ ID NO: 12489 - DNA, 71 bp, chicken (Gallus Gallus)
  misc_feature (36): n=c or t
actccgcaggagtgatgcactgtttctgaaggtgcncgtgtaagctgttagtaataaagatacactgggaa

SEQ ID NO: 12490 - DNA, 71 bp, chicken (Gallus Gallus)
  misc_feature (36): n=c or t
agcagcatttttctgtttcctcctgtcttattttanctctgcagtttgtgacgctctatatatccagcttg

SEQ ID NO: 12491 - DNA, 71 bp, chicken (Gallus Gallus)
  misc_feature (36): n=g or t
ccttctttgcagcttcagttgtacagctgtttgttnccttaatgatgaaaaataaagggaattcatttatg

SEQ ID NO: 12492 - DNA, 71 bp, chicken (Gallus Gallus)
  misc_feature (36): n=a or g
gtaagaagacaagaatgggaagggaaggatccgacngagccactgcctgtacttcttgcaggccatacgca

SEQ ID NO: 12493 - DNA, 71 bp, chicken (Gallus Gallus)
  misc_feature (36): n=a or g
gcaagatatgcctgcagtcacgctttctttccaacncattacttttgtaaaaagaagcccctaatactcag

SEQ ID NO: 12494 - DNA, 71 bp, chicken (Gallus Gallus)
  misc_feature (36): n=a or g
tgctaacattccaattcagcaaaaaaaatcctcaanaatctctcgaaggaaacaccacatacgttaccatg

SEQ ID NO: 12495 - DNA, 71 bp, chicken (Gallus Gallus)
  misc_feature (36): n=c or t
ttgcttttcttctcattagatcttgtgaaaggacangtgcttctacttacatgctttttttcttttaaata

SEQ ID NO: 12496 - DNA, 71 bp, chicken (Gallus Gallus)
  misc_feature (36): n=a or g
gagtctgcacttcgccatgggaaagtggagagcagnggagatttgcctccctactcagcctgaacaccgcc

SEQ ID NO: 12497 - DNA, 71 bp, chicken (Gallus Gallus)
  misc_feature (36): n=c or t
agcagttaccgcaaagctgccgtcctttaactcctncaagctgcaggtcgcagaaccgcagaacgtcccgt

SEQ ID NO: 12498 - DNA, 71 bp, chicken (Gallus Gallus)
  misc_feature (36): n=a or g
ggaattaatttttccctgatatgttgcacaattgtngtgacaaactataaacgcaggtgctgagggaagga

SEQ ID NO: 12499 - DNA, 71 bp, chicken (Gallus Gallus)
  misc_feature (36): n=a or g
cactccagcaagcttacataatctctgaaactatangattacttgaaggcagaagatccacagactcttaa

SEQ ID NO: 12500 - DNA, 71 bp, chicken (Gallus Gallus)
  misc_feature (36): n=c or t
ctgcaactcttcaaggaatatgcaaccaacgcattntttcattcccaaaaggatacactgagggcgacttg

SEQ ID NO: 12501 - DNA, 71 bp, chicken (Gallus Gallus)
  misc_feature (36): n=a or g
gaaaccgtttgttttggtttttttgtttcccacccnagtcagtccatttttgacacacagatgtacttcag

SEQ ID NO: 12502 - DNA, 71 bp, chicken (Gallus Gallus)
  misc_feature (36): n=a or g
gaatattgttttaattacaaggtaaatgctttgtcntcggttgattattctatttaatgaacagaataaac

SEQ ID NO: 12503 - DNA, 71 bp, chicken (Gallus Gallus)
  misc_feature (36): n=a or g
aaaaaacacaggggtcaaaaaaagacggagaggctnaaaaggagtgggaaactggaacaaaggtgggggct

SEQ ID NO: 12504 - DNA, 71 bp, chicken (Gallus Gallus)
  misc_feature (36): n=c or t
cagaaatttcagctctctggggtttaggaagttagngagcctcatctgcattgtaaatgaaatcaacaaga

SEQ ID NO: 12505 - DNA, 71 bp, chicken (Gallus Gallus)
  misc_feature (36): n=c or t
tgtttgttttaaaaacgtcacattacagattgttcnttagtaaccaaaatacagattctctttttcttagc

SEQ ID NO: 12506 - DNA, 71 bp, chicken (Gallus Gallus)
  misc_feature (36): n=a or t
acagaattgagctgtcttactgaaatctttcttgcnactgcaactagggcagtgcatgcttttgcccacca

SEQ ID NO: 12507 - DNA, 71 bp, chicken (Gallus Gallus)
  misc_feature (36): n=a or g
gtggtggtgataaaatattaaaaaaaaaaaaaagancaacatgcagtttaagaaggactagcagaattaat

SEQ ID NO: 12508 - DNA, 71 bp, chicken (Gallus Gallus)
  misc_feature (36): n=a or g
gcttagagaatattgtcaaagctccattcaaattgnagaccatgtatgatttttgtgttgggcctgtgcag

SEQ ID NO: 12509 - DNA, 71 bp, chicken (Gallus Gallus)
  misc_feature (36): n=a or g
ccatcccttgcactacaccaccagaatgaacaggcnaatgtgttttcatatggtcatagcatgctgggttg

SEQ ID NO: 12510 - DNA, 71 bp, chicken (Gallus Gallus)
  misc_feature (36): n=g or t
ggatcacatttgaacacatctttgatcaaccagcangctcaaaccatgacactaacaaagtagcttcgctc

SEQ ID NO: 12511 - DNA, 71 bp, chicken (Gallus Gallus)
  misc_feature (36): n=c or t
tggagcaggtgttgcaattagcactgctgcctgagntagtaaaaacaccagcaagtcatcagtaaggaagc

SEQ ID NO: 12512 - DNA, 71 bp, chicken (Gallus Gallus)
  misc_feature (36): n=g or t
gaagtctggatcacttttatgtacaacagtatcaangacaactgctgttctttcaagaggatgtgctattt

SEQ ID NO: 12513 - DNA, 71 bp, chicken (Gallus Gallus)
  misc_feature (36): n=a or t
gctgcattctttccactgcacaggttggcgcacagnctgacccactggtggcacaggcaatgtctagctac

SEQ ID NO: 12514 - DNA, 71 bp, chicken (Gallus Gallus)
  misc_feature (36): n=g or t
actttctttaccagatttcattgcttgctggggganggggagaaccagcaacctactggtttgctacctga

SEQ ID NO: 12515 - DNA, 71 bp, chicken (Gallus Gallus)
  misc_feature (36): n=c or t
ggcagcaggaggggagtgctctccgtgtccaaactnttctccataagaatgtacctcaggagcatgaagga

SEQ ID NO: 12516 - DNA, 71 bp, chicken (Gallus Gallus)
  misc_feature (36): n=c or t
tgccataaaagacaataacgatagctcaggctgctntgaacgttaatcctacttcctacatcctacttgta

SEQ ID NO: 12517 - DNA, 71 bp, chicken (Gallus Gallus)
  misc_feature (36): n=c or t
cctaagccaccatcctaactgtctggtgacagaagngatgcgtctctgctgctgccactagcagtactact

SEQ ID NO: 12518 - DNA, 71 bp, chicken (Gallus Gallus)
  misc_feature (36): n=c or t
ggtggttgtgaacacacaccttccgcggagaagtgngaggagcaaagcttcccgggcagagtggcgatcct

SEQ ID NO: 12519 - DNA, 71 bp, chicken (Gallus Gallus)
  misc_feature (36): n=a or g
caaaccccacagctcccactgaagaaaccagccccngaaaatggccaaaatgtagtaaaaaagaagtagtt

SEQ ID NO: 12520 - DNA, 71 bp, chicken (Gallus Gallus)
  misc_feature (36): n=c or g
ggcatctcagcccaggaagcagggaaggagcttccnaccaagacactattttgggtttcctattgtaccta

SEQ ID NO: 12521 - DNA, 71 bp, chicken (Gallus Gallus)
  misc_feature (36): n=a or g
ccaaattctcagcaatgcaaagcatctaaaaaagcntccggcaccccaccagtacgtgtcctgtgggacac

SEQ ID NO: 12522 - DNA, 71 bp, chicken (Gallus Gallus)
  misc_feature (36): n=c or t
ctgtctatgtaacccttacctgaatatggaagtctntaaagaagattaacctgtgatgttaccaaaatttc

SEQ ID NO: 12523 - DNA, 71 bp, chicken (Gallus Gallus)
  misc_feature (36): n=c or t
ttcatgaagtatattacccctcgccacacgctatgngaagcggagaaattaacatgtcacagtgaaataca

SEQ ID NO: 12524 - DNA, 71 bp, chicken (Gallus Gallus)
  misc_feature (36): n=a or g
ccatgtgcaatggtcactgtgggctgggatagagtntaaattgtccatggagttcatttagtccataacct

SEQ ID NO: 12525 - DNA, 71 bp, chicken (Gallus Gallus)
  misc_feature (36): n=a or g
gtgaataaatagatgctcgtgctttgtgtttccacncgtgccacctgactgcaccaggactgtttgcttga

SEQ ID NO: 12526 - DNA, 71 bp, chicken (Gallus Gallus)
  misc_feature (36): n=c or g
atgagactcttctcaggcggtggaggcacgatgaanccattttgggcatgcttctccgacaacttctcata

SEQ ID NO: 12527 - DNA, 71 bp, chicken (Gallus Gallus)
  misc_feature (36): n=c or t
aggcaattagcaaagccatagcttagtgttgactanggcgaggaggaggatgtacatgtcacggcacatgc

SEQ ID NO: 12528 - DNA, 71 bp, chicken (Gallus Gallus)
  misc_feature (36): n=a or g
acccatggctatgcagggtgcccggttcccactgcntcagcccagcaccattgttgtggtgttgcttatgg

SEQ ID NO: 12529 - DNA, 71 bp, chicken (Gallus Gallus)
  misc_feature (36): n=c or t
ccatgtttaagaaatgagctgtgtaggcctgaaagnccctttttcagcctaactttagttcagtttttgca

SEQ ID NO: 12530 - DNA, 71 bp, chicken (Gallus Gallus)
  misc_feature (36): n=c or t
tgtacctcaaaacaaacaagcagggtgaatcatgtnttaaacaagacttccagcaactagcgcatgaaaaa

SEQ ID NO: 12531 - DNA, 71 bp, chicken (Gallus Gallus)
  misc_feature (36): n=a or g
ttttcccttgttttaagatctttcaaaataaacctntatcgctgcacataaacgaacagcattgtttataa

SEQ ID NO: 12532 - DNA, 71 bp, chicken (Gallus Gallus)
  misc_feature (36): n=a or g
atgccttcagcatcccatgagccgcattgagaagcnagctccagctggaaccctgaaacagcatgtcccag

SEQ ID NO: 12533 - DNA, 71 bp, chicken (Gallus Gallus)
  misc_feature (36): n=c or t
tccctacatccttgtgggacatccactcctaggganggctgcctgtcccaccggctgcttgctccctagag

SEQ ID NO: 12534 - DNA, 71 bp, chicken (Gallus Gallus)
  misc_feature (36): n=c or t
agagcccgtcagagaaattcccctgggcatcccaangatctgttcacaaacccattcattaaaccccagac

SEQ ID NO: 12535 - DNA, 71 bp, chicken (Gallus Gallus)
  misc_feature (36): n=c or t
cttgctcttagcactggaagcagcctgcaccatcangcttccacaagagcaaggctcacctgagcaccact

SEQ ID NO: 12536 - DNA, 71 bp, chicken (Gallus Gallus)
  misc_feature (36): n=c or t
aagcatccttgctggataaaagcgttgatgtgaaangagcccaaactctgggctggtctgaagttacgaca

SEQ ID NO: 12537 - DNA, 71 bp, chicken (Gallus Gallus)
  misc_feature (36): n=c or t
aggccatgggaacaacactatctagtctcaggcacngggggtgggggtaaataaaaagagcaacttactcc

SEQ ID NO: 12538 - DNA, 71 bp, chicken (Gallus Gallus)
  misc_feature (36): n=g or t
ccactgatttttctttaatctgccttttggcagagncacctccctgttactgacaccaccaccacctgctt

SEQ ID NO: 12539 - DNA, 71 bp, chicken (Gallus Gallus)
  misc_feature (36): n=a or g
gctacacgtgtcttggggaatagaggtgtaaaattnttttaaggagaattcattcagcatatagccaatgt

SEQ ID NO: 12540 - DNA, 71 bp, chicken (Gallus Gallus)
  misc_feature (36): n=a or g
tcactgttttaagttcatcactcaaaacaaagccancatgtagatgcggaatacaataaaagaattcttgg

SEQ ID NO: 12541 - DNA, 71 bp, chicken (Gallus Gallus)
  misc_feature (36): n=g or t
taatgggaggcaaagattcaagataaacattgttcnaagggaggcctttgagctgccttcgtttacagcca

SEQ ID NO: 12542 - DNA, 71 bp, chicken (Gallus Gallus)
  misc_feature (36): n=a or g
tatcccgccgtgcattgcattcgtgaagagtgtacnttgtgattcaggatgctttgcctttttttcccccc

SEQ ID NO: 12543 - DNA, 71 bp, chicken (Gallus Gallus)
  misc_feature (36): n=a or c
atgtaagtaaggccacaaacgtacaaagtccttttntacttttttgttcttgttgtcttttgcatcctatt

SEQ ID NO: 12544 - DNA, 71 bp, chicken (Gallus Gallus)
  misc_feature (36): n=c or t
ttgggcacagtccttaggagaggagcattaggcagntgtagcacatttggagaattgtcagagccctgtga

SEQ ID NO: 12545 - DNA, 71 bp, chicken (Gallus Gallus)
  misc_feature (36): n=c or t
acaaccttcacatgtctgccaaggaggaacgctcangatgctgcatggaggagctggagaacagtgttacc

SEQ ID NO: 12546 - DNA, 71 bp, chicken (Gallus Gallus)
  misc_feature (36): n=a or g
ccgcctgcagctcccagctgcatcccatctggtctncaaggtataaaaggcatctgagcaacctcttctct

SEQ ID NO: 12547 - DNA, 71 bp, chicken (Gallus Gallus)
  misc_feature (36): n=c or t
gtgaccccagctgattgtaaccctgatttaactganataaaagcagacttcggactgctgtccctcctggg

SEQ ID NO: 12548 - DNA, 71 bp, chicken (Gallus Gallus)
  misc_feature (36): n=c or t
ttaaaataaatactcctgtagtgaaaaaataacaanaacataaccctcatctgagcttgttcctcgtctgc

SEQ ID NO: 12549 - DNA, 71 bp, chicken (Gallus Gallus)
  misc_feature (36): n=c or t
accacttttcagcaatacaacctaagggaatggcantgtgctgtgtcagggaacagtcaggtgggggttag

SEQ ID NO: 12550 - DNA, 71 bp, chicken (Gallus Gallus)
  misc_feature (36): n=a or g
ggcctctggaagtcataaagctttccctggaagagnctgaggcaggcaggagcatctgtcattgagcaagt

SEQ ID NO: 12551 - DNA, 71 bp, chicken (Gallus Gallus)
  misc_feature (36): n=a or g
ccaaaggctgcagcttgttaccagtgagggttgcanagtgagttgctgagtgctttcaggagttgtctgca

SEQ ID NO: 12552 - DNA, 71 bp, chicken (Gallus Gallus)
  misc_feature (36): n=a or g
gaggaggggtatggggtagacctcttgatactgatntggtggatttactgtccctggaggttttcaagaag

SEQ ID NO: 12553 - DNA, 71 bp, chicken (Gallus Gallus)
  misc_feature (36): n=c or t
tttgggacctgttggattttgggacctgttggatgnagctggctttgtgccgagtgttgggatgaaaaacc

SEQ ID NO: 12554 - DNA, 71 bp, chicken (Gallus Gallus)
  misc_feature (36): n=c or t
atggcaaatgagactctattacccatgtgcaacagnggccatcccaccactgcttccactcacactggcca

SEQ ID NO: 12555 - DNA, 71 bp, chicken (Gallus Gallus)
  misc_feature (36): n=c or t
gccacagtgctaatcgggctcaagaaacaaaatacncttcccccggccagagaaagtattgactgagattt

SEQ ID NO: 12556 - DNA, 71 bp, chicken (Gallus Gallus)
  misc_feature (36): n=c or t
gtgcaaaagcagcgtgttgagtggtcgaatcgtcanttcccccccccccaggacgtggcagacccacctgg

SEQ ID NO: 12557 - DNA, 71 bp, chicken (Gallus Gallus)
  misc_feature (36): n=a or g
gtttctggctgggaaatgtgagtttgcagtgcaacntttaaggaccaagatgacagaggacacagctctcc

SEQ ID NO: 12558 - DNA, 71 bp, chicken (Gallus Gallus)
  misc_feature (36): n=g or t
acacgtctgctgaagctgttaaattacagtgtttgnctgggaattgttgtgttcggcctcgtgaaacaatg

SEQ ID NO: 12559 - DNA, 71 bp, chicken (Gallus Gallus)
  misc_feature (36): n=a or g
gatccaaaagactcagcactacatccaaggcccacntgccatctttactcccatggcagtgccagcagtct

SEQ ID NO: 12560 - DNA, 71 bp, chicken (Gallus Gallus)
  misc_feature (36): n=c or t
gcaggaaaaacgcggtatgagcatctccatcagcantgtgcatttccagggcatacccacccaattggagc

SEQ ID NO: 12561 - DNA, 71 bp, chicken (Gallus Gallus)
  misc_feature (36): n=a or g
tgaagctcagcatcatgcttaattctaagagttgcncttctgtgttaatacagcaagttttgtgcagggag

SEQ ID NO: 12562 - DNA, 71 bp, chicken (Gallus Gallus)
  misc_feature (36): n=c or t
accctggagagcacctgggaaaccattgaagatggnttaatgtgtttgagaggccctcggataactcggtg

SEQ ID NO: 12563 - DNA, 71 bp, chicken (Gallus Gallus)
  misc_feature (36): n=g or t
ctacacataatccctcttctttctccctcgtgcctnattccatctgttctttggcattagagcaattaatt

SEQ ID NO: 12564 - DNA, 71 bp, chicken (Gallus Gallus)
  misc_feature (36): n=c or t
agatgttctggttttccatccagttacttgcgtatntgtgctttattcagcatgtccttggagcctggtgc

SEQ ID NO: 12565 - DNA, 71 bp, chicken (Gallus Gallus)
  misc_feature (36): n=c or t
gtacacttacttcagtgttacttggtgtctaattcntacgatttctgcttggacaatcagtgctgagaacc

SEQ ID NO: 12566 - DNA, 71 bp, chicken (Gallus Gallus)
  misc_feature (36): n=a or g
gtgaaatcttgcaacagtctcattttataaaggacntgctgaaggtacttcaatccagaaatctgctgcag

SEQ ID NO: 12567 - DNA, 71 bp, chicken (Gallus Gallus)
  misc_feature (36): n=a or g
gatatatgttgaagctcttctgaactactgattctnttcaaactgaatatggtatgattgccccacataac

SEQ ID NO: 12568 - DNA, 71 bp, chicken (Gallus Gallus)
  misc_feature (36): n=g or t
tgaaagggaagggaaaaagcaaatggatatgaaaangagacacagcagtttttagccactggctgttagta

SEQ ID NO: 12569 - DNA, 71 bp, chicken (Gallus Gallus)
  misc_feature (36): n=c or t
tttgggatccccagtataaatccagaacgcgttgtngtaaagaaatacggccgtagtcattgtctcaaatg

SEQ ID NO: 12570 - DNA, 71 bp, chicken (Gallus Gallus)
  misc_feature (36): n=a or g
attcccaaactccaggcaattaatttgagaaggcanaagagctaaccaacttgtatcctcaacagcaactg

SEQ ID NO: 12571 - DNA, 71 bp, chicken (Gallus Gallus)
  misc_feature (36): n=a or g
acaagtattcgtgaatgtccttgaaaagagaaatcntgcatcagtgtatttagaggctgctgttacctctg

SEQ ID NO: 12572 - DNA, 71 bp, chicken (Gallus Gallus)
  misc_feature (36): n=a or g
ctgagtcttcagaaggggataccggagtgaaacacngctgactgctctcagcttccaaagtaactcagttt

SEQ ID NO: 12573 - DNA, 71 bp, chicken (Gallus Gallus)
  misc_feature (36): n=a or c
attctgtttaatgagaaatctcatcctctttcatangcattttgagtgaatgcatttagaggaaaatagaa

SEQ ID NO: 12574 - DNA, 71 bp, chicken (Gallus Gallus)
  misc_feature (36): n=c or t
gctgtgaggcttcccagaattccatcacatcactangtgcaccaaagagtgggcagtttgtagcactgaat

SEQ ID NO: 12575 - DNA, 71 bp, chicken (Gallus Gallus)
  misc_feature (36): n=c or t
aacctgattaaaacagtgacccctccaccacctgtnggtctgtcggaatggattgagcagaagttgtcaaa

SEQ ID NO: 12576 - DNA, 71 bp, chicken (Gallus Gallus)
  misc_feature (36): n=a or g
tctccaaaattatacacaaacatgcaactactttancaggagctttgccagagagaggaagtcagaatgaa

SEQ ID NO: 12577 - DNA, 71 bp, chicken (Gallus Gallus)
  misc_feature (36): n=a or g
tccactgacagtcagctggggtgcaggcttaggggnctgtgacttctgaggagacatcttacccactccac

SEQ ID NO: 12578 - DNA, 71 bp, chicken (Gallus Gallus)
  misc_feature (36): n=c or t
ttaacctcaattttggatactccttctgtgcaattntgtcaccactacaactggtgctgcatctagattac

SEQ ID NO: 12579 - DNA, 71 bp, chicken (Gallus Gallus)
  misc_feature (36): n=a or t
ctggttggttttatacccaccaccggcagcatgaantaacagtaggactggcaggttaacatcatgcctct

SEQ ID NO: 12580 - DNA, 71 bp, chicken (Gallus Gallus)
  misc_feature (36): n=a or g
agtctgcataagcatattaagtttaaacagaaacantatgtgaccatattgctcatggttagccatgtctt

SEQ ID NO: 12581 - DNA, 71 bp, chicken (Gallus Gallus)
  misc_feature (36): n=a or g
acctaagaacttaaagctttttactttcactattgncatacagaagtagtatcccatgaagtctgatgaac

SEQ ID NO: 12582 - DNA, 71 bp, chicken (Gallus Gallus)
  misc_feature (36): n=a or g
tctttaatccctcagctttacagtaaatccaggccngagtgggaacacactgtaaattaaagtatgtcatg

SEQ ID NO: 12583 - DNA, 71 bp, chicken (Gallus Gallus)
  misc_feature (36): n=c or g
gccatataactacaggcagcacaggtaactttacanttgttattatatttcattatatcaatgagaagtgt

SEQ ID NO: 12584 - DNA, 71 bp, chicken (Gallus Gallus)
  misc_feature (36): n=c or t
tatgtctacctaagaaaataaattggccctgaaganttgaaggggggcattttggtctttaaaggatcact

SEQ ID NO: 12585 - DNA, 71 bp, chicken (Gallus Gallus)
  misc_feature (36): n=g or t
gactggttagcacacactgcagcaattgtctgcagngctcagtgacttactatgttgtttttgttgcccgc

SEQ ID NO: 12586 - DNA, 71 bp, chicken (Gallus Gallus)
  misc_feature (36): n=a or g
ccagaagacagcttcttttgtgaataatgatgaacntggcacaagttatggctcctgttagtagagctgtg

SEQ ID NO: 12587 - DNA, 71 bp, chicken (Gallus Gallus)
  misc_feature (36): n=a or g
ggcactgacacaagtcacacatcagacaaagcaaanaagccttcaaaaatacaggtgtcctccgaggtaag

SEQ ID NO: 12588 - DNA, 71 bp, chicken (Gallus Gallus)
  misc_feature (36): n=a or g
aattatttaaattcatggcattttgcaggaggattnggaagttagtttggagtttgatacaaatcacattc

SEQ ID NO: 12589 - DNA, 71 bp, chicken (Gallus Gallus)
  misc_feature (36): n=a or g
aggcaatccgtagaccagatgaatttatttttaatntccctatggaatttgtctgagattatttaattaaa

SEQ ID NO: 12590 - DNA, 71 bp, chicken (Gallus Gallus)
  misc_feature (36): n=c or t
agtaaaccttcgtatacatataacctagctgaactnccaccacaccaggattcaaagagaatgtgttttta

SEQ ID NO: 12591 - DNA, 71 bp, chicken (Gallus Gallus)
  misc_feature (36): n=c or t
atcatatatttgaattttatggatttttaaaaacantttccaaattctgtcttagagtttttttcctgttt

SEQ ID NO: 12592 - DNA, 71 bp, chicken (Gallus Gallus)
  misc_feature (36): n=c or t
caaaagcttgatttttccaggccatccacaggaatnatttctcactgttgcaaatacaggttgcacttctc

SEQ ID NO: 12593 - DNA, 71 bp, chicken (Gallus Gallus)
  misc_feature (36): n=c or g
tcacacagttaaatactgggttattagtgcagcaantccagcttgagttgcatgtttgttttactcgctgt

SEQ ID NO: 12594 - DNA, 71 bp, chicken (Gallus Gallus)
  misc_feature (36): n=c or t
aggttagcggtgctgttcgcaacttccttggcagantgcacaaagtgtctcttggcaacaggatttgctgt

SEQ ID NO: 12595 - DNA, 71 bp, chicken (Gallus Gallus)
  misc_feature (36): n=a or g
tggtagaaccaggatcctggtatttttggcactacntggaatctacaggtccaagccctgcaaaaggtaag

SEQ ID NO: 12596 - DNA, 71 bp, chicken (Gallus Gallus)
  misc_feature (36): n=a or g
tgcgttcactttgaagacaacacaataatcatagantgaccggggttggaaaagacctccaggatcaccca

SEQ ID NO: 12597 - DNA, 71 bp, chicken (Gallus Gallus)
  misc_feature (36): n=c or g
ctgaatacttcctagtgctatatgaatgcatgtgtntctacgctaaaagggatagaatgaagggaattggc

SEQ ID NO: 12598 - DNA, 71 bp, chicken (Gallus Gallus)
  misc_feature (36): n=c or g
aagtcttatttcttatactaatacttctgaagtttntcctttgatcattaccaccaattcaacagatgagc

SEQ ID NO: 12599 - DNA, 71 bp, chicken (Gallus Gallus)
  misc_feature (36): n=a or g
gctctgctcaccttgctcattgcctctgttatcgantctaccatacctccaaccatgcctacttcactagc

SEQ ID NO: 12600 - DNA, 71 bp, chicken (Gallus Gallus)
  misc_feature (36): n=a or t
gaaaactcagataaaatatgtttaatccatgaaacntctacaggtataattaaggctaaaacttagcagat

SEQ ID NO: 12601 - DNA, 71 bp, chicken (Gallus Gallus)
  misc_feature (36): n=a or g
ggcatgcaacaagtagtggaaaaaggagaacacctncagctgtggctgtgcacagtgcacaacacaaagtc

SEQ ID NO: 12602 - DNA, 71 bp, chicken (Gallus Gallus)
  misc_feature (36): n=c or t
accttgatagtcttaacgaggttagcggtgctgttngcaacttccttggcagactgcacaaagtgtctctt

SEQ ID NO: 12603 - DNA, 71 bp, chicken (Gallus Gallus)
  misc_feature (36): n=a or c
ctcttctgccctgcttgtgtgccacagctgagcagnacctctgcggcatatgcctacctacaagtgagaaa

SEQ ID NO: 12604 - DNA, 71 bp, chicken (Gallus Gallus)
  misc_feature (36): n=a or g
ttaacattcaattaacacatttcactgccatcaccnctatcattaaatggagcaagaggagacatcttttg

SEQ ID NO: 12605 - DNA, 71 bp, chicken (Gallus Gallus)
  misc_feature (36): n=a or g
cagtgaaagatggtttacccacagcaatggatgacntttgagagatggctgtttttctcttagtgaaactg

SEQ ID NO: 12606 - DNA, 71 bp, chicken (Gallus Gallus)
  misc_feature (36): n=c or t
ttaaaattgatgtcctgtactatagcaaaaatccangtgaaatttgtatgtgtcccaaatgatgaaaatgc

SEQ ID NO: 12607 - DNA, 71 bp, chicken (Gallus Gallus)
  misc_feature (36): n=c or t
gagtctttagtgacacccagcaaacgaggaaccagnttgtttttacctttcattttttcctaaaccagggt

SEQ ID NO: 12608 - DNA, 71 bp, chicken (Gallus Gallus)
  misc_feature (36): n=a or c
agttcttctaggtacctatttttcctcttatcatcnccttgttgctctccattgcatccatatagtgctgg

SEQ ID NO: 12609 - DNA, 71 bp, chicken (Gallus Gallus)
  misc_feature (36): n=c or t
agaacatcgtagagaggtgcttcaggaagagttatngcttacatccaaataacttacgtgtgtatgctgaa

SEQ ID NO: 12610 - DNA, 71 bp, chicken (Gallus Gallus)
  misc_feature (36): n=a or c
catagagatgtcttctaccaaaacagctgcactggncaggctgtgcagttgtacatgctaaggacgttccc

SEQ ID NO: 12611 - DNA, 71 bp, chicken (Gallus Gallus)
  misc_feature (36): n=c or t
ccgtcatggagggtgcctctgctgtcagccccagcngtttcattccccaggtttatgacgctgtccagctg

SEQ ID NO: 12612 - DNA, 71 bp, chicken (Gallus Gallus)
  misc_feature (36): n=a or g
tctgtttaacagttctttctatagcccaccactacngtattatgaagccctaagaacatcccattctgcat

SEQ ID NO: 12613 - DNA, 71 bp, chicken (Gallus Gallus)
  misc_feature (36): n=c or t
taagaaatttgtaattatggctcattttatttaagncactctgtaaaactgaatagggaactgaataggaa

SEQ ID NO: 12614 - DNA, 71 bp, chicken (Gallus Gallus)
  misc_feature (36): n=a or c
tttatattgtcagtgctaataatcgaataccagtantaaagtaatgcatccaggctgttggttttaaacat

SEQ ID NO: 12615 - DNA, 71 bp, chicken (Gallus Gallus)
  misc_feature (36): n=c or t
attcgacccataacgaccataaagaatggtttatcnctttgttccttgcagtatctgttagacaccaggaa

SEQ ID NO: 12616 - DNA, 71 bp, chicken (Gallus Gallus)
  misc_feature (36): n=c or t
ctacctgagcagaggtgataatctggagaaatcagngtccagctttcggctggaatagagctacttttctt

SEQ ID NO: 12617 - DNA, 71 bp, chicken (Gallus Gallus)
  misc_feature (36): n=a or c
ggtgtaattgctgtcgaccggttatcgaccagggantactagaacaaacttaggcccaggggtgggtgagc

SEQ ID NO: 12618 - DNA, 71 bp, chicken (Gallus Gallus)
  misc_feature (36): n=c or t
tttagagaaagtaagagaggtaaagtctgctcatanttacatcacatagcccttaaaaagaagttccttct

SEQ ID NO: 12619 - DNA, 71 bp, chicken (Gallus Gallus)
  misc_feature (36): n=a or g
gtatgtcctgaaatggactaaagaggggtttcttgntagcacaaacttagactcaagatttatgtaggcta

SEQ ID NO: 12620 - DNA, 71 bp, chicken (Gallus Gallus)
  misc_feature (36): n=c or t
aggttgctatggcacaaatttaaaggaaaagatctngagcttctggaattaaagtgctactggtaggaaga

SEQ ID NO: 12621 - DNA, 71 bp, chicken (Gallus Gallus)
  misc_feature (36): n=c or g
agcttgcttaaaaataaaacgtgaaaaactaagccntccagagacccaaaatctgacccaaatctaactct

SEQ ID NO: 12622 - DNA, 71 bp, chicken (Gallus Gallus)
  misc_feature (36): n=c or t
tagttgttattgctttttggaagactttggggatantatttgtttctttctttctttgttgtcaccagctc

SEQ ID NO: 12623 - DNA, 71 bp, chicken (Gallus Gallus)
  misc_feature (36): n=a or g
gccacaagaccggtcagtctgttcagaatactgaanccattggattctttccccgctttgactggttccct

SEQ ID NO: 12624 - DNA, 71 bp, chicken (Gallus Gallus)
  misc_feature (36): n=a or g
ggagacttagttcaaaatgacacaaaccagatgcantcatgtttttgtgtgtctgttcagacgtacaaaat

SEQ ID NO: 12625 - DNA, 71 bp, chicken (Gallus Gallus)
  misc_feature (36): n=c or t
cagtgttcgttagatatcaaaatttgtcagtaatgntctctagaactcactgttagcgacaagccttctga

SEQ ID NO: 12626 - DNA, 71 bp, chicken (Gallus Gallus)
  misc_feature (36): n=g or t
agaaaacagggtaaattttttttcccatttaaaagntttgttctctgaacataacttccagtaagttaccc

SEQ ID NO: 12627 - DNA, 71 bp, chicken (Gallus Gallus)
  misc_feature (36): n=a or g
agcaatctgggacacttctggatcccttgggcaccnaggtgaaaaaaaggcattgaactgcagagtaagtg

SEQ ID NO: 12628 - DNA, 71 bp, chicken (Gallus Gallus)
  misc_feature (36): n=a or g
caaagaccatgcccacaggagatggatggttacttntggtgtggtcaaggcactgaaaatactattaccac

SEQ ID NO: 12629 - DNA, 71 bp, chicken (Gallus Gallus)
  misc_feature (36): n=a or g
tcctgcacactcccttgtagcctaccagttccccantggtattccacgcaaggaaagtctatggataacag

SEQ ID NO: 12630 - DNA, 71 bp, chicken (Gallus Gallus)
  misc_feature (36): n=c or t
tctgtttccatggcctatttttcaagcttctacaangttagaaaagtagagaagttttgtttttattgctt

SEQ ID NO: 12631 - DNA, 71 bp, chicken (Gallus Gallus)
  misc_feature (36): n=c or t
gcctggctatctgtgtaaaagatcagcagggagaangggcaggcattattagaattgctcatggtcatggt

SEQ ID NO: 12632 - DNA, 71 bp, chicken (Gallus Gallus)
  misc_feature (36): n=a or g
agaaggcaagacaagaaaagaatcgtaaaatgacancaggactcagcctttccacagcatttcacagaatt

SEQ ID NO: 12633 - DNA, 71 bp, chicken (Gallus Gallus)
  misc_feature (36): n=a or g
ttcctgcgatcaaagtatgagagctgctttctgtantactcttcatcttcttcgggatcataatgatttga

SEQ ID NO: 12634 - DNA, 71 bp, chicken (Gallus Gallus)
  misc_feature (36): n=a or c
gtttcctgctgtatcaaatggacaagtagtaactanatattttttcatgtggaatgactaggagttgtgct

SEQ ID NO: 12635 - DNA, 71 bp, chicken (Gallus Gallus)
  misc_feature (36): n=a or g
gaagcagaacgttcagaagtcagtcaaggatgggcnggggggcaaagaagatcagtttgtcacatctctct

SEQ ID NO: 12636 - DNA, 71 bp, chicken (Gallus Gallus)
  misc_feature (36): n=g or t
gcctcttcccccagggaaaacttctgtctagttctnctctctgttatgctttttgcctcttaagactgaag

SEQ ID NO: 12637 - DNA, 71 bp, chicken (Gallus Gallus)
  misc_feature (36): n=a or g
gcaatctagatatcaatttaaaaacaattattggcntaattaaaaagcattttaatgttgctattcattat

SEQ ID NO: 12638 - DNA, 71 bp, chicken (Gallus Gallus)
  misc_feature (36): n=c or t
gtgtagtatgtaaagggacaaaaccaggctcttctnagtgctgtgtggccacaggacaaggggaaacggcc

SEQ ID NO: 12639 - DNA, 71 bp, chicken (Gallus Gallus)
  misc_feature (36): n=a or g
tacggacctaagaatgtgggatgagaaatggaaagnacaaaattctgtgaaaatgggagttcctttacctt

SEQ ID NO: 12640 - DNA, 71 bp, chicken (Gallus Gallus)
  misc_feature (36): n=c or t
cacatgattcaaagagctccttcccacttcaaaganagagctacagactcttcagaactgcagaagagtac

SEQ ID NO: 12641 - DNA, 71 bp, chicken (Gallus Gallus)
  misc_feature (36): n=c or t
tggctgctctaatcaaaggagtaattacatgttgcncaaaaaatgtacaatgcatcaagacacacggagcc

SEQ ID NO: 12642 - DNA, 71 bp, chicken (Gallus Gallus)
  misc_feature (36): n=a or t
gcagtgtgaaatgttatatatgcaaagaggtaagcnagcagcttactatatgctgtgagctgccacattga

SEQ ID NO: 12643 - DNA, 71 bp, chicken (Gallus Gallus)
  misc_feature (36): n=a or g
tgaaagcttgcaatggaaaaagttccagatccaacnagtgtctcacaacaatttcagaagagtctgaaagc

SEQ ID NO: 12644 - DNA, 71 bp, chicken (Gallus Gallus)
  misc_feature (36): n=a or g
aaattcaaggaaaatccctccctgattatttgtgtntgctgctatcactaaatcagttgaagtacaggaaa

SEQ ID NO: 12645 - DNA, 71 bp, chicken (Gallus Gallus)
  misc_feature (36): n=g or t
ggtgcctctttgtggaaggcagtgtgctgcagctgntcagaacaaggatggtgtgtttggtgcattccgtc

SEQ ID NO: 12646 - DNA, 71 bp, chicken (Gallus Gallus)
  misc_feature (36): n=a or g
atcatactaatggtctttgagatgcagtacaagtantgcatgatttaatatttactaattattcaacagct

SEQ ID NO: 12647 - DNA, 71 bp, chicken (Gallus Gallus)
  misc_feature (36): n=c or t
tatatctgagagtattaaccagaaaggaatggtggngctacttaggctgttgcatggttgtaaaccctgca

SEQ ID NO: 12648 - DNA, 71 bp, chicken (Gallus Gallus)
  misc_feature (36): n=a or t
ttgttcactgggttgttccacagactatctgatggnacaaatttcctctactcttctcactacctatgtgg

SEQ ID NO: 12649 - DNA, 71 bp, chicken (Gallus Gallus)
  misc_feature (36): n=a or c
atttttcattagtccccatctctcggaacagggccntgttcttttctcaggagccatctaaaacagcaggg

SEQ ID NO: 12650 - DNA, 71 bp, chicken (Gallus Gallus)
  misc_feature (36): n=a or g
ttctcaagaaagaagtaacgaaccgtggtccctgtngttgtgtttgtgctttactgtctgtgagttctgta

SEQ ID NO: 12651 - DNA, 71 bp, chicken (Gallus Gallus)
  misc_feature (36): n=c or t
acacacatcagatcatacatccacagcattagttgngtttattttgtaatgtttactttataaataaagca

SEQ ID NO: 12652 - DNA, 71 bp, chicken (Gallus Gallus)
  misc_feature (36): n=c or t
atgaatcttttgagcttattgttacaagacagtaantgttgctaaagagtacacatataataaatgtgcct

SEQ ID NO: 12653 - DNA, 71 bp, chicken (Gallus Gallus)
  misc_feature (36): n=c or t
agagactggctgacctctagtttgtcccatgaccangtataaggtgtactcaccgtgataaatcccaaaga

SEQ ID NO: 12654 - DNA, 71 bp, chicken (Gallus Gallus)
  misc_feature (36): n=a or c
ttcgctatttacctaatactgcaacagcctacatanccaagcaaatgtgtaatttatgtaacacaattaaa

SEQ ID NO: 12655 - DNA, 71 bp, chicken (Gallus Gallus)
  misc_feature (36): n=a or g
gaagcacattgatccagtgcgttgcttcataccggntttagctttttgttctgaattggtgtggctgtaaa

SEQ ID NO: 12656 - DNA, 71 bp, chicken (Gallus Gallus)
  misc_feature (36): n=c or g
tgcaggctaagagaactcaaactttgtgttccaaanccttgagatgcagagcaacatgtgtttgtaactct

SEQ ID NO: 12657 - DNA, 71 bp, chicken (Gallus Gallus)
  misc_feature (36): n=a or g
ttcaaaattactcaacaaatataccaaaattaaaantaattactaacaggtttctcaagtcctgactaccg

SEQ ID NO: 12658 - DNA, 71 bp, chicken (Gallus Gallus)
  misc_feature (36): n=a or t
gcacatatagaggcactgtgttataatgctctcttnttcctcagttctgtcctgaaaagaaaaaaacccat

SEQ ID NO: 12659 - DNA, 71 bp, chicken (Gallus Gallus)
  misc_feature (36): n=c or t
gaacaaagaagttgctagtactgaaggaagagatgnattatatttgtgcataaaggatcaggtttgggtga

SEQ ID NO: 12660 - DNA, 71 bp, chicken (Gallus Gallus)
  misc_feature (36): n=c or t
ttgagtcaagtacttctttagcactcatcattccangcttggtactgcagcctaccaaggccaaagtattc

SEQ ID NO: 12661 - DNA, 71 bp, chicken (Gallus Gallus)
  misc_feature (36): n=c or t
catctcctgtcctatagtcagcaataaaagaagcangttgatactgctttcaaatgtatgtattatctaga

SEQ ID NO: 12662 - DNA, 71 bp, chicken (Gallus Gallus)
  misc_feature (36): n=c or t
agtcttgctgtcattcacatctccagagatcatttncattgtgatatctccatgtgttgagttagtaatga

SEQ ID NO: 12663 - DNA, 71 bp, chicken (Gallus Gallus)
  misc_feature (36): n=a or g
cctaccccgactcccacccctaccccaactccaacncccacctctgaaatgattgctggatctcagaacgt

SEQ ID NO: 12664 - DNA, 71 bp, chicken (Gallus Gallus)
  misc_feature (36): n=c or g
gcacgtctccctgtgtgtgaaatcttctctgatcanttggtaggttaaagctgtgtgtgctttatcacttg

SEQ ID NO: 12665 - DNA, 71 bp, chicken (Gallus Gallus)
  misc_feature (36): n=c or t
catgttgcaggaggagcatgattctctcgcctgacnctgtaagttggagccttcagtttagtcatcctgat

SEQ ID NO: 12666 - DNA, 71 bp, chicken (Gallus Gallus)
  misc_feature (36): n=c or t
gtgttccacagctgcaggatgttttgaacccttcancccatcccttgtgagcccccaggccagggtggcag

SEQ ID NO: 12667 - DNA, 71 bp, chicken (Gallus Gallus)
  misc_feature (36): n=g or t
tccaggtccctctggctggcatctcttccatctctnatatcagcttcacaactgagattggtgccatccac

SEQ ID NO: 12668 - DNA, 71 bp, chicken (Gallus Gallus)
  misc_feature (36): n=a or g
gaaacctgccttttcatgttatatacctgtctttantgccatagatttacttgaaatagaagaattgtatg

SEQ ID NO: 12669 - DNA, 71 bp, chicken (Gallus Gallus)
  misc_feature (36): n=c or t
atctagagaaacactggttcctttaaaacaggtctntggcccatcatgggggtgcctgacccagctgggaa

SEQ ID NO: 12670 - DNA, 71 bp, chicken (Gallus Gallus)
  misc_feature (36): n=g or t
taccacaagaactaaggaggaagtttcccacacttnacacattcttactttttattattttgtatttttaa

SEQ ID NO: 12671 - DNA, 71 bp, chicken (Gallus Gallus)
  misc_feature (36): n=c or t
taatagtgtcattaatgtggagattcttctctctgncatcactgtattgccagactttccctgtttaaggt

SEQ ID NO: 12672 - DNA, 71 bp, chicken (Gallus Gallus)
  misc_feature (36): n=a or g
cagaaacctggagttggaaccaccttagcagacccnttgatgcgtgtagggatcttaaacttcttaaagga

SEQ ID NO: 12673 - DNA, 71 bp, chicken (Gallus Gallus)
  misc_feature (36): n=c or g
gttttgtttctttccttgagaaatgttgatttgggnaaaataaattagagtggagattttgaagacaaaag

SEQ ID NO: 12674 - DNA, 71 bp, chicken (Gallus Gallus)
  misc_feature (36): n=c or g
tcaccatctgtgcttcactgacatgtattgcaatgncccccttgtatcgaagaggcagtagactattgatt

SEQ ID NO: 12675 - DNA, 71 bp, chicken (Gallus Gallus)
  misc_feature (36): n=a or g
aatcagctggcagagagaataaggttgctccattcntctctgtagtgactcaattcactaaacaggcaaaa

SEQ ID NO: 12676 - DNA, 71 bp, chicken (Gallus Gallus)
  misc_feature (36): n=a or g
tgtttataaaatacatcttcaacactgaatgatctncagaatatcaggaagtctttgtttctgaatataaa

SEQ ID NO: 12677 - DNA, 71 bp, chicken (Gallus Gallus)
  misc_feature (36): n=c or t
gtagctaccaaacattaggtatttcctccactacangagactagtgggtcagtttcattcatgaccatggg

SEQ ID NO: 12678 - DNA, 71 bp, chicken (Gallus Gallus)
  misc_feature (36): n=c or t
ttaagtttcttccagttttgccaggttttctgatcngtgtgtgtaattcaacggtcatgattattcctatt

SEQ ID NO: 12679 - DNA, 71 bp, chicken (Gallus Gallus)
  misc_feature (36): n=c or t
cttgttgaagtgttctcagccactggtgtatcagcntgacattgaggaacaccggccctgatgagagctgc

SEQ ID NO: 12680 - DNA, 71 bp, chicken (Gallus Gallus)
  misc_feature (36): n=c or t
aagaacaaaacaaaaaaacccagggaagttcagaangtatttctcacctttctaccagattgcttgaccac

SEQ ID NO: 12681 - DNA, 71 bp, chicken (Gallus Gallus)
  misc_feature (36): n=a or g
caaaggaaacaacttgcttacttttggaaggcatcnggacaaggacatccagcgagatccccttccctcta

SEQ ID NO: 12682 - DNA, 71 bp, chicken (Gallus Gallus)
  misc_feature (36): n=a or c
tctgtgctgcctcacctggctggcagctcctgctcngtaacctctggagggcaaaacacacttagtggcct

SEQ ID NO: 12683 - DNA, 71 bp, chicken (Gallus Gallus)
  misc_feature (36): n=a or g
atgatttaggaaggccatttccagaaatagctttcnaagtctggcacattacatcaaatgtaatcatttaa

SEQ ID NO: 12684 - DNA, 71 bp, chicken (Gallus Gallus)
  misc_feature (36): n=c or t
atacgtgatgcaaaagtttcagtcctatattttccnatatataaaatgctcaccatacgatgatcctttga

SEQ ID NO: 12685 - DNA, 71 bp, chicken (Gallus Gallus)
  misc_feature (36): n=a or g
ccaaagctcagcagcacacaccgtgtccttgttctnacaaagctgcagctgccggagaagcagaaatggaa

SEQ ID NO: 12686 - DNA, 71 bp, chicken (Gallus Gallus)
  misc_feature (36): n=g or t
tgacaaacccctattttattttcctctactgcagtngtttgcaatgtgaatacaggaaacaaccctgttga

SEQ ID NO: 12687 - DNA, 71 bp, chicken (Gallus Gallus)
  misc_feature (36): n=c or t
tgtgtgaaacaacggaaaaatggaaaagaacaggcnattgacaaagagacccattcacaccaaaggcagca

SEQ ID NO: 12688 - DNA, 71 bp, chicken (Gallus Gallus)
  misc_feature (36): n=c or t
tgtctataaggaactgtagcacctgttaccagtctnactaaaaatctggaggaagaaataagaaaatacac

SEQ ID NO: 12689 - DNA, 71 bp, chicken (Gallus Gallus)
  misc_feature (36): n=a or g
tcacaaatttcttaactacctacacaggcagtggcntcattacctttcttttcttttgtaaaaggcacgta

SEQ ID NO: 12690 - DNA, 71 bp, chicken (Gallus Gallus)
  misc_feature (36): n=a or g
gttgcagcctgctgcagccaccgggaaggggacacngacctttgtattttgaggctattcaatacctttgt

SEQ ID NO: 12691 - DNA, 71 bp, chicken (Gallus Gallus)
  misc_feature (36): n=c or t
aaacatataggcatctgaagctgtaattcttcagtnacaaactgatagtggcatctggaaggacactctgc

SEQ ID NO: 12692 - DNA, 71 bp, chicken (Gallus Gallus)
  misc_feature (36): n=a or t
taggggccctcacgtaaatcaatctgatctgactgnagaagtcatcccttcaatgtttaacgacacctact

SEQ ID NO: 12693 - DNA, 71 bp, chicken (Gallus Gallus)
  misc_feature (36): n=a or c
aatgtaagaataatttatagtacaatgatatcttgnagcacttttttttttggcagaataaatacgtatgt

SEQ ID NO: 12694 - DNA, 71 bp, chicken (Gallus Gallus)
  misc_feature (36): n=a or g
tacagtttacagattggtaactaactaccaatgggncagtccacttagtttcctagttttgacctactttc

SEQ ID NO: 12695 - DNA, 71 bp, chicken (Gallus Gallus)
  misc_feature (36): n=a or g
aatgtttgttttccaggggctggagaatgcataccngtttatctgttggttcgtaatgcttccttgctgtg

SEQ ID NO: 12696 - DNA, 71 bp, chicken (Gallus Gallus)
  misc_feature (36): n=a or g
ccctttcctacatttggctggtttaaacaaaaaaancagtcattaataaaacttgttgttttctttttgtt

SEQ ID NO: 12697 - DNA, 71 bp, chicken (Gallus Gallus)
  misc_feature (36): n=a or g
agtgtgttcaacgttaaggctgattacttggtgggnagctgccccttgaacacctctgtgtgttcttggct

SEQ ID NO: 12698 - DNA, 71 bp, chicken (Gallus Gallus)
  misc_feature (36): n=c or t
cagtcatggaattagtatttagctccttatgtgccngaaagaaaacaaattgtgaatctatttccattcaa

SEQ ID NO: 12699 - DNA, 71 bp, chicken (Gallus Gallus)
  misc_feature (36): n=c or t
aaataaataggaggcattactttcagaatggcctangtaaatatttgaaaatgaagtgttaaaatgggaga

SEQ ID NO: 12700 - DNA, 71 bp, chicken (Gallus Gallus)
  misc_feature (36): n=c or t
ctgctggctctaccttggagtacttcattgtcacangcatacctatttttcactccatggcttttcaaatg

SEQ ID NO: 12701 - DNA, 71 bp, chicken (Gallus Gallus)
  misc_feature (36): n=c or t
ctgctcagaccagtaatatttccagtccacctcacngggccttaagtgtatgtttgaggcttagccatctg

SEQ ID NO: 12702 - DNA, 71 bp, chicken (Gallus Gallus)
  misc_feature (36): n=c or t
gctttgtgcttctaagttatttttaagcaccttcanggccatcattaaatgttaaaaggatcttgtatctt

SEQ ID NO: 12703 - DNA, 71 bp, chicken (Gallus Gallus)
  misc_feature (36): n=a or g
gccacagataaagctgtgcgtgtgtgtgggtgtacntgtgtactgtacacactaggatgtacttagattcc

SEQ ID NO: 12704 - DNA, 71 bp, chicken (Gallus Gallus)
  misc_feature (36): n=c or t
caagttccagttactcaagatacaatttctccctgngatgttatcatggcagttgagatcattgttaatac

SEQ ID NO: 12705 - DNA, 71 bp, chicken (Gallus Gallus)
  misc_feature (36): n=a or g
taataataaaagatgctttatccatttgtgcaaagntaaacgcagattgtatcttttttaatggtacggca

SEQ ID NO: 12706 - DNA, 71 bp, chicken (Gallus Gallus)
  misc_feature (36): n=c or t
cgttccaaagaagaacagcaaacacgcagccacaanagcactggaaaaataaataaaaatgtaattattgc

SEQ ID NO: 12707 - DNA, 71 bp, chicken (Gallus Gallus)
  misc_feature (36): n=c or t
tttattcatagctttcatggcaaataccatcacccnttcacttatgggaaaaactaagatgatttcccttt

SEQ ID NO: 12708 - DNA, 71 bp, chicken (Gallus Gallus)
  misc_feature (36): n=c or g
aaatacagtgatccatgtgtacgttatgataatcancaaggcttgggaacgttggtcgctttaatgatgtg

SEQ ID NO: 12709 - DNA, 71 bp, chicken (Gallus Gallus)
  misc_feature (36): n=a or c
aggggtcacaaaaaggcaaaagcaattgctgcaaantgtgttgttccggaacgttctctcccggaacgtgt

SEQ ID NO: 12710 - DNA, 71 bp, chicken (Gallus Gallus)
  misc_feature (36): n=a or g
ttacctatacatgcagaaatatttggtgaaatgtgntggcctggaggacaatcacaccgaaaacttccctc

SEQ ID NO: 12711 - DNA, 71 bp, chicken (Gallus Gallus)
  misc_feature (36): n=c or g
ccagggcataaatcaaccaacccttgcgaggaggantgtaattcctcaccgtgcagaggaaacacttagga

SEQ ID NO: 12712 - DNA, 71 bp, chicken (Gallus Gallus)
  misc_feature (36): n=a or t
aaaaaaacattttccaattccatgtgctgctatgcnattgatcccgttcataatacactgtgagttacttt

SEQ ID NO: 12713 - DNA, 71 bp, chicken (Gallus Gallus)
  misc_feature (36): n=a or g
aagaaacaactacttatgtcaagccctgcttttctngaagtgcctgaacatctctctgctcttaggaagta

SEQ ID NO: 12714 - DNA, 71 bp, chicken (Gallus Gallus)
  misc_feature (36): n=a or g
aagtgctttgttgtttttttttcaaagctcaagacnagcataagcaagttacagacttcaggacagaattc

SEQ ID NO: 12715 - DNA, 71 bp, chicken (Gallus Gallus)
  misc_feature (36): n=c or t
aagctacagtaactagagtataaaggtacctggcangactgatgcagctggcgtaaaatcttttgtaactt

SEQ ID NO: 12716 - DNA, 71 bp, chicken (Gallus Gallus)
  misc_feature (36): n=a or g
ttctgctctctgctgctcagcagagctatgaataanggttatccacacacattcctaatagcactcgagta

SEQ ID NO: 12717 - DNA, 71 bp, chicken (Gallus Gallus)
  misc_feature (36): n=c or g
gtatttagagtgatttatgacatttctcctacaatnagggagaaaggaagctggcacacacacacagaaaa

SEQ ID NO: 12718 - DNA, 71 bp, chicken (Gallus Gallus)
  misc_feature (36): n=a or g
ccatgcagattctcacaccttccattgggacagagntcaggatccagtaagcactcattaatgtctacata

SEQ ID NO: 12719 - DNA, 71 bp, chicken (Gallus Gallus)
  misc_feature (36): n=a or g
tccaatatgcactgcacaagcaagctttccacatcngctacatctatgtttaattcctaaaaaaaaaaaaa

SEQ ID NO: 12720 - DNA, 71 bp, chicken (Gallus Gallus)
  misc_feature (36): n=c or t
tataccgtgcaccacctctcttctgatgatccagtnctaggagctggttgacttgatcaattcggccatgt

SEQ ID NO: 12721 - DNA, 71 bp, chicken (Gallus Gallus)
  misc_feature (36): n=a or g
gaattaatggttaaagttcaaattttaactgagtcngtatgcatgaaatattttcctttctggactatgta

SEQ ID NO: 12722 - DNA, 71 bp, chicken (Gallus Gallus)
  misc_feature (36): n=a or g
ctctcaccttaattccggtgaattctaacagaaatntaacttttttcttcactacttcactaagttgtgat

SEQ ID NO: 12723 - DNA, 71 bp, chicken (Gallus Gallus)
  misc_feature (36): n=a or g
ttcataagggatgaactgcttaacctgcttacagangactaccaatacaaatgtatttaatttataacttc

SEQ ID NO: 12724 - DNA, 71 bp, chicken (Gallus Gallus)
  misc_feature (36): n=a or g
tattctgcattaatgggtatcaaactctgatagtcnttgtttggaatggcatttctgttaattcatctccg

SEQ ID NO: 12725 - DNA, 71 bp, chicken (Gallus Gallus)
  misc_feature (36): n=a or g
agcttgcaaatgaaaattggtttgcttactgaaatntgtcactaaattctcttgaggattacaaaattcat

SEQ ID NO: 12726 - DNA, 71 bp, chicken (Gallus Gallus)
  misc_feature (36): n=c or t
aggcttctcccttcctttccctgtaccatcccagcngtattctagaaggatcagcaggacagtaataactc

SEQ ID NO: 12727 - DNA, 71 bp, chicken (Gallus Gallus)
  misc_feature (36): n=a or g
caaaaaaaccctcccaaaaaaacagcaaataaaacnattccttcataacttgttcaaacagaaggaagcac

SEQ ID NO: 12728 - DNA, 71 bp, chicken (Gallus Gallus)
  misc_feature (36): n=a or t
gattcaagagagaagtcttacgttaggcttcctttntaagcagaatctctaacaaagccagacattttggc

SEQ ID NO: 12729 - DNA, 71 bp, chicken (Gallus Gallus)
  misc_feature (36): n=c or g
cacagaactcctcaaagtgacttaacctctcctttnatgctggaatttcttagaaagttttgcctcatagg

SEQ ID NO: 12730 - DNA, 71 bp, chicken (Gallus Gallus)
  misc_feature (36): n=c or g
agctgtattgatgctccttcatgtttgcagcagagntctgagatttttggattaaagaagtgaagcagtgg

SEQ ID NO: 12731 - DNA, 71 bp, chicken (Gallus Gallus)
  misc_feature (36): n=a or c
aaaacagatatcttaaaggttaaacaacttttctcngtagtgatgtattcagacaacatcagcatacagct

SEQ ID NO: 12732 - DNA, 71 bp, chicken (Gallus Gallus)
  misc_feature (36): n=a or g
tatcacagtacttctgttcttgcatctgtagtttantattggcactttcagtctgtttgagagtcatgaat

SEQ ID NO: 12733 - DNA, 71 bp, chicken (Gallus Gallus)
  misc_feature (36): n=a or g
aaaaagctaaaagttcagtcagcaaaaaatcactcntcaggattttaggagcttctgcagaagctttcaca

SEQ ID NO: 12734 - DNA, 71 bp, chicken (Gallus Gallus)
  misc_feature (36): n=a or c
actgaaataacccacagttccaactgacatatagantgatgtagatctaaagttatagaccatacagttat

SEQ ID NO: 12735 - DNA, 71 bp, chicken (Gallus Gallus)
  misc_feature (36): n=c or t
tgcaggtctttctctaatggtgaagaagaacgtggngttcagttgtggcagataaaggttaaacatgctcc

SEQ ID NO: 12736 - DNA, 71 bp, chicken (Gallus Gallus)
  misc_feature (36): n=a or g
caggaagccatcgccctatggatgactccatcttcnttcctctgctgctacgaggagtcctgagttgtgca

SEQ ID NO: 12737 - DNA, 71 bp, chicken (Gallus Gallus)
  misc_feature (36): n=a or g
tagaagaagcatttttctgttctgagcagtcattangcattacacagccatttcctctattctttctgatc

SEQ ID NO: 12738 - DNA, 71 bp, chicken (Gallus Gallus)
  misc_feature (36): n=a or c
gagactcttcctgagaaggcattgaaagaggatccntaaatctgtacctccggagaggtttacacagcctc

SEQ ID NO: 12739 - DNA, 71 bp, chicken (Gallus Gallus)
  misc_feature (36): n=c or t
gccttgagcccctcagctctcaggcttctctctctngtactataattgggccaaatatgaagcagtggcaa

SEQ ID NO: 12740 - DNA, 71 bp, chicken (Gallus Gallus)
  misc_feature (36): n=a or g
catttttctcttggctgagcaaaaatgcaattgacngtctcagcaggcatctgagcaagctaggagtggta

SEQ ID NO: 12741 - DNA, 71 bp, chicken (Gallus Gallus)
  misc_feature (36): n=a or g
tttgcaatgtaagcgtgagcagtgattgtaaatgantgcagattggcttcttaaaccccttctaactgcta

SEQ ID NO: 12742 - DNA, 71 bp, chicken (Gallus Gallus)
  misc_feature (36): n=c or t
cagcagcactgttgtgttcagattttctttagtgcngtttgctaagcattattccaagttgctttaatatc

SEQ ID NO: 12743 - DNA, 71 bp, chicken (Gallus Gallus)
  misc_feature (36): n=a or g
ggaaaatcacggaggtaacagaaagggattgggganttggtgtttgtagatatgtcattatctgtgctcca

SEQ ID NO: 12744 - DNA, 71 bp, chicken (Gallus Gallus)
  misc_feature (36): n=a or t
cgtgttggtgttgtcccggtacggcttgtcttctanataacttgacgtaactgaaactgaacgttctgtgg

SEQ ID NO: 12745 - DNA, 71 bp, chicken (Gallus Gallus)
  misc_feature (36): n=a or g
agagatctgtgattaccacaaagagttataaattcntagcatgattgagattttacttcttgaacattctt

SEQ ID NO: 12746 - DNA, 71 bp, chicken (Gallus Gallus)
  misc_feature (36): n=c or t
cactttcaccctggtgtattgtgctcatctaattcngtgctgtgttcccattggtgggctgtttcctgtcc

SEQ ID NO: 12747 - DNA, 71 bp, chicken (Gallus Gallus)
  misc_feature (36): n=a or g
aacttccttttgaaggttctacagtctttaagctcngtatttatttgtctgcatggcttttcattctgaaa

SEQ ID NO: 12748 - DNA, 71 bp, chicken (Gallus Gallus)
  misc_feature (36): n=a or g
tcagctaatccctttcagccttccttatgcccctcntggttttgtagacttctatcatatccttgaaacat

SEQ ID NO: 12749 - DNA, 71 bp, chicken (Gallus Gallus)
  misc_feature (36): n=c or t
actcatatgagcaaaaaggtgtcaggacagtattantgagggcattggagtggaatttgtgcttttctcgt

SEQ ID NO: 12750 - DNA, 71 bp, chicken (Gallus Gallus)
  misc_feature (36): n=a or t
aattttggctgtgtagtgccctgattttgcctgtanttattgtctgaggggaattcagtagccatagcaat

SEQ ID NO: 12751 - DNA, 71 bp, chicken (Gallus Gallus)
  misc_feature (36): n=c or t
ctgatgatataaactcacgtgtaaaaatgaataacncctttccactatattcttgtagttaatctggagaa

SEQ ID NO: 12752 - DNA, 71 bp, chicken (Gallus Gallus)
  misc_feature (36): n=c or t
gataccacacataagggtatagctaggaaagaattngagatatgcatttcttgtagagcaacttaattcgt

SEQ ID NO: 12753 - DNA, 71 bp, chicken (Gallus Gallus)
  misc_feature (36): n=a or t
attattttaatgccagaacatgcttctgtactattnatagaaggtgaagctgctgcagacttctctgactg

SEQ ID NO: 12754 - DNA, 71 bp, chicken (Gallus Gallus)
  misc_feature (36): n=a or c
caaagtgggaaaagtatagttagtcctgtgttttanctgtaccttgctttgatatcattcccctttattac

SEQ ID NO: 12755 - DNA, 71 bp, chicken (Gallus Gallus)
  misc_feature (36): n=a or g
cctatctgaacatgacatgtatggacgtgaggtacngcagcccgggttcgtggttttggcagccaggtgga

SEQ ID NO: 12756 - DNA, 71 bp, chicken (Gallus Gallus)
  misc_feature (36): n=a or g
gcgtctccatcagaataaccccaaaggatgagtccntgttggagccacatcgtgcatttgttacacatcgt

SEQ ID NO: 12757 - DNA, 71 bp, chicken (Gallus Gallus)
  misc_feature (36): n=a or c
ctgctgaacggtggccgaatcaaagaaccaatctgntgaaagctgctctcagaggtgggggctgagagggg

SEQ ID NO: 12758 - DNA, 71 bp, chicken (Gallus Gallus)
  misc_feature (36): n=a or g
aaaagagatttccgataatatcttaggtagcaatcntcacaattggcttcatgctaaaaatgaaaaaaaga

SEQ ID NO: 12759 - DNA, 71 bp, chicken (Gallus Gallus)
  misc_feature (36): n=a or g
ttgcttttgtttcataatccaattactttggatgcnctgaatcaatggggctattccagccctgagaataa

SEQ ID NO: 12760 - DNA, 71 bp, chicken (Gallus Gallus)
  misc_feature (36): n=a or g
aacacagcttgctctggtgatgcttttgctggaganaaggttgtgctgctatcaaaacaagaaataacata

SEQ ID NO: 12761 - DNA, 71 bp, chicken (Gallus Gallus)
  misc_feature (36): n=c or t
ctgctctaacacaccaggatcttgagaaatttggcnatgttctatacaaaaaatttctatgaagtctgtgg

SEQ ID NO: 12762 - DNA, 71 bp, chicken (Gallus Gallus)
  misc_feature (36): n=c or g
tcactgcctattcccctgttgcaggcgtcctgcatntgacagtggaagttttcagatttcctgtgtttctg

SEQ ID NO: 12763 - DNA, 71 bp, chicken (Gallus Gallus)
  misc_feature (36): n=c or t
cttctagcagatggtgttgtagcagtggagctttantctaagataatttggagctgtgaagtagtcagtga

SEQ ID NO: 12764 - DNA, 71 bp, chicken (Gallus Gallus)
  misc_feature (36): n=a or c
tattcccgtggatcatttggattaaaggatgagtanggtaacagtgtgaaactggcccaaatatctccaga

SEQ ID NO: 12765 - DNA, 71 bp, chicken (Gallus Gallus)
  misc_feature (36): n=c or t
agcaagggaatgggagtgagagagacgtggcgcttngtattgggttgaacatttcaaatgacaaacacaca

SEQ ID NO: 12766 - DNA, 71 bp, chicken (Gallus Gallus)
  misc_feature (36): n=c or t
agggcttgaattttttgcagactaataaacagattngtaattaaatcactattatagccactacagggaaa

SEQ ID NO: 12767 - DNA, 71 bp, chicken (Gallus Gallus)
  misc_feature (36): n=c or t
aaacaaaattgcaaatcaaggcatagttctcaacgncatctattttttaatgaaatgatcagaagtttgga

SEQ ID NO: 12768 - DNA, 71 bp, chicken (Gallus Gallus)
  misc_feature (36): n=a or c
gggacgcttcgataaccacacttgggtttatgcgcnctgcaagattcaactacggctttccacagccgtcc

SEQ ID NO: 12769 - DNA, 71 bp, chicken (Gallus Gallus)
  misc_feature (36): n=c or t
agatttcaagcacaacattgctccttgtttgcacangcttcaagcttacaaatatcatgcacgcattcagt

SEQ ID NO: 12770 - DNA, 71 bp, chicken (Gallus Gallus)
  misc_feature (36): n=c or t
gatcagaaaacacaatctttggacttcaattctttnttgaaccagaatcgataagcagagacagcagcaac

SEQ ID NO: 12771 - DNA, 71 bp, chicken (Gallus Gallus)
  misc_feature (36): n=c or t
tttgaacatctgagagctccaagcgcttgatttacnttgtggttcagatgccagctcaggcagattatttt

SEQ ID NO: 12772 - DNA, 71 bp, chicken (Gallus Gallus)
  misc_feature (36): n=a or g
cttctcatccaacaacgttcacatttttctggttgnaattattgcatgtcaaaaagaacagcaccccaaat

SEQ ID NO: 12773 - DNA, 71 bp, chicken (Gallus Gallus)
  misc_feature (36): n=a or g
cagctaatagggcagcatgggaacaaggaagtgacngaggctttgaaacaggggtcactgagagaactgac

SEQ ID NO: 12774 - DNA, 71 bp, chicken (Gallus Gallus)
  misc_feature (36): n=c or g
cggtcctagacttctacttcaagctccagttgtatnctttaagttcagctccttactcccaatttttcaat

SEQ ID NO: 12775 - DNA, 71 bp, chicken (Gallus Gallus)
  misc_feature (36): n=c or t
tccctttccctatggaaataaagcctgcttccttcngggtaagagcccccaaaacctgcctgggaatgatg

SEQ ID NO: 12776 - DNA, 71 bp, chicken (Gallus Gallus)
  misc_feature (36): n=c or g
tttcttcaaatggggatttttgccatcattcccacnttgagctctccggcacgaggtgccaaagcagccgc

SEQ ID NO: 12777 - DNA, 71 bp, chicken (Gallus Gallus)
  misc_feature (36): n=c or t
gcagacgtttccccactaacttcctgaatggtggangtctctgtgctaatctcagggtatgcagatgtttc

SEQ ID NO: 12778 - DNA, 71 bp, chicken (Gallus Gallus)
  misc_feature (36): n=a or g
gagcagagaaccctacgctacccagggaactcgcantgaagttgaccaagggcccaggaattgagtgacac

SEQ ID NO: 12779 - DNA, 71 bp, chicken (Gallus Gallus)
  misc_feature (36): n=c or t
ttgctctgtcagaaacaaaatgtcctctccaggtangcgtatctgcttaattggatcttcttaatatgttc

SEQ ID NO: 12780 - DNA, 71 bp, chicken (Gallus Gallus)
  misc_feature (36): n=c or t
cctgagagcagtgatacgtcagttgggaagacctcngttccctgggctgtctgattctcaggctcagagga

SEQ ID NO: 12781 - DNA, 71 bp, chicken (Gallus Gallus)
  misc_feature (36): n=c or g
cctctcctcactttccccaggccttcctatcgacancacaattataggaattgctaggttttaatgccatc

SEQ ID NO: 12782 - DNA, 71 bp, chicken (Gallus Gallus)
  misc_feature (36): n=a or g
ccccgcggtggtgctcgtgccttatatccatgcacnccgcgcccggaccccatttgaactctggtgccttc

SEQ ID NO: 12783 - DNA, 71 bp, chicken (Gallus Gallus)
  misc_feature (36): n=c or t
catctctacctatacccccactcatatccccatctntgttctcattctcatccttatccataaccccacct

SEQ ID NO: 12784 - DNA, 71 bp, chicken (Gallus Gallus)
  misc_feature (36): n=a or g
atcccgaagtggggcacatcccaccttcttgccatntcttcttgactgtgagatgataaaggaggtaggga

SEQ ID NO: 12785 - DNA, 71 bp, chicken (Gallus Gallus)
  misc_feature (36): n=c or t
ctatttcaagctgagtctcttcagtgtttctgggtncctgcgctagttcaacatctggagcactggtactg

SEQ ID NO: 12786 - DNA, 71 bp, chicken (Gallus Gallus)
  misc_feature (36): n=a or c
ttttgtttgtttgtttgtttaaaaaaaaaagcctgngccagaaaacagtaattataattaataaatagaag

SEQ ID NO: 12787 - DNA, 71 bp, chicken (Gallus Gallus)
  misc_feature (36): n=a or g
cacagtggtgaaggtgatgaagttgctgcagccttnacacacacctcgtacatttgcctggtataattgca

SEQ ID NO: 12788 - DNA, 71 bp, chicken (Gallus Gallus)
  misc_feature (36): n=c or t
gctcagtcctccgctgtagccaaacaaaataggctnggctttcttaacatttccttgtaaatcaggtttct

SEQ ID NO: 12789 - DNA, 71 bp, chicken (Gallus Gallus)
  misc_feature (36): n=a or g
gctgaatgtgttgcaggacagtggacttaaggctcntgggtgagctgtgtggttttgcttctcctttgctg

SEQ ID NO: 12790 - DNA, 71 bp, chicken (Gallus Gallus)
  misc_feature (36): n=c or t
tgttcaggccattttccgattaaacaacacctgtcnaaggcgagtaaggagaaaaaaaagcagatggatta

SEQ ID NO: 12791 - DNA, 71 bp, chicken (Gallus Gallus)
  misc_feature (36): n=a or c
atgaaaacaagcttgtatcaatacggtttagtgccntctttctcacttggaaagtgcccactggtcctgcc

SEQ ID NO: 12792 - DNA, 71 bp, chicken (Gallus Gallus)
  misc_feature (36): n=a or g
atggacgaggaaccagatgctgaagtagtagatccncaggaaccactcatgcctcttaaaacttctccagc

SEQ ID NO: 12793 - DNA, 71 bp, chicken (Gallus Gallus)
  misc_feature (36): n=c or t
ataatcccacattctggtgagattctttcttttcantttcatagggcctatgctacagtctaacgtgtttt

SEQ ID NO: 12794 - DNA, 71 bp, chicken (Gallus Gallus)
  misc_feature (36): n=c or t
tacaatggggtggagcagaggaaactttccctgtanccttctgtatgtttttaatgctacgtgcatccctt

SEQ ID NO: 12795 - DNA, 71 bp, chicken (Gallus Gallus)
  misc_feature (36): n=a or g
caggggaataaaattctctgtttgaagatggatttnaaacagaaatacgcattgtgattagaatcataaga

SEQ ID NO: 12796 - DNA, 71 bp, chicken (Gallus Gallus)
  misc_feature (36): n=a or g
ctagtcattctggagagagatgttctcacctcctcnatgctttcttttgactaacagccatattctttctt

SEQ ID NO: 12797 - DNA, 71 bp, chicken (Gallus Gallus)
  misc_feature (36): n=a or t
aatagaatttatcgacacagtagtgagacatcagtnaagcacacaacagagactgcacgctgtgagctaag

SEQ ID NO: 12798 - DNA, 71 bp, chicken (Gallus Gallus)
  misc_feature (36): n=c or t
gtgggatgatagtagcagcatgggccaggtcagccnataaagtcaggcctgggccagtacctagaattgga

SEQ ID NO: 12799 - DNA, 71 bp, chicken (Gallus Gallus)
  misc_feature (36): n=a or g
ccagtcctttctgagtacccactggtaggctgtacnagatgcgctaaccaaagtttgtttatctccatcaa

SEQ ID NO: 12800 - DNA, 71 bp, chicken (Gallus Gallus)
  misc_feature (36): n=c or t
gaatttctatgcatacacgaagtccagaagaaaatnacatactctttgtgtgtaggcaccatgtagtacat

SEQ ID NO: 12801 - DNA, 71 bp, chicken (Gallus Gallus)
  misc_feature (36): n=a or g
gtcactggtcagacagccctaaaacagaaattttantcactagttttgactggaaaagtaaattttcaact

SEQ ID NO: 12802 - DNA, 71 bp, chicken (Gallus Gallus)
  misc_feature (36): n=a or g
agttcaaacacaggaggagcaattaagtaacaagcntggcaaatagtaaaaggttgctcaagaggtctctg

SEQ ID NO: 12803 - DNA, 71 bp, chicken (Gallus Gallus)
  misc_feature (36): n=c or g
atgaaattaaaggtcaataaattcattgtttacaanaaatgctttccaagatatggctcaattacctgatg

SEQ ID NO: 12804 - DNA, 71 bp, chicken (Gallus Gallus)
  misc_feature (36): n=a or g
ataatgttaaaaggacaatgtgcatgaagggagctngcatgaggttaccaaaacactttcccgtagtcctt

SEQ ID NO: 12805 - DNA, 71 bp, chicken (Gallus Gallus)
  misc_feature (36): n=g or t
cagagctgcagctcatcactccgttggatatccagngcttgatggaaaacttcaagcaatggagagctcat

SEQ ID NO: 12806 - DNA, 71 bp, chicken (Gallus Gallus)
  misc_feature (36): n=c or t
agctatctgctgagcttaattctttttctggggagnctcagtcttcacatttagaatctccatgtttgcac

SEQ ID NO: 12807 - DNA, 71 bp, chicken (Gallus Gallus)
  misc_feature (36): n=c or t
tttgtatccaatgtgcaaatcctatgtcctcacaanaagaaatgatctttgctgccatcctagtagcccag

SEQ ID NO: 12808 - DNA, 71 bp, chicken (Gallus Gallus)
  misc_feature (36): n=g or t
ttgccatttctagctgaacctattatcagccacaanggcacaaagctgccaaagatgtcccaggtgttaat

SEQ ID NO: 12809 - DNA, 71 bp, chicken (Gallus Gallus)
  misc_feature (36): n=a or g
gtctgagatgatgaggtcccaccgtttccagtctcntcctccctgtttagcgcagagccatgagaaatagc

SEQ ID NO: 12810 - DNA, 71 bp, chicken (Gallus Gallus)
  misc_feature (36): n=a or g
gaattatttgtgttttcactaaatatataatttaanaccccaaatccttccaatggaatatacaaatgaga

SEQ ID NO: 12811 - DNA, 71 bp, chicken (Gallus Gallus)
  misc_feature (36): n=c or t
tgaggataaggagtcagagctgtcacttcctggganttgagatctcacgctattctggttggacattacag

SEQ ID NO: 12812 - DNA, 71 bp, chicken (Gallus Gallus)
  misc_feature (36): n=a or g
ctgccggtgagagcagtaccttgtatgaaggtggcnatatcacatccagcagagggaaggttgtgttatac

SEQ ID NO: 12813 - DNA, 71 bp, chicken (Gallus Gallus)
  misc_feature (36): n=a or g
attttttaaatggaaaccaatatgaggtgggttgtntgagcagagtgaaccgctgcctgaaggaggcagat

SEQ ID NO: 12814 - DNA, 71 bp, chicken (Gallus Gallus)
  misc_feature (36): n=a or g
acgagcaagagtattttgtcccctcagcaggacacntatagcaaaaaggagcaagataaaaaaaatcatgt

SEQ ID NO: 12815 - DNA, 71 bp, chicken (Gallus Gallus)
  misc_feature (36): n=a or g
ttgcccgaaaggtgacttgcccagcacccagaaacntgatggccctgcagtatccagaaatgcaatagctt

SEQ ID NO: 12816 - DNA, 71 bp, chicken (Gallus Gallus)
  misc_feature (36): n=a or g
accaactgatgctgttctgcacgtttgcttgtcacntcccatcagcgccatggcagcatcacacaggatgt

SEQ ID NO: 12817 - DNA, 71 bp, chicken (Gallus Gallus)
  misc_feature (36): n=c or t
ttggcagaactgagagatgctccaaaaagatccctntcctggtcagtactgcagtatcctctcttgggggc

SEQ ID NO: 12818 - DNA, 71 bp, chicken (Gallus Gallus)
  misc_feature (36): n=c or t
catcaggggtcacatcagataacatctgtcttgcanatgagagccagcaccctgggtcaaagtaaaacatg

SEQ ID NO: 12819 - DNA, 71 bp, chicken (Gallus Gallus)
  misc_feature (36): n=a or g
cttccctttccccacccccctcttctctttctgaantgctaacgcatctggctgcctccaagcaaggacaa

SEQ ID NO: 12820 - DNA, 71 bp, chicken (Gallus Gallus)
  misc_feature (36): n=c or t
cctgaaatggttcctggtgaaggggaatgtgttttnttggagctcttttcttatgaaatgttacctttaac

SEQ ID NO: 12821 - DNA, 71 bp, chicken (Gallus Gallus)
  misc_feature (36): n=a or g
ggtagggctgcttcttcatatgtttttttctcttangtttgtacaaatgtatagaaatctatttggggaag

SEQ ID NO: 12822 - DNA, 71 bp, chicken (Gallus Gallus)
  misc_feature (36): n=a or g
ctcgccttaaccaaaggaaggacaaattcattcccngaggttgtggagaaaaggctggatgtggcactgag

SEQ ID NO: 12823 - DNA, 71 bp, chicken (Gallus Gallus)
  misc_feature (36): n=c or t
tgtgacaatcagatgatggaagtaaaggagttattngtttttgggcagtttgtgtctctaaatttacactt

SEQ ID NO: 12824 - DNA, 71 bp, chicken (Gallus Gallus)
  misc_feature (36): n=a or g
taccatcggaggcaccttccttgctgtagttcatcntgttcagtatgagcgggaattgggaagtgcagagg

SEQ ID NO: 12825 - DNA, 71 bp, chicken (Gallus Gallus)
  misc_feature (36): n=a or g
tgcctctgcctccttgcagcggtgatacctgaagcngagcagaagggttttcctttgtttactgtaaaatt

SEQ ID NO: 12826 - DNA, 71 bp, chicken (Gallus Gallus)
  misc_feature (36): n=c or t
actttggatcctacagaaggttattaaaagcaaagngtttgggggaaagagtttgggatgaatgaacggac

SEQ ID NO: 12827 - DNA, 71 bp, chicken (Gallus Gallus)
  misc_feature (36): n=g or t
ttcactgaaaaaactatttcttccttgttcattacnctggatgcttatgtccacgagacacgtgaaaaatg

SEQ ID NO: 12828 - DNA, 71 bp, chicken (Gallus Gallus)
  misc_feature (36): n=c or t
ctaagcctattatttcttatcctactcattgggaanccacagaagccttttattctctaactccctacacc

SEQ ID NO: 12829 - DNA, 71 bp, chicken (Gallus Gallus)
  misc_feature (36): n=c or t
aaggcagccaaaattttgacctcgcctgcacaaacngcataggtcgatgccactctcaataagtcaagcaa

SEQ ID NO: 12830 - DNA, 71 bp, chicken (Gallus Gallus)
  misc_feature (36): n=a or t
gtcaaatcatctgagatgaagtctgcattacactgntgtagttggaagaaggatagagcccttagctatat

SEQ ID NO: 12831 - DNA, 71 bp, chicken (Gallus Gallus)
  misc_feature (36): n=c or t
aaataaagttggttggccgcccttattaagcttcanttagctactgttaattatgaacctagattgagact

SEQ ID NO: 12832 - DNA, 71 bp, chicken (Gallus Gallus)
  misc_feature (36): n=a or t
gctgcactgcaaccagaaagtcattaccagcagacnatcagcccccagtgcatgcaagtttctgatgcttg

SEQ ID NO: 12833 - DNA, 71 bp, chicken (Gallus Gallus)
  misc_feature (36): n=a or g
tgcaacaaaacacaaaacaactaccaagatacaccngatacccatttctaccaaacagaagcacaaaggcc

SEQ ID NO: 12834 - DNA, 71 bp, chicken (Gallus Gallus)
  misc_feature (36): n=a or c
cagccctagttttaactgtgcccacttcctcacagncagatccttgctttgcgcctatttggaggcccagg

SEQ ID NO: 12835 - DNA, 71 bp, chicken (Gallus Gallus)
  misc_feature (36): n=c or t
cttcactaaaagttaacagtccctatgtgttcctangagccaaacctcagagctttttttcccagctgctg

SEQ ID NO: 12836 - DNA, 71 bp, chicken (Gallus Gallus)
  misc_feature (36): n=c or t
ggcaatagtattcatcttacctataaaaactatagngttttatgacagaaggaataaacctccctaagcag

SEQ ID NO: 12837 - DNA, 71 bp, chicken (Gallus Gallus)
  misc_feature (36): n=c or t
gtaaaagaaaaaaaaaaaaagatgtaataaatctangcattctttctaagcagccattgaaagtctgaatg

SEQ ID NO: 12838 - DNA, 71 bp, chicken (Gallus Gallus)
  misc_feature (36): n=a or g
gcattgcaactgtctgagctttttgcatgcgttaangagttgttttcttaacaacaaatcagcccagaaag

SEQ ID NO: 12839 - DNA, 71 bp, chicken (Gallus Gallus)
  misc_feature (36): n=c or t
cctctcattgggttctaagggctgacaggctgtccnactcctaaagagtgccatgaagcatcttgcctttc

SEQ ID NO: 12840 - DNA, 71 bp, chicken (Gallus Gallus)
  misc_feature (36): n=a or g
ttcaataacaaacagactaggtgagggagaagattntttcatctacaacactggcaaagatcagatagttt

SEQ ID NO: 12841 - DNA, 71 bp, chicken (Gallus Gallus)
  misc_feature (36): n=c or t
ttcacttccagaataatagaagataaacttgtaaanactgaatattttgagctttctaaagagagcaagaa

SEQ ID NO: 12842 - DNA, 71 bp, chicken (Gallus Gallus)
  misc_feature (36): n=c or g
gacctgaggataatcactgcctgcctttcactgttntaaaggaccaaaatgcaacttttcctatttttaaa

SEQ ID NO: 12843 - DNA, 71 bp, chicken (Gallus Gallus)
  misc_feature (36): n=g or t
gctggaaagaattaagcagcaagaaaattatctctnctctcagttctggcatcacagcagctcccagcaaa

SEQ ID NO: 12844 - DNA, 71 bp, chicken (Gallus Gallus)
  misc_feature (36): n=a or g
gacacaaccttcacccgagactgaaggtgaagaganggactcagactttccgttatcaggatttaatgtat

SEQ ID NO: 12845 - DNA, 71 bp, chicken (Gallus Gallus)
  misc_feature (36): n=c or t
agatggtatttttgcaagtggacattgttttttaantggtgatttttttcaaagcttggcatagcagaggc

SEQ ID NO: 12846 - DNA, 71 bp, chicken (Gallus Gallus)
  misc_feature (36): n=c or t
agctgactttgtcctcatgacagacacacttcaganaaaatgcctcaacacatagattattctgattcatt

SEQ ID NO: 12847 - DNA, 71 bp, chicken (Gallus Gallus)
  misc_feature (36): n=a or g
tatcatcatgttaggccccaatactctcatcctganagctctcctagtttgaaggaaagttctttcttcca

SEQ ID NO: 12848 - DNA, 71 bp, chicken (Gallus Gallus)
  misc_feature (36): n=a or g
tccttgttaaaaaatggcttttggctgagactagangaaaaaggtcgccactttgacatcgttgcaagtct

SEQ ID NO: 12849 - DNA, 71 bp, chicken (Gallus Gallus)
  misc_feature (36): n=c or g
gggatccgtattctcttgttcctcaaagactgcaanaaacgttctgtgcttccagccctctgctatctcat

SEQ ID NO: 12850 - DNA, 71 bp, chicken (Gallus Gallus)
  misc_feature (36): n=c or t
tttatgctccatagaagctctgttgctggccaacantgataacagacaaagggatacacgcatttttggtt

SEQ ID NO: 12851 - DNA, 71 bp, chicken (Gallus Gallus)
  misc_feature (36): n=a or t
atgccagcattaaagtaggagctgtgcttaatcttnaatgtttgtacattacttgacctaaaatataactt

SEQ ID NO: 12852 - DNA, 71 bp, chicken (Gallus Gallus)
  misc_feature (36): n=a or g
tcaacaaggctgctccctcactcagttcaccactcnaaccaccggaggtttaccaagttctccctgcattg

SEQ ID NO: 12853 - DNA, 71 bp, chicken (Gallus Gallus)
  misc_feature (36): n=c or t
cacagacctagtaataaaagtcattccatctcttanatttacacagcgtatgcatcttctattccaaagaa

SEQ ID NO: 12854 - DNA, 71 bp, chicken (Gallus Gallus)
  misc_feature (36): n=a or g
gatctctgcaaggaagacccatgagcttaatgtacntttggataacaacagcaactctgagctctttgaaa

SEQ ID NO: 12855 - DNA, 71 bp, chicken (Gallus Gallus)
  misc_feature (36): n=a or g
ccaccttctgttcaccttgcaattgctcatacttcnaaagatattcacagtggttcaacagattcccacaa

SEQ ID NO: 12856 - DNA, 71 bp, chicken (Gallus Gallus)
  misc_feature (36): n=c or t
tatatggcatagatgttgcagtaaggattgctgggnaagtagtgaagtgatgcagtggaaacacaaagctg

SEQ ID NO: 12857 - DNA, 71 bp, chicken (Gallus Gallus)
  misc_feature (36): n=a or t
ttgacaaagcaacaacactacaggaaaaaaaaaaancagtccctgagttgcaccaaatattcacctgcaca

SEQ ID NO: 12858 - DNA, 71 bp, chicken (Gallus Gallus)
  misc_feature (36): n=c or g
ggccaaggtcttatcaacagaaacgtacaccatcancgtgttcctgtcagggcaggtgcagtcagtgcagg

SEQ ID NO: 12859 - DNA, 71 bp, chicken (Gallus Gallus)
  misc_feature (36): n=a or t
tcctaaagataaggtacaagcaaataacacaggagncttgggtcccatgagaacgtgctccctgatcagca

SEQ ID NO: 12860 - DNA, 71 bp, chicken (Gallus Gallus)
  misc_feature (36): n=c or g
tggtggggatttctgcttcccatcgcagtacacggnatgggcagtggaacaaagacgaactatacatctct

SEQ ID NO: 12861 - DNA, 71 bp, chicken (Gallus Gallus)
  misc_feature (36): n=c or t
gctctttcacgcttgggaactgtgactgtagcctcngcatcaaagataacttcataatagccttttagtgg

SEQ ID NO: 12862 - DNA, 71 bp, chicken (Gallus Gallus)
  misc_feature (36): n=c or t
ttctgttttgtactgaattcaatttcctgggactcngctttagcaaccagcattttgatcaaagttaattg

SEQ ID NO: 12863 - DNA, 71 bp, chicken (Gallus Gallus)
  misc_feature (36): n=a or g
tttttttttttcctttaacgtactgggatttgattntgcatgcacatggatgggcttaattgaaggaagag

SEQ ID NO: 12864 - DNA, 71 bp, chicken (Gallus Gallus)
  misc_feature (36): n=c or t
tcattgtgctcctttttgccacctcgaaacacggangggacccccgtggtcgggtcgtgtgcacggacccg

SEQ ID NO: 12865 - DNA, 71 bp, chicken (Gallus Gallus)
  misc_feature (36): n=c or t
tggtccactgatggtgtgtggttgttccaagaagtnagtggcagtgagccattccctaggcaggtgcaagt

SEQ ID NO: 12866 - DNA, 71 bp, chicken (Gallus Gallus)
  misc_feature (36): n=a or g
ttgtgctacagctgcctgtgtgaggagttttggcanttctgcaatgaatgctgctctgagatgcctggctt

SEQ ID NO: 12867 - DNA, 71 bp, chicken (Gallus Gallus)
  misc_feature (36): n=c or g
gcaaatgagagcattgctcgttcctggggctatgangtgggatctgactcctcagcagctgtaatagtaag

SEQ ID NO: 12868 - DNA, 71 bp, chicken (Gallus Gallus)
  misc_feature (36): n=a or g
tcacctcttagaatgatctttccagttggcaggacntgctcagcaggttccaaactcagccacaggcagtt

SEQ ID NO: 12869 - DNA, 71 bp, chicken (Gallus Gallus)
  misc_feature (36): n=a or g
tccttgaaatcgatgatcctccccctggtcttagcnttcgcgttgatcatctccatgacctgcatcacgat

SEQ ID NO: 12870 - DNA, 71 bp, chicken (Gallus Gallus)
  misc_feature (36): n=a or g
acaacccaatggaaagcagtgtggtgcattgctggnatgcaaagaaccggacactgagcacttaggactgc

SEQ ID NO: 12871 - DNA, 71 bp, chicken (Gallus Gallus)
  misc_feature (36): n=a or c
aacattaagaaaagccttgaaagcacatcagtacancagcacggttggctataagcagtgcctagagcaac

SEQ ID NO: 12872 - DNA, 71 bp, chicken (Gallus Gallus)
  misc_feature (36): n=a or g
tcttcttattttgtgcttgagaaaaattctgagganaagtgggcaagtaaggcttaaaaaagtgcagaagt

SEQ ID NO: 12873 - DNA, 71 bp, chicken (Gallus Gallus)
  misc_feature (36): n=a or g
ccacatcctgctcccaccgtcagcactgcagggagnagacatgatgaaatgcagtttcacaaagtctggtt

SEQ ID NO: 12874 - DNA, 71 bp, chicken (Gallus Gallus)
  misc_feature (36): n=a or g
aactggatcttgctgaaggtctgctgcaagtacgcntgcctcctgacagggacggtcatcttcttgccctt

SEQ ID NO: 12875 - DNA, 71 bp, chicken (Gallus Gallus)
  misc_feature (36): n=c or t
agggatgtgcctgtgtgcttgggattggttctaggngtggctcgagtgatagtctccgaaatcagggttca

SEQ ID NO: 12876 - DNA, 71 bp, chicken (Gallus Gallus)
  misc_feature (36): n=g or t
tcctaactcctcagggattagctaatacagaaaacngagttattttcaatgggcagcttcacttctcccat

SEQ ID NO: 12877 - DNA, 71 bp, chicken (Gallus Gallus)
  misc_feature (36): n=c or t
aaaggacaagaaaaaagcccaggtgctgtgctatgnccatggggagcactgggaagctcccagcccctgca

SEQ ID NO: 12878 - DNA, 71 bp, chicken (Gallus Gallus)
  misc_feature (36): n=c or t
atgtgtgtgtttgaggggtcaatcagaaaaggaagntgctgaagagtatccctgtgcccaatatactgcac

SEQ ID NO: 12879 - DNA, 71 bp, chicken (Gallus Gallus)
  misc_feature (36): n=a or g
tgccagctctgcaaatgtgcaggaaatgatcatttntagcactgggttctcagtgtgtttatgcttaaaaa

SEQ ID NO: 12880 - DNA, 71 bp, chicken (Gallus Gallus)
  misc_feature (36): n=c or t
gtttcccctattcccaatgcacggccatcagttggngatggaggtgtgctgcaactgattgtctcccaccg

SEQ ID NO: 12881 - DNA, 71 bp, chicken (Gallus Gallus)
  misc_feature (36): n=c or t
aaaccaacctgtctgtcactggaaatctttcaacancttcccaagagaaagctgacaaatcctttccaaac

SEQ ID NO: 12882 - DNA, 71 bp, chicken (Gallus Gallus)
  misc_feature (36): n=a or g
tgggctatgaggtccctcccaacccagccattctgnttcttactgcaggtggtggccacatacccaatgct

SEQ ID NO: 12883 - DNA, 71 bp, chicken (Gallus Gallus)
  misc_feature (36): n=a or g
ctgcaccataaggaacaaacaggagaagccagtccncagactgcccagcctctggtccatgggctgcacag

SEQ ID NO: 12884 - DNA, 71 bp, chicken (Gallus Gallus)
  misc_feature (36): n=a or g
aaatttgcctccactgttagagaacataaacacacntgagttaaaatgaccaagaaaaaaaactaagaata

SEQ ID NO: 12885 - DNA, 71 bp, chicken (Gallus Gallus)
  misc_feature (36): n=a or g
ttgtcacaagatcaaaatgcccaaatcctgtttctntgtattaaccgcagctgtgtcagagacacaattct

SEQ ID NO: 12886 - DNA, 71 bp, chicken (Gallus Gallus)
  misc_feature (36): n=a or t
agtagcagatactatgcagaaagatgacacaacccngtattgctgagccaagtaaattatgggtttctcac

SEQ ID NO: 12887 - DNA, 71 bp, chicken (Gallus Gallus)
  misc_feature (36): n=a or t
tgatcaaatgcatttaaactggcttagctggaaatnacccctgctgctgctcatgtacatggcaatctgtg

SEQ ID NO: 12888 - DNA, 71 bp, chicken (Gallus Gallus)
  misc_feature (36): n=g or t
gtgaacaaattagagcgaggatctcaatcactttcnattaattaaccttccttttattgcagtcacagaat

SEQ ID NO: 12889 - DNA, 71 bp, chicken (Gallus Gallus)
  misc_feature (36): n=c or t
gacctgcatacagcagataaagtcagtctggagaangtggaattctgtttcaaagcacttaaaacagaatt

SEQ ID NO: 12890 - DNA, 71 bp, chicken (Gallus Gallus)
  misc_feature (36): n=a or g
ttccagtcaggtgggaaggaaaatgaattgcttgcngctgtgcttcctgggccagccacccccttcaccag

SEQ ID NO: 12891 - DNA, 71 bp, chicken (Gallus Gallus)
  misc_feature (36): n=c or t
ctttagacgctggctgtcacagccaaaagctagganaatatggaagtctaaaaggtaatactgccctgaaa

SEQ ID NO: 12892 - DNA, 71 bp, chicken (Gallus Gallus)
  misc_feature (36): n=c or t
gccattggtgttcgttggtgagaaagcagttaacangaagatttgctgtgttgctgcgtgctggggtatca

SEQ ID NO: 12893 - DNA, 71 bp, chicken (Gallus Gallus)
  misc_feature (36): n=c or t
ttgaaaagatgaaaagaaaaaccacgctcagcttcnctctagcaccaaaaaggaaaggaaaggaagttctt

SEQ ID NO: 12894 - DNA, 71 bp, chicken (Gallus Gallus)
  misc_feature (36): n=c or t
atagacaccaattcaacctgggaaggggatgagagnaaatatcaactctgctttcccaacccatggtttgt

SEQ ID NO: 12895 - DNA, 71 bp, chicken (Gallus Gallus)
  misc_feature (36): n=c or t
ctccggggctgaggttcccatgtcccttccggaggnaccataaatactgcagtgagctttgagtaaatttc

SEQ ID NO: 12896 - DNA, 71 bp, chicken (Gallus Gallus)
  misc_feature (36): n=c or g
atatatgttgtctttcttgaatattcagatgaatcnaatgcataacttttaacagaaagggcagttcggga

SEQ ID NO: 12897 - DNA, 71 bp, chicken (Gallus Gallus)
  misc_feature (36): n=a or g
atgctgtaaacaaagcagacccagtttggttcagcntgtaggtaattctattcactgttttgacgctaaat

SEQ ID NO: 12898 - DNA, 71 bp, chicken (Gallus Gallus)
  misc_feature (36): n=c or t
tacagacccaaacatgtccatgtgagttgtccatanatctgttacctggtatcaggatgccacaggtttgc

SEQ ID NO: 12899 - DNA, 71 bp, chicken (Gallus Gallus)
  misc_feature (36): n=c or t
ggtgatgtttttccatggcgacttgtgctgggggangctggtgggggcctggcgctgggctcagcgcctcc

SEQ ID NO: 12900 - DNA, 71 bp, chicken (Gallus Gallus)
  misc_feature (36): n=c or t
ttctatccatcccatggaacatggacagatattcangattctctgtggagtaacaggatcgtgtgagctgg

SEQ ID NO: 12901 - DNA, 71 bp, chicken (Gallus Gallus)
  misc_feature (36): n=a or g
tacgttctgttactgggatagcagtctctgtaggtncttttctttctaggaaacagcttttgctgacaacg

SEQ ID NO: 12902 - DNA, 71 bp, chicken (Gallus Gallus)
  misc_feature (36): n=a or g
gatgagttgagatttacacctgatgcaaacaacagntatcaaaggatacatttccaaaggcaccctggcca

SEQ ID NO: 12903 - DNA, 71 bp, chicken (Gallus Gallus)
  misc_feature (36): n=a or g
agatggcaatgaagctttaatatatgcttaaagtgnaatacctgtcccaggactttgctgccccacagtct

SEQ ID NO: 12904 - DNA, 71 bp, chicken (Gallus Gallus)
  misc_feature (36): n=a or g
aggtctgtgtctgctaatccacatcccatcgtacanccagcacagatgtgcaggtctccaaaggttacgga

SEQ ID NO: 12905 - DNA, 71 bp, chicken (Gallus Gallus)
  misc_feature (36): n=c or t
accttcccggttctgctaatgagtaatgaagatgangctctaattaaggcgctgctgagcgtctccttact

SEQ ID NO: 12906 - DNA, 71 bp, chicken (Gallus Gallus)
  misc_feature (36): n=a or c
agacagctataagtttgcagccccatgtcactaaancttacttattatcattattagaaataccagctact

SEQ ID NO: 12907 - DNA, 71 bp, chicken (Gallus Gallus)
  misc_feature (36): n=c or g
tgttaccgtgatacattttgagtcattattacattnttaaagaaacatttattatagtgaagttttcattc

SEQ ID NO: 12908 - DNA, 71 bp, chicken (Gallus Gallus)
  misc_feature (36): n=a or t
tgtcttcctttttccttatgacttccatgctcctantgtggtgctggagaatgtattaaacctagagcttt

SEQ ID NO: 12909 - DNA, 71 bp, chicken (Gallus Gallus)
  misc_feature (36): n=c or t
tttcttgggcccagccaccttggctggctgttggcntggtgtcagtgaagataacaaagaaggaaagggct

SEQ ID NO: 12910 - DNA, 71 bp, chicken (Gallus Gallus)
  misc_feature (36): n=c or t
agtcgtttacttgcttgaattggacaccaaaactcnggatttcaatggaagaccactatgagtcctttgct

SEQ ID NO: 12911 - DNA, 71 bp, chicken (Gallus Gallus)
  misc_feature (36): n=a or g
gggcgttaccaactcactgatttcgaaccttctgcnaagttattttatatctgtttccttttagccaaatg

SEQ ID NO: 12912 - DNA, 71 bp, chicken (Gallus Gallus)
  misc_feature (36): n=c or g
tcatagggaatgctccatacatcaggtatttagagntaggtgtaatcaggcctaggtgtggaatttttcac

SEQ ID NO: 12913 - DNA, 71 bp, chicken (Gallus Gallus)
  misc_feature (36): n=c or t
tttttttaatgagcatttccattctgtataagcaangttgaatgtttgtttctctcagctctcacaccatc

SEQ ID NO: 12914 - DNA, 71 bp, chicken (Gallus Gallus)
  misc_feature (36): n=c or t
ttggctttagaagatgccacagaaaaagaaaccacncacaagtttataacaacactgactttttagaaact

SEQ ID NO: 12915 - DNA, 71 bp, chicken (Gallus Gallus)
  misc_feature (36): n=g or t
atatgggatatatactgaagccagaagaaataggtntaagtaacagctccagaaagaattacagaatatcc

SEQ ID NO: 12916 - DNA, 71 bp, chicken (Gallus Gallus)
  misc_feature (36): n=a or g
atagagcagctcccaggcagctgctgcaacccatgnaggctgctggtaaatacggacgtgtcgtttaacca

SEQ ID NO: 12917 - DNA, 71 bp, chicken (Gallus Gallus)
  misc_feature (36): n=c or t
atcccaaacacatggattgtcacagccatgggaatnttgctgacaagcagacacagcctggattttatgtt

SEQ ID NO: 12918 - DNA, 71 bp, chicken (Gallus Gallus)
  misc_feature (36): n=a or g
ccgcacacgtcgcttcacaaagtctggcttgtcctntcccagaggcaggaccaccactcactttggaacca

SEQ ID NO: 12919 - DNA, 71 bp, chicken (Gallus Gallus)
  misc_feature (36): n=c or t
ttcacctcttcctgtgcatgcagccgattccacttntgtgacatattgttcatctgttacagcaacattaa

SEQ ID NO: 12920 - DNA, 71 bp, chicken (Gallus Gallus)
  misc_feature (36): n=c or t
atgggggaagagatgggaaaggagagagaaatgagnacactgcagctcatgccattcccaccgccgtgtgc

SEQ ID NO: 12921 - DNA, 71 bp, chicken (Gallus Gallus)
  misc_feature (36): n=a or g
tcacggttctgcttgcagtgcgccaggatctgcagnctgtattggtggttccgcacaaactcctggtagat

SEQ ID NO: 12922 - DNA, 71 bp, chicken (Gallus Gallus)
  misc_feature (36): n=c or t
cattagaacagaaaggaaacaaaacaattctcctanattgacgtaatgacattcaccaacttactttgctt

SEQ ID NO: 12923 - DNA, 71 bp, chicken (Gallus Gallus)
  misc_feature (36): n=a or g
tctctgatgatgtgggaaatctgtccagggaggaancaaaaccattggtcacagtgcagccaccactggtg

SEQ ID NO: 12924 - DNA, 71 bp, chicken (Gallus Gallus)
  misc_feature (36): n=c or g
gcattgcatgcatgcaggtcttttcatgaagaccangctgttgcatgtgtgcagctcactgcatgcagtcc

SEQ ID NO: 12925 - DNA, 71 bp, chicken (Gallus Gallus)
  misc_feature (36): n=a or g
cccacagacccggaggagtctcatcaccattccacntagtttaaataaataccagttcccattttgagccc

SEQ ID NO: 12926 - DNA, 71 bp, chicken (Gallus Gallus)
  misc_feature (36): n=c or g
ggaattattttgttccagttgccttaaaaaaatctntaagaacttactctccatcttcctcatacttctgc

SEQ ID NO: 12927 - DNA, 71 bp, chicken (Gallus Gallus)
  misc_feature (36): n=c or t
aatactatttttctccagaaaatatggcagtttctnccacataatagaacttttcccctgaaaatatcaat

SEQ ID NO: 12928 - DNA, 71 bp, chicken (Gallus Gallus)
  misc_feature (36): n=a or c
ttgtctcctttagacttgtcttgtatgccggtacanaaacaacctggaaatattgtgtgttcatgcacaca

SEQ ID NO: 12929 - DNA, 71 bp, chicken (Gallus Gallus)
  misc_feature (36): n=c or t
gataaagtgtaaagatctaagaaacatccgggaganccaagcctgtgagatcagaagccaggcccaacatg

SEQ ID NO: 12930 - DNA, 71 bp, chicken (Gallus Gallus)
  misc_feature (36): n=a or g
cagttcttgagggcaacaagggtgcaggaagaattnctggggtggggcagcggggtgcagggctcttacag

SEQ ID NO: 12931 - DNA, 71 bp, chicken (Gallus Gallus)
  misc_feature (36): n=a or g
aaaaaaaaaaatttggaagctgaatagcaatcttcngtgccatggggttcaaaacagaggaaccgagatcc

SEQ ID NO: 12932 - DNA, 71 bp, chicken (Gallus Gallus)
  misc_feature (36): n=a or g
tctccaggaaaccttttctggcatctcaccaccttntgtgtaaataatttcttcctactatctagtgtttg

SEQ ID NO: 12933 - DNA, 71 bp, chicken (Gallus Gallus)
  misc_feature (36): n=c or t
ctggagaagaagtgcgtgaaggcaacttgtggctgngataggatgagcacttgcatggtcagttaggatct

SEQ ID NO: 12934 - DNA, 71 bp, chicken (Gallus Gallus)
  misc_feature (36): n=g or t
tctacaaactcctccttgacgtcagcatcaaatgtnagataggccaggccctccacagcccagcgccgcgt

SEQ ID NO: 12935 - DNA, 71 bp, chicken (Gallus Gallus)
  misc_feature (36): n=a or g
tcacaacagaaattaccagtgttgcaactgacactncagatagtaactgaaaacactccgagccactgcca

SEQ ID NO: 12936 - DNA, 71 bp, chicken (Gallus Gallus)
  misc_feature (36): n=g or t
aggaggggctggtgtgtggccaagtaccaaacatcnaaacacagaatcgttaaggttggaaaagacctctc

SEQ ID NO: 12937 - DNA, 71 bp, chicken (Gallus Gallus)
  misc_feature (36): n=c or t
ggacctgccacgtgtctgcaacaattgagcaacaangcagatgccattagaaaaccagcactggccaactg

SEQ ID NO: 12938 - DNA, 71 bp, chicken (Gallus Gallus)
  misc_feature (36): n=c or t
ttagcaaaacttctgtgatgaagggccccgcttttngctgctttgcatatggctttgaccaggctggatgc

SEQ ID NO: 12939 - DNA, 71 bp, chicken (Gallus Gallus)
  misc_feature (36): n=a or t
ggagaagaagtcagtacaagaatccagatatactcnctgttattcaaggagatgatggaaatgtgcagcag

SEQ ID NO: 12940 - DNA, 71 bp, chicken (Gallus Gallus)
  misc_feature (36): n=c or t
agggaaagcctttattgccaagacttttcagaatcnttcaggatcagctagttacatttgttccaaattca

SEQ ID NO: 12941 - DNA, 71 bp, chicken (Gallus Gallus)
  misc_feature (36): n=a or g
atgtgtccacacagatatcttcctcctgcatgacancaaattgctagaaagattttggcttaccaatacat

SEQ ID NO: 12942 - DNA, 71 bp, chicken (Gallus Gallus)
  misc_feature (36): n=a or t
gcccacaccaataccactgcctctttcaataccagntgcttttcctgcctttgaacccaacaaacaggtga

SEQ ID NO: 12943 - DNA, 71 bp, chicken (Gallus Gallus)
  misc_feature (36): n=a or g
aatacacacacataacattaaagtaagtctttgtgntattaggctactttaaaattaactactgttgcaca

SEQ ID NO: 12944 - DNA, 71 bp, chicken (Gallus Gallus)
  misc_feature (36): n=c or t
ttttgaaggatactatttaggacatcttgtaaagcnggcagcatcctaaactgatacagccatagctatca

SEQ ID NO: 12945 - DNA, 71 bp, chicken (Gallus Gallus)
  misc_feature (36): n=c or t
cacatgggtcccccagctcacgctgaccccagccanaccttgcccatgcagcgtgtagatctcagtgtaga

SEQ ID NO: 12946 - DNA, 71 bp, chicken (Gallus Gallus)
  misc_feature (36): n=c or t
ttgtattgccctgtccctgtctgatgacttcagccngtgcttttgcctctgagtgctaaaataagaaatgc

SEQ ID NO: 12947 - DNA, 71 bp, chicken (Gallus Gallus)
  misc_feature (36): n=c or g
cagcacctgtgagtaggtatgtccagcgggtagtgntcatacaggaaccaggtcttacccaaaatagcact

SEQ ID NO: 12948 - DNA, 71 bp, chicken (Gallus Gallus)
  misc_feature (36): n=a or c
tatccaacagtgaatttcatgttcctatttaaggtnccagttcccatcctaccaccgaacacctgccaact

SEQ ID NO: 12949 - DNA, 71 bp, chicken (Gallus Gallus)
  misc_feature (36): n=c or t
aaggagaatgatgccattgatatagccatcaaaaangtgacagccttcttcagagggaccctgacttatgg

SEQ ID NO: 12950 - DNA, 71 bp, chicken (Gallus Gallus)
  misc_feature (36): n=a or g
tgtgtacactggaacacttggaaacaatggacctcnggtatgaccaagagtacttatcctgtcattttctc

SEQ ID NO: 12951 - DNA, 71 bp, chicken (Gallus Gallus)
  misc_feature (36): n=a or g
gcggtggaggctttcccacagctatttcagcacatngctgctctctggggggcgagaggcagccaggctgt

SEQ ID NO: 12952 - DNA, 71 bp, chicken (Gallus Gallus)
  misc_feature (36): n=a or g
ggcaaaccgtgctcatgctgttgagcaaacttgacnaaagtaataaaaacaataaggaagccaaggagatc

SEQ ID NO: 12953 - DNA, 71 bp, chicken (Gallus Gallus)
  misc_feature (36): n=c or t
gtgatcagcaggattttcactttctatcctgactangctcaaggatgctgagtttttgttcgtgcatcagc

SEQ ID NO: 12954 - DNA, 71 bp, chicken (Gallus Gallus)
  misc_feature (36): n=a or t
tgtctggggtgaaaattgttcacgtgctgatgcccnaggcccacacattgttttcctgaactttaaaccct

SEQ ID NO: 12955 - DNA, 71 bp, chicken (Gallus Gallus)
  misc_feature (36): n=c or t
ccagatctgaaagggagttttgatctgacctacaangcctgctttaacacgagcccacaagtgcctcacag

SEQ ID NO: 12956 - DNA, 71 bp, chicken (Gallus Gallus)
  misc_feature (36): n=a or g
tgatgatgacgatgatgatgattactattaaagganggggataagggaaagcagagcacaaactccctttt

SEQ ID NO: 12957 - DNA, 71 bp, chicken (Gallus Gallus)
  misc_feature (36): n=a or g
ctgtgccctcaggctgtccgctaaggtacctcatcntaaaaaccatggagctcttcttacgggtagaagaa

SEQ ID NO: 12958 - DNA, 71 bp, chicken (Gallus Gallus)
  misc_feature (36): n=c or g
tggggaagaggatgaagtaaaaaatagttgaaaaantatttactgctttacatttttctttgtggcgctct

SEQ ID NO: 12959 - DNA, 71 bp, chicken (Gallus Gallus)
  misc_feature (36): n=c or g
gggcaaaagtgactttgcttttttaattacaaactngttttctggtgatgcctgaccccctaaatcgagag

SEQ ID NO: 12960 - DNA, 71 bp, chicken (Gallus Gallus)
  misc_feature (36): n=c or t
gcaatgactgtgggcagagatagctcacagaatcanttaggttggaaaagaccactaagatcaccatatct

SEQ ID NO: 12961 - DNA, 71 bp, chicken (Gallus Gallus)
  misc_feature (36): n=c or t
atagaaccatctaggttggaaggggccatcaagatnacaagcccaaccatccatccagcaacccaatctgc

SEQ ID NO: 12962 - DNA, 71 bp, chicken (Gallus Gallus)
  misc_feature (36): n=c or t
tgcagcacgactcccagggctctcccctctcctcanctcagtttgggtattgggaaaagtttcttcttgga

SEQ ID NO: 12963 - DNA, 71 bp, chicken (Gallus Gallus)
  misc_feature (36): n=a or g
tgaagggatgtgaacatgaaggacaggagcagtganagagcagaaagatggagctgtgagctgctgatcct

SEQ ID NO: 12964 - DNA, 71 bp, chicken (Gallus Gallus)
  misc_feature (36): n=g or t
agttctgaagtagagaaagcagtcaaaaccagttgnccctctttctctaaaggtctcctagctcctatgtc

SEQ ID NO: 12965 - DNA, 71 bp, chicken (Gallus Gallus)
  misc_feature (36): n=a or g
gtcacagtgggctgaggcctgcacagagcactggcntgcaactgatccactcaatttagcaaggcagattg

SEQ ID NO: 12966 - DNA, 71 bp, chicken (Gallus Gallus)
  misc_feature (36): n=c or g
gctgttgtcgtcttgagtcatgccttctggtgtcgntatcaagtctctatagccttaggtggaacctcgga

SEQ ID NO: 12967 - DNA, 71 bp, chicken (Gallus Gallus)
  misc_feature (36): n=a or g
cacagctgcaggcagagggctcgatgtctcagctcntaatttattccttgcagaggtttagctgtgagaag

SEQ ID NO: 12968 - DNA, 71 bp, chicken (Gallus Gallus)
  misc_feature (36): n=a or g
agccgacatctcctttctttcagtgtactcattcanctgtcctgactgagacagaaaaacacaagagactc

SEQ ID NO: 12969 - DNA, 71 bp, chicken (Gallus Gallus)
  misc_feature (36): n=a or g
ttccaggctgggaagggtgctgggggtttcatgccncttgagagcctcagataggcatcttgtccacagca

SEQ ID NO: 12970 - DNA, 71 bp, chicken (Gallus Gallus)
  misc_feature (36): n=a or g
ttccccaacttaggcctccctattccccacaccccnttttcccccaaatcaccgctgttgccttgctgctt

SEQ ID NO: 12971 - DNA, 71 bp, chicken (Gallus Gallus)
  misc_feature (36): n=g or t
ggctaaatgctgagttagaagcatgcagtctttttnatttcctgctttgttgtcacgtatacacaagtaaa

SEQ ID NO: 12972 - DNA, 71 bp, chicken (Gallus Gallus)
  misc_feature (36): n=a or g
ggtggaacattggccaaactcatgcaaactacatcngccgacatctcctttctttcagtgtactcattcaa

SEQ ID NO: 12973 - DNA, 71 bp, chicken (Gallus Gallus)
  misc_feature (36): n=c or t
caatggattcacttcacttcactttcttgcagctcnactgaatctgcaacaggtatttgtacagccaaaat

SEQ ID NO: 12974 - DNA, 71 bp, chicken (Gallus Gallus)
  misc_feature (36): n=g or t
cagcaagtctctcctgacacaatggtggttattatnaacagtgtctgtacacagaactctatttgatatgt

SEQ ID NO: 12975 - DNA, 71 bp, chicken (Gallus Gallus)
  misc_feature (36): n=a or g
atgaaagtcagactcaagctaggttatggtaattcngtaatcacagcaacttgtgcccttccacactggtg

SEQ ID NO: 12976 - DNA, 71 bp, chicken (Gallus Gallus)
  misc_feature (36): n=a or g
atcatacgttcatttttataggaaaataaactgtancagctatgttgctggtctagacagtatgcacttgt

SEQ ID NO: 12977 - DNA, 71 bp, chicken (Gallus Gallus)
  misc_feature (36): n=c or t
tgtacagtgaaagtagcatgccattacagcacatgnacatgtatttcagacagtttctaaaaactggcaac

SEQ ID NO: 12978 - DNA, 71 bp, chicken (Gallus Gallus)
  misc_feature (36): n=a or g
aaaaaaaaagttattttaatagtgtttgcagtaacngtagtgcaaactctgtgctactggacatagagaac

SEQ ID NO: 12979 - DNA, 71 bp, chicken (Gallus Gallus)
  misc_feature (36): n=a or g
cctacttctcttgaccacctccttcaatgcatttcnagcagaataaaatgctattacagaggtcttaacag

SEQ ID NO: 12980 - DNA, 71 bp, chicken (Gallus Gallus)
  misc_feature (36): n=c or t
ccttgtcttatctttatgcagagcagtgaccgaccnacaaaacaaaagctgaaaggtttcatatgaaatgc

SEQ ID NO: 12981 - DNA, 71 bp, chicken (Gallus Gallus)
  misc_feature (36): n=c or t
tttttgccatgtctgagtatttgcagacttattttnattctccattgaatcacagaatcatagaatggctt

SEQ ID NO: 12982 - DNA, 71 bp, chicken (Gallus Gallus)
  misc_feature (36): n=a or g
aagtgagcccttgaatcaagaagaaaatggtgcatntttacgaaccaaaactcatctgcaattcaagtatt

SEQ ID NO: 12983 - DNA, 71 bp, chicken (Gallus Gallus)
  misc_feature (36): n=c or t
ttttgacacctcaaaaagtattatttagctcactcngattaaattgtattaggtagccatattttattttt

SEQ ID NO: 12984 - DNA, 71 bp, chicken (Gallus Gallus)
  misc_feature (36): n=g or t
tgtcccaaaacgagacttctggtgactgcagggctnctagctgctgcaggtgctctccattcacatctccc

SEQ ID NO: 12985 - DNA, 71 bp, chicken (Gallus Gallus)
  misc_feature (36): n=c or t
acagtgcgtgacagcaaacactgatgatgtggcttnataacttgtcccaccggagctgtaccgttaattcc

SEQ ID NO: 12986 - DNA, 71 bp, chicken (Gallus Gallus)
  misc_feature (36): n=a or g
ctactgtatcaatacaaaaaaagtcactgcaatccntaaagctgccttgcacaaagattgctcgtgtacaa

SEQ ID NO: 12987 - DNA, 71 bp, chicken (Gallus Gallus)
  misc_feature (36): n=a or c
tttttcctaatcctttccttgccaaaaaatacatanccctcacctctcacctcatccttagtccatctaga

SEQ ID NO: 12988 - DNA, 71 bp, chicken (Gallus Gallus)
  misc_feature (36): n=c or t
gggcagcccgggcagaaaggttcctcttccctcatnttctcacggcctttccactgtctgttgctggttca

SEQ ID NO: 12989 - DNA, 71 bp, chicken (Gallus Gallus)
  misc_feature (36): n=g or t
gtgggtgctggcatgaagcaagaagagatgagaggnctcagatataaagaaagaataaaacaatagttttc

SEQ ID NO: 12990 - DNA, 71 bp, chicken (Gallus Gallus)
  misc_feature (36): n=a or g
aggctctctcatatcaaagtctagcccagtgcagcnatcatctttatgtcttaagttcagtggaaatatta

SEQ ID NO: 12991 - DNA, 71 bp, chicken (Gallus Gallus)
  misc_feature (36): n=a or g
caacgtaaagctatttaatttgatgttcagtccaancaggtagtgcacagagccccacgttcgcctgtaac

SEQ ID NO: 12992 - DNA, 71 bp, chicken (Gallus Gallus)
  misc_feature (36): n=a or g
cactgggattaacttcagagaaggcaagagatacancctcctttgtcagcagctgtgctggttaaaaagga

SEQ ID NO: 12993 - DNA, 71 bp, chicken (Gallus Gallus)
  misc_feature (36): n=c or t
gaggccatttgatgttgtagaggcaggagcagaganggtagggctttgttaattttgctctgaaaatcttc

SEQ ID NO: 12994 - DNA, 71 bp, chicken (Gallus Gallus)
  misc_feature (36): n=c or t
aaaaacatcctgtgtaggatattccctgttagcacnagcaatgcttgtgcatttttcataagcaagattaa

SEQ ID NO: 12995 - DNA, 71 bp, chicken (Gallus Gallus)
  misc_feature (36): n=c or t
gagggaaacatggaagttgtgaaatggcagtggggnagaagtgacagatgcaggatcctgcaggttaatta

SEQ ID NO: 12996 - DNA, 71 bp, chicken (Gallus Gallus)
  misc_feature (36): n=a or c
ccaggttgttctccatttgagtaacaacagaaaaanacccccctgcatctacctttatgaaagatgttttc

SEQ ID NO: 12997 - DNA, 71 bp, chicken (Gallus Gallus)
  misc_feature (36): n=a or g
tgagctgaaacaggattacaatgcaaattggtttgncctacgtacgtaattttactatcttcacaggactc

SEQ ID NO: 12998 - DNA, 71 bp, chicken (Gallus Gallus)
  misc_feature (36): n=a or g
agaatggcatggatttcattcttcttaatatggacntaaaggtgcagaaggggacacagaagaaaagagcc

SEQ ID NO: 12999 - DNA, 71 bp, chicken (Gallus Gallus)
  misc_feature (36): n=c or t
tttaggaggtgggaaggaggaggcagctgagaacangacatttctgcagctattgaagttcatatagagct

SEQ ID NO: 13000 - DNA, 71 bp, chicken (Gallus Gallus)
  misc_feature (36): n=g or t
ctaaaaacaagccttctttaaagccctctttccctngagaacaccaaacacacttatgtgaccacaacttc

SEQ ID NO: 13001 - DNA, 71 bp, chicken (Gallus Gallus)
  misc_feature (36): n=c or t
tgaaagcaaacatgagcatcctgggagtcatgcatngctatggagcagttcagcaaagaactaaacttagt

SEQ ID NO: 13002 - DNA, 71 bp, chicken (Gallus Gallus)
  misc_feature (36): n=c or t
gccccacagcttcttcttcctaacactttacattanatagaaaaaacccggaaacatataaacagaagcag

SEQ ID NO: 13003 - DNA, 71 bp, chicken (Gallus Gallus)
  misc_feature (36): n=g or t
gacacagaactgtgtgcgtgttcagctataccactnaaatcccaagaacacccagcagatggcagtttgat

SEQ ID NO: 13004 - DNA, 71 bp, chicken (Gallus Gallus)
  misc_feature (36): n=g or t
aaccctcaaatctgacttctgtaactcagtgtgagnaagaatgggctaacaaaacagcggaaaagcagaaa

SEQ ID NO: 13005 - DNA, 71 bp, chicken (Gallus Gallus)
  misc_feature (36): n=a or t
atttcatagaggaaattctcagttataaaacactanttttcaccatagtctccacaattagccaatttgtg

SEQ ID NO: 13006 - DNA, 71 bp, chicken (Gallus Gallus)
  misc_feature (36): n=a or g
gaaagtggagctatgatcagaaaaggccctcttatnccagacaggaggatttcatagaggaatgtaattga

SEQ ID NO: 13007 - DNA, 71 bp, chicken (Gallus Gallus)
  misc_feature (36): n=c or t
ataacagtactatggacatgagcaccatgagaccangctgctcaatggaacaagcgtcctgacatgccact

SEQ ID NO: 13008 - DNA, 71 bp, chicken (Gallus Gallus)
  misc_feature (36): n=c or t
caaaggaaaaaccaaactgtctctttttccagaaanctactgaaaaagtttcaggctaagaacgcagcatc

SEQ ID NO: 13009 - DNA, 71 bp, chicken (Gallus Gallus)
  misc_feature (36): n=c or t
atgacctagaagtacccactggaacaattcaggggntcatgtctcttttacagataactccaggcaacaat

SEQ ID NO: 13010 - DNA, 71 bp, chicken (Gallus Gallus)
  misc_feature (36): n=a or c
gttggtttcctggtcagcctgtttacaaaatggtangaatctttctactgatttcaaggagagttggatca

SEQ ID NO: 13011 - DNA, 71 bp, chicken (Gallus Gallus)
  misc_feature (36): n=a or g
cttttgactcttcatgccacatttgcacaggaatanaattgccagaatatggggaagtacagcccaagatt

SEQ ID NO: 13012 - DNA, 71 bp, chicken (Gallus Gallus)
  misc_feature (36): n=c or t
actgcaggatgctgccttcctgagagctgaagaaancaagtattaaagtacacaatttgttctccttctat

SEQ ID NO: 13013 - DNA, 71 bp, chicken (Gallus Gallus)
  misc_feature (36): n=a or t
aaatatttttataatatattataacatatataaatntattattatatatatataatattatatatatatta

SEQ ID NO: 13014 - DNA, 71 bp, chicken (Gallus Gallus)
  misc_feature (36): n=a or g
tagtgtcagtaaaatatcatttcctaggaagatgangtgtgcataactggtcttgtcaaacagttggctgc

SEQ ID NO: 13015 - DNA, 71 bp, chicken (Gallus Gallus)
  misc_feature (36): n=c or t
gtatgaaactcatgtgaagaaaacaaagctctgctntcagatttgagaatttacctttttaactggtagca

SEQ ID NO: 13016 - DNA, 71 bp, chicken (Gallus Gallus)
  misc_feature (36): n=a or g
taagatttacaatataattctaataattatattctnattttaagagatgagctatgtgaaatgactgtgga

SEQ ID NO: 13017 - DNA, 71 bp, chicken (Gallus Gallus)
  misc_feature (36): n=a or g
gcaaacaaacgcaaggtgttactcttcagttgactnttgagctcagattgttgtctgcttgtttccattgc

SEQ ID NO: 13018 - DNA, 71 bp, chicken (Gallus Gallus)
  misc_feature (36): n=c or t
tgtgtaatataataagaaaaccatatttgaatggtngtgagaagagaaccacattttagcaaaatcaacat

SEQ ID NO: 13019 - DNA, 71 bp, chicken (Gallus Gallus)
  misc_feature (36): n=a or g
taagggcattgatttgagggtttttttgtgtgatcntgatttaaactgtgacaatcctgttccagtaagaa

SEQ ID NO: 13020 - DNA, 71 bp, chicken (Gallus Gallus)
  misc_feature (36): n=a or g
agtattattggtgttaattctgaatttctaaaaccngtgatttgctagtgctgttctgtaatgccctacat

SEQ ID NO: 13021 - DNA, 71 bp, chicken (Gallus Gallus)
  misc_feature (36): n=a or g
gaaactttggaaagtagtaatcttcatattttaagnttaagaccaatcatttcagttcaagtccttttccg

SEQ ID NO: 13022 - DNA, 71 bp, chicken (Gallus Gallus)
  misc_feature (36): n=a or g
gttgtggtgaggttggggctagccgcttctcctgtncaactagcaattcagcatgagggagtggcctcatg

SEQ ID NO: 13023 - DNA, 71 bp, chicken (Gallus Gallus)
  misc_feature (36): n=c or t
gattcttgctggctcaaaacagtaatttaagtttgngcattgtcaaactgtgttcctatatgtgtatatct

SEQ ID NO: 13024 - DNA, 71 bp, chicken (Gallus Gallus)
  misc_feature (36): n=c or t
tagactagatggccttcagaggtcccttccaactcngattctatgaagatccctgtaccaatgctcttgtg

SEQ ID NO: 13025 - DNA, 71 bp, chicken (Gallus Gallus)
  misc_feature (36): n=g or t
ttgctaaaaacctgctaagaactttgctaagagccngcacatcacactcataaaaaattgcatcagcagag

SEQ ID NO: 13026 - DNA, 71 bp, chicken (Gallus Gallus)
  misc_feature (36): n=c or t
cggaaataacgtagccaaaaggagcaaggagatgancatctgctctgtactcagctctgataaggccgcat

SEQ ID NO: 13027 - DNA, 71 bp, chicken (Gallus Gallus)
  misc_feature (36): n=a or g
tgtcattgctgtgacacattttccgttgtgttacantgtgttttctggttcctgcaaaagtcttcaatacc

SEQ ID NO: 13028 - DNA, 71 bp, chicken (Gallus Gallus)
  misc_feature (36): n=g or t
tgtatcgttttaataaattcctactaaattatgtgncagggtggttgaaacagtatgatctttgaggtcct

SEQ ID NO: 13029 - DNA, 71 bp, chicken (Gallus Gallus)
  misc_feature (36): n=c or t
tggaattttggtaggtaacctctactgagataccancaagatccacctctgacactgtgggccagcacaat

SEQ ID NO: 13030 - DNA, 71 bp, chicken (Gallus Gallus)
  misc_feature (36): n=c or t
agtttcaggttggatacgaggaaaaaattcttatcnaagagtgacccaggcactggaatggaactgcctgg

SEQ ID NO: 13031 - DNA, 71 bp, chicken (Gallus Gallus)
  misc_feature (36): n=c or t
aaagctaccaaaactatgtccttttgaggcattacnccaaatgtaacattacatcctttaaggtggcaatt

SEQ ID NO: 13032 - DNA, 71 bp, chicken (Gallus Gallus)
  misc_feature (36): n=c or t
cctcaaggatcatgaatctccaacccccttccaggnaggcccaccgacctacccatttactagactaggtt

SEQ ID NO: 13033 - DNA, 71 bp, chicken (Gallus Gallus)
  misc_feature (36): n=a or t
aaataaattttaggtagataaaaacattagcacagnagttaagttcagacattgtattgcccaacagagaa

SEQ ID NO: 13034 - DNA, 71 bp, chicken (Gallus Gallus)
  misc_feature (36): n=a or g
ttttaatttacctgtaaataagtagaaaaccataanatgaatccaacagcaaataattatcatggagtaat

SEQ ID NO: 13035 - DNA, 71 bp, chicken (Gallus Gallus)
  misc_feature (36): n=c or t
acagcactaagagaaaacaggagggagatctttgangatcaagtccatttagcactgagggagctgatgaa

SEQ ID NO: 13036 - DNA, 71 bp, chicken (Gallus Gallus)
  misc_feature (36): n=a or g
aaacaatgcaatgctttcttcataaagctgccaacngtgtgacttaccagctgttagatgtatgtatttgt

SEQ ID NO: 13037 - DNA, 71 bp, chicken (Gallus Gallus)
  misc_feature (36): n=a or g
atttattttgcatgattatatttgaagcttgttttntactaatgccttgcagggtgatgagacaaaaaaaa

SEQ ID NO: 13038 - DNA, 71 bp, chicken (Gallus Gallus)
  misc_feature (36): n=c or t
gcccaaatgaagtatgatcagatggacacatgaagnaggattaattctttgcacagctacctatgtacgtg

SEQ ID NO: 13039 - DNA, 71 bp, chicken (Gallus Gallus)
  misc_feature (36): n=a or g
ttttgagaattcctcgtaggttaacatggtctctgnagggctcacattttgtatcagttttatttccatca

SEQ ID NO: 13040 - DNA, 71 bp, chicken (Gallus Gallus)
  misc_feature (36): n=g or t
ctgttaacagactgcccaaagtggatgcaaaaggcngattgtgaggacgctgcttagttcaggcatggaaa

SEQ ID NO: 13041 - DNA, 71 bp, chicken (Gallus Gallus)
  misc_feature (36): n=c or t
tattttctgtagattcttataagtgcattcagacangtacagactgcagatcgagaacggatagttttgta

SEQ ID NO: 13042 - DNA, 71 bp, chicken (Gallus Gallus)
  misc_feature (36): n=a or t
ttagaaaagctaatgatattcaaatccacctgcacnatctgtctgctttaagatgcctcaagaattaccat

SEQ ID NO: 13043 - DNA, 71 bp, chicken (Gallus Gallus)
  misc_feature (36): n=c or t
gcttcagggtctcatctcaccgggatgtttggacancattacatgcagtcacacttcatttcttcattcat

SEQ ID NO: 13044 - DNA, 71 bp, chicken (Gallus Gallus)
  misc_feature (36): n=c or t
tgtcgtcgttagctgttgcagcctttgcctctcctntgcctaaacctactgtaacgttaaggtatcaggga

SEQ ID NO: 13045 - DNA, 71 bp, chicken (Gallus Gallus)
  misc_feature (36): n=c or t
cctaaatctaccttctttgagcttgaagccatttcngcttgttctatcagcacagaccatgctaaagtctg

SEQ ID NO: 13046 - DNA, 71 bp, chicken (Gallus Gallus)
  misc_feature (36): n=c or t
aaagcacttttaaaatgaactgtaatttggggaagnctgaaattgaactaaaaccaaatatgaacagaact

SEQ ID NO: 13047 - DNA, 71 bp, chicken (Gallus Gallus)
  misc_feature (36): n=c or t
aaagcttactcttctgctttatgtcataattattcngagcagtgaggttaaattaagttctagagtttatc

SEQ ID NO: 13048 - DNA, 71 bp, chicken (Gallus Gallus)
  misc_feature (36): n=a or g
agaaaatcacaaggagctctaaagctctgtaaagcncagtgtcttttatgaactgtgctgagtgagtggaa

SEQ ID NO: 13049 - DNA, 71 bp, chicken (Gallus Gallus)
  misc_feature (36): n=c or t
ttataacaaaggcaaagttagaccctcaaaaagtgnttttgaaaacacatcttgttgctatataaatctag

SEQ ID NO: 13050 - DNA, 71 bp, chicken (Gallus Gallus)
  misc_feature (36): n=c or g
cacagatgttgttgcctggttacattctgtgatganctaatagaaaagaaatatttgatagtaggatcctt

SEQ ID NO: 13051 - DNA, 71 bp, chicken (Gallus Gallus)
  misc_feature (36): n=c or t
gctgttccatttgttcatacacattttaaaatgggngtcatcttggtaagaaccaagaatagaaggctgtt

SEQ ID NO: 13052 - DNA, 71 bp, chicken (Gallus Gallus)
  misc_feature (36): n=a or g
aagaacctttttttttttttccatgtttttgtaccntgacagaatgtctgttcagtcttgaataacattta

SEQ ID NO: 13053 - DNA, 71 bp, chicken (Gallus Gallus)
  misc_feature (36): n=a or g
agattctcaaagccatctgaagctctcagcctacanatgagaaggatggccactgtggttaaagcaaagag

SEQ ID NO: 13054 - DNA, 71 bp, chicken (Gallus Gallus)
  misc_feature (36): n=c or g
cactgcaaaggcaaagctcttcactgggggagcatntaggacctgcttctccaggacttggaataagtgca

SEQ ID NO: 13055 - DNA, 71 bp, chicken (Gallus Gallus)
  misc_feature (36): n=a or t
aaccattgcagtagacaatccaagaatttaaaccangcgtacctattatcaatcaagccaataacattttg

SEQ ID NO: 13056 - DNA, 71 bp, chicken (Gallus Gallus)
  misc_feature (36): n=c or t
tgttcttggaaacagaggagcattttcgatggcaancctatcctaattagggctgacaacctgtgaactac

SEQ ID NO: 13057 - DNA, 71 bp, chicken (Gallus Gallus)
  misc_feature (36): n=c or t
cttgctgcttgtgtggtctggatgagacattgaaantgggcaaagccctgcctgtgtaagctacctcctct

SEQ ID NO: 13058 - DNA, 71 bp, chicken (Gallus Gallus)
  misc_feature (36): n=c or t
attagcctgggatggcaaccagcacaggctctctanggctaatgcaaagagaagaacgcctctgaaaaggc

SEQ ID NO: 13059 - DNA, 71 bp, chicken (Gallus Gallus)
  misc_feature (36): n=a or g
acatgacattatgaattatttcccatggagccacantcacacagcaagttaccatctcccaagtgcaatga

SEQ ID NO: 13060 - DNA, 71 bp, chicken (Gallus Gallus)
  misc_feature (36): n=a or g
gctaatatggggaaaaaaacaaagagggtaaagatngtagtactgcctctgctactgatacagcccttgta

SEQ ID NO: 13061 - DNA, 71 bp, chicken (Gallus Gallus)
  misc_feature (36): n=g or t
attatatttccatccagcatttttttttctaagttncacttgactagtaataggtttccttgaaaagccat

SEQ ID NO: 13062 - DNA, 71 bp, chicken (Gallus Gallus)
  misc_feature (36): n=a or g
ctgatatattagcaagtgacaccacaaggcctcacntatgaatgtgtggctctgtttgatgggactgctga

SEQ ID NO: 13063 - DNA, 71 bp, chicken (Gallus Gallus)
  misc_feature (36): n=g or t
tgttgtttcctcatggcaatgaacagtgcggagccnatactttggcctgacagatgtggaatttggagtaa

SEQ ID NO: 13064 - DNA, 71 bp, chicken (Gallus Gallus)
  misc_feature (36): n=c or t
aatgagggcttacagcttcccgtggttttgtaactncatgtgttagaaatggcagagggttggagagtgtg

SEQ ID NO: 13065 - DNA, 71 bp, chicken (Gallus Gallus)
  misc_feature (36): n=a or g
gtacttctcttctgcaagggctccatatgttatttnctaagtctggggacatttagcgtgaatctcctgag

SEQ ID NO: 13066 - DNA, 71 bp, chicken (Gallus Gallus)
  misc_feature (36): n=c or t
ctgttcgattcttgagggaaactcttcagacagagngctcgtgttagttaaagcatctgcgtgatagcaat

SEQ ID NO: 13067 - DNA, 71 bp, chicken (Gallus Gallus)
  misc_feature (36): n=c or t
aggttttgtcctgtaggtcagtaccggttacatatngtaaaggtttatgccctgggggagcagaactgatc

SEQ ID NO: 13068 - DNA, 71 bp, chicken (Gallus Gallus)
  misc_feature (36): n=a or t
ctttggagcatttaagtgttacatcgggagcctagnctggtaatggtaacctaagctacaagcagcaggga

SEQ ID NO: 13069 - DNA, 71 bp, chicken (Gallus Gallus)
  misc_feature (36): n=a or g
caaacaactatttgtgatattacactgaataacatntatgacaaaacctagaagacatgagtaatctccat

SEQ ID NO: 13070 - DNA, 71 bp, chicken (Gallus Gallus)
  misc_feature (36): n=a or t
ataatattcttcagacatctctcctgaaatactacntctgattctatcctgctcttttgatttcatatgtt

SEQ ID NO: 13071 - DNA, 71 bp, chicken (Gallus Gallus)
  misc_feature (36): n=a or g
accacatgcatgttttgcatgatttgaccatacccnttgactgtatgcagacgtggtgcagtgtaggatgc

SEQ ID NO: 13072 - DNA, 71 bp, chicken (Gallus Gallus)
  misc_feature (36): n=c or t
aagcttcagagaagcctgctgtgctgtttgcattgntcctatttctggatatccttgtagggccagccata

SEQ ID NO: 13073 - DNA, 71 bp, chicken (Gallus Gallus)
  misc_feature (36): n=a or t
aaaaaccacatctaagctagttttgtagttaatgtnaacagaggaaatagggagggaacaagggaggaaga

SEQ ID NO: 13074 - DNA, 71 bp, chicken (Gallus Gallus)
  misc_feature (36): n=a or t
aacaaaattagacacaagcacttctacctgtggaangcacttctaccacccccttaaaaactgtgggtggg

SEQ ID NO: 13075 - DNA, 71 bp, chicken (Gallus Gallus)
  misc_feature (36): n=a or g
aaactactatacacatcataaacagtgggagttttngaatgccaagcagcttttaaattattagcactaat

SEQ ID NO: 13076 - DNA, 71 bp, chicken (Gallus Gallus)
  misc_feature (36): n=c or t
tctttactatacacattcttaatacaagcaagtacntaccgttgactttctgctattagggccacatgaac

SEQ ID NO: 13077 - DNA, 71 bp, chicken (Gallus Gallus)
  misc_feature (36): n=a or g
caaaacacagtaattaatagtataaaatgctggtcnctcaaaggaaagagatacataaggtgctgaattgc

SEQ ID NO: 13078 - DNA, 71 bp, chicken (Gallus Gallus)
  misc_feature (36): n=c or t
gcaattcctttctaaaactcagttttcctgctgctntgatgtgcagctggggaagaagttgctttggttag

SEQ ID NO: 13079 - DNA, 71 bp, chicken (Gallus Gallus)
  misc_feature (36): n=a or g
agcatatcttcaacgaggagggaaaaattcatttcntacatcgtcatatccgataaggttggttgctgaaa

SEQ ID NO: 13080 - DNA, 71 bp, chicken (Gallus Gallus)
  misc_feature (36): n=a or c
taggccctggtaagagatacctgtagatgtgacagncagcttatacaaatatgttgaattcagataaaata

SEQ ID NO: 13081 - DNA, 71 bp, chicken (Gallus Gallus)
  misc_feature (36): n=a or g
ctgtaataactacagaagcagagtggctcaattctntatgaatggtgataatgttactgttgctcagtaca

SEQ ID NO: 13082 - DNA, 71 bp, chicken (Gallus Gallus)
  misc_feature (36): n=a or c
actggggtagtacttagcttattacagttcatttcnttgatcaaacagaaacggtacctgaaatgataggt

SEQ ID NO: 13083 - DNA, 71 bp, chicken (Gallus Gallus)
  misc_feature (36): n=a or t
tccatgcattttgcagtcaaaattatgagttataangagtatttaaaaaaaaaaaagtgtatttaagaaag

SEQ ID NO: 13084 - DNA, 71 bp, chicken (Gallus Gallus)
  misc_feature (36): n=a or g
aaatcagctggcacatagtaatatttgggtacaacnggacatcctatggagttttaaaacaaattgattta

SEQ ID NO: 13085 - DNA, 71 bp, chicken (Gallus Gallus)
  misc_feature (36): n=a or t
gcattttacatggccttaaatttggcaggatttttntaaaatgttttacttaaagtaattgacagtgatac

SEQ ID NO: 13086 - DNA, 71 bp, chicken (Gallus Gallus)
  misc_feature (36): n=a or t
taccgttgactttctgctattagggccacatgaacnaccaaatcattttccagaggtccctaggacataat

SEQ ID NO: 13087 - DNA, 71 bp, chicken (Gallus Gallus)
  misc_feature (36): n=c or t
acactgcaagtttcatttgaggtaaataagtggtanaaaggaatataaaaagtattttgttgatttaacac

SEQ ID NO: 13088 - DNA, 71 bp, chicken (Gallus Gallus)
  misc_feature (36): n=a or g
taaaacacagaaattatggattgcatattaagcttntttatccataagtcaagcatgtgaagagcaaggtg

SEQ ID NO: 13089 - DNA, 71 bp, chicken (Gallus Gallus)
  misc_feature (36): n=c or t
tcaaacggtcgagtgagacatctctactccttgggncatggttagcgtgacatggaaaagatttcttcttc

SEQ ID NO: 13090 - DNA, 71 bp, chicken (Gallus Gallus)
  misc_feature (36): n=c or t
tcactccttctgtgttgctgtgtatgtttttgtgtnattgttagactgctttgcataaacgttggctttag

SEQ ID NO: 13091 - DNA, 71 bp, chicken (Gallus Gallus)
  misc_feature (36): n=a or g
attactggtctaaaatttcaggttttcccagatgantttcatctccaaaccttgaacccatttctcagagc

SEQ ID NO: 13092 - DNA, 71 bp, chicken (Gallus Gallus)
  misc_feature (36): n=a or g
tttggtgcaggtgggaaccaacgtattcgttttacnctgccaccgttggtttttgcagcataccagcttgc

SEQ ID NO: 13093 - DNA, 71 bp, chicken (Gallus Gallus)
  misc_feature (36): n=a or c
tgccttatgtacctttttttttttagatttcttttnttttgtgcctttttattgtttctttcccatcactg

SEQ ID NO: 13094 - DNA, 71 bp, chicken (Gallus Gallus)
  misc_feature (36): n=c or t
agaagtcaaatgaacgctgacatgccttggcagaantcctatggccattagctgaaacagtaaatggaaac

SEQ ID NO: 13095 - DNA, 71 bp, chicken (Gallus Gallus)
  misc_feature (36): n=c or t
taaagagggtaacttggaattttgggttaagtccanagtgcattagaccatagtgcagataggatgtaagt

SEQ ID NO: 13096 - DNA, 71 bp, chicken (Gallus Gallus)
  misc_feature (36): n=a or g
gtaatgatctctttaaaatgaaaacaagacatgccnaagaactgtagagacaacgcagtgtcagtgcttct

SEQ ID NO: 13097 - DNA, 71 bp, chicken (Gallus Gallus)
  misc_feature (36): n=c or t
tcattgctgtactttccatcatgttacagtaacccngtgttgtaagatgttacacttccaacactttgctt

SEQ ID NO: 13098 - DNA, 71 bp, chicken (Gallus Gallus)
  misc_feature (36): n=g or t
ctttaatgctatagaaatctgcattttaagaagttnataagttttttttttttttttcttttcacgtgaag

SEQ ID NO: 13099 - DNA, 71 bp, chicken (Gallus Gallus)
  misc_feature (36): n=c or t
tattcaactatggagtaaaagaaataaacgtgtgcnaagtgagacgtagtgggttcggttctgctgctggc

SEQ ID NO: 13100 - DNA, 71 bp, chicken (Gallus Gallus)
  misc_feature (36): n=a or t
gtggtgctaaaataccagtactccccaaatcagcantgcctttctgcattggtgtgatgtaccttgagttt

SEQ ID NO: 13101 - DNA, 71 bp, chicken (Gallus Gallus)
  misc_feature (36): n=c or t
ctgtggtacatatatcatctcttgggcatttgtttntctttcttccactagtcaggggagcctgacttaca

SEQ ID NO: 13102 - DNA, 71 bp, chicken (Gallus Gallus)
  misc_feature (36): n=a or g
catggctggattaagtttcagcattacagcacagcntttcttttatcctgttcggtgttggagtggtgtga

SEQ ID NO: 13103 - DNA, 71 bp, chicken (Gallus Gallus)
  misc_feature (36): n=c or t
aagaaaacagttccatcccagctgaaactaggatgntaacctactttgttattctcttcagtagttctaat

SEQ ID NO: 13104 - DNA, 71 bp, chicken (Gallus Gallus)
  misc_feature (36): n=a or g
aaaaattatttgtctttaacataaaaagagataatntagataatctggtctgagcttgatttgatctatta

SEQ ID NO: 13105 - DNA, 71 bp, chicken (Gallus Gallus)
  misc_feature (36): n=a or g
aagctcacatctcaagcagtccaactgggcaagaancagggtggcagaaaatgcaaagctgcaaagaccag

SEQ ID NO: 13106 - DNA, 71 bp, chicken (Gallus Gallus)
  misc_feature (36): n=g or t
cttaatttagagattggcacattcattgacttaaangatggctttatactggtatcttctttcttggtgtg

SEQ ID NO: 13107 - DNA, 71 bp, chicken (Gallus Gallus)
  misc_feature (36): n=g or t
tggttccttctggtgtgggaaggggagactgggctncagcacaccctttgaaaaggtctctttattagaaa

SEQ ID NO: 13108 - DNA, 71 bp, chicken (Gallus Gallus)
  misc_feature (36): n=a or g
gacggaagtttttgtgtgagcagcttactgcagggnatgttgctccaatacaaatgaggacagaggatgac

SEQ ID NO: 13109 - DNA, 71 bp, chicken (Gallus Gallus)
  misc_feature (36): n=c or t
gaggaagagaaaaagcaactaacaatttaaaagccnggtggatttaaggagaaatgtgcaagacaccaaat

SEQ ID NO: 13110 - DNA, 71 bp, chicken (Gallus Gallus)
  misc_feature (36): n=c or t
gtgacgtgcaggtaatctcaaaaatgcttgaatagntgacgtaacttattaacttttggggaacattgcag

SEQ ID NO: 13111 - DNA, 71 bp, chicken (Gallus Gallus)
  misc_feature (36): n=g or t
accagtagagctgtatttgaatgcaagagataaaanatgttttccataggcttcattgaagtaatcttgat

SEQ ID NO: 13112 - DNA, 71 bp, chicken (Gallus Gallus)
  misc_feature (36): n=a or g
tggaatttcgcagaggtttgatccacctttgcctcntgttcccctttgttaattctgtcatttctattctg

SEQ ID NO: 13113 - DNA, 71 bp, chicken (Gallus Gallus)
  misc_feature (36): n=a or g
tcctcaaaagatgcaacaggaatgtgaaactatttntgtaagcacccttgtagccagtgctgggctaactc

SEQ ID NO: 13114 - DNA, 71 bp, chicken (Gallus Gallus)
  misc_feature (36): n=a or g
ggctcttgtttcaggtaaggcagcgtcaaaaggcanctgtcagcatggtgctttgcccatgctgacagcag

SEQ ID NO: 13115 - DNA, 71 bp, chicken (Gallus Gallus)
  misc_feature (36): n=a or t
gtttcaggaagaataacaagacagcacttacatcanctttagttctgtgacaacagttaaacattcaaaga

SEQ ID NO: 13116 - DNA, 71 bp, chicken (Gallus Gallus)
  misc_feature (36): n=a or g
tatgcttgcatgggtggcttctcattgcgcctctcncttgctcagtgcagttgcttcactgagagtcagtg

SEQ ID NO: 13117 - DNA, 71 bp, chicken (Gallus Gallus)
  misc_feature (36): n=a or t
gtggaactatcttaatttgttttcctgcagcttgcngcctgtacctttaaaatatctcctttacgtagtca

SEQ ID NO: 13118 - DNA, 71 bp, chicken (Gallus Gallus)
  misc_feature (36): n=a or c
attagcatgaatattgggtgaggaaccaggatactntaagcctgttttaaaattaggagaaaactgcggaa

SEQ ID NO: 13119 - DNA, 71 bp, chicken (Gallus Gallus)
  misc_feature (36): n=a or g
ctgtgtgtctcagatatactgtcttctggaggactnaggaacctgagatgtgatcctgtgatctggatttg

SEQ ID NO: 13120 - DNA, 71 bp, chicken (Gallus Gallus)
  misc_feature (36): n=c or t
tgaggttgtttgttttcatttgtttttttttttttncccctaaattctgatcacctctacctctgagtccc

SEQ ID NO: 13121 - DNA, 71 bp, chicken (Gallus Gallus)
  misc_feature (36): n=a or c
aacccagcatttctgccactgaaggggtaaccagantattctccttcaaggcagaaagaaatgctgtggaa

SEQ ID NO: 13122 - DNA, 71 bp, chicken (Gallus Gallus)
  misc_feature (36): n=a or g
agatcttcagtgtgtttaatgccaacagggatggcntgttaaataaataaggcactagtctgaaatccgtg

SEQ ID NO: 13123 - DNA, 71 bp, chicken (Gallus Gallus)
  misc_feature (36): n=a or g
cctgtttcagctttagtgaacaagaaatataagacnaacaaggaacctaagtaaagatacctcaatgaaaa

SEQ ID NO: 13124 - DNA, 71 bp, chicken (Gallus Gallus)
  misc_feature (36): n=a or g
aagtccgtgaagcaatctgctaaaaacaagacactnaactaaaatccactaaatctcagttccacccccaa

SEQ ID NO: 13125 - DNA, 71 bp, chicken (Gallus Gallus)
  misc_feature (36): n=a or g
atgccagtctacaggtgccatctgccttctttaatngcaaaattgggtgacatacagagtttcagaagacc

SEQ ID NO: 13126 - DNA, 71 bp, chicken (Gallus Gallus)
  misc_feature (36): n=c or t
ctacgtgtgagattcacgacacaaatccaaaagcangagtgtggagaagagatagagggtggctggcagtg

SEQ ID NO: 13127 - DNA, 71 bp, chicken (Gallus Gallus)
  misc_feature (36): n=c or t
ttttctttttttttcttttttttttttatgaaatangagaaaaaaacagtaaagcattatatacgacatct

SEQ ID NO: 13128 - DNA, 71 bp, chicken (Gallus Gallus)
  misc_feature (36): n=c or g
gataaaaatcaaacggtaggatcatggaaattcagntatgcagttgtttagatctgcaataggagatgatg

SEQ ID NO: 13129 - DNA, 71 bp, chicken (Gallus Gallus)
  misc_feature (36): n=c or t
aataagttttccagaatgtttcaggttttgcgtttngattgttttcagttttgaccacaaggcaacaataa

SEQ ID NO: 13130 - DNA, 71 bp, chicken (Gallus Gallus)
  misc_feature (36): n=a or t
gtgtcgtacggagggcttttttgatgggctaaagcnctatctttaattgcaagaccagagatgaggcaaat

SEQ ID NO: 13131 - DNA, 71 bp, chicken (Gallus Gallus)
  misc_feature (36): n=c or t
ggatgatggcctctatgcaagagtgccatatcatanggagtgctttcactttgaaaggaatatcttcatct

SEQ ID NO: 13132 - DNA, 71 bp, chicken (Gallus Gallus)
  misc_feature (36): n=a or g
ttgtttttcagaaggaagcattaggtgagccagtcntggctaccactgcagtggttgctgctgttagtgag

SEQ ID NO: 13133 - DNA, 71 bp, chicken (Gallus Gallus)
  misc_feature (36): n=a or g
gcagggtctatgattagaacaagcatctgagattcnagccttatggatatataaagtagtatcatgctact

SEQ ID NO: 13134 - DNA, 71 bp, chicken (Gallus Gallus)
  misc_feature (36): n=a or g
cttggctgtcagactttttcagtgagtttcctcttntatagttcattccttctcttccctcagctattttc

SEQ ID NO: 13135 - DNA, 71 bp, chicken (Gallus Gallus)
  misc_feature (36): n=a or g
aaaatcccttgtaaaaaataaaagcataacaacacnctactttcacatttcacatcctgacacatctccct

SEQ ID NO: 13136 - DNA, 71 bp, chicken (Gallus Gallus)
  misc_feature (36): n=a or g
caatactactgatgctgaacccaagaagaaacatanacagagttgaagcatgaaaaaggtatgtgctataa

SEQ ID NO: 13137 - DNA, 71 bp, chicken (Gallus Gallus)
  misc_feature (36): n=a or t
actaaaaaggcaaaaacaaacaaacagcaactaatnctgaccatttgatccctataaagtcctccaggatg

SEQ ID NO: 13138 - DNA, 71 bp, chicken (Gallus Gallus)
  misc_feature (36): n=a or g
gtgtggagcaagtcacttcaggtcttgctgagctcntaaacgtgaagtcacagtctcacataaacatagtc

SEQ ID NO: 13139 - DNA, 71 bp, chicken (Gallus Gallus)
  misc_feature (36): n=a or c
taatgcattagaggtaaggcaaagaaagaaaacatnttgactgtagtgactattgttggaataattttttt

SEQ ID NO: 13140 - DNA, 71 bp, chicken (Gallus Gallus)
  misc_feature (36): n=a or c
acggtttaccaatatgtttcaaaattcaggcttaanagatcattttcagcaacaaattgaaatagaagaga

SEQ ID NO: 13141 - DNA, 71 bp, chicken (Gallus Gallus)
  misc_feature (36): n=a or g
atttacctattcaggagacattagtgtatcagagtnagaatgttagggatacatttccatatcatatcata

SEQ ID NO: 13142 - DNA, 71 bp, chicken (Gallus Gallus)
  misc_feature (36): n=a or t
gggggaattttatatttcattcaagaggaaaatgtnttctcaaggcaaacactagtgttaacacttggcca

SEQ ID NO: 13143 - DNA, 71 bp, chicken (Gallus Gallus)
  misc_feature (36): n=c or t
cctgccactcacagtggtcagacagtactgcctacngtcccagtaggacgtgcataagtcaaggcctctgt

SEQ ID NO: 13144 - DNA, 71 bp, chicken (Gallus Gallus)
  misc_feature (36): n=g or t
ctgagcttaaaagaaaatgcagcaacctcagcatgngccaagatatcagttctcatagctaataagctaaa

SEQ ID NO: 13145 - DNA, 71 bp, chicken (Gallus Gallus)
  misc_feature (36): n=a or g
gagagacaagctcccggaccacttgggcagcatagngatttctgctgttacccctaatttcattgtttcat

SEQ ID NO: 13146 - DNA, 71 bp, chicken (Gallus Gallus)
  misc_feature (36): n=c or t
ttagtaactacaacaaagccaagtccttcacactanacttctatagatcaagtctacagaaactgaagaat

SEQ ID NO: 13147 - DNA, 71 bp, chicken (Gallus Gallus)
  misc_feature (36): n=c or t
atatttctttttactcctgttttatactcctccttnctctaattcagtgaaggttcctatgtgccaaaact

SEQ ID NO: 13148 - DNA, 71 bp, chicken (Gallus Gallus)
  misc_feature (36): n=c or t
gttccctgcattccagccacggatccatcagcatcnatgctgtagtgctagctgcatcgctatcgcagccc

SEQ ID NO: 13149 - DNA, 71 bp, chicken (Gallus Gallus)
  misc_feature (36): n=a or c
ttgtgtttcatccagattcccagtctgaactatggnggacctgcaggagatgctgcagagcacttctgcct

SEQ ID NO: 13150 - DNA, 71 bp, chicken (Gallus Gallus)
  misc_feature (36): n=g or t
ccaacatacaactgagtgttgatgatggagggaagnagcatctgaaagagaacaaaaggttgataaagtgc

SEQ ID NO: 13151 - DNA, 71 bp, chicken (Gallus Gallus)
  misc_feature (36): n=a or t
caagagatagattccaaacccaacactgagattccnctggtgatgcagatgactgcttactgggatccttc

SEQ ID NO: 13152 - DNA, 71 bp, chicken (Gallus Gallus)
  misc_feature (36): n=c or t
tatggatggttcacagcagtcagtataactataaanacactgtatttttgcatacattcatttttggaccc

SEQ ID NO: 13153 - DNA, 71 bp, chicken (Gallus Gallus)
  misc_feature (36): n=c or t
ctgtatttgtcttaccagtctgtgcagcataaccancaccgctaccgagaacacacagtcaagttaaagaa

SEQ ID NO: 13154 - DNA, 71 bp, chicken (Gallus Gallus)
  misc_feature (36): n=c or t
ccctgagccctaagaatgcctgcggcaagttttcangaggagaagcagcagtattccttatttgcagagct

SEQ ID NO: 13155 - DNA, 71 bp, chicken (Gallus Gallus)
  misc_feature (36): n=c or t
taagtacttttgtttgaagatggcactttgtccagnatgcgttgacttccttctctgtctaaagagacctt

SEQ ID NO: 13156 - DNA, 71 bp, chicken (Gallus Gallus)
  misc_feature (36): n=a or c
ttacacacccagagcacgagtcagcacagctactgngaccaatggcatcagctttaacatgttttagtctt

SEQ ID NO: 13157 - DNA, 71 bp, chicken (Gallus Gallus)
  misc_feature (36): n=c or t
tagcctgaaaaaatgtgatttttttggaaattctantcttcccctgaagcagctcctcaggaacagcagag

SEQ ID NO: 13158 - DNA, 71 bp, chicken (Gallus Gallus)
  misc_feature (36): n=a or t
acataatacaacttctacaagctgtttctcttggcngatagcatttccattttcagttcaactcaaaaggc

SEQ ID NO: 13159 - DNA, 71 bp, chicken (Gallus Gallus)
  misc_feature (36): n=a or c
gtatgatatgctgcagttgtgatttgctattagtanaccatcccgaatgcactatctgtggggcctgagtt

SEQ ID NO: 13160 - DNA, 71 bp, chicken (Gallus Gallus)
  misc_feature (36): n=a or g
caacagtcatatacaaaaagaatggaactcacccanctagcaaaggggttctctgacaatacagcacttct

SEQ ID NO: 13161 - DNA, 71 bp, chicken (Gallus Gallus)
  misc_feature (36): n=a or g
cagcacgtaacacagttcttagattaagaatggcangctactcaatgaaaacaagattcatggtaagtcat

SEQ ID NO: 13162 - DNA, 71 bp, chicken (Gallus Gallus)
  misc_feature (36): n=a or g
ttcatttctatttaagaacaagggaaagattataanagagccagcatcgagtgaagtacatgaacgggttt

SEQ ID NO: 13163 - DNA, 71 bp, chicken (Gallus Gallus)
  misc_feature (36): n=a or g
tttataccctggtaaagtacttgtaaattgctaggncgttcagaggggtgataatgtaacaaaagagaagg

SEQ ID NO: 13164 - DNA, 71 bp, chicken (Gallus Gallus)
  misc_feature (36): n=a or t
tgaaaacgtaaaccttataatatcagaggatgacantaatttcaggcttgtacagaggatcataagcttta

SEQ ID NO: 13165 - DNA, 71 bp, chicken (Gallus Gallus)
  misc_feature (36): n=g or t
aaattattatttcttgttcacacctctttttttccncctgcaaaggtttacttctttaatgcttgttattt

SEQ ID NO: 13166 - DNA, 71 bp, chicken (Gallus Gallus)
  misc_feature (36): n=c or g
gactcagactactattaacaccagtttgtagttttnatttaaaagagaaaaaaacaccatgattgattata

SEQ ID NO: 13167 - DNA, 71 bp, chicken (Gallus Gallus)
  misc_feature (36): n=c or t
ccgagcccatatgtgtatctcagttatgccaggtgngaacaccaatatctgttctccttacagctgcacaa

SEQ ID NO: 13168 - DNA, 71 bp, chicken (Gallus Gallus)
  misc_feature (36): n=a or g
aaagaagtgtagaagagatctagttcaccctgatcntggcctcgaccagcagccaggaggatggatttcag

SEQ ID NO: 13169 - DNA, 71 bp, chicken (Gallus Gallus)
  misc_feature (36): n=a or g
taggcagttcaagcaacgtaagaaagaaaactaaanctcagagtcacttcagtacccaaagattttagtag

SEQ ID NO: 13170 - DNA, 71 bp, chicken (Gallus Gallus)
  misc_feature (36): n=g or t
ttcataatggggtgatgtattgctgtgctttagatncaggaaatccttaggagctaaactagataaatgca

SEQ ID NO: 13171 - DNA, 71 bp, chicken (Gallus Gallus)
  misc_feature (36): n=a or g
ctaatttggaaggatcagatctgatggatggtactnacttccaaactatctagcactaaatgccaggttcc

SEQ ID NO: 13172 - DNA, 71 bp, chicken (Gallus Gallus)
  misc_feature (36): n=c or t
gtgaattgttacaataataatcctttgaatttctgnagtttgactacagctacccaacttctctgaacaca

SEQ ID NO: 13173 - DNA, 71 bp, chicken (Gallus Gallus)
  misc_feature (36): n=c or t
cagactgactctttttttcaatcattaggttttganaactttgagagcctgcttgctggaggccactggat

SEQ ID NO: 13174 - DNA, 71 bp, chicken (Gallus Gallus)
  misc_feature (36): n=a or c
ttccctgagtgctctttagctttgtttactataganaacaaagcttagccttgtttactatagaaaacaaa

SEQ ID NO: 13175 - DNA, 71 bp, chicken (Gallus Gallus)
  misc_feature (36): n=c or g
actttactgatgtagcttcttcacttgttgcagttnacctcgttgtgtcaagtgttataaatgaaaactag

SEQ ID NO: 13176 - DNA, 71 bp, chicken (Gallus Gallus)
  misc_feature (36): n=c or t
aatgggctggtaaatcacctgctctcctcatagggngtacagaatgaggttttcagattgaataccttttg

SEQ ID NO: 13177 - DNA, 71 bp, chicken (Gallus Gallus)
  misc_feature (36): n=a or g
catattccctcattcaagagttcagagcaatttctntggctttcaggtattagtcaccacaggactggtac

SEQ ID NO: 13178 - DNA, 71 bp, chicken (Gallus Gallus)
  misc_feature (36): n=a or g
tgtctttaaattcttccataaactcagttctcacantccataaaatacaagtcccctctctttccactccc

SEQ ID NO: 13179 - DNA, 71 bp, chicken (Gallus Gallus)
  misc_feature (36): n=c or t
ctatagggcagacaataacttatggaactgttggcnacatactgcttcttatttatagaaatgatcctatt

SEQ ID NO: 13180 - DNA, 71 bp, chicken (Gallus Gallus)
  misc_feature (36): n=c or t
tatccaaccaaaattaggcatttgaagcataaaggngaaacttaccaaaatattttggaccattcttagta

SEQ ID NO: 13181 - DNA, 71 bp, chicken (Gallus Gallus)
  misc_feature (36): n=a or g
gaaagaccaatttagtaactttgctctctcctgccngagctggaacaccatcatgctgtttgagataataa

SEQ ID NO: 13182 - DNA, 71 bp, chicken (Gallus Gallus)
  misc_feature (36): n=c or t
ctgtgttcttgtgagcaattatgtgattaaattcangatgtctctaaagataatctcctgatttctgcttt

SEQ ID NO: 13183 - DNA, 71 bp, chicken (Gallus Gallus)
  misc_feature (36): n=a or c
tgtaggaacaagttctttgctttcctaggcagcaanaattccatccagcttgatagaatagcccatgcctt

SEQ ID NO: 13184 - DNA, 71 bp, chicken (Gallus Gallus)
  misc_feature (36): n=c or t
tcgttggcttgcatctagtagcttaaaaatgagttntgaaccagatagccaaggctttaaatgactttatt

SEQ ID NO: 13185 - DNA, 71 bp, chicken (Gallus Gallus)
  misc_feature (36): n=c or t
tgctttgcaagcagatcttcattaatagttcaccantgagtgtaggactgcgtgtactgtgatttgaagtg

SEQ ID NO: 13186 - DNA, 71 bp, chicken (Gallus Gallus)
  misc_feature (36): n=a or t
gtgtgctgaattgaaagtcgtttgtacctcaaagcngtgcaataggagtaacaaagctttcctcagtaacc

SEQ ID NO: 13187 - DNA, 71 bp, chicken (Gallus Gallus)
  misc_feature (36): n=c or t
ttttcttgtcacaagcaaatagcttctttcatcatngacaacaaaagtaagaaagtcttttggaggggctt

SEQ ID NO: 13188 - DNA, 71 bp, chicken (Gallus Gallus)
  misc_feature (36): n=g or t
atctttaaaagctgtgccgtggtgtctagctgaccntgcttttcattcccagttctatgctactaccagga

SEQ ID NO: 13189 - DNA, 71 bp, chicken (Gallus Gallus)
  misc_feature (36): n=a or g
gcttttcagccactcattctgaggacactgtggtgntaagaaaggtgttttcaaatgttttataacttagt

SEQ ID NO: 13190 - DNA, 71 bp, chicken (Gallus Gallus)
  misc_feature (36): n=c or t
gtggataagctatattgatcagcactccaaaggcgntaggcattacttggaaagaattactattaatcttt

SEQ ID NO: 13191 - DNA, 71 bp, chicken (Gallus Gallus)
  misc_feature (36): n=c or t
gatttgtgaaagcggactgtgcaaaaagtcatttcntttgcttttatcagtttatcttctacagaaattta

SEQ ID NO: 13192 - DNA, 71 bp, chicken (Gallus Gallus)
  misc_feature (36): n=c or t
gcattttctgctttctaaaatgtgtgactattgatnagcactgatgttagctttaagatgcagtgattgaa

SEQ ID NO: 13193 - DNA, 71 bp, chicken (Gallus Gallus)
  misc_feature (36): n=c or t
ggcacttaaacagcctgttacaaacgccctgcgttnagtgactgtgaggtctgcaataatgctcctgatct

SEQ ID NO: 13194 - DNA, 71 bp, chicken (Gallus Gallus)
  misc_feature (36): n=a or g
agcatttttccagtggcttcatttgtaccctgcctnaaccattgctcctgtcgctcactgtaatgtttaca

SEQ ID NO: 13195 - DNA, 71 bp, chicken (Gallus Gallus)
  misc_feature (36): n=a or g
cggaaagttggaatataacttagaataaagcagttntccttcaatgtgtcttgtaaaaaaaaaaaaagtgc

SEQ ID NO: 13196 - DNA, 71 bp, chicken (Gallus Gallus)
  misc_feature (36): n=c or t
ggctcgagtcagtgcagcgattcctcacagtggttnagtggaattcattttactttcatctgcattttgga

SEQ ID NO: 13197 - DNA, 71 bp, chicken (Gallus Gallus)
  misc_feature (36): n=c or t
aatgacttctgcattccctcagttgcttaatacagnggttgctttgtttccatcatagattagtgatgtca

SEQ ID NO: 13198 - DNA, 71 bp, chicken (Gallus Gallus)
  misc_feature (36): n=c or t
ctcttctaaaaccaccatcatccaactatcagtcanccttgctaacagtcacagaagaggtcaaagacaga

SEQ ID NO: 13199 - DNA, 71 bp, chicken (Gallus Gallus)
  misc_feature (36): n=a or t
tttatcttaaagaaagagaaggtattagggtatatnaagggtatataaagaagtaagatgtggacttgtga

SEQ ID NO: 13200 - DNA, 71 bp, chicken (Gallus Gallus)
  misc_feature (36): n=a or t
aataaaataacacagaaattaataatgttataaatnacagtcttaaaatatatacatgcaataaactacaa

SEQ ID NO: 13201 - DNA, 71 bp, chicken (Gallus Gallus)
  misc_feature (36): n=c or t
tcatgggaattgatgtagatttacacttatgcatgncttcttgtttcccaaatgtggtatctataatgttc

SEQ ID NO: 13202 - DNA, 71 bp, chicken (Gallus Gallus)
  misc_feature (36): n=c or t
atgtccttcccaagtttcagaattaaccccacgcangatagaagaaaatgacagtacgatggccatctggc

SEQ ID NO: 13203 - DNA, 71 bp, chicken (Gallus Gallus)
  misc_feature (36): n=a or c
taatcggggctgtgtgatctatacttttgttttctngttggttattgaaatcattaggatttgaagagtca

SEQ ID NO: 13204 - DNA, 71 bp, chicken (Gallus Gallus)
  misc_feature (36): n=c or g
tacaaaacataagacagcctggaagggataaaatgnatagcataagaagagaagactcctaacagtgttca

SEQ ID NO: 13205 - DNA, 71 bp, chicken (Gallus Gallus)
  misc_feature (36): n=a or t
ggctgtgtttttgaaaaaagaatgaatgttagctgntcattcttggtatcatgtgtgctgctctgacttgt

SEQ ID NO: 13206 - DNA, 71 bp, chicken (Gallus Gallus)
  misc_feature (36): n=a or c
cagtctgagacagttacagccactggatactagctntacaccagtatcatatttgtaactattaatatgca

SEQ ID NO: 13207 - DNA, 71 bp, chicken (Gallus Gallus)
  misc_feature (36): n=a or c
actcttttttaatacctcctgaagctcatttattgngtgtaaataagtttgtatgcatatagtttgtacaa

SEQ ID NO: 13208 - DNA, 71 bp, chicken (Gallus Gallus)
  misc_feature (36): n=a or g
ctgattgatgcataacaacatattttctttcccaangaaaatgagataataaagaattactgatgaatgag

SEQ ID NO: 13209 - DNA, 71 bp, chicken (Gallus Gallus)
  misc_feature (36): n=a or c
taatgctctcctgtggaatatttgtctggtttctanccatactgctttttaaatggttgatatagcgtcaa

SEQ ID NO: 13210 - DNA, 71 bp, chicken (Gallus Gallus)
  misc_feature (36): n=a or c
cttctagaacaatggatattaccacatagctgtaantggaagacagaagaactgacatccctcagctgcta

SEQ ID NO: 13211 - DNA, 71 bp, chicken (Gallus Gallus)
  misc_feature (36): n=a or c
gaaaaagaaaaggctaagtaacattaaaatgtaagntgtaacttatctttggctttcatttgttcatctag

SEQ ID NO: 13212 - DNA, 71 bp, chicken (Gallus Gallus)
  misc_feature (36): n=a or g
taaaattctgtccctttatcttgttaactcagtacntatgggttgcaattttcaggctaaaggagggaaag

SEQ ID NO: 13213 - DNA, 71 bp, chicken (Gallus Gallus)
  misc_feature (36): n=a or g
cagacttcagtccaaaactgcaggagatgagcgatntttgtagacaagttgtggcacttggtgacaaatgt

SEQ ID NO: 13214 - DNA, 71 bp, chicken (Gallus Gallus)
  misc_feature (36): n=c or t
aacccctggcccctggaacctctgtgttagttgtangtatttatagtgttacaagaatatcgataggtacc

SEQ ID NO: 13215 - DNA, 71 bp, chicken (Gallus Gallus)
  misc_feature (36): n=a or g
tttttttcaaaattcagtaactatgaatgcagcccntgtttgagaatttagggaggaatatgcaggtttca

SEQ ID NO: 13216 - DNA, 71 bp, chicken (Gallus Gallus)
  misc_feature (36): n=a or g
cttattaatggctattgaaaatacacctgagtccangtgacatcattcaggtttgttacagtgactgaact

SEQ ID NO: 13217 - DNA, 71 bp, chicken (Gallus Gallus)
  misc_feature (36): n=c or g
tttctgcattcattatcagtttctaaatgtctctgnatgggactggaattattttttttctgttttctttc

SEQ ID NO: 13218 - DNA, 71 bp, chicken (Gallus Gallus)
  misc_feature (36): n=c or t
cccatctctgagcagacaggcttacttaggatgcantttttcacatccttcatcaaagctgagtaattctg

SEQ ID NO: 13219 - DNA, 71 bp, chicken (Gallus Gallus)
  misc_feature (36): n=a or g
agatctgttccctgaatgtcttcttccttttagatngaaaaaaaaaaaaattataatattataataggatc

SEQ ID NO: 13220 - DNA, 71 bp, chicken (Gallus Gallus)
  misc_feature (36): n=c or t
tgtttggtagttctaaatatttaatttgatattggntcttccttttttctgccttgttcctgttgacttct

SEQ ID NO: 13221 - DNA, 71 bp, chicken (Gallus Gallus)
  misc_feature (36): n=c or t
gcactagaaatacatgcaatcgactgttacaagtcnaagaaaatgctgtaaattatgtgtgatggaagtgc

SEQ ID NO: 13222 - DNA, 71 bp, chicken (Gallus Gallus)
  misc_feature (36): n=c or g
accttcacacatgtgtaactttgttcactctctggnccgtatgatattactctaactatgcttgtaaagaa

SEQ ID NO: 13223 - DNA, 71 bp, chicken (Gallus Gallus)
  misc_feature (36): n=a or g
tgctgaaggcacagcagctttcggctgcgtttcacngttatttgcatcatgtgtgtgtgtttagtggaatc

SEQ ID NO: 13224 - DNA, 71 bp, chicken (Gallus Gallus)
  misc_feature (36): n=g or t
gaaagcgtttattgtggcacagtaatgattacaagntttaggttctctcgaagctttgaaatgcagtgctg

SEQ ID NO: 13225 - DNA, 71 bp, chicken (Gallus Gallus)
  misc_feature (36): n=a or g
tgatcttgattgcaaaagtttcttccctaaatcacntgctgttgttgcagcatgcaaccagaagagaagtt

SEQ ID NO: 13226 - DNA, 71 bp, chicken (Gallus Gallus)
  misc_feature (36): n=c or t
tttgtctctgacacagtcacactcaggacctttcgntgaatagatgattatgttctgaaaatacaggattg

SEQ ID NO: 13227 - DNA, 71 bp, chicken (Gallus Gallus)
  misc_feature (36): n=g or t
tacttgaaaatgtctccagaaaatgaaaatttttgntttttgctaaaatgtcctcagtgaaacatggattt

SEQ ID NO: 13228 - DNA, 71 bp, chicken (Gallus Gallus)
  misc_feature (36): n=a or g
gtcttcaatgtcctcctctccaacctgctgtttccntacaggttctattctattctacttcatatggcagc

SEQ ID NO: 13229 - DNA, 71 bp, chicken (Gallus Gallus)
  misc_feature (36): n=g or t
tggatggtttcacgttttctaaaaggaatattcagncagttattgcctacctgtttgtctctgatcagtat

SEQ ID NO: 13230 - DNA, 71 bp, chicken (Gallus Gallus)
  misc_feature (36): n=c or t
agtaattggacctttgttagcagtgagatgagaganactgatagctttgtagagatggacccagacctgag

SEQ ID NO: 13231 - DNA, 71 bp, chicken (Gallus Gallus)
  misc_feature (36): n=g or t
ggaaccctcgtactgtaaattagtagtatccaaatnaggaatacccttattttttttaacaccttgtaagt

SEQ ID NO: 13232 - DNA, 71 bp, chicken (Gallus Gallus)
  misc_feature (36): n=c or t
tcctccatttgaaaaaaaaaaaaaatgcaccccacngatgtttattcatgtttgctgggcatttatggaga

SEQ ID NO: 13233 - DNA, 71 bp, chicken (Gallus Gallus)
  misc_feature (36): n=a or g
tgaaccctttttcataggaataaataagcaacaggngtcttaaatttgaattagataaacttgtaactggt

SEQ ID NO: 13234 - DNA, 71 bp, chicken (Gallus Gallus)
  misc_feature (36): n=a or t
ctatcctatgaacaagaacctgcatgctacatttanaaaaatcctcatggctacctggaacatggcttgtc

SEQ ID NO: 13235 - DNA, 71 bp, chicken (Gallus Gallus)
  misc_feature (36): n=a or c
cacctctctgggcagcctgtgccagtgcactgcccntctttcagagaggaaatttttgtgaatatccaacc

SEQ ID NO: 13236 - DNA, 71 bp, chicken (Gallus Gallus)
  misc_feature (36): n=a or g
tctacgtgtatcaaatactttgtttgcgactgctcnaatgcagttcagcaactgacccagcaaggggagct

SEQ ID NO: 13237 - DNA, 71 bp, chicken (Gallus Gallus)
  misc_feature (36): n=c or t
actctttttcatggctggtgagaatgcagaactaanggtggtgactgcgttccaaaataatgctttgtagc

SEQ ID NO: 13238 - DNA, 71 bp, chicken (Gallus Gallus)
  misc_feature (36): n=c or t
ggcagtgcttaatacaatcaatatgctgattacatncttatttataagtgtttatgaatatcaggtcttaa

SEQ ID NO: 13239 - DNA, 71 bp, chicken (Gallus Gallus)
  misc_feature (36): n=a or g
tgtgacccaaaaagagccaagtttccagaagtactnccaaattttaggaatggaagcttcttttcttcaag

SEQ ID NO: 13240 - DNA, 71 bp, chicken (Gallus Gallus)
  misc_feature (36): n=c or t
tcttctccagactgaaccatcccagtatgtaggacntgaagccaggtacatactcagtcgcataagtcagt

SEQ ID NO: 13241 - DNA, 71 bp, chicken (Gallus Gallus)
  misc_feature (36): n=a or g
ggcaaatcttgtgggaatatctgcatcctctgtgcngtgcggctggctcgcaccaagccaaagggtggttt

SEQ ID NO: 13242 - DNA, 71 bp, chicken (Gallus Gallus)
  misc_feature (36): n=c or t
cagccctgagaagataaatcttgggggagaccttantgtggtcttccaatacataaagggcctacaggaaa

SEQ ID NO: 13243 - DNA, 71 bp, chicken (Gallus Gallus)
  misc_feature (36): n=a or g
aacaattgaagaattactaagtttaaaccaaatgtnaaagagctaccttgttttttaaaatatatgtgttt

SEQ ID NO: 13244 - DNA, 71 bp, chicken (Gallus Gallus)
  misc_feature (36): n=c or t
tccagcgtctatgtgaagctgctttccatttcctanaacgatattaatttgtaatttttcctcctgtctct

SEQ ID NO: 13245 - DNA, 71 bp, chicken (Gallus Gallus)
  misc_feature (36): n=a or t
agaatcattaaggttggaaaaggcctctaagatcanctactgtaaccgtcagtccatctccatcatgccta

SEQ ID NO: 13246 - DNA, 71 bp, chicken (Gallus Gallus)
  misc_feature (36): n=c or t
ttgaaaatcatatcaaaagcaacaggatcatccccnagaaaacctcttctaattcaaaggaccccactgga

SEQ ID NO: 13247 - DNA, 71 bp, chicken (Gallus Gallus)
  misc_feature (36): n=a or g
atgaaccttctgatcattggccagaaaagaggcatngttcaggaatactacagtatccttagttcctttct

SEQ ID NO: 13248 - DNA, 71 bp, chicken (Gallus Gallus)
  misc_feature (36): n=a or t
agatccagcaacacagcacgtattttaccaactttncatcagaacagaaaaaaaactaaaatcaccaagtg

SEQ ID NO: 13249 - DNA, 71 bp, chicken (Gallus Gallus)
  misc_feature (36): n=c or t
aagagaggagatttaggccagatataaggaagaatngttttacagtaatagtggtgaggcactggcagagc

SEQ ID NO: 13250 - DNA, 71 bp, chicken (Gallus Gallus)
  misc_feature (36): n=a or g
gggatgccttcgttctttaggttcaaataaaggcangaataaaactataacagaatcagatgcatctcaga

SEQ ID NO: 13251 - DNA, 71 bp, chicken (Gallus Gallus)
  misc_feature (36): n=c or t
cctcaccactcttactgtagaaaacttcttcatatncaatctaaatctctcctcttttggtgtgaaaccat

SEQ ID NO: 13252 - DNA, 71 bp, chicken (Gallus Gallus)
  misc_feature (36): n=c or t
attgattttgcaaccataaagtaaacaacagacacnagaaatgcattgaattggtctcattacaaatctcc

SEQ ID NO: 13253 - DNA, 71 bp, chicken (Gallus Gallus)
  misc_feature (36): n=a or g
agcactaatatgtgggggctgctctgaaagcaatanctcctatcttattctgctgatccacaacatcagag

SEQ ID NO: 13254 - DNA, 71 bp, chicken (Gallus Gallus)
  misc_feature (36): n=a or c
aaaattcaaatccaaacaaactctagaaatctctcncagatctcacaaaggtctgaagaaagacgtgtcca

SEQ ID NO: 13255 - DNA, 71 bp, chicken (Gallus Gallus)
  misc_feature (36): n=a or g
tgcatttgcagttcccttcctcgcagggatgggaangggagatcagtagtttactaatttgttgtgcacca

SEQ ID NO: 13256 - DNA, 71 bp, chicken (Gallus Gallus)
  misc_feature (36): n=c or t
tgtcttcttgaatgcaaagtctcttaaattttattntttagttatccctccgaaaaacaatagtactgaag

SEQ ID NO: 13257 - DNA, 71 bp, chicken (Gallus Gallus)
  misc_feature (36): n=a or g
ataaaccaaaactgagttgtcagtcgcccacaatcncatccaatgttatagaacttccagaaaaagaaaca

SEQ ID NO: 13258 - DNA, 71 bp, chicken (Gallus Gallus)
  misc_feature (36): n=c or t
gatatctataggcagggaacgacattgattccctgncactgctattgccatctccttctttcattctccca

SEQ ID NO: 13259 - DNA, 71 bp, chicken (Gallus Gallus)
  misc_feature (36): n=g or t
tagatttatcagttgaagaggctgaagctgtggaantcagggttgttacatatgagaacacaaagtggcat

SEQ ID NO: 13260 - DNA, 71 bp, chicken (Gallus Gallus)
  misc_feature (36): n=a or c
atggataatattgatgtcactaggagatacaaatanttcctcatgacattcaatgcatttatgaaactaaa

SEQ ID NO: 13261 - DNA, 71 bp, chicken (Gallus Gallus)
  misc_feature (36): n=c or t
agcactaacacctttgcttatgagaatacaacagcncccctgtaacaagggaaacacaggtggagaccgac

SEQ ID NO: 13262 - DNA, 71 bp, chicken (Gallus Gallus)
  misc_feature (36): n=a or g
tgagctattctgaaggaatattccatcctggaaacnctcggagttttcctcagttgttccaaatctccccc

SEQ ID NO: 13263 - DNA, 71 bp, chicken (Gallus Gallus)
  misc_feature (36): n=c or t
gtggtttgtctgggttccaggcagtttggaaggatngcccctttcttatcccagcataataaaacaggagg

SEQ ID NO: 13264 - DNA, 71 bp, chicken (Gallus Gallus)
  misc_feature (36): n=c or t
aaggtgctgagttttaagtggacataaaaaagcctnctcctagggaattcaaaaataagttcatgatttgg

SEQ ID NO: 13265 - DNA, 71 bp, chicken (Gallus Gallus)
  misc_feature (36): n=c or t
agtacaactgagcagaacagagtgatttcctttccnagggatggttgttagggtgacgtggcgtgctgatg

SEQ ID NO: 13266 - DNA, 71 bp, chicken (Gallus Gallus)
  misc_feature (36): n=a or t
atctgcttcttgctccttgaggagtatcatttcaanaggatattaaaattcaccttttcctaagttgaaac

SEQ ID NO: 13267 - DNA, 71 bp, chicken (Gallus Gallus)
  misc_feature (36): n=c or t
gaagacatgcaagaggaaaagctacagaaaagagangcaaagagtattttttgctgttgtagtgctcatag

SEQ ID NO: 13268 - DNA, 71 bp, chicken (Gallus Gallus)
  misc_feature (36): n=a or g
ctttttgttgagccaagtgatttgcacgtggctcanatatatttatgtctcctgaagatgccaggagagga

SEQ ID NO: 13269 - DNA, 71 bp, chicken (Gallus Gallus)
  misc_feature (36): n=c or t
tctcatgttaaattattcaaataagcaagaccaaangctctcaacttcgccagagataatcaactaatgta

SEQ ID NO: 13270 - DNA, 71 bp, chicken (Gallus Gallus)
  misc_feature (36): n=a or g
tggaggactcaggcagcttagtcttccaaaaaacancgtaagatagaatatgatggattagtttctagtaa

SEQ ID NO: 13271 - DNA, 71 bp, chicken (Gallus Gallus)
  misc_feature (36): n=c or t
tgctttcacactgaaaagcctgatatgcaattgtcnaccttgggtgggattagatagaaaacgtcatgttc

SEQ ID NO: 13272 - DNA, 71 bp, chicken (Gallus Gallus)
  misc_feature (36): n=c or t
aacttcttgttttctgccacacaggtcatcaggagngaagggacagagggagcaaagttccgactctctgg

SEQ ID NO: 13273 - DNA, 71 bp, chicken (Gallus Gallus)
  misc_feature (36): n=c or t
cactttgtggagtgacttcaacgtaccatctgatcntctgcgttaacgttggctgccaaccactattccct

SEQ ID NO: 13274 - DNA, 71 bp, chicken (Gallus Gallus)
  misc_feature (36): n=a or g
tggagagctgtctacactattattaacggaaatccngggcagagttttgaaatccataccaatccccagac

SEQ ID NO: 13275 - DNA, 71 bp, chicken (Gallus Gallus)
  misc_feature (36): n=c or t
atttaagtgggaaaatcattgatggcccagtccgcntagatatttctgttattgatcaaaatgataacagg

SEQ ID NO: 13276 - DNA, 71 bp, chicken (Gallus Gallus)
  misc_feature (36): n=c or t
atgagatcagtggggatgtctctgtgacccgacccntggatagagaagcaatagccaattatgaggtgagt

SEQ ID NO: 13277 - DNA, 71 bp, chicken (Gallus Gallus)
  misc_feature (36): n=c or t
acaggtacaggaactttacacatcaccttggaggangtcaatgacaatgtcccctccctttacccaacact

SEQ ID NO: 13278 - DNA, 71 bp, chicken (Gallus Gallus)
  misc_feature (36): n=c or t
tcactttgcaagttgggcagattaggagcatatttngtggcctcagaggccgtgcagtgtgaggcagcctt

SEQ ID NO: 13279 - DNA, 71 bp, chicken (Gallus Gallus)
  misc_feature (36): n=c or t
cttcaatgctctgacgtgccgctctcaggtgagatngtcgtgtcagcaataatttctagtcttaaagaaaa

SEQ ID NO: 13280 - DNA, 71 bp, chicken (Gallus Gallus)
  misc_feature (36): n=a or c
gtggaatgaaggaagggaatcagaaaggtgaaggcncaagaactggtgggttctcactgtgtgtgcaagca

SEQ ID NO: 13281 - DNA, 71 bp, chicken (Gallus Gallus)
  misc_feature (36): n=c or t
tttaacacccaaaccttcacactcagtgctaccgtnctggcaactgccttgtgtaaaatcagttggtattt

SEQ ID NO: 13282 - DNA, 71 bp, chicken (Gallus Gallus)
  misc_feature (36): n=a or g
agttttctgaatgaaaaaaagggtaagttgcacacnacctgtgacctgatgggcacaacacccaggagtct

SEQ ID NO: 13283 - DNA, 71 bp, chicken (Gallus Gallus)
  misc_feature (36): n=a or g
taaagttgcagagactcatttaatcttctgagttgntgctgtgaaaccttgaagcatagactctgtgcagt

SEQ ID NO: 13284 - DNA, 71 bp, chicken (Gallus Gallus)
  misc_feature (36): n=a or g
gacaaagctgaatcttatcattagtcctattggagnatgaatatttattaatgaataaacttttgacttcc

SEQ ID NO: 13285 - DNA, 71 bp, chicken (Gallus Gallus)
  misc_feature (36): n=c or t
tcatataatgaagccaggttttcctagaaatatacncctaatcaatagaaaaataaatcattgctacagaa

SEQ ID NO: 13286 - DNA, 71 bp, chicken (Gallus Gallus)
  misc_feature (36): n=a or g
ccttgtgattgggccacagaaaaggatgttccactnttttgctttctgatggctactgcacacaccatggg

SEQ ID NO: 13287 - DNA, 71 bp, chicken (Gallus Gallus)
  misc_feature (36): n=a or g
gatgtgagcagagatgattttaaagtcttcctgcanaaagagctggcttcctaacatacttaccagaagta

SEQ ID NO: 13288 - DNA, 71 bp, chicken (Gallus Gallus)
  misc_feature (36): n=a or t
gaagaaggttcgatctctattgtttcacacaatacnaccagacaggcttttggccaggaaaccatctatga

SEQ ID NO: 13289 - DNA, 71 bp, chicken (Gallus Gallus)
  misc_feature (36): n=a or t
cagtgcctgatgaaaggaaatagccattttatggangatacagcctgaaagcagactagtgatggataaag

SEQ ID NO: 13290 - DNA, 71 bp, chicken (Gallus Gallus)
  misc_feature (36): n=c or t
cccccatggttgttacacccagatcaagattcaagnagcacctatgcagagtcacacagctgcatgggctc

SEQ ID NO: 13291 - DNA, 71 bp, chicken (Gallus Gallus)
  misc_feature (36): n=a or g
gtgatctattaatcctcaacacacgtcacgaggtcntgttctttcacctgtagctgggcaggagatggctt

SEQ ID NO: 13292 - DNA, 71 bp, chicken (Gallus Gallus)
  misc_feature (36): n=c or t
aatggccacgcaaattcctcgggacttaacagtatnggcacagaggatacggaactgacgggggacatccc

SEQ ID NO: 13293 - DNA, 71 bp, chicken (Gallus Gallus)
  misc_feature (36): n=a or t
ctgagatgctctgcaaggtatgttttttgagaccancttttttcccctacaaatgtggaagaggaagagaa

SEQ ID NO: 13294 - DNA, 71 bp, chicken (Gallus Gallus)
  misc_feature (36): n=a or c
ctcttccctctcctaaagtgcattggtgagcagagntgaactcatctcaaacaaccttctcatttcaacac

SEQ ID NO: 13295 - DNA, 71 bp, chicken (Gallus Gallus)
  misc_feature (36): n=c or t
tttctcccctttctacactgttttctgcttatcatnctgagcctctatggctgcagcaggtcaggagctaa

SEQ ID NO: 13296 - DNA, 71 bp, chicken (Gallus Gallus)
  misc_feature (36): n=a or g
ccacgtctgtgcattaacactcttttggacaagcantgtttcacaataaccaacctgagcctgcagcacca

SEQ ID NO: 13297 - DNA, 71 bp, chicken (Gallus Gallus)
  misc_feature (36): n=c or t
caggtgtgtgagcaggaaataacaaagcaccccacnattgtaggaattccttttataatttgtactaatcg

SEQ ID NO: 13298 - DNA, 71 bp, chicken (Gallus Gallus)
  misc_feature (36): n=g or t
taagcactcagtctgtgatcagaagcttccatactnctggcattctgaatgaatgttacagttagagcaga

SEQ ID NO: 13299 - DNA, 71 bp, chicken (Gallus Gallus)
  misc_feature (36): n=c or t
acaagcttttcctttgaaatgcaaaggtgcaagctnacttttccttttccacgttgacttctcttttatgc

SEQ ID NO: 13300 - DNA, 71 bp, chicken (Gallus Gallus)
  misc_feature (36): n=a or g
ccacttacctcaaaggaatattcaacgtttctttcnttcttcttgtgtgccagtccctttagttccacttt

SEQ ID NO: 13301 - DNA, 71 bp, chicken (Gallus Gallus)
  misc_feature (36): n=c or g
ttctgattctctactagttttgctcatcagccaagnaaacagctctctctgagcttccaccgcaagtagat

SEQ ID NO: 13302 - DNA, 71 bp, chicken (Gallus Gallus)
  misc_feature (36): n=a or g
gcatgacctcaggcacataacagagaccaaaaggcntatctaactttttgtaatagcagtaagaacacaag

SEQ ID NO: 13303 - DNA, 71 bp, chicken (Gallus Gallus)
  misc_feature (36): n=c or t
accaacgtggcggacgtccccagcaagcagatgctnccaacaagatgtccccgaccaataaagcaggcgac

SEQ ID NO: 13304 - DNA, 71 bp, chicken (Gallus Gallus)
  misc_feature (36): n=c or t
ttattgttgctgtcaccaactcacttactgtactcncctctgaaaccaacggctcccattgaacagttgat

SEQ ID NO: 13305 - DNA, 71 bp, chicken (Gallus Gallus)
  misc_feature (36): n=c or t
ggctcaatttactcagcttgactaattaaatactgntgattctaattcagaatactggttataactggctt

SEQ ID NO: 13306 - DNA, 71 bp, chicken (Gallus Gallus)
  misc_feature (36): n=c or t
aaacagctgtgtttgcttgaaaggatgatgcagggnttgctcaaagcctgtttctgtaggacatcgcttga

SEQ ID NO: 13307 - DNA, 71 bp, chicken (Gallus Gallus)
  misc_feature (36): n=a or g
gtgcacagtgcacgatggacagcacccagtgcacantgttccggtgctcaatgcacagtgagtgatacccg

SEQ ID NO: 13308 - DNA, 71 bp, chicken (Gallus Gallus)
  misc_feature (36): n=a or g
tgtgaaggggatgaagtgctgaagaactttctaacntggtcgtttttcaccacgtgggaaggcaatggtgc

SEQ ID NO: 13309 - DNA, 71 bp, chicken (Gallus Gallus)
  misc_feature (36): n=c or t
acgctgctattctttcccctccctttcctccaaaantctctccagtaactttaccttctccacaagccaac

SEQ ID NO: 13310 - DNA, 71 bp, chicken (Gallus Gallus)
  misc_feature (36): n=a or g
ggtggctggctttgtttagacgttacacccagccanctctttgtttcactgagcatttccattgctaattg

SEQ ID NO: 13311 - DNA, 71 bp, chicken (Gallus Gallus)
  misc_feature (36): n=a or g
gcagagagttctgatctggctgcaaacatttggacnttgggcctcttgagcataagaaatggaggaagtct

SEQ ID NO: 13312 - DNA, 71 bp, chicken (Gallus Gallus)
  misc_feature (36): n=a or g
gcagccaaagcatcatcttacttcccttgtttcacngaatggtcttagtgagtaaattaagcaacctacag

SEQ ID NO: 13313 - DNA, 71 bp, chicken (Gallus Gallus)
  misc_feature (36): n=a or g
catcttccaatctttccatctttcttcttgctcagngatgtgatttagcggagggttgttagggtagtttg

SEQ ID NO: 13314 - DNA, 71 bp, chicken (Gallus Gallus)
  misc_feature (36): n=c or g
tcagttgactgcccaatgcctccatgatctgattgncatgcgtagggtctttcagagatatattgttttgt

SEQ ID NO: 13315 - DNA, 71 bp, chicken (Gallus Gallus)
  misc_feature (36): n=a or g
ttggtgagtttagggtttgagtcacagctggagcantgcaggtcggctgacgggttggcacagagcagcga

SEQ ID NO: 13316 - DNA, 71 bp, chicken (Gallus Gallus)
  misc_feature (36): n=c or g
caactcttgtaggaagatggtgagaaggcaattcanagtaaagcaggataatagattggttgcttttgtcc

SEQ ID NO: 13317 - DNA, 71 bp, chicken (Gallus Gallus)
  misc_feature (36): n=a or g
tgcaggctggagaaataacggggatacaacttggcngaagtcagcttgtgcagagagtgctccggtgtgtg

SEQ ID NO: 13318 - DNA, 71 bp, chicken (Gallus Gallus)
  misc_feature (36): n=c or t
gtggaaaatgggatcttatctggcgtgcctcgactngctgagtgcgtcgtgcagcagagcgctgccgggca

SEQ ID NO: 13319 - DNA, 71 bp, chicken (Gallus Gallus)
  misc_feature (36): n=c or t
atggagtgggatggaaacagtgggctggatagcaangggcacagtggtgtggagtgggatggacgcagtgg

SEQ ID NO: 13320 - DNA, 71 bp, chicken (Gallus Gallus)
  misc_feature (36): n=c or t
ccccggtatgttgtgtaggagtaggggctgatcagnagtgggacatgcagcttctgggctgggtcagtgat

SEQ ID NO: 13321 - DNA, 71 bp, chicken (Gallus Gallus)
  misc_feature (36): n=a or g
acagctttgctactgtggctatctggaatgcaaccngtgggtattaaacgtgtttgacccaacacggaacg

SEQ ID NO: 13322 - DNA, 71 bp, chicken (Gallus Gallus)
  misc_feature (36): n=a or g
atcttcagtcaggtttttgtgtgtgagttggtgacntgttgagattgagaaggtggcaggcaggaaaattc

SEQ ID NO: 13323 - DNA, 71 bp, chicken (Gallus Gallus)
  misc_feature (36): n=a or g
cacctgagcaccagtaaagcgctccagctcaaatcngtgaggtgtccagcaaaaaacggtgccaaactggc

SEQ ID NO: 13324 - DNA, 71 bp, chicken (Gallus Gallus)
  misc_feature (36): n=g or t
tatgatattgtataattctaaatagcttaagtgacntgtctttattggctgtgtgggagaattggccttca

SEQ ID NO: 13325 - DNA, 71 bp, chicken (Gallus Gallus)
  misc_feature (36): n=a or g
agaggatcggaggcttgccagtgtgactcccatctntaaggaaagtcacaaggagaatcatgggaacttaa

SEQ ID NO: 13326 - DNA, 71 bp, chicken (Gallus Gallus)
  misc_feature (36): n=c or t
aggctgcaatatcagattagtgaggcttgatttctntgaagaatcttccagtctttagtatgtcagaaaaa

SEQ ID NO: 13327 - DNA, 71 bp, chicken (Gallus Gallus)
  misc_feature (36): n=a or g
agagccaagtttgaatgtctcctacagcttcctganaaccactagttcagaacctgtagctccatcggaat

SEQ ID NO: 13328 - DNA, 71 bp, chicken (Gallus Gallus)
  misc_feature (36): n=a or g
ttgaatgagacccaaatgataaaaacaataaaaacncataataaaaaagaaaccccactgatgaacctcgc

SEQ ID NO: 13329 - DNA, 71 bp, chicken (Gallus Gallus)
  misc_feature (36): n=c or t
tcaactcccttcatgaactccaggaactctgccaanggggagacatcagagatgagggctattaggtggca

SEQ ID NO: 13330 - DNA, 71 bp, chicken (Gallus Gallus)
  misc_feature (36): n=a or g
cagtgaagggttgctgtacttgccaagcaatccagnatcaccaccttcaggaaatacttatggcaaaatgg

SEQ ID NO: 13331 - DNA, 71 bp, chicken (Gallus Gallus)
  misc_feature (36): n=c or t
aagttgtatccccatttttcaagcatttcctctagngctactgcctttgtaattgatttcacatgcagtct

SEQ ID NO: 13332 - DNA, 71 bp, chicken (Gallus Gallus)
  misc_feature (36): n=c or t
gccagcagattggtgctccctgacaagtagtgctgngtggtggagccttcaaattccacatggagcctctg

SEQ ID NO: 13333 - DNA, 71 bp, chicken (Gallus Gallus)
  misc_feature (36): n=c or t
ctttctcccaagctgtttattgagccctctggtcanggactctgttcacagctttcctcctttttctcctc

SEQ ID NO: 13334 - DNA, 71 bp, chicken (Gallus Gallus)
  misc_feature (36): n=a or g
ccagctttagttgtcaaaactgagctacaatcacancctctctgtctgagcacccaccaggaagggaggca

SEQ ID NO: 13335 - DNA, 71 bp, chicken (Gallus Gallus)
  misc_feature (36): n=a or g
gggaaatgcttttcccttcctacagaaatacaagcncttacagtacaacagaatatattaagagccaacta

SEQ ID NO: 13336 - DNA, 71 bp, chicken (Gallus Gallus)
  misc_feature (36): n=a or g
tcttccaggtcaaagaaaataacttcacatatgaantggactttgctaaagtgtactggaacccccgactt

SEQ ID NO: 13337 - DNA, 71 bp, chicken (Gallus Gallus)
  misc_feature (36): n=a or g
tgtttttgtgttcccacaaagctgcctgcttgttgnttggtgctacacctgctgaagtatgctgctggaga

SEQ ID NO: 13338 - DNA, 71 bp, chicken (Gallus Gallus)
  misc_feature (36): n=a or g
agacatagtgagagtccaaaagataatcttgtcacnaacaggaaaattccttagatatcaggtttgttcta

SEQ ID NO: 13339 - DNA, 71 bp, chicken (Gallus Gallus)
  misc_feature (36): n=a or c
cagaagaaggctcagaaaacactcttgacagaaganctctggagtcagctgtgttccctcttctcattttc

SEQ ID NO: 13340 - DNA, 71 bp, chicken (Gallus Gallus)
  misc_feature (36): n=c or t
tttcctctagctcctttgagatcttcctccttcacnggaggacgcttctttttcactgggtctggctaata

SEQ ID NO: 13341 - DNA, 71 bp, chicken (Gallus Gallus)
  misc_feature (36): n=a or g
gttttgctggctatgttacgaacacatgcttcccanctgaggattctggccttgactgaaggaagctgtgt

SEQ ID NO: 13342 - DNA, 71 bp, chicken (Gallus Gallus)
  misc_feature (36): n=c or t
ctgaagtggttttgtgttccccattgtacaaccaangtggagccaacaatttttgtgaaactcagccaaat

SEQ ID NO: 13343 - DNA, 71 bp, chicken (Gallus Gallus)
  misc_feature (36): n=a or g
ggcctcagaagttctccatgcagaaggactgctcanttctgggtgtttgtaacttaaaaataggactgtga

SEQ ID NO: 13344 - DNA, 71 bp, chicken (Gallus Gallus)
  misc_feature (36): n=c or t
tccaaagggctgaagtccttctgcccgtgctgacanccccagaggtacacatcccgagtgcttcaagcagg

SEQ ID NO: 13345 - DNA, 71 bp, chicken (Gallus Gallus)
  misc_feature (36): n=a or g
aatgaaatacgtgcagacaaagcattagtgcagttnttctttcattgtgggctttgatccctagctgaaaa

SEQ ID NO: 13346 - DNA, 71 bp, chicken (Gallus Gallus)
  misc_feature (36): n=a or g
gcacacagaaatctgtttgtccaggaagcttaaatntctctcaaccaaaggtgcacaaatcctgcttcatt

SEQ ID NO: 13347 - DNA, 71 bp, chicken (Gallus Gallus)
  misc_feature (36): n=a or c
atatggactcaaacgataagctatagctcaattgtncacagactaatgcgctaatgcagttattcctaaca

SEQ ID NO: 13348 - DNA, 71 bp, chicken (Gallus Gallus)
  misc_feature (36): n=c or t
ctccctgaaaagctggtaatgtgaagtgtgggactngtaggcacgttggcagatgtcacactgatatcagg

SEQ ID NO: 13349 - DNA, 71 bp, chicken (Gallus Gallus)
  misc_feature (36): n=a or g
tccagtgcaatgcccacacccccaggagcagcctcngccgaagctcactttgtttcttaaaccaaagttaa

SEQ ID NO: 13350 - DNA, 71 bp, chicken (Gallus Gallus)
  misc_feature (36): n=c or t
gtataaagaagtagaaacaagcctaaaacatagccngggatctaaaatatccctctcctggccacctcctc

SEQ ID NO: 13351 - DNA, 71 bp, chicken (Gallus Gallus)
  misc_feature (36): n=a or c
ctgctctgtgttgattttctaccaaagagtacaagnctcttcatcccattcctacttccaccccatccatc

SEQ ID NO: 13352 - DNA, 71 bp, chicken (Gallus Gallus)
  misc_feature (36): n=a or g
tgaaggaattgtctagcaggttctttgaaatcaacnatatttgctatgtaagtgtcataagaagcgctgtt

SEQ ID NO: 13353 - DNA, 71 bp, chicken (Gallus Gallus)
  misc_feature (36): n=c or t
atgataacgtcacctcgagcttccatacaaacgtgntgcacacacgctgtcctgggagtgctttgcgaagg

SEQ ID NO: 13354 - DNA, 71 bp, chicken (Gallus Gallus)
  misc_feature (36): n=a or t
gctaaagaaagctgaacacgctgcttaccttgtganaaaacactgtctccaggaggttgatgatggaggct

SEQ ID NO: 13355 - DNA, 71 bp, chicken (Gallus Gallus)
  misc_feature (36): n=a or t
ttgggcagtgtggcagatgcgtgtaatactgatcangtaacacctggttagtcctcaaacactcggggagg

SEQ ID NO: 13356 - DNA, 71 bp, chicken (Gallus Gallus)
  misc_feature (36): n=a or g
tgcgtgacagtgccatgagcagcattaccagagaancacagggttattttagtcctctggcacacagaaat

SEQ ID NO: 13357 - DNA, 71 bp, chicken (Gallus Gallus)
  misc_feature (36): n=c or t
agcacaggcaggctaaacaacacaaagattgcaaanaaaatctgttgcaaaggggaaacagtcaccaaatg

SEQ ID NO: 13358 - DNA, 71 bp, chicken (Gallus Gallus)
  misc_feature (36): n=c or g
gaaactgcagggaaagcccaatgtaatgaagccagnaggattttttccctgtgagtagggagctggcgagc

SEQ ID NO: 13359 - DNA, 71 bp, chicken (Gallus Gallus)
  misc_feature (36): n=c or t
gcatctccttttttatacagagctgcagggcaacantgacaatatgaagttagtctgggcagaggaagtga

SEQ ID NO: 13360 - DNA, 71 bp, chicken (Gallus Gallus)
  misc_feature (36): n=a or g
tctgccaccccacacctgtgtgtaccgctgtcccanttccaaacctccccactaatttctcttggaagctt

SEQ ID NO: 13361 - DNA, 71 bp, chicken (Gallus Gallus)
  misc_feature (36): n=a or c
gcaggagagacgtgccaagaggagatgatgtgggangtaagctcaacctgaagacttccttggcaaaagcc

SEQ ID NO: 13362 - DNA, 71 bp, chicken (Gallus Gallus)
  misc_feature (36): n=c or t
cctttaatctgtccagatccaattatattaagtatncacaggtgaagcattagagaccgtgtgtctctttt

SEQ ID NO: 13363 - DNA, 71 bp, chicken (Gallus Gallus)
  misc_feature (36): n=a or g
tgttatttatggctgtagatttacctgtagaaaatntagtgttttgggaacaaatccatcagatgatacaa

SEQ ID NO: 13364 - DNA, 71 bp, chicken (Gallus Gallus)
  misc_feature (36): n=a or g
aaaacacgtgcaagtggaatatcgaagttatgtganatgaaagcaggaaatggttcgtttatgtgtttctt

SEQ ID NO: 13365 - DNA, 71 bp, chicken (Gallus Gallus)
  misc_feature (36): n=g or t
gtgttattagagatgtatattctatctgataagccntctaatacgaatctgtcttaaaagaggatctttta

SEQ ID NO: 13366 - DNA, 71 bp, chicken (Gallus Gallus)
  misc_feature (36): n=c or g
gggctttctctggtgatacatgacaaaggagtgcangcattcttctgttttaattagtgccaaaaggaagc

SEQ ID NO: 13367 - DNA, 71 bp, chicken (Gallus Gallus)
  misc_feature (36): n=c or t
aacactatgaaactaactgcaaacaatgatgagagntcttcctccctatttctcctaagtcttggtacaag

SEQ ID NO: 13368 - DNA, 71 bp, chicken (Gallus Gallus)
  misc_feature (36): n=a or g
taggaacagccggggctgtactcaaacctaccattnccaggctgcatgcattcctgtgccattcaggagat

SEQ ID NO: 13369 - DNA, 71 bp, chicken (Gallus Gallus)
  misc_feature (36): n=a or g
tctcccaggtaacagcaatgggatgagagggaatgncctcatgtttcaccacaggaggtcaccgtaggata

SEQ ID NO: 13370 - DNA, 71 bp, chicken (Gallus Gallus)
  misc_feature (36): n=a or g
ctttctgaaggccacgcagcctcacctcaccatgancctaagatctgctatattttgtacatgatgccaac

SEQ ID NO: 13371 - DNA, 71 bp, chicken (Gallus Gallus)
  misc_feature (36): n=a or g
acccggatggttgagccactctcattggcagacacntggtttttgctcagggaaaatgtgctaacaaggaa

SEQ ID NO: 13372 - DNA, 71 bp, chicken (Gallus Gallus)
  misc_feature (36): n=c or t
tcttggggagaagcagtaagtaggcagaaggttgtnggagtgtaggagcacagcacgtgggagggtgtcac

SEQ ID NO: 13373 - DNA, 71 bp, chicken (Gallus Gallus)
  misc_feature (36): n=a or t
cagcccaaaggttactataagttcatttaactacangaagctcattaacagagacccagagactatttctg

SEQ ID NO: 13374 - DNA, 71 bp, chicken (Gallus Gallus)
  misc_feature (36): n=c or t
atggcaggtgcccctctcccacccacgtggcacacncagcctgagcccacatttgatgtgagcattaagaa

SEQ ID NO: 13375 - DNA, 71 bp, chicken (Gallus Gallus)
  misc_feature (36): n=a or g
ttccttcttcctttgtagatctctagtgccttggtnatcaggtatttctctgtcgggatgcatgttctatt

SEQ ID NO: 13376 - DNA, 71 bp, chicken (Gallus Gallus)
  misc_feature (36): n=c or g
ctgccatcttggcaatacctgagatgatgttttgangttatcaggtcttaataaatcaaacacagctctct

SEQ ID NO: 13377 - DNA, 71 bp, chicken (Gallus Gallus)
  misc_feature (36): n=c or g
gcgtggaagttcaggtggaggaagagtcaccttaanacttgtgccttgaaatggaggcccttaaccagcag

SEQ ID NO: 13378 - DNA, 71 bp, chicken (Gallus Gallus)
  misc_feature (36): n=c or t
ccctgaagatgggaaaaagctgtccaaagagttttnttcctccaagagtaacacacatctttcctttgtaa

SEQ ID NO: 13379 - DNA, 71 bp, chicken (Gallus Gallus)
  misc_feature (36): n=g or t
attgtgttttaaaatgatgtgctgcctcgttctcancaagctctatttctgattttctgactgataacgaa

SEQ ID NO: 13380 - DNA, 71 bp, chicken (Gallus Gallus)
  misc_feature (36): n=a or g
tgctctggcagaactgagctgtaaaagacaccctcnctcacctggcgtggctgttgtgggccttggccagc

SEQ ID NO: 13381 - DNA, 71 bp, chicken (Gallus Gallus)
  misc_feature (36): n=a or g
ctggaagagctgtgtgatgtggcccacgagcacggngcaatcacttttgtggatgaagtgcatgctgtggg

SEQ ID NO: 13382 - DNA, 71 bp, chicken (Gallus Gallus)
  misc_feature (36): n=c or g
ctttctaatccaaattacttgccaatgcaatggctnaattcggcaggagtgtgtagatccaggcatgtgct

SEQ ID NO: 13383 - DNA, 71 bp, chicken (Gallus Gallus)
  misc_feature (36): n=g or t
tacagaatttaaatctggataactaaactctgtaancttattcctgacatgctcccctgttatttgtagcc

SEQ ID NO: 13384 - DNA, 71 bp, chicken (Gallus Gallus)
  misc_feature (36): n=g or t
tgaacagcttgcaggcttctttcccccaccacatcnttacagcaatgaaagtacatataagcaaacgttac

SEQ ID NO: 13385 - DNA, 71 bp, chicken (Gallus Gallus)
  misc_feature (36): n=c or t
aaatgaattgctcatacatggagctaaactgaatgntaagttaaaagaaggttgagtgttaactggctgtt

SEQ ID NO: 13386 - DNA, 71 bp, chicken (Gallus Gallus)
  misc_feature (36): n=c or t
agagattagggagataaatgaaggaaagtggtcaanagggtggtgactttgtccttttggtcactcaaaat

SEQ ID NO: 13387 - DNA, 71 bp, chicken (Gallus Gallus)
  misc_feature (36): n=a or g
tctgtttcttgtgctattattgcagagccctacgtntttgaagcaataaaacctataaaagtcaagtggca

SEQ ID NO: 13388 - DNA, 71 bp, chicken (Gallus Gallus)
  misc_feature (36): n=a or c
tcaactacattgacaagagtcattttattttttgtnatgttcataacagaatttttttctttacagtcagt

SEQ ID NO: 13389 - DNA, 71 bp, chicken (Gallus Gallus)
  misc_feature (36): n=a or g
tacaacaatttaaataattgagtcatattcaaatantaaggaagtagaagactctcacataagagcagctg

SEQ ID NO: 13390 - DNA, 71 bp, chicken (Gallus Gallus)
  misc_feature (36): n=a or g
gaaaaagcttagaagcagatttttgactgcctcacnttttttattgttctttaaacagcgcatccaagtaa

SEQ ID NO: 13391 - DNA, 71 bp, chicken (Gallus Gallus)
  misc_feature (36): n=a or g
tgccatactcggtgcaagttaatcaagtgtccaaangattaagagaattagcgggattaacacagttttaa

SEQ ID NO: 13392 - DNA, 71 bp, chicken (Gallus Gallus)
  misc_feature (36): n=c or t
atcttcaacagcttaatgctgtgaaatttaagtagntttttttttttttttttttttttttaatgtaccaa

SEQ ID NO: 13393 - DNA, 71 bp, chicken (Gallus Gallus)
  misc_feature (36): n=a or g
tgtggttgctgtggttgtggtagagggagaagctcnccaggctgggagaggaacagcaggaaaggaaggga

SEQ ID NO: 13394 - DNA, 71 bp, chicken (Gallus Gallus)
  misc_feature (36): n=c or t
aatattgcatatgagcagcaactgcacaccatgcantttcctaacactctcagtttacttctgtgatgctt

SEQ ID NO: 13395 - DNA, 71 bp, chicken (Gallus Gallus)
  misc_feature (36): n=c or g
ttacaagtacagcaatagaaggcaaatttctagagntcacatatcatcttcctaactaactgctctttgat

SEQ ID NO: 13396 - DNA, 71 bp, chicken (Gallus Gallus)
  misc_feature (36): n=c or t
tgcttgctctcccacataacaaagttttacctgctntgccaatagctatcctttcataaatatcctgtacc

SEQ ID NO: 13397 - DNA, 71 bp, chicken (Gallus Gallus)
  misc_feature (36): n=a or g
aacacaagcctctcagccatcattcattctactgcntgaggcctcaacatcacaggatgggtgccccacct

SEQ ID NO: 13398 - DNA, 71 bp, chicken (Gallus Gallus)
  misc_feature (36): n=g or t
ctttctaccagatataacagtctagagcaaattcanttctcccaagtgtcctttttatcagggcaagagaa

SEQ ID NO: 13399 - DNA, 71 bp, chicken (Gallus Gallus)
  misc_feature (36): n=c or g
ggaaagtacacgcagtaaagcttgtaaatgggctancagagagagcagatagatagcaggaaaacgaaagg

SEQ ID NO: 13400 - DNA, 71 bp, chicken (Gallus Gallus)
  misc_feature (36): n=a or g
gccttcatgaagaaatatatctaaacagctgttaangaaattctatagaaaacttgaatgaacaaatttga

SEQ ID NO: 13401 - DNA, 71 bp, chicken (Gallus Gallus)
  misc_feature (36): n=a or g
ttctgcattatcacaaactgctggctgccttttaangacttgaaaagctcattgcagagaaaatattctaa

SEQ ID NO: 13402 - DNA, 71 bp, chicken (Gallus Gallus)
  misc_feature (36): n=c or g
caggaacacaactgacttttgtaacaaaaagtaaanttctcctcatgtactgtgaatgagagataatgaaa

SEQ ID NO: 13403 - DNA, 71 bp, chicken (Gallus Gallus)
  misc_feature (36): n=c or t
cgttcttccatgatcccgtaatccacttttctgccngttgtgtcccgtactttgttcaccaactcctgcag

SEQ ID NO: 13404 - DNA, 71 bp, chicken (Gallus Gallus)
  misc_feature (36): n=a or g
cagtagtgttgctaattctcatgattctactgcaantagaatgatcctgtcctgcattccagccagacttt

SEQ ID NO: 13405 - DNA, 71 bp, chicken (Gallus Gallus)
  misc_feature (36): n=a or g
agccaaagttaagcagaactttaaatacttatgtangttattaaaacagatatcttcgtatggaaacaagt

SEQ ID NO: 13406 - DNA, 71 bp, chicken (Gallus Gallus)
  misc_feature (36): n=c or t
tctgttctgtgttgcacaggagaaaggcacacattnacactggtgctgcagcttgtctctgctgctataga

SEQ ID NO: 13407 - DNA, 71 bp, chicken (Gallus Gallus)
  misc_feature (36): n=a or c
cctcagtttgagtaattatttctaaaaagtcagtgntaaaacaatctgaaaaaagtgggagactgtttttg

SEQ ID NO: 13408 - DNA, 71 bp, chicken (Gallus Gallus)
  misc_feature (36): n=a or t
gctccttgctagctcaaacacagggaacatcagctnacttgtgggcatctgataaggtatgtcttctcttc

SEQ ID NO: 13409 - DNA, 71 bp, chicken (Gallus Gallus)
  misc_feature (36): n=g or t
agtgttttcttaaactcactgcttgactcaaatatntagttatgtatgcaatctgaagtccaggtgacccc

SEQ ID NO: 13410 - DNA, 71 bp, chicken (Gallus Gallus)
  misc_feature (36): n=c or g
gttaacgcacagtcatctgctagcctgtacaataantttatatgttttctatctgttccttatataaaaag

SEQ ID NO: 13411 - DNA, 71 bp, chicken (Gallus Gallus)
  misc_feature (36): n=a or g
ctttataaagtgccttttaactcttgggccaacgcntaatttctcagttctgtataaatattttaaaaact

SEQ ID NO: 13412 - DNA, 71 bp, chicken (Gallus Gallus)
  misc_feature (36): n=c or t
tacttgtcagtcagtagacaaaccagactagtaccngatttactaccactgttttccttactataagtaaa

SEQ ID NO: 13413 - DNA, 71 bp, chicken (Gallus Gallus)
  misc_feature (36): n=a or t
accatctcactaggatctcacacttcactgacattntacttcatttccagtgtcattcatagaagagaaag

SEQ ID NO: 13414 - DNA, 71 bp, chicken (Gallus Gallus)
  misc_feature (36): n=a or g
atcactttcattatggtccttaagggagtttgcacnctcagaataatattcacaattgacactgtgatact

SEQ ID NO: 13415 - DNA, 71 bp, chicken (Gallus Gallus)
  misc_feature (36): n=a or g
tatgcagagttaactgcacagggcaaatcacacaancaggggagagaccatctttaacgcatgcagctctc

SEQ ID NO: 13416 - DNA, 71 bp, chicken (Gallus Gallus)
  misc_feature (36): n=c or t
atctacaggagtgtgggagggatgagaagcagtganagaaggcagcttcttctctgcaaacagatgaaagg

SEQ ID NO: 13417 - DNA, 71 bp, chicken (Gallus Gallus)
  misc_feature (36): n=a or g
cataagcctcaattctaaagacatgaaataataccnttacaaacatgtcaacatatctagatgctacacat

SEQ ID NO: 13418 - DNA, 71 bp, chicken (Gallus Gallus)
  misc_feature (36): n=c or t
gagcaccagtcccacgatggaaccctgggggacacnaggtgcagccctgtcacaagtggacataaatccat

SEQ ID NO: 13419 - DNA, 71 bp, chicken (Gallus Gallus)
  misc_feature (36): n=a or t
gaatgaactctctagaatgacagtttcagtgggatnttttgccttcttcatatatagagcagtatttggaa

SEQ ID NO: 13420 - DNA, 71 bp, chicken (Gallus Gallus)
  misc_feature (36): n=c or t
agaggagggctattaaagtgatcagaggcctggagngcctcccctacgaggacaggctgagagagctgggg

SEQ ID NO: 13421 - DNA, 71 bp, chicken (Gallus Gallus)
  misc_feature (36): n=c or g
ttttgttcccctttgagatcctagttcttacaactntagcaattagaagatatcatattggtcttgtcaac

SEQ ID NO: 13422 - DNA, 71 bp, chicken (Gallus Gallus)
  misc_feature (36): n=c or t
attaatgttatagtaagtctgcttggttctttcggngatgagacctgttttcttctgggttgcagttgaag

SEQ ID NO: 13423 - DNA, 71 bp, chicken (Gallus Gallus)
  misc_feature (36): n=a or c
acactatattaaatgctcttctcaaatttaaccacnaggcatggcccttgcctttcttcaaactgtaggga

SEQ ID NO: 13424 - DNA, 71 bp, chicken (Gallus Gallus)
  misc_feature (36): n=g or t
cttttggtggtcctgtgctaaaatgctctttctacntcgacacttccaaagtgcatggcaataccaaaact

SEQ ID NO: 13425 - DNA, 71 bp, chicken (Gallus Gallus)
  misc_feature (36): n=c or t
gtgcacagagcagccctctgggctatgctctggggntttcacaaggcctgtttccctcctggacttgacag

SEQ ID NO: 13426 - DNA, 71 bp, chicken (Gallus Gallus)
  misc_feature (36): n=a or g
ccatcagcaaactaactccaaccacgtcaatcattnccagaatatctgcaacaacagctgctagtttttca

SEQ ID NO: 13427 - DNA, 71 bp, chicken (Gallus Gallus)
  misc_feature (36): n=c or t
gggtttcaaagtgatgaatcaaatgatctctcattnaactcaaaagagagcttcaactctaactcctatga

SEQ ID NO: 13428 - DNA, 71 bp, chicken (Gallus Gallus)
  misc_feature (36): n=c or t
gctcagacacttgtttcctagggcacagggagatgngctgcttcgtcactgccaaccattctgcaagcagc

SEQ ID NO: 13429 - DNA, 71 bp, chicken (Gallus Gallus)
  misc_feature (36): n=a or g
agagccattttaaggtgtgtgggggcagagaggagntgttctgctgttttcctgcaagtgttcctcaaaca

SEQ ID NO: 13430 - DNA, 71 bp, chicken (Gallus Gallus)
  misc_feature (36): n=a or g
taggatgagagggaatggcctcacgttgtgcctggngggtccaagtttgggcattaggaaaaacttctcca

SEQ ID NO: 13431 - DNA, 71 bp, chicken (Gallus Gallus)
  misc_feature (36): n=a or g
tcctattttcgagaactcaagaattctatgcaactnatttcttagtctcttattcaagcctatgttgtagg

SEQ ID NO: 13432 - DNA, 71 bp, chicken (Gallus Gallus)
  misc_feature (36): n=a or g
tataaactgaaccttgtcatcagtctccatttaaantaaaatggaaaaaaaatctctagccttactacttt

SEQ ID NO: 13433 - DNA, 71 bp, chicken (Gallus Gallus)
  misc_feature (36): n=a or t
tattctcttactctttactcagcctacctcagacanaaaaaacattcaacccaactgctgtactttgggca

SEQ ID NO: 13434 - DNA, 71 bp, chicken (Gallus Gallus)
  misc_feature (36): n=a or t
taaaatggcattatgagcaacctcaagctttccaantaggtagacatatttttggccattaaaaaaaaaaa

SEQ ID NO: 13435 - DNA, 71 bp, chicken (Gallus Gallus)
  misc_feature (36): n=c or t
tgaatttgggctacgtggagaacagatttaatgggngcaccagaacggccaacagcagcgctgtgccaccg

SEQ ID NO: 13436 - DNA, 71 bp, chicken (Gallus Gallus)
  misc_feature (36): n=c or t
acaactgctttcagtggggttcttacagtcccacgntcagcacttacattcatgcctttcagtgcagcaca

SEQ ID NO: 13437 - DNA, 71 bp, chicken (Gallus Gallus)
  misc_feature (36): n=c or t
gacttcgacctctgtatcacacacctgcctttttantatttgtctagaacactgagaagggggagggtacg

SEQ ID NO: 13438 - DNA, 71 bp, chicken (Gallus Gallus)
  misc_feature (36): n=a or g
aactaattgttgttcttacagtgttgtgaacaagcnccagagctgaacaaggagctgaaacctggcaccag

SEQ ID NO: 13439 - DNA, 71 bp, chicken (Gallus Gallus)
  misc_feature (36): n=a or c
atcaaccagagcttctagatacattagtacaatagnactgtacaagatgtatcaagggagccagatgccac

SEQ ID NO: 13440 - DNA, 71 bp, chicken (Gallus Gallus)
  misc_feature (36): n=c or t
aaacaaatcatcacagaaggagcttacgcagctgcnccagctctgggtaccaagagctccccatgataaca

SEQ ID NO: 13441 - DNA, 71 bp, chicken (Gallus Gallus)
  misc_feature (36): n=c or t
ctcattgatgagagctcgttgcagaggagtcaaaantgcctagaaaaaatccagcacgtgctctgcgagga

SEQ ID NO: 13442 - DNA, 71 bp, chicken (Gallus Gallus)
  misc_feature (36): n=a or c
tttaataggatttaatatttcctactttcagctacntaggcgagccatgtgaaaggactagccataatcca

SEQ ID NO: 13443 - DNA, 71 bp, chicken (Gallus Gallus)
  misc_feature (36): n=c or t
ttcacacacacatttagtgaactgatttcccacccntcctccaggcaaattgaagaacaattacatgcttt

SEQ ID NO: 13444 - DNA, 71 bp, chicken (Gallus Gallus)
  misc_feature (36): n=a or t
ataaacagatgtggggacacagcaactggatcttcnaacaatgaataaatgctgtttccagagatttcttt

SEQ ID NO: 13445 - DNA, 71 bp, chicken (Gallus Gallus)
  misc_feature (36): n=c or t
aaatcacactgtaggaaatattattactgtttacangttgacatatccacacattctgctgaaatgcagtg

SEQ ID NO: 13446 - DNA, 71 bp, chicken (Gallus Gallus)
  misc_feature (36): n=a or g
ttgaagagccttaagggcttttctgagataaccacnctcattttttcattgttgcaggagcacaagcagaa

SEQ ID NO: 13447 - DNA, 71 bp, chicken (Gallus Gallus)
  misc_feature (36): n=a or t
tactcagtcgtgagactttggcagaacccttgagtnctctttgccaaattcttagcaaattctgcgctggt

SEQ ID NO: 13448 - DNA, 71 bp, chicken (Gallus Gallus)
  misc_feature (36): n=c or t
ctaagcagagaccactaaaatctatgggactaattnagtactctttaataaaagagcatgaacagaaatcc

SEQ ID NO: 13449 - DNA, 71 bp, chicken (Gallus Gallus)
  misc_feature (36): n=a or g
agatagagaacgatttaagatgagaaataaaccacntgttcttatgtgcacttacattttattcatcagat

SEQ ID NO: 13450 - DNA, 71 bp, chicken (Gallus Gallus)
  misc_feature (36): n=c or g
ttttgctgcgatttatactgatggaagtctgggtcnccatataaagacagggtgataagtacttcatccac

SEQ ID NO: 13451 - DNA, 71 bp, chicken (Gallus Gallus)
  misc_feature (36): n=a or c
tgctggcctatggctagttcaaaaagaaaactaatncaaatgaaaaaaaaaaatcatgaagaggcattcat

SEQ ID NO: 13452 - DNA, 71 bp, chicken (Gallus Gallus)
  misc_feature (36): n=c or t
agtaatgcctcctatttattttcagggaaactacangggatataaagagtgcagtaacactgcttgattga

SEQ ID NO: 13453 - DNA, 71 bp, chicken (Gallus Gallus)
  misc_feature (36): n=g or t
tcacagaatgtcctatttttgtgctgtcagatacanaaaataaatggaaaactgaaagtgctaaaccaatt

SEQ ID NO: 13454 - DNA, 71 bp, chicken (Gallus Gallus)
  misc_feature (36): n=c or g
gttcttggtaatgccttttgatcagagcagtattgnctatggttatctttttttttgtctttgtttcatag

SEQ ID NO: 13455 - DNA, 71 bp, chicken (Gallus Gallus)
  misc_feature (36): n=a or c
aaaagaagtcatacctaccagaagaaaatatttctncttcttactctaaatactaaaactttctgacaagg

SEQ ID NO: 13456 - DNA, 71 bp, chicken (Gallus Gallus)
  misc_feature (36): n=a or t
ctcctgtgtaatagaagacagctttattttagagtnctagctgtagaacaaggctgtttgaaaatgtctac

SEQ ID NO: 13457 - DNA, 71 bp, chicken (Gallus Gallus)
  misc_feature (36): n=a or g
cctaatgctgtcttttaaaccagaaatttgtctccntctgtatttgaaacagcaagtgctctgtgctttga

SEQ ID NO: 13458 - DNA, 71 bp, chicken (Gallus Gallus)
  misc_feature (36): n=g or t
ggtcaatgaaatgtgtaagcctcagtgctccaaatnatctttgaggtctcttccaatccaagccattctat

SEQ ID NO: 13459 - DNA, 71 bp, chicken (Gallus Gallus)
  misc_feature (36): n=a or g
aaagacgtagcctgtcagacttgtcaactttgtaanggaatacagaaaacacagagaaaagggaattggag

SEQ ID NO: 13460 - DNA, 71 bp, chicken (Gallus Gallus)
  misc_feature (36): n=c or g
gaagtacaggcagttggggtacaatgtatttgtctntgtgtgtgtgtagagataatctctatataagcttt

SEQ ID NO: 13461 - DNA, 71 bp, chicken (Gallus Gallus)
  misc_feature (36): n=a or t
aaaggatgatattctgtgaggaattcctcctgactncagcagcatcactcgtggaaacagggtgctactgc

SEQ ID NO: 13462 - DNA, 71 bp, chicken (Gallus Gallus)
  misc_feature (36): n=c or t
atgccgcagataaatgtctcttcagacattaactcncactagtctcgctatactgcacacagaggccaaca

SEQ ID NO: 13463 - DNA, 71 bp, chicken (Gallus Gallus)
  misc_feature (36): n=a or g
aatgaattgccaagagaagcaaagaaataacaagangaaaatgtattcaggtgacttttcactttgccttg

SEQ ID NO: 13464 - DNA, 71 bp, chicken (Gallus Gallus)
  misc_feature (36): n=a or g
ctgcatcatctgttattctacatgaattacaccacntgttgtgtagtttccagatgtatcattgcaaatta

SEQ ID NO: 13465 - DNA, 71 bp, chicken (Gallus Gallus)
  misc_feature (36): n=c or t
ttttaattccattagttatcttccaatattaggtantgacaagataatgggcacaaattgttttgtaggca

SEQ ID NO: 13466 - DNA, 71 bp, chicken (Gallus Gallus)
  misc_feature (36): n=g or t
gggaaaagaggctggagacttgaaaatgaatcagangaagctgagagctgaaaagctggaaggaatatcgc

SEQ ID NO: 13467 - DNA, 71 bp, chicken (Gallus Gallus)
  misc_feature (36): n=c or g
ttccatttctattttgatgtttagtacaatcttgcnttgttaacagcacagtgctatatttctgtctttct

SEQ ID NO: 13468 - DNA, 71 bp, chicken (Gallus Gallus)
  misc_feature (36): n=a or g
agataagacaagaaataactgaaattagagaaaatntgagttagaatattaggaatctttcaatttcaagg

SEQ ID NO: 13469 - DNA, 71 bp, chicken (Gallus Gallus)
  misc_feature (36): n=a or c
tgttgtttgtttttttttaaaactctttttttatcntcgctagtccagataacatctttctttaaaagagt

SEQ ID NO: 13470 - DNA, 71 bp, chicken (Gallus Gallus)
  misc_feature (36): n=a or c
aaatcaaaatcatgaaataattcaaaaagccagcantaaaacatacaaaataaagggaaaagggaacatgg

SEQ ID NO: 13471 - DNA, 71 bp, chicken (Gallus Gallus)
  misc_feature (36): n=c or t
atcaaaacctcactttctgcctatcatatacagaanaaatgctgtagctcagaagcgccaggctgcagctt

SEQ ID NO: 13472 - DNA, 71 bp, chicken (Gallus Gallus)
  misc_feature (36): n=a or t
agcacatacacattgctcagaataatcacaaaaaantcagcaaaaatattttcagttactgttaaaaacca

SEQ ID NO: 13473 - DNA, 71 bp, chicken (Gallus Gallus)
  misc_feature (36): n=c or t
ttactcctctgcacagcagatatccagaaccttcantgaatactgtgtcatcaggagactgcctcatcact

SEQ ID NO: 13474 - DNA, 71 bp, chicken (Gallus Gallus)
  misc_feature (36): n=c or t
aatgcagccctcattctacttcctcagagcaactanggttgttttagatacctccaaccaactctaaatac

SEQ ID NO: 13475 - DNA, 71 bp, chicken (Gallus Gallus)
  misc_feature (36): n=a or c
gtattcctaatttaaaattcagcggcatactgaacnacttgctatcactttcaatgaaaggtataccttgt

SEQ ID NO: 13476 - DNA, 71 bp, chicken (Gallus Gallus)
  misc_feature (36): n=g or t
tgaaaagttgccttatacttcaacaggttagagtgngcatatatatatgtatatacaaaggccaatgcaat

SEQ ID NO: 13477 - DNA, 71 bp, chicken (Gallus Gallus)
  misc_feature (36): n=c or g
ggcagtaacttcttataagtatatagagagaattangttttacttacaaggtttgcagatgaggttttctg

SEQ ID NO: 13478 - DNA, 71 bp, chicken (Gallus Gallus)
  misc_feature (36): n=a or g
cacacgcagaaagattaagaaacagtgcgaacatgntgtaaaaagcagcgcaacgccgcgggctttccaga

SEQ ID NO: 13479 - DNA, 71 bp, chicken (Gallus Gallus)
  misc_feature (36): n=a or g
tggtctggaatctacttctgtgatgtcctctcagcnggctcccaaaaatttgaaatctattctcaagatat

SEQ ID NO: 13480 - DNA, 71 bp, chicken (Gallus Gallus)
  misc_feature (36): n=a or t
aatactaagaaaagccaaatgaaaccaactgaacanaaatgttttattctgacactcaacttctaacttgg

SEQ ID NO: 13481 - DNA, 71 bp, chicken (Gallus Gallus)
  misc_feature (36): n=a or c
ctgcagggagcagcctgtaggccaatacctgctgtnttgtatggattactggtacagaggcattaaacgtg

SEQ ID NO: 13482 - DNA, 71 bp, chicken (Gallus Gallus)
  misc_feature (36): n=a or g
cagagcgagccttgttgcatttacctgatcttcttntagctgtgagtgcctcagtttgtgagtcgtcctgg

SEQ ID NO: 13483 - DNA, 71 bp, chicken (Gallus Gallus)
  misc_feature (36): n=a or g
tcatagatgaaggacatctaaccaaagtggaagaancaaagcttttgaaaggttagatttatggattatat

SEQ ID NO: 13484 - DNA, 71 bp, chicken (Gallus Gallus)
  misc_feature (36): n=a or t
tcacggccgtgaaaccttactgattgcttctaacancagaaaagcacaatgtcaaatgacagcatgtgttt

SEQ ID NO: 13485 - DNA, 71 bp, chicken (Gallus Gallus)
  misc_feature (36): n=c or t
acagatatttctgctttgcaagaagaactacagacngtgcgagcggaactggaacggtggcggaaagatgc

SEQ ID NO: 13486 - DNA, 71 bp, chicken (Gallus Gallus)
  misc_feature (36): n=a or g
ggcgtggcctctctgagctattcccctttcaagggnaagggtgtgcatgtattgggagaaagtgtgtgggt

SEQ ID NO: 13487 - DNA, 71 bp, chicken (Gallus Gallus)
  misc_feature (36): n=c or t
aaaggcaccatttaagtttttcactcagctcactgntgctttaaaggctggatggcacggccctgaccctg

SEQ ID NO: 13488 - DNA, 71 bp, chicken (Gallus Gallus)
  misc_feature (36): n=g or t
gcataaggaggaggctactcgtttgaaaggtacttncttaatagggtgtcacagaccagcactaacagcat

SEQ ID NO: 13489 - DNA, 71 bp, chicken (Gallus Gallus)
  misc_feature (36): n=c or g
atggtaatggtgatttttattccaattaacagtgangtttttgagacattaatttttggatgcatttgctg

SEQ ID NO: 13490 - DNA, 71 bp, chicken (Gallus Gallus)
  misc_feature (36): n=a or g
gagttcagaacgtgttttcctcctctaacaggtccncacacagtcaatgtaacatatgatggcgtgcctgt

SEQ ID NO: 13491 - DNA, 71 bp, chicken (Gallus Gallus)
  misc_feature (36): n=c or t
agctacacacttacaacaccagcgatggccctctgngtctcgttttggtgcatctctggcctgagtgaaag

SEQ ID NO: 13492 - DNA, 71 bp, chicken (Gallus Gallus)
  misc_feature (36): n=c or t
ttggtggttggagccttttacatcttgttcttcacngtgatcatctatgtgaggctggatttctccatcac

SEQ ID NO: 13493 - DNA, 71 bp, chicken (Gallus Gallus)
  misc_feature (36): n=c or t
ttctgtcgttgctgctgactgaagaggaagtaaagntttgagatctttcaggtggtgttacgcaaaagcag

SEQ ID NO: 13494 - DNA, 71 bp, chicken (Gallus Gallus)
  misc_feature (36): n=c or t
acggcccaggtaactagtccctctggaagaaactcngatgcagaaatagtagaagttgacaaaaacaccta

SEQ ID NO: 13495 - DNA, 71 bp, chicken (Gallus Gallus)
  misc_feature (36): n=a or g
cgtttggttattgagtcaactctgattttagtctgnaataaaaccctttttgtttgacatcaggtagactt

SEQ ID NO: 13496 - DNA, 71 bp, chicken (Gallus Gallus)
  misc_feature (36): n=a or g
tgaagttctcctgcttttggctcagtcagatattcnagctgacttttaatacgttgttcagtttctccagc

SEQ ID NO: 13497 - DNA, 71 bp, chicken (Gallus Gallus)
  misc_feature (36): n=c or g
gtccatgcttaagtacagtcctctgctaaacaaacncaacttctcctctcccagggcttttctcttccttg

SEQ ID NO: 13498 - DNA, 71 bp, chicken (Gallus Gallus)
  misc_feature (36): n=a or g
gccatcaatgcactgtgtcagaagtaccctcgcaancacgctgtcctcatgaactttctcttcactatgct

SEQ ID NO: 13499 - DNA, 71 bp, chicken (Gallus Gallus)
  misc_feature (36): n=c or t
aagacttccatccctgtggaattaacgttagtttcnacattacggtgttctatgctttgtaaataacaaag

SEQ ID NO: 13500 - DNA, 71 bp, chicken (Gallus Gallus)
  misc_feature (36): n=a or g
aaccccaactctacacccagcttgctacaaaatccntttctccaggcttccctgtcttttgctgggcgata

SEQ ID NO: 13501 - DNA, 71 bp, chicken (Gallus Gallus)
  misc_feature (36): n=a or g
tcacacttaacattgaatactgaagaactgtaatcntctttcaaattttggaactgaagaattccagttaa

SEQ ID NO: 13502 - DNA, 71 bp, chicken (Gallus Gallus)
  misc_feature (36): n=a or g
gtgcaaggacattatcactgcatttaaaaatacggntcagatttgctacaaatacaaggaaattcataaaa

SEQ ID NO: 13503 - DNA, 71 bp, chicken (Gallus Gallus)
  misc_feature (36): n=c or t
cttgaagggaagagatggataataacatgcagaacnaagacgagttaaggagcttgcatccagtacgctct

SEQ ID NO: 13504 - DNA, 71 bp, chicken (Gallus Gallus)
  misc_feature (36): n=a or g
tctatcgttctataaagagaaaccgagcagcgtcanacagcactcactccaaccaggaaggagcccattag

SEQ ID NO: 13505 - DNA, 71 bp, chicken (Gallus Gallus)
  misc_feature (36): n=c or t
attatacccagatttggtttacaagatagctactcnaacccagaggccccagatgtgatgtgggatacccc

SEQ ID NO: 13506 - DNA, 71 bp, chicken (Gallus Gallus)
  misc_feature (36): n=c or t
tcctaggatgtagagagaagaaatcagtgatttctncagaactgctggcataattgtggcaaaccagagaa

SEQ ID NO: 13507 - DNA, 71 bp, chicken (Gallus Gallus)
  misc_feature (36): n=a or g
aataaatatttctgtattttacacccttccagcacnattttttcagtagtcgtcctactgacatgatttta

SEQ ID NO: 13508 - DNA, 71 bp, chicken (Gallus Gallus)
  misc_feature (36): n=g or t
ggtgaccaagagaagcaactcctaagcacaatttgntacaaaccagcatcagaagcacatcaagaatatcc

SEQ ID NO: 13509 - DNA, 71 bp, chicken (Gallus Gallus)
  misc_feature (36): n=a or g
ggcctatgtgaacttcttcctgcacggcattaactnttggcctcaggcctccttgctgctaggtatgtgca

SEQ ID NO: 13510 - DNA, 71 bp, chicken (Gallus Gallus)
  misc_feature (36): n=c or t
gcaactaataataaagttatgttttctgaacggagngtgtttgagggcatcatttgctatcaccatccctc

SEQ ID NO: 13511 - DNA, 71 bp, chicken (Gallus Gallus)
  misc_feature (36): n=g or t
tggactgctctgtcaggccagaattaaataacaagngttcctattactttgtcaatgataagatgctctat

SEQ ID NO: 13512 - DNA, 71 bp, chicken (Gallus Gallus)
  misc_feature (36): n=a or g
ccaacatgaaagcttatttacaaacttttatcattngatgaaagagtagggatttgcttcccgaatatcgt

SEQ ID NO: 13513 - DNA, 71 bp, chicken (Gallus Gallus)
  misc_feature (36): n=a or g
caaactgagaaccaaattcagcattcattaacttcngctggaagttttcctcaatttctgaatttctcaag

SEQ ID NO: 13514 - DNA, 71 bp, chicken (Gallus Gallus)
  misc_feature (36): n=a or g
taattacctgaattcttccttttctaactgtttcantgtcatgtcatcagttgtctgtgccatccattccc

SEQ ID NO: 13515 - DNA, 71 bp, chicken (Gallus Gallus)
  misc_feature (36): n=c or g
cacaaggatacctgagttttggtattccagggagcnagggctgatggaggacctgagtttcagtatcccag

SEQ ID NO: 13516 - DNA, 71 bp, chicken (Gallus Gallus)
  misc_feature (36): n=a or g
tctcattccatttttcactgaactacagctctaacngttttcctgggcctgccccaggcaaatcgattgcc

SEQ ID NO: 13517 - DNA, 71 bp, chicken (Gallus Gallus)
  misc_feature (36): n=c or t
taataatgctgtatttgcggtccttcagaacagtangctttaaagcaatcttgtgtaaaagcagcgtttaa

SEQ ID NO: 13518 - DNA, 71 bp, chicken (Gallus Gallus)
  misc_feature (36): n=a or g
tgaggcaggacccctgtgcaacttgttaccactccnctggtccggatcaactggttcaaatgtagttgcct

SEQ ID NO: 13519 - DNA, 71 bp, chicken (Gallus Gallus)
  misc_feature (36): n=c or g
ggacctggaccccatccgccccttggtgacctctgnagcccgtcatccatccccgtgttttgatatctgtg

SEQ ID NO: 13520 - DNA, 71 bp, chicken (Gallus Gallus)
  misc_feature (36): n=c or t
ggccatccctccatttcctggtagggctgcagctcngcaccacttatatcccatgtgcttctggtgaaatc

SEQ ID NO: 13521 - DNA, 71 bp, chicken (Gallus Gallus)
  misc_feature (36): n=a or g
tccgccagccgcctcttccgcaaaggacggtcttcntcttcatcgtcgctatctatgggttagggagacaa

SEQ ID NO: 13522 - DNA, 71 bp, chicken (Gallus Gallus)
  misc_feature (36): n=c or t
gtagatatccgtggactcttgggcactgctgaccanggaactgttaaactcttgtccagtgccactcatgt

SEQ ID NO: 13523 - DNA, 71 bp, chicken (Gallus Gallus)
  misc_feature (36): n=a or c
gcctccttcctaaaaatgcctgctacacaagaagtngaacctagcatgtgtccagttggctgggcgatgga

SEQ ID NO: 13524 - DNA, 71 bp, chicken (Gallus Gallus)
  misc_feature (36): n=a or t
catgggaggaattactgctcctctcccacttgattngttctgggagtgaaacgttgtgtgtatccaccagt

SEQ ID NO: 13525 - DNA, 71 bp, chicken (Gallus Gallus)
  misc_feature (36): n=c or t
tttaatgcctcacccacagctcaatggctgttacantgtcatttcttaactgtgcatttttagtagaatcc

SEQ ID NO: 13526 - DNA, 71 bp, chicken (Gallus Gallus)
  misc_feature (36): n=c or t
ccaccccctggaagagaagagagatgctgctgcagntattcctcttctgtcatgatgtggtttttaaaata

SEQ ID NO: 13527 - DNA, 71 bp, chicken (Gallus Gallus)
  misc_feature (36): n=c or g
cccattgaggtaatccatactgctaagagaccgccntaataaacacaacccatctggatcctttagagctg

SEQ ID NO: 13528 - DNA, 71 bp, chicken (Gallus Gallus)
  misc_feature (36): n=c or t
taatgtgctaaatgcaccttgagagatctgtgcacnggtcagcatgttgtgaaaaaaagcatgcacagcat

SEQ ID NO: 13529 - DNA, 71 bp, chicken (Gallus Gallus)
  misc_feature (36): n=g or t
acctaacaaaaccccaaatttcttttgaaacccttntgatggcagactatatgcactatatggctatcaga

SEQ ID NO: 13530 - DNA, 71 bp, chicken (Gallus Gallus)
  misc_feature (36): n=c or t
ttgggttgagaactttattggatatttttggctgangtctacattctggctgcagcatccctgtgtttggc

SEQ ID NO: 13531 - DNA, 71 bp, chicken (Gallus Gallus)
  misc_feature (36): n=a or g
ctcctgatcgctggggtgcaaggcagctgtcagatnttcatctggattttgtggatgtcacagatagccag

SEQ ID NO: 13532 - DNA, 71 bp, chicken (Gallus Gallus)
  misc_feature (36): n=c or g
ctgcaccatacatttccaaacatttgaaatggacgntgcctatagtatttgtttgatgggctatactggaa

SEQ ID NO: 13533 - DNA, 71 bp, chicken (Gallus Gallus)
  misc_feature (36): n=a or t
taaaaagaattctcctgaaggttgtagtagtcacanaccatttgcaaaatttgaactgaaacttccccctc

SEQ ID NO: 13534 - DNA, 71 bp, chicken (Gallus Gallus)
  misc_feature (36): n=a or g
ccatgcccagactgaccacactgctccccctcagcnctgaggtctgttagctgctgcctttctacttgatc

SEQ ID NO: 13535 - DNA, 71 bp, chicken (Gallus Gallus)
  misc_feature (36): n=a or g
cagtgcaaacacagctggctttcctaggacttgctngaagccagcaaactacaaaggcattaggtgcttag

SEQ ID NO: 13536 - DNA, 71 bp, chicken (Gallus Gallus)
  misc_feature (36): n=a or g
gaacttcctgctctcatgcagtgtgtagcacgtttnaaccttcctaggatttgtgctgaataaataaccaa

SEQ ID NO: 13537 - DNA, 71 bp, chicken (Gallus Gallus)
  misc_feature (36): n=a or g
cacttggctatactgcttagaacatcagtctgcaantgacggagctactcagactcccagcacagatccac

SEQ ID NO: 13538 - DNA, 71 bp, chicken (Gallus Gallus)
  misc_feature (36): n=c or t
ggaggcgtggataacaaagaaagtgggttatggacnccaccactgcctgttccaacctttgtgccgcatgg

SEQ ID NO: 13539 - DNA, 71 bp, chicken (Gallus Gallus)
  misc_feature (36): n=a or g
aacacacaaaaaaaagttttcacgggatttaaaaanaaaatccatattattcaggacaaaagttataaaat

SEQ ID NO: 13540 - DNA, 71 bp, chicken (Gallus Gallus)
  misc_feature (36): n=c or g
cgtgagtgcccgagcaattaaaaaccctaaagccanctcgctgtctccgggcccctctggggtacgcctat

SEQ ID NO: 13541 - DNA, 71 bp, chicken (Gallus Gallus)
  misc_feature (36): n=a or g
tatgtctgcctggcacctcagttagctccatccatnctaaaccacagtgtggacatggcacgtcaggtgtc

SEQ ID NO: 13542 - DNA, 71 bp, chicken (Gallus Gallus)
  misc_feature (36): n=a or g
agtgctagccaggcccagccattgatacaaggcttncagtgctaaatcccaaagctgcaaagttgcttcca

SEQ ID NO: 13543 - DNA, 71 bp, chicken (Gallus Gallus)
  misc_feature (36): n=a or g
gctccaggcagcccagctgtgcttagcacatgaatnctgataaagagagacgctggtgcaatgtgggaagt

SEQ ID NO: 13544 - DNA, 71 bp, chicken (Gallus Gallus)
  misc_feature (36): n=a or g
ctcaggcagtcttctataacattatgtacccaacancatattttagcactaacacctggtatgactgtttc

SEQ ID NO: 13545 - DNA, 71 bp, chicken (Gallus Gallus)
  misc_feature (36): n=c or t
acagcctccagtagaaagaaaagcacagcccattgnatacttgactgtcagtagctgagtaaataactccc

SEQ ID NO: 13546 - DNA, 71 bp, chicken (Gallus Gallus)
  misc_feature (36): n=c or t
gacactcctccatttgaagcttggccaccttccgtngagctgctcaactgttcatttttactctcttttaa

SEQ ID NO: 13547 - DNA, 71 bp, chicken (Gallus Gallus)
  misc_feature (36): n=a or g
gaaaataccaactcatttgtaatttggctctttacnagaaaaaacagtaaaaatcacaagcattgagggga

SEQ ID NO: 13548 - DNA, 71 bp, chicken (Gallus Gallus)
  misc_feature (36): n=a or g
caaagagggatggtggagggtgatatggtggtgatntaatggcagtagattttttttccacagtcttttga

SEQ ID NO: 13549 - DNA, 71 bp, chicken (Gallus Gallus)
  misc_feature (36): n=c or g
ccttgtttttgagttacgattagtgtctgcagcacncaggcatgcttgcctgggttaagattgaagcagaa

SEQ ID NO: 13550 - DNA, 71 bp, chicken (Gallus Gallus)
  misc_feature (36): n=a or c
ccagggaagcaggctccacatcctcttaacttctcngtagtgctcctgggtgttggagattgtttactttc

SEQ ID NO: 13551 - DNA, 71 bp, chicken (Gallus Gallus)
  misc_feature (36): n=c or t
ttcggactctgtggtaacctaaaactcattaactangctccctgcagtaacagctgtgtgtcacaaagcca

SEQ ID NO: 13552 - DNA, 71 bp, chicken (Gallus Gallus)
  misc_feature (36): n=a or g
tatgtgccagctcttgtttgctcatgtagtgttccnatagaagttgctgagatgaactgtggaaatgttga

SEQ ID NO: 13553 - DNA, 71 bp, chicken (Gallus Gallus)
  misc_feature (36): n=c or t
aagcagaaccacactcaacgtaaaaaacaccagcancaccttatttaaggaaagccaggcagggtgagtca

SEQ ID NO: 13554 - DNA, 71 bp, chicken (Gallus Gallus)
  misc_feature (36): n=c or t
tgcctttacttctgaccttcagcagctgggggcagngagtctggaattactgtgcattgcatggagaggtt

SEQ ID NO: 13555 - DNA, 71 bp, chicken (Gallus Gallus)
  misc_feature (36): n=a or g
tactggactgaggaatgggtatagtaatgaaaatgntgaaaaccatgatgttggtgttgggtttggacaag

SEQ ID NO: 13556 - DNA, 71 bp, chicken (Gallus Gallus)
  misc_feature (36): n=c or t
taaatgcacagctggagctttgcagcctgcctgaanctacttctatgtgaagccacccagaagcagcacgc

SEQ ID NO: 13557 - DNA, 71 bp, chicken (Gallus Gallus)
  misc_feature (36): n=a or g
attaaacactgctctgtgtctgacaagtgcctaccngtcctggcctactgtctgagctcctatgggatacc

SEQ ID NO: 13558 - DNA, 71 bp, chicken (Gallus Gallus)
  misc_feature (36): n=a or g
aaagcaggtggttctgctcagcaactcctccacacnactgagagaactttttgtggccaaaccagttctgc

SEQ ID NO: 13559 - DNA, 71 bp, chicken (Gallus Gallus)
  misc_feature (36): n=a or g
tgcgatgtaaagtaacttgcaaattagaattctctntacaaggtaatgagcttaatctgcagaaagaaaca

SEQ ID NO: 13560 - DNA, 71 bp, chicken (Gallus Gallus)
  misc_feature (36): n=c or g
gaaactcacaagctaaaaagatttccatattttacncatcactttgggataatgtgggcagtgccagaagt

SEQ ID NO: 13561 - DNA, 71 bp, chicken (Gallus Gallus)
  misc_feature (36): n=a or g
ttctttagcaagatctctagaaataaacactttcanccctgctaccagcagtctctaacctctccactacc

SEQ ID NO: 13562 - DNA, 71 bp, chicken (Gallus Gallus)
  misc_feature (36): n=c or t
gagctgctgggtaaggaaaatgatgcagggtcagangcaggtcagacttatttttcccccagtattattaa

SEQ ID NO: 13563 - DNA, 71 bp, chicken (Gallus Gallus)
  misc_feature (36): n=a or g
tagacataggtacttatgcaacaagtgtaaaaaccnccaacacatggagcacagaatgtagaaaaacaaca

SEQ ID NO: 13564 - DNA, 71 bp, chicken (Gallus Gallus)
  misc_feature (36): n=a or g
ctgtccatagatgaaatgatgggatgaatcttttcnctgaccaacaaagtttctggctccaaaaatgagtt

SEQ ID NO: 13565 - DNA, 71 bp, chicken (Gallus Gallus)
  misc_feature (36): n=c or g
agactgtctgcctgaacccgcaagctacttgttcanagactcagcctgtctaccatgaaagcatgcaggtt

SEQ ID NO: 13566 - DNA, 71 bp, chicken (Gallus Gallus)
  misc_feature (36): n=c or t
gttgtagatggctttgattcatgctagctttcaaanagtgcctgaggtcatcaccgactagaaacataccc

SEQ ID NO: 13567 - DNA, 71 bp, chicken (Gallus Gallus)
  misc_feature (36): n=a or g
ttaaaattaaggtaccgattgttcataggtgtacanaagtaatggaaagccattaaatagcacagaaggta

SEQ ID NO: 13568 - DNA, 71 bp, chicken (Gallus Gallus)
  misc_feature (36): n=c or t
cagagaactgctgtgctgtcacatccatcacctctnctaggttgatagaagaagacagttgaccagcttta

SEQ ID NO: 13569 - DNA, 71 bp, chicken (Gallus Gallus)
  misc_feature (36): n=a or t
ccatgatgaacacaaacctacagaacagaaagaggntacaaagcagctaagagcattcagctgttctactg

SEQ ID NO: 13570 - DNA, 71 bp, chicken (Gallus Gallus)
  misc_feature (36): n=a or t
ggaaagacaaagcaatctaaaacagcataaggcttnggtgcagagccctttctttgtgaataaagtaattg

SEQ ID NO: 13571 - DNA, 71 bp, chicken (Gallus Gallus)
  misc_feature (36): n=c or t
attggtacatgtgcttgctgtccctcttattattgnttagcagtctgtctatccattttttttaaaatata

SEQ ID NO: 13572 - DNA, 71 bp, chicken (Gallus Gallus)
  misc_feature (36): n=a or g
gtatgttcaacacggagctgtctttggttaacagcngagcaggagcatttatcagttccacccgttagacc

SEQ ID NO: 13573 - DNA, 71 bp, chicken (Gallus Gallus)
  misc_feature (36): n=a or g
agttcgacactgaataaaacacagagtaacgcagcngaaggtaaagagaagaaagaaaagaaagaaaagaa

SEQ ID NO: 13574 - DNA, 71 bp, chicken (Gallus Gallus)
  misc_feature (36): n=c or t
ggggcatctcactcacattggcttttctgagccagnctgtgcctcacatggccagtgttcaggatttaatt

SEQ ID NO: 13575 - DNA, 71 bp, chicken (Gallus Gallus)
  misc_feature (36): n=a or g
ttccgcacaccgctgccaagaacaactactttgcantgagagcaccatcgaggccgcagtgctgagctttc

SEQ ID NO: 13576 - DNA, 71 bp, chicken (Gallus Gallus)
  misc_feature (36): n=c or t
gaaggaggtgcacatctgtcctcctgcccatgcagnggagagatccattctgtgatgatgaggacagcagt

SEQ ID NO: 13577 - DNA, 71 bp, chicken (Gallus Gallus)
  misc_feature (36): n=c or t
ctgcacaatctgagatggaaaagagcagtcttaagntagaacacctgcactactcgagcattacagccccc

SEQ ID NO: 13578 - DNA, 71 bp, chicken (Gallus Gallus)
  misc_feature (36): n=a or g
ttgctccatgtcccatccaacctgagctagaaatcntggaggctgcagaattgatggaatgaaatacacaa

SEQ ID NO: 13579 - DNA, 71 bp, chicken (Gallus Gallus)
  misc_feature (36): n=a or c
acttctgctttaggcaagctttgttctgtttctccnggcagggcctctgttgctccctgtgtcctgagaga

SEQ ID NO: 13580 - DNA, 71 bp, chicken (Gallus Gallus)
  misc_feature (36): n=c or g
acaacaaaacaatgaagataatagtgtctatactgntgcccagtaaccacaggtactgtctgctgcccctt

SEQ ID NO: 13581 - DNA, 71 bp, chicken (Gallus Gallus)
  misc_feature (36): n=c or t
ctgcaaagccagtggaaaggttttcaaggaattgcntgagtttctggtcagatcctaagaagctttctcaa

SEQ ID NO: 13582 - DNA, 71 bp, chicken (Gallus Gallus)
  misc_feature (36): n=c or t
aattctattattttaggtcatcaaaatcaaacaganattgttgttatttagctgtatgtatgaaaaatata

SEQ ID NO: 13583 - DNA, 71 bp, chicken (Gallus Gallus)
  misc_feature (36): n=a or g
aaatgggaaaggttaagaacttcaaatacaaccaanaggatagtcagattttccaacgctggtttgaatat

SEQ ID NO: 13584 - DNA, 71 bp, chicken (Gallus Gallus)
  misc_feature (36): n=a or g
tttacgtttatggctgtgcctgcctgctttgcaganttttcgtattttcaggcttaaatgttctataataa

SEQ ID NO: 13585 - DNA, 71 bp, chicken (Gallus Gallus)
  misc_feature (36): n=a or g
ggtttctcatttaaatcaagattaattttgatgcantgtctattagcgttctgttttcttctctggactgt

SEQ ID NO: 13586 - DNA, 71 bp, chicken (Gallus Gallus)
  misc_feature (36): n=a or g
gcaggtcactgttgtcttcacttcctccaagagacntctttttttcctttgctcttttcttcaaatttact

SEQ ID NO: 13587 - DNA, 71 bp, chicken (Gallus Gallus)
  misc_feature (36): n=c or t
acttactcattccctatttggaatctgattgtattnctttgctggtacccttttgtcatgtgtttcttggt

SEQ ID NO: 13588 - DNA, 71 bp, chicken (Gallus Gallus)
  misc_feature (36): n=c or t
taagatcacatagtccaaccaccaacccatcgccantgtgtccactgaatcatgtccctaaaaatagacag

SEQ ID NO: 13589 - DNA, 71 bp, chicken (Gallus Gallus)
  misc_feature (36): n=c or t
gctctcaccatcccggttgaaatatgccatattcgngttgggtccggacaaaagctactgtgggtgagtct

SEQ ID NO: 13590 - DNA, 71 bp, chicken (Gallus Gallus)
  misc_feature (36): n=a or c
gacttatagcgacggggattccagttattattattnatttctttctaacccgaaactctccccaaaagtct

SEQ ID NO: 13591 - DNA, 71 bp, chicken (Gallus Gallus)
  misc_feature (36): n=c or t
cgtttactttcccttaaacaaaggatggctcatcantgagggctgtttttcctcagttatcacagcacaaa

SEQ ID NO: 13592 - DNA, 71 bp, chicken (Gallus Gallus)
  misc_feature (36): n=c or t
gagaatgaagaaccttaaaaaggactctgtacacantgtatctcagcaagctctttcaattaaaccatcac

SEQ ID NO: 13593 - DNA, 71 bp, chicken (Gallus Gallus)
  misc_feature (36): n=g or t
ggacattttggcttctctgaggctatgatttttttncaaaaaaaaaaaaaaagtattttgcagtttgatga

SEQ ID NO: 13594 - DNA, 71 bp, chicken (Gallus Gallus)
  misc_feature (36): n=g or t
tcaggttgaagacaaagcattgcaggagaaaaaatnacccattttgaaaggaaatcaggtgcaaaaagatg

SEQ ID NO: 13595 - DNA, 71 bp, chicken (Gallus Gallus)
  misc_feature (36): n=a or g
ctcctagggcaccatatttttgatcagaaacagtcncagaaacaagatttcaagcaggaaagcttcagagt

SEQ ID NO: 13596 - DNA, 71 bp, chicken (Gallus Gallus)
  misc_feature (36): n=c or t
ccaaacacctttgggcagggtgctagagaaccttanttgggctcctttttctcatgaaatgttggacctgg

SEQ ID NO: 13597 - DNA, 71 bp, chicken (Gallus Gallus)
  misc_feature (36): n=a or g
gttgcttatttagaagatgttgcttcaggtgtttcngtgatgcacctgtgttcatttgcatagggatgctg

SEQ ID NO: 13598 - DNA, 71 bp, chicken (Gallus Gallus)
  misc_feature (36): n=c or g
gcccttgtgcagcctgaattcctcacatttgtgganttagggttgcagcaaaagaaaccgaggatgccact

SEQ ID NO: 13599 - DNA, 71 bp, chicken (Gallus Gallus)
  misc_feature (36): n=c or t
tctcagtgcatctaaaatagcagccagaaaaataanagcgtcactggggaagccactggccctggaagcag

SEQ ID NO: 13600 - DNA, 71 bp, chicken (Gallus Gallus)
  misc_feature (36): n=c or g
gaccacggtgctgctaactgcacactgctcagtatntatgagaaaactatttgggatataaataaggcttc

SEQ ID NO: 13601 - DNA, 71 bp, chicken (Gallus Gallus)
  misc_feature (36): n=c or t
cgtggggttcatagggagcacccagcccaggtttcnttattgacacctgaaacatcagcttctgcacagga

SEQ ID NO: 13602 - DNA, 71 bp, chicken (Gallus Gallus)
  misc_feature (36): n=a or t
tcacgtgtatcgagactggcgctattaaacattcangcagatagcagtcagtaacgtctctgtctggagct

SEQ ID NO: 13603 - DNA, 71 bp, chicken (Gallus Gallus)
  misc_feature (36): n=c or t
ctcagaaagcaagtgcaattgccctgtgccctgttnaaaaccctcaggtggaattgggacactgcatgcat

SEQ ID NO: 13604 - DNA, 71 bp, chicken (Gallus Gallus)
  misc_feature (36): n=a or c
attgctcccacccttccccaagggctccacaagctnctctgcgatgacttcacctataataacaacttcca

SEQ ID NO: 13605 - DNA, 71 bp, chicken (Gallus Gallus)
  misc_feature (36): n=c or t
ccttattctggggaagaatattttatattggaaaantgggaacctgtgctttatcacttgtcaaatactac

SEQ ID NO: 13606 - DNA, 71 bp, chicken (Gallus Gallus)
  misc_feature (36): n=c or t
tcctggagaaaatgtattcacatgttgaattaagcntctttatattattatttttagatggaaaaaaattc

SEQ ID NO: 13607 - DNA, 71 bp, chicken (Gallus Gallus)
  misc_feature (36): n=c or t
attatactgcaagcaacttttgtcgctttcagaaantaaaggaaaaaaaacaaacagcacatgtccttttc

SEQ ID NO: 13608 - DNA, 71 bp, chicken (Gallus Gallus)
  misc_feature (36): n=a or g
agaggaaggggaggtctgaaaagctgcatgttgcanaaacaggaacgggggtttgcacctaccagtaaaaa

SEQ ID NO: 13609 - DNA, 71 bp, chicken (Gallus Gallus)
  misc_feature (36): n=a or c
gcaggggagcaagtgctggggcagagaggttgcccnaactgctgaattctgttgtgtctgctattaattgc

SEQ ID NO: 13610 - DNA, 71 bp, chicken (Gallus Gallus)
  misc_feature (36): n=g or t
agcccccagaactgctgccctacaccccagtggtgncaataaataacccaaagttcaggacaacagaatga

SEQ ID NO: 13611 - DNA, 71 bp, chicken (Gallus Gallus)
  misc_feature (36): n=a or g
ataatgcataaactaatcacattctagcagcaccanttctgagatttcctaaccttggaaccccattctct

SEQ ID NO: 13612 - DNA, 71 bp, chicken (Gallus Gallus)
  misc_feature (36): n=a or g
cgatcagggcccagattcagagagtaatttgggtcnggagtgatctctggaggtctttgggttatctctga

SEQ ID NO: 13613 - DNA, 71 bp, chicken (Gallus Gallus)
  misc_feature (36): n=a or g
cttaggaaaatatgaatgcaatgcaagactaaaccnaacaaaaagcctcaaacaatttacagcaagtacac

SEQ ID NO: 13614 - DNA, 71 bp, chicken (Gallus Gallus)
  misc_feature (36): n=c or t
tttcccccggtgctctcccctctggcttttccactnttctgctgctgttcgcacccagcacttctaacaca

SEQ ID NO: 13615 - DNA, 71 bp, chicken (Gallus Gallus)
  misc_feature (36): n=c or t
gagtctggcttgaaaaaggacctcctccaaaacacngctgccacccagagaagattaacaaactcaaggga

SEQ ID NO: 13616 - DNA, 71 bp, chicken (Gallus Gallus)
  misc_feature (36): n=c or t
gtctgataacataatgtctttattcccttcagcagngtccccagtcctaggtctatagtggcagaggcaca

SEQ ID NO: 13617 - DNA, 71 bp, chicken (Gallus Gallus)
  misc_feature (36): n=a or t
gactgttggaagcaacctgctcttcacctgcactgncactgagaaagtggaaatgcacagcactgaaggct

SEQ ID NO: 13618 - DNA, 71 bp, chicken (Gallus Gallus)
  misc_feature (36): n=a or g
gctcagtgatgctgctctggtccctatgatgccatncctggggaatgctctgcagccaagatggcctttgc

SEQ ID NO: 13619 - DNA, 71 bp, chicken (Gallus Gallus)
  misc_feature (36): n=a or t
tggttggactggaactggcttgtgtatatataaatntagggtttttttgttggtttttttttttcttaaac

SEQ ID NO: 13620 - DNA, 71 bp, chicken (Gallus Gallus)
  misc_feature (36): n=c or t
aattacttagaaacccgccaattcgaattaacgtgncttggatgagggcaagattcgccatactgaaatca

SEQ ID NO: 13621 - DNA, 71 bp, chicken (Gallus Gallus)
  misc_feature (36): n=a or g
tgcagatatgtctcatgccactttcatgggtggtcnagttcagctgaagatcagagacacaatgtgtgtca

SEQ ID NO: 13622 - DNA, 71 bp, chicken (Gallus Gallus)
  misc_feature (36): n=c or t
ttaaacaggaaaacgaatacgtggatgagagcgttngtggctgattccatcagagctggaagctgccttga

SEQ ID NO: 13623 - DNA, 71 bp, chicken (Gallus Gallus)
  misc_feature (36): n=a or t
aagcaagaagacaactctaccaaatataatcaaacntcttccttacttttccatcccaggtaattcctaca

SEQ ID NO: 13624 - DNA, 71 bp, chicken (Gallus Gallus)
  misc_feature (36): n=a or g
gagagctcttttgtcacatttaaggttgcttctggnagtttttgcaggttatgtctaattttaaaatcatc

SEQ ID NO: 13625 - DNA, 71 bp, chicken (Gallus Gallus)
  misc_feature (36): n=c or t
ctgtcagaaggcagttttgggactgtaagtagggcntagctttctactcgtggtgaaatttcattccaggt

SEQ ID NO: 13626 - DNA, 71 bp, chicken (Gallus Gallus)
  misc_feature (36): n=c or t
agtaacgtgttggtgatgattcaaggtgtgcaaggngaggggcaagttctcagtgagacaaatctctgtag

SEQ ID NO: 13627 - DNA, 71 bp, chicken (Gallus Gallus)
  misc_feature (36): n=a or g
gagaggtgtaaagctgagtgaatggcagtgaggacntacagtggctctttaagaaataattacacatggta

SEQ ID NO: 13628 - DNA, 71 bp, chicken (Gallus Gallus)
  misc_feature (36): n=c or t
ttcataactaaactgatgccacctttagatctgggnactactttactggacaactaataaattagttgaaa

SEQ ID NO: 13629 - DNA, 71 bp, chicken (Gallus Gallus)
  misc_feature (36): n=a or g
cctttaaagccatcagcttctcctctgagaccagantagcagtgctttaattcccctttgcattcgggaaa

SEQ ID NO: 13630 - DNA, 71 bp, chicken (Gallus Gallus)
  misc_feature (36): n=c or t
gagtgttttcattactatgcccccatatgaaatcantccgctagtctaatatccacagattgcagtgtgaa

SEQ ID NO: 13631 - DNA, 71 bp, chicken (Gallus Gallus)
  misc_feature (36): n=c or t
cctaacacagaacttaacaccaagcgtctgggtcangtaaaaggtgacatgtgttggtgaggaaatgcatt

SEQ ID NO: 13632 - DNA, 71 bp, chicken (Gallus Gallus)
  misc_feature (36): n=a or g
ctcctctcagagcacagcaggtagctgtaggacctnatgtctgtctgcccataacctcttttgggtgattt

SEQ ID NO: 13633 - DNA, 71 bp, chicken (Gallus Gallus)
  misc_feature (36): n=c or t
gcccccccatctgttaaatgaaagtgatcacacttngcatgcaaagcgcctcacgttcctctggcaaacac

SEQ ID NO: 13634 - DNA, 71 bp, chicken (Gallus Gallus)
  misc_feature (36): n=c or t
tcagtctcatcacatctgtcatcaggacttttcccnaaggatgcatttatagacacttctttccaaaacca

SEQ ID NO: 13635 - DNA, 71 bp, chicken (Gallus Gallus)
  misc_feature (36): n=c or g
aggaagacaaagtaactcaaggacttaaggtggacnaagacacctccagcaagtaagaatatccgagcaaa

SEQ ID NO: 13636 - DNA, 71 bp, chicken (Gallus Gallus)
  misc_feature (36): n=g or t
tcacctgcagcaggaggataaaatcatgatcggtgntttttttcagtcttaattgtgctccggctcctatg

SEQ ID NO: 13637 - DNA, 71 bp, chicken (Gallus Gallus)
  misc_feature (36): n=a or g
gcctttcagccttgcttatatcattcattacagggnacgaatttgatgaacagaagggatgtaaagaacac

SEQ ID NO: 13638 - DNA, 71 bp, chicken (Gallus Gallus)
  misc_feature (36): n=a or g
caaggaattcagggctcctctaagaatattaaaagngtaactttttttgttgtataattaaatgttctggt

SEQ ID NO: 13639 - DNA, 71 bp, chicken (Gallus Gallus)
  misc_feature (36): n=c or t
ttgcatttggtcatttggtcaagcagttgtccaggngtcagtagggtgggcaatccttgcatcctttgcct

SEQ ID NO: 13640 - DNA, 71 bp, chicken (Gallus Gallus)
  misc_feature (36): n=c or t
tacccacttcaagtgcacaccagtactgatgccccntggatgatgttctccaaggaaattttgtctctgct

SEQ ID NO: 13641 - DNA, 71 bp, chicken (Gallus Gallus)
  misc_feature (36): n=c or t
ttaaggacaaacaaataccctgttttttttcctatnctctgtacccggtgtatattgggtttggttttggg

SEQ ID NO: 13642 - DNA, 71 bp, chicken (Gallus Gallus)
  misc_feature (36): n=g or t
tggtaaaactgtgcgatactcataaccaatatgggntctgtcctcacctcacattcctcctttggtagctg

SEQ ID NO: 13643 - DNA, 71 bp, chicken (Gallus Gallus)
  misc_feature (36): n=a or c
ggcatcttctgtggcctgtagttggttactggctgnttcattctgcagagtctctgaagcaatgcatgttg

SEQ ID NO: 13644 - DNA, 71 bp, chicken (Gallus Gallus)
  misc_feature (36): n=a or g
tcctgttcaggtgtagagagccagttaagcgagcantgagctggcctgcggagctgctcgtcagaaaggag

SEQ ID NO: 13645 - DNA, 71 bp, chicken (Gallus Gallus)
  misc_feature (36): n=a or g
agagtcatcacagacagagacaaccagatctgacanggatgtccgaagcagaagacataaaatagcaaatt

SEQ ID NO: 13646 - DNA, 71 bp, chicken (Gallus Gallus)
  misc_feature (36): n=c or t
cacagcactgcacagcagccctcccatatcctttcncttctcttcccttagacttcttctggacttgaatg

SEQ ID NO: 13647 - DNA, 71 bp, chicken (Gallus Gallus)
  misc_feature (36): n=a or g
actgaatgaccaagagagtatcaactgtacgctgcnctcagcgtggcgaagcctcgtgctgccaataacca

SEQ ID NO: 13648 - DNA, 71 bp, chicken (Gallus Gallus)
  misc_feature (36): n=a or t
accttttgttaattctttttccagccataactgatnttcatattgctgcagctctgtgtctctatctccca

SEQ ID NO: 13649 - DNA, 71 bp, chicken (Gallus Gallus)
  misc_feature (36): n=c or t
caacactagcattggatgcaaacattgcatatcaangatgagcactaccagccctgtggcaagttgggaag

SEQ ID NO: 13650 - DNA, 71 bp, chicken (Gallus Gallus)
  misc_feature (36): n=a or g
gggttgggtaaataaactaactgcaaagctcatccntaagaaaaaaaaaagtgaagggctagcctatgtga

SEQ ID NO: 13651 - DNA, 71 bp, chicken (Gallus Gallus)
  misc_feature (36): n=c or t
ttttccaagcaacaagctcaagtaaaaaataacaangatggaagccataaacataccttcccttgttctgt

SEQ ID NO: 13652 - DNA, 71 bp, chicken (Gallus Gallus)
  misc_feature (36): n=a or g
gaagtctgtaaattatgttgcttgtttttcatctangaattatgtgcaaaccaagctttgtatgctctgaa

SEQ ID NO: 13653 - DNA, 71 bp, chicken (Gallus Gallus)
  misc_feature (36): n=c or g
tccaaacctttcctgatgtacactaacatttgcctnctaaatcacaaagctgaatgcaacaaccacagcgc

SEQ ID NO: 13654 - DNA, 71 bp, chicken (Gallus Gallus)
  misc_feature (36): n=c or t
aggacatgaaatattaggggaccattattacggttntgtgatgagaaatcagacctctcttttcaaggccc

SEQ ID NO: 13655 - DNA, 71 bp, chicken (Gallus Gallus)
  misc_feature (36): n=a or t
ctgaggtttctgtctcaagacaaaggaaagggggcntctctttcccaactctccttttctcatcctctttt

SEQ ID NO: 13656 - DNA, 71 bp, chicken (Gallus Gallus)
  misc_feature (36): n=a or g
aaaaaccataaaggagtatttactgttcccagctanaggagtttttctttctgagttctcagtcttcctag

SEQ ID NO: 13657 - DNA, 71 bp, chicken (Gallus Gallus)
  misc_feature (36): n=a or t
agtgcctgaccaagactggcccatatgcatgtcccntaccatgtggcattgtgcttagtagtaaaacgtgg

SEQ ID NO: 13658 - DNA, 71 bp, chicken (Gallus Gallus)
  misc_feature (36): n=c or t
aacaaaatactccttatgttatgaacaacgtttganattactttgttcttatataaaggtgctaaagtgtt

SEQ ID NO: 13659 - DNA, 71 bp, chicken (Gallus Gallus)
  misc_feature (36): n=a or g
tttgtaagatgaaagaaatagtgcttccatgcagancgttcaaaggaatttacatagtttgtaggagttgg

SEQ ID NO: 13660 - DNA, 71 bp, chicken (Gallus Gallus)
  misc_feature (36): n=a or c
ttgataaaaaagcctattttgattttgttaattctnctatggaaagctggttttacattaaactttttttt

SEQ ID NO: 13661 - DNA, 71 bp, chicken (Gallus Gallus)
  misc_feature (36): n=a or t
gcagcacatctgtgctttcttgaaaatatctctagngtgattcatagaatcgctcgctcaggttggaaaag

SEQ ID NO: 13662 - DNA, 71 bp, chicken (Gallus Gallus)
  misc_feature (36): n=g or t
ttctctaagaagaagagtttgagtgaagaggttagngtgtaagcagtcgtcagttgaaattgcagaacatc

SEQ ID NO: 13663 - DNA, 71 bp, chicken (Gallus Gallus)
  misc_feature (36): n=c or t
ccagcactgaacactgttacattaatttcctaaaanatgaaagtctgcagtgaacaaacttctgattttgc

SEQ ID NO: 13664 - DNA, 71 bp, chicken (Gallus Gallus)
  misc_feature (36): n=g or t
agttttcctttcattttccttttaaagttgtgaagntacataccacctggagggctaggaatgtatacacc

SEQ ID NO: 13665 - DNA, 71 bp, chicken (Gallus Gallus)
  misc_feature (36): n=c or t
ctgtcgaaccaccatgacatttcaatgctagcacantcagaaacacagtcaccaactgctattaaactaat

SEQ ID NO: 13666 - DNA, 71 bp, chicken (Gallus Gallus)
  misc_feature (36): n=c or t
aagaaaactcattttcccatctgctttcaacctttncctctttgtcctggatatttgtagcaaaggagaca

SEQ ID NO: 13667 - DNA, 71 bp, chicken (Gallus Gallus)
  misc_feature (36): n=c or t
gtcatcatgagctgtatcagaggagatcttgaaaanatacatgttgtcatatccattcttggagtagtatc

SEQ ID NO: 13668 - DNA, 71 bp, chicken (Gallus Gallus)
  misc_feature (36): n=a or g
ctcatcttgctcttaaatatctcaactgccattacntgcaactgcctttaccacctcctctcacgacctag

SEQ ID NO: 13669 - DNA, 71 bp, chicken (Gallus Gallus)
  misc_feature (36): n=a or g
tccagttttaagtgtccaattttgacgcttactganaaattctgcactttgttagataataccaaaataaa

SEQ ID NO: 13670 - DNA, 71 bp, chicken (Gallus Gallus)
  misc_feature (36): n=a or g
tggaggaggttcccattgtggcttaggccagccctncacacggtaagagtttaagactgccaggagggaaa

SEQ ID NO: 13671 - DNA, 71 bp, chicken (Gallus Gallus)
  misc_feature (36): n=c or g
tgagcaaaagaacgtatctacgggagattttatctnactgagccaattacctgataagatatgcagatcca

SEQ ID NO: 13672 - DNA, 71 bp, chicken (Gallus Gallus)
  misc_feature (36): n=c or t
cacatgtactcaatatatatctgtatatttatatangtataaatccatattacatatgtgaatttgaggct

SEQ ID NO: 13673 - DNA, 71 bp, chicken (Gallus Gallus)
  misc_feature (36): n=a or g
tacttaatggctgaaaaacgtacagctaattggaancccactcctgaattggaagaattgtagaactgcaa

SEQ ID NO: 13674 - DNA, 71 bp, chicken (Gallus Gallus)
  misc_feature (36): n=a or g
ctccataatctgcaccaatatggcccctgcaccttnctcagattactgtgttttcctgccaaagtgaacac

SEQ ID NO: 13675 - DNA, 71 bp, chicken (Gallus Gallus)
  misc_feature (36): n=c or t
atagcttggtgactggccgtgagtgaatggaagagnagcacaggatctgccaggctgtggactggctgttt

SEQ ID NO: 13676 - DNA, 71 bp, chicken (Gallus Gallus)
  misc_feature (36): n=c or t
gggtgcaaacacaccagaaaaaaataacaggcttcntcattgtatgtttgcttgtctttcagagacaaaca

SEQ ID NO: 13677 - DNA, 71 bp, chicken (Gallus Gallus)
  misc_feature (36): n=a or c
atccagatggccaacacatggagaacagagaatggntctattgagctaaagcaggaagaacctttggttga

SEQ ID NO: 13678 - DNA, 71 bp, chicken (Gallus Gallus)
  misc_feature (36): n=c or g
agttcgtgctatgtttaaacaagctagcttttaaanagggcagagaaagccatagcctttgttttctctct

SEQ ID NO: 13679 - DNA, 71 bp, chicken (Gallus Gallus)
  misc_feature (36): n=a or g
acagagccccagcacagcctggcagccatctcctangcagacacatgaatgctgcagtgatgaatccatta

SEQ ID NO: 13680 - DNA, 71 bp, chicken (Gallus Gallus)
  misc_feature (36): n=c or t
ataaggatgtgatgatcccattgaacccagctacanggcagggcacatctttcctattgaggctttgttac

SEQ ID NO: 13681 - DNA, 71 bp, chicken (Gallus Gallus)
  misc_feature (36): n=a or g
ttcactaaatagtaaattaagaagatgctatgcacnttatttatgttactgtgtcctttagtaccatataa

SEQ ID NO: 13682 - DNA, 71 bp, chicken (Gallus Gallus)
  misc_feature (36): n=a or g
tctgagccttacaaccagctcatgaaagaggatganctggcagtacaaaagcagatctgcagcagaaaaca

SEQ ID NO: 13683 - DNA, 71 bp, chicken (Gallus Gallus)
  misc_feature (36): n=c or t
atagaagtttttagcaagtgaaggttaaagatgttntcagtgaaaaagaaaataggccaccaccagtatgt

SEQ ID NO: 13684 - DNA, 71 bp, chicken (Gallus Gallus)
  misc_feature (36): n=c or t
attgactgtttttgtggtttttcccttagtttcacnatgctgtgatgcttttttttttttttttggcaagg

SEQ ID NO: 13685 - DNA, 71 bp, chicken (Gallus Gallus)
  misc_feature (36): n=a or g
taagtctatcttggaatacacagtgagagatttctngacagtccctgtaagtgggtcctcttttcctctgc

SEQ ID NO: 13686 - DNA, 71 bp, chicken (Gallus Gallus)
  misc_feature (36): n=a or g
gagaaaaaagaatccagggatttttcctgtttcctngataaagaccttgggtcctgcatgatttactggct

SEQ ID NO: 13687 - DNA, 71 bp, chicken (Gallus Gallus)
  misc_feature (36): n=c or t
ttcctagtctgacattgaaaacaacagcagcctatnagcttgaaaaggcttggagagccaagtggagaaaa

SEQ ID NO: 13688 - DNA, 71 bp, chicken (Gallus Gallus)
  misc_feature (36): n=c or g
ttcaactgccacgacgtctccataaactcattggantacagcttagaaggcagctgctttcctttcccagt

SEQ ID NO: 13689 - DNA, 71 bp, chicken (Gallus Gallus)
  misc_feature (36): n=c or t
aatggcatcaagtcaacagcagagtagataaaaacntgtataggaatggggaaactcaagaaaaactcaca

SEQ ID NO: 13690 - DNA, 71 bp, chicken (Gallus Gallus)
  misc_feature (36): n=g or t
cacatcagctttaagcaggacagataaaacaccagnaacagatcataccagtcagcagagaactcatctgg

SEQ ID NO: 13691 - DNA, 71 bp, chicken (Gallus Gallus)
  misc_feature (36): n=a or g
aggagggcacatttacagctcgctctgctaggcgcnaagcaatctctttacaaagcaaaggctcaagtaac

SEQ ID NO: 13692 - DNA, 71 bp, chicken (Gallus Gallus)
  misc_feature (36): n=c or t
atacatacatatatatatatatatataacatagtanttgtgtgtgtttaatataaatacatctatatatct

SEQ ID NO: 13693 - DNA, 71 bp, chicken (Gallus Gallus)
  misc_feature (36): n=c or t
cacttagggtgccgtcctcactccagtgctagatancaggttggaaagtacccagagattcatcagcgtag

SEQ ID NO: 13694 - DNA, 71 bp, chicken (Gallus Gallus)
  misc_feature (36): n=a or g
agttccaataagttattgaatgaaatatccattgcntccacatcaactccctcattcttcagtctgacaaa

SEQ ID NO: 13695 - DNA, 71 bp, chicken (Gallus Gallus)
  misc_feature (36): n=a or g
aaaagttgcacagctgaaaagactaagttgctacangttttcataggcctgacttgagttcagttggattt

SEQ ID NO: 13696 - DNA, 71 bp, chicken (Gallus Gallus)
  misc_feature (36): n=c or t
gaccacttcgttaatacatgaatttttaccttaacncttctagatcacatattcaggtcagaaaaagcaat

SEQ ID NO: 13697 - DNA, 71 bp, chicken (Gallus Gallus)
  misc_feature (36): n=a or g
tagaaaagggacaaccagaggcaatcagtccccatntgctggttttctcatgagaaaacagctacaacttc

SEQ ID NO: 13698 - DNA, 71 bp, chicken (Gallus Gallus)
  misc_feature (36): n=c or t
gagcttgtaatgcttgtttatgtatgctgcggattntggctgccagtgataacgttcactgtgttccttga

SEQ ID NO: 13699 - DNA, 71 bp, chicken (Gallus Gallus)
  misc_feature (36): n=a or g
ctttttgcaaactcaattcactgaggataaatctgnagattttttccagtgtgcgcagcagctttctttgc

SEQ ID NO: 13700 - DNA, 71 bp, chicken (Gallus Gallus)
  misc_feature (36): n=c or t
ggcacagagctctgtgagcagggctgtggccatcgngcagctatcccacatttctggtgcaatcactgtct

SEQ ID NO: 13701 - DNA, 71 bp, chicken (Gallus Gallus)
  misc_feature (36): n=c or t
ggggatcgtgctccttaattcctttctgtgtagtcngtaaatgctggagcacaggcagactcgtgtgcttc

SEQ ID NO: 13702 - DNA, 71 bp, chicken (Gallus Gallus)
  misc_feature (36): n=c or t
catcctcagctgcagctcagactgctccgaggtgangacctgcatgctcatctgtctgaaatgaagcagtg

SEQ ID NO: 13703 - DNA, 71 bp, chicken (Gallus Gallus)
  misc_feature (36): n=c or t
aattagctagatggcaaataacagaggggtttggantatttccccaatgaatgctctaggctgactctggt

SEQ ID NO: 13704 - DNA, 71 bp, chicken (Gallus Gallus)
  misc_feature (36): n=c or t
cgtaagtaaaactttccttcctaagtaatgtggttngctagtttgatactgtatgatgcaggtctggtgtt

SEQ ID NO: 13705 - DNA, 71 bp, chicken (Gallus Gallus)
  misc_feature (36): n=c or g
caaagcattttcgaacagtttggagctaaaccttcntggctgagcggctgctgcctttaaggagacattga

SEQ ID NO: 13706 - DNA, 71 bp, chicken (Gallus Gallus)
  misc_feature (36): n=c or t
taaagtagttggtgattagtgatttttctttcactngcttaaaaagttaaagatacatttgctgttttctt

SEQ ID NO: 13707 - DNA, 71 bp, chicken (Gallus Gallus)
  misc_feature (36): n=c or t
gaagagatgtaattctccatgaatgcagcaccttangctcaatgcaccgtttctctgcgtttctcagcctc

SEQ ID NO: 13708 - DNA, 71 bp, chicken (Gallus Gallus)
  misc_feature (36): n=c or t
gagcacactgatcctgacactcaggtttgtcacaangagccctgatgacctctgatgggggactgaaccac

SEQ ID NO: 13709 - DNA, 71 bp, chicken (Gallus Gallus)
  misc_feature (36): n=c or t
tatgtgctgactgtgacctcaatttctcaatctccncctaacaatgtctcctgatattatctctatttttg

SEQ ID NO: 13710 - DNA, 71 bp, chicken (Gallus Gallus)
  misc_feature (36): n=c or t
agtgcatttgtcgcccttaacaataattaaccaagntctccaccagaaaccgtatcaaaggccctggagca

SEQ ID NO: 13711 - DNA, 71 bp, chicken (Gallus Gallus)
  misc_feature (36): n=c or g
tacatctacgcttacttaatgattgatatgaaacantctgctaggagcacgtattaaaactgcatccatta

SEQ ID NO: 13712 - DNA, 71 bp, chicken (Gallus Gallus)
  misc_feature (36): n=a or g
cagacataacgtttatttcacaacagaggacacaancccgcctttctgcacgaaaccaaggacacagtgct

SEQ ID NO: 13713 - DNA, 71 bp, chicken (Gallus Gallus)
  misc_feature (36): n=c or g
agagcaccgacctcctctgtgctgccacagccgagngaaaaatacaggtcagtagatccaaaccaggataa

SEQ ID NO: 13714 - DNA, 71 bp, chicken (Gallus Gallus)
  misc_feature (36): n=a or g
cctctgctgggttgttctaacctttggcagcaagcntggggagcagcctttgctttgtgttttggacaagg

SEQ ID NO: 13715 - DNA, 71 bp, chicken (Gallus Gallus)
  misc_feature (36): n=a or c
ggccggatgccaggaaccatttcttctccgaaaagnggcgatgccctgcacggactgcccggggaacggcg

SEQ ID NO: 13716 - DNA, 71 bp, chicken (Gallus Gallus)
  misc_feature (36): n=a or g
atcagttcagttcccctggtttgaaactggataganagaaggaaaaattatttgaaaatcgaagacattca

SEQ ID NO: 13717 - DNA, 71 bp, chicken (Gallus Gallus)
  misc_feature (36): n=a or g
aataaaagaattcaggagttttgttccaaaaatatncattcagaatgatgtgtcatgaaatctcagacttc

SEQ ID NO: 13718 - DNA, 71 bp, chicken (Gallus Gallus)
  misc_feature (36): n=c or t
cagcatctgctgctgttccaaggcaagatactgggntaggatagatcccaggtctaccttgatcaagtgtg

SEQ ID NO: 13719 - DNA, 71 bp, chicken (Gallus Gallus)
  misc_feature (36): n=c or g
ggtaggagtgtatgaagcttcaaaatctatctgcanctagtagacagtgtctgaaatcagtattaccaatg

SEQ ID NO: 13720 - DNA, 71 bp, chicken (Gallus Gallus)
  misc_feature (36): n=c or t
tttttctaagggtttttaaaacttaatgtttaatgntatgtagggaaataggattggtttctgtacaatgg

SEQ ID NO: 13721 - DNA, 71 bp, chicken (Gallus Gallus)
  misc_feature (36): n=a or g
atgcagcatcctacctgcttatttatttggtaacantgctgttacctaaacgcagagtgtattttttacaa

SEQ ID NO: 13722 - DNA, 71 bp, chicken (Gallus Gallus)
  misc_feature (36): n=g or t
ttatgtatggatcagggcctaaaataatccctcatnatgtgttttttttttttttttttaatagctgtgat

SEQ ID NO: 13723 - DNA, 71 bp, chicken (Gallus Gallus)
  misc_feature (36): n=c or t
gaatgataacagtattcaaacagtcttctggggcangtagttcttcttgtcttcctgacaagcacccggaa

SEQ ID NO: 13724 - DNA, 71 bp, chicken (Gallus Gallus)
  misc_feature (36): n=a or g
gccagggcctgaatgttctgcaatcaaatcctggcngagcagcagcaagaagtgcccgtggcccctgccag

SEQ ID NO: 13725 - DNA, 71 bp, chicken (Gallus Gallus)
  misc_feature (36): n=a or c
tcaaagcacccatagaacagcactgaaataacatcnagctgaaaatattaaactggcatttttgattgcac

SEQ ID NO: 13726 - DNA, 71 bp, chicken (Gallus Gallus)
  misc_feature (36): n=c or t
ctcaccagaggaggctgataaagaagcaggtttccntcacaaagaccagataaggctgcagacatggtgtg

SEQ ID NO: 13727 - DNA, 71 bp, chicken (Gallus Gallus)
  misc_feature (36): n=g or t
acagtccaactgctccatgagttgtactgagcaatnggtattgcattgaaaaggggtagaagctcttgtga

SEQ ID NO: 13728 - DNA, 71 bp, chicken (Gallus Gallus)
  misc_feature (36): n=a or g
aacttttattttggctgaaaacattctgtgcacaantactaacaaaatgtcctcctttaacttcatccttt

SEQ ID NO: 13729 - DNA, 71 bp, chicken (Gallus Gallus)
  misc_feature (36): n=a or g
ctttaccgataacacgagggatgatatccagcctcnagttactgttgtgccccatccgtcaggtcgaactc

SEQ ID NO: 13730 - DNA, 71 bp, chicken (Gallus Gallus)
  misc_feature (36): n=a or t
ctttaaatggggggggggaagggattaaacatatcnctaatttgtctcatttaattcagtcagcaggactg

SEQ ID NO: 13731 - DNA, 71 bp, chicken (Gallus Gallus)
  misc_feature (36): n=a or g
tgtaccagctatatgcattatataattgaagtctangcaagttgcactatcaggagctatatgacagcatt

SEQ ID NO: 13732 - DNA, 71 bp, chicken (Gallus Gallus)
  misc_feature (36): n=c or t
gttagtgggttgtgctttggggttctctctgtgttnctgatttggcattgatctacacttgggaggagaca

SEQ ID NO: 13733 - DNA, 71 bp, chicken (Gallus Gallus)
  misc_feature (36): n=c or t
tgcggtccacacgtcatgtctgcacacctgctatcncagacaaatcggtttttgtttttcatgttgtgctg

SEQ ID NO: 13734 - DNA, 71 bp, chicken (Gallus Gallus)
  misc_feature (36): n=a or g
ctttaatctcattaagtgtttctttacatttcttanacatgaatgcttaagatgtgaagaagctcttctga

SEQ ID NO: 13735 - DNA, 71 bp, chicken (Gallus Gallus)
  misc_feature (36): n=c or t
catggtttttcccccctcacttggtaaaaactttcncacagttcagaaaaccctcatgtgtggaatggtaa

SEQ ID NO: 13736 - DNA, 71 bp, chicken (Gallus Gallus)
  misc_feature (36): n=a or c
gcacccatcagctcgggcggcagaacattgtaatgnagcgctacagcaccaggtgtgtgagccagagagcc

SEQ ID NO: 13737 - DNA, 71 bp, chicken (Gallus Gallus)
  misc_feature (36): n=a or g
gggagtacagcagctattgtattaaccacctgcacncagaaacagaacgtgagtttcctaaccagggtacc

SEQ ID NO: 13738 - DNA, 71 bp, chicken (Gallus Gallus)
  misc_feature (36): n=c or t
atctccgcacagtacgacctgcagggaacagaccanatgttaagctcgcctcaatccaatgtgtggcagca

SEQ ID NO: 13739 - DNA, 71 bp, chicken (Gallus Gallus)
  misc_feature (36): n=c or t
cctcttcaatttgtgctggaaacacacggattccanataggaatgcatgacataaatgtgtttttctgcat

SEQ ID NO: 13740 - DNA, 71 bp, chicken (Gallus Gallus)
  misc_feature (36): n=c or t
gatttagaataaatgcatcttgataaagttcaggancaagtcccttgagattcaaaaaattctacgagcag

SEQ ID NO: 13741 - DNA, 71 bp, chicken (Gallus Gallus)
  misc_feature (36): n=a or c
tgattgcacgtgcacagtgtgaatgtcaggcatctnaatggcagccagcttctcagtgttattcaagaata

SEQ ID NO: 13742 - DNA, 71 bp, chicken (Gallus Gallus)
  misc_feature (36): n=g or t
catgtatcttcagccttatcttttcatctggatggntttttttggctctcctgtcagtctttaagcacaca

SEQ ID NO: 13743 - DNA, 71 bp, chicken (Gallus Gallus)
  misc_feature (36): n=a or g
gctccatcccacagtgcttgccagtttggttgaggngaagaatttccttgggatcccaaatctgacaagag

SEQ ID NO: 13744 - DNA, 71 bp, chicken (Gallus Gallus)
  misc_feature (36): n=a or g
gctgtccgctttctctctgtacaatcagtgcacagncagaggacagaccatgtttgcttgcagctgtgcct

SEQ ID NO: 13745 - DNA, 71 bp, chicken (Gallus Gallus)
  misc_feature (36): n=a or c
tcacaaacctaggactgaggaaaccaagaggatcanagtccttcacctcagctcccatggcatcgactgct

SEQ ID NO: 13746 - DNA, 71 bp, chicken (Gallus Gallus)
  misc_feature (36): n=c or t
taccagttctattttatataatagaatctggagcanggggaagtacacacagatttgtctaatgcccagca

SEQ ID NO: 13747 - DNA, 71 bp, chicken (Gallus Gallus)
  misc_feature (36): n=a or g
gagaagcaatagctactgatgaaaatactgaaagantatcaaaagagattaagtacatcctgcccatacca

SEQ ID NO: 13748 - DNA, 71 bp, chicken (Gallus Gallus)
  misc_feature (36): n=c or t
cttacaaaaaaagaaaaaataatatataaaatgcgnatggatttaaaagctcagaaacacagaaaatacag

SEQ ID NO: 13749 - DNA, 71 bp, chicken (Gallus Gallus)
  misc_feature (36): n=a or g
tgtgaaatgataatgaccaatctgctgggaattagngcttagaaatataaatgcaacatgtaacgtttgtg

SEQ ID NO: 13750 - DNA, 71 bp, chicken (Gallus Gallus)
  misc_feature (36): n=a or t
gacagcaaaaggatgcttaaaaatgctgggttctanctaaaccatcttactcatcagagaggcacaccatt

SEQ ID NO: 13751 - DNA, 71 bp, chicken (Gallus Gallus)
  misc_feature (36): n=c or t
aagacagcttaggctgaggtttgaatgggtgccagngggagcctcagtgctcagcagcactgaccctaagc

SEQ ID NO: 13752 - DNA, 71 bp, chicken (Gallus Gallus)
  misc_feature (36): n=c or t
gtgcatgtgtgcacacatccacgtgtgtttgctcangcgcatgtatgcgtgcgtgcaaacactcacatgtg

SEQ ID NO: 13753 - DNA, 71 bp, chicken (Gallus Gallus)
  misc_feature (36): n=a or g
tgtcccttgctatgcagtgcagagaaagactttagnaccttgcttgcagctggagacctcagtagcttcca

SEQ ID NO: 13754 - DNA, 71 bp, chicken (Gallus Gallus)
  misc_feature (36): n=c or t
acggaaacagcagtgaggttaccaagccaacagctngatgtgatgctgctgagcatgagcacagtcgctta

SEQ ID NO: 13755 - DNA, 71 bp, chicken (Gallus Gallus)
  misc_feature (36): n=a or g
ttgggctctgctttcctgacaatgttctattagccnctcccagaagcagagcccacatcaacctctcttgc

SEQ ID NO: 13756 - DNA, 71 bp, chicken (Gallus Gallus)
  misc_feature (36): n=a or g
cagtgctggttaaggctggttaagggactatgtagntgctgccacctcaagcacttgcgctgtgatcagct

SEQ ID NO: 13757 - DNA, 71 bp, chicken (Gallus Gallus)
  misc_feature (36): n=a or t
acgacctccgcgcaccgcaggtcagtaagcccgtgnaacccttatctctgagtctttcttaactaacactg

SEQ ID NO: 13758 - DNA, 71 bp, chicken (Gallus Gallus)
  misc_feature (36): n=a or c
accttgcaggttatactctttgggatgttgtgaagnggtgatatcaacacactgtggccacttttagcttt

SEQ ID NO: 13759 - DNA, 71 bp, chicken (Gallus Gallus)
  misc_feature (36): n=c or t
aattgagaaatcattattactaagcctaaaaaggtngttaatcttgtatatttcaaaacccaagtttgaga

SEQ ID NO: 13760 - DNA, 71 bp, chicken (Gallus Gallus)
  misc_feature (36): n=a or c
gttttgcagcaacctactctgccatggaagaagtcntaagtttctcagcaaaaccgtttacaacacaccac

SEQ ID NO: 13761 - DNA, 71 bp, chicken (Gallus Gallus)
  misc_feature (36): n=a or g
ctctttgtcttgtatttccacattaaatctctgtcntgcacacgcagaggcttccttgctgtttgttctca

SEQ ID NO: 13762 - DNA, 71 bp, chicken (Gallus Gallus)
  misc_feature (36): n=a or g
cctggagtagacactgctaatcagaccagatggtgnagtagtttaagatgtggctgaagggaggcaatggt

SEQ ID NO: 13763 - DNA, 71 bp, chicken (Gallus Gallus)
  misc_feature (36): n=a or c
ctcggtctgtgcaccttaatgtggctctgcttgctnacctgcagtggtaagtgcacttgtagggcaaatgt

SEQ ID NO: 13764 - DNA, 71 bp, chicken (Gallus Gallus)
  misc_feature (36): n=a or g
cccaccactgtggttactagagcagctggtaagtgnagcaggcaggcagaagggaaggtgggccttcttac

SEQ ID NO: 13765 - DNA, 71 bp, chicken (Gallus Gallus)
  misc_feature (36): n=a or c
gagggcaggagcagctcccacagcccagcacagctntaatgacggctgaagagcagacccagacctgcagc

SEQ ID NO: 13766 - DNA, 71 bp, chicken (Gallus Gallus)
  misc_feature (36): n=a or g
gtgcttttcactatcagtgtagatttaattggcccnacatcctttactgctctttaccaccagatgtcagt

SEQ ID NO: 13767 - DNA, 71 bp, chicken (Gallus Gallus)
  misc_feature (36): n=a or g
cttctttctgaagactgcttgccttggcctcagganttccactgtaatgctcagtcaaaagggtttgcgaa

SEQ ID NO: 13768 - DNA, 71 bp, chicken (Gallus Gallus)
  misc_feature (36): n=c or t
tgcctttctcctgtgcttaggctcatgcgtgtgaangaagctggggccggattgctgtggagggtcccaga

SEQ ID NO: 13769 - DNA, 71 bp, chicken (Gallus Gallus)
  misc_feature (36): n=c or t
tgaatcacacgaccaagttctggttttggtgcctcngttttttggtcaggtttaccttcaggtttctaaaa

SEQ ID NO: 13770 - DNA, 71 bp, chicken (Gallus Gallus)
  misc_feature (36): n=a or g
ttattctgcagtaatgtgagctcgttgcaatggttntgagaagtggtctgtatttgctgcttgcacttgcc

SEQ ID NO: 13771 - DNA, 71 bp, chicken (Gallus Gallus)
  misc_feature (36): n=g or t
ggcttggaccagaagcatagtgagagagggaatccncaagggacctgttgtgctggctgcaggaacagctt

SEQ ID NO: 13772 - DNA, 71 bp, chicken (Gallus Gallus)
  misc_feature (36): n=c or t
ggaagtgctgccttacctgtgttggacagcagcttngtcgcttccagcaccttctcagtgtagactccagg

SEQ ID NO: 13773 - DNA, 71 bp, chicken (Gallus Gallus)
  misc_feature (36): n=c or g
aaaatccactgcgaactcaggaaaataaatgtattnacatcagtgcccacctggccagcacccgacctctg

SEQ ID NO: 13774 - DNA, 71 bp, chicken (Gallus Gallus)
  misc_feature (36): n=c or t
acaacattatggtagaagctttttttttcctccagnatctctcagctctgaactctatctcctctgccgaa

SEQ ID NO: 13775 - DNA, 71 bp, chicken (Gallus Gallus)
  misc_feature (36): n=a or g
gcatcagtcattttgcattatgatactactgctccntccagtatcatggataacacgttcagccacagagc

SEQ ID NO: 13776 - DNA, 71 bp, chicken (Gallus Gallus)
  misc_feature (36): n=a or g
aaataaagagcagaacaaagcaatggcaatttgagnttggagtcattgccatttcaagcatttatttctct

SEQ ID NO: 13777 - DNA, 71 bp, chicken (Gallus Gallus)
  misc_feature (36): n=c or t
tccgaagtattattttctgtgtgttcagtcaaaagnacactgatgtcactgaaaatatttgtgttctccag

SEQ ID NO: 13778 - DNA, 71 bp, chicken (Gallus Gallus)
  misc_feature (36): n=c or t
ggcagtgaagagacaaccttctatctccagagcaangttggctcctgcttccaggcctggtcaacggatgt

SEQ ID NO: 13779 - DNA, 71 bp, chicken (Gallus Gallus)
  misc_feature (36): n=g or t
gttcttcgggaaacatctcagaataggcaaaggtcnggaatttgcttattgaccagttgaatgttgttaaa

SEQ ID NO: 13780 - DNA, 71 bp, chicken (Gallus Gallus)
  misc_feature (36): n=c or t
ttattttactcggaatcatgtttttgggcttctggncttttaaatcctgtcatggcttttagtctagaagg

SEQ ID NO: 13781 - DNA, 71 bp, chicken (Gallus Gallus)
  misc_feature (36): n=a or g
aacatggtgaagaacgcagagaaatatgcagaggangacagacgaagaaaggtaaagtgattgctgctgta

SEQ ID NO: 13782 - DNA, 71 bp, chicken (Gallus Gallus)
  misc_feature (36): n=g or t
atacataaaactttaaaaacaatgtggatgagtganaagctgttaaagttaattgtgagagaatacagctc

SEQ ID NO: 13783 - DNA, 71 bp, chicken (Gallus Gallus)
  misc_feature (36): n=c or t
aaatgttgctctggagcttcttataggggtggaaangtaattgagagaggaagcacgcaccacagctttca

SEQ ID NO: 13784 - DNA, 71 bp, chicken (Gallus Gallus)
  misc_feature (36): n=c or t
gggatagacccagcgctggccaaccaacaacccacntgcctataccacgtccttgccttatggtcagccaa

SEQ ID NO: 13785 - DNA, 71 bp, chicken (Gallus Gallus)
  misc_feature (36): n=a or g
ccttgaccaggtcagctgaatcggccgtgttccacntgtagttacagcctccttgcaagagctgcaaagtg

SEQ ID NO: 13786 - DNA, 71 bp, chicken (Gallus Gallus)
  misc_feature (36): n=a or g
caggagcacagggctggtggtggcagggagcacgcngccgggtttcaatgctgaagatattccagttgaaa

SEQ ID NO: 13787 - DNA, 71 bp, chicken (Gallus Gallus)
  misc_feature (36): n=c or t
agggccagagcaaagtgtgaaaggagcagagaatgnccacgcacgagggcaggcagagcacagggcaggtg

SEQ ID NO: 13788 - DNA, 71 bp, chicken (Gallus Gallus)
  misc_feature (36): n=c or g
aattttttcttcaatgaactagagtttcatttctgncctttcaaaacagggttgtgatgggatccagagca

SEQ ID NO: 13789 - DNA, 71 bp, chicken (Gallus Gallus)
  misc_feature (36): n=c or t
tggcctatgggtgaaccttccctgggctaaatctgngcttcccagttcaacacggagcttcctgggaagga

SEQ ID NO: 13790 - DNA, 71 bp, chicken (Gallus Gallus)
  misc_feature (36): n=c or t
ttttttcctcagatatcccgacgttaccagcacagnagaagcagttttgcaactggttgtgttgaagaagg

SEQ ID NO: 13791 - DNA, 71 bp, chicken (Gallus Gallus)
  misc_feature (36): n=a or g
gcagccaacaggacaggctaaggtgtcattcctgcntacacataacttccctcagctgaccagctgtttcg

SEQ ID NO: 13792 - DNA, 71 bp, chicken (Gallus Gallus)
  misc_feature (36): n=a or g
gctccatgctctccctactggcagggaattattcanagatgcaggtattacagcaaaacatgcaaccagac

SEQ ID NO: 13793 - DNA, 71 bp, chicken (Gallus Gallus)
  misc_feature (36): n=a or c
aatcatgaatctgccagggtcatctgcccaaaatgnacgcgttggagcaagcggctgccaagcagtggacc

SEQ ID NO: 13794 - DNA, 71 bp, chicken (Gallus Gallus)
  misc_feature (36): n=a or g
atttattccgctctttggataagtactgtttctacnccatttcataaacataaaagatcaagatagtaaat

SEQ ID NO: 13795 - DNA, 71 bp, chicken (Gallus Gallus)
  misc_feature (36): n=c or t
acttcaccagcacgaattttacctttatgtcagctngctgataactgagaagatgctccttctgaccagat

SEQ ID NO: 13796 - DNA, 71 bp, chicken (Gallus Gallus)
  misc_feature (36): n=a or g
attactggtattactttctataaaactaagtttccntgctatttaaagacaactaagaaaagagactgtcg

SEQ ID NO: 13797 - DNA, 71 bp, chicken (Gallus Gallus)
  misc_feature (36): n=a or g
taagcatgcaatctgcttcatgcccaatgaagattncacaatccatcaggagatgctacagctcatttcca

SEQ ID NO: 13798 - DNA, 71 bp, chicken (Gallus Gallus)
  misc_feature (36): n=a or g
tagatatgttaataaacacaataagatctagtgtanaaaagggaaatatgagacagatcaactatcaatga

SEQ ID NO: 13799 - DNA, 71 bp, chicken (Gallus Gallus)
  misc_feature (36): n=c or g
caaggaaatcccagcaggtgctccggttggctgctntaatggaagaacaatgctgacattgattgagatga

SEQ ID NO: 13800 - DNA, 71 bp, chicken (Gallus Gallus)
  misc_feature (36): n=c or t
ggtttgcaccagcaaagaggagggagctgaaatggnggcgttactcagagtggaaaagcaagcactatcag

SEQ ID NO: 13801 - DNA, 71 bp, chicken (Gallus Gallus)
  misc_feature (36): n=a or c
tccatagttacactcattagccatcacatcagttanttacaatagagagcaaaaaagggcaacagcagtct

SEQ ID NO: 13802 - DNA, 71 bp, chicken (Gallus Gallus)
  misc_feature (36): n=c or g
cagtggaagctatcagaaatgctatgggcatcccanaccagcagctcctaaaaaattccaagtggtactgc

SEQ ID NO: 13803 - DNA, 71 bp, chicken (Gallus Gallus)
  misc_feature (36): n=c or t
cagtttgtgtgtctgtactatgaataagtgcatgtntgtagaactgagtttaattttactagttataaagt

SEQ ID NO: 13804 - DNA, 71 bp, chicken (Gallus Gallus)
  misc_feature (36): n=g or t
cctatttttatggtacaattttttcctctccttacnatgtttcacagctgcttttcatacatttcctacaa

SEQ ID NO: 13805 - DNA, 71 bp, chicken (Gallus Gallus)
  misc_feature (36): n=a or g
acaccaccacctctatttgctttgcaacgcatcgangggcttcaaatcagacagctgtgcctccccctgca

SEQ ID NO: 13806 - DNA, 71 bp, chicken (Gallus Gallus)
  misc_feature (36): n=a or g
gcaatttttgcatctcctttgtgctgaaatgatctngtgttctcacagaatgacttgccccttagttagat

SEQ ID NO: 13807 - DNA, 71 bp, chicken (Gallus Gallus)
  misc_feature (36): n=a or g
acaatagaaagtgaaatacttcctagcgaacatggnaatagtcatcagctgcccagctgttttcaatcagt

SEQ ID NO: 13808 - DNA, 71 bp, chicken (Gallus Gallus)
  misc_feature (36): n=c or t
tatgtgcaagatgccatgacagcgttactgaactcngtgtgaggaaaatgttggaaaacaagtcgatcaat

SEQ ID NO: 13809 - DNA, 71 bp, chicken (Gallus Gallus)
  misc_feature (36): n=c or t
cagacaagtcaacatggatagaacattgtaagacantgggagaagccccagagaaaggatcaactgaagca

SEQ ID NO: 13810 - DNA, 71 bp, chicken (Gallus Gallus)
  misc_feature (36): n=c or t
tgaaactcccacagtttgtactgatgttagagacanctcctgacaacaatgcttgttccaccgtttcctct

SEQ ID NO: 13811 - DNA, 71 bp, chicken (Gallus Gallus)
  misc_feature (36): n=a or t
catacaaagcattataaaatttccttgaaaattaantaaggaagaacagaattgaaaaaagttctgataaa

SEQ ID NO: 13812 - DNA, 71 bp, chicken (Gallus Gallus)
  misc_feature (36): n=c or t
ttggcaaaagatgattctgcgtgttgatgaattagntgatgtgggaatgtgaacaaaaattaagctagatt

SEQ ID NO: 13813 - DNA, 71 bp, chicken (Gallus Gallus)
  misc_feature (36): n=a or g
ggtaacataaatatatctgtcaaacagatttttaanataccacacaaaaaaaggcatttccaactgtaaga

SEQ ID NO: 13814 - DNA, 71 bp, chicken (Gallus Gallus)
  misc_feature (36): n=a or g
tgttgataaaccgtgatcaagtggctgtggggttcnttgtcattctagcacttcttgcatgttgagaaact

SEQ ID NO: 13815 - DNA, 71 bp, chicken (Gallus Gallus)
  misc_feature (36): n=a or g
aaagtggttagaagtaaggtaccttaaaagaattcnggaagggatatctgaagttgctgtaatggcaagct

SEQ ID NO: 13816 - DNA, 71 bp, chicken (Gallus Gallus)
  misc_feature (36): n=c or g
aggatttgtttgcccatcagtaaataagatcaacanctgagtttcctaagcaacatagttataattttcct

SEQ ID NO: 13817 - DNA, 71 bp, chicken (Gallus Gallus)
  misc_feature (36): n=c or g
cttcacttaaagaatagctgtgtactaaaggcctanaagggcagtagaataaatttttctgaatttaggtt

SEQ ID NO: 13818 - DNA, 71 bp, chicken (Gallus Gallus)
  misc_feature (36): n=c or t
cagctgtttaaatgctttgtagtgagctgtaactcngtggcttcagaacagagcagttattcaagtttagt

SEQ ID NO: 13819 - DNA, 71 bp, chicken (Gallus Gallus)
  misc_feature (36): n=a or g
aattccagactagctagatgatttctgtgtatgggntaagtgcgctgctgctaaagtcatcccagagctgt

SEQ ID NO: 13820 - DNA, 71 bp, chicken (Gallus Gallus)
  misc_feature (36): n=c or g
gctgcaagaagtagacagactttagagaactcaganccttcttcatgtcagacaattatctcccatttatt

SEQ ID NO: 13821 - DNA, 71 bp, chicken (Gallus Gallus)
  misc_feature (36): n=c or g
tttctcctatctttgtctcttttctagttggcaggnactgctcagattgtgttcctgcattgttttctctg

SEQ ID NO: 13822 - DNA, 71 bp, chicken (Gallus Gallus)
  misc_feature (36): n=c or t
tcatgaatagtggtgatacagcctgatggccgaaanccagtggctccttccaagagtaagtcaagcttgtt

SEQ ID NO: 13823 - DNA, 71 bp, chicken (Gallus Gallus)
  misc_feature (36): n=a or g
acgatcttgttgcacaagggggactgaaggcttatncagcacttgctgcatcaaaatatcagcacttatgt

SEQ ID NO: 13824 - DNA, 71 bp, chicken (Gallus Gallus)
  misc_feature (36): n=a or c
agaaaatgaagaactggaagagctcctgagtggacnaatctgcctatttctctcttgctggaaaacctcct

SEQ ID NO: 13825 - DNA, 71 bp, chicken (Gallus Gallus)
  misc_feature (36): n=c or g
ttttcagaccataaactattttttgtctagattaantctaggaaaaagaaatgtctttgcaaggtacgcta

SEQ ID NO: 13826 - DNA, 71 bp, chicken (Gallus Gallus)
  misc_feature (36): n=a or g
cgttaacttacttaagtacaacttaactgagacacnagaccaactctggagcacaacagcatggcctgcac

SEQ ID NO: 13827 - DNA, 71 bp, chicken (Gallus Gallus)
  misc_feature (36): n=a or g
attagaaataaaggaatgaaatgcaaagtacacatngccactgaacaacctctcagccaactgacttcagt

SEQ ID NO: 13828 - DNA, 71 bp, chicken (Gallus Gallus)
  misc_feature (36): n=c or g
gccatcaacaaagatccaaatcctagatctctaaanacactggagttctaaatggttggagattgctgtgt

SEQ ID NO: 13829 - DNA, 71 bp, chicken (Gallus Gallus)
  misc_feature (36): n=a or g
aaatcaatcaggacaaataaactacaacttcttgcnaactgcttctctttgctcacagcaaagactgtgtt

SEQ ID NO: 13830 - DNA, 71 bp, chicken (Gallus Gallus)
  misc_feature (36): n=a or t
ttttggacgacctggcagtaacaaaatcaaggtggnctgtggcatataacagttagacaatcatttattca

SEQ ID NO: 13831 - DNA, 71 bp, chicken (Gallus Gallus)
  misc_feature (36): n=c or t
tagacgttattagctggctatgcacagctgtcacancacaacatgaggagcacctcagtcatccatgttaa

SEQ ID NO: 13832 - DNA, 71 bp, chicken (Gallus Gallus)
  misc_feature (36): n=c or t
cagtgcgcgctgctggggaacctgcctgcgatgtgncagtccttggagtgatgctatcaagtcccaagcgc

SEQ ID NO: 13833 - DNA, 71 bp, chicken (Gallus Gallus)
  misc_feature (36): n=a or t
cttagaggaaaaacatttcatgttagtaaatcactnattcgcatagaaacaaccacttctgaaatatatat

SEQ ID NO: 13834 - DNA, 71 bp, chicken (Gallus Gallus)
  misc_feature (36): n=c or t
atatatatatattttttttttatgatgtactgaccngaaatcaaattaatactttaaaatgaactgtcatt

SEQ ID NO: 13835 - DNA, 71 bp, chicken (Gallus Gallus)
  misc_feature (36): n=a or g
gctgtcctgcagtactttttccacagttcaattatnttcgtcacattttcaaatacagaaaaagtaacaat

SEQ ID NO: 13836 - DNA, 71 bp, chicken (Gallus Gallus)
  misc_feature (36): n=c or t
aaggatgtaacttccatttctatgtaattttaactntatatctataattacagcatctcaagctttgcagt

SEQ ID NO: 13837 - DNA, 71 bp, chicken (Gallus Gallus)
  misc_feature (36): n=g or t
gaatttactttttttttttttttaatccagataaantcaaaagtacttatgcataaaaaaaggcagttgtg

SEQ ID NO: 13838 - DNA, 71 bp, chicken (Gallus Gallus)
  misc_feature (36): n=c or t
gcagtcatgtactaaatttcatttgtgcttcaaaanatgaggatggcagtctggtgtgttttattttgttg

SEQ ID NO: 13839 - DNA, 71 bp, chicken (Gallus Gallus)
  misc_feature (36): n=a or c
tacattgagagaagaataaagcagaagaaatacttnaaagctcacacacaaaccatttggagtaggtgatt

SEQ ID NO: 13840 - DNA, 71 bp, chicken (Gallus Gallus)
  misc_feature (36): n=c or g
actgctgtcacctgtcataatacaatgtctgggcantacaggtgctttgtctggggacttggagatactaa

SEQ ID NO: 13841 - DNA, 71 bp, chicken (Gallus Gallus)
  misc_feature (36): n=a or g
tgctaactaattgaattggaatttcagtctcagccncacttcaaaccgtagcctgaaaaacattttcatcc

SEQ ID NO: 13842 - DNA, 71 bp, chicken (Gallus Gallus)
  misc_feature (36): n=c or g
ctctacagtatcaccatatctaaaattaatactttnggatttaagtctccacatttcaaaaaacaaactga

SEQ ID NO: 13843 - DNA, 71 bp, chicken (Gallus Gallus)
  misc_feature (36): n=a or g
tatggcactaaagaattcagaccactataaagcgcntcatcaatacttcaagtggactttggaaaccatct

SEQ ID NO: 13844 - DNA, 71 bp, chicken (Gallus Gallus)
  misc_feature (36): n=c or t
gcactgctaatgactacacaacaggcatcataaagncttattttcagtttgtgtccatggtaaaaggccag

SEQ ID NO: 13845 - DNA, 71 bp, chicken (Gallus Gallus)
  misc_feature (36): n=c or t
ggtttgggattgttcatctttcacggcatgtacttntcaatgatctcagtgtgctcctatttttttcttct

SEQ ID NO: 13846 - DNA, 71 bp, chicken (Gallus Gallus)
  misc_feature (36): n=c or t
ttattaatactacaggtatttattaatgccaatacntgaccagactagatttctagtaaatcttgagctta

SEQ ID NO: 13847 - DNA, 71 bp, chicken (Gallus Gallus)
  misc_feature (36): n=g or t
gtgcagctctgggagaacatggtagaagtaaaaatntacagctgtgagaggggcagaggctaaaagtcttc

SEQ ID NO: 13848 - DNA, 71 bp, chicken (Gallus Gallus)
  misc_feature (36): n=a or t
aaaaaaacaactaaagaacttacagaaaaggctgcnaaggcctgttctgccctaggattattgtttaatca

SEQ ID NO: 13849 - DNA, 71 bp, chicken (Gallus Gallus)
  misc_feature (36): n=c or t
tttctaatgccaccaatcaagagaaaatactagagngctgttgagggcaagtgtcataggtgtgaaggaaa

SEQ ID NO: 13850 - DNA, 71 bp, chicken (Gallus Gallus)
  misc_feature (36): n=c or g
aaaatttaattagtgtttctattggaatgatgttcnaaaaggattggaacaggagtatttcaattataaac

SEQ ID NO: 13851 - DNA, 71 bp, chicken (Gallus Gallus)
  misc_feature (36): n=c or t
atatagtgtagccagagagttatggtcgatagctcngtgttcaggtggaggtcagtaatgagcggtgtccc

SEQ ID NO: 13852 - DNA, 71 bp, chicken (Gallus Gallus)
  misc_feature (36): n=a or g
tctttccagctttggcggaaaaatacatctatagtntattcctacaccaattcagaaaagaaaaggtaata

SEQ ID NO: 13853 - DNA, 71 bp, chicken (Gallus Gallus)
  misc_feature (36): n=a or g
ctaattttagaacagaaataactgcaaaaatacaantgttgaaataaatttaaacatataaaacactataa

SEQ ID NO: 13854 - DNA, 71 bp, chicken (Gallus Gallus)
  misc_feature (36): n=a or g
tacaaaggcaaaagtagcaactgaagtccatttccnggatgagagccatgatagttcaccctttgcctggg

SEQ ID NO: 13855 - DNA, 71 bp, chicken (Gallus Gallus)
  misc_feature (36): n=a or t
ccaatctcgatttgttaagcatgttatatagatatntagtagcatcctacatatgccatccagatgtttcg

SEQ ID NO: 13856 - DNA, 71 bp, chicken (Gallus Gallus)
  misc_feature (36): n=a or c
agtaagaaccaccatgtgttttggtgtgtgagaganagcattgcttacaatattttatcttcatattcttt

SEQ ID NO: 13857 - DNA, 71 bp, chicken (Gallus Gallus)
  misc_feature (36): n=a or g
ggagaatgggaaggggaaaggaatgtcacaatcggnttacaatgagccttctttagcctgcacttgccctt

SEQ ID NO: 13858 - DNA, 71 bp, chicken (Gallus Gallus)
  misc_feature (36): n=c or g
ttgtataaaagctctttccgatatctccattaactntctaactggatagcatccacagggtttcctataga

SEQ ID NO: 13859 - DNA, 71 bp, chicken (Gallus Gallus)
  misc_feature (36): n=a or g
gttatgaactttgtagttctttggtttcagagaatnttttactattcaaccaactacagaaaaggcttcca

SEQ ID NO: 13860 - DNA, 71 bp, chicken (Gallus Gallus)
  misc_feature (36): n=c or t
atgcagagccaaaatgaatgacatcatccgtaatancagtaagtcagtcagaatggtcctagggatgtcat

SEQ ID NO: 13861 - DNA, 71 bp, chicken (Gallus Gallus)
  misc_feature (36): n=a or g
gtttttttgttgttttttttttttcctaatgtgacntttttcccagctctactctattgctcagcagcata

SEQ ID NO: 13862 - DNA, 71 bp, chicken (Gallus Gallus)
  misc_feature (36): n=c or t
aatttgttaaaatgacttctaaagtacataccaggngctgcctaaactcactctcacttctttctgttatt

SEQ ID NO: 13863 - DNA, 71 bp, chicken (Gallus Gallus)
  misc_feature (36): n=a or c
cttctcaaattgtttttttttttttaaacagctctntattcaagtttcccaaggagatttatgaacgtgtg

SEQ ID NO: 13864 - DNA, 71 bp, chicken (Gallus Gallus)
  misc_feature (36): n=a or c
tgcaaaagtttgggacacagacatttacagttaagnctgttgctttgcaggaatgaggtaacttcaaaaga

SEQ ID NO: 13865 - DNA, 71 bp, chicken (Gallus Gallus)
  misc_feature (36): n=c or t
gtcattcatgtagttatttgtattatggcagcaggnaaaggctgcaaccacggtttggtttcaaaagtact

SEQ ID NO: 13866 - DNA, 71 bp, chicken (Gallus Gallus)
  misc_feature (36): n=c or g
gtactgtttttaattattttcagattgacaaaagtnttctgagtattatgccaacatctcctcagttcagc

SEQ ID NO: 13867 - DNA, 71 bp, chicken (Gallus Gallus)
  misc_feature (36): n=a or g
ctctcctaattgcttgcatttgctagacaagccctntaatgtaccggccaaggtgcagattaatttgtagg

SEQ ID NO: 13868 - DNA, 71 bp, chicken (Gallus Gallus)
  misc_feature (36): n=c or t
tgcttctcccttttttctccacctctttctgtattnagtccgacagtttgtgtctcagaagtgaattttga

SEQ ID NO: 13869 - DNA, 71 bp, chicken (Gallus Gallus)
  misc_feature (36): n=c or t
agaactaggaagacaccttggaccaccgtggaagangggaaggtctttgttatgccacttttgacacaggc

SEQ ID NO: 13870 - DNA, 71 bp, chicken (Gallus Gallus)
  misc_feature (36): n=c or t
ggaacttgaaataaaaatatgaatatggtcacattncattaagagcataatgcatcttcctcacccttatt

SEQ ID NO: 13871 - DNA, 71 bp, chicken (Gallus Gallus)
  misc_feature (36): n=a or g
tactcagcagcaatatggtgcggttatccctgcagntaaaataagctatcaataaccaaagaggtctctct

SEQ ID NO: 13872 - DNA, 71 bp, chicken (Gallus Gallus)
  misc_feature (36): n=c or t
tcccttctcagaataaaggttttctccgtaaatctnctaagactaagaagggtgctggaggcccagatact

SEQ ID NO: 13873 - DNA, 71 bp, chicken (Gallus Gallus)
  misc_feature (36): n=a or g
tttcagtttccaaaaaccaagccacactccagatantgaaattaatctgagtttcaagtaaaatcttatat

SEQ ID NO: 13874 - DNA, 71 bp, chicken (Gallus Gallus)
  misc_feature (36): n=a or t
atgggatttaaacatagtagaaaacaaaagaagacntaagtgaacaggcttccactggcagtgcttccatt

SEQ ID NO: 13875 - DNA, 71 bp, chicken (Gallus Gallus)
  misc_feature (36): n=c or t
catggaatgctgctgagcctgagtgatggcttccancgtgttgtgcaccctggcattgtagggccctctta

SEQ ID NO: 13876 - DNA, 71 bp, chicken (Gallus Gallus)
  misc_feature (36): n=c or t
taaacgtgttcttttactacttaactaggaaaagcntgaaatttccttcattagaagtgttcttaactgcc

SEQ ID NO: 13877 - DNA, 71 bp, chicken (Gallus Gallus)
  misc_feature (36): n=a or g
tccctctaaactcctgtctaaaagaggaattacacngaagctaaactgcagggatggagatgtcagaggga

SEQ ID NO: 13878 - DNA, 71 bp, chicken (Gallus Gallus)
  misc_feature (36): n=c or t
tgtacatttgttctaaggagaagtcatcgttagggncacaagtgcccatgatctctggcatgagaacagtg

SEQ ID NO: 13879 - DNA, 71 bp, chicken (Gallus Gallus)
  misc_feature (36): n=a or g
cgtgggtctggggcttagcaagtttgagtgctgtgnctgcacactgacactaatcaagcctatgggctgtt

SEQ ID NO: 13880 - DNA, 71 bp, chicken (Gallus Gallus)
  misc_feature (36): n=c or g
aaaacggcatggatgattttgtttagagttaaaagncatcctgaagcaggaccctggctgctggagctgct

SEQ ID NO: 13881 - DNA, 71 bp, chicken (Gallus Gallus)
  misc_feature (36): n=c or g
tcaaaggtcaaagtcacttggtttcataatcacttntgtaagcctctggtgggagtggaatgcagggggag

SEQ ID NO: 13882 - DNA, 71 bp, chicken (Gallus Gallus)
  misc_feature (36): n=g or t
aatcagtctctttcacaaagctccctttgctagagncacgaggttaagaccttaattattcacctgttgga

SEQ ID NO: 13883 - DNA, 71 bp, chicken (Gallus Gallus)
  misc_feature (36): n=c or t
taacctgttttgcaaaatgcaaggaaagcacctttnaaatactcacctaatgttcctgaagaattgaaagc

SEQ ID NO: 13884 - DNA, 71 bp, chicken (Gallus Gallus)
  misc_feature (36): n=c or g
agttcccaacctgcaatccaactcactccactgctnctaaaatgtttactggagaaattttaaagaccatc

SEQ ID NO: 13885 - DNA, 71 bp, chicken (Gallus Gallus)
  misc_feature (36): n=g or t
acagccagtcactggcttctcttaaagaggagatangtaagaggaagaagtacctcagggaatggagcatc

SEQ ID NO: 13886 - DNA, 71 bp, chicken (Gallus Gallus)
  misc_feature (36): n=c or t
cagtggaaataccgtgacgagaataattcctggctnttcgtagctctggtgttagcctccagaggcactag

SEQ ID NO: 13887 - DNA, 71 bp, chicken (Gallus Gallus)
  misc_feature (36): n=a or g
actccgagtttctcttcccaaaagcagagtcgctgnagaacagcagaaaagaaggaaaagaaatgtgtgta

SEQ ID NO: 13888 - DNA, 71 bp, chicken (Gallus Gallus)
  misc_feature (36): n=a or g
tccttctcagctgggtgtgatgccaagtttccaaanagctcaggggtgtatccattgtgtcccaataggaa

SEQ ID NO: 13889 - DNA, 71 bp, chicken (Gallus Gallus)
  misc_feature (36): n=a or g
cagtaggaggtgaggcaagctggagcaatgggtccncagcctcagctctgcttaagggttttctctcatca

SEQ ID NO: 13890 - DNA, 71 bp, chicken (Gallus Gallus)
  misc_feature (36): n=a or g
agatagcaggagctcactgcctccataagctaagtncctgctagcacacatccctctcgcaaggctgcaca

SEQ ID NO: 13891 - DNA, 71 bp, chicken (Gallus Gallus)
  misc_feature (36): n=c or t
ttttcttctgtctctcccatttcagggaagatcctnttccgccggagtcacatccgtgatgtcgcagtcaa

SEQ ID NO: 13892 - DNA, 71 bp, chicken (Gallus Gallus)
  misc_feature (36): n=a or g
agaaacagggaaggtgtgttccctgttcctgcatcnagtgatgttctgtgacatccatggtcctggcacca

SEQ ID NO: 13893 - DNA, 71 bp, chicken (Gallus Gallus)
  misc_feature (36): n=a or g
ttgtagagtatcaaacgtagggtaaaaaatgccacngctcattttcaacggtacactgcatcagagctgct

SEQ ID NO: 13894 - DNA, 71 bp, chicken (Gallus Gallus)
  misc_feature (36): n=c or t
ctgtgtgtctgtcatgctggtacctgccggccaacngctaatgctttaagatagatgcccctgctccccat

SEQ ID NO: 13895 - DNA, 71 bp, chicken (Gallus Gallus)
  misc_feature (36): n=a or g
ccacatagtaccactgggactgggagtgtgtgagtntacctcaaaaccaccccagggctgcagggacacgg

SEQ ID NO: 13896 - DNA, 71 bp, chicken (Gallus Gallus)
  misc_feature (36): n=a or t
aatgctggctccaggtggtgatgagctctcctgtgnagttagttagcaacacctgaaccttctcctggggt

SEQ ID NO: 13897 - DNA, 71 bp, chicken (Gallus Gallus)
  misc_feature (36): n=c or t
aaggaggaggatatattttcagaaggatagcgctgngtttgtggcactgagtgatgcagtctggtgggcat

SEQ ID NO: 13898 - DNA, 71 bp, chicken (Gallus Gallus)
  misc_feature (36): n=a or c
cagagggccgagcgcagtgccacagccccgggctgnggttttacctttcttgtccgccttggaatccttgg

SEQ ID NO: 13899 - DNA, 71 bp, chicken (Gallus Gallus)
  misc_feature (36): n=a or g
cactcaataaagggatagggccatgctctgaaagcngcaatccatattttaggcaattttagtgctttcct

SEQ ID NO: 13900 - DNA, 71 bp, chicken (Gallus Gallus)
  misc_feature (36): n=a or t
gaggatgtgtgctggtgttacatagctgatcctaanggaccatcaccagttaagcagccgttgcttcctta

SEQ ID NO: 13901 - DNA, 71 bp, chicken (Gallus Gallus)
  misc_feature (36): n=a or t
gtgctgttatccatttgctttccttcgggcacttanttcttccagtatttttcctggaatcaaagcaaagc

SEQ ID NO: 13902 - DNA, 71 bp, chicken (Gallus Gallus)
  misc_feature (36): n=a or g
agttctgcagcaaaacgcacggacaaaggaaaaacngggagagcaaaacattaacaagagcaaagcggatt

SEQ ID NO: 13903 - DNA, 71 bp, chicken (Gallus Gallus)
  misc_feature (36): n=a or g
cctgcagtaatacctcagtaataccttccctcacgntgctgtggtaagaaaagaatcctcccgttttagaa

SEQ ID NO: 13904 - DNA, 71 bp, chicken (Gallus Gallus)
  misc_feature (36): n=a or g
atttgtgtaactgctgctggcgtgggcacctcttcntcctgcaccaaactctagagctgacagcaggagct

SEQ ID NO: 13905 - DNA, 71 bp, chicken (Gallus Gallus)
  misc_feature (36): n=a or g
gatctctgtgcaggggtgaatcccttaaaacacagntgaaataaaacctttgtaactgatgttggagttat

SEQ ID NO: 13906 - DNA, 71 bp, chicken (Gallus Gallus)
  misc_feature (36): n=c or g
gatgagatagatagttgtatattgcttatcaaatancattaccagtggtacacagaatattgcttacttac

SEQ ID NO: 13907 - DNA, 71 bp, chicken (Gallus Gallus)
  misc_feature (36): n=a or g
tactcaccaacagcgagcagagcttaaatggagctntggagagacaatgaacgaagttatttcatatgaaa

SEQ ID NO: 13908 - DNA, 71 bp, chicken (Gallus Gallus)
  misc_feature (36): n=a or g
aggggacttctatgggtacagtgctgctggctgagntcaaatagaactataggatccttacaaagcaacgg

SEQ ID NO: 13909 - DNA, 71 bp, chicken (Gallus Gallus)
  misc_feature (36): n=c or t
tcctcatttctttcacattatttagatgtccaagangttttgatttgtttttaattgctattgtgctgatc

SEQ ID NO: 13910 - DNA, 71 bp, chicken (Gallus Gallus)
  misc_feature (36): n=a or g
tgcaggtagatgagactgtctcgtgcgcgcagaaangtgcgttggtggttacattgggctgcaggcacact

SEQ ID NO: 13911 - DNA, 71 bp, chicken (Gallus Gallus)
  misc_feature (36): n=c or t
gatgaccttttccaaccttactgattctatgactgnatgacagactctacgatcccacgttttcctgtctc

SEQ ID NO: 13912 - DNA, 71 bp, chicken (Gallus Gallus)
  misc_feature (36): n=a or g
tttggcacaggctgaaaacttcagccaccatttatntggggatgatattcaatctggcctgtttaatgtgc

SEQ ID NO: 13913 - DNA, 71 bp, chicken (Gallus Gallus)
  misc_feature (36): n=a or c
aaaagtgggattgggttggaagcctcagaagtgacncttctgcccaacagatgctaaggtagacccttcag

SEQ ID NO: 13914 - DNA, 71 bp, chicken (Gallus Gallus)
  misc_feature (36): n=g or t
agctcttctatgaacttcagcaagatcactcttcantcttctgtgattaacaatggtaactaatactcaaa

SEQ ID NO: 13915 - DNA, 71 bp, chicken (Gallus Gallus)
  misc_feature (36): n=a or g
aaacctgagttttcgcctgattgtagtaggtgattnctttttttcccttcacttccaagagacaatagaaa

SEQ ID NO: 13916 - DNA, 71 bp, chicken (Gallus Gallus)
  misc_feature (36): n=a or g
tctgcccctctttgggctcccagcaatgggacaacntctgatcgcacatcagttgaggaagaactttaagc

SEQ ID NO: 13917 - DNA, 71 bp, chicken (Gallus Gallus)
  misc_feature (36): n=c or t
taaactcttttcgaggtgtattattttaatagtaanattggaaatagagatgtttttcaaagtaatatgaa

SEQ ID NO: 13918 - DNA, 71 bp, chicken (Gallus Gallus)
  misc_feature (36): n=g or t
gaaaatatatgaaaaacagagttctgttcatcacantgggaggatatacatcaggcactaccacctgagcc

SEQ ID NO: 13919 - DNA, 71 bp, chicken (Gallus Gallus)
  misc_feature (36): n=c or t
acgatacgacaaacattctttaagatctatcaatangagagctgtgcatactctttgctaagaaagagcat

SEQ ID NO: 13920 - DNA, 71 bp, chicken (Gallus Gallus)
  misc_feature (36): n=a or g
tggggcattcaggaaaaccagcgattcattggcacnttgctctttagtcatgctgcactctgcccacattg

SEQ ID NO: 13921 - DNA, 71 bp, chicken (Gallus Gallus)
  misc_feature (36): n=a or g
cctgtgtctttgtggtccttgctcacctcaggatgnggctgaaactaggacagtcttcacctttctgtgcc

SEQ ID NO: 13922 - DNA, 71 bp, chicken (Gallus Gallus)
  misc_feature (36): n=a or g
tacgtgcatgcaaaagtatcagaagctgcttcactntaccctgcagagagaagcagcttctcacttcaatc

SEQ ID NO: 13923 - DNA, 71 bp, chicken (Gallus Gallus)
  misc_feature (36): n=c or g
ttgtgctcccttgtctgtagggctgatcactcctcntctgtgtccctgcaccacagcaaatataggcatct

SEQ ID NO: 13924 - DNA, 71 bp, chicken (Gallus Gallus)
  misc_feature (36): n=a or g
gtaagtggctgaacctatctgtcttctcagcacagntacagtaggctccaaagtggcgcgggtacgatgtg

SEQ ID NO: 13925 - DNA, 71 bp, chicken (Gallus Gallus)
  misc_feature (36): n=c or t
ccatgattctgcaggcacctgtgccagaatgctcangggctgataatctaatcatgaggagtcttgttcct

SEQ ID NO: 13926 - DNA, 71 bp, chicken (Gallus Gallus)
  misc_feature (36): n=a or g
cactccgcaaacaaagacgcgctgaggaacacccgnagcctcataaataaatgccgggagaggaggaaaaa

SEQ ID NO: 13927 - DNA, 71 bp, chicken (Gallus Gallus)
  misc_feature (36): n=c or t
gggactgcttctggatcgaaaacaaggaaaaatctntttggcacccctcgctttcccccccgtgaccatgg

SEQ ID NO: 13928 - DNA, 71 bp, chicken (Gallus Gallus)
  misc_feature (36): n=c or g
agtgtgctggcacaagcctggtacctgctcaggagnaaaaaaaggctttggaaaagctcaaagaagggctg

SEQ ID NO: 13929 - DNA, 71 bp, chicken (Gallus Gallus)
  misc_feature (36): n=a or g
cgcaggttgtggtagctgtccttgaaatgcagcacncggggagccccgatcagctgcccccccatctgctt

SEQ ID NO: 13930 - DNA, 71 bp, chicken (Gallus Gallus)
  misc_feature (36): n=a or g
aactggaggtttctgtgctgggtaagcaaacaaccnctctgcacgcagcataggagcacggctctgctgcc

SEQ ID NO: 13931 - DNA, 71 bp, chicken (Gallus Gallus)
  misc_feature (36): n=c or t
actgtgtgaaatttacatatgggtctggtcattggngaggggttaggaaaagtgtaagcatcccattttta

SEQ ID NO: 13932 - DNA, 71 bp, chicken (Gallus Gallus)
  misc_feature (36): n=c or t
tcttgagtttgctagctcttacagattttacaccantgtggtaagcaggtgatgaggaaatagttgttatg

SEQ ID NO: 13933 - DNA, 71 bp, chicken (Gallus Gallus)
  misc_feature (36): n=c or t
aagacagaacttcccttacaagctatacctggctanaaccttagcccatggtgatcacatctttgtaactg

SEQ ID NO: 13934 - DNA, 71 bp, chicken (Gallus Gallus)
  misc_feature (36): n=c or t
tgaactggtgacccagcagtaaaaggccccgttagngatttccctgaaccatcgagccagggtgtaacaca

SEQ ID NO: 13935 - DNA, 71 bp, chicken (Gallus Gallus)
  misc_feature (36): n=c or t
agtgctgccatcagaagccagattcatgcacagtgngctattttcgttattttaacgatactgttgatgag

SEQ ID NO: 13936 - DNA, 71 bp, chicken (Gallus Gallus)
  misc_feature (36): n=c or t
gggacaatgactgagccaggagatgctctctaatcnctgctctggttttcctgagaaaatctcatgatttg

SEQ ID NO: 13937 - DNA, 71 bp, chicken (Gallus Gallus)
  misc_feature (36): n=c or t
ccctcaagacaaaacttttagtgtagaactgcatcnctttgtgattcttgggagggattttgcgctcaatg

SEQ ID NO: 13938 - DNA, 71 bp, chicken (Gallus Gallus)
  misc_feature (36): n=a or g
tttcattcttctagtgacagtgatgaggaaaaatcnagaagaagtaaatctcccaaagccgaatttaaaaa

SEQ ID NO: 13939 - DNA, 71 bp, chicken (Gallus Gallus)
  misc_feature (36): n=a or g
tgcttcagttttgcatttaattattaatttgctgcnctcgcttccaagagatggggcttgatcagataaac

SEQ ID NO: 13940 - DNA, 71 bp, chicken (Gallus Gallus)
  misc_feature (36): n=c or t
tatgcatggtgtaataaaatcccaacttacctctcnctccttcccattcctatctacctgaaggattctac

SEQ ID NO: 13941 - DNA, 71 bp, chicken (Gallus Gallus)
  misc_feature (36): n=a or g
aatcacagaattgtaggggttggaagggtgctctgnagatcacccagttcaatcccctgctaaagcaggct

SEQ ID NO: 13942 - DNA, 71 bp, chicken (Gallus Gallus)
  misc_feature (36): n=c or t
gcaaaggtttgcaagaaagatcagacagagggaagntactttgcatataagtaggttgctctgaaagtaat

SEQ ID NO: 13943 - DNA, 71 bp, chicken (Gallus Gallus)
  misc_feature (36): n=a or c
gttaccacatagtttctgtcctttaaggcccactgntgtggcaattatcaccagaccattattgctgtact

SEQ ID NO: 13944 - DNA, 71 bp, chicken (Gallus Gallus)
  misc_feature (36): n=a or g
tatttggacaaattgtgtcacggtaaatgagactgntggggctgtgtaacttagtgtgggaaaagctgcac

SEQ ID NO: 13945 - DNA, 71 bp, chicken (Gallus Gallus)
  misc_feature (36): n=a or g
ggggaacgtagggtcagcatcatagactctatcaancagggcttgctgagcagtgtgactaactgaggtgt

SEQ ID NO: 13946 - DNA, 71 bp, chicken (Gallus Gallus)
  misc_feature (36): n=a or g
aaaaacgttaattttttgcatcactacaaaaaatancaagatgaattacactgttaagtaaatctataacc

SEQ ID NO: 13947 - DNA, 71 bp, chicken (Gallus Gallus)
  misc_feature (36): n=c or t
tttcatcagttatgtatttttgaaaactattccggnctaaatcatttagtagtgctgacttttggcattag

SEQ ID NO: 13948 - DNA, 71 bp, chicken (Gallus Gallus)
  misc_feature (36): n=c or t
agacacaccaacccaacaccacgcaccactgaaacngaaacccagtactcagttccaaagcatacaagatt

SEQ ID NO: 13949 - DNA, 71 bp, chicken (Gallus Gallus)
  misc_feature (36): n=a or g
tgcatttccagaggggacatcatctctggacatgcntttctctagtagcatttatcagtgcttacacgagg

SEQ ID NO: 13950 - DNA, 71 bp, chicken (Gallus Gallus)
  misc_feature (36): n=c or t
gctgtgctcctacactcagatttccttggttctttngtaatttggaagaccactttccaaatggtggtctc

SEQ ID NO: 13951 - DNA, 71 bp, chicken (Gallus Gallus)
  misc_feature (36): n=g or t
accgtcaaaaacaacaatcaaaactgtaaggtgtanggctttttttttttcctccagaattctttgtttct

SEQ ID NO: 13952 - DNA, 71 bp, chicken (Gallus Gallus)
  misc_feature (36): n=c or t
ggctttcagacagaaactttatttgtgtttgttctnattgagaatgtctctgctgctctatgaagcacagc

SEQ ID NO: 13953 - DNA, 71 bp, chicken (Gallus Gallus)
  misc_feature (36): n=c or t
agtgaatttggttttgcttctgcccacttatataancagcataaataaatatcccctcagctgcccatcga

SEQ ID NO: 13954 - DNA, 71 bp, chicken (Gallus Gallus)
  misc_feature (36): n=c or t
ttttggttcaattcaaatctcaattcccagatgacngttgatacagataagattaaattagtatccctgat

SEQ ID NO: 13955 - DNA, 71 bp, chicken (Gallus Gallus)
  misc_feature (36): n=a or g
tccctgtcctaacaagcccttaatgcctgttagttnccccgttgtcatactcactgtaactcctagttctc

SEQ ID NO: 13956 - DNA, 71 bp, chicken (Gallus Gallus)
  misc_feature (36): n=g or t
caatgaggaactttgttcactactgaactacagcantaggacagagaccagctcgcagctgctgctccctc

SEQ ID NO: 13957 - DNA, 71 bp, chicken (Gallus Gallus)
  misc_feature (36): n=c or t
tcacaggaatgattaccccaaaaaagcacaaatgcnatataattccacctccaatatgtttagtgggagaa

SEQ ID NO: 13958 - DNA, 71 bp, chicken (Gallus Gallus)
  misc_feature (36): n=a or g
tctgaggcagacattcaggattccttgagcatcatntagatgggaaattccattaatggtagaggtaaccc

SEQ ID NO: 13959 - DNA, 71 bp, chicken (Gallus Gallus)
  misc_feature (36): n=a or g
taaacaccttgcaggggatatcaccatgtccttacngattatgctatatgatatttagaatctggaatctg

SEQ ID NO: 13960 - DNA, 71 bp, chicken (Gallus Gallus)
  misc_feature (36): n=a or g
cctattagcttgtgagaaaattaagcacggaggccngggaagctgctaattggtagggcttttccagccac

SEQ ID NO: 13961 - DNA, 71 bp, chicken (Gallus Gallus)
  misc_feature (36): n=c or t
gtaatatgataggcagaataaaaggagagaaaaaanggactaagtattaagtaaatcaacctttctagtgc

SEQ ID NO: 13962 - DNA, 71 bp, chicken (Gallus Gallus)
  misc_feature (36): n=c or t
gttcactaacataatatgaattccaattcctgtaantcaaactcctgtttattgctttccattttgtagtt

SEQ ID NO: 13963 - DNA, 71 bp, chicken (Gallus Gallus)
  misc_feature (36): n=a or g
gctctcatacagaccgctcactgccaaggcacattncttagcaatttgctgcactgagctacctcatgctc

SEQ ID NO: 13964 - DNA, 71 bp, chicken (Gallus Gallus)
  misc_feature (36): n=c or t
tgagaacaacgtgcagcagagttcagagaatgaatnggatgaaccactctctgacagcagccagatcaagc

SEQ ID NO: 13965 - DNA, 71 bp, chicken (Gallus Gallus)
  misc_feature (36): n=a or g
tgttactcaaaatcttttctgccctcaatagcctgnctgttggtgcccagccccaggagtgctctgagctg

SEQ ID NO: 13966 - DNA, 71 bp, chicken (Gallus Gallus)
  misc_feature (36): n=c or t
cacctccctgctacacccagccccacagtctggctngacacatcatcatccccaggcaaccaaaaggaaag

SEQ ID NO: 13967 - DNA, 71 bp, chicken (Gallus Gallus)
  misc_feature (36): n=c or t
tgaacaagttttgtcttaacccatcctgaacaattngaaagtcacgatgctgttctgaaaatgagcccttc

SEQ ID NO: 13968 - DNA, 71 bp, chicken (Gallus Gallus)
  misc_feature (36): n=c or t
actagaaaagttatagcttttcgcttgttttcctanggagctgtcagaaaaataaaacaatctaattcatg

SEQ ID NO: 13969 - DNA, 71 bp, chicken (Gallus Gallus)
  misc_feature (36): n=a or g
tccagatctgttgcattgtctcttatttaccaactnagaaaaaaaccacacagaggctaaaataatctcct

SEQ ID NO: 13970 - DNA, 71 bp, chicken (Gallus Gallus)
  misc_feature (36): n=a or g
ctttgaaatgtgccatactagagacaaatgcagacntctgtatctactcagccaattgtttacgtggtatc

SEQ ID NO: 13971 - DNA, 71 bp, chicken (Gallus Gallus)
  misc_feature (36): n=a or c
cggtctcctccaggatgccggcgtaggtaaggaggngtctgagtcacgatgaggatcttgttcacatcccg

SEQ ID NO: 13972 - DNA, 71 bp, chicken (Gallus Gallus)
  misc_feature (36): n=a or g
actgctgctgagcttgctctgatatctggagaggangaattgtcagcaagtttgtctttcagatgtgccca

SEQ ID NO: 13973 - DNA, 71 bp, chicken (Gallus Gallus)
  misc_feature (36): n=a or g
gtgcttttatgaacagatgtcaccggttgctgtctnctcataccctgccaactttgtttggcctgctagga

SEQ ID NO: 13974 - DNA, 71 bp, chicken (Gallus Gallus)
  misc_feature (36): n=a or c
atgtggcctctccctcttactcagcactgctggtgncctggaaaggaaaaggaacagcagaatcacaggta

SEQ ID NO: 13975 - DNA, 71 bp, chicken (Gallus Gallus)
  misc_feature (36): n=c or t
ctcttcactaatgggcagtatggggtttaaatcccngtacattgggaatttacatatccatgtacccatcc

SEQ ID NO: 13976 - DNA, 71 bp, chicken (Gallus Gallus)
  misc_feature (36): n=c or t
agtcagggctccaagatgcccagagcccaccactanttgaaaacgttacaaagtagtactgaataaaacat

SEQ ID NO: 13977 - DNA, 71 bp, chicken (Gallus Gallus)
  misc_feature (36): n=g or t
tctgcaggaacagctgaagaagactagaacgcagcnacataagcagaaacattccccaacaacctgtgttt

SEQ ID NO: 13978 - DNA, 71 bp, chicken (Gallus Gallus)
  misc_feature (36): n=c or t
tattagataaagactaaaacacacatcttttctgcntcttctctcccagcacccatttgcacacaattcag

SEQ ID NO: 13979 - DNA, 71 bp, chicken (Gallus Gallus)
  misc_feature (36): n=c or t
tgtctcttgtaacgtcgcagagtattcacttggagntgaaacaagtcgacctggaggtgaaacagagaaca

SEQ ID NO: 13980 - DNA, 71 bp, chicken (Gallus Gallus)
  misc_feature (36): n=a or g
agccagaccttcccagagcaatgtggctgatacggnacccagctctaagtttgaaataagactagattttg

SEQ ID NO: 13981 - DNA, 71 bp, chicken (Gallus Gallus)
  misc_feature (36): n=a or g
ataaagtatcctcaactaagaagggatatgagaacngcacaggcaacgtggataactgggattgccggagc

SEQ ID NO: 13982 - DNA, 71 bp, chicken (Gallus Gallus)
  misc_feature (36): n=a or g
agagctatcgatgctaaaggacaacattggcatganaacaactgacaataaactggccatgaataaatgca

SEQ ID NO: 13983 - DNA, 71 bp, chicken (Gallus Gallus)
  misc_feature (36): n=a or c
tctcccccagcctccccccaaaggctctccttcccnttcagtcttcaactccaaacgacagtgacaacttc

SEQ ID NO: 13984 - DNA, 71 bp, chicken (Gallus Gallus)
  misc_feature (36): n=c or t
tactgcaaaacaacagcaccgcatgctataatgcangccacggtgctaggagctgcacaaaccgagcaagg

SEQ ID NO: 13985 - DNA, 71 bp, chicken (Gallus Gallus)
  misc_feature (36): n=a or g
cattatgtccttgggcttagagttgaactcagccangaggtaagattcaagaacgatacccaggggttctt

SEQ ID NO: 13986 - DNA, 71 bp, chicken (Gallus Gallus)
  misc_feature (36): n=a or g
aaatcatgccaggttttctttctgtgcttgtggatngcaggatgtagtatgaacaccatttttttgtgcct

SEQ ID NO: 13987 - DNA, 71 bp, chicken (Gallus Gallus)
  misc_feature (36): n=a or g
cctaaaatattcttggtcatacatggaagtggtacnaagtccaagtacctcttccagcaccaggtgtacaa

SEQ ID NO: 13988 - DNA, 71 bp, chicken (Gallus Gallus)
  misc_feature (36): n=c or t
ccacatggcaatggattgtgtggcaatagaggaagntcagtggtccaagaggtgttataccacacagaaga

SEQ ID NO: 13989 - DNA, 71 bp, chicken (Gallus Gallus)
  misc_feature (36): n=a or g
gctcagggtgaaaaggaaagcaaatgtggagaacancagggtgacagctgcactccagcaccttgttatgc

SEQ ID NO: 13990 - DNA, 71 bp, chicken (Gallus Gallus)
  misc_feature (36): n=c or t
ttgcctggacctctttcccttccaggaattcccacngaaccagcttgccatcctctctcctctctgacacg

SEQ ID NO: 13991 - DNA, 71 bp, chicken (Gallus Gallus)
  misc_feature (36): n=a or g
ctgccttatgacattcagctgcttcataatcagatnataggtaatcatccttgcattggaactctagtcta

SEQ ID NO: 13992 - DNA, 71 bp, chicken (Gallus Gallus)
  misc_feature (36): n=c or t
atggaagcagcttagtcccgctgcttttacagatcnaaggggaactaacgaccagcatgtcttattcttcc

SEQ ID NO: 13993 - DNA, 71 bp, chicken (Gallus Gallus)
  misc_feature (36): n=c or t
gaatacctcagtaattgaataaggaacatgatatanctttatgttgttatggaataagtatgataatgaga

SEQ ID NO: 13994 - DNA, 71 bp, chicken (Gallus Gallus)
  misc_feature (36): n=c or t
aggagactgtgacaggaagagtcaggacagagccanccatcctgctggaaggctgccccccagcttggcct

SEQ ID NO: 13995 - DNA, 71 bp, chicken (Gallus Gallus)
  misc_feature (36): n=c or g
cttcccaccctccaccccccttcatgttatgccttncatttattgcaggccaaaaatctaccagcctttct

SEQ ID NO: 13996 - DNA, 71 bp, chicken (Gallus Gallus)
  misc_feature (36): n=c or t
ttcgattggctagtgaggtgaatatgactgagttanagggatgggtgagcttcagagatagtaatggtggt

SEQ ID NO: 13997 - DNA, 71 bp, chicken (Gallus Gallus)
  misc_feature (36): n=a or g
acaatcccaatggctaaactgggatatcacccaatnctgacagtgagctcatcgctgcatccacaatatga

SEQ ID NO: 13998 - DNA, 71 bp, chicken (Gallus Gallus)
  misc_feature (36): n=g or t
caatgctcctttcctcaaaggctgggatgtgcaggncgcttctcttccgtgcttggcaaaatgaacataac

SEQ ID NO: 13999 - DNA, 71 bp, chicken (Gallus Gallus)
  misc_feature (36): n=c or t
gctggttttgctctgctcactctgagtataaagacncaactagagaaaaagaaaagtggtttgtttgcaat

SEQ ID NO: 14000 - DNA, 71 bp, chicken (Gallus Gallus)
  misc_feature (36): n=a or g
caggaccttattgcagacctcaagtacgagctgacnggcaaatttgagcggctgattgtaagcttgatgcg

SEQ ID NO: 14001 - DNA, 71 bp, chicken (Gallus Gallus)
  misc_feature (36): n=c or g
ggtaaagagttggtttttgcgtggttttgtaatagnacgtggcaggtcaccagcagtgaaaatgttcttgg

SEQ ID NO: 14002 - DNA, 71 bp, chicken (Gallus Gallus)
  misc_feature (36): n=c or t
tctaaacagctgcatacaggggagtcaagcaagacnaaaccattgacaacccctcacaaggcccactccag

SEQ ID NO: 14003 - DNA, 71 bp, chicken (Gallus Gallus)
  misc_feature (36): n=a or g
attggcaagactgtggttagatatatcatttatcantgctgcaggtgagctcagcctgagtcatctggcac

SEQ ID NO: 14004 - DNA, 71 bp, chicken (Gallus Gallus)
  misc_feature (36): n=a or g
ggatcagagcacggggcctctcctctgccagcaacnaaatctggcacagcgagaaaattcgattcgcttgc

SEQ ID NO: 14005 - DNA, 71 bp, chicken (Gallus Gallus)
  misc_feature (36): n=c or t
ccctgagtgtcccagcctcttccaagagcaatgaancagccccgccagcactctgactccacagtggggac

SEQ ID NO: 14006 - DNA, 71 bp, chicken (Gallus Gallus)
  misc_feature (36): n=c or t
aacacagggcattccagagcaaagctgcaactctcngtggacattcacattgccccatatgctataagctc

SEQ ID NO: 14007 - DNA, 71 bp, chicken (Gallus Gallus)
  misc_feature (36): n=a or g
ctttgctgcgtgtctgactgctgagctgtgagaatngagctgaaggacaacgtgctctcacaggggcatcc

SEQ ID NO: 14008 - DNA, 71 bp, chicken (Gallus Gallus)
  misc_feature (36): n=c or t
gaaggaagttcagggtgcttcagtagtcagcaaagnttgtgaagcaagtgccccagctaggatacagtgta

SEQ ID NO: 14009 - DNA, 71 bp, chicken (Gallus Gallus)
  misc_feature (36): n=a or g
ctagagacacattctttgtaacaatactttcgctangagctctttgcagcaatgctgtacagaaggaaccg

SEQ ID NO: 14010 - DNA, 71 bp, chicken (Gallus Gallus)
  misc_feature (36): n=a or t
cattacagtgaaatcctgctgccattgctgggctgngtttgtctactttggactcctgaccctcactgcct

SEQ ID NO: 14011 - DNA, 71 bp, chicken (Gallus Gallus)
  misc_feature (36): n=a or g
gaccaagtggagaagcatttgctgaacttgaatcanaagaggatgtgaaattggcattgaaaaaagacaga

SEQ ID NO: 14012 - DNA, 71 bp, chicken (Gallus Gallus)
  misc_feature (36): n=g or t
aacagaaaagccgtttttagaaacgcgctcccgccnccccccacagccctatgccgctgccgccccccgcg

SEQ ID NO: 14013 - DNA, 71 bp, chicken (Gallus Gallus)
  misc_feature (36): n=c or t
ggaaacacggattcgtgttacatcatcaaggctctnacattgcagcacacaaactatgtgagatataatca

SEQ ID NO: 14014 - DNA, 71 bp, chicken (Gallus Gallus)
  misc_feature (36): n=a or g
atcatcctgtgttctaaggaagacacagaaagctcnaaatttgcctacaaaaccattgagctgcctcatac

SEQ ID NO: 14015 - DNA, 71 bp, chicken (Gallus Gallus)
  misc_feature (36): n=c or g
taatgatccatatttaaacgtcttacctaaatttanattaagaaaaagtagcagtggaacacgaggctgaa

SEQ ID NO: 14016 - DNA, 71 bp, chicken (Gallus Gallus)
  misc_feature (36): n=a or g
ttactgatctaaaaaggagggattctcacaagtggnaagccagctgctcaaactaccagttcatctttttg

SEQ ID NO: 14017 - DNA, 71 bp, chicken (Gallus Gallus)
  misc_feature (36): n=c or g
ttcccttatgtctgtgtgctgccagggatgagaccntgctgggtcttagactgacatgaatgttattttgt

SEQ ID NO: 14018 - DNA, 71 bp, chicken (Gallus Gallus)
  misc_feature (36): n=a or g
atcgggacctgcagagaaccctcctcctgactgagngagaaaccaggtgagatgtgtttcttaaaaatcta

SEQ ID NO: 14019 - DNA, 71 bp, chicken (Gallus Gallus)
  misc_feature (36): n=a or c
acttaattaaagatcaagccaaaaggaccccagccncagaagaagcagagtatttaataacaaggtacatg

SEQ ID NO: 14020 - DNA, 71 bp, chicken (Gallus Gallus)
  misc_feature (36): n=a or g
aattgtgattgttagtggttatcaacatgagcagcnttgtggctttccctgggctgcacagctctcagtgg

SEQ ID NO: 14021 - DNA, 71 bp, chicken (Gallus Gallus)
  misc_feature (36): n=a or g
taaaatgacagcgttcactttggtagtgttattttntatttgtgcaaagggtgttatgacagaatcacagg

SEQ ID NO: 14022 - DNA, 71 bp, chicken (Gallus Gallus)
  misc_feature (36): n=g or t
ggtgcttgtttgcatccaggggcaatcacctcaccntggccaaacaggagcaaaacgtggcacagctgctc

SEQ ID NO: 14023 - DNA, 71 bp, chicken (Gallus Gallus)
  misc_feature (36): n=a or g
aggccccttcctaaggtgtgaatcccaccaaggagngaaagaaatgcggagcagcagagctggaacaagat

SEQ ID NO: 14024 - DNA, 71 bp, chicken (Gallus Gallus)
  misc_feature (36): n=a or g
catggtgcttttacctgcatttctgctggctgcccntccatcccaccagctgctgggtaaatgttttcctg

SEQ ID NO: 14025 - DNA, 71 bp, chicken (Gallus Gallus)
  misc_feature (36): n=c or g
gctgtatgaaaagttctgataggactccgaggttantgtatagatggtgagcacagagcaaaagaagaggg

SEQ ID NO: 14026 - DNA, 71 bp, chicken (Gallus Gallus)
  misc_feature (36): n=a or g
tttcaagattctgagaaagaaggggaggcctattcngatcaattattctcccattttgctttcctgacatt

SEQ ID NO: 14027 - DNA, 71 bp, chicken (Gallus Gallus)
  misc_feature (36): n=g or t
aaaaagtaattgtcaggcttaatttggatcaagaangtaatacagagggtggagtgtgaattattttgtgc

SEQ ID NO: 14028 - DNA, 71 bp, chicken (Gallus Gallus)
  misc_feature (36): n=g or t
gcttttaagttgtcaggtcagatctgctagagttancagtgagcaaagctgttggggcacagagcctaatg

SEQ ID NO: 14029 - DNA, 71 bp, chicken (Gallus Gallus)
  misc_feature (36): n=a or g
gtgttttttctgatgactctcctctgtcagctaagngagtctattgattgatatttatatatatatatttt

SEQ ID NO: 14030 - DNA, 71 bp, chicken (Gallus Gallus)
  misc_feature (36): n=a or g
ttttagtctacaggtttggggttgaaatttgtcacntgctacgtgacaaatgggacaatatcatccgcttt

SEQ ID NO: 14031 - DNA, 71 bp, chicken (Gallus Gallus)
  misc_feature (36): n=g or t
cgactcactttggttttagtgtaagcctttaccagnggctctggcaaaggcagagggcgatgtttgtgttc

SEQ ID NO: 14032 - DNA, 71 bp, chicken (Gallus Gallus)
  misc_feature (36): n=a or g
catgggtgagacagtttgcaagaaggcctgcaccangtgtttgggccctacagtatttgcacacatttctc

SEQ ID NO: 14033 - DNA, 71 bp, chicken (Gallus Gallus)
  misc_feature (36): n=a or t
ttttcttcaagagcttttgcttattctccaagactngtgagactcaatcaaagtttgaacagcaaactcta

SEQ ID NO: 14034 - DNA, 71 bp, chicken (Gallus Gallus)
  misc_feature (36): n=c or t
ttccactgcaggcattactacagttagtactacagntacctctatacctgtctagaacatgagccaccagc

SEQ ID NO: 14035 - DNA, 71 bp, chicken (Gallus Gallus)
  misc_feature (36): n=a or t
cagttggagaaggatactagaacagtttactgtgcngtctgatgttgtttctgacgtgtacattattatta

SEQ ID NO: 14036 - DNA, 71 bp, chicken (Gallus Gallus)
  misc_feature (36): n=a or g
aaacaccatgtgctttacttacatctcagggttaancaacttgccaggctttgggctgggagaaaggtttg

SEQ ID NO: 14037 - DNA, 71 bp, chicken (Gallus Gallus)
  misc_feature (36): n=a or g
ttctgatcaccagtaaaaatagatgttgattgtgcntaactgttgatacccataactgatttagaaatttc

SEQ ID NO: 14038 - DNA, 71 bp, chicken (Gallus Gallus)
  misc_feature (36): n=c or g
aacaaatttaccctctccaaatcagtcactgttggnagtacagttggcaactctggtgatgcatttgcttc

SEQ ID NO: 14039 - DNA, 71 bp, chicken (Gallus Gallus)
  misc_feature (36): n=c or t
ggccgcgtgcagtggatgactcctgttgtttgctcnagatcagtgacttctcacagcacatgatttcaagc

SEQ ID NO: 14040 - DNA, 71 bp, chicken (Gallus Gallus)
  misc_feature (36): n=g or t
ccatcctggatagttttgttgccacagttaagctgngctgatgggctggcagaggacccactgtcttttca

SEQ ID NO: 14041 - DNA, 71 bp, chicken (Gallus Gallus)
  misc_feature (36): n=c or g
aagttttgttgggtgagcactgcttgaggcaccagnaggcagaagagggtgtgcaggatctcacatagcaa

SEQ ID NO: 14042 - DNA, 71 bp, chicken (Gallus Gallus)
  misc_feature (36): n=a or g
ccaatctaaccacaatacagcagctctgacttgcanacacctacttccagcacccattcttcagtcgttta

SEQ ID NO: 14043 - DNA, 71 bp, chicken (Gallus Gallus)
  misc_feature (36): n=c or t
ctttaaggtcacttgagagagatttaacacaaacangcagcgtgataaagaggatttggaagggcttaaaa

SEQ ID NO: 14044 - DNA, 71 bp, chicken (Gallus Gallus)
  misc_feature (36): n=c or t
gtgctgccaaggcccaaactgatggcaccgagaagnttatctttgcgtaggtaaaaagaggatgcacaaac

SEQ ID NO: 14045 - DNA, 71 bp, chicken (Gallus Gallus)
  misc_feature (36): n=a or c
cttagcccagcttgtctgaaaaggttcatagactcngaaacttcagattcctgggccaactcaaacagggt

SEQ ID NO: 14046 - DNA, 71 bp, chicken (Gallus Gallus)
  misc_feature (36): n=a or g
gggaatataatggcaatatgtacaagcatgaaactngtatgagcaggatgcagagaggagattctggatga

SEQ ID NO: 14047 - DNA, 71 bp, chicken (Gallus Gallus)
  misc_feature (36): n=c or t
aatagatatacagacaatgaatgactaaatatgtangtgttcatatgcatatgtcttactaccacaaggat

SEQ ID NO: 14048 - DNA, 71 bp, chicken (Gallus Gallus)
  misc_feature (36): n=c or t
aagagagagaagaagtgagaatgaggagaattcacnttcagagacagattaaataacatcaggtcttgaag

SEQ ID NO: 14049 - DNA, 71 bp, chicken (Gallus Gallus)
  misc_feature (36): n=c or t
tctatgcaagtggtaaaggatttattaaattatttncatggtcaagtacaatgttgcatattttgcaagat

SEQ ID NO: 14050 - DNA, 71 bp, chicken (Gallus Gallus)
  misc_feature (36): n=c or t
agaaatttcttaagtctccactgcatttgcaaacangatttatgtatttttaagacaagtgtttttctttt

SEQ ID NO: 14051 - DNA, 71 bp, chicken (Gallus Gallus)
  misc_feature (36): n=a or g
aaagaaaattacaggaaataagaacaaaaataaaancaaacactgatttatatatgtgtatatatatatat

SEQ ID NO: 14052 - DNA, 71 bp, chicken (Gallus Gallus)
  misc_feature (36): n=c or t
ctttttaaggaatattggcttattataaatcagaantggatatatcagcgtatcagtcctcagtttttctt

SEQ ID NO: 14053 - DNA, 71 bp, chicken (Gallus Gallus)
  misc_feature (36): n=c or g
tagagatgtgcataaatacaaattctaaaaaaagcnagattagtatcttatctgatacttcaaccaagtgg

SEQ ID NO: 14054 - DNA, 71 bp, chicken (Gallus Gallus)
  misc_feature (36): n=a or g
gtgggtatttctagtaaggctgtatggtaatctgcngaaacccaaggaataaatgaaatgctttccattca

SEQ ID NO: 14055 - DNA, 71 bp, chicken (Gallus Gallus)
  misc_feature (36): n=c or t
actgaaactatgcatgctcccaacgagctttaggantctcctccaaggagctcccagccccattaaatacc

SEQ ID NO: 14056 - DNA, 71 bp, chicken (Gallus Gallus)
  misc_feature (36): n=c or t
gtcaccatccccatgagaaaagcaaagtgttaaaanattttatgcaggtgttctgcaggatctgtttttac

SEQ ID NO: 14057 - DNA, 71 bp, chicken (Gallus Gallus)
  misc_feature (36): n=a or g
ctggtttctccccagaaaaacacttccaggtcaatngctaaggagaaattgtatctgttagcagcaattct

SEQ ID NO: 14058 - DNA, 71 bp, chicken (Gallus Gallus)
  misc_feature (36): n=a or t
attgcttttcaggcaacactgagctgcacgttttanatgggattggagggttttaatgcacacatcctgct

SEQ ID NO: 14059 - DNA, 71 bp, chicken (Gallus Gallus)
  misc_feature (36): n=a or g
cagatatataaggcactatgaagtggataatttggnggttgtcctcctttcccctgtaattccacgacgtt

SEQ ID NO: 14060 - DNA, 71 bp, chicken (Gallus Gallus)
  misc_feature (36): n=g or t
gagtgtttgtaactgcaatcacatagttgcatcacnaaatttaaaatggacttttgttttattaccacttt

SEQ ID NO: 14061 - DNA, 71 bp, chicken (Gallus Gallus)
  misc_feature (36): n=a or g
taacactgatgcaaatcttctgctctgacgacagtngtaaataatgcagagtgaggaaacttctgagcact

SEQ ID NO: 14062 - DNA, 71 bp, chicken (Gallus Gallus)
  misc_feature (36): n=g or t
aaatccccgcatgggctgaacggatgacttcagcgngtaacatttggaaaagacacaacaaaaccagccag

SEQ ID NO: 14063 - DNA, 71 bp, chicken (Gallus Gallus)
  misc_feature (36): n=a or g
ttagcacagacctcttgaatactcttaataaaatcnagggctggaaggaatacttttgctaacgctcgtat

SEQ ID NO: 14064 - DNA, 71 bp, chicken (Gallus Gallus)
  misc_feature (36): n=a or g
tttttcactagaagtaacgtttgggaatgttccccngtgaagcaaaaggccaggctgatttctagcaagca

SEQ ID NO: 14065 - DNA, 71 bp, chicken (Gallus Gallus)
  misc_feature (36): n=a or g
ggtgtgtggctgcggaatgttatgggctgggatgangaggtaaagtttgggttcaaacacaggaaggtgga

SEQ ID NO: 14066 - DNA, 71 bp, chicken (Gallus Gallus)
  misc_feature (36): n=a or g
acaacgcttggttctcctgcagaataacgaagagcngagtctgtggatctcagggagtttcccttttagct

SEQ ID NO: 14067 - DNA, 71 bp, chicken (Gallus Gallus)
  misc_feature (36): n=a or g
caatgggacagccattattgtccctcctctccatcnctgggtactatgtctattgcacttagctaatttag

SEQ ID NO: 14068 - DNA, 71 bp, chicken (Gallus Gallus)
  misc_feature (36): n=c or t
atgaagcatgagtagctgtagctctgggagtaaaantgtgcatctggtcctagtggaggtgtggtctcagc

SEQ ID NO: 14069 - DNA, 71 bp, chicken (Gallus Gallus)
  misc_feature (36): n=c or t
agaacactctcctcacccagtgctggatgacatccncaccatctcctgataactgggcatttgtagagctc

SEQ ID NO: 14070 - DNA, 71 bp, chicken (Gallus Gallus)
  misc_feature (36): n=a or g
gccaggagaattaattccaaagggagaaaaaggggnaaaaaaaagacaacgtgaagaacaaagtctttcat

SEQ ID NO: 14071 - DNA, 71 bp, chicken (Gallus Gallus)
  misc_feature (36): n=a or g
cagacccagtaatggagctcagagcagtctctgggnttctgggcccaaaatactaacaaacactcgcctgc

SEQ ID NO: 14072 - DNA, 71 bp, chicken (Gallus Gallus)
  misc_feature (36): n=c or t
ttcagtagaccttggtttctcttaggtagggctggntgctcccccaaccccttccgcttggcaggaaatct

SEQ ID NO: 14073 - DNA, 71 bp, chicken (Gallus Gallus)
  misc_feature (36): n=a or t
tgtatgtttcagtaacaagacagattagcatctagngtctattactgaatgttttctgaacttatagggtt

SEQ ID NO: 14074 - DNA, 71 bp, chicken (Gallus Gallus)
  misc_feature (36): n=a or g
ttgggaagacacccgtgttttagatagaggaatctntgaagcttataaactcacattcccctcttttctag

SEQ ID NO: 14075 - DNA, 71 bp, chicken (Gallus Gallus)
  misc_feature (36): n=g or t
tctaagcagaaaccaacatttgttaaaagcttgtcncactcaagcaaattaatacaaccaaaaagccgaag

SEQ ID NO: 14076 - DNA, 71 bp, chicken (Gallus Gallus)
  misc_feature (36): n=a or g
gttgaaactggatgctcattatggtccctttcagcnccggccatcctatgattctacaatcctatgaagtg

SEQ ID NO: 14077 - DNA, 71 bp, chicken (Gallus Gallus)
  misc_feature (36): n=c or t
gatgaatgcactacttttgtagctatcaaaaccagntgttccggagatctacgacagtattttatctctag

SEQ ID NO: 14078 - DNA, 71 bp, chicken (Gallus Gallus)
  misc_feature (36): n=a or g
acagaatcctccatcatcaccagggcaggagatctntcacagatgactttttggctgccattttacaattg

SEQ ID NO: 14079 - DNA, 71 bp, chicken (Gallus Gallus)
  misc_feature (36): n=a or g
gcctctgaggcgtctgaaacaaggcaccaaaaagcnctgtttgctcaaccacattcataaactattcataa

SEQ ID NO: 14080 - DNA, 71 bp, chicken (Gallus Gallus)
  misc_feature (36): n=a or g
tcccttgttgttttttatgaatgaaaaataaaaggncattggatcctggaggagcaagaatagaagcccaa

SEQ ID NO: 14081 - DNA, 71 bp, chicken (Gallus Gallus)
  misc_feature (36): n=a or g
aatagaaataatctggtaggcaaaaatagggcaggntgagaccagctcagtagtgctgggaatatgctgtt

SEQ ID NO: 14082 - DNA, 71 bp, chicken (Gallus Gallus)
  misc_feature (36): n=c or t
aggactgcttgcaaacaactgaagcagcggctacanctcgccttccaactctctgctgcccactggtttgc

SEQ ID NO: 14083 - DNA, 71 bp, chicken (Gallus Gallus)
  misc_feature (36): n=c or t
gggtccctgctgggggtcctggctggggccgtgtgncccacacgtaacttgtggatactcacaggctcttc

SEQ ID NO: 14084 - DNA, 71 bp, chicken (Gallus Gallus)
  misc_feature (36): n=c or t
gtatgcttgcaatattttaataaagagaaataaaanggattaccttgaatagccattagagaaagcaggtc

SEQ ID NO: 14085 - DNA, 71 bp, chicken (Gallus Gallus)
  misc_feature (36): n=a or g
tgcctgtgacaattcatgtgagccatcctccatccntgcagggagggtggtgaggtgctggcagtgctgtc

SEQ ID NO: 14086 - DNA, 71 bp, chicken (Gallus Gallus)
  misc_feature (36): n=c or t
ggaaaatacaggaatgaccctggaaatgttgcacantgccttcttcctgctccaagaggcagggctgcctt

SEQ ID NO: 14087 - DNA, 71 bp, chicken (Gallus Gallus)
  misc_feature (36): n=g or t
gcagattttcttcactcagtgtaaagaagctgcaantcatttccacacttcaataactcaacaaatcccat

SEQ ID NO: 14088 - DNA, 71 bp, chicken (Gallus Gallus)
  misc_feature (36): n=c or g
atccaggagtactgcagaagggtcatttggtcatcnaggtgtaagtttctgaaaccttaacaacacaaaaa

SEQ ID NO: 14089 - DNA, 71 bp, chicken (Gallus Gallus)
  misc_feature (36): n=c or t
aggactgcaaccatggaaataagacctcactgctgntgttgaaaacatgcccagccgttgcagcctctctg

SEQ ID NO: 14090 - DNA, 71 bp, chicken (Gallus Gallus)
  misc_feature (36): n=c or t
agtcccatggatagcgacactgccttggacaggtcnggcggaggcacattgtttaccaatccttttgagaa

SEQ ID NO: 14091 - DNA, 71 bp, chicken (Gallus Gallus)
  misc_feature (36): n=c or g
tggggagaagtcttttgcattatgggtgtcttcctnttggaatcttgcattacaggaaattgaggctgcct

SEQ ID NO: 14092 - DNA, 71 bp, chicken (Gallus Gallus)
  misc_feature (36): n=c or t
atcctgtcactacctgaccttataacaagtccctgnctggctttcctgtaggccccttcaggtactggaag

SEQ ID NO: 14093 - DNA, 71 bp, chicken (Gallus Gallus)
  misc_feature (36): n=c or t
tcaaaacgacccatacctagaatgctcacccttcanccattattaaagttactgagtgaaacaactcagaa

SEQ ID NO: 14094 - DNA, 71 bp, chicken (Gallus Gallus)
  misc_feature (36): n=a or t
tacctcctgtcatcctttcccataccttgtgtcatnctcctttgttgtttctgataagtagaggcctgcac

SEQ ID NO: 14095 - DNA, 71 bp, chicken (Gallus Gallus)
  misc_feature (36): n=g or t
aagtaaattattgatttcgtttcttaaaggatcaanctcctcttcaatcatttttaacatttcttctgact

SEQ ID NO: 14096 - DNA, 71 bp, chicken (Gallus Gallus)
  misc_feature (36): n=c or t
agatgtgcaaaaaatcacaaaaatacagtctattanctttttcagatgtttagaattctcatttcattttc

SEQ ID NO: 14097 - DNA, 71 bp, chicken (Gallus Gallus)
  misc_feature (36): n=c or t
cgagcagtaaaaattggaagtgcaactgatttaagngtcttgagatgaagaactttcacatttttccaatt

SEQ ID NO: 14098 - DNA, 71 bp, chicken (Gallus Gallus)
  misc_feature (36): n=c or t
taaagtacttggaatttttaatactcactctcatantctcccttctgttccatacagaccattatcatttc

SEQ ID NO: 14099 - DNA, 71 bp, chicken (Gallus Gallus)
  misc_feature (36): n=a or g
taacaagaacttcttaccctgtgctctgtgcattantcttacctggtccgtgccttcagcttttgctattt

SEQ ID NO: 14100 - DNA, 71 bp, chicken (Gallus Gallus)
  misc_feature (36): n=c or t
acgtgcaagtaaatttcaagcactattaatacctantactataaatgtaggaccaattaatttattcttac

SEQ ID NO: 14101 - DNA, 71 bp, chicken (Gallus Gallus)
  misc_feature (36): n=c or t
tttactgctcagcacaagggtgataaaagtcatgtnctgaatgaagttccctgtatttgcttggtggagaa

SEQ ID NO: 14102 - DNA, 71 bp, chicken (Gallus Gallus)
  misc_feature (36): n=a or g
actgtaataactgcaaggtttgtattccatctactncctggtccctaaaagcagccagctatttcagagga

SEQ ID NO: 14103 - DNA, 71 bp, chicken (Gallus Gallus)
  misc_feature (36): n=c or t
acacgttttttcctgttagaaaacagatgcaaatgntaccaattcatagtgttatgtattttctgcagtgg

SEQ ID NO: 14104 - DNA, 71 bp, chicken (Gallus Gallus)
  misc_feature (36): n=a or g
gatttgcctaacgttgctggatcttacctcacgcancagctgctcctttgctaccctccgcttaaccctac

SEQ ID NO: 14105 - DNA, 71 bp, chicken (Gallus Gallus)
  misc_feature (36): n=a or g
cgctctcaccctaactgcccatgttatgctgttgcngactgttgcctttcagtattcaatatgtgaatgcc

SEQ ID NO: 14106 - DNA, 71 bp, chicken (Gallus Gallus)
  misc_feature (36): n=c or t
cacttagctggcgtgtgataactttccaggcgcttnacagttcaagactcagactccaatttcataatcaa

SEQ ID NO: 14107 - DNA, 71 bp, chicken (Gallus Gallus)
  misc_feature (36): n=g or t
agcaacttggattttttttttttttttttttttttngtctgtgtataatgtagtatattttagaaattgct

SEQ ID NO: 14108 - DNA, 71 bp, chicken (Gallus Gallus)
  misc_feature (36): n=c or t
cactgcagaatctatttcataaagtacgctacaggngctgattcgtgaggagctagagacttccatgtcct

SEQ ID NO: 14109 - DNA, 71 bp, chicken (Gallus Gallus)
  misc_feature (36): n=a or t
agagctggtgatttttccaaagaaatgtctgcacgngtcctggtctgacatcctgcccacacctcccgtgg

SEQ ID NO: 14110 - DNA, 71 bp, chicken (Gallus Gallus)
  misc_feature (36): n=a or g
agcacttccggactgccaccataccagtgtgtttcnattaaatagatcctgttatagatgaagatgggagg

SEQ ID NO: 14111 - DNA, 71 bp, chicken (Gallus Gallus)
  misc_feature (36): n=a or t
ttgtgaataagtgtgcaactctactgactaattatnggaatggtattgtttgaaaaacctttgaagcctaa

SEQ ID NO: 14112 - DNA, 71 bp, chicken (Gallus Gallus)
  misc_feature (36): n=c or g
gtatgctttcccacctctgagccatttctgtgcctntgcagtccccactcagtgcctttcaactcacactg

SEQ ID NO: 14113 - DNA, 71 bp, chicken (Gallus Gallus)
  misc_feature (36): n=a or g
tcccttgtttgcagtctaaggaaaacgtcatgaagntggctggggctgaaccccggggcagtgctgctggt

SEQ ID NO: 14114 - DNA, 71 bp, chicken (Gallus Gallus)
  misc_feature (36): n=c or t
ttcaaaaatgaggatatgccaaaacagtgtgttaangttcgtggtacacttgaatatgtttgcagttattt

SEQ ID NO: 14115 - DNA, 71 bp, chicken (Gallus Gallus)
  misc_feature (36): n=c or t
ctgaagtgagaaaaggtcctgcaactgatggtgccngaccttaactgtggtgtgtagtgctgctggaaaca

SEQ ID NO: 14116 - DNA, 71 bp, chicken (Gallus Gallus)
  misc_feature (36): n=c or g
tttaattcaaagtattacaatgaacaatttgcatanaatgaaggaggaatagatgaaggacaggaagctga

SEQ ID NO: 14117 - DNA, 71 bp, chicken (Gallus Gallus)
  misc_feature (36): n=c or t
tggaatctggtttgcaaagtggatgtaacaggaagnggtctgaagatgtcagcagacactgaatgcacgtt

SEQ ID NO: 14118 - DNA, 71 bp, chicken (Gallus Gallus)
  misc_feature (36): n=a or g
tctgtatgtgcattccaaggcacttgcttaactctngtgacatttatttccttaaatattttgtgaaatct

SEQ ID NO: 14119 - DNA, 71 bp, chicken (Gallus Gallus)
  misc_feature (36): n=c or t
tgcagttcatgtactgcgtgcgctcactaagaacanaggttttctggaaggatttttctctctgtgccgcg

SEQ ID NO: 14120 - DNA, 71 bp, chicken (Gallus Gallus)
  misc_feature (36): n=c or t
accgtactcctcagggtatgaaagtgtttctcttcnctaattcttcaatccatctctgctttagaactgca

SEQ ID NO: 14121 - DNA, 71 bp, chicken (Gallus Gallus)
  misc_feature (36): n=a or g
cgagtatgtaattcctagcatttacagacaggaacnttggaaatagagtggcaaagagcagggtagtccta

SEQ ID NO: 14122 - DNA, 71 bp, chicken (Gallus Gallus)
  misc_feature (36): n=c or g
acggactggagatgtaagaagaataccgaggtgttntttataccagccctaacacagagtagaatgagagc

SEQ ID NO: 14123 - DNA, 71 bp, chicken (Gallus Gallus)
  misc_feature (36): n=g or t
ggatcactctgagaatctgtcaaagtgttttttggnttttttctaagcacttgcaataagaattaattaaa

SEQ ID NO: 14124 - DNA, 71 bp, chicken (Gallus Gallus)
  misc_feature (36): n=a or g
aagagtggaagtttgagatgcaatataaaccttaanggcataataatcctaaacaacaacagtaacgcacc

SEQ ID NO: 14125 - DNA, 71 bp, chicken (Gallus Gallus)
  misc_feature (36): n=a or g
gtttgattatgtctgtgttaataaaggatttgaacngaactagaggtggtttttacgtttgcaggtccact

SEQ ID NO: 14126 - DNA, 71 bp, chicken (Gallus Gallus)
  misc_feature (36): n=a or g
gttctcagctatatttgctacttcgttttagtagcnaatataaacctacagaatagatcctcagctgccat

SEQ ID NO: 14127 - DNA, 71 bp, chicken (Gallus Gallus)
  misc_feature (36): n=c or t
tcattagccaggcacagttcttacatttgtgctctnctgctagatgtcgtattgttgagtccacaaataca

SEQ ID NO: 14128 - DNA, 71 bp, chicken (Gallus Gallus)
  misc_feature (36): n=a or g
tcatagaagcagagctcctgaaataacaactactcnaatctttttctctgtcaagagctgtttcaggggaa

SEQ ID NO: 14129 - DNA, 71 bp, chicken (Gallus Gallus)
  misc_feature (36): n=c or g
tgcattcttttaactgtaccagtttcctgcattgtnctgccttttaccaaaccccatggttgtggtttgca

SEQ ID NO: 14130 - DNA, 71 bp, chicken (Gallus Gallus)
  misc_feature (36): n=c or t
tattagcacataattcattaaaatggcttggcactnaggcttatgctactgacactacatgagctaatgct

SEQ ID NO: 14131 - DNA, 71 bp, chicken (Gallus Gallus)
  misc_feature (36): n=c or t
gcctcagtgagcctacaaaccctgtcttgatggagngtcatgtcgtgtctgctggaccaagcaacaggtgg

SEQ ID NO: 14132 - DNA, 71 bp, chicken (Gallus Gallus)
  misc_feature (36): n=c or t
ctgatctgggactctgtaagtgcaggactgcactgngagctcctgcgtgccgtttggcagcagtggacatc

SEQ ID NO: 14133 - DNA, 71 bp, chicken (Gallus Gallus)
  misc_feature (36): n=a or g
agtttaattcccagctacttgcttactgactcctcnctgctactcgctccctgcattcctctgggtatcta

SEQ ID NO: 14134 - DNA, 71 bp, chicken (Gallus Gallus)
  misc_feature (36): n=a or g
aagcaaaatagttgcaaaatattcgcttgatctgtngtgcagatctttttcccttcgttataattgatgtt

SEQ ID NO: 14135 - DNA, 71 bp, chicken (Gallus Gallus)
  misc_feature (36): n=a or g
tttttttatttctcagactatgaaagacataatgcngaaatagcagcatttcatttggacaggcaagtaaa

SEQ ID NO: 14136 - DNA, 71 bp, chicken (Gallus Gallus)
  misc_feature (36): n=c or t
ttcatttctcaaccctctaacatgtaattcctgganagatgccctaagctgaaagagaaaaagctctgctt

SEQ ID NO: 14137 - DNA, 71 bp, chicken (Gallus Gallus)
  misc_feature (36): n=a or g
tctgctcttaggatctgagttgtccctcttattacncatcccatccacctgttacagtggtgacacaaagc

SEQ ID NO: 14138 - DNA, 71 bp, chicken (Gallus Gallus)
  misc_feature (36): n=c or t
tctgtaacaattggagccttcttctttcatgcagcnaaacaggaatgtgtgactgcagatgcccaaacctg

SEQ ID NO: 14139 - DNA, 71 bp, chicken (Gallus Gallus)
  misc_feature (36): n=a or g
caatactttaatttctcttttttttttttctgtttnaacacacatctgactgattttacagtagttgaact

SEQ ID NO: 14140 - DNA, 71 bp, chicken (Gallus Gallus)
  misc_feature (36): n=c or t
caaacgttaagtgtttgctgaggtctgtaagactcnggcccatgtgctgtaatacctgtgacatccaacgc

SEQ ID NO: 14141 - DNA, 71 bp, chicken (Gallus Gallus)
  misc_feature (36): n=a or g
tgtacatacttttcatctctttcatgttacttcaanagtgagcagaaagtactgcagctacagaagtatgc

SEQ ID NO: 14142 - DNA, 71 bp, chicken (Gallus Gallus)
  misc_feature (36): n=a or c
agctacttcatggaattcccttcaggaaccaaccanacctaacattaaaactttattcccatccgaaggct

SEQ ID NO: 14143 - DNA, 71 bp, chicken (Gallus Gallus)
  misc_feature (36): n=c or t
aaacccaaaccgcaggcggaaaatgtgtattaatgngcttatgggggtaaggcttcatcgccgcagagagg

SEQ ID NO: 14144 - DNA, 71 bp, chicken (Gallus Gallus)
  misc_feature (36): n=c or g
ctgccttctcagccacagactctcctacttaataancttacgagctgctgatgaactgaatagacacacac

SEQ ID NO: 14145 - DNA, 71 bp, chicken (Gallus Gallus)
  misc_feature (36): n=c or t
acgcttgtccttttccaggagaaaaacaagaaaganagcctcttccatgatgacaacttaatagcatccat

SEQ ID NO: 14146 - DNA, 71 bp, chicken (Gallus Gallus)
  misc_feature (36): n=a or g
ctctcactcagtctcctgcagccctgtgatacatcntcattatcttgtggtaccaaagaggagattggaga

SEQ ID NO: 14147 - DNA, 71 bp, chicken (Gallus Gallus)
  misc_feature (36): n=a or c
attcctcctcatctcccatcttggagctgtaacagnactgggtactacaagggctgctcagaaagggactg

SEQ ID NO: 14148 - DNA, 71 bp, chicken (Gallus Gallus)
  misc_feature (36): n=a or g
tcgtaacatacactcagtcccagcactaccagaagntatctaacaaatgacccatcttcagagggaaccca

SEQ ID NO: 14149 - DNA, 71 bp, chicken (Gallus Gallus)
  misc_feature (36): n=c or t
aaaaatatatatatctaaatgagaaatacagcacangcgctacaagtttagacagcttctcctctctggtt

SEQ ID NO: 14150 - DNA, 71 bp, chicken (Gallus Gallus)
  misc_feature (36): n=c or t
gctcggtcgctgctgttttatttttattatctttanttctttaaaaacaataattagaaataagcaggctc

SEQ ID NO: 14151 - DNA, 71 bp, chicken (Gallus Gallus)
  misc_feature (36): n=a or g
ccacttccaaacatttcctttggaaagctatttatnggcatgtaatgccacaacgtgatggaaagcacagc

SEQ ID NO: 14152 - DNA, 71 bp, chicken (Gallus Gallus)
  misc_feature (36): n=c or t
atggactgtcatgagcagactgagcaaaactaagangtgggcgaagctggtggaggaatgtgctgggaaag

SEQ ID NO: 14153 - DNA, 71 bp, chicken (Gallus Gallus)
  misc_feature (36): n=g or t
agcctctgtgctggttctgctgatactgctgggtancagcacagcacacgtcttctctgccctgaatctgc

SEQ ID NO: 14154 - DNA, 71 bp, chicken (Gallus Gallus)
  misc_feature (36): n=a or g
acagcacaaattaatattaggggcttccctgccaancagctttaaccaccgtaggacacatttcctccctt

SEQ ID NO: 14155 - DNA, 71 bp, chicken (Gallus Gallus)
  misc_feature (36): n=c or t
tccaccacttccatgaaatgcccattccaataggtngtagccctgtctgggaataaattttcctaatattc

SEQ ID NO: 14156 - DNA, 71 bp, chicken (Gallus Gallus)
  misc_feature (36): n=a or g
agggaagaaggaaaaccagctcttctggctgaaganctgcaccatcttcctaagagccagcacagtgctgt

SEQ ID NO: 14157 - DNA, 71 bp, chicken (Gallus Gallus)
  misc_feature (36): n=c or t
tttttcttccttcccttcattatgagacacttcttnggcaggacgggtccctcctcagccacaggcagtgc

SEQ ID NO: 14158 - DNA, 71 bp, chicken (Gallus Gallus)
  misc_feature (36): n=a or g
tccatattcttgcactctggaagggtggatgcaccnggttttctccattctgccacattgtagtgccttta

SEQ ID NO: 14159 - DNA, 71 bp, chicken (Gallus Gallus)
  misc_feature (36): n=a or g
gctgtatattttgggtatataagcggtgagaagagntaagcacataggagccacttctgcattaatgccag

SEQ ID NO: 14160 - DNA, 71 bp, chicken (Gallus Gallus)
  misc_feature (36): n=a or t
tgcgctagacacagaggacctgcaaaaagatacaanccatatcatgaggtagagaacaggaacaccactct

SEQ ID NO: 14161 - DNA, 71 bp, chicken (Gallus Gallus)
  misc_feature (36): n=c or t
tggaggattttagaagcccctttaaaacatgaaacntgcctttttattatgagcatccctaggaggactgt

SEQ ID NO: 14162 - DNA, 71 bp, chicken (Gallus Gallus)
  misc_feature (36): n=a or g
tctcagtgcctccgaatctctctcctctccatctcntatctcacctcactgcagctttttaattgcacagc

SEQ ID NO: 14163 - DNA, 71 bp, chicken (Gallus Gallus)
  misc_feature (36): n=c or g
actgagacaaaacctgcaggagttcttgctaagttnttggttctgcctggtggatgctacactgtgggaac

SEQ ID NO: 14164 - DNA, 71 bp, chicken (Gallus Gallus)
  misc_feature (36): n=a or g
ggcagcagagcacataggacaggaaaccagtccttntgtaggaggatgagcccttccatttatttatctga

SEQ ID NO: 14165 - DNA, 71 bp, chicken (Gallus Gallus)
  misc_feature (36): n=a or g
ggaaggaggcttgggatttacgctgaagcttagagnacagtgaattgctccatcatttgaaaagaaggttc

SEQ ID NO: 14166 - DNA, 71 bp, chicken (Gallus Gallus)
  misc_feature (36): n=a or g
aaacaaggaagaatcgggtgagtgccttcagtgcantgacttcttgagtgtgggaggcagtgagttttcct

SEQ ID NO: 14167 - DNA, 71 bp, chicken (Gallus Gallus)
  misc_feature (36): n=c or t
ctgaaagataacctgaataatattatttaaattacngttgtgggatgccttgagtgttttgaatacaaaga

SEQ ID NO: 14168 - DNA, 71 bp, chicken (Gallus Gallus)
  misc_feature (36): n=c or t
accatagcagccttcctttgcaatctcttcattttncctggaaaggtaaatatttgaaaacactgcaagat

SEQ ID NO: 14169 - DNA, 71 bp, chicken (Gallus Gallus)
  misc_feature (36): n=a or g
tctctgtttaacaaattggctatgtatattggccantggataacagatggaagaactccagcagtctgttt

SEQ ID NO: 14170 - DNA, 71 bp, chicken (Gallus Gallus)
  misc_feature (36): n=c or g
caatgctgacacatagtgaatcatacttcctgctantcctaattgcagaaatacatcttttgcttgttact

SEQ ID NO: 14171 - DNA, 71 bp, chicken (Gallus Gallus)
  misc_feature (36): n=a or g
tgattcagtgcgtggctttggtttcagtcttttatnaaggaaattcagagaggtggtcttgctctgtgagg

SEQ ID NO: 14172 - DNA, 71 bp, chicken (Gallus Gallus)
  misc_feature (36): n=a or g
acactttgtaggttaattatctatgggtaactttancttttagaggtaaaggcatccaaagtcctgttgta

SEQ ID NO: 14173 - DNA, 71 bp, chicken (Gallus Gallus)
  misc_feature (36): n=c or t
ccacgttgatgtattggatgcactctgcaaagccangcagtcacagcctggctcaggcagggcagggaagg

SEQ ID NO: 14174 - DNA, 71 bp, chicken (Gallus Gallus)
  misc_feature (36): n=a or g
agtggataaagtaaggaagctcttgatatttacaangtaatgtaagaagcacacctgaattaaataaaaat

SEQ ID NO: 14175 - DNA, 71 bp, chicken (Gallus Gallus)
  misc_feature (36): n=a or t
ttcaggattttaaattatatccatatggagatgttngcaatgtttagggagagttgccatcaggttatctg

SEQ ID NO: 14176 - DNA, 71 bp, chicken (Gallus Gallus)
  misc_feature (36): n=a or g
ggaggtttgggctctctgggtatttcgtgccttgcnttcatttctacacagtgtttgagaataaattttgt

SEQ ID NO: 14177 - DNA, 71 bp, chicken (Gallus Gallus)
  misc_feature (36): n=a or g
aaaagtctgattaaatgcttttgttaatgaaatacncttttcactgtgggagaattacaaatcctcgtagt

SEQ ID NO: 14178 - DNA, 71 bp, chicken (Gallus Gallus)
  misc_feature (36): n=a or g
tgtttccatgggaactgagactggccttagcagccncaagaagcagactttattggtatacttacaaattt

SEQ ID NO: 14179 - DNA, 71 bp, chicken (Gallus Gallus)
  misc_feature (36): n=c or g
aattgtgtgttgtcagctgagatcctgatgaatctnagctgacagcacaagaagcgagcagtgggccaaac

SEQ ID NO: 14180 - DNA, 71 bp, chicken (Gallus Gallus)
  misc_feature (36): n=a or g
tcttaaatataagccaaaggtagaaaaatatcccantgggaaaccaaccgctacgttatctggacatcgta

SEQ ID NO: 14181 - DNA, 71 bp, chicken (Gallus Gallus)
  misc_feature (36): n=a or g
ggaggaaaagcatcgcctcacattttgcagatggancacaactccaaagcgcatcccatgaggggcatgga

SEQ ID NO: 14182 - DNA, 71 bp, chicken (Gallus Gallus)
  misc_feature (36): n=a or g
agccaaacattgcagtaaattccaaggagaactganctgcttttccacttctaatgccactaagtagctca

SEQ ID NO: 14183 - DNA, 71 bp, chicken (Gallus Gallus)
  misc_feature (36): n=c or t
gcagaacacccatgtacacgttccttttgtttgctngagtggcctggtgggagcagcgctgctgtgatgca

SEQ ID NO: 14184 - DNA, 71 bp, chicken (Gallus Gallus)
  misc_feature (36): n=a or g
gccgtggcttattttgcctacagcctcgccagtacntcccacagtagctgtttctacactgaaacctccaa

SEQ ID NO: 14185 - DNA, 71 bp, chicken (Gallus Gallus)
  misc_feature (36): n=c or t
aatgtgctgggggggcagcggggttttgctctcggngctgaacaaaggcagtgggtttggcactgtttttc

SEQ ID NO: 14186 - DNA, 71 bp, chicken (Gallus Gallus)
  misc_feature (36): n=a or g
ccacaaaaataaaccacggcccatttgcacgtgagntagccaagtttgtctccattggatgtgcgatggag

SEQ ID NO: 14187 - DNA, 71 bp, chicken (Gallus Gallus)
  misc_feature (36): n=c or g
ctgccttgttttccccatgcaattttgatgtgacanatgcacgagcaaagaggaactcctggaggagcaca

SEQ ID NO: 14188 - DNA, 71 bp, chicken (Gallus Gallus)
  misc_feature (36): n=a or g
gcaactttaacacttttcctcgcatactggagcacntggggattttgaaggcaagaagattgcctatggca

SEQ ID NO: 14189 - DNA, 71 bp, chicken (Gallus Gallus)
  misc_feature (36): n=a or c
cctttccagttcctcaattcacctgttaggggactnccatggctgggaatttcagtctctggagcaattaa

SEQ ID NO: 14190 - DNA, 71 bp, chicken (Gallus Gallus)
  misc_feature (36): n=c or g
acccctcaccggtacagcattctatgtaaatgcatnttaccccggtgtcttttttaaagtgttttccttct

SEQ ID NO: 14191 - DNA, 71 bp, chicken (Gallus Gallus)
  misc_feature (36): n=c or t
gccagaagtcataagggttgacccaaaacacagganaggccggagaggctgcaaagccgcaatacaaagcg

SEQ ID NO: 14192 - DNA, 71 bp, chicken (Gallus Gallus)
  misc_feature (36): n=c or t
ctgtttccacaggcttttctgttttgctctgaattncctccttgtacaactgtgcatttagatttaaagct

SEQ ID NO: 14193 - DNA, 71 bp, chicken (Gallus Gallus)
  misc_feature (36): n=a or g
gtggtttgaaacagttctgtgcattcagaggacacncacagacccaaggagctgtgtaacagcagcctctc

SEQ ID NO: 14194 - DNA, 71 bp, chicken (Gallus Gallus)
  misc_feature (36): n=c or g
tgcttggagtgttcattaagctctgagagctgtaancggttcagctctctgctcttagaggggacctgctc

SEQ ID NO: 14195 - DNA, 71 bp, chicken (Gallus Gallus)
  misc_feature (36): n=c or t
ttttcagccggtaaagattagagaagggtggatacngattgcactttttgtcccaatgctgtagtcctgct

SEQ ID NO: 14196 - DNA, 71 bp, chicken (Gallus Gallus)
  misc_feature (36): n=c or t
gccatctcttgctcctacttgtttaactccactccnttcagctccgtaccagctacacctggggctgttgc

SEQ ID NO: 14197 - DNA, 71 bp, chicken (Gallus Gallus)
  misc_feature (36): n=g or t
ctggcatatcttggtgctggcctgtaaggtactacntcagcttggttaagttcttctaatgtgacctcact

SEQ ID NO: 14198 - DNA, 71 bp, chicken (Gallus Gallus)
  misc_feature (36): n=a or g
atgacaaaaggaagcattcaggcagctcttaccacnttccagaagaatgggttgaaggcgatagagaggac

SEQ ID NO: 14199 - DNA, 71 bp, chicken (Gallus Gallus)
  misc_feature (36): n=c or t
ttccttcccctgcagcttgagaactgcatgggcacngctttgatcaagccatgcctctttggcagtgtctg

SEQ ID NO: 14200 - DNA, 71 bp, chicken (Gallus Gallus)
  misc_feature (36): n=a or g
cccaatgctgttctgtatttgtgagcctgagggagnagtgttaaaaacagtgactgtgggaatgagcacag

SEQ ID NO: 14201 - DNA, 71 bp, chicken (Gallus Gallus)
  misc_feature (36): n=a or g
tcactgaaagagcttcagacccataagagaaatcantgtgatgaatgtggagcttttggaacaacagagaa

SEQ ID NO: 14202 - DNA, 71 bp, chicken (Gallus Gallus)
  misc_feature (36): n=a or g
ttgcagtcatggagctgctggcaaaatcactgcatngagagcacagagcgctcagccgtgatctgatttgc

SEQ ID NO: 14203 - DNA, 71 bp, chicken (Gallus Gallus)
  misc_feature (36): n=c or t
cacagaggtttcaccaccaaagactcattgtgctgngagccagccctgtcccagcctgtcccagagggatg

SEQ ID NO: 14204 - DNA, 71 bp, chicken (Gallus Gallus)
  misc_feature (36): n=a or g
tgtagggttttaggatcagagaaccaaaacctgccntgctgggtggctttccccctctccagcccaacctc

SEQ ID NO: 14205 - DNA, 71 bp, chicken (Gallus Gallus)
  misc_feature (36): n=c or t
tgtttgcacgctcccttcttgagcaatggaaaaagnacttctgaatcagaagatctggctccttgagttct

SEQ ID NO: 14206 - DNA, 71 bp, chicken (Gallus Gallus)
  misc_feature (36): n=c or t
tccatttgtcttttgggagaaacgaggctgctcgantggagcagtgagaagcatcttggcgtttcactcct

SEQ ID NO: 14207 - DNA, 71 bp, chicken (Gallus Gallus)
  misc_feature (36): n=a or g
ctttaatcctccctgcctcattttcccatggtcacngtgtttctgttgccctctggcacagtttcctgtcc

SEQ ID NO: 14208 - DNA, 71 bp, chicken (Gallus Gallus)
  misc_feature (36): n=c or t
gtgtgcctcgcgaatgagaggcacaaaaagaaggcngggcagaacgcgctgcggttcatcaggcaataccc

SEQ ID NO: 14209 - DNA, 71 bp, chicken (Gallus Gallus)
  misc_feature (36): n=c or g
gagataaagaccaaagctcaccacgtgaaggcaaangactcgcgcttgtaaaagcaaagttctcagctctt

SEQ ID NO: 14210 - DNA, 71 bp, chicken (Gallus Gallus)
  misc_feature (36): n=c or t
agaggtcattatttacagctaccaactttattgaantcttccttacatttcatccatatttgtaagtttat

SEQ ID NO: 14211 - DNA, 71 bp, chicken (Gallus Gallus)
  misc_feature (36): n=a or g
taaaggaccaggcatgctgtgtgattaaagagccgnttcctcttccagttgaagaccacgttgccatcttc

SEQ ID NO: 14212 - DNA, 71 bp, chicken (Gallus Gallus)
  misc_feature (36): n=c or t
gaactctctgctgagttctccaaagcctctgaatgnctgaagacggggaacaggaaggcatttgctagtga

SEQ ID NO: 14213 - DNA, 71 bp, chicken (Gallus Gallus)
  misc_feature (36): n=c or t
ttctaaaatcagacagtccactctagctgtatgtgngtctagcaaacaactattcccctccatatttttaa

SEQ ID NO: 14214 - DNA, 71 bp, chicken (Gallus Gallus)
  misc_feature (36): n=a or g
ttgcaaaatttaggttgaagaggacttctagaagtnacctactccaaactgctgctacaagcgaagttatc

SEQ ID NO: 14215 - DNA, 71 bp, chicken (Gallus Gallus)
  misc_feature (36): n=c or t
tgggaagcaaagaaggagcccccagatttaaaaaantctatctataagagaaggtgaagcttacagcaggg

SEQ ID NO: 14216 - DNA, 71 bp, chicken (Gallus Gallus)
  misc_feature (36): n=c or t
gtaggtgacaatgggttactctgttggtaggcttangtggtattcaaatatagcaacatcttggtgatgat

SEQ ID NO: 14217 - DNA, 71 bp, chicken (Gallus Gallus)
  misc_feature (36): n=c or t
tggcatttgtgcaattgaaaatttgcttgtgctgtnctggtaaagaagtgtctggagaagcagagaagcca

SEQ ID NO: 14218 - DNA, 71 bp, chicken (Gallus Gallus)
  misc_feature (36): n=c or t
aacatttgggcacagctcaaacgaaaatccacaagnttctaccttcatttccattatctctgtctaatatc

SEQ ID NO: 14219 - DNA, 71 bp, chicken (Gallus Gallus)
  misc_feature (36): n=a or g
taaagtgtttagaagtaaaacatgtaaggtcacggncagcagggaggcaatgcaagctgtccctcaaaact

SEQ ID NO: 14220 - DNA, 71 bp, chicken (Gallus Gallus)
  misc_feature (36): n=a or g
aagagatgctgcagtgcaggcagcacaggcaatgcnctggagtgcttttatgtcctctgcctcagcagggc

SEQ ID NO: 14221 - DNA, 71 bp, chicken (Gallus Gallus)
  misc_feature (36): n=c or t
gcagagcggttggtatgaatagaaattctctgctantggcatacagtcctgcttgctcctcgtacaagcag

SEQ ID NO: 14222 - DNA, 71 bp, chicken (Gallus Gallus)
  misc_feature (36): n=a or g
tgtgggtgttgtgactcctgcgcagggaaggctgcnctctcgttcatctcatggcagattttggtcagctc

SEQ ID NO: 14223 - DNA, 71 bp, chicken (Gallus Gallus)
  misc_feature (36): n=a or g
ggctggctttgcacttgtgacagctcagagcaaacnaaaggtgctgagcagagctgttccagcagcaacaa

SEQ ID NO: 14224 - DNA, 71 bp, chicken (Gallus Gallus)
  misc_feature (36): n=c or t
taccacaattatcagtgtgtgttcatcgttttgctnttacagctacctttattcagagggaggggagctcc

SEQ ID NO: 14225 - DNA, 71 bp, chicken (Gallus Gallus)
  misc_feature (36): n=c or t
agatgatcagtgaactcctggataaaaagaaaaaanagcatttatttctgtaaaccactggcacagccttc

SEQ ID NO: 14226 - DNA, 71 bp, chicken (Gallus Gallus)
  misc_feature (36): n=c or t
agagcgctccatcttccccgctttaattacacagtngcagtcattaagctcccattctgccaagagagctc

SEQ ID NO: 14227 - DNA, 71 bp, chicken (Gallus Gallus)
  misc_feature (36): n=c or t
catttcaacctgaggaaagtttcagaagggaggaangaactgcagaaaagcagattttatcactggagccc

SEQ ID NO: 14228 - DNA, 71 bp, chicken (Gallus Gallus)
  misc_feature (36): n=a or g
atcaaaatactggagcacgtcagcaagtgcaatacnttctctgtggaatgcagttttattttgcagtgaag

SEQ ID NO: 14229 - DNA, 71 bp, chicken (Gallus Gallus)
  misc_feature (36): n=a or g
ttggaagctgtttgcgtgggatttgcaataataccntctccagccagctgagaaggaggatgaggaggagg

SEQ ID NO: 14230 - DNA, 71 bp, chicken (Gallus Gallus)
  misc_feature (36): n=c or t
aggaagaagtcgatgatctctgactcctataagatncagccatttaatcacacaaagccacacctctaagc

SEQ ID NO: 14231 - DNA, 71 bp, chicken (Gallus Gallus)
  misc_feature (36): n=g or t
tttggagtcagtggggtgtcctgctcacctgtgttncttctgaagctgggatcacaaaggtcacctgggga

SEQ ID NO: 14232 - DNA, 71 bp, chicken (Gallus Gallus)
  misc_feature (36): n=a or c
gaaaacaatgatcttgtccaaggaaaataatcctgnatattgaaaatatcctcctgacgtgaatctcccat

SEQ ID NO: 14233 - DNA, 71 bp, chicken (Gallus Gallus)
  misc_feature (36): n=c or t
gagtttccccatctatgaaagaggtgatcacacacngttatgaatgcttggagatttggaatgtgtcaccc

SEQ ID NO: 14234 - DNA, 71 bp, chicken (Gallus Gallus)
  misc_feature (36): n=c or g
agttccttataaaccagcacagctaaaaacagcagntctcagaacagccacagacatgcatgaaatatgct

SEQ ID NO: 14235 - DNA, 71 bp, chicken (Gallus Gallus)
  misc_feature (36): n=c or g
caccttgggcctttttccccccagaatcctcatttnctaactgaagccatctccagaggttactagcaccc

SEQ ID NO: 14236 - DNA, 71 bp, chicken (Gallus Gallus)
  misc_feature (36): n=c or t
ctccgtgagtctgctgccccacacattgccctgagncccattttcaatgcgtccccccagtgcatccccca

SEQ ID NO: 14237 - DNA, 71 bp, chicken (Gallus Gallus)
  misc_feature (36): n=a or g
agtcagaacagcaactatgctctgtactcagcacanttccaaaaagaagagaaacctgacacttttctaca

SEQ ID NO: 14238 - DNA, 71 bp, chicken (Gallus Gallus)
  misc_feature (36): n=a or c
aacactgcatggtgctggcattgctgtcctcattantgtaccagagaggaatgctgggtgtgcacagtcac

SEQ ID NO: 14239 - DNA, 71 bp, chicken (Gallus Gallus)
  misc_feature (36): n=a or g
gatggctacaatagcgtggaggctcagattgagaanaacacttgttgagactcagcgcaatgacaatttga

SEQ ID NO: 14240 - DNA, 71 bp, chicken (Gallus Gallus)
  misc_feature (36): n=g or t
atgggtatttgtcactgcagtcacggtaagaacttntcagactggatttctgcagcaatgtgaaggggagt

SEQ ID NO: 14241 - DNA, 71 bp, chicken (Gallus Gallus)
  misc_feature (36): n=c or t
aggagccacactgtgccgctgggatctgagaggtgntcagctttgtcccggctctataggacagagagctc

SEQ ID NO: 14242 - DNA, 71 bp, chicken (Gallus Gallus)
  misc_feature (36): n=c or t
gcagatccttcttgcatattttgagcaagagctgtnagaggaagctttttctatggaacagaattaacagt

SEQ ID NO: 14243 - DNA, 71 bp, chicken (Gallus Gallus)
  misc_feature (36): n=a or g
gcagggggacgggcaggagcttggttattaccaacngcttcaccagatttaatctcatggcaaccacgacc

SEQ ID NO: 14244 - DNA, 71 bp, chicken (Gallus Gallus)
  misc_feature (36): n=a or g
gtgtgatcatttatctgtttctgatgaaatgatgtntaactgtcctgttactggtgtttgtaccaggtcct

SEQ ID NO: 14245 - DNA, 71 bp, chicken (Gallus Gallus)
  misc_feature (36): n=c or t
ctctgcccaaatgacctaagtgagtcctggcattgnaaagcatggattaattcaataacaagtaatgcaga

SEQ ID NO: 14246 - DNA, 71 bp, chicken (Gallus Gallus)
  misc_feature (36): n=a or g
acatgtttcacatttcttgtttgacctgaaagaccntaagtagttgagtcaactattccttttgttgtttt

SEQ ID NO: 14247 - DNA, 71 bp, chicken (Gallus Gallus)
  misc_feature (36): n=c or t
tatttgttttttgtgtcaggccctgttactctcttntacaaactacactttttgcaagtcagtatgtaccc

SEQ ID NO: 14248 - DNA, 71 bp, chicken (Gallus Gallus)
  misc_feature (36): n=c or g
ctgcccgatacacatcacgatcttagtgggacgtantgagggatcttacaaattgtagaactcacagcctg

SEQ ID NO: 14249 - DNA, 71 bp, chicken (Gallus Gallus)
  misc_feature (36): n=c or t
tgcggagaggaggtgctgcagtttggaagattctanggctcttggtctgtgggcctgagcatgaagggaag

SEQ ID NO: 14250 - DNA, 71 bp, chicken (Gallus Gallus)
  misc_feature (36): n=a or c
tttgctgtaactgatccctgttacccattccttagngcttagagtcagaagtgcacaccctgagctcctgt

SEQ ID NO: 14251 - DNA, 71 bp, chicken (Gallus Gallus)
  misc_feature (36): n=a or g
gtgaattctgccttgctgttttgaaaggcatcactnggaaccctgaagcttgatgaatgctggaggtagtt

SEQ ID NO: 14252 - DNA, 71 bp, chicken (Gallus Gallus)
  misc_feature (36): n=a or g
agagaagttcctgcagtgtgtactggagtgattcantcatactgtgaagccaaaaaaggcttgagctctta

SEQ ID NO: 14253 - DNA, 71 bp, chicken (Gallus Gallus)
  misc_feature (36): n=c or t
ctcaccctctgttttctgggctccaggatgaatcangggctccttagagcagcatgctgcctgcagaggta

SEQ ID NO: 14254 - DNA, 71 bp, chicken (Gallus Gallus)
  misc_feature (36): n=a or g
ctgtgtggactggccccaggggattccctgggaagnttgtttcaggctccactgtacctgctgcactcagg

SEQ ID NO: 14255 - DNA, 71 bp, chicken (Gallus Gallus)
  misc_feature (36): n=c or t
ctgcacagcctgtaactgataagggagaggcatatntctgttttcttttacttcactgaaagcaaattgaa

SEQ ID NO: 14256 - DNA, 71 bp, chicken (Gallus Gallus)
  misc_feature (36): n=a or g
tctctgtttcagcaaagaaactgtttcattcagagnatggtagaatttgaccgcaaagtcctatctcagat

SEQ ID NO: 14257 - DNA, 71 bp, chicken (Gallus Gallus)
  misc_feature (36): n=c or t
agcactacatgaatttgactttagagaactggaganacagcactgccataagttttttttttttttcccaa

SEQ ID NO: 14258 - DNA, 71 bp, chicken (Gallus Gallus)
  misc_feature (36): n=c or t
gtctgagcttggtcaatacacagccacactcttgtncagcttgctggggaaaggtttaggttctaacttca

SEQ ID NO: 14259 - DNA, 71 bp, chicken (Gallus Gallus)
  misc_feature (36): n=c or t
tcaacatgaaatggaaaacagacgggatctcacagntataaggatgaaaaaaaataattaagtaatgaagt

SEQ ID NO: 14260 - DNA, 71 bp, chicken (Gallus Gallus)
  misc_feature (36): n=a or g
aagacttttgaacagcgaagtaatgcttttaaccangatctcatgtaatttgaaggatttatcctgtctat

SEQ ID NO: 14261 - DNA, 71 bp, chicken (Gallus Gallus)
  misc_feature (36): n=c or t
catcatagcaacaacatttaactaacagcttaaaantaactattaattgaataattaatgaccatgagaaa

SEQ ID NO: 14262 - DNA, 71 bp, chicken (Gallus Gallus)
  misc_feature (36): n=c or t
tttatttttctgtatccctttttctattctttatcngaatccatgaattacaaggatggaaatgtgagtga

SEQ ID NO: 14263 - DNA, 71 bp, chicken (Gallus Gallus)
  misc_feature (36): n=c or t
tcagcttttatttctttatccttgtctcttcctcantgcctaaatggagagatatatactgctgttgaggc

SEQ ID NO: 14264 - DNA, 71 bp, chicken (Gallus Gallus)
  misc_feature (36): n=c or t
agcattccaggtgcctgctgaatgcccttgctaccntgctaatgactaagagtgccttaattgtcccagct

SEQ ID NO: 14265 - DNA, 71 bp, chicken (Gallus Gallus)
  misc_feature (36): n=c or t
aaaaacagcatgtaataagcaatatgccatcaatgncatcaaaacctttcccaggtgaatggtttagattt

SEQ ID NO: 14266 - DNA, 71 bp, chicken (Gallus Gallus)
  misc_feature (36): n=a or c
ctacaaaacccaggaaagagagacgtaagggaagantcatcacttctgcattttgttgctttctctgaagc

SEQ ID NO: 14267 - DNA, 71 bp, chicken (Gallus Gallus)
  misc_feature (36): n=a or t
gcgaagtaccttctggctgcttattgtacacatacngtaacatctgttgtgttacaacttgcttgatctgt

SEQ ID NO: 14268 - DNA, 71 bp, chicken (Gallus Gallus)
  misc_feature (36): n=a or g
ggaagcaggaatgtacatgtgaataatgggggtgcngatcttttttgatcagttgcaaaaattacattgga

SEQ ID NO: 14269 - DNA, 71 bp, chicken (Gallus Gallus)
  misc_feature (36): n=c or t
gcagcaccgtactcggaaaacaggtctggtgagatngtcatgtgctgagaaggaaccccaactctatcagc

SEQ ID NO: 14270 - DNA, 71 bp, chicken (Gallus Gallus)
  misc_feature (36): n=a or t
gttttttctttaaatggtgtctcactgtatggctgngtgtgttagagccagttctactcgctcactgtaag

SEQ ID NO: 14271 - DNA, 71 bp, chicken (Gallus Gallus)
  misc_feature (36): n=a or g
gctgttgacttctaggcactagagtgcagtaaaatnatctctgaagcttcatagtacaatttggttaaaga

SEQ ID NO: 14272 - DNA, 71 bp, chicken (Gallus Gallus)
  misc_feature (36): n=a or g
tgacgttgtgctcaacgctctcaacagtttgtctcnagaacatagatcttgtatttcttgtcaaacaaaat

SEQ ID NO: 14273 - DNA, 71 bp, chicken (Gallus Gallus)
  misc_feature (36): n=g or t
agtattctttctaagattttttttttttaaaagganggaaaatgtactaacagaagttgtttgtgttttaa

SEQ ID NO: 14274 - DNA, 71 bp, chicken (Gallus Gallus)
  misc_feature (36): n=g or t
cagaggtgccttgtgataaggagaaaaacaaaaagnaggtctgaagtgttacacaaagaaggctctactta

SEQ ID NO: 14275 - DNA, 71 bp, chicken (Gallus Gallus)
  misc_feature (36): n=c or t
acattggtaactaactcagtggggtgtaaatactantgattgtatgaagagaaaggattctgcaatgcagg

SEQ ID NO: 14276 - DNA, 71 bp, chicken (Gallus Gallus)
  misc_feature (36): n=c or t
agttaattgctcattcacaactgtcttcataaaaanaacaaaattagctgtttagacattcatgtattaat

SEQ ID NO: 14277 - DNA, 71 bp, chicken (Gallus Gallus)
  misc_feature (36): n=c or t
gaaacattaagatagaatattgcatcaaagtgatgnatctggtgactcagaggatgtaccctctctcatcc

SEQ ID NO: 14278 - DNA, 71 bp, chicken (Gallus Gallus)
  misc_feature (36): n=g or t
ttaaaaagtttccagtatctctgtatgtgtgtgtgnggggggaaatagtcaattattcatagctcaggaag

SEQ ID NO: 14279 - DNA, 71 bp, chicken (Gallus Gallus)
  misc_feature (36): n=a or g
gcaggccctgagatgctccgtgggctcacagcaggnaaactgcgttatcctcagtagctgttaatgatcct

SEQ ID NO: 14280 - DNA, 71 bp, chicken (Gallus Gallus)
  misc_feature (36): n=a or g
tttgcaggtgttgcccacagctgtgtatttcagaanaaggtaagtggagtgattcgtggctgagggggagc

SEQ ID NO: 14281 - DNA, 71 bp, chicken (Gallus Gallus)
  misc_feature (36): n=a or g
ttctattttcatttcttccactcagttgaaaagacntaagtcgcgtagcccacataaaacaaactctagcc

SEQ ID NO: 14282 - DNA, 71 bp, chicken (Gallus Gallus)
  misc_feature (36): n=a or g
ttgtacagttttatatggaggtctcagtctttggancaaattctctaaaaaaaaattgtcacctagcaagg

SEQ ID NO: 14283 - DNA, 71 bp, chicken (Gallus Gallus)
  misc_feature (36): n=a or t
cccctcagtggcctgctatacaacttgcttgagagntacacatcttttcttaaaattaatgatttcagtaa

SEQ ID NO: 14284 - DNA, 71 bp, chicken (Gallus Gallus)
  misc_feature (36): n=a or g
tgccttttcatctgaagagagacaaaatcattaagngaaagtgggaagcattggacagaattctcttgcag

SEQ ID NO: 14285 - DNA, 71 bp, chicken (Gallus Gallus)
  misc_feature (36): n=a or g
attatatcagtgaaatcagtgaaacaccatcctgtnttggtactttgggctatgttctgaccagtgggttt

SEQ ID NO: 14286 - DNA, 71 bp, chicken (Gallus Gallus)
  misc_feature (36): n=c or t
aagggccctagttcacattttgtagttatattcatngaatgtttttgttgttcgatttgttcatcaaagta

SEQ ID NO: 14287 - DNA, 71 bp, chicken (Gallus Gallus)
  misc_feature (36): n=c or t
cgttcagttgttccatctaccttttagaaccacggncctaagaagcagattgcagcccagtttcagagctc

SEQ ID NO: 14288 - DNA, 71 bp, chicken (Gallus Gallus)
  misc_feature (36): n=a or g
tggccgagtggactctacacacttctacttgtgaantgctttaacagacttctgactctccaagaattact

SEQ ID NO: 14289 - DNA, 71 bp, chicken (Gallus Gallus)
  misc_feature (36): n=a or g
aggactactctttggcagggaacatctcaagtcatncatccctcacggccctgtctccagagttcacgctt

SEQ ID NO: 14290 - DNA, 71 bp, chicken (Gallus Gallus)
  misc_feature (36): n=a or c
aagtgatgcctgcagtaaactacactgcaaagctgncagatttgtcttccttatattagtgaggaaggcaa

SEQ ID NO: 14291 - DNA, 71 bp, chicken (Gallus Gallus)
  misc_feature (36): n=a or t
aaaatcaaattaaagtagatatacatctctttcccnacacacacccgctctgtaattaaattcagggaaaa

SEQ ID NO: 14292 - DNA, 71 bp, chicken (Gallus Gallus)
  misc_feature (36): n=a or t
atcactgttctatttgttattgtatctatctctcanacactgaaactattgagatatttccatggttggga

SEQ ID NO: 14293 - DNA, 71 bp, chicken (Gallus Gallus)
  misc_feature (36): n=c or g
attgcatctgtgtaagttatagttgcctctgaaagnacagatggtaactagcacttgagaaccagatagca

SEQ ID NO: 14294 - DNA, 71 bp, chicken (Gallus Gallus)
  misc_feature (36): n=a or g
ttttcaggctttcaaggaacagaaacttgagactcntgatttcctcaataccagtgtccagtgccagactt

SEQ ID NO: 14295 - DNA, 71 bp, chicken (Gallus Gallus)
  misc_feature (36): n=a or t
tacatactgcagaatccttgcatttcacctcattantttttttttttttttccatgaaactactttggata

SEQ ID NO: 14296 - DNA, 71 bp, chicken (Gallus Gallus)
  misc_feature (36): n=a or t
aaagtcactaaccactgtctgatcatactttccatnctgttaaataattttcacttgtgttatgcaaaata

SEQ ID NO: 14297 - DNA, 71 bp, chicken (Gallus Gallus)
  misc_feature (36): n=c or t
atggatagcaaagtttaatctgtgtcttcacacatnatgcatgaaccgcagacactgcctactgacctttt

SEQ ID NO: 14298 - DNA, 71 bp, chicken (Gallus Gallus)
  misc_feature (36): n=c or t
aatctcagttccactgtaggcacttaatataaccangagaattttcttttggttccttgctgtgttagcca

SEQ ID NO: 14299 - DNA, 71 bp, chicken (Gallus Gallus)
  misc_feature (36): n=a or g
aaccggggatttcggaaggcattctgtttcctaccngtgctttaggttccttttgctggttagctctaatt

SEQ ID NO: 14300 - DNA, 71 bp, chicken (Gallus Gallus)
  misc_feature (36): n=a or g
aacctcatataagactaatgaaataatgcaagccanggaagaaacaggaaaaaaagccacagcagtatgca

SEQ ID NO: 14301 - DNA, 71 bp, chicken (Gallus Gallus)
  misc_feature (36): n=c or g
gctgtgcattacgcctctgaagcagtacatataggntaagggctgaggagagcagtgctgtgatctgcgtg

SEQ ID NO: 14302 - DNA, 71 bp, chicken (Gallus Gallus)
  misc_feature (36): n=a or g
cggttctttgtcagcagaggattggcctgattaaancgtgatgtggcactttggtgaaaactgatcaagat

SEQ ID NO: 14303 - DNA, 71 bp, chicken (Gallus Gallus)
  misc_feature (36): n=c or t
atgtatgttttgggaactgctaaatatttctgagcngctgtcaagctacaggctttgctttccattgactt

SEQ ID NO: 14304 - DNA, 71 bp, chicken (Gallus Gallus)
  misc_feature (36): n=c or g
ttgtgagtacaggagtacagagaactccctagacancaggacattggagctttgtactgatttctccatca

SEQ ID NO: 14305 - DNA, 71 bp, chicken (Gallus Gallus)
  misc_feature (36): n=a or g
aaatgagaaagcagtctgcagaaactgcttctgcangagtataaagttgtaaatatgtgggataattatag

SEQ ID NO: 14306 - DNA, 71 bp, chicken (Gallus Gallus)
  misc_feature (36): n=c or t
atagcaatggatacatagactgtactcatcatatcnccacttgtgatctgtagctttttttccaaatacca

SEQ ID NO: 14307 - DNA, 71 bp, chicken (Gallus Gallus)
  misc_feature (36): n=c or t
ttgagtgtacatgcagagataagcaccaatgactangagcaccctgatctgagaacggcagctcacccaca

SEQ ID NO: 14308 - DNA, 71 bp, chicken (Gallus Gallus)
  misc_feature (36): n=c or g
aatcacagctcagggagcttaaggcaccatcagtgncaggttatcctagctttacccatggccaggtatgt

SEQ ID NO: 14309 - DNA, 71 bp, chicken (Gallus Gallus)
  misc_feature (36): n=c or t
gtgctgtaaaaataataataataaaaaaatgaaggnctagaaactgtgaatgacttaacactagctacctc

SEQ ID NO: 14310 - DNA, 71 bp, chicken (Gallus Gallus)
  misc_feature (36): n=a or c
gaggttcaataatactcgtgagagaacctaagtatnttctttaatgttttttgagaaaagacccacctgca

SEQ ID NO: 14311 - DNA, 71 bp, chicken (Gallus Gallus)
  misc_feature (36): n=a or g
ctacataaatcacagaaaacatgaccttattagaantgctatgatatctaaagttcttgagacaaacaagg

SEQ ID NO: 14312 - DNA, 71 bp, chicken (Gallus Gallus)
  misc_feature (36): n=a or t
ggcacagcttccacagattttctcattaaaaaaaanttactagctcttttcttaaggttcatgacccagta

SEQ ID NO: 14313 - DNA, 71 bp, chicken (Gallus Gallus)
  misc_feature (36): n=c or t
attaattttccaacttgagtatcttgatttcaacantactaaagagtcatttcgagaataatggaagagac

SEQ ID NO: 14314 - DNA, 71 bp, chicken (Gallus Gallus)
  misc_feature (36): n=g or t
agatataaaaatcagattaactgaccatcaccaatnccagtctaatgaaaatacctcacagaggacgtgct

SEQ ID NO: 14315 - DNA, 71 bp, chicken (Gallus Gallus)
  misc_feature (36): n=c or t
gcagatcatccagttgagttgatgacagacagtaangccaaacggacgaaaagtgaaatgttaaggctggg

SEQ ID NO: 14316 - DNA, 71 bp, chicken (Gallus Gallus)
  misc_feature (36): n=c or t
acctgtaacaactacccattccttccaattctctgngttcattgtccttctaaggattcccagaagaggaa

SEQ ID NO: 14317 - DNA, 71 bp, chicken (Gallus Gallus)
  misc_feature (36): n=a or g
taacatcacattcgggtattaagcgaggagtatccntcaggccacacagcagtgaatcttcacaggtgttc

SEQ ID NO: 14318 - DNA, 71 bp, chicken (Gallus Gallus)
  misc_feature (36): n=a or g
aagtgcacagcagccagattccccatacttcagtanaaagcccaacaggatgaattttgttaaggtctaaa

SEQ ID NO: 14319 - DNA, 71 bp, chicken (Gallus Gallus)
  misc_feature (36): n=a or g
catccacttctctgagtaggtatgttaaatcaaacnatctttaatgagaccgcctttctatttgccaagca

SEQ ID NO: 14320 - DNA, 71 bp, chicken (Gallus Gallus)
  misc_feature (36): n=c or t
ttaagtcaaacgtctttgactgtgaaggcagactgnatatttcatagaatttacagacaattaccaaataa

SEQ ID NO: 14321 - DNA, 71 bp, chicken (Gallus Gallus)
  misc_feature (36): n=a or g
aaaacttctgaaaaaaagcacaaggagcagtaccantttctaccattaccattcccaaacagacctactaa

SEQ ID NO: 14322 - DNA, 71 bp, chicken (Gallus Gallus)
  misc_feature (36): n=c or t
ataaaagatgtcaactttctgtaatccctcgaccangcttccactcccaactcgagaacaggcagatcacg

SEQ ID NO: 14323 - DNA, 71 bp, chicken (Gallus Gallus)
  misc_feature (36): n=a or g
aaaaaatctgatatctagccttaaacttcctgtgcncacagaaacaaaaacaaaacaaacaaccaaaccaa

SEQ ID NO: 14324 - DNA, 71 bp, chicken (Gallus Gallus)
  misc_feature (36): n=g or t
ggcagtgtcattggggcccacacgaagaacagccanggactaatagaggaccacaaaagctttgacagtct

SEQ ID NO: 14325 - DNA, 71 bp, chicken (Gallus Gallus)
  misc_feature (36): n=a or t
agtcgtggacagatttcagtaaatttagtaaagggnttcaaattatgtacgttttagcacttgaggtcaca

SEQ ID NO: 14326 - DNA, 71 bp, chicken (Gallus Gallus)
  misc_feature (36): n=a or g
tttagccgaactgaaagaaacatacggatagtcacntggcagcatctcagttctgcatgcagtactacgat

SEQ ID NO: 14327 - DNA, 71 bp, chicken (Gallus Gallus)
  misc_feature (36): n=a or g
cataaacgtggcgaaagcaatgaactgtattcatcngcatagcttttaaaaacacaatatcgtattcttcc

SEQ ID NO: 14328 - DNA, 71 bp, chicken (Gallus Gallus)
  misc_feature (36): n=a or g
ggcctccagtccagccaacacggttttacacctaanaccattttgagataatttgccaatctcatcccaac

SEQ ID NO: 14329 - DNA, 71 bp, chicken (Gallus Gallus)
  misc_feature (36): n=a or g
caagggaatctagtgacattaggcagcagtagtccnaactcttcaacttcaaagaggaccctttcagtcct

SEQ ID NO: 14330 - DNA, 71 bp, chicken (Gallus Gallus)
  misc_feature (36): n=a or g
cttctctacatgaatgaatgaagaaatttataatanaatacacatagtgtaaatatacttattaaaagtaa

SEQ ID NO: 14331 - DNA, 71 bp, chicken (Gallus Gallus)
  misc_feature (36): n=a or c
tctcactgatggcttatcagtcaccatttaaaatgntgatggagcataaagagacagctcttttaaaaaca

SEQ ID NO: 14332 - DNA, 71 bp, chicken (Gallus Gallus)
  misc_feature (36): n=c or t
tctctaaactgtggatgacagtacacagatgttgcntaatacaacctagacattagaggctaaacagaagt

SEQ ID NO: 14333 - DNA, 71 bp, chicken (Gallus Gallus)
  misc_feature (36): n=c or t
gaggaagctactcaaaattaaaacacaagacaagtnttagaaaaaaaaaatatcactttatcatatctact

SEQ ID NO: 14334 - DNA, 71 bp, chicken (Gallus Gallus)
  misc_feature (36): n=a or t
acaaagtgcatgatgctcacactgtgaggtcatcantttttcttctacaatatcagatgaatattgaggaa

SEQ ID NO: 14335 - DNA, 71 bp, chicken (Gallus Gallus)
  misc_feature (36): n=a or c
gctgttggtgacatcactctgaagagcagaaaaaancagctgatttgagatagaatgggggaaaggccata

SEQ ID NO: 14336 - DNA, 71 bp, chicken (Gallus Gallus)
  misc_feature (36): n=a or c
aagggtctgccaattagcctagcatgtgctgtgttntttctgtgataatgtgatattatttccgacatcat

SEQ ID NO: 14337 - DNA, 71 bp, chicken (Gallus Gallus)
  misc_feature (36): n=g or t
gcattccaacggacaagcagggaggtttatgaaggnttcaagagttaacagtcaaaaattggcagtgatca

SEQ ID NO: 14338 - DNA, 71 bp, chicken (Gallus Gallus)
  misc_feature (36): n=c or t
actgctcaaactttgttgtctagcccatgaagttangcagcatttacagaaatcacgtaaataatgctgtt

SEQ ID NO: 14339 - DNA, 71 bp, chicken (Gallus Gallus)
  misc_feature (36): n=c or t
gacagtttgttagcatcctatgctagaaaaatactntctaaattgagttcataacataagaaatcttcaga

SEQ ID NO: 14340 - DNA, 71 bp, chicken (Gallus Gallus)
  misc_feature (36): n=c or t
taatcacaccttcaactcaattcttataacttgtancaacagcaaacaaaaaacctgtaatgaatcaactg

SEQ ID NO: 14341 - DNA, 71 bp, chicken (Gallus Gallus)
  misc_feature (36): n=a or g
tatagaataccttggtacaatagattggagtctgcnatctttactcaacaaaaaattccttttaacatgag

SEQ ID NO: 14342 - DNA, 71 bp, chicken (Gallus Gallus)
  misc_feature (36): n=c or t
tagttttatgttatagcattcataaatgtctcagantccaaaagttgaaaagtattttgttgaaactgtgt

SEQ ID NO: 14343 - DNA, 71 bp, chicken (Gallus Gallus)
  misc_feature (36): n=c or g
cttgagcaactccatgtcattcctgtagcaacaggnctttaactgaacatagtattccaagtgcaaactca

SEQ ID NO: 14344 - DNA, 71 bp, chicken (Gallus Gallus)
  misc_feature (36): n=a or g
atgtacaacatttcacaatgtgtacctgtttgtacntttttcctctcttttctcttgcaatgaatgtgaag

SEQ ID NO: 14345 - DNA, 71 bp, chicken (Gallus Gallus)
  misc_feature (36): n=a or g
cacataatgctatcctatttagtatcaacaagaacnctacgaatacaatgaaagaagaaacatatatataa

SEQ ID NO: 14346 - DNA, 71 bp, chicken (Gallus Gallus)
  misc_feature (36): n=c or t
attacattttgaaattaaaaggaatcagtactatanaaaagtcccaaactgcatagaagaggaaagagata

SEQ ID NO: 14347 - DNA, 71 bp, chicken (Gallus Gallus)
  misc_feature (36): n=a or g
aataatactaaagcaaaaggcattttattttccccnttgcattttctccagctcccatagggtggcttcct

SEQ ID NO: 14348 - DNA, 71 bp, chicken (Gallus Gallus)
  misc_feature (36): n=c or t
gagatgaaattggatatcaacctacctattagcagnaacacagtcttggcatgtaacaccgagtaaaagag

SEQ ID NO: 14349 - DNA, 71 bp, chicken (Gallus Gallus)
  misc_feature (36): n=a or g
ctgaaacaaattgctgctaacccgatcacttccccntgcttgaagtcgccataaaagcagtactaaatcag

SEQ ID NO: 14350 - DNA, 71 bp, chicken (Gallus Gallus)
  misc_feature (36): n=g or t
atggtgttctcctttgccaggaagaatcagaaaacnacatcatttaaactttctagcttctgtccataaaa

SEQ ID NO: 14351 - DNA, 71 bp, chicken (Gallus Gallus)
  misc_feature (36): n=a or g
ttttacaccaagacaaaaatccccaggaatggctcnttaaacaatagaagtagcacaagtgctagaatgaa

SEQ ID NO: 14352 - DNA, 71 bp, chicken (Gallus Gallus)
  misc_feature (36): n=c or t
taggacaaaggacagagggagaagctgatggaccantctagaaaggaaacaagaaccttgatacttgagca

SEQ ID NO: 14353 - DNA, 71 bp, chicken (Gallus Gallus)
  misc_feature (36): n=c or t
atgattattctagaagactgaaatagtagctgtttntcaacttaataaaaacaccataaaaatgattttgt

SEQ ID NO: 14354 - DNA, 71 bp, chicken (Gallus Gallus)
  misc_feature (36): n=a or g
cagtagagaagatcttgacgtacacgatcacttacngaatgttgtcataccgtgaaggcaaactcttcaca

SEQ ID NO: 14355 - DNA, 71 bp, chicken (Gallus Gallus)
  misc_feature (36): n=a or g
caaccagctaagtaactgcagcgctaaaggccactnatctccctctaaaaacagcctgtgactcacgcagg

SEQ ID NO: 14356 - DNA, 71 bp, chicken (Gallus Gallus)
  misc_feature (36): n=c or t
tttagtgatgcagctcagatctgtatcagggagaantgcagattaaggaaacaaactactgggcaatatcg

SEQ ID NO: 14357 - DNA, 71 bp, chicken (Gallus Gallus)
  misc_feature (36): n=a or g
gtttttctttttcctggtttacagaaatgagttcanctgatctgctattcccagcaggtgggataatacca

SEQ ID NO: 14358 - DNA, 71 bp, chicken (Gallus Gallus)
  misc_feature (36): n=a or g
tcaaaaagctgcctgtatccaggccgtgtaccaacnaaggctggtagctgagtctcttatgctggctcccc

SEQ ID NO: 14359 - DNA, 71 bp, chicken (Gallus Gallus)
  misc_feature (36): n=c or t
gtaagcggtgatttcatggcttcctggaagtgtctngttataggagaggctttagcttttgttcctgtgtt

SEQ ID NO: 14360 - DNA, 71 bp, chicken (Gallus Gallus)
  misc_feature (36): n=a or g
ggagcagcagcagcaacacctcactgctagcagtgntgcatccctaaccctgctgtgcatttgaggctctg

SEQ ID NO: 14361 - DNA, 71 bp, chicken (Gallus Gallus)
  misc_feature (36): n=a or g
gcattctgagccatctttctcagttactgcaagctntaaggagttaccaaaggcacctctgcttctgtacc

SEQ ID NO: 14362 - DNA, 71 bp, chicken (Gallus Gallus)
  misc_feature (36): n=c or t
tagagcagcatggattgctgcaagtctcgaagtacnagagatgtgaacttaagcgggctcccactcgtcct

SEQ ID NO: 14363 - DNA, 71 bp, chicken (Gallus Gallus)
  misc_feature (36): n=a or g
aggatgttatttctgttcaaaacacactcctcactnctgtgaaattccgaatttaatagagtctaaatgat

SEQ ID NO: 14364 - DNA, 71 bp, chicken (Gallus Gallus)
  misc_feature (36): n=c or g
agtggagctggtccctaactctttgcaagaagccantaaatgcctgacagtgctggaacgtgccaaaatct

SEQ ID NO: 14365 - DNA, 71 bp, chicken (Gallus Gallus)
  misc_feature (36): n=c or t
gcaggcctccagcatgatgaagggtggggataaaanctatccccaacccttttctggcacagctctgcttg

SEQ ID NO: 14366 - DNA, 71 bp, chicken (Gallus Gallus)
  misc_feature (36): n=c or t
tgggtgctgcctgcccaagcaatctcagattctgcncctttaactctcgtgcctcagcaacctgtaatctg

SEQ ID NO: 14367 - DNA, 71 bp, chicken (Gallus Gallus)
  misc_feature (36): n=c or t
ccatggtcaataatgcctcattaatgcctcagtaanaaagaagtgcttcctatcaaaaccaatcctccaag

SEQ ID NO: 14368 - DNA, 71 bp, chicken (Gallus Gallus)
  misc_feature (36): n=c or t
tggtcactcgctgctcagaggctgcttttgatctcngctaatgaagccatctcctcatccccagctttcac

SEQ ID NO: 14369 - DNA, 71 bp, chicken (Gallus Gallus)
  misc_feature (36): n=a or g
tccaagtgattttcattttttgtgacagcacaaacngcagcatcctgcagcagaccctctccccataacag

SEQ ID NO: 14370 - DNA, 71 bp, chicken (Gallus Gallus)
  misc_feature (36): n=a or g
aatctgtgcttcgcctcaggtttccttccacacccnccccaattaactgaagtcacaacacagacatcgtt

SEQ ID NO: 14371 - DNA, 71 bp, chicken (Gallus Gallus)
  misc_feature (36): n=c or t
aatttgttaagaaaaaattaagatgtgaatatcatngttgtaggaaacagtctgactgttttggagtgata

SEQ ID NO: 14372 - DNA, 71 bp, chicken (Gallus Gallus)
  misc_feature (36): n=c or t
acgtggatgtgtctcgtttccctctgacctgaccanttgggatccccctgtgtatggcagagccaaaccca

SEQ ID NO: 14373 - DNA, 71 bp, chicken (Gallus Gallus)
  misc_feature (36): n=g or t
ccattccgagatgaatgtgttcaagctgtacaagangactgcttgggcactagagtggctcagcatgcagg

SEQ ID NO: 14374 - DNA, 71 bp, chicken (Gallus Gallus)
  misc_feature (36): n=a or g
agcaggcactggagagtgaaggatgtcagtcagtancacactgagaatcccagctggagaggccacaaacc

SEQ ID NO: 14375 - DNA, 71 bp, chicken (Gallus Gallus)
  misc_feature (36): n=g or t
aagacagagaactaagaaccctgtatgaaaggcgcngagctgtcacacttgtcattactaagacacacaag

SEQ ID NO: 14376 - DNA, 71 bp, chicken (Gallus Gallus)
  misc_feature (36): n=a or g
ggagtgcattcatgatctgctcgtgttcatggaggnatcatcggatcgggttaaaaaccaggaggtaaaca

SEQ ID NO: 14377 - DNA, 71 bp, chicken (Gallus Gallus)
  misc_feature (36): n=a or g
ggatgggaacaggattgagaacaggaatagggaagngaatggggaaaaggaacaggaatggggacagggag

SEQ ID NO: 14378 - DNA, 71 bp, chicken (Gallus Gallus)
  misc_feature (36): n=c or t
tagaaacaagacctcagcttaactaagcccagctantgagatactccatttcagcatttggaaatggatga

SEQ ID NO: 14379 - DNA, 71 bp, chicken (Gallus Gallus)
  misc_feature (36): n=a or g
acttagctgagtgtatttttatctgttttaatgttnctaaaataaatacacatacaaaacatgtggccaac

SEQ ID NO: 14380 - DNA, 71 bp, chicken (Gallus Gallus)
  misc_feature (36): n=c or t
tcaaagtgaatggaagaatccacagaagagcaatanggaaatagctttaaagtagatttaataatttattt

SEQ ID NO: 14381 - DNA, 71 bp, chicken (Gallus Gallus)
  misc_feature (36): n=c or t
agggagagggagaatttagtgagccaggtcagctcnctctatggtcatgtgaagagctagtaaagttttgg

SEQ ID NO: 14382 - DNA, 71 bp, chicken (Gallus Gallus)
  misc_feature (36): n=a or g
tcctgtcttgtcctgctctggagaggcctcgagcantgcctttggtctgagataacgtccagaggtcgtgg

SEQ ID NO: 14383 - DNA, 71 bp, chicken (Gallus Gallus)
  misc_feature (36): n=a or g
aaggaaattctcaccagtgctgttgcatcattcagnttggaaaagacctctcagatctccaggtccaatcc

SEQ ID NO: 14384 - DNA, 71 bp, chicken (Gallus Gallus)
  misc_feature (36): n=a or t
accaaagtgactggcaatagcccagcctccatttcncgactgccagacgcatgggttcagaggggcagagc

SEQ ID NO: 14385 - DNA, 71 bp, chicken (Gallus Gallus)
  misc_feature (36): n=c or t
agttgttgctgagtagttttgtatagaggatataangatgttttagtactctcagcttctcctattgtcct

SEQ ID NO: 14386 - DNA, 71 bp, chicken (Gallus Gallus)
  misc_feature (36): n=a or g
acagctcttgggaagcaattctaggtgtgaaacacntcagtagggtaggaaactggctgcagggaacactc

SEQ ID NO: 14387 - DNA, 71 bp, chicken (Gallus Gallus)
  misc_feature (36): n=a or g
taaaaccctccctggtggcaaatgctctctgattcngcgctctcccctccctgctgtgctggccctgctca

SEQ ID NO: 14388 - DNA, 71 bp, chicken (Gallus Gallus)
  misc_feature (36): n=c or t
ttcagctgtagcagtgggaagaaaacagagctctgnaggtaggtgtttggtctggactttccttagcaggc

SEQ ID NO: 14389 - DNA, 71 bp, chicken (Gallus Gallus)
  misc_feature (36): n=c or t
ggtgggctgggcagaaaccctcagttgggccctgangtagcctgaaagcagctatagtaagtagcacatac

SEQ ID NO: 14390 - DNA, 71 bp, chicken (Gallus Gallus)
  misc_feature (36): n=c or g
acttgtaaaaatcattgcatatactgtgtgacaaanaggtgggagcatctatggcaatgcatagttgccat

SEQ ID NO: 14391 - DNA, 71 bp, chicken (Gallus Gallus)
  misc_feature (36): n=c or g
gtatttgaacacgtgtatgaattgcaccagttatanctgctgtacaagaaacacattgctgggtgatttta

SEQ ID NO: 14392 - DNA, 71 bp, chicken (Gallus Gallus)
  misc_feature (36): n=c or t
gttcaggctcagactttcaggctaaaaaaaaaaagnagcattaaagtagcatattaaaggctaatttctcc

SEQ ID NO: 14393 - DNA, 71 bp, chicken (Gallus Gallus)
  misc_feature (36): n=a or g
tgaacatctgattgcaactctgtgcattccatgcgnaattttgcaggtaatgtgtttatgtcaagtgaaaa

SEQ ID NO: 14394 - DNA, 71 bp, chicken (Gallus Gallus)
  misc_feature (36): n=a or g
agaaagtgcctaacctaagaaatgggacaagaaacngctcgttgatcttcttgccatcacattcagggttg

SEQ ID NO: 14395 - DNA, 71 bp, chicken (Gallus Gallus)
  misc_feature (36): n=c or t
agaacaatgttgacacagaaagaagaggatttctgnaggccatgaatatctttaaattgaaatgaggagaa

SEQ ID NO: 14396 - DNA, 71 bp, chicken (Gallus Gallus)
  misc_feature (36): n=a or g
gctccaaatctttgctgtagaaaaacaaactggatngtgatgttgttcttccagcccagaaggccagcaga

SEQ ID NO: 14397 - DNA, 71 bp, chicken (Gallus Gallus)
  misc_feature (36): n=a or t
ttttactttggaccacctagggatacaacgcagtgntttttctgtcagggagcagaaatgcttcggagcct

SEQ ID NO: 14398 - DNA, 71 bp, chicken (Gallus Gallus)
  misc_feature (36): n=a or g
ttcgagtcgactgaattcatccaagacgtggcattnagacccaatccgacctcattggaagggcacaactc

SEQ ID NO: 14399 - DNA, 71 bp, chicken (Gallus Gallus)
  misc_feature (36): n=a or g
atcaatcacttactcccagtgaagaaggcctgtaanagggaatatagaatctctaaggctcttctaaattc

SEQ ID NO: 14400 - DNA, 71 bp, chicken (Gallus Gallus)
  misc_feature (36): n=a or g
tgatcttatcctgggttattccccttttgtgcccantgcccagtgattactgttatgagttcagttccaga

SEQ ID NO: 14401 - DNA, 71 bp, chicken (Gallus Gallus)
  misc_feature (36): n=a or g
gaatgtcatctttcttaccaaggaaaaacaagaaangttatttgccagtcacaagactgttcccctaccag

SEQ ID NO: 14402 - DNA, 71 bp, chicken (Gallus Gallus)
  misc_feature (36): n=a or t
aaaagtattttaggagaatttatctagcaggaaacnaaacaccacaggaaaaaaaatcattgtttatgtaa

SEQ ID NO: 14403 - DNA, 71 bp, chicken (Gallus Gallus)
  misc_feature (36): n=a or g
ctgttattattctctaatagctaaaaattagtgacnttaaaaattctcaataaaattcttccctcggttcc

SEQ ID NO: 14404 - DNA, 71 bp, chicken (Gallus Gallus)
  misc_feature (36): n=c or t
gctcacatttctgcatgaaaagcttttgagctgtgnaggctctcactgcttattccgctggaagaaaattg

SEQ ID NO: 14405 - DNA, 71 bp, chicken (Gallus Gallus)
  misc_feature (36): n=c or t
tgcttgaagccccaagccatacaaaacacttaccgnaagtttgttttggagcctacctcttcattttccat

SEQ ID NO: 14406 - DNA, 71 bp, chicken (Gallus Gallus)
  misc_feature (36): n=c or t
tgtgttgctccatgggcgtgctcactttttacaacngtggtacacctatctgcctcttctgtttggattct

SEQ ID NO: 14407 - DNA, 71 bp, chicken (Gallus Gallus)
  misc_feature (36): n=a or t
gattaacttgtatttataaaaaaatttctaagtttnattttaagtacagcaggaaaacatgggaatagtag

SEQ ID NO: 14408 - DNA, 71 bp, chicken (Gallus Gallus)
  misc_feature (36): n=c or g
aaaagctttggaagaaaacaacatattcattctttntccttgttccaagaaatgtattttagttgaacttt

SEQ ID NO: 14409 - DNA, 71 bp, chicken (Gallus Gallus)
  misc_feature (36): n=c or t
tgtcctcttcaattggaggagctctggatgagtccngaaatccacagcccctgagactgattctctgctgt

SEQ ID NO: 14410 - DNA, 71 bp, chicken (Gallus Gallus)
  misc_feature (36): n=c or t
gttataaaaccagtttttccttcacttaaccagccngaaacttattctaaggcataagtactggcagcatt

SEQ ID NO: 14411 - DNA, 71 bp, chicken (Gallus Gallus)
  misc_feature (36): n=a or t
tataaggaacacacaacttttgcttcaacccaaagnactttgagtgttgttatttctctgtatgcagttga

SEQ ID NO: 14412 - DNA, 71 bp, chicken (Gallus Gallus)
  misc_feature (36): n=a or g
ggaactgaaatgcaaggcagactttctctggctacnctctcatcatctttaaagtaatgcatgagaatatt

SEQ ID NO: 14413 - DNA, 71 bp, chicken (Gallus Gallus)
  misc_feature (36): n=c or t
ctgcaagaaaacccgcccggaagaaaaggcagtgangggaacgtgggaaggcactttatttacgcggatgg

SEQ ID NO: 14414 - DNA, 71 bp, chicken (Gallus Gallus)
  misc_feature (36): n=a or g
tcttctctgacgttgtcgggcctatcgattcacttntatgtgtctaaaccagctgcaaacccagtggcact

SEQ ID NO: 14415 - DNA, 71 bp, chicken (Gallus Gallus)
  misc_feature (36): n=c or g
ttactctggattgctccactattttattaatctctntaagctgtgctggaattggccttagtatcacaagt

SEQ ID NO: 14416 - DNA, 71 bp, chicken (Gallus Gallus)
  misc_feature (36): n=c or t
gctcccatccaaacctgctgaagttgttagagtcangtgctccattggtttgatgtctggttgttctcacc

SEQ ID NO: 14417 - DNA, 71 bp, chicken (Gallus Gallus)
  misc_feature (36): n=c or t
tttacaaagtaagcagtgctaaagaattacaaaganatcctttttatggatggtctgtgagcacacacaga

SEQ ID NO: 14418 - DNA, 71 bp, chicken (Gallus Gallus)
  misc_feature (36): n=a or g
taactgtgctcatcagtgtgagaaatttttactggngtttttgacagcttaaatggcagtgatgctgatgt

SEQ ID NO: 14419 - DNA, 71 bp, chicken (Gallus Gallus)
  misc_feature (36): n=c or g
aattctcccaatgcttgtctttaagccctcattttntcatttatgtttcctttaaaaattcaacttttgtt

SEQ ID NO: 14420 - DNA, 71 bp, chicken (Gallus Gallus)
  misc_feature (36): n=c or g
caggaagaaccaatactagaaaatgaaagacaaatnataaccagcacgtgcaaaagctacttttgaatctg

SEQ ID NO: 14421 - DNA, 71 bp, chicken (Gallus Gallus)
  misc_feature (36): n=a or c
cacttcgctgtgagcaatccacggtttggcagcagngtgtaggaactttattgctttgctataaccaataa

SEQ ID NO: 14422 - DNA, 71 bp, chicken (Gallus Gallus)
  misc_feature (36): n=a or t
ctatcttaaaccaacaccagtaataaatcaaagtantaccaagtgaatttcagaaagatgccagacagcac

SEQ ID NO: 14423 - DNA, 71 bp, chicken (Gallus Gallus)
  misc_feature (36): n=a or g
ttgaacataaagaaagccaatgcagcagtgaatacnaccatcacttacttctcctgtgattggattggttc

SEQ ID NO: 14424 - DNA, 71 bp, chicken (Gallus Gallus)
  misc_feature (36): n=c or t
ctcttaaatactccgtagtttagtgtccagtattgntgagcaacaagctcacagtgcctctctaaagctgc

SEQ ID NO: 14425 - DNA, 71 bp, chicken (Gallus Gallus)
  misc_feature (36): n=a or t
gcaatgctgtaatttctgtattccctactcctaagngaagagaaactccctccaagtgctgtgtctaaact

SEQ ID NO: 14426 - DNA, 71 bp, chicken (Gallus Gallus)
  misc_feature (36): n=a or g
atatgaagcagttaattttgtagttatgagctatgntaaaataagcaccataaaatatagttacattcaaa

SEQ ID NO: 14427 - DNA, 71 bp, chicken (Gallus Gallus)
  misc_feature (36): n=a or c
agattttcaagcattgctacacagaacttcacttanaaacatttgttgacaacaatgaagttaacattact

SEQ ID NO: 14428 - DNA, 71 bp, chicken (Gallus Gallus)
  misc_feature (36): n=c or t
gaatcgagagtgtgaatttttgtccatcttctgcanggggcctggcaggtttgcagagctcactgtacatg

SEQ ID NO: 14429 - DNA, 71 bp, chicken (Gallus Gallus)
  misc_feature (36): n=c or t
cctcagctccatgcaaaacaaagctgcagaaaggtnttacttggctttgcttgcagccacttttacattca

SEQ ID NO: 14430 - DNA, 71 bp, chicken (Gallus Gallus)
  misc_feature (36): n=a or g
tcagctgaatgacgaactatgaaaacacagcactangaatacaaaaacgtggtggtactgcaagaaactgc

SEQ ID NO: 14431 - DNA, 71 bp, chicken (Gallus Gallus)
  misc_feature (36): n=a or g
atacacatgtattttgcttaggaaaagcagagtccncttccttttagcatacagcggtgccagcatgagtc

SEQ ID NO: 14432 - DNA, 71 bp, chicken (Gallus Gallus)
  misc_feature (36): n=c or t
acagagttgttcagctatgcctaagtctcttcttcntcccttccaaatcaatggattttttatgcatgcac

SEQ ID NO: 14433 - DNA, 71 bp, chicken (Gallus Gallus)
  misc_feature (36): n=c or t
tcctctccaatacgtatacaaacaccaacatcctangcctcacatgcctgccttaagcaggcaattttgtt

SEQ ID NO: 14434 - DNA, 71 bp, chicken (Gallus Gallus)
  misc_feature (36): n=c or g
cagaacgtagcaattgtggacataggtcccaaacancgagcagtaacacagcaagggagatgaccacgtgc

SEQ ID NO: 14435 - DNA, 71 bp, chicken (Gallus Gallus)
  misc_feature (36): n=a or g
agtccagtacttttctggcctcttcagtctctgggncttgtatgggcagtcctctctgttaagctgaatgc

SEQ ID NO: 14436 - DNA, 71 bp, chicken (Gallus Gallus)
  misc_feature (36): n=c or t
ttccaactctttacaggcaattaaaaaataaacagncatcccacctacccctacaggacagctggacagat

SEQ ID NO: 14437 - DNA, 71 bp, chicken (Gallus Gallus)
  misc_feature (36): n=g or t
acctctagaatggaatatctgttgtaatgtaacttntttcaaccatgctaaaaaggtcatgctacagaatt

SEQ ID NO: 14438 - DNA, 71 bp, chicken (Gallus Gallus)
  misc_feature (36): n=a or g
ctgatctctctcctggagagttgaagctagaagtgncattcggcgatgatgtattttgtggtttttctttg

SEQ ID NO: 14439 - DNA, 71 bp, chicken (Gallus Gallus)
  misc_feature (36): n=c or t
cagacatcagtctagcttgttcagatacagaaacanctcaggagaacaagctgcaagcagcaggtcagtcc

SEQ ID NO: 14440 - DNA, 71 bp, chicken (Gallus Gallus)
  misc_feature (36): n=c or g
gtgcttgggtgaagcagcagaagaggccttgcaganctttccctcacctagcaaagacgatgcatctgctc

SEQ ID NO: 14441 - DNA, 71 bp, chicken (Gallus Gallus)
  misc_feature (36): n=a or g
tttgttaatcaaatgaatttcagtcaggatgggccntggaggccatcaggtgtatctctgtcctgggtact

SEQ ID NO: 14442 - DNA, 71 bp, chicken (Gallus Gallus)
  misc_feature (36): n=c or t
acccagtaattcctgcctcactttgaaaagagctanatacaaaaagcccagcaacaccataaggccacata

SEQ ID NO: 14443 - DNA, 71 bp, chicken (Gallus Gallus)
  misc_feature (36): n=a or g
aagctctgctgctcatacaagcctgtttgctggtcncagcacgggaactttaccaggtgatgattcatttg

SEQ ID NO: 14444 - DNA, 71 bp, chicken (Gallus Gallus)
  misc_feature (36): n=a or g
ttgagaaaacatagctgtcagagagaaaacttctcntgtgtgtatatgtatttttaaatcagaacagctca

SEQ ID NO: 14445 - DNA, 71 bp, chicken (Gallus Gallus)
  misc_feature (36): n=a or g
aactatgaactttcagtgtcacgttgcaaaaataancccagagctgggggggccgcactgcttataatttt

SEQ ID NO: 14446 - DNA, 71 bp, chicken (Gallus Gallus)
  misc_feature (36): n=c or t
aaagagaaggtctaaagcaccacagagctgaagacnagtacggcaaagaagccacagccacattgtgtaaa

SEQ ID NO: 14447 - DNA, 71 bp, chicken (Gallus Gallus)
  misc_feature (36): n=c or t
agcaaataaaacgaccagtcttcccctgctgccgcntcccctcaccattcttaaatccattgcaaactgtg

SEQ ID NO: 14448 - DNA, 71 bp, chicken (Gallus Gallus)
  misc_feature (36): n=a or g
ttttggtgcagggatgacatacagatgaagacaccncacagtaaaataaatggacagccaaaaggaatatc

SEQ ID NO: 14449 - DNA, 71 bp, chicken (Gallus Gallus)
  misc_feature (36): n=a or g
aatacgtgcaagcaaagctgagaatctgcaccagtnttgtatttgagatttgcatcccagtgatgctctgc

SEQ ID NO: 14450 - DNA, 71 bp, chicken (Gallus Gallus)
  misc_feature (36): n=a or g
aggtgagagaacttttatgcacaacttaaaggaganctggaaataattattgtggtatttataaaagctcc

SEQ ID NO: 14451 - DNA, 71 bp, chicken (Gallus Gallus)
  misc_feature (36): n=c or t
cgcagggcagcggaggcaccagccctcagaattgangtgactgaggagaataaaaacaaatgtccgcttgc

SEQ ID NO: 14452 - DNA, 71 bp, chicken (Gallus Gallus)
  misc_feature (36): n=c or g
aagtggactgcagtggtttgcagccattaatatgtnagaagctttactaacgagcttaaactttttcaatt

SEQ ID NO: 14453 - DNA, 71 bp, chicken (Gallus Gallus)
  misc_feature (36): n=a or g
gaggtggagaaattgctgggaaagaggtagctgtgnttgcagcttcactgttgcatagctgtaatctgccc

SEQ ID NO: 14454 - DNA, 71 bp, chicken (Gallus Gallus)
  misc_feature (36): n=a or g
gggcagaacccatgggatccaaatctcagagcacangagatgatggggaatgcagaagacttgagctctca

SEQ ID NO: 14455 - DNA, 71 bp, chicken (Gallus Gallus)
  misc_feature (36): n=a or g
tctcttcaccctgtactgtctgagctgctcttctanccgtcttcttgcttgaagtcgtatttgttcttcat

SEQ ID NO: 14456 - DNA, 71 bp, chicken (Gallus Gallus)
  misc_feature (36): n=a or g
ttggtactttcctttcactgggaggaagtctatacntgtttttctggttgcagagggcaagcacagtgagc

SEQ ID NO: 14457 - DNA, 71 bp, chicken (Gallus Gallus)
  misc_feature (36): n=c or g
caattctcctaactagaatacacaagcacaaccacntagaaaacctcctcctgctgtcttagactgaaaat

SEQ ID NO: 14458 - DNA, 71 bp, chicken (Gallus Gallus)
  misc_feature (36): n=c or t
gccaccagaaacggaccgagccacgcagttcccttntgctgacgacatttgctttaggaaactctcagcat

SEQ ID NO: 14459 - DNA, 71 bp, chicken (Gallus Gallus)
  misc_feature (36): n=c or t
ggtagacggaatggagagaaatggagaacaaggcangggcttgcaaggaaagggagctagcagaagacata

SEQ ID NO: 14460 - DNA, 71 bp, chicken (Gallus Gallus)
  misc_feature (36): n=c or t
tgagtaaaaggtacctccaacctatctgtcactganggacaaggatgctagaaattctggctctctaaaat

SEQ ID NO: 14461 - DNA, 71 bp, chicken (Gallus Gallus)
  misc_feature (36): n=c or t
actgccaaatctccaaagcaactgcacaggttcatntttccttgacaccgaagtcaagatttgtttttctc

SEQ ID NO: 14462 - DNA, 71 bp, chicken (Gallus Gallus)
  misc_feature (36): n=a or g
cacaatgccttggcgaattcacagatctaattccanaaagaagagcgactgctaacacacggaatgcctta

SEQ ID NO: 14463 - DNA, 71 bp, chicken (Gallus Gallus)
  misc_feature (36): n=a or g
ccgtttgacctccggttccaaacaacagcaaagacnaaatgtaccaagagagtgggcacaacacagtgaaa

SEQ ID NO: 14464 - DNA, 71 bp, chicken (Gallus Gallus)
  misc_feature (36): n=c or t
aataatgaagtcaaaggagaaacttggggttgaccnggaggattttgtgcacgtctgaagagatgagtggc

SEQ ID NO: 14465 - DNA, 71 bp, chicken (Gallus Gallus)
  misc_feature (36): n=a or c
gtttgcacagaggactaagaaactccctacaaaaangtgcacatttttgtaccctaaggaacggtgtccta

SEQ ID NO: 14466 - DNA, 71 bp, chicken (Gallus Gallus)
  misc_feature (36): n=c or t
cggccgtgttttcttttccctttcaggccctactcnataacagatttttcctcataaaacttacaactggt

SEQ ID NO: 14467 - DNA, 71 bp, chicken (Gallus Gallus)
  misc_feature (36): n=c or t
ggtctttcacctatatgggaacatgcctcaaactgnatgctgtcagccattccaccaaccagcccacagtc

SEQ ID NO: 14468 - DNA, 71 bp, chicken (Gallus Gallus)
  misc_feature (36): n=a or c
atttcacaagcttgaccaagctacagcgtcaataanaaagtcaaagtgtgggattgctcagtactgtcaaa

SEQ ID NO: 14469 - DNA, 71 bp, chicken (Gallus Gallus)
  misc_feature (36): n=a or g
ctgctgctgcagagcttgtcactcggtgtgagctgnggaaaaattgctgcatttcttcaataatttgagaa

SEQ ID NO: 14470 - DNA, 71 bp, chicken (Gallus Gallus)
  misc_feature (36): n=g or t
tcctcacgataatattgtgtatgtaatgctgtttgntttttttttaattatgtgattttaaactggaaata

SEQ ID NO: 14471 - DNA, 71 bp, chicken (Gallus Gallus)
  misc_feature (36): n=g or t
ttagcacagctagtctgataattacaagacacgcanaaacggaagacttcttcttccctctgaatttagaa

SEQ ID NO: 14472 - DNA, 71 bp, chicken (Gallus Gallus)
  misc_feature (36): n=c or g
tctaggaactgtggtgctgatctaggctgatgtatntaggggcagacttcatcacagtgcaggggtctgtg

SEQ ID NO: 14473 - DNA, 71 bp, chicken (Gallus Gallus)
  misc_feature (36): n=a or t
tagtttttctttaattcagaattttccacctttctnaaatatctccagatttaaacaaagcaagcaagcaa

SEQ ID NO: 14474 - DNA, 71 bp, chicken (Gallus Gallus)
  misc_feature (36): n=a or g
atcattagctagaaaaaaagaaaaataaactcatgncatgctttaatttccacaatgactgaagggtacgt

SEQ ID NO: 14475 - DNA, 71 bp, chicken (Gallus Gallus)
  misc_feature (36): n=g or t
catggagagatatagagagtttccatgcataaaagntaggaagaaatttatagctactgctttccctttcc

SEQ ID NO: 14476 - DNA, 71 bp, chicken (Gallus Gallus)
  misc_feature (36): n=c or t
gttctgaaaggcagtcaggctgtgtttgagatgagnacagcacactgcagcagattgcagactttgaaagg

SEQ ID NO: 14477 - DNA, 71 bp, chicken (Gallus Gallus)
  misc_feature (36): n=c or t
ctgaagccgtgggcatctgcgtgctattaaagctcngtgtggagctcaaagctgtcatgtaagacctttca

SEQ ID NO: 14478 - DNA, 71 bp, chicken (Gallus Gallus)
  misc_feature (36): n=a or c
cagagaaggatttacctaacgtccaatccaaatctncccatttagcttgtaatgtcttagagatgaaatca

SEQ ID NO: 14479 - DNA, 71 bp, chicken (Gallus Gallus)
  misc_feature (36): n=c or t
atcgttttaatttaaatgttaatggcaagatgggangggttagggaaaattgtctccctgccccattcccc

SEQ ID NO: 14480 - DNA, 71 bp, chicken (Gallus Gallus)
  misc_feature (36): n=c or t
ccaaggggaaggaatggcttctggggactctttggngaagacaccttgtgcttggcctcaaattaatcttt

SEQ ID NO: 14481 - DNA, 71 bp, chicken (Gallus Gallus)
  misc_feature (36): n=c or t
tatctccctatgtgttgtgcagtttcacttcagaanacatgaaggactgtacatcattaaaatgactggtg

SEQ ID NO: 14482 - DNA, 71 bp, chicken (Gallus Gallus)
  misc_feature (36): n=c or t
ctcaccagagatgaggcactaaacaaaatgccccangtgctgtgctcccattgctgtgcctgcaggaatgc

SEQ ID NO: 14483 - DNA, 71 bp, chicken (Gallus Gallus)
  misc_feature (36): n=a or g
ggtttgcatctttcctacaagctacagagcaaggtntggaagtaaggaagacagtttgtcccatcatgacc

SEQ ID NO: 14484 - DNA, 71 bp, chicken (Gallus Gallus)
  misc_feature (36): n=a or t
taaaatgtttttatttctaaatgtaacaaaaatggnatctaatgcaaattttctgaagtgcctgaaataat

SEQ ID NO: 14485 - DNA, 71 bp, chicken (Gallus Gallus)
  misc_feature (36): n=a or c
tcacgcagccttctttaagcaatgagaagtcccgangctaattaaccagatgtagaacacagccactttac

SEQ ID NO: 14486 - DNA, 71 bp, chicken (Gallus Gallus)
  misc_feature (36): n=a or t
aagcaaagataaatataatcttccctacctgtaatngcactgataaactgtatatatatgtggccacagat

SEQ ID NO: 14487 - DNA, 71 bp, chicken (Gallus Gallus)
  misc_feature (36): n=a or g
tcttaaaagaagaaaagcagagccttgtcacaggcngggagccctgctacagctcacacagaggagctgca

SEQ ID NO: 14488 - DNA, 71 bp, chicken (Gallus Gallus)
  misc_feature (36): n=a or g
tatttgtgtttgcagcgtgcacagtaggtctaaccncagcacatacagataaacacaaaaatatctttctg

SEQ ID NO: 14489 - DNA, 71 bp, chicken (Gallus Gallus)
  misc_feature (36): n=a or g
agtaaaacaaacaaacaaaaaaaaccaaaacaccanagttagaggtaactttttccaactaactcaggcat

SEQ ID NO: 14490 - DNA, 71 bp, chicken (Gallus Gallus)
  misc_feature (36): n=a or t
acgcccatagttacttctgcaaatttcagaaggtanttatttgcacagtgcagtcagttacagcaacactg

SEQ ID NO: 14491 - DNA, 71 bp, chicken (Gallus Gallus)
  misc_feature (36): n=g or t
actcattctctttcattctcttgcagtgaccaaaanagaagcaatttgtgaaatcactgatcttctgaaga

SEQ ID NO: 14492 - DNA, 71 bp, chicken (Gallus Gallus)
  misc_feature (36): n=a or t
aagagactcaatactgttttgcttcagtatgattgnatcaccttgcttggtgctcctgatcatcgctgttt

SEQ ID NO: 14493 - DNA, 71 bp, chicken (Gallus Gallus)
  misc_feature (36): n=c or t
tgtaaacatggtggacatttcaatctcagatgtaancaactatggaagagatcattgcctgagatagatgg

SEQ ID NO: 14494 - DNA, 71 bp, chicken (Gallus Gallus)
  misc_feature (36): n=a or g
agacacactcagcatctcttcaggtgatcagctccnttgctttgatactctccttccactattggaagttt

SEQ ID NO: 14495 - DNA, 71 bp, chicken (Gallus Gallus)
  misc_feature (36): n=c or t
agaatttcctgcttcacttcagttcaatgtctcagngaattacttcatttttatgtactaaaacagataac

SEQ ID NO: 14496 - DNA, 71 bp, chicken (Gallus Gallus)
  misc_feature (36): n=a or t
cttctgtccaagtgaatagatttggacaataggaangtgatctcaaagatggatacacacttgcaatttca

SEQ ID NO: 14497 - DNA, 71 bp, chicken (Gallus Gallus)
  misc_feature (36): n=c or t
atactagatggacactgtaaaaaagtatcaatcttncacgtagcagccttcatgactcctggctgttaagg

SEQ ID NO: 14498 - DNA, 71 bp, chicken (Gallus Gallus)
  misc_feature (36): n=a or t
ctctgtataaatttcttgacatggttcttcaattancactaattatgtattcaaagaaagagcaaagatgt

SEQ ID NO: 14499 - DNA, 71 bp, chicken (Gallus Gallus)
  misc_feature (36): n=a or g
ttgtcagacaaactgcagcttgaagtgaaacaatcnatctgaatgcagggagtgtcatcattttccattag

SEQ ID NO: 14500 - DNA, 71 bp, chicken (Gallus Gallus)
  misc_feature (36): n=c or g
tgatctgtgcatcagccccattcactgaattaaaanccaccctggaattaggcctgctccattaactagag

SEQ ID NO: 14501 - DNA, 71 bp, chicken (Gallus Gallus)
  misc_feature (36): n=c or t
cacattccaagtcaagtcagaagccagacaaacttncatcctgattcttaacttccatttacgtacataaa

SEQ ID NO: 14502 - DNA, 71 bp, chicken (Gallus Gallus)
  misc_feature (36): n=c or t
atcagtgcctgctgaaatgacagtccccttacgtanttgagctatctatgattcggatcttatatatcggt

SEQ ID NO: 14503 - DNA, 71 bp, chicken (Gallus Gallus)
  misc_feature (36): n=a or c
gtaattttttcatttttcaataaaatgttgaaatgncattcattgtccagcagtaaattttgcaaattctg

SEQ ID NO: 14504 - DNA, 71 bp, chicken (Gallus Gallus)
  misc_feature (36): n=a or g
caaacgtgttaatggattacaaggcttgaaagagtngagtcagaacacaccacaaaactccaattcctcgt

SEQ ID NO: 14505 - DNA, 71 bp, chicken (Gallus Gallus)
  misc_feature (36): n=a or t
acagtgctctatgcttacaatcgatatttcattagngcagcagtattccctacctttatgcattttttcat

SEQ ID NO: 14506 - DNA, 71 bp, chicken (Gallus Gallus)
  misc_feature (36): n=a or g
ttttgttgaactatggaggtcttgtagagaatgcantgtgtttttggcaaggtgtaaaatcaagcaggaag

SEQ ID NO: 14507 - DNA, 71 bp, chicken (Gallus Gallus)
  misc_feature (36): n=a or g
atttttgtaggagatgatgatgatgacagaaaagantcagtggaagaaatgcgaaaatttaagaaatcaag

SEQ ID NO: 14508 - DNA, 71 bp, chicken (Gallus Gallus)
  misc_feature (36): n=c or t
gcttactgcaacgtatctcacaggtcattgagaaantggcttcttacagccagtgtctgctctccagtcct

SEQ ID NO: 14509 - DNA, 71 bp, chicken (Gallus Gallus)
  misc_feature (36): n=a or t
agctcaggaatattttggtagaggtccaaagtctcngggtttgagaaagctccccgctgctctacttcttt

SEQ ID NO: 14510 - DNA, 71 bp, chicken (Gallus Gallus)
  misc_feature (36): n=a or g
actggagggaccatttttggacacatgctataaccnttggttaccctacagggtaaggcagacttaagttc

SEQ ID NO: 14511 - DNA, 71 bp, chicken (Gallus Gallus)
  misc_feature (36): n=c or t
agggaaggaaagaacagtgatgtctgaggagcgtcngccagagagggatcagtacaggagcaggataggag

SEQ ID NO: 14512 - DNA, 71 bp, chicken (Gallus Gallus)
  misc_feature (36): n=c or t
aggaatttcatcaagagccacatagaaatacacttngtcagttttctgttctgttaactgaaacagagaat

SEQ ID NO: 14513 - DNA, 71 bp, chicken (Gallus Gallus)
  misc_feature (36): n=c or t
agcctgtcttacacttcctagacagaaccaaacaangatgactgcctctcagagtcagaaaagttggcaat

SEQ ID NO: 14514 - DNA, 71 bp, chicken (Gallus Gallus)
  misc_feature (36): n=a or t
tgaactgtcactgcaaatgtcacctgagtgagatantttaaaatatgtccaattcttttgcaggcattatt

SEQ ID NO: 14515 - DNA, 71 bp, chicken (Gallus Gallus)
  misc_feature (36): n=a or g
agtggccaaagcaggattcctgagcctggccatccnagtccttgcttggagccactttggagcttccaggt

SEQ ID NO: 14516 - DNA, 71 bp, chicken (Gallus Gallus)
  misc_feature (36): n=a or g
ctgtatacttatgatataccgagttcctaacttatngagcgccctggtttacataggatcattaaggttgg

SEQ ID NO: 14517 - DNA, 71 bp, chicken (Gallus Gallus)
  misc_feature (36): n=c or t
aaaaacaggctacagtttctacgtaatgtctaagangtgtgctgaggaaagaaatattttaagacttacat

SEQ ID NO: 14518 - DNA, 71 bp, chicken (Gallus Gallus)
  misc_feature (36): n=c or t
gcttataaggaggaattctaacacttgaattttttntttcttaccgaggactttcccctagagtagcagac

SEQ ID NO: 14519 - DNA, 71 bp, chicken (Gallus Gallus)
  misc_feature (36): n=g or t
ttctaatgtggacttaatttgttttattttagaggngttggtgccatggagatagttgctatggatatgaa

SEQ ID NO: 14520 - DNA, 71 bp, chicken (Gallus Gallus)
  misc_feature (36): n=c or t
aaaaggaataaaggacattctccagtacagcgatantaccgtggacgcacagttgtgcagtgctgcagctg

SEQ ID NO: 14521 - DNA, 71 bp, chicken (Gallus Gallus)
  misc_feature (36): n=a or g
aatggccccagtggaaacatctgaaggagcgaggantcaggaactgtaaaacaaagcatcactcttactgt

SEQ ID NO: 14522 - DNA, 71 bp, chicken (Gallus Gallus)
  misc_feature (36): n=g or t
ggtattcctaatgtgtactgcaaagaaggctggatncctgttttccttaaattgaagcatttccttaatcc

SEQ ID NO: 14523 - DNA, 71 bp, chicken (Gallus Gallus)
  misc_feature (36): n=g or t
agagcagccctcatgtgattcagcagtacaaaaatnacagtgaaatactgactgttgaaatctacagcaaa

SEQ ID NO: 14524 - DNA, 71 bp, chicken (Gallus Gallus)
  misc_feature (36): n=a or g
cagacacaatttggatgtttgatgggggaacagagngaaaaaaaaaccacctcctttgagctggtctttcg

SEQ ID NO: 14525 - DNA, 71 bp, chicken (Gallus Gallus)
  misc_feature (36): n=a or t
ctgcacaagtctatgggtagacccctcagatgcatntctgacagctcctcattttctctgatcgatggctg

SEQ ID NO: 14526 - DNA, 71 bp, chicken (Gallus Gallus)
  misc_feature (36): n=c or t
taatttttttttcttttgcaatagttcctctcttangaggaaattgttggcacaaatggcatgaactcatt

SEQ ID NO: 14527 - DNA, 71 bp, chicken (Gallus Gallus)
  misc_feature (36): n=a or c
tcaggctccagcatatatatgaaggatgtttttctnctgtagagctcttactggaagaaataaggagagca

SEQ ID NO: 14528 - DNA, 71 bp, chicken (Gallus Gallus)
  misc_feature (36): n=a or g
ttcagatgcaggctgctttattgtcagtggctacanctagcatttacagcagggcttttgtttaaagaagt

SEQ ID NO: 14529 - DNA, 71 bp, chicken (Gallus Gallus)
  misc_feature (36): n=a or g
agtggttattattgaacaggacaggaatagttcttntgcggtgatcttgttgggatgggctgcagctacag

SEQ ID NO: 14530 - DNA, 71 bp, chicken (Gallus Gallus)
  misc_feature (36): n=c or t
acagcaggtttttgtctgataccacctggcagctgngttgctccttaacttctttccacctaccagctttt

SEQ ID NO: 14531 - DNA, 71 bp, chicken (Gallus Gallus)
  misc_feature (36): n=c or g
ggaaaaaaacacactggaagccgtaggcaaaccctntcccattcccagtatacgctctaggcagcagcact

SEQ ID NO: 14532 - DNA, 71 bp, chicken (Gallus Gallus)
  misc_feature (36): n=a or g
tcttctgcctttggtctggaattgtagcctctgggngtgaattcttagtgctacgttttagtgagaagttc

SEQ ID NO: 14533 - DNA, 71 bp, chicken (Gallus Gallus)
  misc_feature (36): n=a or g
cagtagctccaagtgattaatctatcaggtccactntgatggcaggtcattgtgcttcctggtctttccct

SEQ ID NO: 14534 - DNA, 71 bp, chicken (Gallus Gallus)
  misc_feature (36): n=c or t
actattcctgaagagtatgggtttgtacagagttgnccaggtggaaagctgttgatcaggtgctagggtag

SEQ ID NO: 14535 - DNA, 71 bp, chicken (Gallus Gallus)
  misc_feature (36): n=c or t
ggactgacttcggcaatcgtatactgccgttagcangaaggcaaaggccttgtaaagtggcagtagtgagt

SEQ ID NO: 14536 - DNA, 71 bp, chicken (Gallus Gallus)
  misc_feature (36): n=c or t
tcagcagagagcctgccccactcataccctcagctncggcactgtttgcactgtgattcatatgagaggcg

SEQ ID NO: 14537 - DNA, 71 bp, chicken (Gallus Gallus)
  misc_feature (36): n=c or t
ttccagctacacgaggttcgtggcaggagcaagatntctttcagcacgtgttatacccggcagactgcgtc

SEQ ID NO: 14538 - DNA, 71 bp, chicken (Gallus Gallus)
  misc_feature (36): n=c or g
ggactgatgttctgaacaaaaaagtcaccaattctngacacatccaaagttgaaactacaagagaattgcc

SEQ ID NO: 14539 - DNA, 71 bp, chicken (Gallus Gallus)
  misc_feature (36): n=a or g
aagccagatgggatttcaatttgagcaggtagagcngtattaaagatcttttacatgcacctttctattgg

SEQ ID NO: 14540 - DNA, 71 bp, chicken (Gallus Gallus)
  misc_feature (36): n=a or c
taaaaaaccaaaccaacaaaaaactacaaaaacaanaaaaaaaaaagccaagctccttctgcaaataaaca

SEQ ID NO: 14541 - DNA, 71 bp, chicken (Gallus Gallus)
  misc_feature (36): n=c or t
accatttctttctctctctgttcttgcagtttcttngctctttccaacctagaaaatacatgaggaatgag

SEQ ID NO: 14542 - DNA, 71 bp, chicken (Gallus Gallus)
  misc_feature (36): n=a or c
attgttatgcagttaacactgcaaatttcacattangctggtaagttagaaaatgaacacaacggaagaca

SEQ ID NO: 14543 - DNA, 71 bp, chicken (Gallus Gallus)
  misc_feature (36): n=a or g
tgggacttgaatttttcagaatttcagtatcttctnctgccttactgctcaggagatgaatacacagttca

SEQ ID NO: 14544 - DNA, 71 bp, chicken (Gallus Gallus)
  misc_feature (36): n=a or c
cctcatagttacacaaacacatggcatgctaaatcntcccaatacagctcagttcactaattccagagtga

SEQ ID NO: 14545 - DNA, 71 bp, chicken (Gallus Gallus)
  misc_feature (36): n=c or t
agctaacagtaataggacgtgaggtgatggccttgngttgcaccaggggtgggtcgggttgggtgttagga

SEQ ID NO: 14546 - DNA, 71 bp, chicken (Gallus Gallus)
  misc_feature (36): n=a or g
ttcctaccaaggaagggtttctgcatcctcaattcntgctgggtggtgatgtccataagaggcttttacat

SEQ ID NO: 14547 - DNA, 71 bp, chicken (Gallus Gallus)
  misc_feature (36): n=a or c
accccatcagtcccatcagtctcttccatcctattnatccactcatcccatccacctcattcaccccatcc

SEQ ID NO: 14548 - DNA, 71 bp, chicken (Gallus Gallus)
  misc_feature (36): n=a or g
gaatgaaacttcaaaccaaagtcaccaccaaaagtngtggaacagcataactatgtaaacctggcctttat

SEQ ID NO: 14549 - DNA, 71 bp, chicken (Gallus Gallus)
  misc_feature (36): n=c or t
gggcagtcaccgagcacggacctctcccagccctcngccgtatctctgaagaaggctgatattttaccctt

SEQ ID NO: 14550 - DNA, 71 bp, chicken (Gallus Gallus)
  misc_feature (36): n=c or t
attccctaccaccagttgctgggaagtgacacagcncctgttttactttgggaagtcccaatgcgaggtcc

SEQ ID NO: 14551 - DNA, 71 bp, chicken (Gallus Gallus)
  misc_feature (36): n=c or t
tccattgccaaaagatactgaatccagagcccaacngtccagggacagttcctgacagcacggtcatgagc

SEQ ID NO: 14552 - DNA, 71 bp, chicken (Gallus Gallus)
  misc_feature (36): n=a or g
acccagagggaccgtgcaccgaaaaagacctatctntaaaataaacaaccgaagggcacggagcagcggta

SEQ ID NO: 14553 - DNA, 71 bp, chicken (Gallus Gallus)
  misc_feature (36): n=c or t
gggctctttccagccgagcattcaggccagatgagngtttggtccgttgcagagatccttgtgcacaggcc

SEQ ID NO: 14554 - DNA, 71 bp, chicken (Gallus Gallus)
  misc_feature (36): n=c or t
acccaacctcagcacctctctgagatgctcccaaangctttgggcatttaatgttgccttctgtctggaag

SEQ ID NO: 14555 - DNA, 71 bp, chicken (Gallus Gallus)
  misc_feature (36): n=g or t
ggaatgcaggggagatgctgggctggagctctctgnaagggagtttctctcgagttttgctgcagaaatgt

SEQ ID NO: 14556 - DNA, 71 bp, chicken (Gallus Gallus)
  misc_feature (36): n=c or t
cgttattactgaagctgtgttatgcagatggtgcanggggtttggaagtgactggggcagccctgagctca

SEQ ID NO: 14557 - DNA, 71 bp, chicken (Gallus Gallus)
  misc_feature (36): n=a or g
cttacttttctcagcagcctgacttttctcttagtngggtaaattccctcttcagttgttgggtgattttc

SEQ ID NO: 14558 - DNA, 71 bp, chicken (Gallus Gallus)
  misc_feature (36): n=a or g
tataaatatgttactacgtcacgaatggtagaacanactgtaacacactttatatacatgtctgttttcat

SEQ ID NO: 14559 - DNA, 71 bp, chicken (Gallus Gallus)
  misc_feature (36): n=c or t
caatatttgttcttctcaataacagcacacaaaatntacgtgacgagctcctagattatctacacaagcat

SEQ ID NO: 14560 - DNA, 71 bp, chicken (Gallus Gallus)
  misc_feature (36): n=a or g
tttctccagcaagtgtgagatgatacctatacacanggtggtacatggaagctttaagctctttgcaggac

SEQ ID NO: 14561 - DNA, 71 bp, chicken (Gallus Gallus)
  misc_feature (36): n=a or g
tgttaacgagggttctccttacaggtttaatcctcntaccacgtcctgccctccaagctgccccagccacg

SEQ ID NO: 14562 - DNA, 71 bp, chicken (Gallus Gallus)
  misc_feature (36): n=a or g
ggtccccatgctgaagggacagatggagctgcaccncggccaagagcacagaatagaaacggccatgcaca

SEQ ID NO: 14563 - DNA, 71 bp, chicken (Gallus Gallus)
  misc_feature (36): n=c or t
agccttcagagagctgtggggctctgatccttcccngaaacttttgatctcagcagattgatcattattag

SEQ ID NO: 14564 - DNA, 71 bp, chicken (Gallus Gallus)
  misc_feature (36): n=c or t
gcctgcatggagctaaagccacagcactgctcctgnagccccagctcataccaacttccatttgtcccctt

SEQ ID NO: 14565 - DNA, 71 bp, chicken (Gallus Gallus)
  misc_feature (36): n=c or t
aaaaagaaaatctttcctaatgtcactctttcctcnctgttctttaggagcctgcaaacgctgccattcat

SEQ ID NO: 14566 - DNA, 71 bp, chicken (Gallus Gallus)
  misc_feature (36): n=a or g
ctcagccaggcatggaagtgcaaagtaaggactgangcgtgccctagctctgtgctgaccacaagcacttg

SEQ ID NO: 14567 - DNA, 71 bp, chicken (Gallus Gallus)
  misc_feature (36): n=a or g
cttcccagcccagccccaggcactgggtacccaatncacacaggaggtgctgccaggaacttcatttccct

SEQ ID NO: 14568 - DNA, 71 bp, chicken (Gallus Gallus)
  misc_feature (36): n=c or g
gcatgtaatcccagagactgtgcagtgctcacacancttgagagagcagggaaagaccaaggaaactgaag

SEQ ID NO: 14569 - DNA, 71 bp, chicken (Gallus Gallus)
  misc_feature (36): n=a or t
tcagaacaggaaatctcaaaaacacaacgttataangcaagatgtacttttacttgatggcacccactctc

SEQ ID NO: 14570 - DNA, 71 bp, chicken (Gallus Gallus)
  misc_feature (36): n=a or g
aaacatcaaaagctagtatatattctactgcattgntgtctcagttgtggcctatcagtatttaaattggt

SEQ ID NO: 14571 - DNA, 71 bp, chicken (Gallus Gallus)
  misc_feature (36): n=a or g
cgtgatggtggtgttgccaaagcattggaagctgcngcccgtgccatgtttgcagcctatccaatctactg

SEQ ID NO: 14572 - DNA, 71 bp, chicken (Gallus Gallus)
  misc_feature (36): n=g or t
agctactaagaaaggacaccacgatcaagtgagtgncgctaccaaccctccacaccaagatctctaagaac

SEQ ID NO: 14573 - DNA, 71 bp, chicken (Gallus Gallus)
  misc_feature (36): n=c or t
cgactgccattagaaacagccactcgaacccattcngagacatcacccacggttggctccatctcaaccat

SEQ ID NO: 14574 - DNA, 71 bp, chicken (Gallus Gallus)
  misc_feature (36): n=a or g
catctgtatttcaaggattagcctgcccactgcaancagcatggtgctgcacgcaactgattactgggaac

SEQ ID NO: 14575 - DNA, 71 bp, chicken (Gallus Gallus)
  misc_feature (36): n=a or g
aaaatccgtataacagtacctattctgatggcaaantggctctgtgtattggtcaggcaaaggattacatt

SEQ ID NO: 14576 - DNA, 71 bp, chicken (Gallus Gallus)
  misc_feature (36): n=a or g
agtgatgcttcttccagctgtctttctgtgcatttnggaggtttcatagaatcatagaatggcctggattg

SEQ ID NO: 14577 - DNA, 71 bp, chicken (Gallus Gallus)
  misc_feature (36): n=c or t
gaatatcttgactctggctcagctaaccaagcattnttgtagatgttaatgaaattattcatcattcttaa

SEQ ID NO: 14578 - DNA, 71 bp, chicken (Gallus Gallus)
  misc_feature (36): n=a or g
tagcttgaagggggcaggtgaaacttccaggccacntgttagcatatgctgtgtatcaactagtcctgaga

SEQ ID NO: 14579 - DNA, 71 bp, chicken (Gallus Gallus)
  misc_feature (36): n=c or t
caccagtatcattttgctaccaagcgaagaacaagntgggtgagaaaaagcacggcttggattctctccaa

SEQ ID NO: 14580 - DNA, 71 bp, chicken (Gallus Gallus)
  misc_feature (36): n=a or g
agctattcctcaaagctcaacaacacagtgtgtgtntatatatatatacacacacataaatacatgcatat

SEQ ID NO: 14581 - DNA, 71 bp, chicken (Gallus Gallus)
  misc_feature (36): n=c or t
tctctaaagtgaaatctttgttttccattttgaacntcaggctgttattcatgattttaggatgttttgaa

SEQ ID NO: 14582 - DNA, 71 bp, chicken (Gallus Gallus)
  misc_feature (36): n=a or t
tcatcagtgctggtgtttgctccaccgcacccttgnatggaatttgagcaatcctcaccactcaggagaag

SEQ ID NO: 14583 - DNA, 71 bp, chicken (Gallus Gallus)
  misc_feature (36): n=c or t
tgtaaagactctttggaaacaacaatgaaaaagggngggggactcagaggaaagggagtagttgagctgca

SEQ ID NO: 14584 - DNA, 71 bp, chicken (Gallus Gallus)
  misc_feature (36): n=c or t
actctacacaacaagtcattagcaagcactgcatgncgtttctgaacataccttttccaccatccccagaa

SEQ ID NO: 14585 - DNA, 71 bp, chicken (Gallus Gallus)
  misc_feature (36): n=c or t
tcccaatctgcttgttacagctatgatagagctgtntgggattatggatcaattgtttggaaataggtata

SEQ ID NO: 14586 - DNA, 71 bp, chicken (Gallus Gallus)
  misc_feature (36): n=a or g
ctctgccacacctgggctgactgcaagagcatactncatgcttttaatcagtgacattggaattccactgt

SEQ ID NO: 14587 - DNA, 71 bp, chicken (Gallus Gallus)
  misc_feature (36): n=c or t
gtttttttctggcaccatttcagcaaggcatttctnttcgatcctccatattctcttgctagggcagacaa

SEQ ID NO: 14588 - DNA, 71 bp, chicken (Gallus Gallus)
  misc_feature (36): n=a or g
ttcttcactaagaattaaatgcggccataaaatacntacctgcataggggatacagcagcagctgggggag

SEQ ID NO: 14589 - DNA, 71 bp, chicken (Gallus Gallus)
  misc_feature (36): n=a or g
cttaactatctgaaaggaggttgtagcaaggaaagngtcggtctattctcccatgcaacagtgatatgaca

SEQ ID NO: 14590 - DNA, 71 bp, chicken (Gallus Gallus)
  misc_feature (36): n=c or t
tctgatttggacttgctcatccgaatatccgattcnggattggtgcgactacgggaacgtttggccagtac

SEQ ID NO: 14591 - DNA, 71 bp, chicken (Gallus Gallus)
  misc_feature (36): n=c or t
tcaggctgaatagacaggtcctgtcattctccttangcaaactttcgtctgatgtaccaaaaaaacatact

SEQ ID NO: 14592 - DNA, 71 bp, chicken (Gallus Gallus)
  misc_feature (36): n=a or t
caataagcatgaatgtagccacagaaaaaaccattnccctgtaccagcagcagcccatgggtctccacgtc

SEQ ID NO: 14593 - DNA, 71 bp, chicken (Gallus Gallus)
  misc_feature (36): n=c or g
atcttaagcgtagctagagcccgaattatgcgtgtnagggagtcaattgcattatagataatcagaggttt

SEQ ID NO: 14594 - DNA, 71 bp, chicken (Gallus Gallus)
  misc_feature (36): n=c or t
aaggaacccctcagttttagacagaaaaccatctgnatctgaaagcattacaccttcatatggtaggaggt

SEQ ID NO: 14595 - DNA, 71 bp, chicken (Gallus Gallus)
  misc_feature (36): n=c or t
gcagaagaagaagtagtgcaaactgtccttgctaangaaactccagcagatcaagaagttcccagggaagc

SEQ ID NO: 14596 - DNA, 71 bp, chicken (Gallus Gallus)
  misc_feature (36): n=c or t
tggtttcctgttgaaggaagtctaacatctgagtgngcaatgtgcttaaactcgcacctataaaatcaact

SEQ ID NO: 14597 - DNA, 71 bp, chicken (Gallus Gallus)
  misc_feature (36): n=c or t
acacactgcctacatggtatgggaagcaaaattccngcagacaggctcagatgtgcagagacagaagactt

SEQ ID NO: 14598 - DNA, 71 bp, chicken (Gallus Gallus)
  misc_feature (36): n=c or t
ttacattccacaggcactggagcacagggatcaccngctggtgtgcaaacaacacctcagaatgtgccgtc

SEQ ID NO: 14599 - DNA, 71 bp, chicken (Gallus Gallus)
  misc_feature (36): n=a or g
acacaccctgggtacaggacaacttgctgaattacnaagtaaaacatggtgtgaggtagtcatgttctgag

SEQ ID NO: 14600 - DNA, 71 bp, chicken (Gallus Gallus)
  misc_feature (36): n=c or t
gcacctcagctgattttaacatcaatggaaaatgantagcctttctggcttgaagccaacaaagattaagg

SEQ ID NO: 14601 - DNA, 71 bp, chicken (Gallus Gallus)
  misc_feature (36): n=c or t
gaccctcccttccctgttacagccctttctgtctcngcagtgaatggttttactccctttgcattcgtctc

SEQ ID NO: 14602 - DNA, 71 bp, chicken (Gallus Gallus)
  misc_feature (36): n=a or g
aatttacaccccttagcagatgctgttaacttaatntaaaaactgataaccactcttcacgtgagcagcac

SEQ ID NO: 14603 - DNA, 71 bp, chicken (Gallus Gallus)
  misc_feature (36): n=c or t
ctttttcctaggtagactcccattcttgaaattttngctaatacctttctggctgagcatatgaagcttgt

SEQ ID NO: 14604 - DNA, 71 bp, chicken (Gallus Gallus)
  misc_feature (36): n=a or g
gttttgaaaacttaatttcctcattatacagagtgnatagacagagcaaagggagtgcatctgaaagtctg

SEQ ID NO: 14605 - DNA, 71 bp, chicken (Gallus Gallus)
  misc_feature (36): n=c or t
tctatgaagtactgtgacagaaagatttgagttcanggctcaggctatattttaggcattgaatgaaactt

SEQ ID NO: 14606 - DNA, 71 bp, chicken (Gallus Gallus)
  misc_feature (36): n=c or t
gaggctctgcagttgccagtatagcccttagggttngccctgtcaggtgaggccactgagtgacctgaagg

SEQ ID NO: 14607 - DNA, 71 bp, chicken (Gallus Gallus)
  misc_feature (36): n=a or t
tttttagttattttagggaaaaacagcggaaagacngttacacagtgctttcagcaacaaaaaaagttaag

SEQ ID NO: 14608 - DNA, 71 bp, chicken (Gallus Gallus)
  misc_feature (36): n=c or t
tcagctttcctgtggtacttgaagagtgttgaaggnttttttttttttttttctggtgtgtgttatttttt

SEQ ID NO: 14609 - DNA, 71 bp, chicken (Gallus Gallus)
  misc_feature (36): n=a or g
cctcctggtgagcagcagttgcttgtgaggtcttancttgtagaggtgaacttggagtgtcttttcattgt

SEQ ID NO: 14610 - DNA, 71 bp, chicken (Gallus Gallus)
  misc_feature (36): n=c or t
gcagaactgtgtgcatttctgtcagaagaggagctnaatactgttctccaccagcacttactgggtaggtg

SEQ ID NO: 14611 - DNA, 71 bp, chicken (Gallus Gallus)
  misc_feature (36): n=a or g
gtgccatgtaggtgctggtggcgtggaaagatgatntctcgtaatgaccctctcgagttaggtttgacatt

SEQ ID NO: 14612 - DNA, 71 bp, chicken (Gallus Gallus)
  misc_feature (36): n=c or t
caggtaaacgagagcaaagagcatatccctgtgccngttgtcttgggattctccagaaaatgatgctaatg

SEQ ID NO: 14613 - DNA, 71 bp, chicken (Gallus Gallus)
  misc_feature (36): n=c or t
cccagcgggatgcctggtaaactgcagagctgcctncattttccccctctggatgaaaaaggcttagttaa

SEQ ID NO: 14614 - DNA, 71 bp, chicken (Gallus Gallus)
  misc_feature (36): n=a or g
cagcaagctctcaggcagattgggtccgtcatcagnaatccagagatccttggtaagaactgtctgtatct

SEQ ID NO: 14615 - DNA, 71 bp, chicken (Gallus Gallus)
  misc_feature (36): n=c or t
aggagctcttagtttgtgcatcatgttttaggtcanctgaaatccaacagtgtgcagctcatggatgaagc

SEQ ID NO: 14616 - DNA, 71 bp, chicken (Gallus Gallus)
  misc_feature (36): n=a or g
tatgttgcaggggaagatgtttagaaccagatgaantcagtcttgttgggaagggggaaaagaggcttcaa

SEQ ID NO: 14617 - DNA, 71 bp, chicken (Gallus Gallus)
  misc_feature (36): n=c or t
ggtttcataagcttaaaaataagggtaataggagangttgacctgaggtctgagttggtggtttgtacgat

SEQ ID NO: 14618 - DNA, 71 bp, chicken (Gallus Gallus)
  misc_feature (36): n=c or t
ctcattcatgtttgttctcagtagacctcagaacgncttggaaaaaagtatgggtcatggtattgcactat

SEQ ID NO: 14619 - DNA, 71 bp, chicken (Gallus Gallus)
  misc_feature (36): n=c or g
ttccatggagagcaaaggtagttttacagtgaagtngaatgaacagatgtgccggtgtgatttggtaagga

SEQ ID NO: 14620 - DNA, 71 bp, chicken (Gallus Gallus)
  misc_feature (36): n=a or c
ctgttggggaggacacaccaaatcccatctgtatcnagttccagaggtctcctaaagaaagaaggaagatc

SEQ ID NO: 14621 - DNA, 71 bp, chicken (Gallus Gallus)
  misc_feature (36): n=c or t
ttatgcaaatgcagaccaagttatcaggctgtttcnattctgctcagttatgagactccaatagcagataa

SEQ ID NO: 14622 - DNA, 71 bp, chicken (Gallus Gallus)
  misc_feature (36): n=a or g
ttatggactgattaaatgctgatatgggaagatgcntaatggccataagccaatcatttgtacagggaggt

SEQ ID NO: 14623 - DNA, 71 bp, chicken (Gallus Gallus)
  misc_feature (36): n=c or t
gcttctgtagacactgaaatcataagctactgtgtnaaaggaagccccttctggccatttgtgaagtctga

SEQ ID NO: 14624 - DNA, 71 bp, chicken (Gallus Gallus)
  misc_feature (36): n=c or t
tcatttctataatcgaggtgacacctgccgaaccancttccattcttatgcttgaggcaattcctggtaaa

SEQ ID NO: 14625 - DNA, 71 bp, chicken (Gallus Gallus)
  misc_feature (36): n=c or t
aaggctgctgggctgtgcctgcgggcagaaccaggntcccatagcacccataggtcaggctgtgaatatac

SEQ ID NO: 14626 - DNA, 71 bp, chicken (Gallus Gallus)
  misc_feature (36): n=c or g
tgcttttgagggcattgcccttggactgctgcctgntgatgctcacagccttgaagggcatgatccctgaa

SEQ ID NO: 14627 - DNA, 71 bp, chicken (Gallus Gallus)
  misc_feature (36): n=c or t
gaaacaagtctactggatgaatgcaatagtggaaangctttggaacagacagcatgggttgttacctactg

SEQ ID NO: 14628 - DNA, 71 bp, chicken (Gallus Gallus)
  misc_feature (36): n=a or c
tctttttcacagtgcagcagcttcctcattcagtgnaggtcttacaacttcttgcaccagcttggatgtga

SEQ ID NO: 14629 - DNA, 71 bp, chicken (Gallus Gallus)
  misc_feature (36): n=c or t
acaaataccaaagcaatcccttcctgtacacgctangctttccctgaagagcagctctgggatcctttgct

SEQ ID NO: 14630 - DNA, 71 bp, chicken (Gallus Gallus)
  misc_feature (36): n=a or g
tgtgtaacagcacagaatatgatggaagaagggacnttttgggagtcattttggctggaaatcccagattt

SEQ ID NO: 14631 - DNA, 71 bp, chicken (Gallus Gallus)
  misc_feature (36): n=c or t
tgccatgagccccccagaagctatcaacatcacttnaagtgaagatatctgagggtactggagctctactg

SEQ ID NO: 14632 - DNA, 71 bp, chicken (Gallus Gallus)
  misc_feature (36): n=a or c
ctcaccttcagccgattgtactccacagtccctgcnatgacctttccttcactgtaactgacctcacagtg

SEQ ID NO: 14633 - DNA, 71 bp, chicken (Gallus Gallus)
  misc_feature (36): n=a or g
caatcaatccctccattctttgcctcagccacaaanttttttatgaatgagtttttaatatgcgtgttcga

SEQ ID NO: 14634 - DNA, 71 bp, chicken (Gallus Gallus)
  misc_feature (36): n=c or t
gcatagacaagcaacgggaatacactgtgcaggtcntgcattcccctaatgcatgtgttaaactgtgattt

SEQ ID NO: 14635 - DNA, 71 bp, chicken (Gallus Gallus)
  misc_feature (36): n=c or t
gccactttcctttcagacagcgcttctatttcacantgggagaaagcaaaggggacgagcgtgcattggga

SEQ ID NO: 14636 - DNA, 71 bp, chicken (Gallus Gallus)
  misc_feature (36): n=c or t
atttccccaccttgcagggaataactgtggctattngaaagcaatgctggggatgaagagagcattttaac

SEQ ID NO: 14637 - DNA, 71 bp, chicken (Gallus Gallus)
  misc_feature (36): n=c or t
tctgcaatgctgagagatgctgtgagtgaaagggangagcctgccacttggcacgaggagaggtgggaagt

SEQ ID NO: 14638 - DNA, 71 bp, chicken (Gallus Gallus)
  misc_feature (36): n=c or t
atgacctccgtggtccgtttacctccagggtctgtnatagccacccccatgccaccaataatccacacccc

SEQ ID NO: 14639 - DNA, 71 bp, chicken (Gallus Gallus)
  misc_feature (36): n=a or g
cagctcccgttccttcagccacaagggagtgcagantcccagctcacgctcaggtcaggttttatttccag

SEQ ID NO: 14640 - DNA, 71 bp, chicken (Gallus Gallus)
  misc_feature (36): n=c or t
gcttcattttcaaaggcagggacactatgcgaatgntcggtcaaacctatggagatcgcacagtgaacaaa

SEQ ID NO: 14641 - DNA, 71 bp, chicken (Gallus Gallus)
  misc_feature (36): n=c or g
ttgagctcagtgtctccatgctgacagcctgcacantgtattccttctgagcctccagctcctgctgtctt

SEQ ID NO: 14642 - DNA, 71 bp, chicken (Gallus Gallus)
  misc_feature (36): n=c or t
gtgtgtgtgtgtgtccctgtgcatgcatacatgagngtatatggatgtgtgtgccctatgcatgcacatgt

SEQ ID NO: 14643 - DNA, 71 bp, chicken (Gallus Gallus)
  misc_feature (36): n=g or t
agcacagcactggagcacaaagtgctgtgcacacanaccttcttacaaagcagtttttcaaggcctgacca

SEQ ID NO: 14644 - DNA, 71 bp, chicken (Gallus Gallus)
  misc_feature (36): n=c or t
ggtttgtcagggatgcggctccgtctccttttcttnggcaggagatctttgcaggactcattatagctgct

SEQ ID NO: 14645 - DNA, 71 bp, chicken (Gallus Gallus)
  misc_feature (36): n=a or g
caggctcaggattttctctttattttaaggctaaanctcaccctccctcaccctgaacaaattaaagcagg

SEQ ID NO: 14646 - DNA, 71 bp, chicken (Gallus Gallus)
  misc_feature (36): n=c or t
ccaaatctctgtcaaacacgatgggagaagaaaaangtcttgtactcatttacttactgctaggacagcaa

SEQ ID NO: 14647 - DNA, 71 bp, chicken (Gallus Gallus)
  misc_feature (36): n=c or t
gacaggctgactcctgctttgattaactgagcacanggctatttttgcccctcgcaggctacatacgtgca

SEQ ID NO: 14648 - DNA, 71 bp, chicken (Gallus Gallus)
  misc_feature (36): n=a or g
gtctattgaattgtaaacaaagagagaacagtgagntacaaaaacaaagactgggaatctgtttttaactg

SEQ ID NO: 14649 - DNA, 71 bp, chicken (Gallus Gallus)
  misc_feature (36): n=c or t
ccccaggcacccaatgaggacaactgatagaggtgnccaaagcaccccaaggcactctgtgatggacacat

SEQ ID NO: 14650 - DNA, 71 bp, chicken (Gallus Gallus)
  misc_feature (36): n=c or t
agctagctgtgttcccatggggttggtactgggccnggtctcgtttgacacctccatccatgagctgaatg

SEQ ID NO: 14651 - DNA, 71 bp, chicken (Gallus Gallus)
  misc_feature (36): n=c or t
aatcagtcactcctacacagctcatttcatagcatntcttcagaacatgatgagcaccatggagctttaca

SEQ ID NO: 14652 - DNA, 71 bp, chicken (Gallus Gallus)
  misc_feature (36): n=c or t
ataaatgcagctgatgagaagcctttaacttttacnctgatcaatatcacgtttagattggaaaacacttt

SEQ ID NO: 14653 - DNA, 71 bp, chicken (Gallus Gallus)
  misc_feature (36): n=g or t
gaaaaagctgaagcctggagtgtaggtggggactgntaactcggtttgcccttggcttatggtcaggattg

SEQ ID NO: 14654 - DNA, 71 bp, chicken (Gallus Gallus)
  misc_feature (36): n=c or t
ctccatggggaccactgacatctccccaatgtgagntttttccgccacggagatgctgggcaatgagagca

SEQ ID NO: 14655 - DNA, 71 bp, chicken (Gallus Gallus)
  misc_feature (36): n=c or t
ttccccagcagttgaatagtttgctttaaaaacatncagtggttatttttcctcattaaacatttcctata

SEQ ID NO: 14656 - DNA, 71 bp, chicken (Gallus Gallus)
  misc_feature (36): n=c or g
aaatcttttctaacattaatcattttaattaaaatnttttttttatggcatagctgtaatttttttgttaa

SEQ ID NO: 14657 - DNA, 71 bp, chicken (Gallus Gallus)
  misc_feature (36): n=c or g
aacagtggaatcgacgtaatgtatggaaagaaattnaagattcctacctctgcactacactacaatcaaga

SEQ ID NO: 14658 - DNA, 71 bp, chicken (Gallus Gallus)
  misc_feature (36): n=c or t
caactttccatccctgaatccaatcaaaaggtcttntcttttatggtactgtgaaggaccaacaggaggat

SEQ ID NO: 14659 - DNA, 71 bp, chicken (Gallus Gallus)
  misc_feature (36): n=a or c
gtacaggctgggagagctcactgagagcagctctgntgagaaggacttgggaactgtgatggacaaaaagc

SEQ ID NO: 14660 - DNA, 71 bp, chicken (Gallus Gallus)
  misc_feature (36): n=a or g
taaactccatactggctacaatctttatattgcctntgtaatagtctagagataatttccagaattcttct

SEQ ID NO: 14661 - DNA, 71 bp, chicken (Gallus Gallus)
  misc_feature (36): n=g or t
tgactgctccatggtgacagttttatcctcttcttnctttacttattaggagaaactgtgtttttaacata

SEQ ID NO: 14662 - DNA, 71 bp, chicken (Gallus Gallus)
  misc_feature (36): n=a or g
ttaccttgactaaactgtgttacaatcatgttgatnaggctacttgtatgcatgaaaagtgtgcagtgagg

SEQ ID NO: 14663 - DNA, 71 bp, chicken (Gallus Gallus)
  misc_feature (36): n=c or g
acatcctctccatgaaacctccctctgcacttcagntattttgtctgtttcttaacatacatcaacgcaaa

SEQ ID NO: 14664 - DNA, 71 bp, chicken (Gallus Gallus)
  misc_feature (36): n=c or t
taaaagctgatgttaaggagcaatgccacatctttngtaggaacccagtatgttgctgattataccagatt

SEQ ID NO: 14665 - DNA, 71 bp, chicken (Gallus Gallus)
  misc_feature (36): n=a or g
catttgtagaattgagtttgtggggaagggtcaccnctttgacacatatctgaaggtattgaggttatgag

SEQ ID NO: 14666 - DNA, 71 bp, chicken (Gallus Gallus)
  misc_feature (36): n=a or c
gcttatacagagtatcagtctttgccatataacgcncgtgtacattgcaatccaaaggtgagcttacagct

SEQ ID NO: 14667 - DNA, 71 bp, chicken (Gallus Gallus)
  misc_feature (36): n=a or g
aagttcacctccttgcggaacagacagtctaaaacncagtattgcatacacctttgtctggaattctgttc

SEQ ID NO: 14668 - DNA, 71 bp, chicken (Gallus Gallus)
  misc_feature (36): n=c or t
ggtgagtgtgtgacactgcttggctgcagcacgaantgttatgcaggagaacagcagttctgtgagctggg

SEQ ID NO: 14669 - DNA, 71 bp, chicken (Gallus Gallus)
  misc_feature (36): n=a or t
gcaggaaacactcagatccagttcagtttcttgacngcactagctctgctggttgtaaaaacaaactcctt

SEQ ID NO: 14670 - DNA, 71 bp, chicken (Gallus Gallus)
  misc_feature (36): n=a or g
gaggtagcctttaagaagtgagttatgttttagctnagaaaagaggaaactctaaaactgtgcacatcaat

SEQ ID NO: 14671 - DNA, 71 bp, chicken (Gallus Gallus)
  misc_feature (36): n=c or t
ctgtacttagatcttagacatgtaaagtagtatctntggcatagctccactgtggtcctctacacttctgt

SEQ ID NO: 14672 - DNA, 71 bp, chicken (Gallus Gallus)
  misc_feature (36): n=a or g
cacactccatatggtgacatttcagtctggtctgantctggttacctgggcaatgagtttctatgcataca

SEQ ID NO: 14673 - DNA, 71 bp, chicken (Gallus Gallus)
  misc_feature (36): n=c or t
acccccattggggaaggatctctggttggagatccntccgtagtggagcttttcccctatgagcctggaat

SEQ ID NO: 14674 - DNA, 71 bp, chicken (Gallus Gallus)
  misc_feature (36): n=a or g
agttatagcaaaaaaaaagaaaggaagtgaatgaancaacaagttttttgcatgagcagtgtattgaacgc

SEQ ID NO: 14675 - DNA, 71 bp, chicken (Gallus Gallus)
  misc_feature (36): n=a or t
ctgcggtgagatggttgtttgctacacactggaggntgtaatcgaagcacctccatgtgtccttctggggt

SEQ ID NO: 14676 - DNA, 71 bp, chicken (Gallus Gallus)
  misc_feature (36): n=c or t
agctgtaattttaactgcttggctgcatgatgcagnccccattagtgactgtggcagacaccgcgtggtgt

SEQ ID NO: 14677 - DNA, 71 bp, chicken (Gallus Gallus)
  misc_feature (36): n=a or g
aactcaggctggggcacttcataaagtgtacagctnaggatgagtagtatttacagagtccccaccaaccc

SEQ ID NO: 14678 - DNA, 71 bp, chicken (Gallus Gallus)
  misc_feature (36): n=g or t
gcatgcaaaatagtagtggtgaagaagcaagaatanaaagataccaaaaggaaagagagagaggagagaat

SEQ ID NO: 14679 - DNA, 71 bp, chicken (Gallus Gallus)
  misc_feature (36): n=c or g
aacatggacataacattttgctgctgggatgggagnggagggcagttcttatagcacttcagatcatgaca

SEQ ID NO: 14680 - DNA, 71 bp, chicken (Gallus Gallus)
  misc_feature (36): n=a or g
aaacactgcaaatattcccacattataaaaatttgnaaaagtttctatgcagaaaacatccaaatattttg

SEQ ID NO: 14681 - DNA, 71 bp, chicken (Gallus Gallus)
  misc_feature (36): n=a or g
tcatttgcctgagcaaatctgttgtaatgaaactgntgctgctactcagacatcagcacctctgcacggac

SEQ ID NO: 14682 - DNA, 71 bp, chicken (Gallus Gallus)
  misc_feature (36): n=c or t
ctggcttgctggaggaatctgggagaatcgctgtcnagctctgtccgtccattttgctgtcagcaagactg

SEQ ID NO: 14683 - DNA, 71 bp, chicken (Gallus Gallus)
  misc_feature (36): n=a or t
gactgcatagaagctgggaaacaccagaactggacngctggagtgattcatgttctagagaagtacaacga

SEQ ID NO: 14684 - DNA, 71 bp, chicken (Gallus Gallus)
  misc_feature (36): n=c or t
ttctgagtagacagtttgaatcaacgagatgtgctnggactccaaggagtgggaacatcctactggtgaag

SEQ ID NO: 14685 - DNA, 71 bp, chicken (Gallus Gallus)
  misc_feature (36): n=c or t
atgagtggcttggaaatggctttttcagaaccctcncaaagtggcattttccagaaacacagtcccctctg

SEQ ID NO: 14686 - DNA, 71 bp, chicken (Gallus Gallus)
  misc_feature (36): n=c or t
tgcctttcttttgtagagagaagaaatgcagagttnggtgagtcttcctctgctaaccaaagagatttggg

SEQ ID NO: 14687 - DNA, 71 bp, chicken (Gallus Gallus)
  misc_feature (36): n=c or g
gactgggagagcctacagaggccaagtgggacatantgggacctgctgagctatcctagagcttactgggt

SEQ ID NO: 14688 - DNA, 71 bp, chicken (Gallus Gallus)
  misc_feature (36): n=a or g
tgtgtattctgggggcacagatcccagtgtgggacncacacaatgacccaaagggttttctctgctctttg

SEQ ID NO: 14689 - DNA, 71 bp, chicken (Gallus Gallus)
  misc_feature (36): n=a or c
acacggaaacgggaagaaatcagtgaccacatgcantccaggacaagcttctctcattttaccgaggtact

SEQ ID NO: 14690 - DNA, 71 bp, chicken (Gallus Gallus)
  misc_feature (36): n=a or g
agttcaggtgaactggcaaaggagaagttttatccngaagcaaaggcagtgaagaaatactttggcctctg

SEQ ID NO: 14691 - DNA, 71 bp, chicken (Gallus Gallus)
  misc_feature (36): n=c or g
agataaaatatgttttacccatgggccacctggganccaggaaaaaaggtcaaggtctgggcttttccaag

SEQ ID NO: 14692 - DNA, 71 bp, chicken (Gallus Gallus)
  misc_feature (36): n=c or t
ccaacttgtggacaggcttctgatgccctgtgtatnagaaccattctgatggtggccctgcagatctgctc

SEQ ID NO: 14693 - DNA, 71 bp, chicken (Gallus Gallus)
  misc_feature (36): n=g or t
cccgttccaactccagcatctcatggaaaaattcanccctgagctcttccaaaggctgctgtccttcagtt

SEQ ID NO: 14694 - DNA, 71 bp, chicken (Gallus Gallus)
  misc_feature (36): n=a or g
gacatccaaaaagattgcatcacttcacacacagcntggtcatccaaaccactgagcctacctgcagggtc

SEQ ID NO: 14695 - DNA, 71 bp, chicken (Gallus Gallus)
  misc_feature (36): n=c or t
acccttagtgtggcacagaaagaacagattttgtanccctcccacccccccccccccacacacaaaaaagg

SEQ ID NO: 14696 - DNA, 71 bp, chicken (Gallus Gallus)
  misc_feature (36): n=c or t
aaagcaatgggttggaaaggagggacctccctccantccatccatcaaaagttcaatgtgaggaatcacag

SEQ ID NO: 14697 - DNA, 71 bp, chicken (Gallus Gallus)
  misc_feature (36): n=g or t
tcactgcagcaaccacagggtaaagagacctacaanaatgtcacggggagcaagagccaagattacagaat

SEQ ID NO: 14698 - DNA, 71 bp, chicken (Gallus Gallus)
  misc_feature (36): n=a or g
gggaaaggatttggggtggagtttctgtagaaaaangactttccctgaccgggaatcgaacccgggccgcg

SEQ ID NO: 14699 - DNA, 71 bp, chicken (Gallus Gallus)
  misc_feature (36): n=a or g
gctgcagggttgagtggtctcttgggcacaccccanttgtcttcagcactctctgctgttcccattctgtg

SEQ ID NO: 14700 - DNA, 71 bp, chicken (Gallus Gallus)
  misc_feature (36): n=g or t
gctcctccaaaggcgtcttcaccatgaataggtttngggtcaaaacacccaaaaatacaatgctggcccca

SEQ ID NO: 14701 - DNA, 71 bp, chicken (Gallus Gallus)
  misc_feature (36): n=g or t
tcccagaaacccaacccaaccatctcatccatgcanatccatttcaaatcacgccatgtgccccttccaac

SEQ ID NO: 14702 - DNA, 71 bp, chicken (Gallus Gallus)
  misc_feature (36): n=g or t
cagaaggcgttttgaaggggttgggagttcattttnctcagtcccgttgcttgggttctagctgggtgttg

SEQ ID NO: 14703 - DNA, 71 bp, chicken (Gallus Gallus)
  misc_feature (36): n=a or g
cttctgtgccacgaagatgtggagatggacacttgnaccccagaagtgacaatgatgtccctttggcatcg

SEQ ID NO: 14704 - DNA, 71 bp, chicken (Gallus Gallus)
  misc_feature (36): n=a or t
tgaccattgtgtgaccatgaagttactatgaagganctatggggaaaacgtggggtgaccctgaaaggact

SEQ ID NO: 14705 - DNA, 71 bp, chicken (Gallus Gallus)
  misc_feature (36): n=a or g
ttcatcagtgataaccagagtaaggagatgaacagnaggggttggagctgtcctgcaaccgaggtcgggta

SEQ ID NO: 14706 - DNA, 71 bp, chicken (Gallus Gallus)
  misc_feature (36): n=a or c
ccgtaacctggttgatgagctcttgggttaatgatnaccatcagcacagcagaatgaggaacacacgtggc

SEQ ID NO: 14707 - DNA, 71 bp, chicken (Gallus Gallus)
  misc_feature (36): n=a or c
tgaaggccatctgtgctggagaagaggaggggggangaatttagggagagagaggaaggatactgagaagg

SEQ ID NO: 14708 - DNA, 71 bp, chicken (Gallus Gallus)
  misc_feature (36): n=a or g
caggacagctccaacccctccgtgttcgcctccttnctctggttatcactgatgaaaattaccttttggag

SEQ ID NO: 14709 - DNA, 71 bp, chicken (Gallus Gallus)
  misc_feature (36): n=c or t
ggaagccagcctccggtccttccccaaaaggggctnccctggcttgtgcataggcattactggtgagctct

SEQ ID NO: 14710 - DNA, 71 bp, chicken (Gallus Gallus)
  misc_feature (36): n=a or g
tattcttgaagatagttctattcatccttctggcanttaaacagaactagaagaaagttatggctgagaat

SEQ ID NO: 14711 - DNA, 71 bp, chicken (Gallus Gallus)
  misc_feature (36): n=c or t
tactcattcagctcttctctctaattagtagccccnagttttcctcaaatgcaacatcccagcttgggccc

SEQ ID NO: 14712 - DNA, 71 bp, chicken (Gallus Gallus)
  misc_feature (36): n=a or c
aaggcatcgtgaggcaaagctgtctgggcttgaagngactttcagcacttccatcaaagcctcatgcaagg

SEQ ID NO: 14713 - DNA, 71 bp, chicken (Gallus Gallus)
  misc_feature (36): n=a or g
ggtcttggagtctccgttgtagagcagaacaggcanctgagcgccgggcgcaaaatccttcagcacatcca

SEQ ID NO: 14714 - DNA, 71 bp, chicken (Gallus Gallus)
  misc_feature (36): n=a or g
gcagcacactcctccatacacactgattacaggatntgaatgctgaactgcatctcctgacaagcagagga

SEQ ID NO: 14715 - DNA, 71 bp, chicken (Gallus Gallus)
  misc_feature (36): n=a or g
gcatgcgctcctgcttgccggatgcctgccactgcnaataaaatctgcttttatcacagataccgtcctga

SEQ ID NO: 14716 - DNA, 71 bp, chicken (Gallus Gallus)
  misc_feature (36): n=a or g
agctgccttcaagacccgaggcatgggaggagcacnttacctagtttagtgatggttgcatctgagtagag

SEQ ID NO: 14717 - DNA, 71 bp, chicken (Gallus Gallus)
  misc_feature (36): n=g or t
caagcatttctaatcccacaagcacatccacagagnagacagaacatagaagtgtcccgagtttgcaagaa

SEQ ID NO: 14718 - DNA, 71 bp, chicken (Gallus Gallus)
  misc_feature (36): n=c or g
tgcctactacttgcattgcccgatttctctgtgctntactatcccctcaggtgcagttttctcttacatca

SEQ ID NO: 14719 - DNA, 71 bp, chicken (Gallus Gallus)
  misc_feature (36): n=c or t
aaaaggacccacagaagttatttggagaaaaactcngtgtgctatagaggggatgaagtggatgaaagtgg

SEQ ID NO: 14720 - DNA, 71 bp, chicken (Gallus Gallus)
  misc_feature (36): n=c or t
ggaagcagttgtctaaatatttccccatacaagctncctgcacccagaaagcaaggtgcttgtaagttaca

SEQ ID NO: 14721 - DNA, 71 bp, chicken (Gallus Gallus)
  misc_feature (36): n=a or c
tccaccacagaggcagcatgcatgcaaacattgccnactctgccaatacacccgaggaccctctttaattg

SEQ ID NO: 14722 - DNA, 71 bp, chicken (Gallus Gallus)
  misc_feature (36): n=a or g
actcacaggtctgcaagctaccgaccgccaccagtncatcctgcaagaactttgcactgaccaatgaacca

SEQ ID NO: 14723 - DNA, 71 bp, chicken (Gallus Gallus)
  misc_feature (36): n=a or t
gctgaaaatctcagcaaggtcagcccatgatttaanagctttctgagcattgcaaagttctgttccaagga

SEQ ID NO: 14724 - DNA, 71 bp, chicken (Gallus Gallus)
  misc_feature (36): n=c or t
gctctttcaccctggtgtgggtgcaaacaggagacncccgaggatgtgcacaatgcagtgtttaaggcatg

SEQ ID NO: 14725 - DNA, 71 bp, chicken (Gallus Gallus)
  misc_feature (36): n=g or t
agatctcccgggatcttctcctttctagaggttcanatgggtgaaaatcttcagcagacatgcagcaacat

SEQ ID NO: 14726 - DNA, 71 bp, chicken (Gallus Gallus)
  misc_feature (36): n=g or t
tacatcttgaatgcatgggtgtctttcaaattccgngtcaaagtagtttgtaaaagtagtttgttttgaaa

SEQ ID NO: 14727 - DNA, 71 bp, chicken (Gallus Gallus)
  misc_feature (36): n=a or g
acgatgaaacacagcaaatgccaatgtgatgaaggntgatgtgaaaagcaggatcccaatgacagccatca

SEQ ID NO: 14728 - DNA, 71 bp, chicken (Gallus Gallus)
  misc_feature (36): n=c or t
acccacaccatatttgtagagcatggtgaccacacnaacctccagcagtgctgggcacttcacatcagagc

SEQ ID NO: 14729 - DNA, 71 bp, chicken (Gallus Gallus)
  misc_feature (36): n=a or t
tatcagttttgagccaagaggggaaacagagcaagncgatggacgtggcatgccctcgtcttgctttattt

SEQ ID NO: 14730 - DNA, 71 bp, chicken (Gallus Gallus)
  misc_feature (36): n=a or g
agcaagatagttgatagagaggtggtggatagttcntgttggattcaacacgtgcaggatgatgagttttc

SEQ ID NO: 14731 - DNA, 71 bp, chicken (Gallus Gallus)
  misc_feature (36): n=a or g
acgtgagggcagcggtgtggttatttaaccctgacnttcaacttcaggtaggaacagagtctccaggggag

SEQ ID NO: 14732 - DNA, 71 bp, chicken (Gallus Gallus)
  misc_feature (36): n=g or t
ttcatcactaatcaacagcctggagccaggcatttncacttatagaggaaaataagtgcaggcagtagact

SEQ ID NO: 14733 - DNA, 71 bp, chicken (Gallus Gallus)
  misc_feature (36): n=a or c
ccccccacacacacacaatttttgttttgaattctncacgttaattatttcattgattttcccctcagttt

SEQ ID NO: 14734 - DNA, 71 bp, chicken (Gallus Gallus)
  misc_feature (36): n=c or t
tgcgcacctccagataggcatttctgtgttcacagnggtgttaataaggctgggaactgagttacacgagc

SEQ ID NO: 14735 - DNA, 71 bp, chicken (Gallus Gallus)
  misc_feature (36): n=a or g
ggacaacccttgtaatgttgcaacaaaacaccaccnactggcagcactcgctgcatgccaactacaaggat

SEQ ID NO: 14736 - DNA, 71 bp, chicken (Gallus Gallus)
  misc_feature (36): n=a or c
gggggctgagaaagaagacatctccaagagaagaangcaaactctttggccatgctggcaagacctgttca

SEQ ID NO: 14737 - DNA, 71 bp, chicken (Gallus Gallus)
  misc_feature (36): n=c or t
agcatataaagctgacaggctgttttctgtgacttnggcgttctgaggtttaaataacatgcttcctagtt

SEQ ID NO: 14738 - DNA, 71 bp, chicken (Gallus Gallus)
  misc_feature (36): n=a or t
gcagcacacctgtacaagggccaatgatcccctganctgaattccttccctaagtgaaccagaattaaaaa

SEQ ID NO: 14739 - DNA, 71 bp, chicken (Gallus Gallus)
  misc_feature (36): n=a or g
aagctcactgacagaaatcagatgagaagcagtttnggtcacaggcacaggcacctccacaaaaggctgaa

SEQ ID NO: 14740 - DNA, 71 bp, chicken (Gallus Gallus)
  misc_feature (36): n=c or t
tggtaactctcgggtcatgttttcaaagctttctcnacgtgctcaatagctccctgtgttgttttaaatga

SEQ ID NO: 14741 - DNA, 71 bp, chicken (Gallus Gallus)
  misc_feature (36): n=c or t
tgccgggctgtagaagtatgacagggcatgctgagnccctgtctcccatgggaagggagatggggcagtaa

SEQ ID NO: 14742 - DNA, 71 bp, chicken (Gallus Gallus)
  misc_feature (36): n=a or g
gagatgtcccgcttgggcaggtcccatgtccagggntagggagggatggctgattgcagataatgtttttc

SEQ ID NO: 14743 - DNA, 71 bp, chicken (Gallus Gallus)
  misc_feature (36): n=c or t
ccctctgggactggagtcttgccagttttccatgcngctatctgatccacggcaaaatgatttggctatat

SEQ ID NO: 14744 - DNA, 71 bp, chicken (Gallus Gallus)
  misc_feature (36): n=c or t
ctttgaaagcactgcgagagcaggtggatgtactgnaggaactgtggaaatcacccacagtttgatgggtt

SEQ ID NO: 14745 - DNA, 71 bp, chicken (Gallus Gallus)
  misc_feature (36): n=a or g
ctgtgccaaacctgacccccatccatccattccccntagacacatcgaagccgccatcgagaagctgagca

SEQ ID NO: 14746 - DNA, 71 bp, chicken (Gallus Gallus)
  misc_feature (36): n=c or t
taaagtgcactcctaaatgttcttggtttagtgganggtctgcacagaggagctgcttcagatccccaagg

SEQ ID NO: 14747 - DNA, 71 bp, chicken (Gallus Gallus)
  misc_feature (36): n=c or t
tgtccaatgaattctgaggcgacagaagagccccancattgttctggagccctcaaaatggcaatcacacc

SEQ ID NO: 14748 - DNA, 71 bp, chicken (Gallus Gallus)
  misc_feature (36): n=a or g
tgacctggataaaagtttgtatttgctatatcgaangatatgcatacaaacacttgtaccaagttcttgac

SEQ ID NO: 14749 - DNA, 71 bp, chicken (Gallus Gallus)
  misc_feature (36): n=c or t
tccgaggttctggaatgctgtaccgccacctgggcngtgtccttctgtaacatcagttcctccactgacgc

SEQ ID NO: 14750 - DNA, 71 bp, chicken (Gallus Gallus)
  misc_feature (36): n=c or t
gggaaggtgtaactgctacttgaatgaggagaaagnggtttgggtgcaaccatcccagcataaggagattt

SEQ ID NO: 14751 - DNA, 71 bp, chicken (Gallus Gallus)
  misc_feature (36): n=c or t
cattaggagaaaacctatagccctctaaaaattacntatgtctcacttttaattgtatttcaggacaacag

SEQ ID NO: 14752 - DNA, 71 bp, chicken (Gallus Gallus)
  misc_feature (36): n=a or g
cttttaatttttgtttcccttttggttccctttcgnttgtttccttgttaactagaaggtggtgtgtctct

SEQ ID NO: 14753 - DNA, 71 bp, chicken (Gallus Gallus)
  misc_feature (36): n=a or g
agtttaaggccagagcaaatcttttgaacgtttggnctgaacacctttgtggccttggacactgtgtctcc

SEQ ID NO: 14754 - DNA, 71 bp, chicken (Gallus Gallus)
  misc_feature (36): n=c or t
ttgtcatttaattggctcagttctggcacccgtcangcagcgcagagcaataaccactcagcctgtgtgtg

SEQ ID NO: 14755 - DNA, 71 bp, chicken (Gallus Gallus)
  misc_feature (36): n=c or t
agaaaagaaaaatggaacagaaaaggaactggttgnatgagcaataatgatttttggtggcagtggaaaga

SEQ ID NO: 14756 - DNA, 71 bp, chicken (Gallus Gallus)
  misc_feature (36): n=c or g
cagccctgatgcccacccagcctgtccccaacctgntcccaatgtgtccccagtgtgtcttattgctatcc

SEQ ID NO: 14757 - DNA, 71 bp, chicken (Gallus Gallus)
  misc_feature (36): n=a or g
gggtctgggggtagagcgtctttgtgtatgagcacntttccagccaaacccctttttggggggagggagag

SEQ ID NO: 14758 - DNA, 71 bp, chicken (Gallus Gallus)
  misc_feature (36): n=a or g
tgagctctggtcactaagtcgtgactttcctcctcnttacctgagaggtaaccacaatggggacgatcctt

SEQ ID NO: 14759 - DNA, 71 bp, chicken (Gallus Gallus)
  misc_feature (36): n=c or t
gcatgagtgaggaccagtttagcaaggcaacagcgnacggagccaggaatagtttttatcatgagattttt

SEQ ID NO: 14760 - DNA, 71 bp, chicken (Gallus Gallus)
  misc_feature (36): n=c or t
ttcctcgaggctgaaagatgtcaagctactctgcangcttgcagaatgtaatgagagacagaaaaagctgg

SEQ ID NO: 14761 - DNA, 71 bp, chicken (Gallus Gallus)
  misc_feature (36): n=a or t
tggggatctctgggaagcatggctggttgtacctgngagtagcaagaataaaatgagaggatgtatggatg

SEQ ID NO: 14762 - DNA, 71 bp, chicken (Gallus Gallus)
  misc_feature (36): n=a or g
gctcccgtagtctttgaatgcatctccggttgtcantgaaggagttaaggtccgggccgtaatcaagttag

SEQ ID NO: 14763 - DNA, 71 bp, chicken (Gallus Gallus)
  misc_feature (36): n=a or c
ctcccacactgctgtttcccaagcatgagaacatcntaccctttcatttgcttaccagacactgcgtgatt

SEQ ID NO: 14764 - DNA, 71 bp, chicken (Gallus Gallus)
  misc_feature (36): n=a or g
aacaattttccataaaacaaaacaaaaaaaaagccntgtttggaaaagtactttgtttccccataagaaaa

SEQ ID NO: 14765 - DNA, 71 bp, chicken (Gallus Gallus)
  misc_feature (36): n=g or t
ctgaaaaggcttttgtggtgtaaggtgacatgctgntgaggaggatccaaccctccacttggaaaattgaa

SEQ ID NO: 14766 - DNA, 71 bp, chicken (Gallus Gallus)
  misc_feature (36): n=c or t
tagaggatgtagagcttttcttcttgccttcttacntatagtgcataccacaactgcagagaatgatgcca

SEQ ID NO: 14767 - DNA, 71 bp, chicken (Gallus Gallus)
  misc_feature (36): n=c or t
caaaaggcaagaagtatttgatacaaggcagaacgnttgccagagctcctccacgtacgtcgtgatgggga

SEQ ID NO: 14768 - DNA, 71 bp, chicken (Gallus Gallus)
  misc_feature (36): n=c or t
cctacctgggagcagaggctgacctcaccgtgccangacttccttccaggtatttgtagagagcagtaaag

SEQ ID NO: 14769 - DNA, 71 bp, chicken (Gallus Gallus)
  misc_feature (36): n=a or g
agctccaagtgttgataaatgaaataattagcagcngtggaatctgcgtgtttaacatggaattggtggta

SEQ ID NO: 14770 - DNA, 71 bp, chicken (Gallus Gallus)
  misc_feature (36): n=a or t
agcaagcttgaaggaaagtaccattaaatcagtgtnggacaaaaatacttcttaaaaaaataagatgtttg

SEQ ID NO: 14771 - DNA, 71 bp, chicken (Gallus Gallus)
  misc_feature (36): n=g or t
aaccactaaatcagcaccagatcagtccaaccagtnccccatccaacccggccttgaacacatcccaggat

SEQ ID NO: 14772 - DNA, 71 bp, chicken (Gallus Gallus)
  misc_feature (36): n=c or t
atgttctcagccccctacatctacatccatcacacngaaacgcccatggatccctattctgaactcacata

SEQ ID NO: 14773 - DNA, 71 bp, chicken (Gallus Gallus)
  misc_feature (36): n=a or g
ccagtgtactacatgatgttacggtgtggaataccnataaccaaaaatcataaaaccataacactggtaaa

SEQ ID NO: 14774 - DNA, 71 bp, chicken (Gallus Gallus)
  misc_feature (36): n=a or g
aagaactctcaagctagcagaacaagcaactaaaanagtatgagggtctgagtgggctaaaatagaaactg

SEQ ID NO: 14775 - DNA, 71 bp, chicken (Gallus Gallus)
  misc_feature (36): n=c or t
tgttcacacatacctttacatctgtgtgcctaactngccttaggcagggctgggccagtagttgaactgag

SEQ ID NO: 14776 - DNA, 71 bp, chicken (Gallus Gallus)
  misc_feature (36): n=c or t
cacggtcctaacctaacctaaggaagttcatgatgngctgcctatgcctggttgcactttgtaaaggcact

SEQ ID NO: 14777 - DNA, 71 bp, chicken (Gallus Gallus)
  misc_feature (36): n=a or g
cttctgtcctgggatcattctccactgacttgtcangacaagcttcatgcactaacactgactcaaaagcc

SEQ ID NO: 14778 - DNA, 71 bp, chicken (Gallus Gallus)
  misc_feature (36): n=c or t
tgaataatgaaaggatatacaaaagtatttttctcnttaagcactagcacccttttcagtccatagggctt

SEQ ID NO: 14779 - DNA, 71 bp, chicken (Gallus Gallus)
  misc_feature (36): n=c or t
aaggaatttagtgaatccaaagcatactcattctcnttgagcgttgatctggtggctacacctccacatag

SEQ ID NO: 14780 - DNA, 71 bp, chicken (Gallus Gallus)
  misc_feature (36): n=a or g
gagtggtgagcagcatccataaaaataaaatgtggntacaaaatatttgaatttaagtagatttgctagaa

SEQ ID NO: 14781 - DNA, 71 bp, chicken (Gallus Gallus)
  misc_feature (36): n=a or g
ctgtggcagaggagtgcataggacaaggaagaggangccaggtcatgcattaatacatgttggacacagat

SEQ ID NO: 14782 - DNA, 71 bp, chicken (Gallus Gallus)
  misc_feature (36): n=a or g
gaaagtcatcttggcttgaagagtggacttgtatcnagcacccatctcatgccaggaaaagtcacaagttg

SEQ ID NO: 14783 - DNA, 71 bp, chicken (Gallus Gallus)
  misc_feature (36): n=a or g
gccctaacttgcaaaatgacatcatattctaccttngattttaccttctcgacctctgtttttcccacccg

SEQ ID NO: 14784 - DNA, 71 bp, chicken (Gallus Gallus)
  misc_feature (36): n=a or g
aaggatagtcaagaattggaatagactgctgggagnctggagccactggaggtttttaaaagcaggttaaa

SEQ ID NO: 14785 - DNA, 71 bp, chicken (Gallus Gallus)
  misc_feature (36): n=c or t
ttgtcactctgcatttcctttccagcacgctgtcgnagacaagccgttttctgttggtcaaatgacttgtt

SEQ ID NO: 14786 - DNA, 71 bp, chicken (Gallus Gallus)
  misc_feature (36): n=c or g
gctccgtcaggaaataattctaatgagctcttggantcagtggctgattgcatcgtcacacaccaggtctg

SEQ ID NO: 14787 - DNA, 71 bp, chicken (Gallus Gallus)
  misc_feature (36): n=a or g
agacaggcactacagaaaatcacagcaaagaggaanggaaacactcgttcccaatcaaagcaaaataaagg

SEQ ID NO: 14788 - DNA, 71 bp, chicken (Gallus Gallus)
  misc_feature (36): n=c or t
ggattttgtgaggtgaaaccaaaacccacctccccnttcagtattcattaacaaaagtcatccttgcacat

SEQ ID NO: 14789 - DNA, 71 bp, chicken (Gallus Gallus)
  misc_feature (36): n=c or t
tgagatggtgcaagataagaagatacaggctgtttngtgttccctaagcaggtctgggtctcattccaacc

SEQ ID NO: 14790 - DNA, 71 bp, chicken (Gallus Gallus)
  misc_feature (36): n=a or c
caacactggtacccaacaccagagctgggctgaatntgcactggtttagagagtctgatgccagaattttc

SEQ ID NO: 14791 - DNA, 71 bp, chicken (Gallus Gallus)
  misc_feature (36): n=a or g
gctctgcagcacagaggctctggtacaggtttacanagaggagtctcaggtgacacaacagcagtgaggtc

SEQ ID NO: 14792 - DNA, 71 bp, chicken (Gallus Gallus)
  misc_feature (36): n=c or t
ctgtcctgctttgccaccttacctgctcacacttanctgctcacacttacccaggtaggctcctggcatcc

SEQ ID NO: 14793 - DNA, 71 bp, chicken (Gallus Gallus)
  misc_feature (36): n=a or g
atgctcaaagccgaccttattacagtggctttgagnacacagaaatcccacccgtgaggaacaattgctcc

SEQ ID NO: 14794 - DNA, 71 bp, chicken (Gallus Gallus)
  misc_feature (36): n=c or g
tgagctttatggacccacacacgtgctttggagacncacacatcctcttggcacccacatattcactccag

SEQ ID NO: 14795 - DNA, 71 bp, chicken (Gallus Gallus)
  misc_feature (36): n=c or t
ctccctgatgctcttattacttttggcactgggctngcatcccgattaagcacattggctcctgttttctc

SEQ ID NO: 14796 - DNA, 71 bp, chicken (Gallus Gallus)
  misc_feature (36): n=a or g
tttgctgtaaagggagtttgtgcctccactggaaancctttagggctcatgtgaacttacatcgttggtgt

SEQ ID NO: 14797 - DNA, 71 bp, chicken (Gallus Gallus)
  misc_feature (36): n=g or t
tcttggggaagctgtgctgacatttagggaaatgcntgcaaaacaaagccacgctatgagctcggcctctc

SEQ ID NO: 14798 - DNA, 71 bp, chicken (Gallus Gallus)
  misc_feature (36): n=a or t
ttcttgaaaatacagacatgaaaagttcaggttaancaattttctgtggtacataaagatgggaagttcat

SEQ ID NO: 14799 - DNA, 71 bp, chicken (Gallus Gallus)
  misc_feature (36): n=c or t
ttattattattaagaaccaagggagtgcagcgctgnagggaaatggagatttgcaaacagagcactctctg

SEQ ID NO: 14800 - DNA, 71 bp, chicken (Gallus Gallus)
  misc_feature (36): n=c or t
gctaagattttacagcagcaaaggctggggatgaangttttaagatggctgtcagaaggatgagctctgcc

SEQ ID NO: 14801 - DNA, 71 bp, chicken (Gallus Gallus)
  misc_feature (36): n=a or g
tattgttgatatatatacgttcctttcccagacaangagctctttgaggacagtttctcttctcctcacag

SEQ ID NO: 14802 - DNA, 71 bp, chicken (Gallus Gallus)
  misc_feature (36): n=c or t
tgcccacaaatggctccaggacagaggagtgcacantggtgtgtttgtaagcagagcagcccccgcagctg

SEQ ID NO: 14803 - DNA, 71 bp, chicken (Gallus Gallus)
  misc_feature (36): n=c or t
tgcatctaaacccttggtccccctcgtgtccatccnctgtgtccatctgttccctctgttcctcttgcatc

SEQ ID NO: 14804 - DNA, 71 bp, chicken (Gallus Gallus)
  misc_feature (36): n=c or t
acgtttttattatcgctgcatggtgtcaatgaaatncttttggtagcctactctgtttaattcgcaccaaa

SEQ ID NO: 14805 - DNA, 71 bp, chicken (Gallus Gallus)
  misc_feature (36): n=a or g
cagccccatcaccgtctccaaggtacgcacacctcntcctgctgcagcatttcccatacacacattatgaa

SEQ ID NO: 14806 - DNA, 71 bp, chicken (Gallus Gallus)
  misc_feature (36): n=c or t
tctaccttttccagttcctgccactgtggatgtaancactctgcaagcagctttccaggcttcgtggataa

SEQ ID NO: 14807 - DNA, 71 bp, chicken (Gallus Gallus)
  misc_feature (36): n=c or t
ttggggagccaggagaatcccctgctgtccaggcangcgccagaagtgatccatttggcctttatttctca

SEQ ID NO: 14808 - DNA, 71 bp, chicken (Gallus Gallus)
  misc_feature (36): n=c or t
tccatctcctgcgtcctttttgcatttgtcctctcngtccctcttgcatctaaacccttggtccccctcgt

SEQ ID NO: 14809 - DNA, 71 bp, chicken (Gallus Gallus)
  misc_feature (36): n=a or g
tttcacctttgcaatagaagagatttctaaacatcntgtgctacatggtggctttattcccacattcacac

SEQ ID NO: 14810 - DNA, 71 bp, chicken (Gallus Gallus)
  misc_feature (36): n=a or g
ttaggcaggggctgctttattaaccagcagctgaancctaaaactccaagtgatacgctgtgtgcacagct

SEQ ID NO: 14811 - DNA, 71 bp, chicken (Gallus Gallus)
  misc_feature (36): n=c or g
ctcactcccaacccaggacagtccagatccaaattnctccctgccccaaggatccctacagcccagctctc

SEQ ID NO: 14812 - DNA, 71 bp, chicken (Gallus Gallus)
  misc_feature (36): n=c or t
cttttggagaagctgaggatgcaaacataaaaatcnactgaatgtttattgccttgctttaggcttttctg

SEQ ID NO: 14813 - DNA, 71 bp, chicken (Gallus Gallus)
  misc_feature (36): n=c or t
gtcctggatcctttttcttttaccacagtgcagtcngaacagcaactgcttcaattctgtgtcaagaagtc

SEQ ID NO: 14814 - DNA, 71 bp, chicken (Gallus Gallus)
  misc_feature (36): n=a or g
gctgacattaccttgcttgagttcaaaatgactccnttgtgctaattgctcagtacaagcagtggctattg

SEQ ID NO: 14815 - DNA, 71 bp, chicken (Gallus Gallus)
  misc_feature (36): n=c or t
acctccccgtacagctcagtcttaggaaggcaaaanggagtaaaaactcatctgttggtcggaaaaggctc

SEQ ID NO: 14816 - DNA, 71 bp, chicken (Gallus Gallus)
  misc_feature (36): n=a or g
aagacctatctcatttccaagtaagaaaacaaaacnatggaagaagagctgaatgtgactggccctgtgaa

SEQ ID NO: 14817 - DNA, 71 bp, chicken (Gallus Gallus)
  misc_feature (36): n=a or g
tttctcctcacacccctaccacaataaggagccacncttatcctactctttcatagcttcttattgtggtt

SEQ ID NO: 14818 - DNA, 71 bp, chicken (Gallus Gallus)
  misc_feature (36): n=a or g
cttttcacacagtctgcacgtatgatggtacacacngtggcaacgtttaactcaatcaaggtaacagtaca

SEQ ID NO: 14819 - DNA, 71 bp, chicken (Gallus Gallus)
  misc_feature (36): n=c or t
actgtgcctcactgtaattctgtacgtaggtcctgnatggtggaggagtcgggaacactggaatcccagct

SEQ ID NO: 14820 - DNA, 71 bp, chicken (Gallus Gallus)
  misc_feature (36): n=a or g
tgaagtacacaagcggaaggaactggtatagcgtgntgcctgttcctattacgcacaaggccagaagacag

SEQ ID NO: 14821 - DNA, 71 bp, chicken (Gallus Gallus)
  misc_feature (36): n=c or t
agaaaacctgcatgtcggaatatctcacaagcattntgggggtacgttaaatctcctagaaagcctgcctt

SEQ ID NO: 14822 - DNA, 71 bp, chicken (Gallus Gallus)
  misc_feature (36): n=c or t
gagttttcccctggccgcactaggaacaaaaccatncagatctgttatctgaatacaggcatattcctgta

SEQ ID NO: 14823 - DNA, 71 bp, chicken (Gallus Gallus)
  misc_feature (36): n=a or g
ggaggttaaaaaagagatgaacggagcagaaaaagngtgaatggagcagttcccattacaccaggtatctc

SEQ ID NO: 14824 - DNA, 71 bp, chicken (Gallus Gallus)
  misc_feature (36): n=a or g
cagggaagagacctttaggggaagcttatgagcacnagcactcatagggcctcaggtctggtgcacagccc

SEQ ID NO: 14825 - DNA, 71 bp, chicken (Gallus Gallus)
  misc_feature (36): n=c or t
aaggcagcgagctctgcaatgtgtaaccaggccatnggttacatatttaatccagaattgtaatgaacgcg

SEQ ID NO: 14826 - DNA, 71 bp, chicken (Gallus Gallus)
  misc_feature (36): n=a or g
tgggctgggtgatagctatttgagtaatggttagtnattttctgatcattataatctgtatgtacgagatg

SEQ ID NO: 14827 - DNA, 71 bp, chicken (Gallus Gallus)
  misc_feature (36): n=a or g
tccatgctatgtttatggaaccatgactgctttacncagccctccacaagaaggtatgctctccatacaaa

SEQ ID NO: 14828 - DNA, 71 bp, chicken (Gallus Gallus)
  misc_feature (36): n=c or t
ggagacacagtctgagcacctaaatcagaagcaggnagctgggtgatgcagcattcttcaacggctgccag

SEQ ID NO: 14829 - DNA, 71 bp, chicken (Gallus Gallus)
  misc_feature (36): n=a or g
gcagtgcctgtgtaaggatacagctggaaccctgancttcagtcccattctatttgttgtctttggaacag

SEQ ID NO: 14830 - DNA, 71 bp, chicken (Gallus Gallus)
  misc_feature (36): n=c or g
tttcttttttaacagaagaaaaagataaatcaaaanaagaaataatatatagcattcctcctagtcaagcc

SEQ ID NO: 14831 - DNA, 71 bp, chicken (Gallus Gallus)
  misc_feature (36): n=a or g
tgtcggagcaacattcccagccaggatatgaggtgnggacagggaattgtggcagatcccacacggtattt

SEQ ID NO: 14832 - DNA, 71 bp, chicken (Gallus Gallus)
  misc_feature (36): n=a or g
cttaactagaaggtgactgaattacagaagcatcanaaatctggctgaaaggatttgtcagaccaccccat

SEQ ID NO: 14833 - DNA, 71 bp, chicken (Gallus Gallus)
  misc_feature (36): n=a or g
agaatggaagatttcagaaggtgataatgctgtttntatgtcctgttcagtcatctttaatttcaatttct

SEQ ID NO: 14834 - DNA, 71 bp, chicken (Gallus Gallus)
  misc_feature (36): n=g or t
aattacctgcccttcttcctgatggagaagacactnttcctgtaccactacttgcctgccctcacattcca

SEQ ID NO: 14835 - DNA, 71 bp, chicken (Gallus Gallus)
  misc_feature (36): n=a or g
ccagcctgacagagctggtgagaaaaccaaggaccnagcgtgggcctggagcccttatttgttacttgcgt

SEQ ID NO: 14836 - DNA, 71 bp, chicken (Gallus Gallus)
  misc_feature (36): n=c or t
agaagaactaaacctgctcctccagcaacttaaaangaacatactccattgtgaagcagacaatcctgttt

SEQ ID NO: 14837 - DNA, 71 bp, chicken (Gallus Gallus)
  misc_feature (36): n=c or t
agctcagtagtcctttttctttcccttgcagacccnctggaccatgaacctgctatttctcctttgctgcc

SEQ ID NO: 14838 - DNA, 71 bp, chicken (Gallus Gallus)
  misc_feature (36): n=c or t
cttgcacggcacaaaacactaaatccctcgtaagantctgggctcatgacatcatcttggctcagcagatt

SEQ ID NO: 14839 - DNA, 71 bp, chicken (Gallus Gallus)
  misc_feature (36): n=c or g
gagtgaaacagcttggaccagttcagagctgaaaancactctgctttcttctgcaggttcactgctgtaga

SEQ ID NO: 14840 - DNA, 71 bp, chicken (Gallus Gallus)
  misc_feature (36): n=c or t
aagaacttagagccgcagcaaattcagcagagcacnggagcatgactgaacttcacactgagccaagagcc

SEQ ID NO: 14841 - DNA, 71 bp, chicken (Gallus Gallus)
  misc_feature (36): n=c or t
ctgcatcaacagacttctccctatgccttaaaaaanttccattctggttttttttttttccattccatttg

SEQ ID NO: 14842 - DNA, 71 bp, chicken (Gallus Gallus)
  misc_feature (36): n=c or t
tccgacaaagtttggtacgcagtccaatgctatcancttgtcttacagaatactttctaacatcttagaat

SEQ ID NO: 14843 - DNA, 71 bp, chicken (Gallus Gallus)
  misc_feature (36): n=a or g
tgtcactttctaatttctctgcctctctttatacangaacatgctcacaacagcacacatcgattaggata

SEQ ID NO: 14844 - DNA, 71 bp, chicken (Gallus Gallus)
  misc_feature (36): n=a or g
tatgtggatagatgtaaatggaaacaaggagaaaanaaaataacccatgctgagggacatgtacatttcca

SEQ ID NO: 14845 - DNA, 71 bp, chicken (Gallus Gallus)
  misc_feature (36): n=a or g
cacatttgtgacaaagggcagttaagcgattgagcnctgtcaagattcaagagagtcagaaaagaattaag

SEQ ID NO: 14846 - DNA, 71 bp, chicken (Gallus Gallus)
  misc_feature (36): n=a or g
acaccacctcatgcttaaaggagtgatggatttcancagcccagaggagaaccaggcattgatcctcagcc

SEQ ID NO: 14847 - DNA, 71 bp, chicken (Gallus Gallus)
  misc_feature (36): n=a or c
acccacatgaagttattgacatccatataacctaangcaatgtcacgtagctttaaaatgaacacagacta

SEQ ID NO: 14848 - DNA, 71 bp, chicken (Gallus Gallus)
  misc_feature (36): n=a or c
tcaaacgtcaggccactcttttagcaacagtcctcntgagtgatataaaggcttcactacatacaataaca

SEQ ID NO: 14849 - DNA, 71 bp, chicken (Gallus Gallus)
  misc_feature (36): n=c or t
ctctgtggttatctgataacagaagtgctgtgctgngtgaatctgtaccaacgaacgcagctatcagctgt

SEQ ID NO: 14850 - DNA, 71 bp, chicken (Gallus Gallus)
  misc_feature (36): n=a or g
gcaacccggagtgttgaagcatggtgatatgaaganccaaggagaaatgtgaggggatttaccagatctgg

SEQ ID NO: 14851 - DNA, 71 bp, chicken (Gallus Gallus)
  misc_feature (36): n=a or g
caaggagctgctcctggccatccatctctgcccccntttgtacttctttccgttccaatggagactgctct

SEQ ID NO: 14852 - DNA, 71 bp, chicken (Gallus Gallus)
  misc_feature (36): n=a or g
gagctgggctactgaaagagcaaaaatgcaaagaanggtacttagagaggggatgggtgtgtgtaaagatc

SEQ ID NO: 14853 - DNA, 71 bp, chicken (Gallus Gallus)
  misc_feature (36): n=a or g
ccaaccgacggaaaactaaaagttgcaaatcaaccnggctggatgaattgaagcaggctggcagacgttta

SEQ ID NO: 14854 - DNA, 71 bp, chicken (Gallus Gallus)
  misc_feature (36): n=a or g
ctcagtttacccacgtgcaaaacgggggtaagtatncccagcgaaggaaggcaaacgttgggacttttata

SEQ ID NO: 14855 - DNA, 71 bp, chicken (Gallus Gallus)
  misc_feature (36): n=a or g
aagaaattaataagaattcatatgaagtggctaaanctgacttcaagtgtatgctaacacaccattcttag

SEQ ID NO: 14856 - DNA, 71 bp, chicken (Gallus Gallus)
  misc_feature (36): n=c or t
ttcccccctccctgccaaagaaaattggcatatgantaacaagaatagcaatgatattaataatagcaatc

SEQ ID NO: 14857 - DNA, 71 bp, chicken (Gallus Gallus)
  misc_feature (36): n=a or t
cagaccagtagcatttaacctcagatgttgatcgtngggtctttctgcccagctaccagctgaaacttact

SEQ ID NO: 14858 - DNA, 71 bp, chicken (Gallus Gallus)
  misc_feature (36): n=a or g
acaccaaatcaacaagtgaaacccattcgtacttgntcgaggcccaaagtacaacgtgttgaagaagatac

SEQ ID NO: 14859 - DNA, 71 bp, chicken (Gallus Gallus)
  misc_feature (36): n=c or t
tggtcactgtggagatcccagtgcaaaaataataangggatgaagtcagttccctaagatttcagtaatgg

SEQ ID NO: 14860 - DNA, 71 bp, chicken (Gallus Gallus)
  misc_feature (36): n=a or g
ggatgagggagggcagcagcacgtccccaccgcccnctgttccttttctttacttttcttatagaaaaaga

SEQ ID NO: 14861 - DNA, 71 bp, chicken (Gallus Gallus)
  misc_feature (36): n=c or t
cgtgggaaggatgagagatgcggcgtagcatccaangattaaatccacattactcagagatgcagaagaaa

SEQ ID NO: 14862 - DNA, 71 bp, chicken (Gallus Gallus)
  misc_feature (36): n=a or g
tcttaaagtgttatcctcaggttagacactactatnaattaagcagctgatgtcagcattggaaggtgaat

SEQ ID NO: 14863 - DNA, 71 bp, chicken (Gallus Gallus)
  misc_feature (36): n=c or t
aatccagatattattagacagaatgactcttatttncttttttttttcactgaatagcacagaagattgat

SEQ ID NO: 14864 - DNA, 71 bp, chicken (Gallus Gallus)
  misc_feature (36): n=a or c
ggaagcaggattttggtgcaggggacatccaaactnttgggtaccatcctgctgaagggtaccagtgtgcc

SEQ ID NO: 14865 - DNA, 71 bp, chicken (Gallus Gallus)
  misc_feature (36): n=c or t
agaaccccctctacaacagccagcttttcccagctnccccagtagatactctaacacacatacaaatgcct

SEQ ID NO: 14866 - DNA, 71 bp, chicken (Gallus Gallus)
  misc_feature (36): n=a or c
cgactgctgctgaggttggggcttcctaaaatgctnctcatcctaacagagctgattgcacagttttgtta

SEQ ID NO: 14867 - DNA, 71 bp, chicken (Gallus Gallus)
  misc_feature (36): n=c or g
ctggcacaattacagctgaaagcaacatgtaggcancctcccataaacacatttgctgtatttgccccggt

SEQ ID NO: 14868 - DNA, 71 bp, chicken (Gallus Gallus)
  misc_feature (36): n=c or t
tagctttggttttatttcttagcttaccaacaggtngtaggcagcaacacaaataaactgcccctggcagc

SEQ ID NO: 14869 - DNA, 71 bp, chicken (Gallus Gallus)
  misc_feature (36): n=c or t
agcccctctgtgattctgtggctgcttagtgccatngcacttgagaaatcaatcacatgtctgaataaaag

SEQ ID NO: 14870 - DNA, 71 bp, chicken (Gallus Gallus)
  misc_feature (36): n=c or t
tccgtcctgcgtagatccatacagatgttttacttngctcacaacgacttcaaatcaaacaactctgcaga

SEQ ID NO: 14871 - DNA, 71 bp, chicken (Gallus Gallus)
  misc_feature (36): n=a or g
aatgaatttatagctttaattggtggggacaccaantatctgctgtgttatgccaatgcctaatgcataat

SEQ ID NO: 14872 - DNA, 71 bp, chicken (Gallus Gallus)
  misc_feature (36): n=a or c
aggtgacatacttgtctaaacactcctgaaaggggnaaagcctgaggcctggccttccaaatagcttacca

SEQ ID NO: 14873 - DNA, 71 bp, chicken (Gallus Gallus)
  misc_feature (36): n=a or t
tcaggcaaaggagtcttcttccattttccaaatgangagtcagtgagattccaaatgatgagacagtgagt

SEQ ID NO: 14874 - DNA, 71 bp, chicken (Gallus Gallus)
  misc_feature (36): n=c or t
cagaggcttactaagtgacagttgtctattctctgnccggaatgagggacagggctggaggcaaatgcatt

SEQ ID NO: 14875 - DNA, 71 bp, chicken (Gallus Gallus)
  misc_feature (36): n=c or t
tgctcacttgacatgagcacaggctttacaccattncaccagccgggaaggcagaggttcacatgagcaga

SEQ ID NO: 14876 - DNA, 71 bp, chicken (Gallus Gallus)
  misc_feature (36): n=a or g
agaagtaatttgcccagagcaattgatccaaggagngatggagcagtgccagtggcagctctgtcctggtt

SEQ ID NO: 14877 - DNA, 71 bp, chicken (Gallus Gallus)
  misc_feature (36): n=g or t
tgagttaaattcaggtaacgaccttacagccacttngctggcacatggtaagaccctgtttgctgaggatt

SEQ ID NO: 14878 - DNA, 71 bp, chicken (Gallus Gallus)
  misc_feature (36): n=a or g
tcagggatgtgggtcttgtggtgctggtggcagcantcattacactgtgatctccacaacctctggtggca

SEQ ID NO: 14879 - DNA, 71 bp, chicken (Gallus Gallus)
  misc_feature (36): n=c or t
gaaatcactctttgttcatggagttattaggtgtgngttaattactgcaggctttgtaaaggcacaggctg

SEQ ID NO: 14880 - DNA, 71 bp, chicken (Gallus Gallus)
  misc_feature (36): n=c or t
ccccgtatccaggtttggatatttggggttgtggcnataggagccccatatccaggtttggagatttgggg

SEQ ID NO: 14881 - DNA, 71 bp, chicken (Gallus Gallus)
  misc_feature (36): n=c or t
acccttaagtcacacagctgttacagccaaatgcanttctacatcagaaacacatcttgaaaaagcgatgt

SEQ ID NO: 14882 - DNA, 71 bp, chicken (Gallus Gallus)
  misc_feature (36): n=c or t
tgccagccaagccctgcaggacagcaccgaagcagnagataggcaggcaatttacagagcagccatagcta

SEQ ID NO: 14883 - DNA, 71 bp, chicken (Gallus Gallus)
  misc_feature (36): n=c or t
cttctgtattcaggagcaggaataaagcatcacccntagcaattaggggcaggagcagcaatgccagctct

SEQ ID NO: 14884 - DNA, 71 bp, chicken (Gallus Gallus)
  misc_feature (36): n=c or t
gccggtaagaccaaagtaccttcataatgctgtcgnttgggctgcagttcccatctctggctccctgttac

SEQ ID NO: 14885 - DNA, 71 bp, chicken (Gallus Gallus)
  misc_feature (36): n=a or c
ctgcctccatcagactgtattagctttgcttacagnttttggtgctactgaagcacaggaatcttattcat

SEQ ID NO: 14886 - DNA, 71 bp, chicken (Gallus Gallus)
  misc_feature (36): n=g or t
cagggcccacctccaagtcatcatttgctggggctnggaggtggattaattttcaggataggaagcgtttc

SEQ ID NO: 14887 - DNA, 71 bp, chicken (Gallus Gallus)
  misc_feature (36): n=c or t
ccggactattagcatgtactaaatatcagaggcacngtatatctctgcatgatacttgcaagcgataaagc

SEQ ID NO: 14888 - DNA, 71 bp, chicken (Gallus Gallus)
  misc_feature (36): n=a or t
atcattggaataaaatcccatacaagattttcatanataatagtagttttaagaagaaataaacattaatt

SEQ ID NO: 14889 - DNA, 71 bp, chicken (Gallus Gallus)
  misc_feature (36): n=a or g
cacaattgtcatttgtgttgggaagagctgttcagnggagcgttgtatcacctgggatagcaaaacacaaa

SEQ ID NO: 14890 - DNA, 71 bp, chicken (Gallus Gallus)
  misc_feature (36): n=c or t
cccagcatctgctatgaacgtcggaaaacagatcanccaggctattttctgtagctagttacaatattgtg

SEQ ID NO: 14891 - DNA, 71 bp, chicken (Gallus Gallus)
  misc_feature (36): n=a or t
cggttaaataaggaaactgttttatcccattgaatntctcccccaggtgacatccttgcttggcttcacct

SEQ ID NO: 14892 - DNA, 71 bp, chicken (Gallus Gallus)
  misc_feature (36): n=c or g
tatctcccctttatagaagtactgcatgtgccatcncaggaaggcagcacccttcaagaagaaaccctcag

SEQ ID NO: 14893 - DNA, 71 bp, chicken (Gallus Gallus)
  misc_feature (36): n=c or t
agagcattaagaacttctgaatatccgtactcacanggtaaggttagtctgtgggttcttgtcaggtctca

SEQ ID NO: 14894 - DNA, 71 bp, chicken (Gallus Gallus)
  misc_feature (36): n=a or g
ttgtttaaacaattcttcaagaactggagggacaangaccagacagaaggactgggagaggcttacatttc

SEQ ID NO: 14895 - DNA, 71 bp, chicken (Gallus Gallus)
  misc_feature (36): n=a or g
caatgaagtaaggtacttcattaatgttattatgtntatatttactatacacctagtctgtgtgaaagttg

SEQ ID NO: 14896 - DNA, 71 bp, chicken (Gallus Gallus)
  misc_feature (36): n=a or g
agcttttgtgagctggtgaagatttataagatgttncatttgtgtacaagctcttgagcacgaagtatctg

SEQ ID NO: 14897 - DNA, 71 bp, chicken (Gallus Gallus)
  misc_feature (36): n=a or g
gtcacatccacagcttctccaaagggaaaagtttcngacagcacagaaagcacttcagcgttgaaacagat

SEQ ID NO: 14898 - DNA, 71 bp, chicken (Gallus Gallus)
  misc_feature (36): n=a or g
ttagcaagcagaggagcccatgaattctgtcaaggnacagaacttcttacacatttaactcctcctgtccc

SEQ ID NO: 14899 - DNA, 71 bp, chicken (Gallus Gallus)
  misc_feature (36): n=a or c
aaaaaaaaagaatgagtgacacaatagaattattanattggcaggagagcttattaaaaaatcaattcctt

SEQ ID NO: 14900 - DNA, 71 bp, chicken (Gallus Gallus)
  misc_feature (36): n=c or t
agctacgagcagttcctctacaacacctccatgctnatggactatggcgtggaggccctggcggagtcctt

SEQ ID NO: 14901 - DNA, 71 bp, chicken (Gallus Gallus)
  misc_feature (36): n=a or g
cattgcaataggaatgtcataattttaagaaaattnaatgttaagagactaagaagtaagagaaaaaaggt

SEQ ID NO: 14902 - DNA, 71 bp, chicken (Gallus Gallus)
  misc_feature (36): n=c or t
ggcactgcatcagggtcgaggtgcttcaaacactgnacaactggtgacataaactaacaaatgtgaggata

SEQ ID NO: 14903 - DNA, 71 bp, chicken (Gallus Gallus)
  misc_feature (36): n=a or g
agcagtttgctgtcagtctctaattagcgagttacnttacggctgtggtgggaatatgccttcacttcttt

SEQ ID NO: 14904 - DNA, 71 bp, chicken (Gallus Gallus)
  misc_feature (36): n=c or t
tgtgttctgctggcacgtggtgctgagggctacggntgggtttgtgggattacatgaactctgcgatgcct

SEQ ID NO: 14905 - DNA, 71 bp, chicken (Gallus Gallus)
  misc_feature (36): n=a or g
ctccacaccaaaggcatttttccatctcaccgtcgnatcaaaatggagggattcgttctccccaaaccgca

SEQ ID NO: 14906 - DNA, 71 bp, chicken (Gallus Gallus)
  misc_feature (36): n=c or t
gcggcacagaccggttgctcgctgtggatgggggtngctgttctttagcgataactttgcggatgcggtta

SEQ ID NO: 14907 - DNA, 71 bp, chicken (Gallus Gallus)
  misc_feature (36): n=c or t
ctgggtatgcacagctatacatgtgcacagctgtanatgagcacagctgtacatgcatgcaactgtaagaa

SEQ ID NO: 14908 - DNA, 71 bp, chicken (Gallus Gallus)
  misc_feature (36): n=c or t
tgcctgagtcactttatacctgcaggcacagttaanatgaaggcataaaagtaattaaaaacacagaatga

SEQ ID NO: 14909 - DNA, 71 bp, chicken (Gallus Gallus)
  misc_feature (36): n=c or t
cagcaggaccccgctcctccccaacgtgctctgcgngtttttagtcctttcaccgccccataatgaattca

SEQ ID NO: 14910 - DNA, 71 bp, chicken (Gallus Gallus)
  misc_feature (36): n=a or g
agtgctgctgtgggcttttccttacagatgcattcnctgctcaccccagagatgtgggctcccaccagctg

SEQ ID NO: 14911 - DNA, 71 bp, chicken (Gallus Gallus)
  misc_feature (36): n=a or g
tcattaataatgcgcatcacgttcaacccagcaatngtaccagcatcttttgtggcctgacgctgagcatc

SEQ ID NO: 14912 - DNA, 71 bp, chicken (Gallus Gallus)
  misc_feature (36): n=c or t
ttgctgaacttctgacgccatctttagcaaatcccngttctctgcccgtgtatccagaaggcgggcaggat

SEQ ID NO: 14913 - DNA, 71 bp, chicken (Gallus Gallus)
  misc_feature (36): n=c or t
cctgataagctcagcagagccacagccagcctgganacccgcagaagagcaacagtaatttcgtctataaa

SEQ ID NO: 14914 - DNA, 71 bp, chicken (Gallus Gallus)
  misc_feature (36): n=c or g
agactgaggaacagtctggatttggccaggaattantggtgtgggaacagctctgcttgggttgttgacat

SEQ ID NO: 14915 - DNA, 71 bp, chicken (Gallus Gallus)
  misc_feature (36): n=a or g
acagccctgccctgggccctggtgccccttgtgccntgctctgagccaccgtgaatgtatgacatctgctg

SEQ ID NO: 14916 - DNA, 71 bp, chicken (Gallus Gallus)
  misc_feature (36): n=a or g
gggagaaagctctcagaattataagagctgtaaccntagaacttttttcctactcagcccaatgtcccctt

SEQ ID NO: 14917 - DNA, 71 bp, chicken (Gallus Gallus)
  misc_feature (36): n=c or g
caccacagccaaaatctcacatccaaatactgattntttagtttataaaataaatatgtaaaaagaaaata

SEQ ID NO: 14918 - DNA, 71 bp, chicken (Gallus Gallus)
  misc_feature (36): n=c or t
atggataaccttgttacaaaagacctgtgactaccnggatagtctttctcacccatcatggaaactgggac

SEQ ID NO: 14919 - DNA, 71 bp, chicken (Gallus Gallus)
  misc_feature (36): n=a or c
atcaaaatctgaccaagatccttatctggggcaganaggaggccagcaatagcatatcatttctcactcaa

SEQ ID NO: 14920 - DNA, 71 bp, chicken (Gallus Gallus)
  misc_feature (36): n=c or t
cttttcatgtgaacctggaaaatgtcccagatgaanaaggcctttaccaatcgtcctctcagggcatactg

SEQ ID NO: 14921 - DNA, 71 bp, chicken (Gallus Gallus)
  misc_feature (36): n=a or g
tcccctcttcatgttccagggaggcctaggaaaaanaaaaaataaaaacaaaacaaaacaatacaaagtaa

SEQ ID NO: 14922 - DNA, 71 bp, chicken (Gallus Gallus)
  misc_feature (36): n=a or g
caccagcctgctacatgagtggcaataggtcttgcnctggcagatttttcagctgaactaaaaacaatctg

SEQ ID NO: 14923 - DNA, 71 bp, chicken (Gallus Gallus)
  misc_feature (36): n=c or t
ttcacaaaggattctttggggtgcaccacaaagacngatgacttggcatcaaaaggcttgttctgggcctc

SEQ ID NO: 14924 - DNA, 71 bp, chicken (Gallus Gallus)
  misc_feature (36): n=c or t
cccattcttcaagctatacttacagcctcctcagcntgtctcttgtaggatttcaccttcatctgcagttt

SEQ ID NO: 14925 - DNA, 71 bp, chicken (Gallus Gallus)
  misc_feature (36): n=a or g
ttcagtggcatgcttttccttctcaactttggccantgttaactccaggtcatctatatctttcttcagct

SEQ ID NO: 14926 - DNA, 71 bp, chicken (Gallus Gallus)
  misc_feature (36): n=a or g
tgcctgggctgcttggtatccagctgctggttgatncgaataaccatccacaagaacatcttctcatagac

SEQ ID NO: 14927 - DNA, 71 bp, chicken (Gallus Gallus)
  misc_feature (36): n=a or c
tgcacccacatgtttttcttttccacaggtggatgncctgaaggccaagctggcagcccaggaagtggagc

SEQ ID NO: 14928 - DNA, 71 bp, chicken (Gallus Gallus)
  misc_feature (36): n=a or g
actcagcacttggtgctgaatgagaactgctctgcngtgcacaatgcgcgcagctacaagatccaaagcca

SEQ ID NO: 14929 - DNA, 71 bp, chicken (Gallus Gallus)
  misc_feature (36): n=a or g
caggtgttataccagctgctagaagtcagaagtcanggtctctcaccaccatcctgcagttgccaggtctt

SEQ ID NO: 14930 - DNA, 71 bp, chicken (Gallus Gallus)
  misc_feature (36): n=c or t
caaggcttttgcaactgctgttggacctctcaactnccttgcccctgcattagtgcagtggagcagctgca

SEQ ID NO: 14931 - DNA, 71 bp, chicken (Gallus Gallus)
  misc_feature (36): n=a or c
caggaagtatcaaacaagaaacttaaaaagcttaanacagtaaactgaaggaaaagaggtagagaacgctc

SEQ ID NO: 14932 - DNA, 71 bp, chicken (Gallus Gallus)
  misc_feature (36): n=c or t
tctttcttcagctctgaacattcatcctccagtttnctcttcttggctgtcagttcagcattaatttcctc

SEQ ID NO: 14933 - DNA, 71 bp, chicken (Gallus Gallus)
  misc_feature (36): n=c or g
agccccaacctctgtggaagggtagcagcatttcanactttatgataagccctttggacgtgatgatttca

SEQ ID NO: 14934 - DNA, 71 bp, chicken (Gallus Gallus)
  misc_feature (36): n=c or g
tggagggctttcttctcttttgtcagcttcacaatngtctcatccagggctgccatctcctctgtgaggtt

SEQ ID NO: 14935 - DNA, 71 bp, chicken (Gallus Gallus)
  misc_feature (36): n=a or g
ctgcgcagcaaagcttggatgagagcaaggaaaaangaagcccaaagaaaacaggtgaaaacaatggaact

SEQ ID NO: 14936 - DNA, 71 bp, chicken (Gallus Gallus)
  misc_feature (36): n=a or t
tgatggctcacacaccccttaggttataagatgatnaaagtcaagactgaaaatccagtctaagacgactg

SEQ ID NO: 14937 - DNA, 71 bp, chicken (Gallus Gallus)
  misc_feature (36): n=a or g
catgccaaacctgtgacagacattcagacctcaccntggctttttcagcttctcatgcacaacagcaacag

SEQ ID NO: 14938 - DNA, 71 bp, chicken (Gallus Gallus)
  misc_feature (36): n=a or c
gtgaaggaaaggggtgaaaactcttgtgttcctccnagctgtcctttaaatcagcgtatggttctcccaca

SEQ ID NO: 14939 - DNA, 71 bp, chicken (Gallus Gallus)
  misc_feature (36): n=a or g
tgtggttgagatagaaaccacgtgatacggagcagntgctgctctgcacacccttttgcagagctggggga

SEQ ID NO: 14940 - DNA, 71 bp, chicken (Gallus Gallus)
  misc_feature (36): n=c or t
ttgaaaattttctaaatgttctcctgcctagaactnccatttctgcccatgtagtgcacagtggagcctgt

SEQ ID NO: 14941 - DNA, 71 bp, chicken (Gallus Gallus)
  misc_feature (36): n=a or g
ccagctctgctgctggagacaaagccgagccatgcngtgtgtcatcagctttgctgaacagagatttccgc

SEQ ID NO: 14942 - DNA, 71 bp, chicken (Gallus Gallus)
  misc_feature (36): n=a or g
gtctaacaaagtgcattattttaggtgaagatgatngagaaaagtccacacaggtgccctctgtggtgctt

SEQ ID NO: 14943 - DNA, 71 bp, chicken (Gallus Gallus)
  misc_feature (36): n=c or g
gtttttgctgtgttatgagaaaggaccgaacctctncttcccaaagacaagccacacacacagggattcag

SEQ ID NO: 14944 - DNA, 71 bp, chicken (Gallus Gallus)
  misc_feature (36): n=c or t
aatcctggacagtgatcattagttacttgagtgagncccactggctgcctggctcctgcacaaacactgca

SEQ ID NO: 14945 - DNA, 71 bp, chicken (Gallus Gallus)
  misc_feature (36): n=a or g
gaagaaaggaaaaaaagggtcctacaccaattctancactctctaaaccaattctaaactgaaaaacttgc

SEQ ID NO: 14946 - DNA, 71 bp, chicken (Gallus Gallus)
  misc_feature (36): n=c or g
cagcagatattttctaggcttgattcccaaattcancagtttcagtcagacaacctcctcccctgctgtgt

SEQ ID NO: 14947 - DNA, 71 bp, chicken (Gallus Gallus)
  misc_feature (36): n=c or t
ttctttccataccccgaatctggggtgcgaggtganacttgggtgcacacaaacttatgctacaccccagt

SEQ ID NO: 14948 - DNA, 71 bp, chicken (Gallus Gallus)
  misc_feature (36): n=c or t
acactaattctgagagaggttcagtctgcaagctcngagaacagattgttagcaagtttagagccaactcc

SEQ ID NO: 14949 - DNA, 71 bp, chicken (Gallus Gallus)
  misc_feature (36): n=a or t
ttacatacagaatgacctgtgactgagattcttgcntctaaaggttttaacatagtgcagaatttcacagg

SEQ ID NO: 14950 - DNA, 71 bp, chicken (Gallus Gallus)
  misc_feature (36): n=c or g
catgacttgcacaataagcagctttacattttaaantggatgagtactgataccgaggcaaaaaaaaaaag

SEQ ID NO: 14951 - DNA, 71 bp, chicken (Gallus Gallus)
  misc_feature (36): n=c or t
catgggaagaaacattaatacattcagttagaaaangctggagcaggatcctgatgagagactttaaatac

SEQ ID NO: 14952 - DNA, 71 bp, chicken (Gallus Gallus)
  misc_feature (36): n=a or g
agaaataggagtagcaagagtatttaaatacatctncagagagtttcgttctgatttaaaagttaagactc

SEQ ID NO: 14953 - DNA, 71 bp, chicken (Gallus Gallus)
  misc_feature (36): n=a or g
taccgcctcctacctccagtaggtagcctacattcnacggatgaaaggaatgtctcagagcatgtcgcaac

SEQ ID NO: 14954 - DNA, 71 bp, chicken (Gallus Gallus)
  misc_feature (36): n=a or g
ttcttttgagccttcttttgatccagccttgttccnagactggaactcagaggatgatgactcccaacagg

SEQ ID NO: 14955 - DNA, 71 bp, chicken (Gallus Gallus)
  misc_feature (36): n=a or g
caacattgtgccaagaaaagtatgttaaaaggaccnttagtttggcatgcttgatggtagttgcattgtgc

SEQ ID NO: 14956 - DNA, 71 bp, chicken (Gallus Gallus)
  misc_feature (36): n=a or g
tacaactacaatgaccctgcagagcaagcaagaaangtgaccgacaaagcttgaatgactcttcgtccaaa

SEQ ID NO: 14957 - DNA, 71 bp, chicken (Gallus Gallus)
  misc_feature (36): n=c or t
gtgttgggagtgaatactcttcccttcaagataggngttgttttgaaaccaaaccaaaagcacactaacaa

SEQ ID NO: 14958 - DNA, 71 bp, chicken (Gallus Gallus)
  misc_feature (36): n=g or t
gtggacagtctcaccttcctagaaaggcaactctgnatgatactggttaggaattaatagaaagcacatca

SEQ ID NO: 14959 - DNA, 71 bp, chicken (Gallus Gallus)
  misc_feature (36): n=a or g
aggactcagcagtacagtatgggcagcaaatactcntttacagagttgcaacctgccttaaaagactcctt

SEQ ID NO: 14960 - DNA, 71 bp, chicken (Gallus Gallus)
  misc_feature (36): n=c or t
acagttgggatgaggtgagagtaactgaaattaaangtggaggggctttaccaaggaaatcatcagcctgc

SEQ ID NO: 14961 - DNA, 71 bp, chicken (Gallus Gallus)
  misc_feature (36): n=c or t
gccccatccctcagccccgcaggctgcagcagcgcntcgtctggattcagttcttctttctcggtgcaaaa

SEQ ID NO: 14962 - DNA, 71 bp, chicken (Gallus Gallus)
  misc_feature (36): n=a or g
tacccatccttcttgtaaaactccagcatcatgttntctgtggccacgctgagtggccgccgcgcctggtc

SEQ ID NO: 14963 - DNA, 71 bp, chicken (Gallus Gallus)
  misc_feature (36): n=c or t
tcctgctgtttaggccaaccagctgctgtcttcccnatgaggctcaaacctctcaagacacacggggggag

SEQ ID NO: 14964 - DNA, 71 bp, chicken (Gallus Gallus)
  misc_feature (36): n=c or t
tgctgatgttctgctttgtaaagcacctgcacaagnttggcctgaaagaggctgcacttttgctgggccga

SEQ ID NO: 14965 - DNA, 71 bp, chicken (Gallus Gallus)
  misc_feature (36): n=a or g
ttctattgtaataaagcatcagatggagtttttccntaagaaatgatgtcacaacagtttaaccaacagaa

SEQ ID NO: 14966 - DNA, 71 bp, chicken (Gallus Gallus)
  misc_feature (36): n=c or t
cattcaggcactgagatgtggtgatttaggcagctntgtagtgctcagcatcctctcatggatgcctcagc

SEQ ID NO: 14967 - DNA, 71 bp, chicken (Gallus Gallus)
  misc_feature (36): n=c or t
aagtcacaaaggtgtcactttgccaaacacagctcngctgtacaaaccagggatgaatttcccctcggctc

SEQ ID NO: 14968 - DNA, 71 bp, chicken (Gallus Gallus)
  misc_feature (36): n=a or g
gtgccagggctggcggaggcacttccaaaaggttcnaagggtttcagagcaagggattgccgaaagtgcct

SEQ ID NO: 14969 - DNA, 71 bp, chicken (Gallus Gallus)
  misc_feature (36): n=c or t
cccattgctgttccttgcactgacagtaatggagtnctaacaccatcggtcttttagcaacagagcaaaaa

SEQ ID NO: 14970 - DNA, 71 bp, chicken (Gallus Gallus)
  misc_feature (36): n=c or t
tgctttgggcttcttccatgcgtactccactccatncatggctctgcaggtggatcagtgctgcagttcct

SEQ ID NO: 14971 - DNA, 71 bp, chicken (Gallus Gallus)
  misc_feature (36): n=a or g
ctggctggagccccactggcccagtgctggagcgcnatgtctgtcctctgtctgtgcgtcagagatgtgtc

SEQ ID NO: 14972 - DNA, 71 bp, chicken (Gallus Gallus)
  misc_feature (36): n=a or g
ggagaacaggtgctcccattttgtgtgcacctgtcngcagagagcctgcagcctagaaggggttaggagtt

SEQ ID NO: 14973 - DNA, 71 bp, chicken (Gallus Gallus)
  misc_feature (36): n=a or g
acctccacttgctctgaagcacaagatgggaggagntcagagtcaccccaaggggcttggagcgagcgtgg

SEQ ID NO: 14974 - DNA, 71 bp, chicken (Gallus Gallus)
  misc_feature (36): n=c or g
ctctcccaccatctgcaccatcccagaaacgtttgnaggaggaaaacacctttgggtttctaataacctcc

SEQ ID NO: 14975 - DNA, 71 bp, chicken (Gallus Gallus)
  misc_feature (36): n=a or g
caaaatgaattactatctgcaattgggaaggagggngccgatgcagcctacagcatccacttgacggatcg

SEQ ID NO: 14976 - DNA, 71 bp, chicken (Gallus Gallus)
  misc_feature (36): n=c or t
ggggttgcagcagggtccgtcccgaccctgcctgcngatgctgagcaagcttgaaaatatggccccggccg

SEQ ID NO: 14977 - DNA, 71 bp, chicken (Gallus Gallus)
  misc_feature (36): n=c or g
actacaaaaccacaaacagcatccaatccgttcccngtgttctcactgctgtgattgcctttgatactccg

SEQ ID NO: 14978 - DNA, 71 bp, chicken (Gallus Gallus)
  misc_feature (36): n=g or t
cacatccgggtgagctctaacagtctatttctcacngagcagctatatcccactcttagagaaacctcttc

SEQ ID NO: 14979 - DNA, 71 bp, chicken (Gallus Gallus)
  misc_feature (36): n=a or t
tttgaaacaatccctgctacaaagagttacacacanactaaacaagtgggaaatcaaaccctgaggaggtt

SEQ ID NO: 14980 - DNA, 71 bp, chicken (Gallus Gallus)
  misc_feature (36): n=g or t
cgccaagtcagaagtgaaataaattctcaccctgtngtcacaacagaactattttgttaagatcagcccaa

SEQ ID NO: 14981 - DNA, 71 bp, chicken (Gallus Gallus)
  misc_feature (36): n=c or t
cgcccaactgtcacagaagcgacgtgctggacgtancagcagctcagacctcttcatattgataaaatcac

SEQ ID NO: 14982 - DNA, 71 bp, chicken (Gallus Gallus)
  misc_feature (36): n=a or g
ttgagaacactttgagacccaccaagaggattcagnaaggccaccgagccccgcagctacaagcaatccca

SEQ ID NO: 14983 - DNA, 71 bp, chicken (Gallus Gallus)
  misc_feature (36): n=a or t
ttccagatatgtttctctgatattaactcatgaggnaggagtaagaaacaacacatcacgtattgattcgg

SEQ ID NO: 14984 - DNA, 71 bp, chicken (Gallus Gallus)
  misc_feature (36): n=a or g
accacaagcacagtgtggactggaggtctgagtcantaacatgggatgtttgggtgccaggaggagctaaa

SEQ ID NO: 14985 - DNA, 71 bp, chicken (Gallus Gallus)
  misc_feature (36): n=a or t
acaactacattattgcaacaaggttcctatgagcancatctctgactttgctgagtttgcagatcatcccc

SEQ ID NO: 14986 - DNA, 71 bp, chicken (Gallus Gallus)
  misc_feature (36): n=a or g
agtcagacataaccaaacaagcaatggaaagcgagnagtggaagcacagctcaattggagtgcatttattt

SEQ ID NO: 14987 - DNA, 71 bp, chicken (Gallus Gallus)
  misc_feature (36): n=a or g
cttgaattttatacttgtatatatttgtgccccagnggtatgcttcataaaggtcatttggaacaataaaa

SEQ ID NO: 14988 - DNA, 71 bp, chicken (Gallus Gallus)
  misc_feature (36): n=g or t
ctattttctaattccaacctagtcactacaagacancaccagtctttgttgtaggtaatggatgtttcatt

SEQ ID NO: 14989 - DNA, 71 bp, chicken (Gallus Gallus)
  misc_feature (36): n=c or t
acaggggatttccaatgcagaaatgttggaagtatnggcagcaaagcatctacccaaacccagaaactcac

SEQ ID NO: 14990 - DNA, 71 bp, chicken (Gallus Gallus)
  misc_feature (36): n=c or g
gctgtaagaatacacttgtcatgaaatggaattatnataagaaatttggttaaatggcagtcaaatcaagc

SEQ ID NO: 14991 - DNA, 71 bp, chicken (Gallus Gallus)
  misc_feature (36): n=c or t
gagatgtctccctttgttctccatcccgtttcgttnttaacgttctatgctaatttctacggaattactac

SEQ ID NO: 14992 - DNA, 71 bp, chicken (Gallus Gallus)
  misc_feature (36): n=c or t
cacaatggtgacactgacaggatataatctgagagngctgaagtcatttaactgacaactcgtatcaccag

SEQ ID NO: 14993 - DNA, 71 bp, chicken (Gallus Gallus)
  misc_feature (36): n=c or t
tcagtttgcgttagtgtgacaatccccctaagtccngcagttcttagcacatcagctcagaggccttattc

SEQ ID NO: 14994 - DNA, 71 bp, chicken (Gallus Gallus)
  misc_feature (36): n=c or t
atggatccatgaactaaagaacactgcctgaatacngtcctgaaaagcagacagaaaggtgacacatttat

SEQ ID NO: 14995 - DNA, 71 bp, chicken (Gallus Gallus)
  misc_feature (36): n=c or t
aaagctagaagtttaaaatgaacctgtattacaaangccatgaaagggaacatgaagtcctcccagctctg

SEQ ID NO: 14996 - DNA, 71 bp, chicken (Gallus Gallus)
  misc_feature (36): n=a or g
ttgatgggagtgtgtgttacagcagaattgcaggangactcagcctgcctggtccgagaagagccctgtcc

SEQ ID NO: 14997 - DNA, 71 bp, chicken (Gallus Gallus)
  misc_feature (36): n=c or t
acattgcaatattggttttctggaaggtccctgcangtcctttcaagtttcttcatctctgttctacgaac

SEQ ID NO: 14998 - DNA, 71 bp, chicken (Gallus Gallus)
  misc_feature (36): n=c or t
gccttacctatctcagaatggcctgaatcaccttcnataggtgcctgcctccctgtgctgcccacagagag

SEQ ID NO: 14999 - DNA, 71 bp, chicken (Gallus Gallus)
  misc_feature (36): n=a or g
cctttggatatttcctcccttggcgccttattctcntctcccttcacttctgttggaacatttcctccccg

SEQ ID NO: 15000 - DNA, 71 bp, chicken (Gallus Gallus)
  misc_feature (36): n=c or g
ctctgctcctgaccgtggacagacgcatcccaccantttgtacccagcatctggccaggagaaacctccct

SEQ ID NO: 15001 - DNA, 71 bp, chicken (Gallus Gallus)
  misc_feature (36): n=a or g
tttctgtgacacagagaatcgtagaatagaatcatngaatcattagtgttggaaaagacctgtaagatccc

SEQ ID NO: 15002 - DNA, 71 bp, chicken (Gallus Gallus)
  misc_feature (36): n=a or g
agtggggaggggaaaagaagtcctgcactacaacantgttcagggattgcctcggtgtgcacccgtttctc

SEQ ID NO: 15003 - DNA, 71 bp, chicken (Gallus Gallus)
  misc_feature (36): n=a or g
cagtgagcagtcctaactgtgctttgtgaagcctcnttggtgtgccgttcctgctttggcactaatgcatt

SEQ ID NO: 15004 - DNA, 71 bp, chicken (Gallus Gallus)
  misc_feature (36): n=a or g
tcagggtgcagtggggttgttggtaaggatcattgnaagcatatagattcttgatgttccaagctacaatt

SEQ ID NO: 15005 - DNA, 71 bp, chicken (Gallus Gallus)
  misc_feature (36): n=a or g
tatgttgggactgcaattacatccaaatcttgaagnaacttttagcagggttgcataaggctgacaatgca

SEQ ID NO: 15006 - DNA, 71 bp, chicken (Gallus Gallus)
  misc_feature (36): n=a or g
tctttgagaaaagtgttaatggaaagaaaatggagngtcttagcctggagaaaatgaaataagaaacgtgt

SEQ ID NO: 15007 - DNA, 71 bp, chicken (Gallus Gallus)
  misc_feature (36): n=c or t
atcatatgagtgttaccaaggcacaggaggccgacntgagctgtgtgcatcataaatgaacccggttcggg

SEQ ID NO: 15008 - DNA, 71 bp, chicken (Gallus Gallus)
  misc_feature (36): n=a or g
gggctcaaagagaaacgggaaaacccaccgctttcngaaagaaagccaaaaggagctcacagcaaacagac

SEQ ID NO: 15009 - DNA, 71 bp, chicken (Gallus Gallus)
  misc_feature (36): n=c or t
gcattcctaatttaaactgaatgttttcttgtgtanctctcatatgaaatcctgttaaatactttaacgga

SEQ ID NO: 15010 - DNA, 71 bp, chicken (Gallus Gallus)
  misc_feature (36): n=g or t
catagctcctatcaagtggactttggcaaggagcantcaaagacatacagtgtaaagctaggctagtgctc

SEQ ID NO: 15011 - DNA, 71 bp, chicken (Gallus Gallus)
  misc_feature (36): n=c or t
tgcacagagcaggacatggacgacggacgtcactcncctcccatggtcaaaaatgcaactgtgcatcctgg

SEQ ID NO: 15012 - DNA, 71 bp, chicken (Gallus Gallus)
  misc_feature (36): n=c or t
aggctctgggtgagaagtggtcattgcttcacccangcccgtgctcttaactttgtgtcacttgatcaggt

SEQ ID NO: 15013 - DNA, 71 bp, chicken (Gallus Gallus)
  misc_feature (36): n=a or g
acgtaattacaatatttgcttgaatgctttacttcntgtctgattcctgtcatgtagtctctgcttggacc

SEQ ID NO: 15014 - DNA, 71 bp, chicken (Gallus Gallus)
  misc_feature (36): n=a or g
cacaaatatcggagtgttccatgggctggtggacancttcaggtgaccttgggcatattgttcttgcacca

SEQ ID NO: 15015 - DNA, 71 bp, chicken (Gallus Gallus)
  misc_feature (36): n=g or t
ttggatgaaagtcaatgctttcccaagctgccttgnacagctcggagcccaacccctgcattggtgcaggt

SEQ ID NO: 15016 - DNA, 71 bp, chicken (Gallus Gallus)
  misc_feature (36): n=c or t
gggttgctgagttgtgttttttagtaggtagtgcantggtatggccagcaggtggaagtgcagcttagagt

SEQ ID NO: 15017 - DNA, 71 bp, chicken (Gallus Gallus)
  misc_feature (36): n=g or t
ccacagatttggagctttcatgggagcagagagttngcctggcctccagtttttggatgggaatggacatg

SEQ ID NO: 15018 - DNA, 71 bp, chicken (Gallus Gallus)
  misc_feature (36): n=a or g
ccagtataccagctggtaatttctatgaagcttgcnggataaatactgacttttctaaaagatgcgtggca

SEQ ID NO: 15019 - DNA, 71 bp, chicken (Gallus Gallus)
  misc_feature (36): n=c or t
ccacctcatttttgtgtcacctgggttatgtgtcanctctcatatctcacctgggctttctcctttatctt

SEQ ID NO: 15020 - DNA, 71 bp, chicken (Gallus Gallus)
  misc_feature (36): n=a or g
aagaagctgtctctgatttgctttattttttaaacnttgacttacgacttgcacagtgctgtttgaattaa

SEQ ID NO: 15021 - DNA, 71 bp, chicken (Gallus Gallus)
  misc_feature (36): n=a or g
ataataattagtttcccatgctgcctacttttcccnatatggtacagcatacagagatacaagtgctgaca

SEQ ID NO: 15022 - DNA, 71 bp, chicken (Gallus Gallus)
  misc_feature (36): n=c or t
gtggtggatttgggaatgagattggctttgcaggtnggcagagcaaggcctggctgtaaacatcatttcat

SEQ ID NO: 15023 - DNA, 71 bp, chicken (Gallus Gallus)
  misc_feature (36): n=c or t
tcaaccaagtcaaacatgggtcatccagagcctgcntctgggcttgctgcattagccaaggtaacacatgg

SEQ ID NO: 15024 - DNA, 71 bp, chicken (Gallus Gallus)
  misc_feature (36): n=a or g
aattcagacttctcagaactccttccttagcaatcnaactatttgttggacagtgaagcccagagagggga

SEQ ID NO: 15025 - DNA, 71 bp, chicken (Gallus Gallus)
  misc_feature (36): n=c or t
ggtgtggaggtgcgccagacgctggagagagactangacatcgtaatgaccatgagggagatccgactcct

SEQ ID NO: 15026 - DNA, 71 bp, chicken (Gallus Gallus)
  misc_feature (36): n=a or g
aacagtaatttccttggtccattcagacagtaacanacagggaagatgaacacagagagctatgaagaaca

SEQ ID NO: 15027 - DNA, 71 bp, chicken (Gallus Gallus)
  misc_feature (36): n=a or g
gagcctgcagttcagaggcaacgtgtgggaagctgnttgtctgacagctttggtatctctcagtcactaac

SEQ ID NO: 15028 - DNA, 71 bp, chicken (Gallus Gallus)
  misc_feature (36): n=c or t
acaactccaggtagcatagctcccttggaaaccttngggcaaggaaagttagctccaaatcaaaacctatc

SEQ ID NO: 15029 - DNA, 71 bp, chicken (Gallus Gallus)
  misc_feature (36): n=a or g
ccctgataccatttgtcataagcagtctcccatgcntcaaaacattgcagcaactccaggtttgttaaaat

SEQ ID NO: 15030 - DNA, 71 bp, chicken (Gallus Gallus)
  misc_feature (36): n=a or g
ttcgatgtaagtattggaggagagagagaaaatggnttctgggtttttctctgcagataacttacagcaat

SEQ ID NO: 15031 - DNA, 71 bp, chicken (Gallus Gallus)
  misc_feature (36): n=c or t
cagacccgccgggatcttctaaagcttggtttgggngcttgttttgaagcgcgtctgtgcttctctcagta

SEQ ID NO: 15032 - DNA, 71 bp, chicken (Gallus Gallus)
  misc_feature (36): n=c or t
taatttgaactcctcagtggtgctgggttcaccacncttgtagcagttgggagtaatcttcctgaagacac

SEQ ID NO: 15033 - DNA, 71 bp, chicken (Gallus Gallus)
  misc_feature (36): n=a or c
taacttaagcacttgctaagccactcacacaaatgncaagtgatttatctgctacttccttgtacctgtag

SEQ ID NO: 15034 - DNA, 71 bp, chicken (Gallus Gallus)
  misc_feature (36): n=a or g
tgatacacaaatgtcacaactgactacatcagaagnaagatgggaaacactgcctgtcccagtgaggatgg

SEQ ID NO: 15035 - DNA, 71 bp, chicken (Gallus Gallus)
  misc_feature (36): n=a or g
tttactactcccccgtttttagtttttttaaacacnaaacaccttgctgtgttattgacccccagagatgc

SEQ ID NO: 15036 - DNA, 71 bp, chicken (Gallus Gallus)
  misc_feature (36): n=c or t
aagggaaagtagactaaatatctgactttgcaaagntttgtatctttttccttgctgtgtttcttcaaaac

SEQ ID NO: 15037 - DNA, 71 bp, chicken (Gallus Gallus)
  misc_feature (36): n=a or g
gtttgacccctgcagtgtgcctccttgtgaagtgcntgaaactgtttcccttgcaattagggaaagacact

SEQ ID NO: 15038 - DNA, 71 bp, chicken (Gallus Gallus)
  misc_feature (36): n=a or g
aatcacaccggagtgaaagaccacgtgtggggcccngagggagcaacgttttgcatataactgcatatggg

SEQ ID NO: 15039 - DNA, 71 bp, chicken (Gallus Gallus)
  misc_feature (36): n=c or g
tgcgaatgcccggaataaggctgaattctgttgggntattcaggtagaagttagcaggctgtcatttctgt

SEQ ID NO: 15040 - DNA, 71 bp, chicken (Gallus Gallus)
  misc_feature (36): n=a or g
taaataaaatataattctcactttacagacaggaanatctgagaagctgcagctttctaggataatgctgg

SEQ ID NO: 15041 - DNA, 71 bp, chicken (Gallus Gallus)
  misc_feature (36): n=c or g
cccttaaatgctatgtctgcatatttcttacatacntccaagagtcacagctcctcctcttccttggacag

SEQ ID NO: 15042 - DNA, 71 bp, chicken (Gallus Gallus)
  misc_feature (36): n=a or c
agttaacacggcattcacagtgccctggtgtttggnactgtcctgctgtatgtgatggatgatttttgtcc

SEQ ID NO: 15043 - DNA, 71 bp, chicken (Gallus Gallus)
  misc_feature (36): n=a or g
agtctacttagaatgtataacccagatgccaaatantatgcagagctagtgagagctacgcatctgaaggg

SEQ ID NO: 15044 - DNA, 71 bp, chicken (Gallus Gallus)
  misc_feature (36): n=c or t
cacggaggtttaggctgtggtttttgtttttttttnctaaggagataaatttccttttctatttactagaa

SEQ ID NO: 15045 - DNA, 71 bp, chicken (Gallus Gallus)
  misc_feature (36): n=g or t
agaaacagcttcactcaacctgctttgattttcagngcaactctgaggtaacattcatgtaaatggctgta

SEQ ID NO: 15046 - DNA, 71 bp, chicken (Gallus Gallus)
  misc_feature (36): n=c or t
attatatatacagtaatgatactgagcagcatggtnaaaaatgaactctgtgtatggatggctgtgagtca

SEQ ID NO: 15047 - DNA, 71 bp, chicken (Gallus Gallus)
  misc_feature (36): n=a or g
gagcagcagcagagatattgggttcattctttgacntctgaaaataaaaaccagggtacggagaaatgtaa

SEQ ID NO: 15048 - DNA, 71 bp, chicken (Gallus Gallus)
  misc_feature (36): n=c or g
tgtcatttctaggggagatttcactgttactttcantgtgagacataattcctaggagttttacatgcctc

SEQ ID NO: 15049 - DNA, 71 bp, chicken (Gallus Gallus)
  misc_feature (36): n=c or t
atttttttccgcgtcataataattatatttcagcangctgccccatcaggcttttcaatcccaaccgcagc

SEQ ID NO: 15050 - DNA, 71 bp, chicken (Gallus Gallus)
  misc_feature (36): n=a or g
gccttcagccaacacacatttgcttttcattttacnttgcagtactgtcgaggtattttaggaagtggggg

SEQ ID NO: 15051 - DNA, 71 bp, chicken (Gallus Gallus)
  misc_feature (36): n=c or g
ctcgcactcagagcagcctcacaccatttgctttcncgtgctctgcagcattgcagggccatgcactcctc

SEQ ID NO: 15052 - DNA, 71 bp, chicken (Gallus Gallus)
  misc_feature (36): n=a or g
acatgctgtgtaccagtaaaactcttgttcagtggntacagttacggttttcacagagaaaatctattcag

SEQ ID NO: 15053 - DNA, 71 bp, chicken (Gallus Gallus)
  misc_feature (36): n=a or t
actttcgttcagagggtaaatactcagtcaaaaaantaatgatagagaatagaataccaagtttctcatgc

SEQ ID NO: 15054 - DNA, 71 bp, chicken (Gallus Gallus)
  misc_feature (36): n=c or t
tgggaaggggtgcagttgtcccaaatgtctttccancattattcttcctttaaaatcctggtctcctgggg

SEQ ID NO: 15055 - DNA, 71 bp, chicken (Gallus Gallus)
  misc_feature (36): n=c or g
gaagtggtggatggtgattttggctcctattagtgnttggtacaattattgtgttggaatccttcacaatt

SEQ ID NO: 15056 - DNA, 71 bp, chicken (Gallus Gallus)
  misc_feature (36): n=a or g
ttcttggggctggcatgcgtttaggtgttagaggtngaaaggctcctccaatccaacactgcacagtgaaa

SEQ ID NO: 15057 - DNA, 71 bp, chicken (Gallus Gallus)
  misc_feature (36): n=a or g
gggcttctttagaatggaaatgttaattaaattgcngagcggtggccacagcgggtcaaactcatcgctga

SEQ ID NO: 15058 - DNA, 71 bp, chicken (Gallus Gallus)
  misc_feature (36): n=c or t
ggtctatgacactttaatttagtgccctgctgtatnccaggctgcaagccaaaatatatccaggtaataag

SEQ ID NO: 15059 - DNA, 71 bp, chicken (Gallus Gallus)
  misc_feature (36): n=c or t
caaaaagctttcataacgtgcagttatatgtatagnatgtattatccccgctgcatgtacctactgtacag

SEQ ID NO: 15060 - DNA, 71 bp, chicken (Gallus Gallus)
  misc_feature (36): n=a or g
cagagcctatctgtaaatgtgaacagagacccagtntaggtactgggccagaatcctatcttcagagatac

SEQ ID NO: 15061 - DNA, 71 bp, chicken (Gallus Gallus)
  misc_feature (36): n=g or t
ctctgggccaggcctgggtttattttggcataaagnagtgagaatggggtctgaggtctggtggctgagca

SEQ ID NO: 15062 - DNA, 71 bp, chicken (Gallus Gallus)
  misc_feature (36): n=a or g
taaacaatttacccaatttgttgtaggaagccttcngcccttttcctttcaaagggaaaacaaaacagatg

SEQ ID NO: 15063 - DNA, 71 bp, chicken (Gallus Gallus)
  misc_feature (36): n=a or g
attaaagaatctaaatccatagacgtgttcttgganggtcagctgcttacagccatctttcaggaaggctg

SEQ ID NO: 15064 - DNA, 71 bp, chicken (Gallus Gallus)
  misc_feature (36): n=a or g
aagctttctgcacattttattctaaaaataaggccnatatttatctctgcatgctagagttgcaggcaata

SEQ ID NO: 15065 - DNA, 71 bp, chicken (Gallus Gallus)
  misc_feature (36): n=c or t
ttctaggatcagtatccactcacatcttctagcatntgccaaagatgtacaaccaacggcgtgggccagga

SEQ ID NO: 15066 - DNA, 71 bp, chicken (Gallus Gallus)
  misc_feature (36): n=a or t
gaaacttcttttcaggatgtttcagtttagaaatgnataattgacttcttttaccagcttttaagctaaag

SEQ ID NO: 15067 - DNA, 71 bp, chicken (Gallus Gallus)
  misc_feature (36): n=a or g
aaaagtgtctacctgaagtatacccttcagacctgnaatttctattcagatcttctcccatagacactttg

SEQ ID NO: 15068 - DNA, 71 bp, chicken (Gallus Gallus)
  misc_feature (36): n=a or g
tgggcgcagcagcttccagtgccatttctgccttgnaaaagcaaagcgagtcctgcccaaccttcaggcca

SEQ ID NO: 15069 - DNA, 71 bp, chicken (Gallus Gallus)
  misc_feature (36): n=a or g
caggcgctctgactcctggaacattgggtggcagcnaggagagcctctgcaggcagaaaatccatcttgtg

SEQ ID NO: 15070 - DNA, 71 bp, chicken (Gallus Gallus)
  misc_feature (36): n=c or t
gtgggaatgtcagctctgagcactaacatgcaggangccctggggctggaaaattcccatttctttctggc

SEQ ID NO: 15071 - DNA, 71 bp, chicken (Gallus Gallus)
  misc_feature (36): n=c or g
aacccctttctttctcgttctggttttgggtcatanatgtgcaccgaaaacaaatgactcagaagtatctc

SEQ ID NO: 15072 - DNA, 71 bp, chicken (Gallus Gallus)
  misc_feature (36): n=a or g
tcccccagctctgggtcaacagaccatgcccttcantttgtccccattcagcaaagcaagcagtaaggttg

SEQ ID NO: 15073 - DNA, 71 bp, chicken (Gallus Gallus)
  misc_feature (36): n=c or t
gtagcagttcctctccagacatctgatttcaatccntagctgcatgccagcagaataccctcatgccaatc

SEQ ID NO: 15074 - DNA, 71 bp, chicken (Gallus Gallus)
  misc_feature (36): n=c or g
gctagaacacaaaagcagaggaagttgtacagcagncacttacttctgctgagaagtatttttcaatcagg

SEQ ID NO: 15075 - DNA, 71 bp, chicken (Gallus Gallus)
  misc_feature (36): n=c or t
caggcctattttctagcagggcagccttgcctcccnctagcaatgactaaactggatttaagcagcataca

SEQ ID NO: 15076 - DNA, 71 bp, chicken (Gallus Gallus)
  misc_feature (36): n=c or t
atacagacaaaataccgtgagctcaccttcagtatntcaggttctttgatgtctagagctcctgtattcca

SEQ ID NO: 15077 - DNA, 71 bp, chicken (Gallus Gallus)
  misc_feature (36): n=c or t
ataaaatatttgtacaaggaggaataatctgcaacntgataaatcatattgtaatgttccagtacaagtat

SEQ ID NO: 15078 - DNA, 71 bp, chicken (Gallus Gallus)
  misc_feature (36): n=a or g
ttcctcataggttaatatatgatgttttcttaatgngccagttctccagcaatacttcttatcatcctaaa

SEQ ID NO: 15079 - DNA, 71 bp, chicken (Gallus Gallus)
  misc_feature (36): n=c or t
tttaaaagaaactgaatctacccacataagcaaagnttacaaaataacctattcaaaaaaagtatttattc

SEQ ID NO: 15080 - DNA, 71 bp, chicken (Gallus Gallus)
  misc_feature (36): n=g or t
gcagaggcactgcagcagggcagggcgcagctcctncaattcagcaatgcagcacaaagcccacaaatgtt

SEQ ID NO: 15081 - DNA, 71 bp, chicken (Gallus Gallus)
  misc_feature (36): n=c or g
tttcagaaaagtagatctccatcaatctgggagctntctgaaactctcctaaaccacgtacagcatgaggg

SEQ ID NO: 15082 - DNA, 71 bp, chicken (Gallus Gallus)
  misc_feature (36): n=a or g
cagaaagcatgcacagagcaaacaaaacataggctntaaatacaaattcttaagcggatcctgagtgataa

SEQ ID NO: 15083 - DNA, 71 bp, chicken (Gallus Gallus)
  misc_feature (36): n=c or t
gttgtgcctgaagtttgaggctcacctttgcttgcnccttgcattgcataccctcagggcaggagaacagt

SEQ ID NO: 15084 - DNA, 71 bp, chicken (Gallus Gallus)
  misc_feature (36): n=a or g
tgaagcacatgagattctctcttctctgcagtaagncacagaagtaagctacacagagagcaacctacctt

SEQ ID NO: 15085 - DNA, 71 bp, chicken (Gallus Gallus)
  misc_feature (36): n=a or t
ccttctttttgttggtcccaggatgaatgcagctcnctcctcacgtgtcagatctgccctcctaggacgtt

SEQ ID NO: 15086 - DNA, 71 bp, chicken (Gallus Gallus)
  misc_feature (36): n=a or g
agtagcagtgccatgaatcttgtatttggctatacntgggtaaagtgctgcctttgtggagtcctggagca

SEQ ID NO: 15087 - DNA, 71 bp, chicken (Gallus Gallus)
  misc_feature (36): n=a or g
agaaaaataacaaaagcaaaacccaagaaaaaacanaacgcccaaaaccccaaacctgttcccaaacagcc

SEQ ID NO: 15088 - DNA, 71 bp, chicken (Gallus Gallus)
  misc_feature (36): n=a or c
agcttcacactctggcttgtgaaaactgctgtggcngagtcaaaatccttacgtgtgaattcagtaaacaa

SEQ ID NO: 15089 - DNA, 71 bp, chicken (Gallus Gallus)
  misc_feature (36): n=a or c
ttgcactgggaaagctttctcgtcattgatacgtangtagaatggaagcagatcgggtttgctgtgtttgc

SEQ ID NO: 15090 - DNA, 71 bp, chicken (Gallus Gallus)
  misc_feature (36): n=a or g
gagtcaatggactctattgaggtgcgtgtttgctcnttttcaagcatgtactttgtctctgcaggctcttc

SEQ ID NO: 15091 - DNA, 71 bp, chicken (Gallus Gallus)
  misc_feature (36): n=a or g
ctcgtagtcctacatctgcgtgggagatgaactgangagatgggcagtgtgtccagacgtgccgatgcttt

SEQ ID NO: 15092 - DNA, 71 bp, chicken (Gallus Gallus)
  misc_feature (36): n=a or g
gaaatgaggccacttatttagtatctaaatgtggantttagttactaacttgaaaacacccacattagaaa

SEQ ID NO: 15093 - DNA, 71 bp, chicken (Gallus Gallus)
  misc_feature (36): n=c or t
gtagctctcccacagcacatgtgttagaaaggccangtgctgatgtgagacacctccaacgagctatcaat

SEQ ID NO: 15094 - DNA, 71 bp, chicken (Gallus Gallus)
  misc_feature (36): n=a or g
ttgcacatgtatgggcacttggcaaagaagcacacnttgctggctggaggagaacagagagaacaggggga

SEQ ID NO: 15095 - DNA, 71 bp, chicken (Gallus Gallus)
  misc_feature (36): n=c or t
aaggctgcaatctcagcattgtgccgctggaagtcnacaaagtagaagaagtcctcgggtgtctcctcctc

SEQ ID NO: 15096 - DNA, 71 bp, chicken (Gallus Gallus)
  misc_feature (36): n=c or t
taggtgcctgtattcaaaacttgtgttgaactcccncccggtggtattagacaaagtgcaactcacttgaa

SEQ ID NO: 15097 - DNA, 71 bp, chicken (Gallus Gallus)
  misc_feature (36): n=a or g
gagaaatgaatccatttctgagaaagacggataacntaaggaactcttttggacatgatttcaggaaaaaa

SEQ ID NO: 15098 - DNA, 71 bp, chicken (Gallus Gallus)
  misc_feature (36): n=c or t
tgtgctgtcactgctgtgctttccattatcttatgnatctctgtacacatctgtgactgcagagcagcagg

SEQ ID NO: 15099 - DNA, 71 bp, chicken (Gallus Gallus)
  misc_feature (36): n=a or g
tggacttgtttcatgccagcatcttgcactgggaancttaagactgggtgcagtactttgtgcaaatctgt

SEQ ID NO: 15100 - DNA, 71 bp, chicken (Gallus Gallus)
  misc_feature (36): n=a or c
attattcaaggattagtagctgtgactttgcaaaangcctttctgcagcctgtaagaggccatctgaggga

SEQ ID NO: 15101 - DNA, 71 bp, chicken (Gallus Gallus)
  misc_feature (36): n=c or t
cagaaacctatgggtgggctccaagtaggggatccncaatttccacactgcagagtgaatgttggggctca

SEQ ID NO: 15102 - DNA, 71 bp, chicken (Gallus Gallus)
  misc_feature (36): n=a or g
agggcagaggaatgcaggtccagaaacacagacagntttgtgcaaggtcccatgtaatactgggatctgca

SEQ ID NO: 15103 - DNA, 71 bp, chicken (Gallus Gallus)
  misc_feature (36): n=a or g
aaacagaaaaaaaacaaagataccttgagacaagcnggactctgcacgtttgggtggcacctttcttatta

SEQ ID NO: 15104 - DNA, 71 bp, chicken (Gallus Gallus)
  misc_feature (36): n=c or t
aaaaaggtttttaatcctgccggcattcacagttangtatctggaatggtttaaaatctgtctaagaaaca

SEQ ID NO: 15105 - DNA, 71 bp, chicken (Gallus Gallus)
  misc_feature (36): n=g or t
cgtgagatccaactcttgcacagggtgcacctcagnctcctcctgcagctcccagatctgtgccgttccag

SEQ ID NO: 15106 - DNA, 71 bp, chicken (Gallus Gallus)
  misc_feature (36): n=a or g
ctcgcctttataagctcaatgtaggaaatttctgtntttttattttgaatttataatcctggtccaagatc

SEQ ID NO: 15107 - DNA, 71 bp, chicken (Gallus Gallus)
  misc_feature (36): n=c or t
attaaaaatgtaatcattcgtgcattgcatctgtgnaacagttacagacctgtgtgtgtatttcaaagcca

SEQ ID NO: 15108 - DNA, 71 bp, chicken (Gallus Gallus)
  misc_feature (36): n=a or g
cacctggctctcaccatcccacatttcatctccacntatctgtgctaagctccatgtctctgcacagtcca

SEQ ID NO: 15109 - DNA, 71 bp, chicken (Gallus Gallus)
  misc_feature (36): n=a or g
tcacgccctctttaattcacttctgtcttgagatangcagtgaagtgctgttagcactgcttgtatggtat

SEQ ID NO: 15110 - DNA, 71 bp, chicken (Gallus Gallus)
  misc_feature (36): n=c or t
ttttcaatgtcattttaattatctatttgaagctancagaaggtttccctcactgatggcttctatcagtc

SEQ ID NO: 15111 - DNA, 71 bp, chicken (Gallus Gallus)
  misc_feature (36): n=c or t
gacatgagctacctaatgacagtatatgaatgaganctggcatggtgcacagcttgtgtgtccaggtgtgc

SEQ ID NO: 15112 - DNA, 71 bp, chicken (Gallus Gallus)
  misc_feature (36): n=c or t
agtaattgcgctacaaatcagggcctgaagataagntcccccctggggggtttgacttttgtttgttcgga

SEQ ID NO: 15113 - DNA, 71 bp, chicken (Gallus Gallus)
  misc_feature (36): n=c or t
tacaggaagctggctaaaatctgaaacaacaacaangcccctgcccccaaagtgagaaaataatgacggat

SEQ ID NO: 15114 - DNA, 71 bp, chicken (Gallus Gallus)
  misc_feature (36): n=c or g
agctcttgtacaatattggttggagtagactgtctnattcaaaatttatcgtgtaagaactctcaaagctg

SEQ ID NO: 15115 - DNA, 71 bp, chicken (Gallus Gallus)
  misc_feature (36): n=a or g
cctgctgtgtgcatgggaacaaactatgagcaaacnagattattaaatgccaatcagagcacaggtaaatt

SEQ ID NO: 15116 - DNA, 71 bp, chicken (Gallus Gallus)
  misc_feature (36): n=a or g
gagggatggcagaaagaagccaaaggaaatctcaantagttttacctggaataagcttgattgtaggctgg

SEQ ID NO: 15117 - DNA, 71 bp, chicken (Gallus Gallus)
  misc_feature (36): n=g or t
gggctgaaattctgcatttctttctcactgctgatnggtgcatctccttttggctttggaatgcgctgtca

SEQ ID NO: 15118 - DNA, 71 bp, chicken (Gallus Gallus)
  misc_feature (36): n=c or t
ttgagggaaaatcgtctctagagctacaaagcttcncttcttgtattgcttctcaaatgaattcagataat

SEQ ID NO: 15119 - DNA, 71 bp, chicken (Gallus Gallus)
  misc_feature (36): n=c or t
cggagagaagcctgccaaataccacacgctgcaaangctcagtgctttcagttgcctcgactgactccttg

SEQ ID NO: 15120 - DNA, 71 bp, chicken (Gallus Gallus)
  misc_feature (36): n=a or g
ttgctgagaagggagaggcttttataggggagagcnataattacactgcaattaagcgcagctgaaagcca

SEQ ID NO: 15121 - DNA, 71 bp, chicken (Gallus Gallus)
  misc_feature (36): n=c or t
ctgtgaaaacctctgccttggctatcaaacagaacngaaaccattttcgagccgcttgctgaccctccaca

SEQ ID NO: 15122 - DNA, 71 bp, chicken (Gallus Gallus)
  misc_feature (36): n=g or t
aaaatcaaaccctgttaaacacacatcctcctccanctgatgtgcggaggaaacctgcagtgtctctgcag

SEQ ID NO: 15123 - DNA, 71 bp, chicken (Gallus Gallus)
  misc_feature (36): n=g or t
gttgtgtgattatttttgctttttaaggaaccattntctgcacggtcactgaggataaggaagttgcactt

SEQ ID NO: 15124 - DNA, 71 bp, chicken (Gallus Gallus)
  misc_feature (36): n=a or g
ctgttccagtcttgaggaaaagcctttaaggaccanagcatgcactggaagcaaagcactccagtgcccaa

SEQ ID NO: 15125 - DNA, 71 bp, chicken (Gallus Gallus)
  misc_feature (36): n=a or g
cagcaggattcagacagcaggggtagagttgcaccnttctctttggaacaggacttggtctggataagggg

SEQ ID NO: 15126 - DNA, 71 bp, chicken (Gallus Gallus)
  misc_feature (36): n=g or t
tatatctattgagataaaacaaattgccagaggggntatttctccatgaaccatctttgttaggtgtgtaa

SEQ ID NO: 15127 - DNA, 71 bp, chicken (Gallus Gallus)
  misc_feature (36): n=a or g
gtgcagaacaattgtgcttgccagcagttaatgtcngaacaaaagcattggccctcactaaaattgcctgt

SEQ ID NO: 15128 - DNA, 71 bp, chicken (Gallus Gallus)
  misc_feature (36): n=c or t
caaaataattcagatgacagatgatattgctgagcngaaggtgatgccaataaggattaaatccacccgga

SEQ ID NO: 15129 - DNA, 71 bp, chicken (Gallus Gallus)
  misc_feature (36): n=c or t
catatctaggtaccatgtcccatgtccgagtacagngttccatatctgggtatgacgtcttctgcttgtgt

SEQ ID NO: 15130 - DNA, 71 bp, chicken (Gallus Gallus)
  misc_feature (36): n=c or t
ccccccagccctcctcctccaccccgactatttctnttttccttcagtctttgcaatttcactttgatgtc

SEQ ID NO: 15131 - DNA, 71 bp, chicken (Gallus Gallus)
  misc_feature (36): n=c or t
gcttatcctcaacatgtaggagtggaattctgcaantgacagttcagacagcatgcttgtcccctctgctc

SEQ ID NO: 15132 - DNA, 71 bp, chicken (Gallus Gallus)
  misc_feature (36): n=a or g
actgtacttaggcaacataacatcgtttgggccaancagctcctcagtgcaatgcacgttgcttctgggcc

SEQ ID NO: 15133 - DNA, 71 bp, chicken (Gallus Gallus)
  misc_feature (36): n=a or g
agtttttcaattttgatggatattgggatgagattntttattcaagaatagcactgccaagcagttggccc

SEQ ID NO: 15134 - DNA, 71 bp, chicken (Gallus Gallus)
  misc_feature (36): n=c or t
gggttcatgtaggagataaagctactggggtgtccngtcctacagttagggctcatctctgctccctgggg

SEQ ID NO: 15135 - DNA, 71 bp, chicken (Gallus Gallus)
  misc_feature (36): n=g or t
ggaggtgttataggagaaaaaccacaaagatgtgcnactctgcaaaaaagtcttgcttcttccaagcaaaa

SEQ ID NO: 15136 - DNA, 71 bp, chicken (Gallus Gallus)
  misc_feature (36): n=a or c
agcacggggatcctcgtggctctgctcagactgagnagctgtaaagccaagctgatgctcaataaagcttc

SEQ ID NO: 15137 - DNA, 71 bp, chicken (Gallus Gallus)
  misc_feature (36): n=a or g
cgcacggctgtctccaggcatatccggtggcccacngagatatacagaggtttagagctgttgttgcagcc

SEQ ID NO: 15138 - DNA, 71 bp, chicken (Gallus Gallus)
  misc_feature (36): n=a or g
aggcagaactggaaggagcaacaaatctctcctcgngacatgcttgtggagggtggggagccagagctcag

SEQ ID NO: 15139 - DNA, 71 bp, chicken (Gallus Gallus)
  misc_feature (36): n=a or g
tctgcactgcacatagcctaaccagacacaagaacngcatttctgctgctgagatctcttgctagagatct

SEQ ID NO: 15140 - DNA, 71 bp, chicken (Gallus Gallus)
  misc_feature (36): n=a or g
gcagtgactctcatgagatccaggaatcgaagagtnagtgaccaaactacatccccagactgtgcagaaaa

SEQ ID NO: 15141 - DNA, 71 bp, chicken (Gallus Gallus)
  misc_feature (36): n=c or t
ggcaattaagtcagcactctgcttggccacttcacngctcgaggtctggatttcctgggaaacaacgcatt

SEQ ID NO: 15142 - DNA, 71 bp, chicken (Gallus Gallus)
  misc_feature (36): n=a or g
agttctctagcaaaaacactcttgtggcacaacacntaggcttcaagggatgggtaagaagtgtgagcaag

SEQ ID NO: 15143 - DNA, 71 bp, chicken (Gallus Gallus)
  misc_feature (36): n=c or t
aaagttcaagcaaccacgtcagtgcagcacagtccnttcaagtgcaacacgcaacaattagaaaccacgta

SEQ ID NO: 15144 - DNA, 71 bp, chicken (Gallus Gallus)
  misc_feature (36): n=a or g
tcaatgtttttttaaaggcagcatggtgtacactanccactttaaatggcacagcagggttcaaggcattc

SEQ ID NO: 15145 - DNA, 71 bp, chicken (Gallus Gallus)
  misc_feature (36): n=c or t
ggtgttagaaacaacacttggaagtacttggtaaanagacacatttctcacatcaggaagtcagctattct

SEQ ID NO: 15146 - DNA, 71 bp, chicken (Gallus Gallus)
  misc_feature (36): n=a or g
ggaaaaagctgtatttttcctatttggtgataaacnaagtcttatgagctatctcgcaacaacaagagaca

SEQ ID NO: 15147 - DNA, 71 bp, chicken (Gallus Gallus)
  misc_feature (36): n=a or g
gtgcatgttttccctctcctgtaggctacaagaggncttggagagtatcaagatagacttcaatgtatatc

SEQ ID NO: 15148 - DNA, 71 bp, chicken (Gallus Gallus)
  misc_feature (36): n=c or g
ataccaccagaggcctcaatgttgtcatgacaaacncagaggcagggctgtggggacaggcacagcctggc

SEQ ID NO: 15149 - DNA, 71 bp, chicken (Gallus Gallus)
  misc_feature (36): n=g or t
tataggtagagcagaagcttgtggggcaggacttanagagcacatctgtggggcacagtgtggaaactggg

SEQ ID NO: 15150 - DNA, 71 bp, chicken (Gallus Gallus)
  misc_feature (36): n=a or g
tgaaataaactggggaaaattaaaaacaacagaaangtttcttacagctgctggcgctgtgaggcgggagc

SEQ ID NO: 15151 - DNA, 71 bp, chicken (Gallus Gallus)
  misc_feature (36): n=a or c
ctgcctcccttcactctgttcatctttcctatcacnaggagaaagtgaagagaaagcgggagacgattgtg

SEQ ID NO: 15152 - DNA, 71 bp, chicken (Gallus Gallus)
  misc_feature (36): n=c or g
gtgatgtaaactgatttgagaaagttcctctctttntggtgaactttgtgatgctggaatttttcttccaa

SEQ ID NO: 15153 - DNA, 71 bp, chicken (Gallus Gallus)
  misc_feature (36): n=c or t
ctccccagatgtccctttccaggatatggcagcaangtttccctttttcccagggacttcagctgacagcc

SEQ ID NO: 15154 - DNA, 71 bp, chicken (Gallus Gallus)
  misc_feature (36): n=a or g
gaaacactagtgagaaatgagggcagacggatctgngggaaaactgagccgctttcacttaccaaaaggct

SEQ ID NO: 15155 - DNA, 71 bp, chicken (Gallus Gallus)
  misc_feature (36): n=c or t
acaaggatgcttctaagctctagaaagtctgagacngtctaaatctcaccacacttttgaacaaaactggt

SEQ ID NO: 15156 - DNA, 71 bp, chicken (Gallus Gallus)
  misc_feature (36): n=a or c
gaagggtgcagtgtgtgcagaggctgaaaggtaacngtgctcagaggcagacccagaccacctggtgtttc

SEQ ID NO: 15157 - DNA, 71 bp, chicken (Gallus Gallus)
  misc_feature (36): n=g or t
ctttaccgctctcaaaggctgaaaaagtctcaggantggaggcagcagctccgggggagatctgctcatca

SEQ ID NO: 15158 - DNA, 71 bp, chicken (Gallus Gallus)
  misc_feature (36): n=a or g
aagggtggggggtgggggacgcttcaatgctccagncttcacaaggattttgtttttaaacagacaagcta

SEQ ID NO: 15159 - DNA, 71 bp, chicken (Gallus Gallus)
  misc_feature (36): n=g or t
tggcatgagttatataataaaaggcagttgtaaaanggaaaagaaaaaaaaaaataaaggaactgaaataa

SEQ ID NO: 15160 - DNA, 71 bp, chicken (Gallus Gallus)
  misc_feature (36): n=a or g
caagactgtcttgtacagccactgtggctgggagcngtacacttttgtcagtggcattatttatgttagac

SEQ ID NO: 15161 - DNA, 71 bp, chicken (Gallus Gallus)
  misc_feature (36): n=c or t
atgggacaacacaataaaacaggaggaactactttnggagcagtccttgtacttacagtgagaaatctacc

SEQ ID NO: 15162 - DNA, 71 bp, chicken (Gallus Gallus)
  misc_feature (36): n=c or t
gaagaactcagcttctagaaagcacctttaattcangaggaaatatccttcaagagcagcaaggtgttgtt

SEQ ID NO: 15163 - DNA, 71 bp, chicken (Gallus Gallus)
  misc_feature (36): n=c or t
ctgcagaaaaagaaatgaaacttctggctggagctntcccctgctgacctgatgattaatcagcttcgaaa

SEQ ID NO: 15164 - DNA, 71 bp, chicken (Gallus Gallus)
  misc_feature (36): n=c or t
ctgcctctctgtcatcttctgaagacagaggtgatngcaagttacccagacaactgacaaaaggcaaatgt

SEQ ID NO: 15165 - DNA, 71 bp, chicken (Gallus Gallus)
  misc_feature (36): n=g or t
cactcaatgaggttgacctgaaccttagagcagccnttatgtactatttagagaacataaaatctaccaaa

SEQ ID NO: 15166 - DNA, 71 bp, chicken (Gallus Gallus)
  misc_feature (36): n=a or g
gcaaacagcctaacgtctgctatgggtgacccagcnaagaatcagcatgggaagggttagcacaagcctgg

SEQ ID NO: 15167 - DNA, 71 bp, chicken (Gallus Gallus)
  misc_feature (36): n=a or g
gatgactttttttttttttttcacagcatttttatntaaacaagaaatatttgttaatgtagcgtatgtca

SEQ ID NO: 15168 - DNA, 71 bp, chicken (Gallus Gallus)
  misc_feature (36): n=g or t
aacttaacagctttaaatgggcaatcagtccagcangttttttttctgccagttcctgaaggactcgtccc

SEQ ID NO: 15169 - DNA, 71 bp, chicken (Gallus Gallus)
  misc_feature (36): n=c or t
acgctgtagaagtgccagtttttctccatgtagtangaagtctagaaaagtgactgagatggaggtgtgcg

SEQ ID NO: 15170 - DNA, 71 bp, chicken (Gallus Gallus)
  misc_feature (36): n=c or t
gtaattgaccttcagtaatcattctctcagtagttntttaattaaagctactcttccatagacttacctta

SEQ ID NO: 15171 - DNA, 71 bp, chicken (Gallus Gallus)
  misc_feature (36): n=c or t
cggtgttttccttttaataacacttcgcagccgaanctcgctcctggatattttgccttagatcttgagga

SEQ ID NO: 15172 - DNA, 71 bp, chicken (Gallus Gallus)
  misc_feature (36): n=c or t
aaagagagtttgcaattaaatactactccctttttngagccttttttgactctcccactaaaagcccagaa

SEQ ID NO: 15173 - DNA, 71 bp, chicken (Gallus Gallus)
  misc_feature (36): n=c or t
tacctgagtgctgtggacagagaccctcaaagaagncattcctacaccaaagctgcagcaggggccctttt

SEQ ID NO: 15174 - DNA, 71 bp, chicken (Gallus Gallus)
  misc_feature (36): n=c or t
aaaaaaacccacccaagccctcctatagtttcaagngttactttattttactgttcctaaatccagcagca

SEQ ID NO: 15175 - DNA, 71 bp, chicken (Gallus Gallus)
  misc_feature (36): n=c or t
ggtggataacagcatctcctcgttcctcaccccgcnctcctttcatacttccactggaaggtttttgagga

SEQ ID NO: 15176 - DNA, 71 bp, chicken (Gallus Gallus)
  misc_feature (36): n=c or g
gctactgcagtgcgtcctgttgaggcctgcatgctntgatttaacatgcactgcctcaggtatgtctagac

SEQ ID NO: 15177 - DNA, 71 bp, chicken (Gallus Gallus)
  misc_feature (36): n=c or t
ggcaaagagcaccaaaacctgcaaggcattgcagcncttcaattacattaatttcacaagaatttgttcaa

SEQ ID NO: 15178 - DNA, 71 bp, chicken (Gallus Gallus)
  misc_feature (36): n=c or g
gtcaggaaggatgccatgtgcctgctacaagctcanatcagggaaaggtgagccactgctgagagcactgg

SEQ ID NO: 15179 - DNA, 71 bp, chicken (Gallus Gallus)
  misc_feature (36): n=c or t
cattgacacattgggaatggggatgcatgctctganacaacttaagcccatccacagaagggacacagaca

SEQ ID NO: 15180 - DNA, 71 bp, chicken (Gallus Gallus)
  misc_feature (36): n=c or t
tgaagtagctgctttgcgagtgatctgactgaaacntcaaacactaaagtccacacaaggatcccaaggaa

SEQ ID NO: 15181 - DNA, 71 bp, chicken (Gallus Gallus)
  misc_feature (36): n=c or t
cctggcttgcaatcctttaacatcggaggctgccanagaaaaaatattgggccaaatgcagagggtgctgc

SEQ ID NO: 15182 - DNA, 71 bp, chicken (Gallus Gallus)
  misc_feature (36): n=g or t
ttccccctttacatatttatttgcactttttgttcngatttgaaatgaaaaggataactcacaaagcttag

SEQ ID NO: 15183 - DNA, 71 bp, chicken (Gallus Gallus)
  misc_feature (36): n=c or g
tttaacaatgctcacttcaagatttccacaagagcnttaaaggaaacgcatagtaacactccatctaacaa

SEQ ID NO: 15184 - DNA, 71 bp, chicken (Gallus Gallus)
  misc_feature (36): n=c or g
gaaactatggagtcttttcctgtattaaataccctnaaatcagtgtcacaaacgacgacacgcagggatgt

SEQ ID NO: 15185 - DNA, 71 bp, chicken (Gallus Gallus)
  misc_feature (36): n=a or t
tgagttacctgcttgttctctctctcctctttatangggtgaaacctgtggaaggttttgctgtgaccacc

SEQ ID NO: 15186 - DNA, 71 bp, chicken (Gallus Gallus)
  misc_feature (36): n=c or g
tacagaccctattaaatacagttgaaaatacatccngggttggcaaaaattcatttttctctcctccccca

SEQ ID NO: 15187 - DNA, 71 bp, chicken (Gallus Gallus)
  misc_feature (36): n=c or t
ggctgagttgttatttaccaagcggattgcccatangatggcagtgaatggactgggatgcagatcacagg

SEQ ID NO: 15188 - DNA, 71 bp, chicken (Gallus Gallus)
  misc_feature (36): n=c or t
aaaacattctatgtctctacatatgtgctgctacangtatatatacacaaaccagcacaccacatgcactc

SEQ ID NO: 15189 - DNA, 71 bp, chicken (Gallus Gallus)
  misc_feature (36): n=c or t
aataagtgaatgcaaaaaatccaacaaaatagtttngctcccatacagattccctttcctaccttttcttc

SEQ ID NO: 15190 - DNA, 71 bp, chicken (Gallus Gallus)
  misc_feature (36): n=c or t
accaaagtaatccaccactttcaccaaagattacangtaaacatttcatctcagcagagctttccaaaact

SEQ ID NO: 15191 - DNA, 71 bp, chicken (Gallus Gallus)
  misc_feature (36): n=a or c
tcctagagcaaaccagcaaaaaatgaaccaacaacnaccaagaaaatgtactttcctaggaggttatatgg

SEQ ID NO: 15192 - DNA, 71 bp, chicken (Gallus Gallus)
  misc_feature (36): n=c or t
tgctaagtcatttgctaagtgcaaagcaagatctanggggaaaggcaaaaggagacattttataacgttga

SEQ ID NO: 15193 - DNA, 71 bp, chicken (Gallus Gallus)
  misc_feature (36): n=c or t
gagatgtgtgctgcagtggcagtgctacactatttntgatacaagccaggatgctgttggccctcttggcc

SEQ ID NO: 15194 - DNA, 71 bp, chicken (Gallus Gallus)
  misc_feature (36): n=a or g
accattgcccacatttatgacggaagcaccagagantcccaaggaaagccagcacagactggcttgaaagg

SEQ ID NO: 15195 - DNA, 71 bp, chicken (Gallus Gallus)
  misc_feature (36): n=a or g
aactcaaaggattctatgatggtatcccactgcccngtggccagtgtgtactcagtggcccctgactactg

SEQ ID NO: 15196 - DNA, 71 bp, chicken (Gallus Gallus)
  misc_feature (36): n=a or g
ccaccacatccagacatggaaacactctcaggcagnagctggataaacaaaagaaatactccagtcacttc

SEQ ID NO: 15197 - DNA, 71 bp, chicken (Gallus Gallus)
  misc_feature (36): n=a or t
acaataaagttctcttattctatccttcccataacnctacagcttgccctgggctagccaggctgcccaga

SEQ ID NO: 15198 - DNA, 71 bp, chicken (Gallus Gallus)
  misc_feature (36): n=a or g
atacagtgcttcaaagtgccttttattttcttgcanggaaacactcttcagtcacctcaaattgtgggatg

SEQ ID NO: 15199 - DNA, 71 bp, chicken (Gallus Gallus)
  misc_feature (36): n=c or g
atcagaaaacagaaggttgaccctggtatcagtaancagcgcgttctgctcggaccacactactgagcaat

SEQ ID NO: 15200 - DNA, 71 bp, chicken (Gallus Gallus)
  misc_feature (36): n=g or t
aagcactttctcttggtgaggcggaaggtggttttnctcaagtgagaagtctttggggtaacacaggcagg

SEQ ID NO: 15201 - DNA, 71 bp, chicken (Gallus Gallus)
  misc_feature (36): n=c or t
acatcttcagcctggaaaaggagatatcattctaanatatcaaaggacaaagcaacgtggagcaggcaacg

SEQ ID NO: 15202 - DNA, 71 bp, chicken (Gallus Gallus)
  misc_feature (36): n=a or c
ccagcacaagagaacctctccaagcaacactgcccntcagcaagcagaaacacagacaagggcatccacta

SEQ ID NO: 15203 - DNA, 71 bp, chicken (Gallus Gallus)
  misc_feature (36): n=a or g
acagcattctaatgacacgtttaagaatcactcacntcagaggcttgcatgctgagcaaaaggaaaagctg

SEQ ID NO: 15204 - DNA, 71 bp, chicken (Gallus Gallus)
  misc_feature (36): n=c or t
gggctcttcaggcgattctgaatgaatttgtagagntatattcattaaataagaaagaaatctatccactg

SEQ ID NO: 15205 - DNA, 71 bp, chicken (Gallus Gallus)
  misc_feature (36): n=c or t
gggcgttaatgctactcgttggtggatccaatctcnctcctctccaaaatgaggctttgatgtattcagtt

SEQ ID NO: 15206 - DNA, 71 bp, chicken (Gallus Gallus)
  misc_feature (36): n=g or t
aaaaggtttttgcattgtagcactttggtttcagantgcaaatgacatagccataaatttgttatgagtcg

SEQ ID NO: 15207 - DNA, 71 bp, chicken (Gallus Gallus)
  misc_feature (36): n=c or t
catttgttacttgcttgtacgaaactgtgattgagnaggtcagggttagatgctcttgttcctcacttctg

SEQ ID NO: 15208 - DNA, 71 bp, chicken (Gallus Gallus)
  misc_feature (36): n=a or g
gaagaatgtcatcaacctcagttgtgttacagcacnccattcgttgctgagatggaatgggaagttagttg

SEQ ID NO: 15209 - DNA, 71 bp, chicken (Gallus Gallus)
  misc_feature (36): n=a or g
tactaagccatggactaaatgtccattttatggacntcccacagttcacagactaaggaatggtatctgtg

SEQ ID NO: 15210 - DNA, 71 bp, chicken (Gallus Gallus)
  misc_feature (36): n=g or t
tacacaaaattgtagatacacaaaatggatgtctgnaagaattaagagcaatatgctctaacatacctctg

SEQ ID NO: 15211 - DNA, 71 bp, chicken (Gallus Gallus)
  misc_feature (36): n=a or c
agaagaacagtgctgttctgtattttcagaagcagnagtactgaaaagattggcttgatttgtggctcacc

SEQ ID NO: 15212 - DNA, 71 bp, chicken (Gallus Gallus)
  misc_feature (36): n=g or t
agacaaagtctgacaaactgccagaatttaagcttntaaaatagtaatctgcccagagaggttgtggatgc

SEQ ID NO: 15213 - DNA, 71 bp, chicken (Gallus Gallus)
  misc_feature (36): n=a or g
agtaggagaagaaaaaaaactcttaaactgtcttgnaaattggtggatttctgtgcttgtaggtaaagcaa

SEQ ID NO: 15214 - DNA, 71 bp, chicken (Gallus Gallus)
  misc_feature (36): n=a or g
gcatggatatcagtgaagccaaatagttgcttttcnaatcaacctgactgtaatctctagcagcttctgga

SEQ ID NO: 15215 - DNA, 71 bp, chicken (Gallus Gallus)
  misc_feature (36): n=c or g
agcctgaccctggctgtctgcagggatgggcacctncacctctctggacgaaaaggaaccctttgtggctt

SEQ ID NO: 15216 - DNA, 71 bp, chicken (Gallus Gallus)
  misc_feature (36): n=c or t
tggaaggacttcttgcagttattttgtcaaacttgncgttatctgggttgggtttttggttattttttgac

SEQ ID NO: 15217 - DNA, 71 bp, chicken (Gallus Gallus)
  misc_feature (36): n=c or t
tgcaacaagctagaaactgttcctcaaaaactacgncaggttttctaaagaagtcctttctaaaagaactc

SEQ ID NO: 15218 - DNA, 71 bp, chicken (Gallus Gallus)
  misc_feature (36): n=c or t
aggaactaaaaagtggtcatccaaaatgataatcanggatgtgaaagggcaatatcagattgtgccctact

SEQ ID NO: 15219 - DNA, 71 bp, chicken (Gallus Gallus)
  misc_feature (36): n=g or t
ttggtttctcagcagatctttgcacaatatggaatngagtcttgtgatgttaaatgcagtacttccagtaa

SEQ ID NO: 15220 - DNA, 71 bp, chicken (Gallus Gallus)
  misc_feature (36): n=c or t
caggctgtgcactcttacttccaacagcatttaccnctcagtgaatcttccacgagggaatcgttggctga

SEQ ID NO: 15221 - DNA, 71 bp, chicken (Gallus Gallus)
  misc_feature (36): n=a or g
gtgaaggaggctgtggtcacatcaggagcattcctngagtatcaaacacagttgcagggttgctgattccc

SEQ ID NO: 15222 - DNA, 71 bp, chicken (Gallus Gallus)
  misc_feature (36): n=a or g
actgaactgcactattaggcaacctactgaagtggngtttgctctcacaaggcagaaaaccttctctggct

SEQ ID NO: 15223 - DNA, 71 bp, chicken (Gallus Gallus)
  misc_feature (36): n=a or g
gtcacacctcagcagggaagaggtcagtataggttngtgctgcgtactgtcgtctttgttttggctgtaga

SEQ ID NO: 15224 - DNA, 71 bp, chicken (Gallus Gallus)
  misc_feature (36): n=c or g
ttcctccttcatatgtgtggcttatctggaaaaaanaatgtgttgaaaattagaacagttgacttttgaaa

SEQ ID NO: 15225 - DNA, 71 bp, chicken (Gallus Gallus)
  misc_feature (36): n=c or t
ttcattctccataggcttcattcacatcggttgtgngaaggttcattcttagatggagcccacgcgttgtg

SEQ ID NO: 15226 - DNA, 71 bp, chicken (Gallus Gallus)
  misc_feature (36): n=a or g
tatcatttagtcttagaaacagtactaaaagtcagntatatttccatctcttagtcgcatctgctctttcc

SEQ ID NO: 15227 - DNA, 71 bp, chicken (Gallus Gallus)
  misc_feature (36): n=a or g
tcccttgaaacactaaggcctgaccttgttgggccncttaaccacaggctgaggttcctggcagctgtgct

SEQ ID NO: 15228 - DNA, 71 bp, chicken (Gallus Gallus)
  misc_feature (36): n=a or t
aagtatgtttggctgccgagcgtggcctgtaattgntgggagcctgtttctttgtcatttagccctgttgt

SEQ ID NO: 15229 - DNA, 71 bp, chicken (Gallus Gallus)
  misc_feature (36): n=c or t
aatgcttgttacccacggcatccttgaagagcccangtcaggccctcttatcacagatactttggggttca

SEQ ID NO: 15230 - DNA, 71 bp, chicken (Gallus Gallus)
  misc_feature (36): n=c or t
ctaacgctacagaatcacttgttatttttggaggcnttatttctcctgagctgcagtaaggatcttagcac

SEQ ID NO: 15231 - DNA, 71 bp, chicken (Gallus Gallus)
  misc_feature (36): n=c or t
agcccacacagttgccacctcacatgaatagggtcncagggagccatcagaagacagggttaccagcttgc

SEQ ID NO: 15232 - DNA, 71 bp, chicken (Gallus Gallus)
  misc_feature (36): n=c or t
ttttgtccaacagtcattcactttgctatcactgtngtctatggtatcctcataattctgtccttcttgtc

SEQ ID NO: 15233 - DNA, 71 bp, chicken (Gallus Gallus)
  misc_feature (36): n=a or t
gtgggcatacaggtgcaaaagcgaacagtatgagtnaaacagtacagatttgaagcaggctttggtgctaa

SEQ ID NO: 15234 - DNA, 71 bp, chicken (Gallus Gallus)
  misc_feature (36): n=a or g
cacgcacggcccggagccagcagccggccccacacngcagcacatttaggaacgtattaaactaaagtttt

SEQ ID NO: 15235 - DNA, 71 bp, chicken (Gallus Gallus)
  misc_feature (36): n=a or g
gcagcctaaggaatgtggactttcccactcccggcnaactcaatgggaatctgtacctctgagtcaagctg

SEQ ID NO: 15236 - DNA, 71 bp, chicken (Gallus Gallus)
  misc_feature (36): n=a or g
caagagtcagtgtctggggttgaaataccctttatntcattaacagaaatcttcaaagtaaatgttggtta

SEQ ID NO: 15237 - DNA, 71 bp, chicken (Gallus Gallus)
  misc_feature (36): n=c or t
aatggggaccacctgagcgaagtctacataaacaangtgataacagaccctactttcacttaccttgttgc

SEQ ID NO: 15238 - DNA, 71 bp, chicken (Gallus Gallus)
  misc_feature (36): n=a or g
cttgggaaactaactctcatttctcttgtttacacntgagtttgagcattgctgaacaagttgcttagcac

SEQ ID NO: 15239 - DNA, 71 bp, chicken (Gallus Gallus)
  misc_feature (36): n=a or t
tttgattttttttttttaattttttttttaattgcntctgatctgggaaaattggctgctgtaagttattc

SEQ ID NO: 15240 - DNA, 71 bp, chicken (Gallus Gallus)
  misc_feature (36): n=c or t
aaaaataggatcactgtgccttttccagcatttctnctgtgtattcctttccacctaaatgctctaatgcc

SEQ ID NO: 15241 - DNA, 71 bp, chicken (Gallus Gallus)
  misc_feature (36): n=a or g
ctgctctcctggcctggcaaaggtttgtgggctgcnttggctttggttaaatagcatctcaggaggttgtg

SEQ ID NO: 15242 - DNA, 71 bp, chicken (Gallus Gallus)
  misc_feature (36): n=a or g
atcaatctaaccaaccaagccttaattaatcatgcnccacttgagagaaaagctgcttcagtcaacactag

SEQ ID NO: 15243 - DNA, 71 bp, chicken (Gallus Gallus)
  misc_feature (36): n=a or g
ccatcctaaaaagacaacgagctttacagatctacnctacacaaggccaggaaaaagacaagatgcttcaa

SEQ ID NO: 15244 - DNA, 71 bp, chicken (Gallus Gallus)
  misc_feature (36): n=c or t
atagctcgaacagccttacgaacaaagtcaacatcnacctcagtagcatattccttcagctctgccaggac

SEQ ID NO: 15245 - DNA, 71 bp, chicken (Gallus Gallus)
  misc_feature (36): n=a or g
ttcagagactggtagagcatgtcctgaccctccacnttcctcttggcaatggtgtagacgttgttgttctg

SEQ ID NO: 15246 - DNA, 71 bp, chicken (Gallus Gallus)
  misc_feature (36): n=g or t
gcctctcccagccccatgctgcaagcacattgctgncagatttccttttgcaaaccctcattttgcgttga

SEQ ID NO: 15247 - DNA, 71 bp, chicken (Gallus Gallus)
  misc_feature (36): n=a or t
caagcaaaaccaaccctgctttgctgcccctgtganctaactgtacccacacgtgctctctggaagaaagc

SEQ ID NO: 15248 - DNA, 71 bp, chicken (Gallus Gallus)
  misc_feature (36): n=a or g
ccatggtgaattggcaagtgcttgcggtggataccntggctcccttccacgaaagcattgggtggtttgtg

SEQ ID NO: 15249 - DNA, 71 bp, chicken (Gallus Gallus)
  misc_feature (36): n=c or t
cagaaaagaaagagttattaaggacagcatcctccngctgtgccaggaaacacaaaatgggaaggggacca

SEQ ID NO: 15250 - DNA, 71 bp, chicken (Gallus Gallus)
  misc_feature (36): n=a or g
gattctctgctgccagattcacgctccaagcgcaantattctaatgactgccaggtggcagagcttcatgg

SEQ ID NO: 15251 - DNA, 71 bp, chicken (Gallus Gallus)
  misc_feature (36): n=g or t
agtaagagctcacagacagttcacagtaaaacactntcctgaccccagtcccctgctggctaaccggatca

SEQ ID NO: 15252 - DNA, 71 bp, chicken (Gallus Gallus)
  misc_feature (36): n=a or g
gccttttctttggagagttggtacagctcctgtccnaacagaaacaaagcattcccttcagccacagtgaa

SEQ ID NO: 15253 - DNA, 71 bp, chicken (Gallus Gallus)
  misc_feature (36): n=a or g
tgaccagaggaagccactggtgctcagtgcagaagnaatgactgttgctgtgtaacctgagctgtggtggg

SEQ ID NO: 15254 - DNA, 71 bp, chicken (Gallus Gallus)
  misc_feature (36): n=c or t
agttgactacaagtccttgatggcaaaaattaactncaggagctgacagaccaaagcccattgcagcatcc

SEQ ID NO: 15255 - DNA, 71 bp, chicken (Gallus Gallus)
  misc_feature (36): n=a or g
gaccagctcagcatttttggtttctatcagctgcancagcaagctgaccccgttgttctggaaaatcctct

SEQ ID NO: 15256 - DNA, 71 bp, chicken (Gallus Gallus)
  misc_feature (36): n=a or g
ctttcctcggtgaaaacctatttaaagagtttcagnctgcatattctagagatacaaccatattaagctgt

SEQ ID NO: 15257 - DNA, 71 bp, chicken (Gallus Gallus)
  misc_feature (36): n=a or g
attagaatggctgttggctttgttgccttccttacnagacaatagcgtttccaattagggatttccttctc

SEQ ID NO: 15258 - DNA, 71 bp, chicken (Gallus Gallus)
  misc_feature (36): n=a or g
gccttttgattaatgagcccttcagagccacgttgnagcctgggctgaggggaagggggggacggggggag

SEQ ID NO: 15259 - DNA, 71 bp, chicken (Gallus Gallus)
  misc_feature (36): n=c or t
tattgtggtcacaaagacatcacatataaatgttgntagtggcagcctggaggtggctcagcatctcccaa

SEQ ID NO: 15260 - DNA, 71 bp, chicken (Gallus Gallus)
  misc_feature (36): n=c or t
tggtatatattgtttgaagagtataaataataaaanagtatgaaagaaactcatttctcagctttgtgctc

SEQ ID NO: 15261 - DNA, 71 bp, chicken (Gallus Gallus)
  misc_feature (36): n=a or t
atgaatctctattagaggaagctgtcttacagggtnggaataaagctgagttgtttgtatcaaaaccaaac

SEQ ID NO: 15262 - DNA, 71 bp, chicken (Gallus Gallus)
  misc_feature (36): n=a or t
tgctgtttaaagtgctctctgtgttgtgcttagatngaaaaaacaggaagtggctcatccctgttactgtc

SEQ ID NO: 15263 - DNA, 71 bp, chicken (Gallus Gallus)
  misc_feature (36): n=c or t
tgactgtcttgacacacaaaatgcttgttaatcttncaggctgatcagggggctggttttggatcatggtg

SEQ ID NO: 15264 - DNA, 71 bp, chicken (Gallus Gallus)
  misc_feature (36): n=a or g
aagaaaataacgtggaatagatcaaaacagtgtacntttggacacctgcttttacgtatcactttctgtgc

SEQ ID NO: 15265 - DNA, 71 bp, chicken (Gallus Gallus)
  misc_feature (36): n=c or t
tcctcctccgtcctgtcccctctctcttctctccanagtcctctgatgttctttggtctgaagggtcttcc

SEQ ID NO: 15266 - DNA, 71 bp, chicken (Gallus Gallus)
  misc_feature (36): n=c or t
accctgaggctgcaagctgctgcagtgttcttgggnaacttggccacacagagcatggtttcatgttatca

SEQ ID NO: 15267 - DNA, 71 bp, chicken (Gallus Gallus)
  misc_feature (36): n=a or g
tgcagactgcctttttgccagtgctgttgtctgctnaactgcagtgaaatctttagtgtggaagtgcattt

SEQ ID NO: 15268 - DNA, 71 bp, chicken (Gallus Gallus)
  misc_feature (36): n=c or t
ctgctttctgctctccaaactaatgattctcccaangccatcagtgtgctctgttagttctcttggaggca

SEQ ID NO: 15269 - DNA, 71 bp, chicken (Gallus Gallus)
  misc_feature (36): n=c or t
tttcttttcttgcttgcttttggaaccttttctttnggtctgtcatagttttgacaaatgctggtgcagga

SEQ ID NO: 15270 - DNA, 71 bp, chicken (Gallus Gallus)
  misc_feature (36): n=c or t
ttctatggttctaaaattcaacggcagatcttgacntgggcataaagaaattttgcagctggcaacataaa

SEQ ID NO: 15271 - DNA, 71 bp, chicken (Gallus Gallus)
  misc_feature (36): n=a or g
atggtagcgctgtgctttttaacctctccaaatatnaatcgccaaagcactggaacatgaggccttcagaa

SEQ ID NO: 15272 - DNA, 71 bp, chicken (Gallus Gallus)
  misc_feature (36): n=a or g
gagagctgcacagacacagctgcttcttggctcggnttgctctcccccagagtctcagagatgacaaaaag

SEQ ID NO: 15273 - DNA, 71 bp, chicken (Gallus Gallus)
  misc_feature (36): n=a or g
tagccacttggggtcagtttgtaggctgtcagcgtncaggaacctggtgtaaaactgaaggggagcagaga

SEQ ID NO: 15274 - DNA, 71 bp, chicken (Gallus Gallus)
  misc_feature (36): n=a or g
gacttggtacctaattttcacctcagtccagacacnccgatatctttgtgttttcctggatggaattctga

SEQ ID NO: 15275 - DNA, 71 bp, chicken (Gallus Gallus)
  misc_feature (36): n=c or t
agaagagggcagttcagttgtatgtaatgaatatcnctttttgtctgcatttggggtgataatggcagaca

SEQ ID NO: 15276 - DNA, 71 bp, chicken (Gallus Gallus)
  misc_feature (36): n=a or g
ctctcctccagtgcccatctcgcacattctggctcntggtttgttgcagtgatgactttcttcagttctgc

SEQ ID NO: 15277 - DNA, 71 bp, chicken (Gallus Gallus)
  misc_feature (36): n=c or t
ttgttctcccacgttttaaaagtctatactcctatngaatcaaagctctgaaaagccaagatttttagaat

SEQ ID NO: 15278 - DNA, 71 bp, chicken (Gallus Gallus)
  misc_feature (36): n=a or g
tagttgatcaccacgttgtttttggctgtcatgtantcagcaatgttgtgatcaacaataagacgcaacag

SEQ ID NO: 15279 - DNA, 71 bp, chicken (Gallus Gallus)
  misc_feature (36): n=a or g
cacccacacctttcaaaggtgctttctaggtcatcnctgggccacaacaatacaactgtgacctgagggga

SEQ ID NO: 15280 - DNA, 71 bp, chicken (Gallus Gallus)
  misc_feature (36): n=c or t
tgtcattaatttctagttgtgtataatgaaaaagcngagagcaaaaggagctgctctcaaacagggatgct

SEQ ID NO: 15281 - DNA, 71 bp, chicken (Gallus Gallus)
  misc_feature (36): n=a or g
gacctcaccctgatggacagacagatggacacagcnctggcggtttatttgggtctagctaggtgccgtgc

SEQ ID NO: 15282 - DNA, 71 bp, chicken (Gallus Gallus)
  misc_feature (36): n=c or t
tgaggaggcaaaaaataaaacactaatgcagtgganaggccacgacatccaagcctggctcctctctggga

SEQ ID NO: 15283 - DNA, 71 bp, chicken (Gallus Gallus)
  misc_feature (36): n=a or g
gcgttacccttgaagaagtagactcgctcattgccntgatagctgtgcgccgggagggcaaaagcagcgtc

SEQ ID NO: 15284 - DNA, 71 bp, chicken (Gallus Gallus)
  misc_feature (36): n=a or g
ggagcatggtctcatcctgtgtgcatacctgttganctcataacccagtgcaagggcattgggttgtactc

SEQ ID NO: 15285 - DNA, 71 bp, chicken (Gallus Gallus)
  misc_feature (36): n=g or t
agctgcaaggcgcagtgcaacgcagctgcaggacanatttattccacaggtgtgcacaaggagggctgcag

SEQ ID NO: 15286 - DNA, 71 bp, chicken (Gallus Gallus)
  misc_feature (36): n=g or t
ggaaagttctcacattttatggtaacaattcagagnaaaaggtgatatatatctacattgtcatgtctgga

SEQ ID NO: 15287 - DNA, 71 bp, chicken (Gallus Gallus)
  misc_feature (36): n=a or g
aataaatgtcctgatacaattctgcagtggtgtcangaggttctgagggtcagtaatcagagggcaagaaa

SEQ ID NO: 15288 - DNA, 71 bp, chicken (Gallus Gallus)
  misc_feature (36): n=a or g
tgcaggcgtgctgccagctgccgggcatgcagcacnttggccagtttgctgtcacagtagtcctggaaggc

SEQ ID NO: 15289 - DNA, 71 bp, chicken (Gallus Gallus)
  misc_feature (36): n=g or t
ggcatggaacaccaggggtagttcctgtttaccctngacatcagatgtgccctgagccaaaaccactgctg

SEQ ID NO: 15290 - DNA, 71 bp, chicken (Gallus Gallus)
  misc_feature (36): n=c or t
agctgctgctggactgagatctgatcttgtcacctngggctcggcagtcactttccagctgtaggtcttgg

SEQ ID NO: 15291 - DNA, 71 bp, chicken (Gallus Gallus)
  misc_feature (36): n=g or t
tcaattaagcaagtgtacgtccctgccccgtccttntgtaggttagatttaagttctctcctcctacagga

SEQ ID NO: 15292 - DNA, 71 bp, chicken (Gallus Gallus)
  misc_feature (36): n=a or g
tgactgctgacttcagacatctcacctacacattcnttcagtccccacctccttctcctgccccaacaagg

SEQ ID NO: 15293 - DNA, 71 bp, chicken (Gallus Gallus)
  misc_feature (36): n=a or g
cggggtcctaatccgtcacatcagctttgccgagcnggagtctattaacggcggccgcgagccggagagat

SEQ ID NO: 15294 - DNA, 71 bp, chicken (Gallus Gallus)
  misc_feature (36): n=a or g
tcagcatcctacataacttccttgtgcagcataccncaggctgcttaatgcccaagaagtagctagatagt

SEQ ID NO: 15295 - DNA, 71 bp, chicken (Gallus Gallus)
  misc_feature (36): n=c or t
caaaccagctctaagaccacctccagctgaacccantcaccatgaagttaggtgcgttgtgtcctaaacat

SEQ ID NO: 15296 - DNA, 71 bp, chicken (Gallus Gallus)
  misc_feature (36): n=a or g
gtaggaaaggccaaagggacaaaaacaagatgggancagaggtgagacagagccctgggtgccctaaagag

SEQ ID NO: 15297 - DNA, 71 bp, chicken (Gallus Gallus)
  misc_feature (36): n=c or t
ttcatctgttcccatccaggaatacttcagctctgnactgctgtgggaggaggggggaggaggaggaagga

SEQ ID NO: 15298 - DNA, 71 bp, chicken (Gallus Gallus)
  misc_feature (36): n=a or g
aacagtttgtagcacaacacctttacacattatgtnaagtgtccctcctattaattctgagcagctgtgca

SEQ ID NO: 15299 - DNA, 71 bp, chicken (Gallus Gallus)
  misc_feature (36): n=c or t
cccagagcaatcccacttgggcaaaaagctataganacatacagagcctgcccgaatggtaaagcacacag

SEQ ID NO: 15300 - DNA, 71 bp, chicken (Gallus Gallus)
  misc_feature (36): n=a or g
aggtcagaagctgctagccatcctagttctgctgtngcacaaaattgggtaaatagtgccattccttaatg

SEQ ID NO: 15301 - DNA, 71 bp, chicken (Gallus Gallus)
  misc_feature (36): n=c or t
cttcccatggtggcattaggcactgatctgtgcgcnaagtgatggcacatccctttagatccctgcttgca

SEQ ID NO: 15302 - DNA, 71 bp, chicken (Gallus Gallus)
  misc_feature (36): n=a or t
taaccaaatcatctcttgcttaggccaaaatttgcnggtttatttgcagtaagagaaggaggctatctgtc

SEQ ID NO: 15303 - DNA, 71 bp, chicken (Gallus Gallus)
  misc_feature (36): n=a or g
atgtcagagggtgttgtatggagcagtgggtctgtntgattcctccccgctcctcctaacagcacacagtc

SEQ ID NO: 15304 - DNA, 71 bp, chicken (Gallus Gallus)
  misc_feature (36): n=a or g
gtccagaacagttttctggaagtagagctctgcttntgtttagcacagaacttgtccagctggtttgagaa

SEQ ID NO: 15305 - DNA, 71 bp, chicken (Gallus Gallus)
  misc_feature (36): n=c or g
agtggccaattaatgggctgagtttgggcatgcttnatgccagctacgctgccctgaggcggtgattaaac

SEQ ID NO: 15306 - DNA, 71 bp, chicken (Gallus Gallus)
  misc_feature (36): n=a or g
tggaaaagatcagcaggattcttcagatgcaaaatncaatttatggggccaatagatgtgtagaaataacg

SEQ ID NO: 15307 - DNA, 71 bp, chicken (Gallus Gallus)
  misc_feature (36): n=c or t
gctgcctgcaccaatcagctctgcattgtgaaattnctccttgagaacccctaccaggctgctgacattgc

SEQ ID NO: 15308 - DNA, 71 bp, chicken (Gallus Gallus)
  misc_feature (36): n=a or g
gttaacagaaagcaaaagatgccaaagcttttcagnttaaaaagaaataaaaacccccaaacctgcatggg

SEQ ID NO: 15309 - DNA, 71 bp, chicken (Gallus Gallus)
  misc_feature (36): n=a or t
acttagagaaacagcgaatgctatacagttgttccngccatgttgccatgacatgacctcctctgggtaaa

SEQ ID NO: 15310 - DNA, 71 bp, chicken (Gallus Gallus)
  misc_feature (36): n=c or t
gatactcttcccaccttcaggaagagcctggtttgnttctctgagactggagacctgagtgaggatgagat

SEQ ID NO: 15311 - DNA, 71 bp, chicken (Gallus Gallus)
  misc_feature (36): n=a or g
aaggaggacaattaaaatgcttccttcataagagcngggatttatggaaaaaggccaaagaagctaggaaa

SEQ ID NO: 15312 - DNA, 71 bp, chicken (Gallus Gallus)
  misc_feature (36): n=a or t
agagcttcttcatcatgagccgcattcaaactcagntgaagagtagagggcgttcttacaggatatatgac

SEQ ID NO: 15313 - DNA, 71 bp, chicken (Gallus Gallus)
  misc_feature (36): n=c or g
tggtttttcaccttccctcccagaaacaaatgtcgncatggctcagggccagaacttcttgacttaatacc

SEQ ID NO: 15314 - DNA, 71 bp, chicken (Gallus Gallus)
  misc_feature (36): n=a or g
taaaagaacaatgctttttgtgttgtattaccttcntaggctcctggtgatgaaggatggtctgtaaggtt

SEQ ID NO: 15315 - DNA, 71 bp, chicken (Gallus Gallus)
  misc_feature (36): n=c or t
gaagtcattgcacgtgaagcaaaggaaaacgatggntttcctattctcaaacaaccttcagacgttgacag

SEQ ID NO: 15316 - DNA, 71 bp, chicken (Gallus Gallus)
  misc_feature (36): n=a or g
tatttacagagcatgtgtcatctggcagtggagaancatgctgcaattccagcatgtctgaaaggaaagat

SEQ ID NO: 15317 - DNA, 71 bp, chicken (Gallus Gallus)
  misc_feature (36): n=c or t
ttaaatatagaggaattagagctgtgatgatgtgtnctgcaccatctgcttccctgtttgtgtagaatggc

SEQ ID NO: 15318 - DNA, 71 bp, chicken (Gallus Gallus)
  misc_feature (36): n=g or t
acatacacatccctctcagtgtttctttccctcacncttgtttcctttgtctcacattttatatggctcag

SEQ ID NO: 15319 - DNA, 71 bp, chicken (Gallus Gallus)
  misc_feature (36): n=c or t
catgtcaagttatctctatacaccacaattagcttntgatttattcatgcctttttataatgtggcttttc

SEQ ID NO: 15320 - DNA, 71 bp, chicken (Gallus Gallus)
  misc_feature (36): n=a or g
ccaactgctacaaaaacatgcacaaatcagacttgnaataaaacgcaacaaatggattaaagaaacgccag

SEQ ID NO: 15321 - DNA, 71 bp, chicken (Gallus Gallus)
  misc_feature (36): n=a or g
ttgtaagaatgtgccttttttgaggaagtggatacnctattgcagtgaaaacagtgctgtgtttctgctgt

SEQ ID NO: 15322 - DNA, 71 bp, chicken (Gallus Gallus)
  misc_feature (36): n=c or g
agcatcttgtggacgttttgatggcttcttctttanatcaagctttgtacctgatgctgtagtctagtact

SEQ ID NO: 15323 - DNA, 71 bp, chicken (Gallus Gallus)
  misc_feature (36): n=a or c
aagcagcaccatctggtatcacaatgcaaacagatngggctgccccaaacacggagctttcagaggcttgg

SEQ ID NO: 15324 - DNA, 71 bp, chicken (Gallus Gallus)
  misc_feature (36): n=a or g
aacaccttcacacgacttgtttctgcaagctgcaanggcaatggctgggctgaaaaccccacagcatcccc

SEQ ID NO: 15325 - DNA, 71 bp, chicken (Gallus Gallus)
  misc_feature (36): n=a or g
gtgcctagtgagcagaattccttctcattcatggcnttataagataaaagcagtacgagtgataatgaacg

SEQ ID NO: 15326 - DNA, 71 bp, chicken (Gallus Gallus)
  misc_feature (36): n=a or g
tcaagcagctgtcagggctaacgtttctcttctggngggatcaaaaaattgacacttttgtttcaaatgtt

SEQ ID NO: 15327 - DNA, 71 bp, chicken (Gallus Gallus)
  misc_feature (36): n=c or t
gatttaaaaatacttggttttcaccttcgttaattntaacttctcataaagatgtgttgaatgagtatatg

SEQ ID NO: 15328 - DNA, 71 bp, chicken (Gallus Gallus)
  misc_feature (36): n=a or g
acttttaacatatgccaaacactgctgaatggccancagctttgtcactgccacttcgggcaagatgtggg

SEQ ID NO: 15329 - DNA, 71 bp, chicken (Gallus Gallus)
  misc_feature (36): n=a or c
tgccatcataagcctccagtctgattttccaatctngaatatctttgttattaaatttggtgcaagccatg

SEQ ID NO: 15330 - DNA, 71 bp, chicken (Gallus Gallus)
  misc_feature (36): n=a or g
atgtggagcagatcctgccctctgcagaaaagggangcagcgcgaaaaacatagtatcagttggtgtgatg

SEQ ID NO: 15331 - DNA, 71 bp, chicken (Gallus Gallus)
  misc_feature (36): n=c or t
agccttcagcaccttagtggctgtctgcgtgccttnctccttcgttaagcagcatctttcctttccgtagg

SEQ ID NO: 15332 - DNA, 71 bp, chicken (Gallus Gallus)
  misc_feature (36): n=a or c
aagagcaacttctcagatccatatgtatttttttantatgaggacagacaccatgggatgttgaaatatca

SEQ ID NO: 15333 - DNA, 71 bp, chicken (Gallus Gallus)
  misc_feature (36): n=a or c
tctcctgtcagtcttactttctgaaatgtttggctntttgatttaaagctgttccctgtgtcccatcactg

SEQ ID NO: 15334 - DNA, 71 bp, chicken (Gallus Gallus)
  misc_feature (36): n=a or g
tggctgctgttctccaagctgttgtttgtgggcacngtctaggaaggcgtcctggcaggagctgaggtggc

SEQ ID NO: 15335 - DNA, 71 bp, chicken (Gallus Gallus)
  misc_feature (36): n=a or c
aaagtaatttttttgataagtctttgtgaaccaggngtagtggcccatccaatgtgggtgcagaaacagta

SEQ ID NO: 15336 - DNA, 71 bp, chicken (Gallus Gallus)
  misc_feature (36): n=g or t
tattataggtcctacacctgtggctcattctttctntacatcttgttacctacgctgtattttcctttgct

SEQ ID NO: 15337 - DNA, 71 bp, chicken (Gallus Gallus)
  misc_feature (36): n=a or g
gggaagacttgatttggcccattgggttgaccagcngggtgacaagcagggatgatttgatatctttgact

SEQ ID NO: 15338 - DNA, 71 bp, chicken (Gallus Gallus)
  misc_feature (36): n=c or t
attaaaatgtagaaaattgacatttggaattgagcngggatgcgctgcaaacgccgtcgtattgggggggg

SEQ ID NO: 15339 - DNA, 71 bp, chicken (Gallus Gallus)
  misc_feature (36): n=c or t
gcttcccactcccctgggcagccatgggatctgggngcctttttttgcactaccgagagagcagaaatagg

SEQ ID NO: 15340 - DNA, 71 bp, chicken (Gallus Gallus)
  misc_feature (36): n=c or t
tctctgctgtgcagtaaagtgcaagcatgtgtcagntcctgctccccaaaacttgggaggactttgctgtt

SEQ ID NO: 15341 - DNA, 71 bp, chicken (Gallus Gallus)
  misc_feature (36): n=a or g
gattagtaccttgctttgccaatagttgtcaaaacnttgtaactctgcccacgcaaggaggcatcgctggg

SEQ ID NO: 15342 - DNA, 71 bp, chicken (Gallus Gallus)
  misc_feature (36): n=c or t
ttcctagctttgcactcagaattcctcctttaaccngagggacccccggtgagctcctggctcccttggta

SEQ ID NO: 15343 - DNA, 71 bp, chicken (Gallus Gallus)
  misc_feature (36): n=c or g
agacagtgagtgctgaggggtcagacgtggaatagntctcctcccctcttctggctttaaaatctatccaa

SEQ ID NO: 15344 - DNA, 71 bp, chicken (Gallus Gallus)
  misc_feature (36): n=a or g
gaggtatgaccctgcagatcatgagtgtgacatgcntgcattcgtcctgagcttcatgttgtcgttgcagt

SEQ ID NO: 15345 - DNA, 71 bp, chicken (Gallus Gallus)
  misc_feature (36): n=a or g
gtaggtgcaatgcagtggaattgcaaagcaaaacangatgaggagcctgaccatgatgtggaaagcgaaaa

SEQ ID NO: 15346 - DNA, 71 bp, chicken (Gallus Gallus)
  misc_feature (36): n=a or g
ctgggaaccactcccagaccacttggaatggaggtngaaagattctggctagaatcacagcaggaaaacag

SEQ ID NO: 15347 - DNA, 71 bp, chicken (Gallus Gallus)
  misc_feature (36): n=c or t
aggagttggactcattaatccctatgggtcccatcnatctcaggatttctatgaagatctcacgtccagca

SEQ ID NO: 15348 - DNA, 71 bp, chicken (Gallus Gallus)
  misc_feature (36): n=a or g
tgccagcagggctgatgcaactggatgtcatactcnatgtaacacagtaagaaaacactgtatgtgtcata

SEQ ID NO: 15349 - DNA, 71 bp, chicken (Gallus Gallus)
  misc_feature (36): n=c or g
ccttgctccatgtgcagtctatgggatagacctcanagctatttctgtataatatatttctgtataatatt

SEQ ID NO: 15350 - DNA, 71 bp, chicken (Gallus Gallus)
  misc_feature (36): n=a or c
attacttgagatgagataccaaagattaaggtgatnagttaaaagggagtcagatcatgaaatactatttg

SEQ ID NO: 15351 - DNA, 71 bp, chicken (Gallus Gallus)
  misc_feature (36): n=c or t
tactattatctgaattagtggatgtatcaataatgntttgcaactgaacagtttagaggcacttaattttt

SEQ ID NO: 15352 - DNA, 71 bp, chicken (Gallus Gallus)
  misc_feature (36): n=a or c
tactttgcacttcttcaggtgtctaggtgattgtanattacctcatgtatgtgaatttacttgagtgtcaa

SEQ ID NO: 15353 - DNA, 71 bp, chicken (Gallus Gallus)
  misc_feature (36): n=a or t
atattgtctttgtatttgttttatagactactaacntttgtaatttcaagccttcttagtccttaaagcta

SEQ ID NO: 15354 - DNA, 71 bp, chicken (Gallus Gallus)
  misc_feature (36): n=a or g
aagcaagacgaaaaaatacttcttcctagctcagcnagaagggaaaggaaaaggtgaggtctcaattgctt

SEQ ID NO: 15355 - DNA, 71 bp, chicken (Gallus Gallus)
  misc_feature (36): n=c or t
ttcttttacatttgtgaatacgtacttctgaaacangcacctcttgcatcctcctctaaccaagtttcaac

SEQ ID NO: 15356 - DNA, 71 bp, chicken (Gallus Gallus)
  misc_feature (36): n=c or t
gggattagaaaagtaaacccgagggatgcttgcttncacatcagcacaagcattcagggccgtccaatctg

SEQ ID NO: 15357 - DNA, 71 bp, chicken (Gallus Gallus)
  misc_feature (36): n=c or g
gataaatagcagcgagcctgggagactgtaaaactntaccctgatttccacattctccagcataagtttta

SEQ ID NO: 15358 - DNA, 71 bp, chicken (Gallus Gallus)
  misc_feature (36): n=a or t
gatgagttggagagcagttatttgctatttgtgtantttttttttatttatactgctatatatgttgtttc

SEQ ID NO: 15359 - DNA, 71 bp, chicken (Gallus Gallus)
  misc_feature (36): n=a or g
ttgtgtgaggtttgtgcagaatgcgggcgtacggcncacctgtggatctgttggcaaagttgcatttgctt

SEQ ID NO: 15360 - DNA, 71 bp, chicken (Gallus Gallus)
  misc_feature (36): n=a or g
acacaataacttccatcattaatattaaatagcatngagggggaaaagcgacctaaaaagagcacgcgctc

SEQ ID NO: 15361 - DNA, 71 bp, chicken (Gallus Gallus)
  misc_feature (36): n=a or g
actgaggatcaagagcagccagtgcaagggatgcantgaagatgctgcgtgtgcaacttgggatgctgact

SEQ ID NO: 15362 - DNA, 71 bp, chicken (Gallus Gallus)
  misc_feature (36): n=c or t
gactccaaagtaagcaattttggcagcagctctggntcaaagctttattcttgccaaagcatccatagatt

SEQ ID NO: 15363 - DNA, 71 bp, chicken (Gallus Gallus)
  misc_feature (36): n=a or c
taccgttgcaaagcaccatcttgctggaaacaaagntccattgccagtgctgaaactaataactgtatttt

SEQ ID NO: 15364 - DNA, 71 bp, chicken (Gallus Gallus)
  misc_feature (36): n=a or c
ccaccaccactttgtttccttggaagcttcccttcnctgccttatgtgatgtctagtcaaaactgtgaaac

SEQ ID NO: 15365 - DNA, 71 bp, chicken (Gallus Gallus)
  misc_feature (36): n=a or g
gagggacccggccattctactgccgtggcaacatcnacatccagggaacggtactgagctcgtggagtaaa

SEQ ID NO: 15366 - DNA, 71 bp, chicken (Gallus Gallus)
  misc_feature (36): n=g or t
gcccccagccaggagctcccagctgagctgcacagngtgaggaagttcatccctgtgtgctttctccttaa

SEQ ID NO: 15367 - DNA, 71 bp, chicken (Gallus Gallus)
  misc_feature (36): n=c or t
aaaaccagacgtttgtataaagggagctgggattcnactgcgtgtcaatggcactgaaaaaaataaaactg

SEQ ID NO: 15368 - DNA, 71 bp, chicken (Gallus Gallus)
  misc_feature (36): n=g or t
acagaacatgcagcacctcaggaagcatggaaacangatggtcctaatggttaattatagatttaagaact

SEQ ID NO: 15369 - DNA, 71 bp, chicken (Gallus Gallus)
  misc_feature (36): n=c or t
gaacccatgagatgaccacaccactaagaccagctncattggttggaaagtccctttcacaaagaagaaaa

SEQ ID NO: 15370 - DNA, 71 bp, chicken (Gallus Gallus)
  misc_feature (36): n=a or c
ttactgaaaaacagagatcatgcacactcaaactgngtttaaaattttaacagttgattttgaaagagtga

SEQ ID NO: 15371 - DNA, 71 bp, chicken (Gallus Gallus)
  misc_feature (36): n=c or t
aggtatgcttcctgtactcagcagcatccaacatcnatccctgtgtgcagcagaagaggtgccaaccaaca

SEQ ID NO: 15372 - DNA, 71 bp, chicken (Gallus Gallus)
  misc_feature (36): n=c or t
cggtacgcataatgctaaggctgcttcttctctctntgcaggaacatgacattgagacagctttcggagtg

SEQ ID NO: 15373 - DNA, 71 bp, chicken (Gallus Gallus)
  misc_feature (36): n=c or t
aggctgcactggacatgaggtgactccagtggaacntaaatctgaaattaaactgtgcgccatgaggggcc

SEQ ID NO: 15374 - DNA, 71 bp, chicken (Gallus Gallus)
  misc_feature (36): n=a or g
tgcctttaaaaacacccttgatgatatttaaccacntcacttatgtggtttgggaatacctgcttggggta

SEQ ID NO: 15375 - DNA, 71 bp, chicken (Gallus Gallus)
  misc_feature (36): n=a or g
aagacaaacaaggctcttctcagaggtttgcagtgngagctgcaagaagggaaattcctattgaatacaag

SEQ ID NO: 15376 - DNA, 71 bp, chicken (Gallus Gallus)
  misc_feature (36): n=c or t
ctgaacacaatttgtttactgaagtacaccagtccnaagcagggcaagctggcacttcctgaccccacggc

SEQ ID NO: 15377 - DNA, 71 bp, chicken (Gallus Gallus)
  misc_feature (36): n=c or t
acttttaaagacataaagaagatattcagaacctcngccttttccttatcctcagtggtcacattcccaga

SEQ ID NO: 15378 - DNA, 71 bp, chicken (Gallus Gallus)
  misc_feature (36): n=a or g
aagagaaaagctttctcacaaacaagtagctgtctncaatcagaacacaaataaatcattggtttttacca

SEQ ID NO: 15379 - DNA, 71 bp, chicken (Gallus Gallus)
  misc_feature (36): n=a or t
gaaatcatggcataagaaccaattggccaaaatacngatagtgtgcaacattggtgtgctctgaaatgagt

SEQ ID NO: 15380 - DNA, 71 bp, chicken (Gallus Gallus)
  misc_feature (36): n=a or t
aaaagaaaaataaaacaacaaaatcacactctatcngaccacatgatcaatctttttaacacagttatata

SEQ ID NO: 15381 - DNA, 71 bp, chicken (Gallus Gallus)
  misc_feature (36): n=c or t
cctccatcaacaggacatgaagctcgattgctttgnctgtgctcaccttcagaatgtcactgggaagtgat

SEQ ID NO: 15382 - DNA, 71 bp, chicken (Gallus Gallus)
  misc_feature (36): n=a or t
tgaaccacatctgtttatttcaggacccttttccanttcagacccatgcagttcctccccattggatctga

SEQ ID NO: 15383 - DNA, 71 bp, chicken (Gallus Gallus)
  misc_feature (36): n=a or g
aaaaagcatctaaaccaacaccaacacttttactancagcctccagaagtttactgcagccaactgcctag

SEQ ID NO: 15384 - DNA, 71 bp, chicken (Gallus Gallus)
  misc_feature (36): n=c or t
ctggagatcagaagcagcagctctcaagaatcaganagtgttgaaatagcaaaacaacacactctagaaca

SEQ ID NO: 15385 - DNA, 71 bp, chicken (Gallus Gallus)
  misc_feature (36): n=c or t
aatgttatcccattgtcagtagtttggaaaacgacnccgtattttaaagaggcaattaaaatgctatcatg

SEQ ID NO: 15386 - DNA, 71 bp, chicken (Gallus Gallus)
  misc_feature (36): n=a or g
cccacacactgcagctctgcatacagcctgcactcntcagggcactctctgctaacaaacagccagccagg

SEQ ID NO: 15387 - DNA, 71 bp, chicken (Gallus Gallus)
  misc_feature (36): n=a or g
gctcgctttcacaaactttcaaggtaacatccaacnaacacacaacagcggctttttttctggccaataac

SEQ ID NO: 15388 - DNA, 71 bp, chicken (Gallus Gallus)
  misc_feature (36): n=g or t
tagggttagttggaccctcgtctagaggagattcangaagctctgaaggcaattgtgctcactgcatgggc

SEQ ID NO: 15389 - DNA, 71 bp, chicken (Gallus Gallus)
  misc_feature (36): n=a or g
taggccttttgcagcgtgatccatcgtcctggggantaggagttcatctgaaatgaggcttgtgccatttt

SEQ ID NO: 15390 - DNA, 71 bp, chicken (Gallus Gallus)
  misc_feature (36): n=a or g
cacagctcacagaacctgcttttctggtgcgacacngtgccacaccacatgaggaaagcactgaactcttc

SEQ ID NO: 15391 - DNA, 71 bp, chicken (Gallus Gallus)
  misc_feature (36): n=c or t
tgttttgtaagtgtccaggaaatagtccaggcaatnatactgattatgatatactacagtatataggatga

SEQ ID NO: 15392 - DNA, 71 bp, chicken (Gallus Gallus)
  misc_feature (36): n=c or t
gaagctgtggctgctgctcatttggacaagctgtcngtgaagctgacaaaactgagtgagaagcaggccaa

SEQ ID NO: 15393 - DNA, 71 bp, chicken (Gallus Gallus)
  misc_feature (36): n=a or g
ttccagaagttgcagaatgatgaactaaaattattnatactgaggaagaatgatagaagaaatataaaagc

SEQ ID NO: 15394 - DNA, 71 bp, chicken (Gallus Gallus)
  misc_feature (36): n=c or t
tcctgtgtagtgtttgcctggaaaggagaaacggangaggagtatttgtggtgcattgagcagaccctgta

SEQ ID NO: 15395 - DNA, 71 bp, chicken (Gallus Gallus)
  misc_feature (36): n=a or g
tgatgatcatttttaaagcactggtgccagtgcacnatgttccagatgaaaccctctctttgttagcttgg

SEQ ID NO: 15396 - DNA, 71 bp, chicken (Gallus Gallus)
  misc_feature (36): n=c or t
ttctgtgcacagagacaagcatcaacatctcagggnttgtcaccatgagctgtctatttccagggtttgca

SEQ ID NO: 15397 - DNA, 71 bp, chicken (Gallus Gallus)
  misc_feature (36): n=a or g
ccatcaacagagtacagctctgaagaagcacttatnctcatgacaagctatacagccaaggaagaacacat

SEQ ID NO: 15398 - DNA, 71 bp, chicken (Gallus Gallus)
  misc_feature (36): n=a or t
aatttgggctgtgccatgggtcaccctagcttcgtnatgagcaactccttcaccaaccaggtgctggcgca

SEQ ID NO: 15399 - DNA, 71 bp, chicken (Gallus Gallus)
  misc_feature (36): n=c or t
acttgtattgacataattcacatgtggcgtttattnatgaacactattacagccattttagggctcccgtg

SEQ ID NO: 15400 - DNA, 71 bp, chicken (Gallus Gallus)
  misc_feature (36): n=c or g
catgtggtctgctgtccaccttgcttaggagaaagncacacacctgcttatttgctggatgcttctgtact

SEQ ID NO: 15401 - DNA, 71 bp, chicken (Gallus Gallus)
  misc_feature (36): n=a or g
aagaaggatactgaggcaccaaacagcccaattccncatatgcatgcttcccccttcctcttccacgttat

SEQ ID NO: 15402 - DNA, 71 bp, chicken (Gallus Gallus)
  misc_feature (36): n=a or t
gagcggtcagtctgtgccaggtccccacacttcaangtagaaagacgcactgcccaaaaccacaacaacaa

SEQ ID NO: 15403 - DNA, 71 bp, chicken (Gallus Gallus)
  misc_feature (36): n=a or g
cattgaatttgctgctctactgttcaaggagagcanggaagaacagaaggattaagcactgttactctggt

SEQ ID NO: 15404 - DNA, 71 bp, chicken (Gallus Gallus)
  misc_feature (36): n=c or g
tttgtgtttactgctcatttctgccttcaaaaatgnggttctgaataatgctgtctactctaaggttaatt

SEQ ID NO: 15405 - DNA, 71 bp, chicken (Gallus Gallus)
  misc_feature (36): n=a or g
atttaataggaaaaaaaatatatattttatgaaaangatctcattcagtgtctcttttggagtgattacat

SEQ ID NO: 15406 - DNA, 71 bp, chicken (Gallus Gallus)
  misc_feature (36): n=a or g
ggttaaaaaggggacagaataatgaagtgttggtcnttccagagctgatttagaatgatacataattttgc

SEQ ID NO: 15407 - DNA, 71 bp, chicken (Gallus Gallus)
  misc_feature (36): n=c or t
gcatctggcaggggatttcagctggcactgtcgttntggtagctgccaagtgtgggttatgtcccagcctt

SEQ ID NO: 15408 - DNA, 71 bp, chicken (Gallus Gallus)
  misc_feature (36): n=c or t
atacagcgatctcctctcccgcccccatccctggtntttaaaccagcctccattctgctccttcaagcctc

SEQ ID NO: 15409 - DNA, 71 bp, chicken (Gallus Gallus)
  misc_feature (36): n=a or g
ctgactgctggagagaatgatgccatgtttaatggngtttggctctgcccagcctgcagtgacaccaccac

SEQ ID NO: 15410 - DNA, 71 bp, chicken (Gallus Gallus)
  misc_feature (36): n=c or g
aaaggtgggcagaggccttcagaggtcaacctgctnctggtgtgcttcttgcacatgaattcagcataagc

SEQ ID NO: 15411 - DNA, 71 bp, chicken (Gallus Gallus)
  misc_feature (36): n=c or t
tcctcagataaccttagaagctggcagagcctctcngtgtgacatttccaagcttttggcagggcagcttg

SEQ ID NO: 15412 - DNA, 71 bp, chicken (Gallus Gallus)
  misc_feature (36): n=g or t
atttacttttgccctgcaaaccttggatctccttgnctagctgctacttgggtgaagggattgccacagtg

SEQ ID NO: 15413 - DNA, 71 bp, chicken (Gallus Gallus)
  misc_feature (36): n=a or g
gggctcagccgtgtgacaaaatcacactgaagatgncaccgtcccacgggcactgcagcacctctgtgcca

SEQ ID NO: 15414 - DNA, 71 bp, chicken (Gallus Gallus)
  misc_feature (36): n=c or t
ttaatgactcatcatcagtctgaagagtttccgagncagcagtcaaccactgtgctggaaggaatcattgc

SEQ ID NO: 15415 - DNA, 71 bp, chicken (Gallus Gallus)
  misc_feature (36): n=g or t
tactctgctgctctttcaaagtattctgtggcggtnttcatttaattctttttaatcattcaaaacccaat

SEQ ID NO: 15416 - DNA, 71 bp, chicken (Gallus Gallus)
  misc_feature (36): n=a or g
cctgggagaccccgggacctccaattctagggttancattcccagtgcattcaattctttgtgttaatcaa

SEQ ID NO: 15417 - DNA, 71 bp, chicken (Gallus Gallus)
  misc_feature (36): n=c or g
ttcagtagagattctgggaatgaggacctcagttancaggtggctgtgggtgcaggtagagggaggccatg

SEQ ID NO: 15418 - DNA, 71 bp, chicken (Gallus Gallus)
  misc_feature (36): n=a or g
agcagattttgtttgggattgccctgttatcagtcnatgagattaatccacaacccacctcttgccctagc

SEQ ID NO: 15419 - DNA, 71 bp, chicken (Gallus Gallus)
  misc_feature (36): n=a or g
ccaccatggatgggaccactgatgctcaccctcagntatctgctggagactggctttattttaccaactgt

SEQ ID NO: 15420 - DNA, 71 bp, chicken (Gallus Gallus)
  misc_feature (36): n=c or t
agatgaggtgggggagggaggaatccatacttagcnatggcatgaagacaacagatgttggcaaaacgaag

SEQ ID NO: 15421 - DNA, 71 bp, chicken (Gallus Gallus)
  misc_feature (36): n=c or t
tccatccttcatggggagaagaggtcatgttgtacncacataccccactcttattattgtggccctactaa

SEQ ID NO: 15422 - DNA, 71 bp, chicken (Gallus Gallus)
  misc_feature (36): n=g or t
gggagacagacccatcatgacatgaatgcaccatgnagggtaacctcacccccagggccttgcagtggggt

SEQ ID NO: 15423 - DNA, 71 bp, chicken (Gallus Gallus)
  misc_feature (36): n=a or g
gtggctgagaagaatggtgcacaaccagcttcaggntgtgactgggagaaaaagcagtgaggtataccttg

SEQ ID NO: 15424 - DNA, 71 bp, chicken (Gallus Gallus)
  misc_feature (36): n=c or t
actggatgagcattgtggtccttttcaaccctggcnattctatgaaagctttccaagattgaccaaccaag

SEQ ID NO: 15425 - DNA, 71 bp, chicken (Gallus Gallus)
  misc_feature (36): n=a or g
tgttttaggaacaaatatctccttttaaacagccangaacttaatgagctgagtgcaatctcccataaagc

SEQ ID NO: 15426 - DNA, 71 bp, chicken (Gallus Gallus)
  misc_feature (36): n=a or g
agagcaagggaaccacgaattcccatggcagccctnagacaacaagcctataatgcagcttcaggttttca

SEQ ID NO: 15427 - DNA, 71 bp, chicken (Gallus Gallus)
  misc_feature (36): n=a or t
gcctccaagtgcatctcagagcttggtattttcggngtctatgtcaggtgagtatcgtgcagtgtggggtg

SEQ ID NO: 15428 - DNA, 71 bp, chicken (Gallus Gallus)
  misc_feature (36): n=a or g
gcttgacccctctgtccatgtgacatctgtgtaacngagataacaatgctgctctgttgagcagagtcatt

SEQ ID NO: 15429 - DNA, 71 bp, chicken (Gallus Gallus)
  misc_feature (36): n=c or t
cttttcagttttcattgaagcatagtatgcagttangaatgtcagaaaactcaatactttaagtgtggggt

SEQ ID NO: 15430 - DNA, 71 bp, chicken (Gallus Gallus)
  misc_feature (36): n=c or t
cttttcctttttctttctaccatagctcttcagttnctaagctaagcaagcagagagtgctgcataaactt

SEQ ID NO: 15431 - DNA, 71 bp, chicken (Gallus Gallus)
  misc_feature (36): n=a or t
gaatgctcacagggagagcaggaagcaaagtcctanggatttcctctgtaaacctgggaattgagcagagg

SEQ ID NO: 15432 - DNA, 71 bp, chicken (Gallus Gallus)
  misc_feature (36): n=c or t
tgctttttcaaaaattgcttaggtttttattctaantattttgtgttgtccttttaaattgtttgttgtcc

SEQ ID NO: 15433 - DNA, 71 bp, chicken (Gallus Gallus)
  misc_feature (36): n=c or t
tgttttgtttgtttgtttgtttgtttttggtgcaangagaagagtaatttagaattttgaaatataggtac

SEQ ID NO: 15434 - DNA, 71 bp, chicken (Gallus Gallus)
  misc_feature (36): n=a or g
tggtagtttcaagctgtgctgtcggagggagcagcnctaaggaactgacatgcactttagatagctcgtgt

SEQ ID NO: 15435 - DNA, 71 bp, chicken (Gallus Gallus)
  misc_feature (36): n=a or c
ttacctaaaagtaaactaaaggcaggcatgctgacnccactgcactttgatgcattgaactaatgttggtg

SEQ ID NO: 15436 - DNA, 71 bp, chicken (Gallus Gallus)
  misc_feature (36): n=g or t
agtcatgtttttagtgatccaaaattcagatcaatntttacagttagtcttaatgtattccttaggaagtc

SEQ ID NO: 15437 - DNA, 71 bp, chicken (Gallus Gallus)
  misc_feature (36): n=a or g
taaggaaataaagtatctccattctctgcactgacnatcagcaaagttggagtcttttagatgtagttaga

SEQ ID NO: 15438 - DNA, 71 bp, chicken (Gallus Gallus)
  misc_feature (36): n=c or t
cccctggccattaccctcaacccacagggatgagcngggttgcagagcagagcgttgactctaaaccaagt

SEQ ID NO: 15439 - DNA, 71 bp, chicken (Gallus Gallus)
  misc_feature (36): n=a or g
cctgtgtgtactcctacagctgattaaagcacctgntaaggagtaccttcacacagaagatattatacctt

SEQ ID NO: 15440 - DNA, 71 bp, chicken (Gallus Gallus)
  misc_feature (36): n=a or g
gtgactccctatggatgctatggaaatatgaattantatttagcattctgttaattttacatggaaactag

SEQ ID NO: 15441 - DNA, 71 bp, chicken (Gallus Gallus)
  misc_feature (36): n=c or t
cctgaggagaagaagactgctccagtagcactgagntatacaaaaccttacccacagtcttaaagacaagt

SEQ ID NO: 15442 - DNA, 71 bp, chicken (Gallus Gallus)
  misc_feature (36): n=c or t
aaggacaagcagcacatcaagtctggtctcacatangatcatttctatgttatcaggctccctgtatcaag

SEQ ID NO: 15443 - DNA, 71 bp, chicken (Gallus Gallus)
  misc_feature (36): n=a or g
tttcccagctatttctctatataggtgctatttaancctttatttaggaagtattttggcctcttgaacat

SEQ ID NO: 15444 - DNA, 71 bp, chicken (Gallus Gallus)
  misc_feature (36): n=a or g
aattaaaaccattgcatgaaatttccagttaaaatntgacctgttttttgactcagtgcgagttttgtttt

SEQ ID NO: 15445 - DNA, 71 bp, chicken (Gallus Gallus)
  misc_feature (36): n=c or t
ccttggttttctcgtctaggtcattgagagctcttngtccattttgcatcaccatttccatgtgcttcgca

SEQ ID NO: 15446 - DNA, 71 bp, chicken (Gallus Gallus)
  misc_feature (36): n=a or g
agggatgggaacgtggatgcaactgcttgaaggatnagcggagcctctaggatggctgggaggggggcatt

SEQ ID NO: 15447 - DNA, 71 bp, chicken (Gallus Gallus)
  misc_feature (36): n=c or t
attagagaccagcccagctgttggcccgctggtttngggacaacctgaagatctgttgtctttgtctttga

SEQ ID NO: 15448 - DNA, 71 bp, chicken (Gallus Gallus)
  misc_feature (36): n=c or g
gggaaagtccatgaaaaattcatgttgattgatggnattagagtgacaacaggctcctacaggcaagtatt

SEQ ID NO: 15449 - DNA, 71 bp, chicken (Gallus Gallus)
  misc_feature (36): n=c or t
cactgggaatgcccagctgtgaatgttaccctttgncttaggcccaaagcctaacagacgttcaagaaacc

SEQ ID NO: 15450 - DNA, 71 bp, chicken (Gallus Gallus)
  misc_feature (36): n=c or t
tgcagcatgtggagtaatactttaaacaaccactcncaagctgcaaaggaaaatacggagttcattttgtt

SEQ ID NO: 15451 - DNA, 71 bp, chicken (Gallus Gallus)
  misc_feature (36): n=a or g
acaaatgcaacgttgtaatttgtggcagctggtgcnattgttattctcatggagctgtagctccttggttg

SEQ ID NO: 15452 - DNA, 71 bp, chicken (Gallus Gallus)
  misc_feature (36): n=c or t
gttagaatccttcactgtctgtggataactcagtancatggagaattgcaagtgaattttaagtgtgttga

SEQ ID NO: 15453 - DNA, 71 bp, chicken (Gallus Gallus)
  misc_feature (36): n=a or g
gttactttcctgtgctgtcttgaggtgtgtgtgttnaagttaccaaaccttttacttttaatccaaagctc

SEQ ID NO: 15454 - DNA, 71 bp, chicken (Gallus Gallus)
  misc_feature (36): n=a or t
gaatttaaatacaaagtaaccggaggcttgtaatgnaaacctgccctctccatgttgtgagcagggacagg

SEQ ID NO: 15455 - DNA, 71 bp, chicken (Gallus Gallus)
  misc_feature (36): n=a or g
tcctgttgatttcaagacctttggatctggcccagngggaaccaaatgtgattgtttttgcatgtgagaca

SEQ ID NO: 15456 - DNA, 71 bp, chicken (Gallus Gallus)
  misc_feature (36): n=a or g
tagctcagcagaaagtaattcttcctctgtgtgctntttttttggataggcctttaaaaaagtaaatttaa

SEQ ID NO: 15457 - DNA, 71 bp, chicken (Gallus Gallus)
  misc_feature (36): n=c or t
ttaaaatacagagttgtattaccagtgacctgtgcncagcaggcatttaaaatcccacagtcctgggcaga

SEQ ID NO: 15458 - DNA, 71 bp, chicken (Gallus Gallus)
  misc_feature (36): n=c or t
tatattttctttaaaccccagtttctgtattcacgntattaatgagatttttagctgtatcttaaataaat

SEQ ID NO: 15459 - DNA, 71 bp, chicken (Gallus Gallus)
  misc_feature (36): n=a or g
atcaaaccagagcaggagagcagagaatgtacaagnatccatcctgcagcctgccaagcaccttcctgctc

SEQ ID NO: 15460 - DNA, 71 bp, chicken (Gallus Gallus)
  misc_feature (36): n=a or g
gcaaaagactgcaagtctctcaaaattactcccttncaggcagcttgtccctgtcacaaaatccatgatgt

SEQ ID NO: 15461 - DNA, 71 bp, chicken (Gallus Gallus)
  misc_feature (36): n=a or t
aagcttgcttttaaaagctcagctcggcttctgacntatttctgtgttctagatctgagctttaacagcaa

SEQ ID NO: 15462 - DNA, 71 bp, chicken (Gallus Gallus)
  misc_feature (36): n=c or t
gtcctggttgcatctgtgaggacagtgtttaccttngtgttttctacagtttctgttgtgaaatagtaaag

SEQ ID NO: 15463 - DNA, 71 bp, chicken (Gallus Gallus)
  misc_feature (36): n=c or t
cattacacttcttgaaaacagagattttaggcagangtacattggtaattttgaaatatattcttctttca

SEQ ID NO: 15464 - DNA, 71 bp, chicken (Gallus Gallus)
  misc_feature (36): n=a or g
tgggatatctcagtacctggatgttcagatgccttnaacatgttgtagaggaaggaaaagaagagagtggg

SEQ ID NO: 15465 - DNA, 71 bp, chicken (Gallus Gallus)
  misc_feature (36): n=a or g
agctataactgaactagagagcaaactacagctacnttgtgctaagtccaaattagtggctgtgattttta

SEQ ID NO: 15466 - DNA, 71 bp, chicken (Gallus Gallus)
  misc_feature (36): n=c or t
cgtgtgctgaagcactgctgcctcctgtgccagcangcactgctcaaccaatggcagggatgaaatgggga

SEQ ID NO: 15467 - DNA, 71 bp, chicken (Gallus Gallus)
  misc_feature (36): n=a or g
tcacctcaggacagatgctctgtcccaggtctgcancaagagatacatgttaaagttattccacttctgaa

SEQ ID NO: 15468 - DNA, 71 bp, chicken (Gallus Gallus)
  misc_feature (36): n=a or g
ctggaactttattgaccaacagagctgcatttcacnttgttatatgtgaccaacaccaattggcatcttga

SEQ ID NO: 15469 - DNA, 71 bp, chicken (Gallus Gallus)
  misc_feature (36): n=c or t
gaaatgcggctcatgtaaaagcgatccaagaagtantgaatgttttgattggtgacaggatctactttaaa

SEQ ID NO: 15470 - DNA, 71 bp, chicken (Gallus Gallus)
  misc_feature (36): n=a or c
ttcatttgaagttgcttttcaactacctattattancagctgtcaggctcaggaattgtgcttctttgtgg

SEQ ID NO: 15471 - DNA, 71 bp, chicken (Gallus Gallus)
  misc_feature (36): n=a or t
aagtctagaaacaccatcagtggtatggtcagatanggcagtgcggtttaagaaatcttgttgggtctgat

SEQ ID NO: 15472 - DNA, 71 bp, chicken (Gallus Gallus)
  misc_feature (36): n=a or c
tagggagatccggcatcaaacctgatgcataaaagnttacaatctagttttcagctttcaagtcagaaaga

SEQ ID NO: 15473 - DNA, 71 bp, chicken (Gallus Gallus)
  misc_feature (36): n=c or t
atggacgggcattgatttgctctgccttccctagcntcaactgaaaaagttattagtctctactttaaacg

SEQ ID NO: 15474 - DNA, 71 bp, chicken (Gallus Gallus)
  misc_feature (36): n=a or c
gtcttaaatacccaaacctacaaagcttcacattcnagtttcattttgagcacatgatccatcctatggag

SEQ ID NO: 15475 - DNA, 71 bp, chicken (Gallus Gallus)
  misc_feature (36): n=c or g
gcccttaaatgccccttccaactgaaaagattctanaattctaagaggagggaaaattagatctgattaca

SEQ ID NO: 15476 - DNA, 71 bp, chicken (Gallus Gallus)
  misc_feature (36): n=g or t
atttttttcagtgtgaaacatcacctgagctgttangacctgctggagcattccctctcgtgttggccagt

SEQ ID NO: 15477 - DNA, 71 bp, chicken (Gallus Gallus)
  misc_feature (36): n=c or t
ttctcgtgcccttcggtgtctttttgcatacctacnccctgctcagcatctccatcaggagatgtatgggc

SEQ ID NO: 15478 - DNA, 71 bp, chicken (Gallus Gallus)
  misc_feature (36): n=c or t
tgcataccccagtttgggttcatgaaaggggaaaangattggcaaaagtaggactttcacatcgctgtgca

SEQ ID NO: 15479 - DNA, 71 bp, chicken (Gallus Gallus)
  misc_feature (36): n=c or t
gggttccctctagagtcagatggaaagagggcatcnctcagtgacagatgaagctgctggcagacagttac

SEQ ID NO: 15480 - DNA, 71 bp, chicken (Gallus Gallus)
  misc_feature (36): n=a or g
agcaccaaagcagaagaagttgccacgttctttgcnaaaatgctcgaccatgaatacactacgaaggagat

SEQ ID NO: 15481 - DNA, 71 bp, chicken (Gallus Gallus)
  misc_feature (36): n=a or g
gtttttaagaatcttcagctgttcatggagaacaancagcctgaggatgacctttttgaccgcctcaatgt

SEQ ID NO: 15482 - DNA, 71 bp, chicken (Gallus Gallus)
  misc_feature (36): n=c or t
agcatttctgcagcagctggggaaatacgcaaggcngtttaggctttgcttttgctgatgcctgtattcat

SEQ ID NO: 15483 - DNA, 71 bp, chicken (Gallus Gallus)
  misc_feature (36): n=c or t
actgctgacagccatcagaattttgctctatccttncagctgatagatgtgaacagtggagctgatctcat

SEQ ID NO: 15484 - DNA, 71 bp, chicken (Gallus Gallus)
  misc_feature (36): n=a or g
gtactgagtgtggacataaagagaagggaatggaanagaggggaggagatcagagggaaatggagggaaaa

SEQ ID NO: 15485 - DNA, 71 bp, chicken (Gallus Gallus)
  misc_feature (36): n=a or g
accccatctgcagtatcctagtggttcagctgctcngcactctgactgctggtggagctaaattaagccct

SEQ ID NO: 15486 - DNA, 71 bp, chicken (Gallus Gallus)
  misc_feature (36): n=a or c
atgtatagcatctgcctcactctcagccagcagcanctgagtgctgggaacattctttctaggctttcata

SEQ ID NO: 15487 - DNA, 71 bp, chicken (Gallus Gallus)
  misc_feature (36): n=c or t
gctggcttcaaacctagaaggggttagagatacagnttaagtaagttctaaagccatagaagaacaaatcc

SEQ ID NO: 15488 - DNA, 71 bp, chicken (Gallus Gallus)
  misc_feature (36): n=a or g
ataatagtacgttccttggtatgggaatccaccacntcctccctcccaccctgctgacaagccagtgacac

SEQ ID NO: 15489 - DNA, 71 bp, chicken (Gallus Gallus)
  misc_feature (36): n=a or g
agtaaaatgcagtgaaaattctgaaaatgcatcctntgcatttttcttgtccagatacagagcccagtgct

SEQ ID NO: 15490 - DNA, 71 bp, chicken (Gallus Gallus)
  misc_feature (36): n=c or t
gaagcagaggttttgggggggtctgccttccctgtntgtttctctgtttgtgtccttccctacagcacagg

SEQ ID NO: 15491 - DNA, 71 bp, chicken (Gallus Gallus)
  misc_feature (36): n=a or g
cttagaaaaactgtgcttgattgcctgcttcagccnttctgcgctcttcctgacttgacataatctttagg

SEQ ID NO: 15492 - DNA, 71 bp, chicken (Gallus Gallus)
  misc_feature (36): n=c or t
gaggctaagcatcctcaggcctggaaccaaaggcancagcacccaaaacacggctgtgagcaactcatggg

SEQ ID NO: 15493 - DNA, 71 bp, chicken (Gallus Gallus)
  misc_feature (36): n=a or t
aatgaagtgatcgtatcatgtccaacctgtgaaagnagtttgtggaaaaacatgaatccctggaccagggt

SEQ ID NO: 15494 - DNA, 71 bp, chicken (Gallus Gallus)
  misc_feature (36): n=g or t
atggagcgtattctagtggaaaatgtaaagcaagtntagctctttattgaatgtccagcaggccttggagg

SEQ ID NO: 15495 - DNA, 71 bp, chicken (Gallus Gallus)
  misc_feature (36): n=a or g
ttcaaaaaaatgcctgtcttgcccaaaaccccacantatataatggcacaatgctctagaccaactgttta

SEQ ID NO: 15496 - DNA, 71 bp, chicken (Gallus Gallus)
  misc_feature (36): n=a or t
cattaggtaccaggataaatgttttttatttcatgngggaagaaagaactcatctcttttaaatccttgaa

SEQ ID NO: 15497 - DNA, 71 bp, chicken (Gallus Gallus)
  misc_feature (36): n=a or c
ggggctgcaaggctacagctgtgttagtgcaagtanaccactcctcaacagtgagttactaatgcagaagg

SEQ ID NO: 15498 - DNA, 71 bp, chicken (Gallus Gallus)
  misc_feature (36): n=a or g
acatgctctgttgagcttcatacatctaaggaattngtcttgatccagaaagtgggccacctaaacttcat

SEQ ID NO: 15499 - DNA, 71 bp, chicken (Gallus Gallus)
  misc_feature (36): n=c or g
aattactgcagtaacagccccaagcactgcagtatntactgaggattggcatactcactgctcacgattca

SEQ ID NO: 15500 - DNA, 71 bp, chicken (Gallus Gallus)
  misc_feature (36): n=a or g
aaatggccgtcacatctactgaccatgtggtgtacntgtctgcctgcttgtattggagaaactattggact

SEQ ID NO: 15501 - DNA, 71 bp, chicken (Gallus Gallus)
  misc_feature (36): n=c or t
aggttggtatccatcctccaaacccaagttaaacanggccccgttcagctcaacagatacagagcgggtag

SEQ ID NO: 15502 - DNA, 71 bp, chicken (Gallus Gallus)
  misc_feature (36): n=g or t
taaggcttaagttcactacatgcttcattctctcanataagattcccagagggcaggtacatgccgtattt

SEQ ID NO: 15503 - DNA, 71 bp, chicken (Gallus Gallus)
  misc_feature (36): n=a or g
acagtgtgtgctttgcaggttgatttctttggcatnccaactgttaagaggtagcccgcgtttgtcactca

SEQ ID NO: 15504 - DNA, 71 bp, chicken (Gallus Gallus)
  misc_feature (36): n=a or g
tagaagcaaaaactgatttagctacaaagactgganttcatctaagttttagacagtgatttaaatattta

SEQ ID NO: 15505 - DNA, 71 bp, chicken (Gallus Gallus)
  misc_feature (36): n=a or g
gcttctctgcagcaaaaacgtgttgaagctttgacntgagaaggaaacatgcttagaaataatttacacca

SEQ ID NO: 15506 - DNA, 71 bp, chicken (Gallus Gallus)
  misc_feature (36): n=a or c
tgctgcaggtgaagtttggggttatgcaggcaaggntactgtgtggaaaggagaacactgatgcaaaaagc

SEQ ID NO: 15507 - DNA, 71 bp, chicken (Gallus Gallus)
  misc_feature (36): n=c or t
aagaaaaaaaaaaaaaagagggtagttttggactgnagttccctttgggaaaggactgcattttggtagta

SEQ ID NO: 15508 - DNA, 71 bp, chicken (Gallus Gallus)
  misc_feature (36): n=a or g
tgtcaaaggtgggttccaaactttgtcatctttacnaagggctcagagacccccagcaagctgctctggat

SEQ ID NO: 15509 - DNA, 71 bp, chicken (Gallus Gallus)
  misc_feature (36): n=c or t
acttatgcagcacatgctcttgaaaggctgtttacnatgagagggacgaacaatacgacactgtaagtttt

SEQ ID NO: 15510 - DNA, 71 bp, chicken (Gallus Gallus)
  misc_feature (36): n=a or t
gaatgctgttcagtgaggcaagatcgctgcaggatntggcagtgtaagatcctaagattccattacatgtg

SEQ ID NO: 15511 - DNA, 71 bp, chicken (Gallus Gallus)
  misc_feature (36): n=c or t
tataaacctattgatccttatacagggatgagatcnacttacaactatacaatgagaggtggtacttatcc

SEQ ID NO: 15512 - DNA, 71 bp, chicken (Gallus Gallus)
  misc_feature (36): n=c or t
gaggatttaaaaactcctctgttttattcctgagcncgctttgattcggtgtctgtaacaagtaacttaag

SEQ ID NO: 15513 - DNA, 71 bp, chicken (Gallus Gallus)
  misc_feature (36): n=c or t
agtaagcagctagcacttaaatgtttccagaattantgatttctgagttaaattgctggatcccaaataat

SEQ ID NO: 15514 - DNA, 71 bp, chicken (Gallus Gallus)
  misc_feature (36): n=a or t
tctgtctctcattcttggtaactagttgtcctatcngcgtatcagcaccacctgatagaaaaatacaccct

SEQ ID NO: 15515 - DNA, 71 bp, chicken (Gallus Gallus)
  misc_feature (36): n=c or t
taaagaaatattaaatgcttatgtaattctacttanctgtatattttagtacagtagaatgatctgtgtgt

SEQ ID NO: 15516 - DNA, 71 bp, chicken (Gallus Gallus)
  misc_feature (36): n=a or g
gctaaaagaaagacgatatagcccaaaagaatcctntgctcagtggaagctgaacccagatctgtttgggg

SEQ ID NO: 15517 - DNA, 71 bp, chicken (Gallus Gallus)
  misc_feature (36): n=c or t
aatgtgattgcaattatttagaaaaaaagggttacncacattttgttacctaagatttaatgtctcagaac

SEQ ID NO: 15518 - DNA, 71 bp, chicken (Gallus Gallus)
  misc_feature (36): n=a or g
gttagagtcagaccttaaatcattgttagataacangccatgctggcttcattatttcatttaatgacaca

SEQ ID NO: 15519 - DNA, 71 bp, chicken (Gallus Gallus)
  misc_feature (36): n=a or g
aagggaactgagcaccaaattatttaagaacagggngcctgcaattgtgacagcttttttttttttttctc

SEQ ID NO: 15520 - DNA, 71 bp, chicken (Gallus Gallus)
  misc_feature (36): n=a or g
tcctcagacacagcagatggctgactcaagcctgcnctcttatgcccaaaagtatgtacatagattaattc

SEQ ID NO: 15521 - DNA, 71 bp, chicken (Gallus Gallus)
  misc_feature (36): n=c or g
taaattgccaatatctctatcaaaatacagcctganatacagaataaccgaagtttcatgcctagatttgt

SEQ ID NO: 15522 - DNA, 71 bp, chicken (Gallus Gallus)
  misc_feature (36): n=a or g
tagaagtatgataaattttgaaatactggcagtgcnacaattcccttaattacaagttgaaaaaatgaagg

SEQ ID NO: 15523 - DNA, 71 bp, chicken (Gallus Gallus)
  misc_feature (36): n=a or g
aatgtaatggtactgagttccaagcatcctgggctnacgtattatcatttgcaaaagatcatagatgggtc

SEQ ID NO: 15524 - DNA, 71 bp, chicken (Gallus Gallus)
  misc_feature (36): n=c or t
taaaccaatgactgagatagtatcagatactgctanatttactgttcccacagtgaattttcagggccagt

SEQ ID NO: 15525 - DNA, 71 bp, chicken (Gallus Gallus)
  misc_feature (36): n=a or g
aataacactgcctgtaggacaaatctcctcgctggncgtccacagcagaagtccagtcaaagtattgaaaa

SEQ ID NO: 15526 - DNA, 71 bp, chicken (Gallus Gallus)
  misc_feature (36): n=a or g
gcattaaatactagcaagaattttcttcagctaatnctcctattctttaagaatgtttttgatgctcctat

SEQ ID NO: 15527 - DNA, 71 bp, chicken (Gallus Gallus)
  misc_feature (36): n=a or g
aagttcaaattttattggtgagactgtgtcaactgncagttggtgttaatggcattgtttttccagcctag

SEQ ID NO: 15528 - DNA, 71 bp, chicken (Gallus Gallus)
  misc_feature (36): n=c or t
ctgcaaacaaagacgattaggagggcaagagccatncttacaattgtagtttaagttggtcttcaagattt

SEQ ID NO: 15529 - DNA, 71 bp, chicken (Gallus Gallus)
  misc_feature (36): n=a or g
cgtgataagcatgccagtgagtctgacagcagtatngtttaaagggtctattgagtgaaacttgactgtta

SEQ ID NO: 15530 - DNA, 71 bp, chicken (Gallus Gallus)
  misc_feature (36): n=c or t
cgtacagtgagaactgttgtctttatgtacctgtanggagccaaaatatgattcccagaatctaaaattaa

SEQ ID NO: 15531 - DNA, 71 bp, chicken (Gallus Gallus)
  misc_feature (36): n=a or g
tagtataaaagaatgaaatggcaacaaattgtcttntaacttgacatgtgataaagtgctgtacacgtttg

SEQ ID NO: 15532 - DNA, 71 bp, chicken (Gallus Gallus)
  misc_feature (36): n=a or g
attgttagaacaacgtagtattctgactaaggaagnaaaatccatgcctcatgaaacaacaaataggatca

SEQ ID NO: 15533 - DNA, 71 bp, chicken (Gallus Gallus)
  misc_feature (36): n=a or g
tagtgcatactgaggccagaaggaactggtggggcncacagtggctttctgtagatcacaggctgtaggat

SEQ ID NO: 15534 - DNA, 71 bp, chicken (Gallus Gallus)
  misc_feature (36): n=c or t
tggtcacctcgtgtgttcttgtggtggagaccctcntggacctctcgctttcaagagaacacttggatgga

SEQ ID NO: 15535 - DNA, 71 bp, chicken (Gallus Gallus)
  misc_feature (36): n=c or t
agtgctgtagtaataataattaaaatgcatactacngcaggtaactcccaaaacttgcgctttgctctgaa

SEQ ID NO: 15536 - DNA, 71 bp, chicken (Gallus Gallus)
  misc_feature (36): n=c or t
ctgagggcagtcatcattgtttgtgcctcactcacngccactcacaatggaggagcactcgcgtgcatctg

SEQ ID NO: 15537 - DNA, 71 bp, chicken (Gallus Gallus)
  misc_feature (36): n=c or t
atggaacaccaggctgatttagtgctgtgcagcctncagcgcctctttagagctcccaaatcatacagtac

SEQ ID NO: 15538 - DNA, 71 bp, chicken (Gallus Gallus)
  misc_feature (36): n=c or t
ccagaagagcaaacaagtgcaagccaaaattctatnctttcttgtgtgtgcatttgtgctcacgttaatgc

SEQ ID NO: 15539 - DNA, 71 bp, chicken (Gallus Gallus)
  misc_feature (36): n=a or g
agttaggagaagagcaacgcaataaaaaactgtgangagtgaagacaatagaattcaagaaaaactacatg

SEQ ID NO: 15540 - DNA, 71 bp, chicken (Gallus Gallus)
  misc_feature (36): n=g or t
tgaagcaacctacatagaaaatgtcattccaagcanaacagctcatgcaattcagcatcccctcatgatgc

SEQ ID NO: 15541 - DNA, 71 bp, chicken (Gallus Gallus)
  misc_feature (36): n=a or g
accagcatcattcagcatctcacattctgttcaccnttactcactgttcactgttgaagcagtacggatca

SEQ ID NO: 15542 - DNA, 71 bp, chicken (Gallus Gallus)
  misc_feature (36): n=c or t
tgttactgtgctctatgtatcagttgtattctccanggaaataaataggatacattacttctgaaacaact

SEQ ID NO: 15543 - DNA, 71 bp, chicken (Gallus Gallus)
  misc_feature (36): n=a or g
taagggattatttggcaacccttgataatagatcanccctttcaggctgcactcctgattttttttctagg

SEQ ID NO: 15544 - DNA, 71 bp, chicken (Gallus Gallus)
  misc_feature (36): n=c or t
gaaatcacattctgggggggaaccttcatgattttncagctcttgcaggtggtggtggggatgtggcgacc

SEQ ID NO: 15545 - DNA, 71 bp, chicken (Gallus Gallus)
  misc_feature (36): n=a or g
aaagactattaaatgagctatcaaagtattgccagntattaagagttatttctctgtaaatcacttcctca

SEQ ID NO: 15546 - DNA, 71 bp, chicken (Gallus Gallus)
  misc_feature (36): n=g or t
atactgactgatgtgtgatttccgtagtggaagtgnaatagatttttgtcccgatggctgaaatcactgca

SEQ ID NO: 15547 - DNA, 71 bp, chicken (Gallus Gallus)
  misc_feature (36): n=a or g
caggtcactaaatgcagacaagaaaacgcactgttngaaaacacagcatgagctcagctgcccttaaggtg

SEQ ID NO: 15548 - DNA, 71 bp, chicken (Gallus Gallus)
  misc_feature (36): n=c or g
acctgttgtgtacataatgtaattattggtaaactntggctagaacaatatggaacggtagaaattgtgaa

SEQ ID NO: 15549 - DNA, 71 bp, chicken (Gallus Gallus)
  misc_feature (36): n=c or t
agcacagcccagccagaagccagctgctaaggtcangtcagaaatagggccaaaatctggaattctcttca

SEQ ID NO: 15550 - DNA, 71 bp, chicken (Gallus Gallus)
  misc_feature (36): n=c or t
tgctctggccgtgaggggctctgctccctgcagtgngccagtgcgaccaagtgagaacaagaatccttttt

SEQ ID NO: 15551 - DNA, 71 bp, chicken (Gallus Gallus)
  misc_feature (36): n=a or g
gaatggggtttgtttgatattggaatgctatcttcngtttctcattctcaaagcaacgttaacatcttttc

SEQ ID NO: 15552 - DNA, 71 bp, chicken (Gallus Gallus)
  misc_feature (36): n=a or g
acccctagtgagaaggatgagatctctttcagaaanacgtccaaccatgcctgaaaggctctctatgaagg

SEQ ID NO: 15553 - DNA, 71 bp, chicken (Gallus Gallus)
  misc_feature (36): n=c or t
atctttagtaattaaaatatcaggaacacacagatntttctaaaataagagcttaaaaaaaatcagtaggt

SEQ ID NO: 15554 - DNA, 71 bp, chicken (Gallus Gallus)
  misc_feature (36): n=c or t
caaccaagtatatccatttttgattactttgtcatngcagtgtttacataaatgtgcaaaccacaggccag

SEQ ID NO: 15555 - DNA, 71 bp, chicken (Gallus Gallus)
  misc_feature (36): n=a or g
gcaatgtgcaacgcagactgcggctgcctgcagganacctacagccccgtctgtggaagcaatgatgttat

SEQ ID NO: 15556 - DNA, 71 bp, chicken (Gallus Gallus)
  misc_feature (36): n=c or t
aataggtattcacaaaatgagtacccatttcctcangaatttttgctctttcaagacaaatttcttatggt

SEQ ID NO: 15557 - DNA, 71 bp, chicken (Gallus Gallus)
  misc_feature (36): n=c or t
cttttcttttttttttttttccagctgtagcagccnggtgtgctttggatttaactgcatgggagaagtcc

SEQ ID NO: 15558 - DNA, 71 bp, chicken (Gallus Gallus)
  misc_feature (36): n=a or g
ctcccaacaagttcaacctctgtttaacgttgcctnacagtcccatgcggatgctctacatgggagtatcc

SEQ ID NO: 15559 - DNA, 71 bp, chicken (Gallus Gallus)
  misc_feature (36): n=c or t
cgggttaactcctacgtactgctggcagcccttctntctacaagggtatgtatgatttgtgctgggcccca

SEQ ID NO: 15560 - DNA, 71 bp, chicken (Gallus Gallus)
  misc_feature (36): n=g or t
gccaaagtgtgcagaaacggaataaatctcagcacnactcaatgaggtgctaaaggcttaagcagattggt

SEQ ID NO: 15561 - DNA, 71 bp, chicken (Gallus Gallus)
  misc_feature (36): n=a or g
ttcaatggagttttcataccttactcagtattctcntgaagttctgttggaaagaagtggtccagtagcaa

SEQ ID NO: 15562 - DNA, 71 bp, chicken (Gallus Gallus)
  misc_feature (36): n=c or t
ttttctcctcctctttcttttgcatgacccacttcntcctggcactgatttttccaacacagatgtaattt

SEQ ID NO: 15563 - DNA, 71 bp, chicken (Gallus Gallus)
  misc_feature (36): n=c or t
gttaggttaggaacttctgaagtaagcaatcctcanttggaaaatacttaagcctttaaggctacctgtaa

SEQ ID NO: 15564 - DNA, 71 bp, chicken (Gallus Gallus)
  misc_feature (36): n=c or t
cttgtaggaactgcagcttgtagggtaatgggaaangcactgctccctgggaagcggctgctgtcttggca

SEQ ID NO: 15565 - DNA, 71 bp, chicken (Gallus Gallus)
  misc_feature (36): n=a or g
ttcatcagcactgcactaaaaatcttgcatcctgcnctcttcttatgtccagcctgtctccccagagttcc

SEQ ID NO: 15566 - DNA, 71 bp, chicken (Gallus Gallus)
  misc_feature (36): n=c or t
aattgcaggggttggaagggacctcaagagatcatngagtccagccccctaatgatacagttctgaatggg

SEQ ID NO: 15567 - DNA, 71 bp, chicken (Gallus Gallus)
  misc_feature (36): n=a or g
cgctctcctcctgcaccatgtttgttgtgtaccagncgtcgcctcatcgctttcaaatcaaacaccgcctt

SEQ ID NO: 15568 - DNA, 71 bp, chicken (Gallus Gallus)
  misc_feature (36): n=a or g
cgtttttagctgggctaaagagaaagctaccgtatnacggagtggttacagagctgccttgggatcgatgt

SEQ ID NO: 15569 - DNA, 71 bp, chicken (Gallus Gallus)
  misc_feature (36): n=a or g
atttcattgcaacactttctgctccttccacctgcnttaaaagaaacgttgaaatgaatgtggagagcact

SEQ ID NO: 15570 - DNA, 71 bp, chicken (Gallus Gallus)
  misc_feature (36): n=c or t
gacttctgccactgctggcagtgcttacactgactngagaaacgcaacagccttgctctcttggctggagc

SEQ ID NO: 15571 - DNA, 71 bp, chicken (Gallus Gallus)
  misc_feature (36): n=a or g
atggcacaggcacaacctttccatcctctctgctgnagctgggctaacttagcccaaaaccatctcccaca

SEQ ID NO: 15572 - DNA, 71 bp, chicken (Gallus Gallus)
  misc_feature (36): n=a or g
tggttcctatcacccacctcaggataagagaggttntcctctaatattgcacgtctcttcgtctacaagtg

SEQ ID NO: 15573 - DNA, 71 bp, chicken (Gallus Gallus)
  misc_feature (36): n=c or t
gagacagacaagtcctgtacccacagactgtactgngtgccgtggggacagccctactgatggcttttgtt

SEQ ID NO: 15574 - DNA, 71 bp, chicken (Gallus Gallus)
  misc_feature (36): n=c or t
ggttcccagtttcagtgtgacacgtctgcaatgacngatattgtcctgcttgtggatggatcatggagcat

SEQ ID NO: 15575 - DNA, 71 bp, chicken (Gallus Gallus)
  misc_feature (36): n=a or g
ggcatggctggagccaatgaggaagggatccaaggncccagaggaagaacaggtaaatactacctctctgt

SEQ ID NO: 15576 - DNA, 71 bp, chicken (Gallus Gallus)
  misc_feature (36): n=a or g
cccatctcaccttgagcatggagcagagtcaaaaancaaaactacttagaaagagtggtgcagatttgcaa

SEQ ID NO: 15577 - DNA, 71 bp, chicken (Gallus Gallus)
  misc_feature (36): n=c or t
ccattgtcctccctcacccaatacttcatcagtgtncgatctatgtacgatgagggtgactcctttccaat

SEQ ID NO: 15578 - DNA, 71 bp, chicken (Gallus Gallus)
  misc_feature (36): n=c or t
catttataactgcctgatgagaaactgttgaccagngggctcatgttccaccagcagaaagtgctctcggc

SEQ ID NO: 15579 - DNA, 71 bp, chicken (Gallus Gallus)
  misc_feature (36): n=c or t
gcttccccatcacccccaacccgctgtgacagcagntaaagacctcggacatctgaagacatcaccaagtc

SEQ ID NO: 15580 - DNA, 71 bp, chicken (Gallus Gallus)
  misc_feature (36): n=c or t
tccaaaacaacaggaaagaggattcatttacacaanaaacccaaaccacacaattgaaaacctcttctctg

SEQ ID NO: 15581 - DNA, 71 bp, chicken (Gallus Gallus)
  misc_feature (36): n=a or c
cacggatacctcattggtttgtaatgacagctctanggggagttagtgctgggagccccatcccagctcac

SEQ ID NO: 15582 - DNA, 71 bp, chicken (Gallus Gallus)
  misc_feature (36): n=c or t
cgcacccatctgcccatagctgagagctccgggtgnttttcgtcttctgttccttggattccaaatggaat

SEQ ID NO: 15583 - DNA, 71 bp, chicken (Gallus Gallus)
  misc_feature (36): n=a or g
gttttccaagagaagaaaaagcagtaaaaggtgcanaatgcccccccacccacttccctctccctgcccaa

SEQ ID NO: 15584 - DNA, 71 bp, chicken (Gallus Gallus)
  misc_feature (36): n=a or g
aataaaatattccatgcctggggctccttcttaatngagacataaagatggctttgacattcccagaaccg

SEQ ID NO: 15585 - DNA, 71 bp, chicken (Gallus Gallus)
  misc_feature (36): n=a or g
catataccaaaacaaacattttgacttcagaatacnaagttctcatgcttgggagtatttttttgcttggg

SEQ ID NO: 15586 - DNA, 71 bp, chicken (Gallus Gallus)
  misc_feature (36): n=c or t
atctgtacatgattgtcattaggaagtgttctctantgtacgctaattacttctctggtgtctttttttca

SEQ ID NO: 15587 - DNA, 71 bp, chicken (Gallus Gallus)
  misc_feature (36): n=a or g
cagctataagttagatacttggtactgaaagttgcnatgtgtgtacagggcgttagttctgctgttgggtc

SEQ ID NO: 15588 - DNA, 71 bp, chicken (Gallus Gallus)
  misc_feature (36): n=a or t
gttaggtggcatttaagtcgcattacccatactaanacatgcacctcgcagagggcctgcctctgctcccc

SEQ ID NO: 15589 - DNA, 71 bp, chicken (Gallus Gallus)
  misc_feature (36): n=a or c
ccgagggacgtggtcagttggcactgtgtgctgggngtcctgaaggtcttcattaacaatggtatggttct

SEQ ID NO: 15590 - DNA, 71 bp, chicken (Gallus Gallus)
  misc_feature (36): n=g or t
ttttcagaagagtggtctttgacataaaaataacangtaaagcaatcaccaaagcattatttttaaatggt

SEQ ID NO: 15591 - DNA, 71 bp, chicken (Gallus Gallus)
  misc_feature (36): n=c or t
tttatctcggtattttatactgtctgacaccgtggntcatctcaccttcaagttcctagtggaactttaat

SEQ ID NO: 15592 - DNA, 71 bp, chicken (Gallus Gallus)
  misc_feature (36): n=c or g
gctgttgctttgagcccccgtttctgccgctgtgcnttcgtttaatggtgtcagctgttcttacggtccgg

SEQ ID NO: 15593 - DNA, 71 bp, chicken (Gallus Gallus)
  misc_feature (36): n=c or t
gggaaatcttcttttctctgtgaaaaagaaaggtanaacttaaacttctcagggacatgaggagctttgga

SEQ ID NO: 15594 - DNA, 71 bp, chicken (Gallus Gallus)
  misc_feature (36): n=a or g
gtgctgcagcaatggctgcggccacgtctgcacacngatacataacggtgaggatgctaagggacaggacc

SEQ ID NO: 15595 - DNA, 71 bp, chicken (Gallus Gallus)
  misc_feature (36): n=c or t
gaagtaatgtgacaggagattttatgtgcttcatcntggggaggcgctccgctcccctccctgctgtctga

SEQ ID NO: 15596 - DNA, 71 bp, chicken (Gallus Gallus)
  misc_feature (36): n=a or g
actggatcacgtagcagggagtagtcgatcccaatntgctcgtctacgtagttccttactgccagggaaga

SEQ ID NO: 15597 - DNA, 71 bp, chicken (Gallus Gallus)
  misc_feature (36): n=a or g
gtaaatattgtctcaggtaccataggacaggtagtntgtgtcaaagcagtatgaaaataccataaactcaa

SEQ ID NO: 15598 - DNA, 71 bp, chicken (Gallus Gallus)
  misc_feature (36): n=a or g
cttcccagagaagcaccattaggaaggagatctgcnttatgcagctgccagacagcccaacacaacccctg

SEQ ID NO: 15599 - DNA, 71 bp, chicken (Gallus Gallus)
  misc_feature (36): n=a or g
ggactgaggcggtctcccagcaggtgtgtggcaagnaataaaacacagatttcctgtggaaagaaaaaaca

SEQ ID NO: 15600 - DNA, 71 bp, chicken (Gallus Gallus)
  misc_feature (36): n=a or g
ctgtccaccacagaagaaatctctgctaacagaccncaaacaaagagcagagccagtaacttttcaatacc

SEQ ID NO: 15601 - DNA, 71 bp, chicken (Gallus Gallus)
  misc_feature (36): n=c or t
gccctgctcggtactgttgttaaagatttggatagngggcaaagggcactctcagtaaatccatggatgac

SEQ ID NO: 15602 - DNA, 71 bp, chicken (Gallus Gallus)
  misc_feature (36): n=a or g
gaatagtgagtcccagctgccttgagcagtgctganagtgaacctccgagaggttaagaagtgaaccagac

SEQ ID NO: 15603 - DNA, 71 bp, chicken (Gallus Gallus)
  misc_feature (36): n=a or g
cctgaaataatttgttactggcacatgattcaaaangagctggctgggagcaatgacacaatagccttgtg

SEQ ID NO: 15604 - DNA, 71 bp, chicken (Gallus Gallus)
  misc_feature (36): n=g or t
ccaggagagtgctagagtgaaatcccagttccagtncagttaactataatgcccgtagtgtgaaatgctcc

SEQ ID NO: 15605 - DNA, 71 bp, chicken (Gallus Gallus)
  misc_feature (36): n=c or t
tttctaagtgaacagtattaataacttcatactgcngtgttctgtgtgtctattctgtactgttcagagta

SEQ ID NO: 15606 - DNA, 71 bp, chicken (Gallus Gallus)
  misc_feature (36): n=c or t
caacgaatggattcaaagcaatctgttactgtaaangctctcaaaatatagcagcaggaatattgattttg

SEQ ID NO: 15607 - DNA, 71 bp, chicken (Gallus Gallus)
  misc_feature (36): n=c or t
ctgggggaatctgtgctcctcggctcccaatgctangaagttgcttctgtgacttacctgagagatttctt

SEQ ID NO: 15608 - DNA, 71 bp, chicken (Gallus Gallus)
  misc_feature (36): n=c or t
atatagtcgttaacttaatcatgctctggaagtgangtgttacatgaacacaacattttgttgtcctttaa

SEQ ID NO: 15609 - DNA, 71 bp, chicken (Gallus Gallus)
  misc_feature (36): n=a or g
tctgcaaaattgtaatttctgattaaaaaaatgcantgcttgaaagtgacttccaatgtttgttcagcctt

SEQ ID NO: 15610 - DNA, 71 bp, chicken (Gallus Gallus)
  misc_feature (36): n=c or t
tggatttctcattcttcaggcatgcatacacaaganatcatgccagtttaccttctttgctctaagaacag

SEQ ID NO: 15611 - DNA, 71 bp, chicken (Gallus Gallus)
  misc_feature (36): n=a or t
agcaaataatacaggttgctctctaacaagtcttcnccaggattactagtttattcgatattaacaatgaa

SEQ ID NO: 15612 - DNA, 71 bp, chicken (Gallus Gallus)
  misc_feature (36): n=a or g
aaagtagcattaaatgctaaaaaactattacttgcntctatgaaaaatatgagaaaagagaaccttttctt

SEQ ID NO: 15613 - DNA, 71 bp, chicken (Gallus Gallus)
  misc_feature (36): n=a or g
ctctaaacttcatgtgcaacctcctaagatacacantgccctccagaatattcacctcctacaaataccga

SEQ ID NO: 15614 - DNA, 71 bp, chicken (Gallus Gallus)
  misc_feature (36): n=c or g
acaggaaagttctcccagggagagacagcagaatgnttaaagtgaggaatgccttgatgggacgctggtgg

SEQ ID NO: 15615 - DNA, 71 bp, chicken (Gallus Gallus)
  misc_feature (36): n=a or c
tgcattcaactcagataacaatctcatcattagaanagcctagcttctttgtttgaagttaatcactctca

SEQ ID NO: 15616 - DNA, 71 bp, chicken (Gallus Gallus)
  misc_feature (36): n=c or g
tcttgagagccctaacaaactataaaacctttgcanagaagaaaacacacagaaacccaatccccaggtcc

SEQ ID NO: 15617 - DNA, 71 bp, chicken (Gallus Gallus)
  misc_feature (36): n=a or c
cgacctaccagcagcaccacgaccgccagaggcagnagtatgtggttctgtttgctgtgatcgtctacaaa

SEQ ID NO: 15618 - DNA, 71 bp, chicken (Gallus Gallus)
  misc_feature (36): n=a or g
gggttaaaaaaaaaagaaaaaagaaaaaaagaacanaagagcttcgtttgtttctcagtgctcaggctggc

SEQ ID NO: 15619 - DNA, 71 bp, chicken (Gallus Gallus)
  misc_feature (36): n=c or t
gtgctgtattccatttagtaacctacataaatgttnatatttgtaagagagcacatcagtaaatgctggat

SEQ ID NO: 15620 - DNA, 71 bp, chicken (Gallus Gallus)
  misc_feature (36): n=c or t
gcagggccctgcctccctgctgcaggatgaaagtanagtgatgctgatagaagttctgcataccctggggc

SEQ ID NO: 15621 - DNA, 71 bp, chicken (Gallus Gallus)
  misc_feature (36): n=a or g
tttcctgtaaggatgatctcctccatgcttctgccnttctttgcccgcctgcagagattcctaattcaaag

SEQ ID NO: 15622 - DNA, 71 bp, chicken (Gallus Gallus)
  misc_feature (36): n=g or t
aggcacccagcttgccttaccttgctactaagactnacacatccatatggttcagcttggttttcaaagat

SEQ ID NO: 15623 - DNA, 71 bp, chicken (Gallus Gallus)
  misc_feature (36): n=c or t
ctgcaactgacatcagacactgtgatctagatgttngagtcccctacagagacagcaaagttacaaacatt

SEQ ID NO: 15624 - DNA, 71 bp, chicken (Gallus Gallus)
  misc_feature (36): n=a or g
acctcattctagactcagtatcccctagttgtgaanaatacatgggttaactggacaaaggcatggcaaat

SEQ ID NO: 15625 - DNA, 71 bp, chicken (Gallus Gallus)
  misc_feature (36): n=g or t
gttgtattttgacatggcaggagggagactggattntctgatagcatccttttgattgtgagcatcagatt

SEQ ID NO: 15626 - DNA, 71 bp, chicken (Gallus Gallus)
  misc_feature (36): n=c or t
gcaggagagggagcgactttctgacagtgatgggangagggggaatggctttagactgaaagaggggaggt

SEQ ID NO: 15627 - DNA, 71 bp, chicken (Gallus Gallus)
  misc_feature (36): n=a or g
gtagatcagatgttgtgtaagtaaacagcactgcancaccccatttatgcaggaacgcgtgtgcagtgcga

SEQ ID NO: 15628 - DNA, 71 bp, chicken (Gallus Gallus)
  misc_feature (36): n=a or t
cacacgtccattttgtgtgctgcgtgtgggagcaancttagagccccatttagaagcaacttcatttggat

SEQ ID NO: 15629 - DNA, 71 bp, chicken (Gallus Gallus)
  misc_feature (36): n=c or t
gacattaccataggaaatgctttatgctaaatgcgngctgatagaatctaaagtccactttctgcagataa

SEQ ID NO: 15630 - DNA, 71 bp, chicken (Gallus Gallus)
  misc_feature (36): n=a or g
tctgggatgactttaattatttgttcttaaatcatngtggaaaaatgctgattgttgtaaagccgcatgag

SEQ ID NO: 15631 - DNA, 71 bp, chicken (Gallus Gallus)
  misc_feature (36): n=a or g
taagggcagttattggttggggctgctacactttcncctcacatatgcttaatagacagcagatctcaggg

SEQ ID NO: 15632 - DNA, 71 bp, chicken (Gallus Gallus)
  misc_feature (36): n=a or t
tcagttgatgctgttaattgtagaggagctgttgcnaatatttctgaaagcaaatatttgaagtctccttc

SEQ ID NO: 15633 - DNA, 71 bp, chicken (Gallus Gallus)
  misc_feature (36): n=g or t
ttcatagtaaagcacaagtggtatattttggatttngtctgtaaacgcaacgccgctatcaatttgtcctc

SEQ ID NO: 15634 - DNA, 71 bp, chicken (Gallus Gallus)
  misc_feature (36): n=a or g
tctgtgcttgtgactgcattcacagtgattcatgcnaacttcagcaatgtgcacttatacagcatcgaata

SEQ ID NO: 15635 - DNA, 71 bp, chicken (Gallus Gallus)
  misc_feature (36): n=a or g
gcagaaacaaactgctggacatgactgcagaacctncccaggagcatctccagccctgatgtgcactctgt

SEQ ID NO: 15636 - DNA, 71 bp, chicken (Gallus Gallus)
  misc_feature (36): n=a or c
ggatctcaagcccgcagaaatcctttgaaaaaacanatgcgaagatgctttcccacactcctttaatcaga

SEQ ID NO: 15637 - DNA, 71 bp, chicken (Gallus Gallus)
  misc_feature (36): n=c or t
acatgaaatcttctaaatgagactgcaggtaaaaantgaaataatttcctctggaacccatataatcttga

SEQ ID NO: 15638 - DNA, 71 bp, chicken (Gallus Gallus)
  misc_feature (36): n=g or t
gtagcacatcttttcctttctggctcatgctgttcngaagagggtaggctgctgtaaaattttcctttctg

SEQ ID NO: 15639 - DNA, 71 bp, chicken (Gallus Gallus)
  misc_feature (36): n=c or t
ccatttcttcaattcatctaaacaatttaaaaccangtttcaaattcttatggcacaaaactggctcagaa

SEQ ID NO: 15640 - DNA, 71 bp, chicken (Gallus Gallus)
  misc_feature (36): n=a or g
aaaggggaagagatgaaacatgctgcatttttattntattttctcaccagacctaagcccagttccttaca

SEQ ID NO: 15641 - DNA, 71 bp, chicken (Gallus Gallus)
  misc_feature (36): n=a or g
agctctgccaacgggacagccacacaacgaacacanatcggccccaacgagcaaacggggacacacagccc

SEQ ID NO: 15642 - DNA, 71 bp, chicken (Gallus Gallus)
  misc_feature (36): n=a or g
aaactcgtctgggtttaacgagcacacttagcaggnccagctatagagtgtgcattatcctttaacccttt

SEQ ID NO: 15643 - DNA, 71 bp, chicken (Gallus Gallus)
  misc_feature (36): n=c or t
attcaccttgattgtacttaataaacagcattaaanactctcagacttctttccaattcataggctgaaaa

SEQ ID NO: 15644 - DNA, 71 bp, chicken (Gallus Gallus)
  misc_feature (36): n=c or t
tattttagatgaaacaaacaataatcttcccagtanctgagattacaatccagactagtatgtgagttatt

SEQ ID NO: 15645 - DNA, 71 bp, chicken (Gallus Gallus)
  misc_feature (36): n=a or g
ttccctgatggaacttcgtgctgtttccacacatcntgtcatcagttcccagggaagaaagcctggcacct

SEQ ID NO: 15646 - DNA, 71 bp, chicken (Gallus Gallus)
  misc_feature (36): n=a or c
tagggaaaacgaaacaaaacctaacaaagaaaaagnatagaacagacgtgtagaaaagagcttaaagacag

SEQ ID NO: 15647 - DNA, 71 bp, chicken (Gallus Gallus)
  misc_feature (36): n=a or g
tgggactgatcctgctgagctccactggcacagacntggctaagatgctccatgtcccaaggagaaggata

SEQ ID NO: 15648 - DNA, 71 bp, chicken (Gallus Gallus)
  misc_feature (36): n=c or t
agaaaaagaaagcacccttagcttacctgagagccncagttaccgggagttcaagtgtgcatcagagagag

SEQ ID NO: 15649 - DNA, 71 bp, chicken (Gallus Gallus)
  misc_feature (36): n=c or t
aggctgcgccatgggaagagaaggaaccaaagacangtctatgcctgtgagcccacagaaggaattcagtt

SEQ ID NO: 15650 - DNA, 71 bp, chicken (Gallus Gallus)
  misc_feature (36): n=a or g
taagatgggctttgttcaggccagtgtttgttactnaggaatgaaattgtagaatgtatacaaacaaatgc

SEQ ID NO: 15651 - DNA, 71 bp, chicken (Gallus Gallus)
  misc_feature (36): n=c or t
tctttcagctcccgatgaaacaactgcttttgcaanatgctggtagagcaataaacagctgtggtgatggc

SEQ ID NO: 15652 - DNA, 71 bp, chicken (Gallus Gallus)
  misc_feature (36): n=a or g
acacagaggtctccatcaggagaccaagagcaaagngaaaaggagttttcaaagcatgcactggctcggct

SEQ ID NO: 15653 - DNA, 71 bp, chicken (Gallus Gallus)
  misc_feature (36): n=g or t
ctaaaatcttgaaggaccatgtccaccatccatccnttggaagtggagcccagagcatgctgctttgtgta

SEQ ID NO: 15654 - DNA, 71 bp, chicken (Gallus Gallus)
  misc_feature (36): n=g or t
atggaactcagttatctctcagaaacttctgtgcanttcgtgcttaagtactacagattttttatactcta

SEQ ID NO: 15655 - DNA, 71 bp, chicken (Gallus Gallus)
  misc_feature (36): n=a or g
ggttcggcaataaacactgcgacggtttccaaaacngatgggacccagtctggggctggttctgatacgga

SEQ ID NO: 15656 - DNA, 71 bp, chicken (Gallus Gallus)
  misc_feature (36): n=a or g
acagagttactgatggtggcactgacgatccagacntggcactggctcatgatagtggctgagctgcttag

SEQ ID NO: 15657 - DNA, 71 bp, chicken (Gallus Gallus)
  misc_feature (36): n=a or g
tgttgtgtgcaggaaggcaaacaagcatcgctcgcngcagatttctctatcactcagtttaaacatctggg

SEQ ID NO: 15658 - DNA, 71 bp, chicken (Gallus Gallus)
  misc_feature (36): n=a or g
tctgcagagaagagagaaggaaaaattgatgccgantcggtgggagggatgtacctcaagatagaaccccc

SEQ ID NO: 15659 - DNA, 71 bp, chicken (Gallus Gallus)
  misc_feature (36): n=c or t
agctactcttgttgggaatacaaagaaagaaagttntgctctataagaatttttaaaagattttttcagca

SEQ ID NO: 15660 - DNA, 71 bp, chicken (Gallus Gallus)
  misc_feature (36): n=c or g
tctcaatttgtcgttgaaatgaggcttggtgcactntacacatactgggttcctctggtaggtgattggag

SEQ ID NO: 15661 - DNA, 71 bp, chicken (Gallus Gallus)
  misc_feature (36): n=a or g
catgttggtgctgcttctgttacaggaactcttacncagaatgagatggtcttcaagcgacttcatctggg

SEQ ID NO: 15662 - DNA, 71 bp, chicken (Gallus Gallus)
  misc_feature (36): n=a or c
tgacatttgcaaaagattgggcacagaaagatacangcaccaaagcaatgctttgcaactggcagagctct

SEQ ID NO: 15663 - DNA, 71 bp, chicken (Gallus Gallus)
  misc_feature (36): n=c or t
atctctttttatacatttttaatcttcctcctgctntgagcaggacaattgcagccactgtcttactcagc

SEQ ID NO: 15664 - DNA, 71 bp, chicken (Gallus Gallus)
  misc_feature (36): n=c or t
gtatgactacgacttccagtaactgaatcgtgtagntggtgagataggtgcaatccttgggctctacttgc

SEQ ID NO: 15665 - DNA, 71 bp, chicken (Gallus Gallus)
  misc_feature (36): n=c or t
atccgcctcttaaacacctcctggcagacagagcangtgaaaacctgcaagagaaggaaggcatcagcttc

SEQ ID NO: 15666 - DNA, 71 bp, chicken (Gallus Gallus)
  misc_feature (36): n=c or t
tgaatgtaattgctgcctccaaattttgctaaaacnttttcaaagtccaccgaaattagggaacactgata

SEQ ID NO: 15667 - DNA, 71 bp, chicken (Gallus Gallus)
  misc_feature (36): n=c or g
gcagctctgtccgagacagaaagcacttggagcaanttgagcactgcaagtccataggagagctcggggtt

SEQ ID NO: 15668 - DNA, 71 bp, chicken (Gallus Gallus)
  misc_feature (36): n=a or g
agtaaactgtcattaaccgcaggctgtgtttctgangaaacacctcctcatatgccaataaaaaatgggcc

SEQ ID NO: 15669 - DNA, 71 bp, chicken (Gallus Gallus)
  misc_feature (36): n=a or g
ttaagtacatcttcaactagaatccaaatctctctnggggtacaatgctgaaatcaacccagatataaaga

SEQ ID NO: 15670 - DNA, 71 bp, chicken (Gallus Gallus)
  misc_feature (36): n=c or t
gggcacctgcagacctcataattgacaagggaatangatcagcacattgccacatcccttctgtgagtgtc

SEQ ID NO: 15671 - DNA, 71 bp, chicken (Gallus Gallus)
  misc_feature (36): n=c or t
gatgcaggaaaataactgggagactgaatagggaanggcgcggtggtggtgggagtgttttgacctcaaaa

SEQ ID NO: 15672 - DNA, 71 bp, chicken (Gallus Gallus)
  misc_feature (36): n=c or t
aacaaatgaatgagcaaggagccttgcaatgtgcancacgttgctaacggtgcccaatgctgcccggctgc

SEQ ID NO: 15673 - DNA, 71 bp, chicken (Gallus Gallus)
  misc_feature (36): n=c or g
cgcgatctgcagtgccgcggtggacgtcggcgttangtgtgagcttcagctcagtgcagataacagcacat

SEQ ID NO: 15674 - DNA, 71 bp, chicken (Gallus Gallus)
  misc_feature (36): n=c or t
ccgtgactctgttagcttagggccttattctgctanggtccaggggtcaaagggatccacacagctttaaa

SEQ ID NO: 15675 - DNA, 71 bp, chicken (Gallus Gallus)
  misc_feature (36): n=c or t
ctccccaatgcttgtttttaatagtccccgtgaggngttatatacctccatttgggttcctaactttgtgc

SEQ ID NO: 15676 - DNA, 71 bp, chicken (Gallus Gallus)
  misc_feature (36): n=g or t
aaaatccctgtgtttctcagtacttgaaatgctttncttccatgaatgcatgtggagaggatgagtgagga

SEQ ID NO: 15677 - DNA, 71 bp, chicken (Gallus Gallus)
  misc_feature (36): n=a or t
atcctaacaagtatgtatcaaacttaagtagatccntaatgacaatgaaatagcttattaacatctaactt

SEQ ID NO: 15678 - DNA, 71 bp, chicken (Gallus Gallus)
  misc_feature (36): n=a or g
aacaggtgggcaataacaaaaatgaatttgaatcanaaaaggaaaggttaaactcttttcttctaggcgtt

SEQ ID NO: 15679 - DNA, 71 bp, chicken (Gallus Gallus)
  misc_feature (36): n=c or t
tgtctttccctgcatgatgtttaaaatacctctctncactgaccacgttacttgagcctttgttgtgttcc

SEQ ID NO: 15680 - DNA, 71 bp, chicken (Gallus Gallus)
  misc_feature (36): n=a or g
cctgggtgatgaggttgatatctgtgggtccgagcnctttgcagctctgtgcatcagcacccagcacacgc

SEQ ID NO: 15681 - DNA, 71 bp, chicken (Gallus Gallus)
  misc_feature (36): n=a or g
gtcttgtgcctgcttcatgaacaggtataagtacantccaaaaccagcctaactttaaactcactcatgaa

SEQ ID NO: 15682 - DNA, 71 bp, chicken (Gallus Gallus)
  misc_feature (36): n=g or t
ttagaatacaagcttgaagaagatttgtctgacganggcacaatggggaacgaggtcacttctgaaggaga

SEQ ID NO: 15683 - DNA, 71 bp, chicken (Gallus Gallus)
  misc_feature (36): n=a or c
cccaataacaaacaaaaaaaccaaagcaacagaaanctcttaaaacatctgggctgattctgaggagaggg

SEQ ID NO: 15684 - DNA, 71 bp, chicken (Gallus Gallus)
  misc_feature (36): n=c or t
actctgtcaaaacctggggcatcacatggctgaaantgaaggcacaactttgtctccccagtaggagctgt

SEQ ID NO: 15685 - DNA, 71 bp, chicken (Gallus Gallus)
  misc_feature (36): n=g or t
tgcccagagctgcttggctcccgccggaagcaccanctctttcttgtctaacgaggatgtcttcttgttgc

SEQ ID NO: 15686 - DNA, 71 bp, chicken (Gallus Gallus)
  misc_feature (36): n=a or g
ggttatgatgacttcaactgcaatgtttgggatacnctgaaagctgatagagcaggtaaacgtatttggtt

SEQ ID NO: 15687 - DNA, 71 bp, chicken (Gallus Gallus)
  misc_feature (36): n=c or t
ctgtagatagaattccagttctgtctccattgttangccaaatcaggaggggatttaaaaacaaaacaaac

SEQ ID NO: 15688 - DNA, 71 bp, chicken (Gallus Gallus)
  misc_feature (36): n=a or g
ggacagcttcctcaagatctggaactgaagtaagtnggtatcaaactaacactgtccttatatggcactca

SEQ ID NO: 15689 - DNA, 71 bp, chicken (Gallus Gallus)
  misc_feature (36): n=c or t
caagaacacttcccatacaacagttgctcataattnccttttttgtttgtcactttttcaatgtcaatgcc

SEQ ID NO: 15690 - DNA, 71 bp, chicken (Gallus Gallus)
  misc_feature (36): n=c or t
tgctgggggaaattctctgattctctaaaggattanttttatcagtgtttttctccccgtgcactacagat

SEQ ID NO: 15691 - DNA, 71 bp, chicken (Gallus Gallus)
  misc_feature (36): n=c or t
gggtgaaaatgccattcaaagactgaaaaccatatnggaaaagtaaattaaaaacaaacagccttgagaaa

SEQ ID NO: 15692 - DNA, 71 bp, chicken (Gallus Gallus)
  misc_feature (36): n=a or c
ttgagatatgtatcagttaataggagattttatagncttctctgaatcttgattcctagcaaatatttaat

SEQ ID NO: 15693 - DNA, 71 bp, chicken (Gallus Gallus)
  misc_feature (36): n=a or g
catttgattacttttttgtatctcctatgatttaantagcactttcctttgacttccagttttcaaaatca

SEQ ID NO: 15694 - DNA, 71 bp, chicken (Gallus Gallus)
  misc_feature (36): n=a or g
ggtaaggtcggcttaaagggaacgtcttggtgtagntgcacacccttcccaaactgccctttgttcagatg

SEQ ID NO: 15695 - DNA, 71 bp, chicken (Gallus Gallus)
  misc_feature (36): n=a or g
ggagaaatacgttctttgcttttgaattgcttttgncagagcaaagtgcagtcagcacttgggaaggtttt

SEQ ID NO: 15696 - DNA, 71 bp, chicken (Gallus Gallus)
  misc_feature (36): n=a or g
ggcacgtcctccagtccagagaaacgagccactccntccattgaaatgaagacaataaaggcaggagggtc

SEQ ID NO: 15697 - DNA, 71 bp, chicken (Gallus Gallus)
  misc_feature (36): n=a or g
cccctttcaccaggtgtaggaaaggtgcctgtaacncagaacatgtgtcctctttgaaaaacacagaagag

SEQ ID NO: 15698 - DNA, 71 bp, chicken (Gallus Gallus)
  misc_feature (36): n=c or t
ggaccaaaaccgtgtagcatatttagaacagttcangataaactaagattgggcacaatgcctaggaaaca

SEQ ID NO: 15699 - DNA, 71 bp, chicken (Gallus Gallus)
  misc_feature (36): n=a or t
agagccctggcagtgggcttctgagctgtgacatgnttggcatggctgggtagaccatttggaaatacccc

SEQ ID NO: 15700 - DNA, 71 bp, chicken (Gallus Gallus)
  misc_feature (36): n=a or t
gaaattggccttttaaaccttgaaaatgacctgttnttggcagaatgcatacagctagctctttgcagaat

SEQ ID NO: 15701 - DNA, 71 bp, chicken (Gallus Gallus)
  misc_feature (36): n=c or t
gaaaaaaacaaaaaaaatcaacactcacaaagtttncttgctgctatctgtgttatatgcgtactgtgttg

SEQ ID NO: 15702 - DNA, 71 bp, chicken (Gallus Gallus)
  misc_feature (36): n=a or c
gttacgattaccatatagagaagagtgaattaatangtgagactgctgctaccccacatggaatttattct

SEQ ID NO: 15703 - DNA, 71 bp, chicken (Gallus Gallus)
  misc_feature (36): n=g or t
ctctatctgtaagagaaaggggagctttctaaacgncacttgttatttccatgcataaaaagagcacttag

SEQ ID NO: 15704 - DNA, 71 bp, chicken (Gallus Gallus)
  misc_feature (36): n=c or t
tttattttcatcacccagagctgttcaccagacctnagttctgtacctgtttgaccgtctctactgtttcc

SEQ ID NO: 15705 - DNA, 71 bp, chicken (Gallus Gallus)
  misc_feature (36): n=c or t
ctccatcagcctacagacagtacaaagaaaagaaanggttaaagacacacagttcactgcagcccaatttt

SEQ ID NO: 15706 - DNA, 71 bp, chicken (Gallus Gallus)
  misc_feature (36): n=a or t
ccctagaatggcaatcgtaaccaaacagcacatgtnccctttcaggtcctgcaaaataacccatcttatcc

SEQ ID NO: 15707 - DNA, 71 bp, chicken (Gallus Gallus)
  misc_feature (36): n=a or g
aatgtagccttaacttttggggatgcccgcattgtnggggttccccaagggctctcatttacaaatgttag

SEQ ID NO: 15708 - DNA, 71 bp, chicken (Gallus Gallus)
  misc_feature (36): n=a or c
gagggacaaagaatgactgcagcccaacttcagtgntcatgaatgaggttatgagggcttcaagtggggct

SEQ ID NO: 15709 - DNA, 71 bp, chicken (Gallus Gallus)
  misc_feature (36): n=a or g
gtccacaagcaattaaaatataataactaaaacaancttcagtattatgactatccacagcgaaagaaaag

SEQ ID NO: 15710 - DNA, 71 bp, chicken (Gallus Gallus)
  misc_feature (36): n=a or g
ttttttattatgtttaaaaacagcctatctgttggnaaaacagatgaccgtcagcgggtttcctggctgat

SEQ ID NO: 15711 - DNA, 71 bp, chicken (Gallus Gallus)
  misc_feature (36): n=a or g
tcgtgctgtagagacagcacttacagcccatcccgncagccaatttatcccaattcataagtaatcaaatc

SEQ ID NO: 15712 - DNA, 71 bp, chicken (Gallus Gallus)
  misc_feature (36): n=c or t
caccctcaagctttgagaggatacaggaaagaacantgtgctaagacctacatttattaattatgaaaatc

SEQ ID NO: 15713 - DNA, 71 bp, chicken (Gallus Gallus)
  misc_feature (36): n=c or t
gtacagtgttatatcacaaatactattaagtactanggagagctgtgctggacaaagcctggccatcacat

SEQ ID NO: 15714 - DNA, 71 bp, chicken (Gallus Gallus)
  misc_feature (36): n=a or g
gagctgcttctgctttctgctgctgcactgactganccacagttgtgactcgtttagctcacagcagcagg

SEQ ID NO: 15715 - DNA, 71 bp, chicken (Gallus Gallus)
  misc_feature (36): n=c or t
cagaacccctgtggtccatggcagtccaccccttcnatgtcatttattgtggcttattggcaaagagaaat

SEQ ID NO: 15716 - DNA, 71 bp, chicken (Gallus Gallus)
  misc_feature (36): n=c or t
atggtccactcatccactattattgctatgagagangagcaggtcaacagtattgccaaccccccaaagat

SEQ ID NO: 15717 - DNA, 71 bp, chicken (Gallus Gallus)
  misc_feature (36): n=a or g
gatgagaaaggtgaacttctgaaccccatgggcacngtgcaatgcaaccccaacacagaaagtgcagcagc

SEQ ID NO: 15718 - DNA, 71 bp, chicken (Gallus Gallus)
  misc_feature (36): n=c or t
gtagatccaggataaatacctgcagcagaaataacngaatgtgttgcaggttgatagttgattcttttgta

SEQ ID NO: 15719 - DNA, 71 bp, chicken (Gallus Gallus)
  misc_feature (36): n=g or t
attgtattatttttaatgcagtgtaggtgcaagagnctgagttagtgattaaaagtttcacattccctcag

SEQ ID NO: 15720 - DNA, 71 bp, chicken (Gallus Gallus)
  misc_feature (36): n=a or g
tgcgagggaaggcacccatgtctgttacagtgtacntctctaactgaagcacatctcctgatccatacctg

SEQ ID NO: 15721 - DNA, 71 bp, chicken (Gallus Gallus)
  misc_feature (36): n=g or t
gctggggtaggttgcaagtatcccatattggttcgntgctgtggttgggtatgtaggtatgaatgctggta

SEQ ID NO: 15722 - DNA, 71 bp, chicken (Gallus Gallus)
  misc_feature (36): n=c or t
attcttgtgtccagtgataaatggaaataccaaacntgatttctttctacataagcaatctgatgtttctg

SEQ ID NO: 15723 - DNA, 71 bp, chicken (Gallus Gallus)
  misc_feature (36): n=a or g
gagtcttttctgatcatgtgtatatgcaattaaacntacagcacagtgacatgtcctgcactggcctttca

SEQ ID NO: 15724 - DNA, 71 bp, chicken (Gallus Gallus)
  misc_feature (36): n=c or t
accgtgatctcatccggagcgatggtgtcgatcttnttgaactgtcgcttctggaaattggtgccgtagtc

SEQ ID NO: 15725 - DNA, 71 bp, chicken (Gallus Gallus)
  misc_feature (36): n=c or t
ttgtttttacagatctttatccccatcctgcaaggnctggctgtagcttccaaagagtgctcccttgatag

SEQ ID NO: 15726 - DNA, 71 bp, chicken (Gallus Gallus)
  misc_feature (36): n=c or t
tgctactgcgttctgttttaaagtctgcttttctancctaggttaagaaggatattaagactggtcactca

SEQ ID NO: 15727 - DNA, 71 bp, chicken (Gallus Gallus)
  misc_feature (36): n=a or g
cttgaaccaggtgttcctggtctggctgtggagggntctgtcctgagaaatgcaacctgtgcacaagctgc

SEQ ID NO: 15728 - DNA, 71 bp, chicken (Gallus Gallus)
  misc_feature (36): n=c or t
agccaacaagcagtgcagccacttcagttacaacangcattagcaccattagcacgagccctgcaaagcag

SEQ ID NO: 15729 - DNA, 71 bp, chicken (Gallus Gallus)
  misc_feature (36): n=c or t
ctacactcctcccaagctccattcctgcaaacacangagctgctccctgtttcatttagagccctttctac

SEQ ID NO: 15730 - DNA, 71 bp, chicken (Gallus Gallus)
  misc_feature (36): n=c or t
ctgatttcagtgatgctgcatcatttgcaaatgagntgatgaaagcaagaggttcttgttgtgccttatgc

SEQ ID NO: 15731 - DNA, 71 bp, chicken (Gallus Gallus)
  misc_feature (36): n=g or t
gagtaatcccagccatcatttcccagccccagcccnaaacccatcagtgatcccagtcccaatacctattg

SEQ ID NO: 15732 - DNA, 71 bp, chicken (Gallus Gallus)
  misc_feature (36): n=a or g
gtggtttcagcccaacacatacagaggatccaagcnctacatcttcctgggatcccaactctgcacccatt

SEQ ID NO: 15733 - DNA, 71 bp, chicken (Gallus Gallus)
  misc_feature (36): n=a or g
tgaccctattttcttctcttcccttcagcggactcntctagcttccgtgtagacactgctgttatcaaaca

SEQ ID NO: 15734 - DNA, 71 bp, chicken (Gallus Gallus)
  misc_feature (36): n=g or t
tctcattaccaacagcccatcaacgattttacctanaatgagaaaatgcacccacttcagtgttgtgtttc

SEQ ID NO: 15735 - DNA, 71 bp, chicken (Gallus Gallus)
  misc_feature (36): n=c or t
caggagagggcacttagctgcaggttaatgatcccnccactccctcctgcctgagtagctgaattcctcct

SEQ ID NO: 15736 - DNA, 71 bp, chicken (Gallus Gallus)
  misc_feature (36): n=a or g
gttctttcattgtttgcacagaaggagcaattaggnttagccagggccttagaagtcatgctctgacaaga

SEQ ID NO: 15737 - DNA, 71 bp, chicken (Gallus Gallus)
  misc_feature (36): n=c or t
cccctgccctcccagggaggcttttcccttcctatngccagagctccaaagggaaataccaccattagggt

SEQ ID NO: 15738 - DNA, 71 bp, chicken (Gallus Gallus)
  misc_feature (36): n=a or c
gaaagcagaaagtacaaattccaagtgtctttctgncaagtccagtgatgcattttattatgtttgactga

SEQ ID NO: 15739 - DNA, 71 bp, chicken (Gallus Gallus)
  misc_feature (36): n=c or t
aacaaacagcatttcacagagcaaggggttggagangaagttgtggttagtgttttgcagtcgaatctcga

SEQ ID NO: 15740 - DNA, 71 bp, chicken (Gallus Gallus)
  misc_feature (36): n=c or t
tccttctgcagtgtttgcattctctggcacctacangctgctgttcatcgctcgtgctctacaaggtgttg

SEQ ID NO: 15741 - DNA, 71 bp, chicken (Gallus Gallus)
  misc_feature (36): n=a or g
actgctgagctgagctccacgtctgcgttacccacncgtacaaaagcaaacgggtgattcagcagcctggg

SEQ ID NO: 15742 - DNA, 71 bp, chicken (Gallus Gallus)
  misc_feature (36): n=a or g
cccagcttttaaaagcaaagagcacagactgcaccntgatcgggggtcaaaggttcccaggtactctgcta

SEQ ID NO: 15743 - DNA, 71 bp, chicken (Gallus Gallus)
  misc_feature (36): n=a or g
gatgaggaatttaaacctgctcactttctaaccctngcaaaaatgcaaactgcttcagcagttttaagaac

SEQ ID NO: 15744 - DNA, 71 bp, chicken (Gallus Gallus)
  misc_feature (36): n=a or g
aaggctcttcccaaagcgccgtccattctagctgcnataggaagcatgcagaaatgctttacgatgttgga

SEQ ID NO: 15745 - DNA, 71 bp, chicken (Gallus Gallus)
  misc_feature (36): n=g or t
tactctttcgccagactcagtggctttcaagctggnctaagcagccttgtgcttcaaaagcgtccttgctc

SEQ ID NO: 15746 - DNA, 71 bp, chicken (Gallus Gallus)
  misc_feature (36): n=a or t
ttgcttacatcactgtagtaaagcggttctgctganttttaccatcagaaactgaccctggtaaaaatcag

SEQ ID NO: 15747 - DNA, 71 bp, chicken (Gallus Gallus)
  misc_feature (36): n=c or t
cggaaggtgagggacaaactgagcttcaaagaagantgagatttggggcagagtgggggataccatggcca

SEQ ID NO: 15748 - DNA, 71 bp, chicken (Gallus Gallus)
  misc_feature (36): n=a or c
ggagtggctgctgcaatccgagcttcttcctctacnaaaagatgctgaggagttgaggcttatgtttaaaa

SEQ ID NO: 15749 - DNA, 71 bp, chicken (Gallus Gallus)
  misc_feature (36): n=a or g
cacagagcaccttggtagatagctctgatatctccnaagtaacctgtgcatcgtggccccccatggctgag

SEQ ID NO: 15750 - DNA, 71 bp, chicken (Gallus Gallus)
  misc_feature (36): n=c or t
cgctgcatcaaaagtagaaaaggaagcacggaaagntgaggcgaagcgtgaggaggtccttctagagagag

SEQ ID NO: 15751 - DNA, 71 bp, chicken (Gallus Gallus)
  misc_feature (36): n=c or t
gtgcattactactatgccatcgagcccagctggcangagaagatccagggcttcttcatgcccacagctgc

SEQ ID NO: 15752 - DNA, 71 bp, chicken (Gallus Gallus)
  misc_feature (36): n=c or t
tcttcttgacttttactcgatgttgctaccactttngacataaatttgggctcatcatcaaaatccgaatc

SEQ ID NO: 15753 - DNA, 71 bp, chicken (Gallus Gallus)
  misc_feature (36): n=c or t
tctattacagaggtacaccaactccaagacacttantgcccagtgcattatatagaacacaaagcaaacac

SEQ ID NO: 15754 - DNA, 71 bp, chicken (Gallus Gallus)
  misc_feature (36): n=a or c
tcagtgttcacagaacatgaaatgaacctccactgngcctccaaacgctgccagggcggcttcgagcaacg

SEQ ID NO: 15755 - DNA, 71 bp, chicken (Gallus Gallus)
  misc_feature (36): n=a or c
tcggtaacgctcggagtgtcggagagggaagagccnaaacccgcacagctgcggttattttctgtgtcctc

SEQ ID NO: 15756 - DNA, 71 bp, chicken (Gallus Gallus)
  misc_feature (36): n=a or g
agtgccattggggttggtgctgattagtggagatgnggatgggatggagcacacctggcaggttggaggct

SEQ ID NO: 15757 - DNA, 71 bp, chicken (Gallus Gallus)
  misc_feature (36): n=c or t
caaacagtacacttaaatcaaagccaggctttcatngagataattcatattgggattgattgcaagtgtcc

SEQ ID NO: 15758 - DNA, 71 bp, chicken (Gallus Gallus)
  misc_feature (36): n=c or t
gtgagaatggccgcatttgatctgtgcccaaagctngtgggcagcagcaaagcagcattagaactgcacgt

SEQ ID NO: 15759 - DNA, 71 bp, chicken (Gallus Gallus)
  misc_feature (36): n=a or g
caaagtcggtggcactgaggacaccagaacctaccntaggcctcttctatcatgctacagtacgggttgat

SEQ ID NO: 15760 - DNA, 71 bp, chicken (Gallus Gallus)
  misc_feature (36): n=c or t
gcaggagtggctcagtacgtgcaggcttttgatgcnattctgtctggcccggtagctgagtacatcaacat

SEQ ID NO: 15761 - DNA, 71 bp, chicken (Gallus Gallus)
  misc_feature (36): n=a or g
caagagaattcagtgcatggagatgacaaagcagcnaagtgtagcaatacttctctctgagcgcctgtccc

SEQ ID NO: 15762 - DNA, 71 bp, chicken (Gallus Gallus)
  misc_feature (36): n=g or t
tgaagcattccatgctcttggagctcacattgcatntggaggcattttcatacatcttacaattaatcatt

SEQ ID NO: 15763 - DNA, 71 bp, chicken (Gallus Gallus)
  misc_feature (36): n=c or g
gcaactttagaaatccagatgtatgttctgcatgtntctttaggctatgaatgttagaggaatctggaaat

SEQ ID NO: 15764 - DNA, 71 bp, chicken (Gallus Gallus)
  misc_feature (36): n=a or g
ttaccctttctgtgtgttatctggctaacatattcnagacagatgtggaacaaaagtaaggtgcttggctc

SEQ ID NO: 15765 - DNA, 71 bp, chicken (Gallus Gallus)
  misc_feature (36): n=c or g
ttggctttgttgggcacttgactgtccttaacccantctagtagcatgctgtcacagaaccatagccccag

SEQ ID NO: 15766 - DNA, 71 bp, chicken (Gallus Gallus)
  misc_feature (36): n=a or c
catgtacacatactagtctctgggtttaaaaaaaanccctcattatttgtgtaaaatagtcctagcaactt

SEQ ID NO: 15767 - DNA, 71 bp, chicken (Gallus Gallus)
  misc_feature (36): n=c or t
caccccaacgcatgcaaccctgagcatgcaaacagnactgtgcatgcgtgcatcttcatgtgcacacattg

SEQ ID NO: 15768 - DNA, 71 bp, chicken (Gallus Gallus)
  misc_feature (36): n=a or c
catcttgaagcaactgctgaaaagggaagctcagancttacttagacaagtactgaagatcacagtcacct

SEQ ID NO: 15769 - DNA, 71 bp, chicken (Gallus Gallus)
  misc_feature (36): n=a or g
ggatacatggactgtgctcaaggtccttttccaccntgcagtcctgtttgccatgaaggaggggaatgaga

SEQ ID NO: 15770 - DNA, 71 bp, chicken (Gallus Gallus)
  misc_feature (36): n=c or t
acggccacggtctcatcttgcagtcctttggaaatngaggcaggttctgaaaagagaaacagttctgtgtg

SEQ ID NO: 15771 - DNA, 71 bp, chicken (Gallus Gallus)
  misc_feature (36): n=a or g
taggggcgcgacgcggcgctgcgggggctctccccntagttgttcacagcgatcacacggaacttgtacag

SEQ ID NO: 15772 - DNA, 71 bp, chicken (Gallus Gallus)
  misc_feature (36): n=a or g
aaaaatgctattcagaaattctacagaaaaaaagcnaaaagtaccagctgaggtctgcacaaacagtaagc

SEQ ID NO: 15773 - DNA, 71 bp, chicken (Gallus Gallus)
  misc_feature (36): n=c or t
ccttcctccgaagcgctctccggtcagctctcacangcagcagtctgcagttcttaataacctcctcttcc

SEQ ID NO: 15774 - DNA, 71 bp, chicken (Gallus Gallus)
  misc_feature (36): n=a or g
aaaataagcaaaacaaacaaacaaacatcagtgtcngagtaagggacataaagcttcaaatcatttgcagg

SEQ ID NO: 15775 - DNA, 71 bp, chicken (Gallus Gallus)
  misc_feature (36): n=c or t
gctgttcaagctgcaattctgtctggggacaagtcngagaacgtccaagatctgctcctgttggatgtgac

SEQ ID NO: 15776 - DNA, 71 bp, chicken (Gallus Gallus)
  misc_feature (36): n=c or g
gaagttagctgtcagcaaacaggcagcggagcagantgtattaggcagaagaagtgcatgtagatttcctt

SEQ ID NO: 15777 - DNA, 71 bp, chicken (Gallus Gallus)
  misc_feature (36): n=a or g
ttcctatgcccttggtattggttcctcttaaagcanagcgtgtacacctttatacagtttttcattggtgc

SEQ ID NO: 15778 - DNA, 71 bp, chicken (Gallus Gallus)
  misc_feature (36): n=c or t
tccagagacagatgtgatcattctcattagcagcantgctatcccatgtagatgttttgttgaagatgttc

SEQ ID NO: 15779 - DNA, 71 bp, chicken (Gallus Gallus)
  misc_feature (36): n=a or g
cgctcaactgctccgctttcctattcaagtttcacngtcccctccctgcagcaccgacacaccgccgggct

SEQ ID NO: 15780 - DNA, 71 bp, chicken (Gallus Gallus)
  misc_feature (36): n=a or g
ctgcaaacgagaagggagctaaaattaaaactcggncgtggaacacgagcaacacgagaggcagcggcagg

SEQ ID NO: 15781 - DNA, 71 bp, chicken (Gallus Gallus)
  misc_feature (36): n=a or g
tgctcaaaaataaaatccagctggctgagatacagncagttcccagctcttccctggatgctttgccaggt

SEQ ID NO: 15782 - DNA, 71 bp, chicken (Gallus Gallus)
  misc_feature (36): n=a or g
caggatctgcagtaaggtaatgggggcactgctagnccaatctgctaagggtctgggtccagccctctgac

SEQ ID NO: 15783 - DNA, 71 bp, chicken (Gallus Gallus)
  misc_feature (36): n=c or t
cacagaaaggaatatgcctcagtgtttcaatgcaancaaaaccccacgtcctcaggttatctcccaggaag

SEQ ID NO: 15784 - DNA, 71 bp, chicken (Gallus Gallus)
  misc_feature (36): n=a or g
ctcttattctgtagtatcataatgcaatgaatatanaccctagtttcaaataacatcacagaaaaacaaaa

SEQ ID NO: 15785 - DNA, 71 bp, chicken (Gallus Gallus)
  misc_feature (36): n=a or g
atgtcctctcttgcagaaagtgcagaactcatcccnatcactgtcagctccttcgccattgtcctcttcct

SEQ ID NO: 15786 - DNA, 71 bp, chicken (Gallus Gallus)
  misc_feature (36): n=c or t
agctggcaccgacattgtgctggatatggattgcanggagctgccggtggccaaagggtacctgaagcagt

SEQ ID NO: 15787 - DNA, 71 bp, chicken (Gallus Gallus)
  misc_feature (36): n=c or t
ccatcaccgaatgctgggctcggtaattcggcatancctacgaaccgcgccctccgctggctccgtctcgc

SEQ ID NO: 15788 - DNA, 71 bp, chicken (Gallus Gallus)
  misc_feature (36): n=a or g
gatcgaaaataccactaggattcatgatacttaacnttacaaattaaagactgtttctactagaaagaatg

SEQ ID NO: 15789 - DNA, 71 bp, chicken (Gallus Gallus)
  misc_feature (36): n=c or t
attaggcctaaaaaaccatttgactccgaatgcccntttcacacaaaaagtgaaattgaaatcatctttaa

SEQ ID NO: 15790 - DNA, 71 bp, chicken (Gallus Gallus)
  misc_feature (36): n=c or t
aaaccacatgcagaaaactacttctgccaaaatacnttctcaaaacaccaagaaatgaattagctataacc

SEQ ID NO: 15791 - DNA, 71 bp, chicken (Gallus Gallus)
  misc_feature (36): n=g or t
agatgaaacaatgttgggtttaaactagtgcagtgnaagaaatcaagtataaagatacgtgatatatttta

SEQ ID NO: 15792 - DNA, 71 bp, chicken (Gallus Gallus)
  misc_feature (36): n=c or t
ccccattgctcgcttgggaccaagatgatggtaagntgaaagctcataatttattacttcattatcaattt

SEQ ID NO: 15793 - DNA, 71 bp, chicken (Gallus Gallus)
  misc_feature (36): n=a or c
tctgtaaatggacagtggaataagggtcaggagtangagtagccacccctgcactgccagctgtgctaact

SEQ ID NO: 15794 - DNA, 71 bp, chicken (Gallus Gallus)
  misc_feature (36): n=a or g
aggtcctggcagggtttggaacagaaaacagaaacntcctagagcagtccaagccctgttgcatgcgagga

SEQ ID NO: 15795 - DNA, 71 bp, chicken (Gallus Gallus)
  misc_feature (36): n=g or t
gtgggttgtcatccacctgggttggctcttgggatntgatggtattgactcctgtctcctcttcatcctcc

SEQ ID NO: 15796 - DNA, 71 bp, chicken (Gallus Gallus)
  misc_feature (36): n=a or g
ctgcagttcgggttgtttcccacacccgaatgccancacagctccctgtagcccccgcagcgggatttggg

SEQ ID NO: 15797 - DNA, 71 bp, chicken (Gallus Gallus)
  misc_feature (36): n=c or t
tttattttaacttcctagggctaaaattgacctttngcttcaatctctgctcacccttttgggccagagag

SEQ ID NO: 15798 - DNA, 71 bp, chicken (Gallus Gallus)
  misc_feature (36): n=c or t
cacgtctccttctttggattgcacccacagtgatgncttcacacgcagcagcagagcatgggggtgtgtga

SEQ ID NO: 15799 - DNA, 71 bp, chicken (Gallus Gallus)
  misc_feature (36): n=a or g
atagcaacatatggaaaacgtacagcaagaaatatntgcctttggaggggtgacatttagcagtttcctct

SEQ ID NO: 15800 - DNA, 71 bp, chicken (Gallus Gallus)
  misc_feature (36): n=a or g
aaagtccagggctcagcccacgctggggtcccacancccatacacagctctgacatctcccattgtggacc

SEQ ID NO: 15801 - DNA, 71 bp, chicken (Gallus Gallus)
  misc_feature (36): n=c or t
ctgtccccaggtgtgcaatacttcctgaaggtgtcngtcctcgccggcccgtatcgatcctcgtcacactt

SEQ ID NO: 15802 - DNA, 71 bp, chicken (Gallus Gallus)
  misc_feature (36): n=c or t
tcctctcatcttacatgaaaatgtggtgtctccctntatgagaggcagcttctttgtgttcctcctcctgc

SEQ ID NO: 15803 - DNA, 71 bp, chicken (Gallus Gallus)
  misc_feature (36): n=c or t
taggagaacagtggtcgttctgcatgcatgggggtngattcctctcctcgatccttgttttttcaccattt

SEQ ID NO: 15804 - DNA, 71 bp, chicken (Gallus Gallus)
  misc_feature (36): n=c or t
cccatctccagggcgaagccacttcctcatttcccngtggatcatcttgtagcaccatcaggttggctttt

SEQ ID NO: 15805 - DNA, 71 bp, chicken (Gallus Gallus)
  misc_feature (36): n=a or g
taagtttatttaaatccgtctcttttgagtttgtanaaaaacaactgcttggagtagtctgtttgctgtga

SEQ ID NO: 15806 - DNA, 71 bp, chicken (Gallus Gallus)
  misc_feature (36): n=c or t
gagtcatccgaacagaaagggagtcctgtaatggangcacctgcttagaaggaaaaggctgagccattata

SEQ ID NO: 15807 - DNA, 71 bp, chicken (Gallus Gallus)
  misc_feature (36): n=a or g
catgtttaagcttcttagctctgtccttatctggcnttcccttctgccagtcagatttttcatgttcctcc

SEQ ID NO: 15808 - DNA, 71 bp, chicken (Gallus Gallus)
  misc_feature (36): n=a or g
acacaaaactcatactgcagacccttcttgagatcngttattttcagcttcttgtctgcagaaagaaaacg

SEQ ID NO: 15809 - DNA, 71 bp, chicken (Gallus Gallus)
  misc_feature (36): n=c or g
ttctccataggaaaccttccatgtgtgctgcctgangatgctgggatgttgcacaggagtcatccgaacag

SEQ ID NO: 15810 - DNA, 71 bp, chicken (Gallus Gallus)
  misc_feature (36): n=a or g
acttggatgaaggtgtgtcaacacgactgtgttgtnatgttgctatttctctttgtcattctccattgcag

SEQ ID NO: 15811 - DNA, 71 bp, chicken (Gallus Gallus)
  misc_feature (36): n=c or t
gaaaggataaataagtctatttcctgccagccaaangataaccagccttgcaatcatccatcaacctcagc

SEQ ID NO: 15812 - DNA, 71 bp, chicken (Gallus Gallus)
  misc_feature (36): n=a or g
ctgcgtgggctcattcatcccagcagggcagagaanctggatttccatggaggaacattaattcatgggcg

SEQ ID NO: 15813 - DNA, 71 bp, chicken (Gallus Gallus)
  misc_feature (36): n=c or t
agtgctgcagcaggataaaaatcttgattgaactcntccttccttccactcattacctgctacactgccat

SEQ ID NO: 15814 - DNA, 71 bp, chicken (Gallus Gallus)
  misc_feature (36): n=c or t
tccagctacaacaagcaggacaacaactgccacttngatgccacacttgtctccttcatcaacttcttcac

SEQ ID NO: 15815 - DNA, 71 bp, chicken (Gallus Gallus)
  misc_feature (36): n=c or t
cggatgatgaaggacatctccaacttggaagacaangacgagacgcgcttcatcctgagcaaggtgccaag

SEQ ID NO: 15816 - DNA, 71 bp, chicken (Gallus Gallus)
  misc_feature (36): n=c or t
ttgggttcgggacacggatcaaactgtgctgatagngtgtggcaggagacatgctttcattctgagttttg

SEQ ID NO: 15817 - DNA, 71 bp, chicken (Gallus Gallus)
  misc_feature (36): n=a or g
tgagccttgctggtagcaacacttgaaggtagaaancacatgccaagtgttggtttggaattacactgggc

SEQ ID NO: 15818 - DNA, 71 bp, chicken (Gallus Gallus)
  misc_feature (36): n=a or g
ctgctctgtttctaataggagacgattaagctctcnttgccctgtgtggctggcaggtcctgctgcatcac

SEQ ID NO: 15819 - DNA, 71 bp, chicken (Gallus Gallus)
  misc_feature (36): n=c or t
gacctgctggtagatagaaagatatgtgtaactggngttgcatgctgagctaaaaagtctcctccttttgt

SEQ ID NO: 15820 - DNA, 71 bp, chicken (Gallus Gallus)
  misc_feature (36): n=a or c
tccaagtatagccaatgggcgctacactgaagcagncaactatgtttatcaaacaacagtaacctatagtt

SEQ ID NO: 15821 - DNA, 71 bp, chicken (Gallus Gallus)
  misc_feature (36): n=c or t
tccttgctcctagaagtggttttggtgcaaaaagcngaaggctgttaaagagtgcctgggattcctctggg

SEQ ID NO: 15822 - DNA, 71 bp, chicken (Gallus Gallus)
  misc_feature (36): n=a or g
atgttatgcaggctacacattacatggtgcagctcntattgagtatattggaggaggcagatggactccag

SEQ ID NO: 15823 - DNA, 71 bp, chicken (Gallus Gallus)
  misc_feature (36): n=a or g
tggcagggtgggggcacacggtgagcatccccttcncatatcgcgctccataaatctgagcccttcgtatc

SEQ ID NO: 15824 - DNA, 71 bp, chicken (Gallus Gallus)
  misc_feature (36): n=a or g
actgtaggaaggctttgtgaaatgaccttatcccantgaggtgctgttcacctttagaatatggaaacagc

SEQ ID NO: 15825 - DNA, 71 bp, chicken (Gallus Gallus)
  misc_feature (36): n=a or g
acctggttgaccagggttggatgtcaggctgcctcnttgagtgttatccgggtcagcatcctccctttaaa

SEQ ID NO: 15826 - DNA, 71 bp, chicken (Gallus Gallus)
  misc_feature (36): n=c or t
aacaacacgtttctcttttctttgtaggacagcaanggcaagaagctgctactcaaaagtgctctgtctca

SEQ ID NO: 15827 - DNA, 71 bp, chicken (Gallus Gallus)
  misc_feature (36): n=a or g
agatccaggtaagctgcattgtctggcaataacagnaaaaactgcttgccatacactactgcatttgctca

SEQ ID NO: 15828 - DNA, 71 bp, chicken (Gallus Gallus)
  misc_feature (36): n=c or t
tctttgggatcagaactgttcagttcttctctcatncccctaagacttgcaacccatggcatgggggttaa

SEQ ID NO: 15829 - DNA, 71 bp, chicken (Gallus Gallus)
  misc_feature (36): n=c or g
tcgcttatttcgcagatgggggaagaaccgtgaagnagccccgagaactgctctggaacctggatgtcctg

SEQ ID NO: 15830 - DNA, 71 bp, chicken (Gallus Gallus)
  misc_feature (36): n=g or t
ctagtgtgacccagcaccaggagcaacgtgtttctnatttgtgttttcatcttgacacctctgccaggtca

SEQ ID NO: 15831 - DNA, 71 bp, chicken (Gallus Gallus)
  misc_feature (36): n=c or g
actgtaacccaaggtctgtggcatcgtagaatcatnatagaatggcctgggctgaaaaggaccataatgat

SEQ ID NO: 15832 - DNA, 71 bp, chicken (Gallus Gallus)
  misc_feature (36): n=a or t
actgcacttaaagggaaaaccaggaaagcggtaagngcagcaagctgccactgcaaactccaaagtcaagg

SEQ ID NO: 15833 - DNA, 71 bp, chicken (Gallus Gallus)
  misc_feature (36): n=a or g
acagcaccttgccctgtgtaccgtacattggagtcntgtagaaaagagtttccagtagaagaaatggaaga

SEQ ID NO: 15834 - DNA, 71 bp, chicken (Gallus Gallus)
  misc_feature (36): n=a or g
tcactgtagtccttctccatgcagttctctgcaacntgattcaaaaatggttatctaaaaccttcattgta

SEQ ID NO: 15835 - DNA, 71 bp, chicken (Gallus Gallus)
  misc_feature (36): n=a or t
caggagtggactgctttaaacatttcttttatgtgngttagtacagttgtttagacgcacatttacatctg

SEQ ID NO: 15836 - DNA, 71 bp, chicken (Gallus Gallus)
  misc_feature (36): n=c or t
tatgttcaatatatcatattcagtatgtttaaatanaatgaaaacaattagacacaaaacaaccacaagag

SEQ ID NO: 15837 - DNA, 71 bp, chicken (Gallus Gallus)
  misc_feature (36): n=a or g
ggaaagacggatccttgctctgactcacggccatcntttatccccactcccaccaggcttgcaagagactg

SEQ ID NO: 15838 - DNA, 71 bp, chicken (Gallus Gallus)
  misc_feature (36): n=a or c
agctgacagtagtgctcccaaatgccagtctctacntggcctctgctttagttaccagcctgggtcaggtc

SEQ ID NO: 15839 - DNA, 71 bp, chicken (Gallus Gallus)
  misc_feature (36): n=c or t
atcctggactcagctctgctgcgccctggccgcatngacaggaagattgagtttccccctcccaatgagga

SEQ ID NO: 15840 - DNA, 71 bp, chicken (Gallus Gallus)
  misc_feature (36): n=c or t
aacctgagagaataatcccctgcaaataggatgggntgcaaagcagatctgaatacctttagcactgatgc

SEQ ID NO: 15841 - DNA, 71 bp, chicken (Gallus Gallus)
  misc_feature (36): n=c or t
agccctcccagccccgctctgctgtgggtttttgcnctgtgagtgggatgtaaagcttattaaaacggttt

SEQ ID NO: 15842 - DNA, 71 bp, chicken (Gallus Gallus)
  misc_feature (36): n=c or t
cagatgaagatgcagttatttctaaagatagatatntatgttcagaagccttgatgaggaaacctaaactt

SEQ ID NO: 15843 - DNA, 71 bp, chicken (Gallus Gallus)
  misc_feature (36): n=g or t
tagctgaaactaattgtcctctgcctgttgtttggnaagtggtgctcagcgtcagccctcatccttggggt

SEQ ID NO: 15844 - DNA, 71 bp, chicken (Gallus Gallus)
  misc_feature (36): n=c or t
atggaaggctcctcaggtggcggacggtctacatgnttgtctctccatctctcattgctcctctcgagata

SEQ ID NO: 15845 - DNA, 71 bp, chicken (Gallus Gallus)
  misc_feature (36): n=c or t
gatgggtgaatatagactacttgttgatcaatgagngttcgataaccctcctggggatccttctttgctgc

SEQ ID NO: 15846 - DNA, 71 bp, chicken (Gallus Gallus)
  misc_feature (36): n=a or g
cttttatccggcattccagaagtgccattgccctangggttgttaagtcttgtcctactggaactgttcag

SEQ ID NO: 15847 - DNA, 71 bp, chicken (Gallus Gallus)
  misc_feature (36): n=a or g
acatgtttgtctctccatctctcattgctcctctcnagatacttgtctcgatccctacggtccctgcttgg

SEQ ID NO: 15848 - DNA, 71 bp, chicken (Gallus Gallus)
  misc_feature (36): n=c or t
ttgcaggccaggagttccaggctcacaaagccatcntagcaggtcagtactgagttggatgggccttagca

SEQ ID NO: 15849 - DNA, 71 bp, chicken (Gallus Gallus)
  misc_feature (36): n=g or t
gttggtgtcttaatggagctatttgcaagccttctnttactttctgaagcttttctctaacaaagtactta

SEQ ID NO: 15850 - DNA, 71 bp, chicken (Gallus Gallus)
  misc_feature (36): n=a or g
acatgtttccaacattcatccatccacatatccgcntctctgtccatgcatccgcctctcccttatccctc

SEQ ID NO: 15851 - DNA, 71 bp, chicken (Gallus Gallus)
  misc_feature (36): n=c or t
cattggctctcaggtgctcctgagtgctgctttctnctgcaaaagccatctgcaagctgtgccacagttcc

SEQ ID NO: 15852 - DNA, 71 bp, chicken (Gallus Gallus)
  misc_feature (36): n=c or t
ggttgaactctgcagaagcaatcagcagtgatttcngagcagctgcttcctcaccgtgagatcagcgtggc

SEQ ID NO: 15853 - DNA, 71 bp, chicken (Gallus Gallus)
  misc_feature (36): n=a or g
gaatccaagcatgcctgctgcagagtgagccgatgnggaagacgcaacgttagctggattaacactgaact

SEQ ID NO: 15854 - DNA, 71 bp, chicken (Gallus Gallus)
  misc_feature (36): n=c or t
gctcccattttacagcctgggaaggagcacaggctnagcacaggcttccctcctatcctttaaagaaaaaa

SEQ ID NO: 15855 - DNA, 71 bp, chicken (Gallus Gallus)
  misc_feature (36): n=a or g
ttaaaatcatcaggcatcaacatgacggggacgggnacgttgctgagttcgttgatctgcaagaagaagga

SEQ ID NO: 15856 - DNA, 71 bp, chicken (Gallus Gallus)
  misc_feature (36): n=g or t
ccaatcctagagagtgagtattcatccctggcatgncccccacactgggtgctgctctgcacttcagggtg

SEQ ID NO: 15857 - DNA, 71 bp, chicken (Gallus Gallus)
  misc_feature (36): n=a or g
acctccaccagctccgtggcttttacttccacctcnccctctctaattttcttgacgtggaaagtgaaggg

SEQ ID NO: 15858 - DNA, 71 bp, chicken (Gallus Gallus)
  misc_feature (36): n=c or t
ctctagattaaatgctacagaagcccggggcagagntgcttctctttgtgatttttctcactcagacagct

SEQ ID NO: 15859 - DNA, 71 bp, chicken (Gallus Gallus)
  misc_feature (36): n=c or t
cccagtgtcgtttctgggtagaaaagctggagccangcactgaagatgctggacggggtccccctgcacca

SEQ ID NO: 15860 - DNA, 71 bp, chicken (Gallus Gallus)
  misc_feature (36): n=a or g
gttcgataatttgcaaagtagtatcctccatgatcnctgaggagtcctggctaggagagcccagagaaagt

SEQ ID NO: 15861 - DNA, 71 bp, chicken (Gallus Gallus)
  misc_feature (36): n=a or g
gaacatacttaccgtgtaaaagagccacagttcctnagcacgtcaacaaaggcaactccaataaatccatc

SEQ ID NO: 15862 - DNA, 71 bp, chicken (Gallus Gallus)
  misc_feature (36): n=a or g
attctaatgtattcagattaattcaaatacattttnatgtagttaaaaatgtagatcaaatgaccagcgtt

SEQ ID NO: 15863 - DNA, 71 bp, chicken (Gallus Gallus)
  misc_feature (36): n=c or g
tatacactgtgatgattctgacagctgaataaacantagatagactttttttcctaaaagacaataacttt

SEQ ID NO: 15864 - DNA, 71 bp, chicken (Gallus Gallus)
  misc_feature (36): n=c or t
gtttactgcgttaatgctatgctcactgctgctctnaactttttaaagacctgtcattttcatttgcttca

SEQ ID NO: 15865 - DNA, 71 bp, chicken (Gallus Gallus)
  misc_feature (36): n=c or g
agatataggcaaaatcaaaacaaagtgtttccactnacagaaaacatattttcagggcttctttatttctc

SEQ ID NO: 15866 - DNA, 71 bp, chicken (Gallus Gallus)
  misc_feature (36): n=c or t
acttatcttggcctttcctgttttaagaactttccngttggaaagaaagctttccatcaaaaacaggacta

SEQ ID NO: 15867 - DNA, 71 bp, chicken (Gallus Gallus)
  misc_feature (36): n=a or g
tacagcaagctcatgttcagtagctttgtcttcatntatctgttgctgtgaaaaatcagctgggagggaat

SEQ ID NO: 15868 - DNA, 71 bp, chicken (Gallus Gallus)
  misc_feature (36): n=a or t
aatatggtatcttctttccagcattatttaaaatgnttacagcatgttaaagttttaagcaactctctgaa

SEQ ID NO: 15869 - DNA, 71 bp, chicken (Gallus Gallus)
  misc_feature (36): n=a or g
ctttgttgtgctaaagcaaggaagcacttgctgcantaccttagcaagttgggcacgcagatcagccacct

SEQ ID NO: 15870 - DNA, 71 bp, chicken (Gallus Gallus)
  misc_feature (36): n=c or g
tatctgcctgtttgatgtcaaaatgatcacatacangccaccaatttcatgtcctggtctaacagttctct

SEQ ID NO: 15871 - DNA, 71 bp, chicken (Gallus Gallus)
  misc_feature (36): n=c or t
tccttgttactctttgtatcccttgccaagtccagnttcaccttggctttaccgattccatctctgcacat

SEQ ID NO: 15872 - DNA, 71 bp, chicken (Gallus Gallus)
  misc_feature (36): n=a or g
cggactcatagaggttcttgatgccactgacctaanggggaaaaaagagtgttcagacatgaaaacattcc

SEQ ID NO: 15873 - DNA, 71 bp, chicken (Gallus Gallus)
  misc_feature (36): n=a or g
aacatgtcggtgatcgcccacgttgatcacggcaantccaccctgaccgattctctggtgtgcaaagctgg

SEQ ID NO: 15874 - DNA, 71 bp, chicken (Gallus Gallus)
  misc_feature (36): n=c or t
cttggcttgcagggaagggggaaggcacggcaaacnaggccaagttccactgtaaaagccctcctggctac

SEQ ID NO: 15875 - DNA, 71 bp, chicken (Gallus Gallus)
  misc_feature (36): n=c or t
ccaatactgctaaataggctccgtagctcatcctgngtcatgttctgggggaggtagttcacaattagatt

SEQ ID NO: 15876 - DNA, 71 bp, chicken (Gallus Gallus)
  misc_feature (36): n=a or g
agcttgcattttaagcatccttttatgtttttactnttgcaaatctcagtcctgtattttaggttttagtg

SEQ ID NO: 15877 - DNA, 71 bp, chicken (Gallus Gallus)
  misc_feature (36): n=a or g
gagactttaggggtaggagtacaagagaagcccccnttagattggtcactctctccaaagtcatacgtctc

SEQ ID NO: 15878 - DNA, 71 bp, chicken (Gallus Gallus)
  misc_feature (36): n=c or t
tgtggcagcaggcaatggcacgttggtgccaacccngcagaagacacctcaccaatgtgtcaccaatgctt

SEQ ID NO: 15879 - DNA, 71 bp, chicken (Gallus Gallus)
  misc_feature (36): n=c or t
gtttagtttgggcttttagctgtgactttgtgttgnatttggggagatctgtaacacggtgattgcagcgt

SEQ ID NO: 15880 - DNA, 71 bp, chicken (Gallus Gallus)
  misc_feature (36): n=c or t
aacctaagaggggatctaacatcctgctgaggcttngtcacgaagcataatagtgttctctccagcgtaag

SEQ ID NO: 15881 - DNA, 71 bp, chicken (Gallus Gallus)
  misc_feature (36): n=a or g
tggctgctggtatctcaagttgctacactggagtangcagatgctggggctgtggtgctgggggaggagag

SEQ ID NO: 15882 - DNA, 71 bp, chicken (Gallus Gallus)
  misc_feature (36): n=g or t
gggtaggattactttgcaatgcctctgtgtgtgtgnggggagcagcagcatcacagctccctgtgtgctgc

SEQ ID NO: 15883 - DNA, 71 bp, chicken (Gallus Gallus)
  misc_feature (36): n=c or t
ggggctgtggtgctgggggaggagaggggtctgcantgtgttctgttcacatttgggtgacaaagactgag

SEQ ID NO: 15884 - DNA, 71 bp, chicken (Gallus Gallus)
  misc_feature (36): n=c or t
tctcttacatccaaaagagatcttgctgcacatacnggaatagcatgattggctttatgggttctcttcat

SEQ ID NO: 15885 - DNA, 71 bp, chicken (Gallus Gallus)
  misc_feature (36): n=a or g
cacctgcacagcaaaacaaccacagagtctgccttngctggaataaagccaaggagaaacacgttacgaca

SEQ ID NO: 15886 - DNA, 71 bp, chicken (Gallus Gallus)
  misc_feature (36): n=c or t
ttacctgtataatgcgttttcttcaccagtgatggngatggccaccaagatacaagagataactgcccatc

SEQ ID NO: 15887 - DNA, 71 bp, chicken (Gallus Gallus)
  misc_feature (36): n=a or g
tttcagtggtggaggaaggtgggaatgagtaaaatngaaggtttttttgttgtgcgtggggactgcactca

SEQ ID NO: 15888 - DNA, 71 bp, chicken (Gallus Gallus)
  misc_feature (36): n=c or t
cactttattttaatttgtaaaaactttgatgtttgngaacttggctcttgtacagtcctaaactaccagca

SEQ ID NO: 15889 - DNA, 71 bp, chicken (Gallus Gallus)
  misc_feature (36): n=c or g
cccagaagtgacacttgggttctgaacactctcacntcaccagagtgaccgctccaaacaacgacagcgac

SEQ ID NO: 15890 - DNA, 71 bp, chicken (Gallus Gallus)
  misc_feature (36): n=c or t
gataacttgtttttaaatagaaaataccatggtgtnaggctacatgcaatttctctcataactttgatgac

SEQ ID NO: 15891 - DNA, 71 bp, chicken (Gallus Gallus)
  misc_feature (36): n=g or t
tatgtgtgaatttagtatgcatagcatttggtcatngagagagtgctcccaggaggaaaattgtgcccttc

SEQ ID NO: 15892 - DNA, 71 bp, chicken (Gallus Gallus)
  misc_feature (36): n=c or t
atactgtaatctcatgttcacccaattaaccatcancataaattactgtctaacgaatccttgataactgt

SEQ ID NO: 15893 - DNA, 71 bp, chicken (Gallus Gallus)
  misc_feature (36): n=a or t
catgggaatcagagtgttttttgaaattatgttacnaacatttttacccaaagaaagcttacagtaaaaac

SEQ ID NO: 15894 - DNA, 71 bp, chicken (Gallus Gallus)
  misc_feature (36): n=a or g
aggtgaggaaaatgagagcactgagcaatggtttcntctaattcctccatggacggtgcaacgtgctggca

SEQ ID NO: 15895 - DNA, 71 bp, chicken (Gallus Gallus)
  misc_feature (36): n=a or g
ctagcattgctacacagcgatgtctccacgaggacntttgctgcaagtcatgctctgctgtacgagcagtg

SEQ ID NO: 15896 - DNA, 71 bp, chicken (Gallus Gallus)
  misc_feature (36): n=c or t
agctgtggggttttactgttctatgaaaatatgaangccccttcaaagagagagacaagcaaaatatttgt

SEQ ID NO: 15897 - DNA, 71 bp, chicken (Gallus Gallus)
  misc_feature (36): n=c or t
acacattttgcaggttttcagacagactcgttgctnaaaagtgaaataccccgacacatctgtgtgtttga

SEQ ID NO: 15898 - DNA, 71 bp, chicken (Gallus Gallus)
  misc_feature (36): n=a or g
ttcttgtcttgtgtatgatgtactctgatgtatgangtactctggcttcctggtttcatttttatttgtgc

SEQ ID NO: 15899 - DNA, 71 bp, chicken (Gallus Gallus)
  misc_feature (36): n=a or g
ctgtgcctggcctggggctctccctgaggctgtctngagcagtgtcgtgctgctatccagcaagaattgcc

SEQ ID NO: 15900 - DNA, 71 bp, chicken (Gallus Gallus)
  misc_feature (36): n=a or g
tttttgaaggcttgtaaaaatgaacataaataatcntttttaagaaccttttaaagtggttgttttccact

SEQ ID NO: 15901 - DNA, 71 bp, chicken (Gallus Gallus)
  misc_feature (36): n=a or g
ctccttccgaggaaggctctgggggcagtttccganctgttggcatcgactctgatgggtttgtgtcctgg

SEQ ID NO: 15902 - DNA, 71 bp, chicken (Gallus Gallus)
  misc_feature (36): n=c or t
gtccctctccatcttccctacaggtccctgacaagngaagtaattcttactcatcgctagtttggggcata

SEQ ID NO: 15903 - DNA, 71 bp, chicken (Gallus Gallus)
  misc_feature (36): n=c or t
cataaccttatgtgtcctttccacaactatggcacngtacaaacagcacccaagctgccgtccagccatct

SEQ ID NO: 15904 - DNA, 71 bp, chicken (Gallus Gallus)
  misc_feature (36): n=c or t
atttttctgtgtaattaaagaaaagcagatttcatntatattgatctttgccaaaaaaagtctcgttctgt

SEQ ID NO: 15905 - DNA, 71 bp, chicken (Gallus Gallus)
  misc_feature (36): n=c or t
ctttcttgcacactgttttcttaacagttggtgagnttggtagagttttgcttttcatggatgttggtttc

SEQ ID NO: 15906 - DNA, 71 bp, chicken (Gallus Gallus)
  misc_feature (36): n=g or t
cattgattattttccacagctttggttcaggagtcncaatcaagttgaactttttctcatttgaatgcatc

SEQ ID NO: 15907 - DNA, 71 bp, chicken (Gallus Gallus)
  misc_feature (36): n=g or t
agggctgctcgtggaggagtctttgtgggtgaaatntggcactccaccaaataggtccaagagcaataaag

SEQ ID NO: 15908 - DNA, 71 bp, chicken (Gallus Gallus)
  misc_feature (36): n=a or g
gaggctgtctggggaagatcactactgtggagtaantcataagagactgctttaagagccactcacctgtg

SEQ ID NO: 15909 - DNA, 71 bp, chicken (Gallus Gallus)
  misc_feature (36): n=a or g
atgtgcaaaagtgatgaaattagaatttgccaaccncttcattaaatttcttaacgttggcaataatgaga

SEQ ID NO: 15910 - DNA, 71 bp, chicken (Gallus Gallus)
  misc_feature (36): n=c or t
tacattaacttctttgttttttaccttaaagtgaangttacaaaagtagagaggagtttcgtaacatctcg

SEQ ID NO: 15911 - DNA, 71 bp, chicken (Gallus Gallus)
  misc_feature (36): n=c or t
agttccctcggctctcacaggcagcagagttcgggntgtgaattatattggatacacttgtttgaagtgag

SEQ ID NO: 15912 - DNA, 71 bp, chicken (Gallus Gallus)
  misc_feature (36): n=c or g
gcatttgcacctcagtatctggccgttgaaaaagtnttgggcctggaccctgaaaaaaccaacgtcaatgg

SEQ ID NO: 15913 - DNA, 71 bp, chicken (Gallus Gallus)
  misc_feature (36): n=c or t
gtgaggccgttctctcgcccagttctgcaagttcangacatctggagcattctggatctcagatgctgatc

SEQ ID NO: 15914 - DNA, 71 bp, chicken (Gallus Gallus)
  misc_feature (36): n=c or t
aatgccacactacaattagtaaacccaaatttcaanggcttggtaactgcaactgacagcagcctttgtcc

SEQ ID NO: 15915 - DNA, 71 bp, chicken (Gallus Gallus)
  misc_feature (36): n=a or c
aggtcaatagatttaaggaacttcaaaattcttggnacagcattaccatcaccgtatattttggagctata

SEQ ID NO: 15916 - DNA, 71 bp, chicken (Gallus Gallus)
  misc_feature (36): n=a or g
atctgtcacagtgatctgcatgcttacagcagcatngacaaattttaaccaaaagacattgcgtcctgggt

SEQ ID NO: 15917 - DNA, 71 bp, chicken (Gallus Gallus)
  misc_feature (36): n=c or g
gtttgagccatgggttttgcaggacatggtccactnctcacacaggagccatcatccctcttgttgcacat

SEQ ID NO: 15918 - DNA, 71 bp, chicken (Gallus Gallus)
  misc_feature (36): n=a or g
cttggtgccaccaggccatgtggtgcctgagctagnatgagtttggtcccagctactccctgcagatggcc

SEQ ID NO: 15919 - DNA, 71 bp, chicken (Gallus Gallus)
  misc_feature (36): n=c or t
aggtcagaccacgcgggctgcaggtttcaccctgangtggctctggttacaaaatactggctcccagctcc

SEQ ID NO: 15920 - DNA, 71 bp, chicken (Gallus Gallus)
  misc_feature (36): n=c or t
cccagtctctttaaagtattactttttcagtgttanttggtatagttggatgatttccagtgtggatgacc

SEQ ID NO: 15921 - DNA, 71 bp, chicken (Gallus Gallus)
  misc_feature (36): n=c or t
actctgtcgcttctggaagaatcctctcttcctgcngccctgggagtgccgggttaacatttccctgctgc

SEQ ID NO: 15922 - DNA, 71 bp, chicken (Gallus Gallus)
  misc_feature (36): n=c or t
ggcgatgcacgtctcaggtgtgaacctgctcctaangcagctctttgcctccccaggcatctacctcaacc

SEQ ID NO: 15923 - DNA, 71 bp, chicken (Gallus Gallus)
  misc_feature (36): n=a or g
ggtgtatcggggatcttgaaccaaaatttgatgaancaaatggaaaggctcccatcattcgtagtcaattt

SEQ ID NO: 15924 - DNA, 71 bp, chicken (Gallus Gallus)
  misc_feature (36): n=a or g
cttctgtttcttactatttctgggccatacaatatngtgaagaatatttgccaggcagcgccttttgcaga

SEQ ID NO: 15925 - DNA, 71 bp, chicken (Gallus Gallus)
  misc_feature (36): n=a or t
tcgtggttgtatggggcaggctcggtcctccatcgngtcctactgcatctactaaccaaaagctttctgca

SEQ ID NO: 15926 - DNA, 71 bp, chicken (Gallus Gallus)
  misc_feature (36): n=c or g
tagcccattaagagaaatgagtccaacctacagaantgaatagaaatggaacatcagtgacatttgtttta

SEQ ID NO: 15927 - DNA, 71 bp, chicken (Gallus Gallus)
  misc_feature (36): n=a or g
tgatgagtattcatatctcttcatggcctgttgaanatggcatccatcttattattgaattacgaaagcca

SEQ ID NO: 15928 - DNA, 71 bp, chicken (Gallus Gallus)
  misc_feature (36): n=a or g
agctttaaccttacctttagagcaaccagaacagcntgtgttttcgacttcagccccacagtggctgagcc

SEQ ID NO: 15929 - DNA, 71 bp, chicken (Gallus Gallus)
  misc_feature (36): n=a or g
ctgtttagaaagcacaagtcatccaataatatatcntgtgcttcccagggaaatagcagtgggaatttctc

SEQ ID NO: 15930 - DNA, 71 bp, chicken (Gallus Gallus)
  misc_feature (36): n=c or t
cacactgaggaccttttgcttcttagtggaaaccanggaggtgatgaatgagcactagtacatctgtagga

SEQ ID NO: 15931 - DNA, 71 bp, chicken (Gallus Gallus)
  misc_feature (36): n=c or t
tgggaaacatagggaaaacttggctatttgctgtcncatgcaattaccagatgtttgccatggtaacccct

SEQ ID NO: 15932 - DNA, 71 bp, chicken (Gallus Gallus)
  misc_feature (36): n=a or c
gagagaaaaaaaatatataaatataaatatattaantatattaaaacatattcacttacaaactacagaga

SEQ ID NO: 15933 - DNA, 71 bp, chicken (Gallus Gallus)
  misc_feature (36): n=c or t
actgaacgccctgtaatgagcaggagggaaaaaaanaatcattaaaaaaatcaggctaaaaaagcactgct

SEQ ID NO: 15934 - DNA, 71 bp, chicken (Gallus Gallus)
  misc_feature (36): n=g or t
ctttaaaggtgacacttggcagttgtctgaaaaatntactaaacagttttacagcctctagagaagaattc

SEQ ID NO: 15935 - DNA, 71 bp, chicken (Gallus Gallus)
  misc_feature (36): n=c or g
gtaaggagaaggctttagaagacattcctacattgngaatgaacacagaactcaagaggcaaaatttacac

SEQ ID NO: 15936 - DNA, 71 bp, chicken (Gallus Gallus)
  misc_feature (36): n=c or t
gggtaattgcagtgcagtcagaacaagatgatctcnacagctcctttagtatgtctggcatcacttccaca

SEQ ID NO: 15937 - DNA, 71 bp, chicken (Gallus Gallus)
  misc_feature (36): n=a or g
cctcatacttggagctgaaggctagatagctagaantggggagggatgcagaaagcatacctctttttgat

SEQ ID NO: 15938 - DNA, 71 bp, chicken (Gallus Gallus)
  misc_feature (36): n=a or g
tgtctcttacccagcaaactgttcactggccttaancatgttaagcagtgcattgtgtcacatcctgtaag

SEQ ID NO: 15939 - DNA, 71 bp, chicken (Gallus Gallus)
  misc_feature (36): n=c or t
atactatatactccttatatattataaactccttantcagcatatatattatatatattattgcagaacat

SEQ ID NO: 15940 - DNA, 71 bp, chicken (Gallus Gallus)
  misc_feature (36): n=a or c
taaagttctgcctttgtgttggatggatttcatttncagatactatttgtcatgctgaaagttctcaattc

SEQ ID NO: 15941 - DNA, 71 bp, chicken (Gallus Gallus)
  misc_feature (36): n=a or g
caatctgcacagctggggtacagttttccctccttntcttagtaggtgacaacttacctaagtcctttggg

SEQ ID NO: 15942 - DNA, 71 bp, chicken (Gallus Gallus)
  misc_feature (36): n=a or t
ctggagagctcctgttctaactgccttgtaagcatngtaaaaaatagtaactacaacctaaagcataacaa

SEQ ID NO: 15943 - DNA, 71 bp, chicken (Gallus Gallus)
  misc_feature (36): n=a or t
aggcattgagtactgtaaggaagccagtttcctttnactgtgaagggacttttcctattactggttgttcc

SEQ ID NO: 15944 - DNA, 71 bp, chicken (Gallus Gallus)
  misc_feature (36): n=c or t
ctgacctctgctgtaagtagaaatctgtccccaaanactgggataatctggcttgcatttttataccactc

SEQ ID NO: 15945 - DNA, 71 bp, chicken (Gallus Gallus)
  misc_feature (36): n=c or g
agaagtcatgaaagcaagaccctgtgccatctcatncaactgtaaagttagctctgtttgagtaggagatt

SEQ ID NO: 15946 - DNA, 71 bp, chicken (Gallus Gallus)
  misc_feature (36): n=a or g
gctttaagctttcatctttcttgagtcaaagctctntgtttggactctgagtggaacgttgacccaataga

SEQ ID NO: 15947 - DNA, 71 bp, chicken (Gallus Gallus)
  misc_feature (36): n=a or g
tcgcctgctgtgggagggggagatgggcagtcacantgatgctcatttcctacggaaaacaggctgtgaat

SEQ ID NO: 15948 - DNA, 71 bp, chicken (Gallus Gallus)
  misc_feature (36): n=g or t
atcttccaagatgttttagagtgggacatacagatncataagccactgttttctgaatgtaattttgaatg

SEQ ID NO: 15949 - DNA, 71 bp, chicken (Gallus Gallus)
  misc_feature (36): n=a or t
ctcacatagcatgttacaaacctggatgtcaaagtnctcaacgaaaagcctatagcattgtttctgtctca

SEQ ID NO: 15950 - DNA, 71 bp, chicken (Gallus Gallus)
  misc_feature (36): n=a or g
tctctccagtgtcagcagaaggcaactgttttcctnatttaggttaagtttgcaaaggtaggaaggatcat

SEQ ID NO: 15951 - DNA, 71 bp, chicken (Gallus Gallus)
  misc_feature (36): n=a or g
ctgctgtaaactagtggttaaaaagctgtcttgctngttgctgagacttgcagaaatgcaactaaattgaa

SEQ ID NO: 15952 - DNA, 71 bp, chicken (Gallus Gallus)
  misc_feature (36): n=c or t
tcctggtaggtaataaaacttccaactcaatatctngtgttttattgacatagataccatcaatatttatg

SEQ ID NO: 15953 - DNA, 71 bp, chicken (Gallus Gallus)
  misc_feature (36): n=c or t
gctgttcagggtatatagccaattcacacttcatcntatgatatttttaattacaaatgtgatgttcttct

SEQ ID NO: 15954 - DNA, 71 bp, chicken (Gallus Gallus)
  misc_feature (36): n=a or g
gtagtaaatcaaattattgcatcttctagttctaantgactcacatagtggaaggtacactaatcctacaa

SEQ ID NO: 15955 - DNA, 71 bp, chicken (Gallus Gallus)
  misc_feature (36): n=c or g
cattttaatttgaaattcaaattatttttcaatcantttttgtagtttaccggtaatttttttttccatat

SEQ ID NO: 15956 - DNA, 71 bp, chicken (Gallus Gallus)
  misc_feature (36): n=a or g
tgcttggagttctggggctaggtataaagcacaaanaaacccccaccatttccccttctcacaaactctgt

SEQ ID NO: 15957 - DNA, 71 bp, chicken (Gallus Gallus)
  misc_feature (36): n=a or g
atttgcttgtaggctgaagccagacttgcagcaaancgggcggctcgagcagaagcaagagatatacgtat

SEQ ID NO: 15958 - DNA, 71 bp, chicken (Gallus Gallus)
  misc_feature (36): n=c or g
atgctatggggtgtcaaggcctcagagtgtctgctnttgaaaccaatcctctagatacacaagcttatctg

SEQ ID NO: 15959 - DNA, 71 bp, chicken (Gallus Gallus)
  misc_feature (36): n=c or t
tcacagcatcactttttgggcgtgggagttgacaangaggacccatttcactaaatgcttacaaaggatat

SEQ ID NO: 15960 - DNA, 71 bp, chicken (Gallus Gallus)
  misc_feature (36): n=c or t
atttttgagatccttcaaaatacctgtggtagtcangagaacgtttaaaataatgtagctatattattttc

SEQ ID NO: 15961 - DNA, 71 bp, chicken (Gallus Gallus)
  misc_feature (36): n=c or t
tgtcctttaggtcctgcttttgatgcataggccacncagtcagtatgaattgagtttacaatatggtggta

SEQ ID NO: 15962 - DNA, 71 bp, chicken (Gallus Gallus)
  misc_feature (36): n=c or g
cttctttcagggaaagagaggaacatgctaaagatnaaaaagatttcttcagtgtgatttatttttctgga

SEQ ID NO: 15963 - DNA, 71 bp, chicken (Gallus Gallus)
  misc_feature (36): n=a or t
atcttgctttctaatctaaacttccaggcaccagtntatgtacatttgtttatgatcagagaatgcaaaac

SEQ ID NO: 15964 - DNA, 71 bp, chicken (Gallus Gallus)
  misc_feature (36): n=c or t
ttcagtgtatatatatataacacacacacacagatnttccctacaactgccaaatctctcactaccagtgt

SEQ ID NO: 15965 - DNA, 71 bp, chicken (Gallus Gallus)
  misc_feature (36): n=c or t
cctcatcactctcccgaatgcctgaaagaaggctgnggtgaggttgggtcagcttctgctcccgggtaaca

SEQ ID NO: 15966 - DNA, 71 bp, chicken (Gallus Gallus)
  misc_feature (36): n=a or g
ctactctttatatcttttctatttgtgtgattacanttattttaatctacttttgtttgaccaccaaacca

SEQ ID NO: 15967 - DNA, 71 bp, chicken (Gallus Gallus)
  misc_feature (36): n=c or t
agagattgctgagttactcccctcagcctcactgangagtaccaactctgcaagtaatactacagaactgc

SEQ ID NO: 15968 - DNA, 71 bp, chicken (Gallus Gallus)
  misc_feature (36): n=a or g
ggtctaaaactggtcaaattgcaagcctcgtcaccncttgtggttctctctaacgaacgcctcccaacgat

SEQ ID NO: 15969 - DNA, 71 bp, chicken (Gallus Gallus)
  misc_feature (36): n=c or t
gaaaccaaaaattatccctgcacccctcacactctnaacagcaatttttccccctccagtaggatcacctt

SEQ ID NO: 15970 - DNA, 71 bp, chicken (Gallus Gallus)
  misc_feature (36): n=a or g
attcaagaggagcacagcttactttttctgtactcnagtaaatgcctgccttgtcttcagcgacaacgcac

SEQ ID NO: 15971 - DNA, 71 bp, chicken (Gallus Gallus)
  misc_feature (36): n=a or t
ataatttggaatagtaacaaaagaaaaacctggacnaccataactagacagaatctcttcctgaactatac

SEQ ID NO: 15972 - DNA, 71 bp, chicken (Gallus Gallus)
  misc_feature (36): n=a or c
aaaataaacctggtttatttctctgacgttctctgntttttgagcatatacaaaaataaataaataaaatc

SEQ ID NO: 15973 - DNA, 71 bp, chicken (Gallus Gallus)
  misc_feature (36): n=c or t
gatgtcactgagggttaaggacatgtaagctataantggatacattaaaacttctagggtgtttggatttt

SEQ ID NO: 15974 - DNA, 71 bp, chicken (Gallus Gallus)
  misc_feature (36): n=a or g
ggtagatcctcattcatgccactagcatgaggactntcccttttagcccttttttgttacacttggttgta

SEQ ID NO: 15975 - DNA, 71 bp, chicken (Gallus Gallus)
  misc_feature (36): n=a or t
atttaaaattccctaatacttaatgcaaagtgtatnatgtactctacataagttattgctttatggtaaga

SEQ ID NO: 15976 - DNA, 71 bp, chicken (Gallus Gallus)
  misc_feature (36): n=c or t
ttggctcaatgcaaaactgtttttcctcttcagttnttttatgagaaatgatttctgaaagacgtggtgca

SEQ ID NO: 15977 - DNA, 71 bp, chicken (Gallus Gallus)
  misc_feature (36): n=g or t
ctgaaagctgccacgtgtgaaattgaaaggatctgngaacatgtgcagtggtgaagcctggctcccagtgg

SEQ ID NO: 15978 - DNA, 71 bp, chicken (Gallus Gallus)
  misc_feature (36): n=c or t
agaacagtttaatagaacctttcttttttctgtttnccaaatgccattcaacatagcttttaaaaatgttg

SEQ ID NO: 15979 - DNA, 71 bp, chicken (Gallus Gallus)
  misc_feature (36): n=c or t
gctggatcaacaatccagcttttctcttttactagnaagcaacgttctgtattcctcaaacacaatcatga

SEQ ID NO: 15980 - DNA, 71 bp, chicken (Gallus Gallus)
  misc_feature (36): n=c or t
gacatgaacagattaatttttggctcctttctcagntagaattttaacagtttcttctaaagtagctcttc

SEQ ID NO: 15981 - DNA, 71 bp, chicken (Gallus Gallus)
  misc_feature (36): n=a or g
gttttgtgccctttagaaacagggaagcctgtgacngccacagaatgccacatctgaaatcagactcctgg

SEQ ID NO: 15982 - DNA, 71 bp, chicken (Gallus Gallus)
  misc_feature (36): n=a or g
tttttttttcatcactcccagccagactagaaaatnttggaaggcaggggaaaatatatttaaaatgtgaa

SEQ ID NO: 15983 - DNA, 71 bp, chicken (Gallus Gallus)
  misc_feature (36): n=c or t
cacacatgatttgaactgcagaaaagagatgatcgntgtggctcatgtatgcaatctgtctcctgtgaggc

SEQ ID NO: 15984 - DNA, 71 bp, chicken (Gallus Gallus)
  misc_feature (36): n=c or t
accaagaattactaatcacaatcatcataattatanacagctcaaaagttcagagttctaaacctctcaga

SEQ ID NO: 15985 - DNA, 71 bp, chicken (Gallus Gallus)
  misc_feature (36): n=c or t
tatacctgcacgcacacaattgaagcacgactctanatttcatctttgccatgctccagacaaagttaatt

SEQ ID NO: 15986 - DNA, 71 bp, chicken (Gallus Gallus)
  misc_feature (36): n=a or g
tagaggtacataggaaaacaaatgtatttgcctacngattttgaacatttgcatcatacagtttatctaga

SEQ ID NO: 15987 - DNA, 71 bp, chicken (Gallus Gallus)
  misc_feature (36): n=c or g
gtaatatatgtcacagatgaaagaaataagactatnagaactgcagccagaatgtggcctagtagtaaaga

SEQ ID NO: 15988 - DNA, 71 bp, chicken (Gallus Gallus)
  misc_feature (36): n=c or t
atcaatatgctgcagcactgagttaaatgaaaatanacatttatattcaacaggctcaagtagggcctctt

SEQ ID NO: 15989 - DNA, 71 bp, chicken (Gallus Gallus)
  misc_feature (36): n=a or g
gagtatcgcttgcttaggatgcagctgctagaggcntctcccccacatcctaagtttcttgcatgaatcat

SEQ ID NO: 15990 - DNA, 71 bp, chicken (Gallus Gallus)
  misc_feature (36): n=a or g
agatcactgctgctgaatttaatagtatgcatatgngtgagatgcaggacaacaaatatgaagaatatgta

SEQ ID NO: 15991 - DNA, 71 bp, chicken (Gallus Gallus)
  misc_feature (36): n=a or c
cagcagcaaggcacgtgaaaaaaggagttggacaancgcaccgacagcttgagcaacttggtgcctccact

SEQ ID NO: 15992 - DNA, 71 bp, chicken (Gallus Gallus)
  misc_feature (36): n=a or g
caccagcttgatgtgctccagacacgaaccaaaganactctgctctctgcactcccagaagtcactgtgtc

SEQ ID NO: 15993 - DNA, 71 bp, chicken (Gallus Gallus)
  misc_feature (36): n=a or g
aatcatcatactcctcttccctccaaaatgttgagncagaaaatcctttggcttctttatttcaaaagatg

SEQ ID NO: 15994 - DNA, 71 bp, chicken (Gallus Gallus)
  misc_feature (36): n=a or g
cagagtccaatgagatttgaaccacctagccaaaantttggggcatgaaagctttccatccacaccaggga

SEQ ID NO: 15995 - DNA, 71 bp, chicken (Gallus Gallus)
  misc_feature (36): n=c or t
caggaaaccacactgtcttcctcagccacaggagcngtgtcgggaccttgtagctaaaatttgtttttcct

SEQ ID NO: 15996 - DNA, 71 bp, chicken (Gallus Gallus)
  misc_feature (36): n=a or g
cagttggttagaaatgtatgcgttggaaaatggagnaggacttaaatatgttgtcttggtgatggatctga

SEQ ID NO: 15997 - DNA, 71 bp, chicken (Gallus Gallus)
  misc_feature (36): n=c or t
gttgtgttaaactttgtgaattggggcctttaccanaagcaagctaggcaacagttttcttttgtatttct

SEQ ID NO: 15998 - DNA, 71 bp, chicken (Gallus Gallus)
  misc_feature (36): n=c or t
agctcgccttagggctgggggtcaggagggaccccngatgctgttctcctgccagattggagggttttaac

SEQ ID NO: 15999 - DNA, 71 bp, chicken (Gallus Gallus)
  misc_feature (36): n=g or t
acatctggtaggacttctgaagtttaaacagttctnctattctaatgtgacacaggttctaccttctaaag

SEQ ID NO: 16000 - DNA, 71 bp, chicken (Gallus Gallus)
  misc_feature (36): n=c or t
actcatcactggaggagcatttggaaactgttttcngggctatttcaaggaaaatggcacaaagaagcaat

SEQ ID NO: 16001 - DNA, 71 bp, chicken (Gallus Gallus)
  misc_feature (36): n=g or t
cccaaggaaatgctggattcttagggtcacaagaanagatatgaaccccagctgatggttttttatcctca

SEQ ID NO: 16002 - DNA, 71 bp, chicken (Gallus Gallus)
  misc_feature (36): n=a or c
ttctgattttcagtgaaaaagccagaaatgcaaaanactaacatagaatgtgggatgaaaaataaaatgga

SEQ ID NO: 16003 - DNA, 71 bp, chicken (Gallus Gallus)
  misc_feature (36): n=c or g
actttacattcaagatgtttacaggtactgtttctntagattattagaaatttagataagttttcaaattt

SEQ ID NO: 16004 - DNA, 71 bp, chicken (Gallus Gallus)
  misc_feature (36): n=c or t
cacagaggaagaaggtattcagagtgatggaggtangggaaggggaagtattgaatctgggtcggaagcta

SEQ ID NO: 16005 - DNA, 71 bp, chicken (Gallus Gallus)
  misc_feature (36): n=a or g
ccagtgctttattcagtattttatttctttctgttntagtatttcagacaccttttaagaggagcagagtc

SEQ ID NO: 16006 - DNA, 71 bp, chicken (Gallus Gallus)
  misc_feature (36): n=a or t
tggggggatctactatttactcagctgtgccaagtngtgacaatgcactctttgccttcaccctcatttta

SEQ ID NO: 16007 - DNA, 71 bp, chicken (Gallus Gallus)
  misc_feature (36): n=a or g
tggcatgcacccagcattatcagttgaagaaaggangaaaggaggaaaggaggaaaggaggaaaggaggaa

SEQ ID NO: 16008 - DNA, 71 bp, chicken (Gallus Gallus)
  misc_feature (36): n=a or c
caatacgatcaggatatagtgtgcctgtgcagaatngttatcaattttattacattaagcctctcttcctt

SEQ ID NO: 16009 - DNA, 71 bp, chicken (Gallus Gallus)
  misc_feature (36): n=c or g
aaggagggatgaggaaaggatgaagctcacttcccnttttcttgagatgaaaggtgcatggtatcacagaa

SEQ ID NO: 16010 - DNA, 71 bp, chicken (Gallus Gallus)
  misc_feature (36): n=a or g
catgtggtctactcataatgtgctgctccgctgccnatagcccttggaaggatcagtcttcacaagaaatc

SEQ ID NO: 16011 - DNA, 71 bp, chicken (Gallus Gallus)
  misc_feature (36): n=c or t
cttgctataaaacatctgggaaatactactaaaccnacaaaatggggcaaagaaatactgtttttctgtgc

SEQ ID NO: 16012 - DNA, 71 bp, chicken (Gallus Gallus)
  misc_feature (36): n=g or t
tgtcaccagtgactcctcagggaggctgatcaaatngttggaagaaacctatgggatacctgatggaatga

SEQ ID NO: 16013 - DNA, 71 bp, chicken (Gallus Gallus)
  misc_feature (36): n=c or t
taaaggtcccttccaactcaaacaattctattattntaagaatttgtccaggtcttgtatttcatggcatg

SEQ ID NO: 16014 - DNA, 71 bp, chicken (Gallus Gallus)
  misc_feature (36): n=c or t
atatggaatcacatcaagggaatctaatttgaggtnatactcatatccctttcatttcttgatcttatagt

SEQ ID NO: 16015 - DNA, 71 bp, chicken (Gallus Gallus)
  misc_feature (36): n=a or g
tgctggaacgcctttttttttctgtttgtttctttntttttagcactttttgtttgaccacgtagtacaac

SEQ ID NO: 16016 - DNA, 71 bp, chicken (Gallus Gallus)
  misc_feature (36): n=c or t
aatctgagtatctttttatcctccatagttgatcanaaagacattaatgattggaatctaaggcatatgtc

SEQ ID NO: 16017 - DNA, 71 bp, chicken (Gallus Gallus)
  misc_feature (36): n=c or g
aacgtcaatattttctccagaaagaaacaggctggncctcacatgggccagcagcagagctcagcacagac

SEQ ID NO: 16018 - DNA, 71 bp, chicken (Gallus Gallus)
  misc_feature (36): n=c or g
taaatcagattaacagtttattaggaatgtccacantaagtgtacgtgcatacactgatacttcactgttt

SEQ ID NO: 16019 - DNA, 71 bp, chicken (Gallus Gallus)
  misc_feature (36): n=c or t
ccaaagggaaatttggcacttactgttagattccanagacaatcctaattgctccagcaagactcctgagc

SEQ ID NO: 16020 - DNA, 71 bp, chicken (Gallus Gallus)
  misc_feature (36): n=c or t
gcatccatctgaaatctaggcatcatgctacaaacnatgagattcagccttcaaaattttttaaaccatga

SEQ ID NO: 16021 - DNA, 71 bp, chicken (Gallus Gallus)
  misc_feature (36): n=c or t
caccacaaataccaataaaatcttcctctaaagcangaggatgtgaattccttcacttaaagctgtcagat

SEQ ID NO: 16022 - DNA, 71 bp, chicken (Gallus Gallus)
  misc_feature (36): n=a or t
gacagataaacgagcatgacagggtgggtaagtaangcccttcttcaccagtctaaattcttttgaagaaa

SEQ ID NO: 16023 - DNA, 71 bp, chicken (Gallus Gallus)
  misc_feature (36): n=c or t
gaataaaaaaaaggaacaacagaaactgtcattgcnagaaaaaaaaatcttcccagaagaaaacacatatt

SEQ ID NO: 16024 - DNA, 71 bp, chicken (Gallus Gallus)
  misc_feature (36): n=a or t
gagcctcttacatgcatgtctctgaaaaccttaaangtaaaaagggttcgagcttggttgcacagataatg

SEQ ID NO: 16025 - DNA, 71 bp, chicken (Gallus Gallus)
  misc_feature (36): n=g or t
aattaaaacatcataaaagcaagaccctcacaggangaaaacgcacgtacgaaaccagaaaataatgagaa

SEQ ID NO: 16026 - DNA, 71 bp, chicken (Gallus Gallus)
  misc_feature (36): n=c or t
gctgctaggatttggaaggtggcaagaagatgtggntatttgattttgaaaacagcctcctattgcctcta

SEQ ID NO: 16027 - DNA, 71 bp, chicken (Gallus Gallus)
  misc_feature (36): n=a or g
ccaaatggcttgaggaacaagtcagactagcaggangccttatacaggagctgtgcaaaatgcatctgatg

SEQ ID NO: 16028 - DNA, 71 bp, chicken (Gallus Gallus)
  misc_feature (36): n=c or t
tacagatgtgtggcaatgagctaatctcctttaccnacagttagtagagcttcttcataccagcattagtg

SEQ ID NO: 16029 - DNA, 71 bp, chicken (Gallus Gallus)
  misc_feature (36): n=c or t
ttttgccgtgtgcttttgtttactttcccactcccnaccatagagtacttctctataatttttattttgtt

SEQ ID NO: 16030 - DNA, 71 bp, chicken (Gallus Gallus)
  misc_feature (36): n=a or g
gcggcgttcccaggcagggaaaggcagcactccaancctggtgaggattttaggcaggattgaaactgtgt

SEQ ID NO: 16031 - DNA, 71 bp, chicken (Gallus Gallus)
  misc_feature (36): n=a or g
taaattaaagactgggaaaatactgacttacatacntgtttctagctgtacttttgctatctagccgaaca

SEQ ID NO: 16032 - DNA, 71 bp, chicken (Gallus Gallus)
  misc_feature (36): n=c or t
aaccaaaataacctcccaccacctactgtagctctncaaagtggaaatttcaaagaaacctatagggaagc

SEQ ID NO: 16033 - DNA, 71 bp, chicken (Gallus Gallus)
  misc_feature (36): n=c or t
gtgaggtaactgttctcattttcatctcagtagganttagtcttctaagagacatgagagaatgaatatag

SEQ ID NO: 16034 - DNA, 71 bp, chicken (Gallus Gallus)
  misc_feature (36): n=a or t
tctcctggttttagactctgctgtatgtagtaggangctttctatggtagtagctaaccagaaaagtgaaa

SEQ ID NO: 16035 - DNA, 71 bp, chicken (Gallus Gallus)
  misc_feature (36): n=c or t
catgtggaaaaccagacagtatgctgacagaacaancattactcttaacattaagaaaaatttaatgcatt

SEQ ID NO: 16036 - DNA, 71 bp, chicken (Gallus Gallus)
  misc_feature (36): n=c or t
taattcagcaacctgttgtcattcacactgaagtgnacccactaactgctttctaatagtaccgtcctttt

SEQ ID NO: 16037 - DNA, 71 bp, chicken (Gallus Gallus)
  misc_feature (36): n=c or t
aatgtacaatgactacactttagacaagatcaaggngaaaaatctggataggcccataaagtagttttgtg

SEQ ID NO: 16038 - DNA, 71 bp, chicken (Gallus Gallus)
  misc_feature (36): n=a or g
taagtagagatgaaggtgagagaaggccaaatgagngcaaacttactgccagtactctggaggatggtcta

SEQ ID NO: 16039 - DNA, 71 bp, chicken (Gallus Gallus)
  misc_feature (36): n=c or t
ttccattcacctaatagtggtagaactgagggtgcngtaagagcttggctaagtaattatgttttagaaga

SEQ ID NO: 16040 - DNA, 71 bp, chicken (Gallus Gallus)
  misc_feature (36): n=a or g
ccgaaagttgggaaaagtcgggaaaggcgatgaaancgatgcctctgtgtctggagataggtgggttttgt

SEQ ID NO: 16041 - DNA, 71 bp, chicken (Gallus Gallus)
  misc_feature (36): n=a or g
atgcaatgattttgctctcatctcgcagcaaggaanagcactgcacaattcctgtttttcctgcagaaaaa

SEQ ID NO: 16042 - DNA, 71 bp, chicken (Gallus Gallus)
  misc_feature (36): n=c or t
tcttcttctagttccctctgctgctcctcatgtcgntttgcctttatctccatagcttcagtgataaggtc

SEQ ID NO: 16043 - DNA, 71 bp, chicken (Gallus Gallus)
  misc_feature (36): n=a or g
tttggcttgtctgaagtaacctctgttgtcctgaantacgatcataagttcattgagaacattggatatgt

SEQ ID NO: 16044 - DNA, 71 bp, chicken (Gallus Gallus)
  misc_feature (36): n=c or t
tttcagattgctactgtggtctgttcacaggatgangaatattaagatgcatgctttccacataagtatta

SEQ ID NO: 16045 - DNA, 71 bp, chicken (Gallus Gallus)
  misc_feature (36): n=a or g
gaatcattccattatcagagccaccaatgtcatagncaagcctatgaagaagtaaaaaaagagtcttcaaa

SEQ ID NO: 16046 - DNA, 71 bp, chicken (Gallus Gallus)
  misc_feature (36): n=c or t
agtttgctgcaaagatactgctgctgtgtagtttcngtctaggtgtccagatttttcaacttcagctttct

SEQ ID NO: 16047 - DNA, 71 bp, chicken (Gallus Gallus)
  misc_feature (36): n=c or t
aaagcgtgtgatagcacctaactacaatacctgtcntctggagcaaaaatcatcgcctacaattaagtact

SEQ ID NO: 16048 - DNA, 71 bp, chicken (Gallus Gallus)
  misc_feature (36): n=a or g
tacatagctctggctgaagactacacaacacacccnaagtaagtctaatcatttctaaattcctggacaaa

SEQ ID NO: 16049 - DNA, 71 bp, chicken (Gallus Gallus)
  misc_feature (36): n=c or t
atgaatgaataaatgaagtgctttaaagatgtagtnaatgcactgttatttctctccttaggaatgtgaat

SEQ ID NO: 16050 - DNA, 71 bp, chicken (Gallus Gallus)
  misc_feature (36): n=a or c
ttgcagagacactcatttggaggtagtggagtggcncaggccagcttgtttgggacctttcctgggaagca

SEQ ID NO: 16051 - DNA, 71 bp, chicken (Gallus Gallus)
  misc_feature (36): n=a or g
catagtttcctagtgacagcacttcacaagactganttgccgtacacatccagtttgccaatatttcactg

SEQ ID NO: 16052 - DNA, 71 bp, chicken (Gallus Gallus)
  misc_feature (36): n=a or t
tccacaagcaattgagggtatgtggacaagtcatangtttattaggtaagccgtggagtcatgtattggct

SEQ ID NO: 16053 - DNA, 71 bp, chicken (Gallus Gallus)
  misc_feature (36): n=c or t
aaatggttcagcagcccacagtgctgtaatagattncaagatgagaacagacaaatgatacaatgatgtga

SEQ ID NO: 16054 - DNA, 71 bp, chicken (Gallus Gallus)
  misc_feature (36): n=g or t
taatagtcacgtacagcatggagtccttttcacagncagctgaacatttggttatggcctgagcctaaaaa

SEQ ID NO: 16055 - DNA, 71 bp, chicken (Gallus Gallus)
  misc_feature (36): n=a or c
aagctttcccaggcatactttttgttcctcttccangggaaaatgttcccttcctgtgaccaatcccagag

SEQ ID NO: 16056 - DNA, 71 bp, chicken (Gallus Gallus)
  misc_feature (36): n=a or g
atctacaccctactctgacattctgcttatttctcngacccaagaccaatagctgattggactctgctaag

SEQ ID NO: 16057 - DNA, 71 bp, chicken (Gallus Gallus)
  misc_feature (36): n=g or t
ttcagcccagacaaatacagcctgactctgcccagngtgcactttggttttctatgccttatgtgggataa

SEQ ID NO: 16058 - DNA, 71 bp, chicken (Gallus Gallus)
  misc_feature (36): n=a or g
agactcacagaatcattgcctgctgcctcatgcacncaatttgcttccctgctgtcaagtgaactcctgcc

SEQ ID NO: 16059 - DNA, 71 bp, chicken (Gallus Gallus)
  misc_feature (36): n=c or t
tactgtggcccagaacaccagacctgtcacaagcangtagatacccaatgaaaatgactattgaaattcct

SEQ ID NO: 16060 - DNA, 71 bp, chicken (Gallus Gallus)
  misc_feature (36): n=c or t
aactaaaggtcctggaaagtgtctaagctgaagccngggcttcctttctaaaccaaactacactgtattat

SEQ ID NO: 16061 - DNA, 71 bp, chicken (Gallus Gallus)
  misc_feature (36): n=a or t
ccttaaactttgctgtcttgagaagccaatcactancacagtatatgtgatcagaagaaaaacacagtagt

SEQ ID NO: 16062 - DNA, 71 bp, chicken (Gallus Gallus)
  misc_feature (36): n=c or t
tgaaaggacacttttaatgtccccaaaaggactgangagacaatatttgtccacgtctgcactgggggttt

SEQ ID NO: 16063 - DNA, 71 bp, chicken (Gallus Gallus)
  misc_feature (36): n=c or t
aaacaggagggcagacattccttactagggagttanttctttataacaatgagagcaacatagctgaaaag

SEQ ID NO: 16064 - DNA, 71 bp, chicken (Gallus Gallus)
  misc_feature (36): n=c or t
atcttagagtcgtggctgtgtttccgtccccacctntttctgattcaaagtgtccacttctggctcttgac

SEQ ID NO: 16065 - DNA, 71 bp, chicken (Gallus Gallus)
  misc_feature (36): n=c or t
tggcaatgagaaagcaaagcttcagtgtattactcngcttatagattttgactggttgccagtgttccttc

SEQ ID NO: 16066 - DNA, 71 bp, chicken (Gallus Gallus)
  misc_feature (36): n=c or g
agggtgatggtcatgatccttaccaatgtatcctgntatctaataacagctgagaaaaacacacctgcata

SEQ ID NO: 16067 - DNA, 71 bp, chicken (Gallus Gallus)
  misc_feature (36): n=a or t
tacctatagcatttccaaatccccatctcaaagcanatgtactttcacttgtggggactttgttctgattt

SEQ ID NO: 16068 - DNA, 71 bp, chicken (Gallus Gallus)
  misc_feature (36): n=a or g
ccctcatgctctgtcctctgccccatctcccccagnctgaaaccagcagttccagtccacaactccaccag

SEQ ID NO: 16069 - DNA, 71 bp, chicken (Gallus Gallus)
  misc_feature (36): n=c or g
aggctgaggggtggcttgttttaagaccagccttgnaagcaaataaaaatcatccaaaggagaaatgaaaa

SEQ ID NO: 16070 - DNA, 71 bp, chicken (Gallus Gallus)
  misc_feature (36): n=g or t
gtgcagtgagcagtataaaggtttaaatgtacagtngtctcagtaaatttcctggagatctttggtggtgc

SEQ ID NO: 16071 - DNA, 71 bp, chicken (Gallus Gallus)
  misc_feature (36): n=g or t
agaaatagctaaagtgttagcacacgtagaacaacntaacatgtcagtctagttttataactcaaggtagc

SEQ ID NO: 16072 - DNA, 71 bp, chicken (Gallus Gallus)
  misc_feature (36): n=a or g
cagcatcctgcaggtgatgcccaggcacttgcctcngggacaaacagaaagcatcttgcatgaaatttgca

SEQ ID NO: 16073 - DNA, 71 bp, chicken (Gallus Gallus)
  misc_feature (36): n=a or c
tatttttctcaaaagaagacagataatctgtgttcnagaaactaaaatgactggttgatcaaatataacca

SEQ ID NO: 16074 - DNA, 71 bp, chicken (Gallus Gallus)
  misc_feature (36): n=a or g
aaattatttacaatgacagtctcacagacttacttntctccatactacattcagaacctgaaactttacaa

SEQ ID NO: 16075 - DNA, 71 bp, chicken (Gallus Gallus)
  misc_feature (36): n=a or g
tccattcgggcagaacataaacaggcttaatgagtncagaattggcaagagccgatatttcttctcaatgt

SEQ ID NO: 16076 - DNA, 71 bp, chicken (Gallus Gallus)
  misc_feature (36): n=a or c
attagagatctccaaggaagaacaaatccaaccccnaaaaaatgtcaactacacgatttaattactaagat

SEQ ID NO: 16077 - DNA, 71 bp, chicken (Gallus Gallus)
  misc_feature (36): n=a or g
ccaaatattctaaactgtcctcacagtaagatatcnttttgcttacctgttaactttccatggaagatgaa

SEQ ID NO: 16078 - DNA, 71 bp, chicken (Gallus Gallus)
  misc_feature (36): n=c or t
ataattgtgacggccttggaggagtcgcaacaatanattttacagctcttacacaacaagcatcgcacctt

SEQ ID NO: 16079 - DNA, 71 bp, chicken (Gallus Gallus)
  misc_feature (36): n=a or g
agatggagaaatagacaaatagaatactttttcaantctgtggtgagagttgcactaagttgtataattat

SEQ ID NO: 16080 - DNA, 71 bp, chicken (Gallus Gallus)
  misc_feature (36): n=a or t
tctattaaagcatgtaacagaactatgttttagttntaaaacaaagcaattcactttcaggttttatcaaa

SEQ ID NO: 16081 - DNA, 71 bp, chicken (Gallus Gallus)
  misc_feature (36): n=g or t
ggaatagactttgaaattagagatttctagaaacangtgagatgcaaaaaatttacatggagccatgtttg

SEQ ID NO: 16082 - DNA, 71 bp, chicken (Gallus Gallus)
  misc_feature (36): n=c or t
atccttttgctttgagctgccagtgtgcatgtgacngctgtggcttgtcattaaatgagtgcaagaagaca

SEQ ID NO: 16083 - DNA, 71 bp, chicken (Gallus Gallus)
  misc_feature (36): n=c or g
tgaggatgtcacaacatccagcatgtaccatctgantgcacctatctgggcttcattctccagttgtgaaa

SEQ ID NO: 16084 - DNA, 71 bp, chicken (Gallus Gallus)
  misc_feature (36): n=a or g
actaaatcacagatgctggaggatttgcaagatacntagttatctcagtcccctgtaacagataccattct

SEQ ID NO: 16085 - DNA, 71 bp, chicken (Gallus Gallus)
  misc_feature (36): n=c or t
ataattactgtattatcatgctgataaaatggaggntcatttaactaagccaaatatgtgaagcaaagtag

SEQ ID NO: 16086 - DNA, 71 bp, chicken (Gallus Gallus)
  misc_feature (36): n=g or t
accaaggaggatgaacactggctgccggacatttcncagatcccagcctttcaaactgcagtcaactgcac

SEQ ID NO: 16087 - DNA, 71 bp, chicken (Gallus Gallus)
  misc_feature (36): n=a or c
gagtttcctggcaaaagattacactgctgtggaagnaagacctagagtatgtatctgtaatttaaagagaa

SEQ ID NO: 16088 - DNA, 71 bp, chicken (Gallus Gallus)
  misc_feature (36): n=a or t
caatactctcattcacagaaaaggatctcagaccanatttaaacacgcttgcataaatctgggtaactagg

SEQ ID NO: 16089 - DNA, 71 bp, chicken (Gallus Gallus)
  misc_feature (36): n=g or t
gtaaaggatagcagcactattatgattactattatnatgaccctcaatgtgctgtgtcgagcatggagtca

SEQ ID NO: 16090 - DNA, 71 bp, chicken (Gallus Gallus)
  misc_feature (36): n=a or g
atggcagagctgcaataggtcatcttcctcccatgncataccactagttgttttggtgacaattgctattt

SEQ ID NO: 16091 - DNA, 71 bp, chicken (Gallus Gallus)
  misc_feature (36): n=c or t
tgtgctctggtttctctcctgagatagtaaatgttnattaaagtatttaaataaactgagtaattaaaata

SEQ ID NO: 16092 - DNA, 71 bp, chicken (Gallus Gallus)
  misc_feature (36): n=g or t
tagtgatggggaagattaaaagttttgactgtccanagggatctggttttcacttgagtaggaaggggaaa

SEQ ID NO: 16093 - DNA, 71 bp, chicken (Gallus Gallus)
  misc_feature (36): n=c or t
cagtctgatggattacagaccaccagcaacttctgntgggggcagggacttcaagtgactggagcttatgg

SEQ ID NO: 16094 - DNA, 71 bp, chicken (Gallus Gallus)
  misc_feature (36): n=a or c
tcggcctttgtatttctcattttactgggttagttnagatccttgcttctttgtttatcaaaccagccgac

SEQ ID NO: 16095 - DNA, 71 bp, chicken (Gallus Gallus)
  misc_feature (36): n=a or g
tcacggattgactgagccacataagatgttcaagtncttggtagcttcagtgagaaatcagtggaaaaaaa

SEQ ID NO: 16096 - DNA, 71 bp, chicken (Gallus Gallus)
  misc_feature (36): n=a or g
tcagcgaagttaagatccctgtcaagcatgaaattnttttttaagcaactgtgtgaatacatttatgggaa

SEQ ID NO: 16097 - DNA, 71 bp, chicken (Gallus Gallus)
  misc_feature (36): n=a or g
atacatgaattcttcaggaactgtgcaaagaaactnatacattactactccacagtagtactagttgtgct

SEQ ID NO: 16098 - DNA, 71 bp, chicken (Gallus Gallus)
  misc_feature (36): n=c or t
cattgagcacatcttaagtgtgcgagattaaactcnaaatttctgtcttaacttgagataggtgaacatta

SEQ ID NO: 16099 - DNA, 71 bp, chicken (Gallus Gallus)
  misc_feature (36): n=a or g
cccagagtatacagatacatcctcttacattaaacnaaagtttaactccagtgcaagaaacacctcgcctt

SEQ ID NO: 16100 - DNA, 71 bp, chicken (Gallus Gallus)
  misc_feature (36): n=c or t
tctcagtggagtgcattttcttgccagctggccttntgaatttgctccctttggcttgatcagtctagaac

SEQ ID NO: 16101 - DNA, 71 bp, chicken (Gallus Gallus)
  misc_feature (36): n=c or t
cctcccaccttagcaaaaaacaactattctgttcangggtttcttagttgtgaaagtggaggtttggagct

SEQ ID NO: 16102 - DNA, 71 bp, chicken (Gallus Gallus)
  misc_feature (36): n=c or t
ctggctttgcaaggcaacactcatcagctacttcanagcaatagcacagggggtctctgagaggaagctgt

SEQ ID NO: 16103 - DNA, 71 bp, chicken (Gallus Gallus)
  misc_feature (36): n=c or g
acaaaagatgctccagttatgtttccagaagcctanctgagtttagggacatactacaactaaaagagtgg

SEQ ID NO: 16104 - DNA, 71 bp, chicken (Gallus Gallus)
  misc_feature (36): n=a or c
caacttgcaattacagtgaaacccctctaagagtanagagattggatgaattcatgccttcaagtaacagg

SEQ ID NO: 16105 - DNA, 71 bp, chicken (Gallus Gallus)
  misc_feature (36): n=a or g
tctttggtgccaacagaatcaggattgtattaaaantgggctccattcttgataatggccagaacatgcta

SEQ ID NO: 16106 - DNA, 71 bp, chicken (Gallus Gallus)
  misc_feature (36): n=c or t
taagtttatacaatatcctaatacaggtgggctttngtggtattagcaagtgctgctgcagggatcctctg

SEQ ID NO: 16107 - DNA, 71 bp, chicken (Gallus Gallus)
  misc_feature (36): n=c or t
tttctttaagtaatatgagtatgtagaaatatgcangtacagataactcaaaaaattcaaccaaaacactt

SEQ ID NO: 16108 - DNA, 71 bp, chicken (Gallus Gallus)
  misc_feature (36): n=c or t
cacctgggatgtaggtattgctgcaggagtttattnttgttggtctgagctttgccttagaatggttccct

SEQ ID NO: 16109 - DNA, 71 bp, chicken (Gallus Gallus)
  misc_feature (36): n=c or t
agatcatgtgtgccatcttctcttcaagaagactgnggaggccactgaaatacagagggagacatacacat

SEQ ID NO: 16110 - DNA, 71 bp, chicken (Gallus Gallus)
  misc_feature (36): n=c or t
gttgagattccttgattttaaataattcaacttcanaataccgacgctgtgatattatcagatctttagga

SEQ ID NO: 16111 - DNA, 71 bp, chicken (Gallus Gallus)
  misc_feature (36): n=c or t
cttgtttccctggaacatgaagggttctttctgatnactataaaaagcttaaacagccacacacacacaca

SEQ ID NO: 16112 - DNA, 71 bp, chicken (Gallus Gallus)
  misc_feature (36): n=a or g
gagaagctatgctgtccactattctggagagtcaancaccaccgtaagagacattctgagaagcccaatca

SEQ ID NO: 16113 - DNA, 71 bp, chicken (Gallus Gallus)
  misc_feature (36): n=c or t
aggtccttaatctgcccatgctaacagagaaacctncaggctctgtcttgcataggtcagagattctttgt

SEQ ID NO: 16114 - DNA, 71 bp, chicken (Gallus Gallus)
  misc_feature (36): n=g or t
aatcaggtagaaatgcatatgagaattgttggtttngggaaaaaaaataattaaaaaaaggattctttttt

SEQ ID NO: 16115 - DNA, 71 bp, chicken (Gallus Gallus)
  misc_feature (36): n=c or t
atattattatggacagtgtttatttttttttttcanaatgctaataacaacatttttcaccacggtcattt

SEQ ID NO: 16116 - DNA, 71 bp, chicken (Gallus Gallus)
  misc_feature (36): n=g or t
gaagtgtcctgcttttcagggtctctgaggagctgnatagagttttcaagatttcaaaatgaatagatggt

SEQ ID NO: 16117 - DNA, 71 bp, chicken (Gallus Gallus)
  misc_feature (36): n=a or g
ctcacaatgttcattaaatggatggctgtccatgcnaaaggcattcgatatttgcctagtctttggcaaaa

SEQ ID NO: 16118 - DNA, 71 bp, chicken (Gallus Gallus)
  misc_feature (36): n=c or t
ttttgtctctgaagtgaagagagaaatgtttgactngggaattaatgcctttttcctacagtaagtgggca

SEQ ID NO: 16119 - DNA, 71 bp, chicken (Gallus Gallus)
  misc_feature (36): n=c or t
aagtatgcaacaggatagactgacttatgtgagatncctccagagagaagcactaaacctcagtctcctga

SEQ ID NO: 16120 - DNA, 71 bp, chicken (Gallus Gallus)
  misc_feature (36): n=a or g
gaatagtgcttttgctctatggaatagtgtggatcngtgtatcagaagaagaaattaataattctttatgc

SEQ ID NO: 16121 - DNA, 71 bp, chicken (Gallus Gallus)
  misc_feature (36): n=c or t
caagatgttgatattatcatcactacagcacttatnccaggtatggaagtgttatatattctctgtgtgaa

SEQ ID NO: 16122 - DNA, 71 bp, chicken (Gallus Gallus)
  misc_feature (36): n=a or c
tgaaccataactgaacactcagaggattaaataganggattattgtttgcagatgtgattgtagtaataaa

SEQ ID NO: 16123 - DNA, 71 bp, chicken (Gallus Gallus)
  misc_feature (36): n=a or t
ggctctcccttagaggaacgcaggagctcaaattgngtatgaagaagcaaaatgaaatacgttccattgca

SEQ ID NO: 16124 - DNA, 71 bp, chicken (Gallus Gallus)
  misc_feature (36): n=c or t
agagtgggaggtgtgtattctgtttgatggtcacanagagatgtcttaaccaattttcagtactgtgaggc

SEQ ID NO: 16125 - DNA, 71 bp, chicken (Gallus Gallus)
  misc_feature (36): n=c or t
ggcctacagttaccactatctagaggatagttaaanatgcaaaaatgttgttggttttactcttctgttat

SEQ ID NO: 16126 - DNA, 71 bp, chicken (Gallus Gallus)
  misc_feature (36): n=g or t
gagaatgcagcacccagagctggaagcgaagtaaangggagctgtcaggactggggttcgtgggggagggc

SEQ ID NO: 16127 - DNA, 71 bp, chicken (Gallus Gallus)
  misc_feature (36): n=c or t
tcttcaggtgcaggatgttaaacaactacacccagntaatataaaatattgttatctgactacagtatgtt

SEQ ID NO: 16128 - DNA, 71 bp, chicken (Gallus Gallus)
  misc_feature (36): n=a or t
agaaaggacctggtcatatcagaggagggctggacntaggctttcctgttatatgagtgttccagctggca

SEQ ID NO: 16129 - DNA, 71 bp, chicken (Gallus Gallus)
  misc_feature (36): n=c or t
tttaaacaatgttgacacaccaaagtctaggaccangcgctctacatcaaaacagtgccaatctccctggc

SEQ ID NO: 16130 - DNA, 71 bp, chicken (Gallus Gallus)
  misc_feature (36): n=c or g
gatgacagaaaatgtactcctcgctttccttccgtncttcattcctcttccatccactcttgcattataaa

SEQ ID NO: 16131 - DNA, 71 bp, chicken (Gallus Gallus)
  misc_feature (36): n=a or g
aaaaagagtaaaaaatactatcttttctccataatntcagagatgcctagagaagcagcttgagaggacag

SEQ ID NO: 16132 - DNA, 71 bp, chicken (Gallus Gallus)
  misc_feature (36): n=a or g
gaaagaacttatatcatcaggcacacggtgttgctngtgcaatagatccagaaggtaataaataccctttt

SEQ ID NO: 16133 - DNA, 71 bp, chicken (Gallus Gallus)
  misc_feature (36): n=c or t
gataacctgtccactgggtgatggactagttcatgnaacctgcattaatcactttgaggtcacaaatgaac

SEQ ID NO: 16134 - DNA, 71 bp, chicken (Gallus Gallus)
  misc_feature (36): n=a or t
cagtgctatctattccaacaccaaaacaggcacatngtatagcttaactctgatgttggcttggagtgaaa

SEQ ID NO: 16135 - DNA, 71 bp, chicken (Gallus Gallus)
  misc_feature (36): n=a or g
attggcaaagaattaaaatgattattagaagagaangaggaacatctggaaagtggtgtgcatccttctaa

SEQ ID NO: 16136 - DNA, 71 bp, chicken (Gallus Gallus)
  misc_feature (36): n=c or g
tcaaagatttgaaactttaaaaattctacgtactangctgaaatctgagatattctatttacattaaaaat

SEQ ID NO: 16137 - DNA, 71 bp, chicken (Gallus Gallus)
  misc_feature (36): n=a or g
ggtctttaaaggtcccttccaactcaaatgattctntgattctgtgaactgcagatgacctgttggcttgg

SEQ ID NO: 16138 - DNA, 71 bp, chicken (Gallus Gallus)
  misc_feature (36): n=c or t
gttttcattttggattgctattgcagccttggtgcngtggcagttacttctgcctcatttccagtgcctga

SEQ ID NO: 16139 - DNA, 71 bp, chicken (Gallus Gallus)
  misc_feature (36): n=c or t
gattgatcacctctgatttcagtgcctacaggacangctgggagcagagcattcacctcctccctctgact

SEQ ID NO: 16140 - DNA, 71 bp, chicken (Gallus Gallus)
  misc_feature (36): n=a or g
tctccttactggggagctttacttcttatgcaccantttatcaaagtttgatttgtggttttctcaagaca

SEQ ID NO: 16141 - DNA, 71 bp, chicken (Gallus Gallus)
  misc_feature (36): n=a or c
aaaaaaaatccagaatacagatgaaattctcattcngcagagttgtgtaaggtcacatctatgtgtttaat

SEQ ID NO: 16142 - DNA, 71 bp, chicken (Gallus Gallus)
  misc_feature (36): n=a or g
gtagcagggggatatgttaaacaacgaaatcaagcncagatggagccacgtgtgtccatcataggagtcaa

SEQ ID NO: 16143 - DNA, 71 bp, chicken (Gallus Gallus)
  misc_feature (36): n=a or g
agcagcaccaaccactttctgtgtaggctttagatntatttactgcactgagtaacagcaatatgtgcaat

SEQ ID NO: 16144 - DNA, 71 bp, chicken (Gallus Gallus)
  misc_feature (36): n=a or g
ttttttaaacatataaacaggaagagcagggctaangagaatctccatcctttattggatgtggcagggaa

SEQ ID NO: 16145 - DNA, 71 bp, chicken (Gallus Gallus)
  misc_feature (36): n=c or t
ataaacatagtttatcattggtttatgtgatgacanctttataagacgtttgaggtggggaaagcaatagg

SEQ ID NO: 16146 - DNA, 71 bp, chicken (Gallus Gallus)
  misc_feature (36): n=g or t
ttcatctcaacaaacaacaagcctcctagagagcanccagtcagagagcagcagcactggtaaattggtaa

SEQ ID NO: 16147 - DNA, 71 bp, chicken (Gallus Gallus)
  misc_feature (36): n=a or g
gctcagctcactttgtagaccatctctcctcctctngtgagctgtgaatggatgtaccttcatagttcctt

SEQ ID NO: 16148 - DNA, 71 bp, chicken (Gallus Gallus)
  misc_feature (36): n=a or g
tcccatttcccccaaaacctggcaatattgccttcngccctgcagacaaaagaatcagcttcttcttcaag

SEQ ID NO: 16149 - DNA, 71 bp, chicken (Gallus Gallus)
  misc_feature (36): n=a or g
tttcaacccaggccattctatgattccattattctnttcctgctgttctttctgacattagtgtttgccat

SEQ ID NO: 16150 - DNA, 71 bp, chicken (Gallus Gallus)
  misc_feature (36): n=a or c
cacattcccacaggtagcagtggcaaaactttgagnagcagtcttgagtccccccctacagaaagtaccta

SEQ ID NO: 16151 - DNA, 71 bp, chicken (Gallus Gallus)
  misc_feature (36): n=c or t
aagacaagctctaaaaacttagctagctgaagatgntctttgtatacgttaagctgacaagcaaagggcaa

SEQ ID NO: 16152 - DNA, 71 bp, chicken (Gallus Gallus)
  misc_feature (36): n=c or g
cattcctaattagtgccaggatcagatcccagatgnacctactggtaatattttttcatcctaaaaatgca

SEQ ID NO: 16153 - DNA, 71 bp, chicken (Gallus Gallus)
  misc_feature (36): n=c or t
ttaaaaaaaatctcagtatttactatcattatttcnaggcatggtgatttttcttaagtctcgtttcctca

SEQ ID NO: 16154 - DNA, 71 bp, chicken (Gallus Gallus)
  misc_feature (36): n=a or g
ggtaaggagctcagtaaagcatcttcaatgaagctntagaagcattactgcatctgtatttcagttggctt

SEQ ID NO: 16155 - DNA, 71 bp, chicken (Gallus Gallus)
  misc_feature (36): n=c or t
taactggtaagcgcatcagacagagatatctgaaanagagctttaacaaatgcccaaggcccttggaatgc

SEQ ID NO: 16156 - DNA, 71 bp, chicken (Gallus Gallus)
  misc_feature (36): n=a or g
tttgtagttctctagtcagttaacagggtattgcanagagattatgtatggaatcaattttgtttctgagg

SEQ ID NO: 16157 - DNA, 71 bp, chicken (Gallus Gallus)
  misc_feature (36): n=a or g
aggtaaataaaaatgaaccaagtatttaatagtcancagctgggaaggttacaatttccttcttctgtaga

SEQ ID NO: 16158 - DNA, 71 bp, chicken (Gallus Gallus)
  misc_feature (36): n=c or t
acttagaggcacagtaggagtgattggaattgtcangttaatgaaactcaggtttaataattaaatcctgg

SEQ ID NO: 16159 - DNA, 71 bp, chicken (Gallus Gallus)
  misc_feature (36): n=g or t
agtattactagtaaagaagaactaaacagctctacnagtaatatttctatcaattttcccaagtgagaatc

SEQ ID NO: 16160 - DNA, 71 bp, chicken (Gallus Gallus)
  misc_feature (36): n=c or t
cttttaaggcaattcttgttttcttaagctattacnttatgttttgcattagtaaaatactcattagatca

SEQ ID NO: 16161 - DNA, 71 bp, chicken (Gallus Gallus)
  misc_feature (36): n=a or g
ttggctacaattacatcatttacaacaaaccacacncagctctgtgtgtgtcagtatatgttacttcaaca

SEQ ID NO: 16162 - DNA, 71 bp, chicken (Gallus Gallus)
  misc_feature (36): n=a or c
aaaaaaaccattctgaattagcacattcagccttanaatgtgcaggtcttcagactacaaggagaatcagc

SEQ ID NO: 16163 - DNA, 71 bp, chicken (Gallus Gallus)
  misc_feature (36): n=c or g
tgacatgtagtttgcctggtgattcactgtcttctntatttcagctgcattctggtcacatcctctgtctt

SEQ ID NO: 16164 - DNA, 71 bp, chicken (Gallus Gallus)
  misc_feature (36): n=c or t
ttgaagagcttgtgaccagtagagagtaggtggacnggggctagaaaggaaagatggtgcacagaatgaag

SEQ ID NO: 16165 - DNA, 71 bp, chicken (Gallus Gallus)
  misc_feature (36): n=a or g
agtgtctggcaagctctgatttatccacaatggtcncattttaagctctgcacagacactttttgatggct

SEQ ID NO: 16166 - DNA, 71 bp, chicken (Gallus Gallus)
  misc_feature (36): n=c or t
acagatttaaatgcagacacaattaaaggaaccagnatgccctataaagcatttcaaactgccataacttt

SEQ ID NO: 16167 - DNA, 71 bp, chicken (Gallus Gallus)
  misc_feature (36): n=a or g
agttaggggagcaagacttgggtctatttttcacanttcaaaagctaatattgtttttcatctgtttttct

SEQ ID NO: 16168 - DNA, 71 bp, chicken (Gallus Gallus)
  misc_feature (36): n=a or t
atatttttattttatttaaagaatttaaaggcagtnctgaaggctctactgaatgcaaaatattaaagtgt

SEQ ID NO: 16169 - DNA, 71 bp, chicken (Gallus Gallus)
  misc_feature (36): n=c or t
aagattaacgtgatgttcaccgctatctacccatgncttatgaatgacacaaacagcaggaataggaagac

SEQ ID NO: 16170 - DNA, 71 bp, chicken (Gallus Gallus)
  misc_feature (36): n=a or t
ccatccatttgcaaagctgcaacctacttccttagnaattaaagttcttctatcttctccctctttccctc

SEQ ID NO: 16171 - DNA, 71 bp, chicken (Gallus Gallus)
  misc_feature (36): n=a or g
tgtcacagaaaaccaatccttctgtcctcccaggcntcctgtcatttacccatgtgaaatgaacacaaatg

SEQ ID NO: 16172 - DNA, 71 bp, chicken (Gallus Gallus)
  misc_feature (36): n=c or t
gtcttttattaaaaaaaaataaaatcagtcttattntgtggtgaatttaatttggaagcactgtgttgaca

SEQ ID NO: 16173 - DNA, 71 bp, chicken (Gallus Gallus)
  misc_feature (36): n=a or g
ctgctgttattttctaaccctgacacagtctttctnaaaagtctgcctgttctgaaatgtagcaaattgta

SEQ ID NO: 16174 - DNA, 71 bp, chicken (Gallus Gallus)
  misc_feature (36): n=c or t
gcagtgtaacattttgcaatccctaccttagactgntcctggtgtacgttaactcagtcgatattttttat

SEQ ID NO: 16175 - DNA, 71 bp, chicken (Gallus Gallus)
  misc_feature (36): n=c or t
ctggaagagtacaccactggcatggcagactgtatngttgtgaacagcaaattcaccgccagtgtattcaa

SEQ ID NO: 16176 - DNA, 71 bp, chicken (Gallus Gallus)
  misc_feature (36): n=c or t
atcatgaatttctcacaaaccaaagtgcttgacctngctgcagaggatgccaaaccagagagcattagtgt

SEQ ID NO: 16177 - DNA, 71 bp, chicken (Gallus Gallus)
  misc_feature (36): n=c or t
aaatgggaatatagaaattggtaccaccagaatggnttgaaccaagagagaaaatagagtattccattatc

SEQ ID NO: 16178 - DNA, 71 bp, chicken (Gallus Gallus)
  misc_feature (36): n=c or g
agaactgctcccttttaattgctgaaaattcacacntatgacaaggtatcggttttgtctggcagctgtga

SEQ ID NO: 16179 - DNA, 71 bp, chicken (Gallus Gallus)
  misc_feature (36): n=c or t
ctaaaccttcgtgccggtcaaaactacatgatggcnaaacttccattagagaattatctctacagatgacc

SEQ ID NO: 16180 - DNA, 71 bp, chicken (Gallus Gallus)
  misc_feature (36): n=a or g
ggtaaactacaagcaagagcaggccaaatccctctncagcttctgaagcaatggttaaatgccactcaagg

SEQ ID NO: 16181 - DNA, 71 bp, chicken (Gallus Gallus)
  misc_feature (36): n=c or t
aacttttttccctctattttctgtaatgatactccngtcagagtacaggattatagccatacaggatcaca

SEQ ID NO: 16182 - DNA, 71 bp, chicken (Gallus Gallus)
  misc_feature (36): n=a or g
caaattgaagatatttcaccagggtatcaaaggtgncaacaacttaagatcaaatacccattctatgtttt

SEQ ID NO: 16183 - DNA, 71 bp, chicken (Gallus Gallus)
  misc_feature (36): n=a or g
agcaaggactcatttcacaccagcacgctgaaatantcacatagtgtatcttcacaagtggattttttcat

SEQ ID NO: 16184 - DNA, 71 bp, chicken (Gallus Gallus)
  misc_feature (36): n=g or t
ggagactgcaactgggggaaaagtcttgcagttggngatgtcttctcctagaaggaaaagagattcaaaaa

SEQ ID NO: 16185 - DNA, 71 bp, chicken (Gallus Gallus)
  misc_feature (36): n=a or g
tcatataaaaaattgagccacaccctgtataatctntggaactgaattatatttgactaattgaagaggat

SEQ ID NO: 16186 - DNA, 71 bp, chicken (Gallus Gallus)
  misc_feature (36): n=c or t
aactgtacttctggaaacagatccaatctaatcttncacaaatttgaatgtaataccaatttttactgacc

SEQ ID NO: 16187 - DNA, 71 bp, chicken (Gallus Gallus)
  misc_feature (36): n=c or t
ctgtgtacatatttacatgtgtgtaaaagtgctggntaataaggaagcagaatagtttcctttgccttatc

SEQ ID NO: 16188 - DNA, 71 bp, chicken (Gallus Gallus)
  misc_feature (36): n=c or t
cattgtcatgtattggagcagaatatggcatacttnactgttaatttcataggtgaagtacagacaaagtg

SEQ ID NO: 16189 - DNA, 71 bp, chicken (Gallus Gallus)
  misc_feature (36): n=c or t
ccagaccacttgatttgcatggaaggcattcggtcngtgtgcagaaagcagccaaggatgacatcctggag

SEQ ID NO: 16190 - DNA, 71 bp, chicken (Gallus Gallus)
  misc_feature (36): n=c or t
gaattagcatagacaagaacaagcacattaagttgnagtttaaatgacttttaatagtaaagccatgctaa

SEQ ID NO: 16191 - DNA, 71 bp, chicken (Gallus Gallus)
  misc_feature (36): n=a or g
ctgctttcacagaaatgtcagcatttcctttttctnctatcactacctagttacagattactgtcagaaga

SEQ ID NO: 16192 - DNA, 71 bp, chicken (Gallus Gallus)
  misc_feature (36): n=a or t
tcttctactttttaaaaaaaacttctaagactcagnctaagacagtcatctgctttcaaaaagaactcaaa

SEQ ID NO: 16193 - DNA, 71 bp, chicken (Gallus Gallus)
  misc_feature (36): n=c or g
gcaaaacccttcctggcccactcagaggataccatnatgcacaaaaagcacgcttcaaaatgctttgcaga

SEQ ID NO: 16194 - DNA, 71 bp, chicken (Gallus Gallus)
  misc_feature (36): n=a or g
aaaaccaattccacgcttctctgcatctctgaagtntgatgacttcttgaatttgcacactgcctattctt

SEQ ID NO: 16195 - DNA, 71 bp, chicken (Gallus Gallus)
  misc_feature (36): n=a or g
aaaccaagttaaaaaggataacttgggtgggcagtnaaaaggagcctggaagatgggttttgcacaattaa

SEQ ID NO: 16196 - DNA, 71 bp, chicken (Gallus Gallus)
  misc_feature (36): n=a or g
tcagccaggtagggctcatccagaagacagcaagcncttccatgaaggtggacctaaagccatagaattaa

SEQ ID NO: 16197 - DNA, 71 bp, chicken (Gallus Gallus)
  misc_feature (36): n=c or t
tgtgtaggaatggtctgcgtgtatgccttccatgcnttccaacagccatagcaggttctaatttgttcaat

SEQ ID NO: 16198 - DNA, 71 bp, chicken (Gallus Gallus)
  misc_feature (36): n=a or g
agccactcattgggtgctgtgggtgggggccacgtntttgctcacacattgctgcgctgaagcccaacctc

SEQ ID NO: 16199 - DNA, 71 bp, chicken (Gallus Gallus)
  misc_feature (36): n=c or t
gggaaataaaagactgcttgaggggatgttcttccntgcatcaaagtcatcgtctggcagcctgggtggag

SEQ ID NO: 16200 - DNA, 71 bp, chicken (Gallus Gallus)
  misc_feature (36): n=a or g
gttgaaatcggtccccaaaacttctaaaacatgacngcctgtctctgcaagttctaagttaatcaagctgc

SEQ ID NO: 16201 - DNA, 71 bp, chicken (Gallus Gallus)
  misc_feature (36): n=a or g
ttttttttttttgagtcctttattatttttaaagtnactgattaaaaaatgaagcgaccttcactctaagg

SEQ ID NO: 16202 - DNA, 71 bp, chicken (Gallus Gallus)
  misc_feature (36): n=a or g
agggaaaaaaaaaaaaaaaaaaaaaggtaggctatnaatgaccccttctgctgtctgtttgtagtgctgtc

SEQ ID NO: 16203 - DNA, 71 bp, chicken (Gallus Gallus)
  misc_feature (36): n=c or t
ggctgctgccactctttgtaacccacgctgctcttncttggtgatcaaatgattgcccatttctccccaca

SEQ ID NO: 16204 - DNA, 71 bp, chicken (Gallus Gallus)
  misc_feature (36): n=a or g
tgtaaaccactgaaagtaggaaatgcctcatctggntggtttgtacagcacctctgggtccaatcctttct

SEQ ID NO: 16205 - DNA, 71 bp, chicken (Gallus Gallus)
  misc_feature (36): n=c or g
gctcttcgttcttttttctattttggatgcttcttntacacaaactcctgagtacttacttcaacatcttc

SEQ ID NO: 16206 - DNA, 71 bp, chicken (Gallus Gallus)
  misc_feature (36): n=a or g
gttctttattatgcagcattagtaatgactgatcancaagactttgtcacttctgctcatttgtccctatt

SEQ ID NO: 16207 - DNA, 71 bp, chicken (Gallus Gallus)
  misc_feature (36): n=a or g
gttgattctcttgaggttagagagaactaatggganctatttatagagtggaaccactggagaatttatgc

SEQ ID NO: 16208 - DNA, 71 bp, chicken (Gallus Gallus)
  misc_feature (36): n=c or t
tgagtgttgatgtttgtaagaatattccacaagttncaaagtaagttatttggataggttgttttttaaaa

SEQ ID NO: 16209 - DNA, 71 bp, chicken (Gallus Gallus)
  misc_feature (36): n=g or t
tgaggattgaactaacttaactctccagtgctaagnttttaaatcgctcctgaggtttcctgtcttttatc

SEQ ID NO: 16210 - DNA, 71 bp, chicken (Gallus Gallus)
  misc_feature (36): n=a or t
tatccactgacaaaacttgtatttgaagtgtaaatntcaaacaaaaatgtaaataccaagcaaacttttct

SEQ ID NO: 16211 - DNA, 71 bp, chicken (Gallus Gallus)
  misc_feature (36): n=a or c
acagtgagtgggtgtaaaggttatgaggtgcaaganattgaagtaggaggcatgctagtaaatgcattcca

SEQ ID NO: 16212 - DNA, 71 bp, chicken (Gallus Gallus)
  misc_feature (36): n=g or t
tcctgtcatataaatagctatctcttgctaatatgntctcacgtgtttgttttaaaaagcatgtgtagagc

SEQ ID NO: 16213 - DNA, 71 bp, chicken (Gallus Gallus)
  misc_feature (36): n=c or t
aaagatataatttgggaagctacaccctcaacaganaggtgtagtcttaaaaacaagatgatgcggtgcag

SEQ ID NO: 16214 - DNA, 71 bp, chicken (Gallus Gallus)
  misc_feature (36): n=c or t
gttacattgtgtaacatgaagtttttttgtttcatncaagcatcaatgacaagcaaagaatgaagctctga

SEQ ID NO: 16215 - DNA, 71 bp, chicken (Gallus Gallus)
  misc_feature (36): n=g or t
gaatgctttttagcacacagcacagtgtacttctanaccaaagtgagagtgttagcttacctctttaatga

SEQ ID NO: 16216 - DNA, 71 bp, chicken (Gallus Gallus)
  misc_feature (36): n=a or g
tttggaatgggaactacacagagttgtgggttttgnttgatatttgttttcgttctttaacttttataact

SEQ ID NO: 16217 - DNA, 71 bp, chicken (Gallus Gallus)
  misc_feature (36): n=a or g
aaaaaggtcttgtaagagcacagcacctcagggaanccaagtggtttgtggttcgtttcctaagcattaat

SEQ ID NO: 16218 - DNA, 71 bp, chicken (Gallus Gallus)
  misc_feature (36): n=a or g
ttcatgtcagaatactgtaacttccttcaaaatgantgttcagacatttctgcagcagggccttaaaaatt

SEQ ID NO: 16219 - DNA, 71 bp, chicken (Gallus Gallus)
  misc_feature (36): n=a or t
atttcaatgaccaatttgataataaagatactcagnaataagaaatattagtagtttaaaatataaatgac

SEQ ID NO: 16220 - DNA, 71 bp, chicken (Gallus Gallus)
  misc_feature (36): n=a or g
tattttatatgctggtgtacaggcacttaagagggncacccaaacattttgagtccctggaaagtgttttt

SEQ ID NO: 16221 - DNA, 71 bp, chicken (Gallus Gallus)
  misc_feature (36): n=g or t
gtattttaccaaagtgtcttgctccaaaacataaanaagttacagcattcaaaagaaaagaccttcaattc

SEQ ID NO: 16222 - DNA, 71 bp, chicken (Gallus Gallus)
  misc_feature (36): n=c or g
gagggaaagaccttaaaaatgatctggtctgccttnatatggtcaccagtagcaactgctgtttcagaaac

SEQ ID NO: 16223 - DNA, 71 bp, chicken (Gallus Gallus)
  misc_feature (36): n=a or g
gatattgaaagaaaaatccatgataaatagaatacntattttagaatgacaatggaaaaaaaaggaaatgg

SEQ ID NO: 16224 - DNA, 71 bp, chicken (Gallus Gallus)
  misc_feature (36): n=a or c
tcccttggccctgccttgcaggctgtgcagccttgntgctctgtgctcaaggtgcgttttcagggagctgt

SEQ ID NO: 16225 - DNA, 71 bp, chicken (Gallus Gallus)
  misc_feature (36): n=a or g
tatgagttttatgagtcaataatgtgttctggggangaagaatgccgtgtaggaaattactgaactaggtt

SEQ ID NO: 16226 - DNA, 71 bp, chicken (Gallus Gallus)
  misc_feature (36): n=c or t
cttggcaaaaatcactgtgtaagatgccaaaggcangtgaaaaggaaacttatggaaggtgtggtggatca

SEQ ID NO: 16227 - DNA, 71 bp, chicken (Gallus Gallus)
  misc_feature (36): n=a or t
tgacagaagtctatgaaatagatgcattcagaagantgtaaagtacaagaaagatgctggaactggttgat

SEQ ID NO: 16228 - DNA, 71 bp, chicken (Gallus Gallus)
  misc_feature (36): n=c or t
tagcattttggtggttcttgtttctttctgtgatanccttctccacgatgtttctgacttgtaccaacatt

SEQ ID NO: 16229 - DNA, 71 bp, chicken (Gallus Gallus)
  misc_feature (36): n=c or t
actaaagtcactgatgttattccttctcactgtagnggcattgagtttcattcccagaacttccagctaag

SEQ ID NO: 16230 - DNA, 71 bp, chicken (Gallus Gallus)
  misc_feature (36): n=c or t
ccatttttaaaattaccctcttccctaccaaataangacatctgaaggagatagaccttataaacatacaa

SEQ ID NO: 16231 - DNA, 71 bp, chicken (Gallus Gallus)
  misc_feature (36): n=g or t
gtttaaaattagactgtttgtctagttatacaaccnagttgctcatgaattgactgtagaagcttggtacg

SEQ ID NO: 16232 - DNA, 71 bp, chicken (Gallus Gallus)
  misc_feature (36): n=a or g
cacccagggaggtggttgagtcaccatccctgaacntgtttaaaatccatttgtatgtgatgctcagggac

SEQ ID NO: 16233 - DNA, 71 bp, chicken (Gallus Gallus)
  misc_feature (36): n=a or t
tttgtgcaaactcaggtaccactgcgaggcacttgnttcactcagatttggaagatctcagccatgagggc

SEQ ID NO: 16234 - DNA, 71 bp, chicken (Gallus Gallus)
  misc_feature (36): n=c or g
cttttgtacacctctgcttgcagtcacagtgcactncccattttcaaagagctccaagaggaacaccagcc

SEQ ID NO: 16235 - DNA, 71 bp, chicken (Gallus Gallus)
  misc_feature (36): n=a or g
ctgacaagacactgtaagtctgaaaataaaatgacnctcatgcatttattacacatgcatatgttcagtca

SEQ ID NO: 16236 - DNA, 71 bp, chicken (Gallus Gallus)
  misc_feature (36): n=c or t
ttctggtgcctacagagatcaatgaatgcactctcntgggtcgagtgctgcctcctggcccccagtcagta

SEQ ID NO: 16237 - DNA, 71 bp, chicken (Gallus Gallus)
  misc_feature (36): n=c or t
tcaataaagaaactgaaacttgaaaaataatagttntttctctttgattctcaagtaggcaaggcagaaaa

SEQ ID NO: 16238 - DNA, 71 bp, chicken (Gallus Gallus)
  misc_feature (36): n=c or t
acaaaacccattatttatctttcttatagtaatccngaaaaacagctatcaacagcatagaactgaggtga

SEQ ID NO: 16239 - DNA, 71 bp, chicken (Gallus Gallus)
  misc_feature (36): n=c or t
agctcaggccaatgacaaaacctagatctcttcccnctaacagacagaatgcatactcagctaaggacaag

SEQ ID NO: 16240 - DNA, 71 bp, chicken (Gallus Gallus)
  misc_feature (36): n=c or t
ctagcagtccccaggaaggatttatctacaccaaanccaaaaaagtgctctaagatcataaacaccctctc

SEQ ID NO: 16241 - DNA, 71 bp, chicken (Gallus Gallus)
  misc_feature (36): n=a or g
gccagatccttttaggcctctgtaaagaggaaaccntatctcagtatgagacatactccaatacatttcta

SEQ ID NO: 16242 - DNA, 71 bp, chicken (Gallus Gallus)
  misc_feature (36): n=c or t
gctctcccttacatctcttgattgcccttccttccnacgactaaacgaagcaaaactcactaagacagaaa

SEQ ID NO: 16243 - DNA, 71 bp, chicken (Gallus Gallus)
  misc_feature (36): n=c or t
tgtggtggtgacatttctcagttttgtgtcacagcntctgttatctcttcttctattggtgtctcagcagc

SEQ ID NO: 16244 - DNA, 71 bp, chicken (Gallus Gallus)
  misc_feature (36): n=c or t
taaatggatttacatcaggctggccagtagagttcngcagatacatgtttttggggctatttctctttctc

SEQ ID NO: 16245 - DNA, 71 bp, chicken (Gallus Gallus)
  misc_feature (36): n=a or g
ataattgtggtaaccgcagctatcttggaaaatacnaagctgtaggcttgcatcctgaccaagttctatca

SEQ ID NO: 16246 - DNA, 71 bp, chicken (Gallus Gallus)
  misc_feature (36): n=c or t
cctagcacaaacattactctgtgcatggaacgttangtgccattcaaaaatttcactccttatattaaata

SEQ ID NO: 16247 - DNA, 71 bp, chicken (Gallus Gallus)
  misc_feature (36): n=g or t
ccaagaaaacagaaaaggtacaccgaaacccaggcnagtccatggaggcacttctccacacttaacaccta

SEQ ID NO: 16248 - DNA, 71 bp, chicken (Gallus Gallus)
  misc_feature (36): n=g or t
gaagagcttcataaacatgatattttttgctgaatnaatatattgatatagttactaacattgccaaatgc

SEQ ID NO: 16249 - DNA, 71 bp, chicken (Gallus Gallus)
  misc_feature (36): n=a or t
gaagttgaatgttgtactgaaacattacttttgcantaatttcagcatgcagttttagaaggcaaacccag

SEQ ID NO: 16250 - DNA, 71 bp, chicken (Gallus Gallus)
  misc_feature (36): n=a or g
tttttttcttcacactgattttaatttgcatatcancaggtttaatatacaacacctaaaaaaaatgtatt

SEQ ID NO: 16251 - DNA, 71 bp, chicken (Gallus Gallus)
  misc_feature (36): n=c or t
ttatgtttaatgcattgactaaaaacagtctgctgngaggcacagctatgcttattagtggcagtgtttat

SEQ ID NO: 16252 - DNA, 71 bp, chicken (Gallus Gallus)
  misc_feature (36): n=c or t
aaaaatcacttggattttaatttgggtcaccaatcncaattctctcctgaccttttccctgttttcattca

SEQ ID NO: 16253 - DNA, 71 bp, chicken (Gallus Gallus)
  misc_feature (36): n=a or g
ccttcatatttttctctctcctttttcccctttgtntctttactctaacaacttttgcaagttttaattgc

SEQ ID NO: 16254 - DNA, 71 bp, chicken (Gallus Gallus)
  misc_feature (36): n=a or g
tgggttttaatgcaagcaaaccctacctgtaagagngagaactggaagcagttgggacttggagactgaac

SEQ ID NO: 16255 - DNA, 71 bp, chicken (Gallus Gallus)
  misc_feature (36): n=c or t
ggctctccggttggaatgctggagtttttctgtcangctgtaagcaatggaaaccaatgaggtctgctgag

SEQ ID NO: 16256 - DNA, 71 bp, chicken (Gallus Gallus)
  misc_feature (36): n=c or t
taacatctggcagacacaggcacacatcactgttantttgttacatgtggatactttctccctttccccat

SEQ ID NO: 16257 - DNA, 71 bp, chicken (Gallus Gallus)
  misc_feature (36): n=c or t
aggtgatgatgacaccccaaaccatttcatgccagncatatatcactcttctggcaccagtcctcctctga

SEQ ID NO: 16258 - DNA, 71 bp, chicken (Gallus Gallus)
  misc_feature (36): n=c or t
atttatttttaatttgtgaagataatgtcattttgnaggaagcatgaactagtgttggctagcagcctttt

SEQ ID NO: 16259 - DNA, 71 bp, chicken (Gallus Gallus)
  misc_feature (36): n=g or t
aaaaaaaacccgatgttagttggcagcaagctgctnctgttgttcccttcctgtcccattctactgatgtg

SEQ ID NO: 16260 - DNA, 71 bp, chicken (Gallus Gallus)
  misc_feature (36): n=a or g
agaagagcactaaaaacactcaggaatgagctcttngtgtttaaagcaagctacaagctattgtagcagag

SEQ ID NO: 16261 - DNA, 71 bp, chicken (Gallus Gallus)
  misc_feature (36): n=a or g
ctggaagccaacaacacggctgaaggatgtggtgtngcttgaaaaagccttaaagacagcattaaaaaaca

SEQ ID NO: 16262 - DNA, 71 bp, chicken (Gallus Gallus)
  misc_feature (36): n=a or g
tacttctgtcagcacagctgctaactcagtggcacnttttcggcaccagagaaatctaatctgttgtaaaa

SEQ ID NO: 16263 - DNA, 71 bp, chicken (Gallus Gallus)
  misc_feature (36): n=a or g
agcatgggtgcagggttggatggagacccagagagntgactctggtctccttcaccagtgcaatgagcacc

SEQ ID NO: 16264 - DNA, 71 bp, chicken (Gallus Gallus)
  misc_feature (36): n=a or g
atccatttatgaatcttcaaggtcaggcaaagccanacaatttattcacacgtttgtttgtttgtttttgt

SEQ ID NO: 16265 - DNA, 71 bp, chicken (Gallus Gallus)
  misc_feature (36): n=a or g
ttacatgagtttggacactcttcaaaaacctcctantttgctatgttagacactaaagtaaattcatgtct

SEQ ID NO: 16266 - DNA, 71 bp, chicken (Gallus Gallus)
  misc_feature (36): n=c or t
gtgaacagcatcagtagggatgttacatgctctttnggtagctggcagagttgctgtagttcacttactgg

SEQ ID NO: 16267 - DNA, 71 bp, chicken (Gallus Gallus)
  misc_feature (36): n=c or t
cagcaggatactgcaacaggttgatcatcggtgtcnctgagaagaatcagattttattatgctgttaaacg

SEQ ID NO: 16268 - DNA, 71 bp, chicken (Gallus Gallus)
  misc_feature (36): n=c or t
ggaacagatgtttgtaaagaggcagcagatatgatncttgtggatgatgattttcagacaataatgtaggt

SEQ ID NO: 16269 - DNA, 71 bp, chicken (Gallus Gallus)
  misc_feature (36): n=a or g
atgacacctatttagcaagtttctcctttctcctcnttttgaaacgaagtcctaggaagagtaccttactg

SEQ ID NO: 16270 - DNA, 71 bp, chicken (Gallus Gallus)
  misc_feature (36): n=c or t
ctcacagagcaagcccacacttgcacatcagggagnccaagatgagagcaatatcctgtacacttgaggct

SEQ ID NO: 16271 - DNA, 71 bp, chicken (Gallus Gallus)
  misc_feature (36): n=g or t
gcaagaagctgctgaggtcagttgtttaagttgatncaaagtattttatttacagtatgcagagaaaagac

SEQ ID NO: 16272 - DNA, 71 bp, chicken (Gallus Gallus)
  misc_feature (36): n=c or g
gccaacagcattgaataatcaagtagagaatgtttnactcagccaggttgtttgccacaagaaggaaatca

SEQ ID NO: 16273 - DNA, 71 bp, chicken (Gallus Gallus)
  misc_feature (36): n=a or t
ccagtgtccctactggaaatctacgcagtgaaatantaacacttgataattttagagcttgaaaatatagt

SEQ ID NO: 16274 - DNA, 71 bp, chicken (Gallus Gallus)
  misc_feature (36): n=c or g
ttgtttttgtttgctctatgttttaattatttgatnaagctttgaatttaaacacctattaaataaatgaa

SEQ ID NO: 16275 - DNA, 71 bp, chicken (Gallus Gallus)
  misc_feature (36): n=c or t
gtagtctcacgttcattgtccttgcaaagtgaatanactcttattatttatttcctgaagtagaatgatgt

SEQ ID NO: 16276 - DNA, 71 bp, chicken (Gallus Gallus)
  misc_feature (36): n=c or t
taaaagtatgtcaactacaatgtaaattagtacatnatgagcataaagagaacacaggtacatcagcttca

SEQ ID NO: 16277 - DNA, 71 bp, chicken (Gallus Gallus)
  misc_feature (36): n=c or t
tgctgggcacaattcttccgataggtttttctccanagcatcttgactatttgaccctcaagctccacaac

SEQ ID NO: 16278 - DNA, 71 bp, chicken (Gallus Gallus)
  misc_feature (36): n=a or t
atttagtgtttcatgctcacaagtttatttttgggnagtctgggttgcgtcctacaatacataagacagga

SEQ ID NO: 16279 - DNA, 71 bp, chicken (Gallus Gallus)
  misc_feature (36): n=c or t
ccagccttcagtttctcttctggcaggagagaatcncacaaagctgaaggtgtggttccacagcagctgac

SEQ ID NO: 16280 - DNA, 71 bp, chicken (Gallus Gallus)
  misc_feature (36): n=a or g
ataccatttttagagtagtaattataggtatcagancaaggcctgcagacagtttcctttggaaagtggtg

SEQ ID NO: 16281 - DNA, 71 bp, chicken (Gallus Gallus)
  misc_feature (36): n=c or t
gagatttggacttcagttgagaagtctctccagaanggtaggcaataatccaggcacagaggacagatgaa

SEQ ID NO: 16282 - DNA, 71 bp, chicken (Gallus Gallus)
  misc_feature (36): n=c or g
gctgtgcccagtaataaaacaagctgacaaagtcantcctctctactttttttttttttttttttttaagt

SEQ ID NO: 16283 - DNA, 71 bp, chicken (Gallus Gallus)
  misc_feature (36): n=c or t
ctctaaaatgatgtaatgaatttctggtgagatggntttaaatacaagtccctgaccttcatcaggatgtg

SEQ ID NO: 16284 - DNA, 71 bp, chicken (Gallus Gallus)
  misc_feature (36): n=a or g
ctttcactgctggtcagcacccaacaaataataaantttgtggaaatattctacgtttctttaggaaaatg

SEQ ID NO: 16285 - DNA, 71 bp, chicken (Gallus Gallus)
  misc_feature (36): n=c or t
aaaacagcttctgatcttatggttttgttactgctnggaggtaagtgcagtgtgtcacttctgcaaagcaa

SEQ ID NO: 16286 - DNA, 71 bp, chicken (Gallus Gallus)
  misc_feature (36): n=a or g
cattttaattttgctatagccaagtgtaactaaaanctataaaatctgaaagaactatagtttattactta

SEQ ID NO: 16287 - DNA, 71 bp, chicken (Gallus Gallus)
  misc_feature (36): n=c or t
ccctatttttttcatatatacactacatcttaacantttcagcgaatgcttaggattccacagcaaaaaga

SEQ ID NO: 16288 - DNA, 71 bp, chicken (Gallus Gallus)
  misc_feature (36): n=c or t
tttagggatttttatatgtaattctctattctggcngtaattacatttacctggaaagtaggtgatcatca

SEQ ID NO: 16289 - DNA, 71 bp, chicken (Gallus Gallus)
  misc_feature (36): n=a or t
ccaacaaatgcagtgaatcataatacaggagttaanctagaataagatggagtccttttcttcaaatatat

SEQ ID NO: 16290 - DNA, 71 bp, chicken (Gallus Gallus)
  misc_feature (36): n=c or t
aatatgtgttattgtggttatgattgcccatcatgntgatgcgacactgacatattctgttttacttacat

SEQ ID NO: 16291 - DNA, 71 bp, chicken (Gallus Gallus)
  misc_feature (36): n=c or t
agcgaggtcccttgagtgaaaaaaaaaaagtaacangctatgcttggcaacctccaggtctgaaagaatga

SEQ ID NO: 16292 - DNA, 71 bp, chicken (Gallus Gallus)
  misc_feature (36): n=a or g
acaaaagagcacagtggcaataaagagatctggccnatttcagatactgtcatttgagctcacaaggaatt

SEQ ID NO: 16293 - DNA, 71 bp, chicken (Gallus Gallus)
  misc_feature (36): n=c or t
ttctcactcccatggccagagcgcctaggaagcagnagtgttatccattttctctcctctgcagcatgccc

SEQ ID NO: 16294 - DNA, 71 bp, chicken (Gallus Gallus)
  misc_feature (36): n=a or g
caaacaggcagcattttaaagtatttcatctaccancaactgccttatgaaacttgctatgatatctcaag

SEQ ID NO: 16295 - DNA, 71 bp, chicken (Gallus Gallus)
  misc_feature (36): n=a or g
ttgagaaattagttctgacagcatctgctacgtgangatctctactgtttcttagagaacagagatggatt

SEQ ID NO: 16296 - DNA, 71 bp, chicken (Gallus Gallus)
  misc_feature (36): n=c or t
caacttaaggttaccaactatagaatggaacatttnccccccttagaatctatcaattcccagcagctccc

SEQ ID NO: 16297 - DNA, 71 bp, chicken (Gallus Gallus)
  misc_feature (36): n=a or g
tacctgaacaatgtcactttcaagtgaattgtcaanaagttcattggaaaatgtggagaaaacacgtaaca

SEQ ID NO: 16298 - DNA, 71 bp, chicken (Gallus Gallus)
  misc_feature (36): n=a or g
tccaggagctgaattaagctttgctgactcccagcntgttggctgagccgcaggaccatctttccctccta

SEQ ID NO: 16299 - DNA, 71 bp, chicken (Gallus Gallus)
  misc_feature (36): n=c or g
tctaacaccttgatttgcagtaatgggccaaaagcngaaaagctgtaggttaaaatgaaagtgcaacatct

SEQ ID NO: 16300 - DNA, 71 bp, chicken (Gallus Gallus)
  misc_feature (36): n=c or t
catgcaagtaatacaaaaggcgtgagtactggcttncttttgtgagatgcctttgtggattacttgccaca

SEQ ID NO: 16301 - DNA, 71 bp, chicken (Gallus Gallus)
  misc_feature (36): n=a or g
aggttcctggagtttggaatgagagctcttgcaggnagggtttatctaggagagaatgaagaactgaggtg

SEQ ID NO: 16302 - DNA, 71 bp, chicken (Gallus Gallus)
  misc_feature (36): n=c or t
atacagaagtcaaacagctgaatgtgatttgcatgnatggtatggacaagcaaaatatgaagcccttacag

SEQ ID NO: 16303 - DNA, 71 bp, chicken (Gallus Gallus)
  misc_feature (36): n=c or t
atcaaattaccctagtgatggtgcttgttgaaggangtttaggtgtatgtacacgccactcatttttgttc

SEQ ID NO: 16304 - DNA, 71 bp, chicken (Gallus Gallus)
  misc_feature (36): n=c or t
aatcagatgttctctgagaatggacgatacaggggnactatcaacttattgaaaacaagtgaagaaaacac

SEQ ID NO: 16305 - DNA, 71 bp, chicken (Gallus Gallus)
  misc_feature (36): n=a or g
ggcaattacttcctgatgacattcaaagaagtgggncggagacctcccagctttggagatgcttcagtcat

SEQ ID NO: 16306 - DNA, 71 bp, chicken (Gallus Gallus)
  misc_feature (36): n=a or g
gtgagtccttcaattatcaagcattgctttacactnaaacagtaatggaaatgttagcaatacctatagag

SEQ ID NO: 16307 - DNA, 71 bp, chicken (Gallus Gallus)
  misc_feature (36): n=c or t
cacagtgagtgcaggcttagactgcctttcattcanaatgttaagaggaaggataaagagaattggtggtg

SEQ ID NO: 16308 - DNA, 71 bp, chicken (Gallus Gallus)
  misc_feature (36): n=c or g
gcttaggttagtgtatgagatgggggaaatacccanctgacctggcatccttggttagaggaccaatttta

SEQ ID NO: 16309 - DNA, 71 bp, chicken (Gallus Gallus)
  misc_feature (36): n=c or t
ggagagggcagcactggagccaatattcaccactgnggtgtgattccttggaggaatcaatctgcagcttc

SEQ ID NO: 16310 - DNA, 71 bp, chicken (Gallus Gallus)
  misc_feature (36): n=a or g
ggggtatgacatgcgggttcaagtcatgtaggttcnattattgaaactgactgaaaactgcatgaaaaata

SEQ ID NO: 16311 - DNA, 71 bp, chicken (Gallus Gallus)
  misc_feature (36): n=c or t
tcagtagtgcacattctttggcagcaaacaaaaccngaaaaaatgacaacccgtgatgaccctcatagtac

SEQ ID NO: 16312 - DNA, 71 bp, chicken (Gallus Gallus)
  misc_feature (36): n=c or g
ttgtgaggtgaacttccctttgtcagaggatcattngtcttaatttcctgttgaagggacctttcttaatg

SEQ ID NO: 16313 - DNA, 71 bp, chicken (Gallus Gallus)
  misc_feature (36): n=a or g
atttatacattaagtgcatgtttttataaatgtgangaaaaatgaatggtaatttctcagcatttgttagt

SEQ ID NO: 16314 - DNA, 71 bp, chicken (Gallus Gallus)
  misc_feature (36): n=a or g
tttgataactttgatagctgtaccgtcacactggcntcccttttggactaagactgatttaatttttctca

SEQ ID NO: 16315 - DNA, 71 bp, chicken (Gallus Gallus)
  misc_feature (36): n=c or t
gctctcaaagatggcttgagagacttttctgtcgtngtcctgcagaactcaaccaatttcatcaccattta

SEQ ID NO: 16316 - DNA, 71 bp, chicken (Gallus Gallus)
  misc_feature (36): n=g or t
agagcagggttcaaaaagcatgcagtgaaaagcatnaacagccagggtaaactgcaagcagatgctcatta

SEQ ID NO: 16317 - DNA, 71 bp, chicken (Gallus Gallus)
  misc_feature (36): n=a or g
taaaaaggttgcattcttagctcaatatctttagtntgtgatcctttcattgccttcccttccgccccccc

SEQ ID NO: 16318 - DNA, 71 bp, chicken (Gallus Gallus)
  misc_feature (36): n=a or t
atatcaagagacactgcattacttttacaccacaanctccttaatccttctctaggtattaatttctagtg

SEQ ID NO: 16319 - DNA, 71 bp, chicken (Gallus Gallus)
  misc_feature (36): n=a or t
acaacaggatgactctgatgcatgatgcaaatcccncggtgtgcaataaatatggcacacagctataaatg

SEQ ID NO: 16320 - DNA, 71 bp, chicken (Gallus Gallus)
  misc_feature (36): n=a or c
tggtcttgtatctaccacccatggtgaacttttgancctcttcctgcttggaccttttaaacaacaacaat

SEQ ID NO: 16321 - DNA, 71 bp, chicken (Gallus Gallus)
  misc_feature (36): n=c or t
aatacacattatttcctctattctgagaaagctttngagattactgtactagacctctttttaatatttgt

SEQ ID NO: 16322 - DNA, 71 bp, chicken (Gallus Gallus)
  misc_feature (36): n=a or g
aatgctgtcctcaaagtgagatgaaagatatcaccntatccatttagaaatcaaattcaaaggctagggga

SEQ ID NO: 16323 - DNA, 71 bp, chicken (Gallus Gallus)
  misc_feature (36): n=a or g
aatcccctaaaggaacaaatccttcttaaacaactntatttaattttcaatgtcagaacctaaacttttga

SEQ ID NO: 16324 - DNA, 71 bp, chicken (Gallus Gallus)
  misc_feature (36): n=a or g
gccagttttgaacagagctggtgacaagttcatctntctaaagcaacttcctccagtaacatgctgaatct

SEQ ID NO: 16325 - DNA, 71 bp, chicken (Gallus Gallus)
  misc_feature (36): n=c or t
aggtcacgcagagcatcgcccatttgaagtaacccngcagaggttatgtaaggcttcctaactggaagaac

SEQ ID NO: 16326 - DNA, 71 bp, chicken (Gallus Gallus)
  misc_feature (36): n=a or c
caaatagaaattcatttagacattgcgtttaaatancttatgtaggtatctcacatttggaactcaattta

SEQ ID NO: 16327 - DNA, 71 bp, chicken (Gallus Gallus)
  misc_feature (36): n=a or g
agcatatccaggtgacagacatgattgggaacatcnttaacatcataacttcctttgaaattattgaattt

SEQ ID NO: 16328 - DNA, 71 bp, chicken (Gallus Gallus)
  misc_feature (36): n=c or t
agaggcttcaatccggtaccaaaacccatcatcaanggtcagatctggatactctacccgtccaacaccag

SEQ ID NO: 16329 - DNA, 71 bp, chicken (Gallus Gallus)
  misc_feature (36): n=a or g
tcaataataaagaatttgctttccccaaaaggcctngcagactagaagtaaaacatctttgtgtgtactca

SEQ ID NO: 16330 - DNA, 71 bp, chicken (Gallus Gallus)
  misc_feature (36): n=a or t
tcttgccctatctaccttgatttttctgacaaatgntatttgaaaataattcttgctgttgcagcaagaga

SEQ ID NO: 16331 - DNA, 71 bp, chicken (Gallus Gallus)
  misc_feature (36): n=a or g
aggagagaaacgagcagagaaattttgatatcactnccgttggcagagggaaaatgccatgggtagtgctg

SEQ ID NO: 16332 - DNA, 71 bp, chicken (Gallus Gallus)
  misc_feature (36): n=a or g
ctgaggaaatgctttaccttttcagtctcttctaangccgtgaaagcaacttaaaaggtatgaggagtgca

SEQ ID NO: 16333 - DNA, 71 bp, chicken (Gallus Gallus)
  misc_feature (36): n=a or g
gctggaggatgtatgctgaagaaaggggacagttgnctgaaaagctttcctcaggcaggataacttggtct

SEQ ID NO: 16334 - DNA, 71 bp, chicken (Gallus Gallus)
  misc_feature (36): n=c or t
aaaataagcaagataaagattagtgcaatggcagantggagcagtgtcacaacaatacttctaatccacag

SEQ ID NO: 16335 - DNA, 71 bp, chicken (Gallus Gallus)
  misc_feature (36): n=c or g
gttttcagatttgtgccttcttcttaggcaggctgntgaaagcagttttcttacttctatatttcatagta

SEQ ID NO: 16336 - DNA, 71 bp, chicken (Gallus Gallus)
  misc_feature (36): n=a or g
taatctccaccttaaacatgatgtggtccacacctntgagagtaaatgcaagagaaacagagaattcatca

SEQ ID NO: 16337 - DNA, 71 bp, chicken (Gallus Gallus)
  misc_feature (36): n=a or g
aggaagcatggaatcttgctgaattaaatgagagcnttcttatgcttacagcttttctgtgttcagtatca

SEQ ID NO: 16338 - DNA, 71 bp, chicken (Gallus Gallus)
  misc_feature (36): n=a or g
tccgagacccaagtcatcattgtgataaggattgtnctttgtgaatatttgttttgagaacttcctctcat

SEQ ID NO: 16339 - DNA, 71 bp, chicken (Gallus Gallus)
  misc_feature (36): n=c or t
tcatgtaaattctctctgttccaattgctagttctntcaaagagtttgaatggcatgctgcttgtcctttt

SEQ ID NO: 16340 - DNA, 71 bp, chicken (Gallus Gallus)
  misc_feature (36): n=c or t
aaagagcagcctggttatggataactattcgactantgattctcaataacccatgaggcatttctgcagta

SEQ ID NO: 16341 - DNA, 71 bp, chicken (Gallus Gallus)
  misc_feature (36): n=c or t
ctgatacctctccttcagagggctgctcagaagatngagagtttttataaaattgcctgctgcagtagaca

SEQ ID NO: 16342 - DNA, 71 bp, chicken (Gallus Gallus)
  misc_feature (36): n=a or g
gtttttaccaatcctttggggcagtgcggttgctcngttcagcattaatgtgggacccacagaactgatta

SEQ ID NO: 16343 - DNA, 71 bp, chicken (Gallus Gallus)
  misc_feature (36): n=c or t
taaacttccatcactggtagaggattgggaaaacanctatctttcacaaatcacatacccagggggtcttc

SEQ ID NO: 16344 - DNA, 71 bp, chicken (Gallus Gallus)
  misc_feature (36): n=c or t
tgttcaacaaggaaagatgtacagtcagagcacaantcttgccaagcgtatatgcaaaaagctgtttagag

SEQ ID NO: 16345 - DNA, 71 bp, chicken (Gallus Gallus)
  misc_feature (36): n=g or t
agttcagctccatctgtgcgttggctttcctggtcntatctctatacacgcagacaacatccctatattcc

SEQ ID NO: 16346 - DNA, 71 bp, chicken (Gallus Gallus)
  misc_feature (36): n=a or g
catcagcaaattagtgaatttcctaaaggtactgtntctgtgagaagtcctgaagagcaaaacttgtgtta

SEQ ID NO: 16347 - DNA, 71 bp, chicken (Gallus Gallus)
  misc_feature (36): n=c or t
ctgcttgagtcttaaaaacaaagcaacagataaaanctatcactgtgaggaaaatccagatacaaaacaat

SEQ ID NO: 16348 - DNA, 71 bp, chicken (Gallus Gallus)
  misc_feature (36): n=a or g
tgaatcacaaggattccctccgggatgggtacccanaggattacatgcacaagctggattgggaaatacaa

SEQ ID NO: 16349 - DNA, 71 bp, chicken (Gallus Gallus)
  misc_feature (36): n=a or g
tggtttgaagtgtacaaaatttctgcagtactattngactgaatgaagaaggcatgaaattcatgctgaga

SEQ ID NO: 16350 - DNA, 71 bp, chicken (Gallus Gallus)
  misc_feature (36): n=c or t
ctgtcaaacaaagatgctgtgggagcaccagaatantgagtttaccacagatttaagaactggatgaagtt

SEQ ID NO: 16351 - DNA, 71 bp, chicken (Gallus Gallus)
  misc_feature (36): n=c or t
gggagatttgatattataaatacagcaacaaagganagcaaactgaaacctctgtctttcttccctcccac

SEQ ID NO: 16352 - DNA, 71 bp, chicken (Gallus Gallus)
  misc_feature (36): n=a or g
ggatctgagcattatgtaaatggtatggaaaaaggngtggatactgtcagtttcagctggaataaaattgt

SEQ ID NO: 16353 - DNA, 71 bp, chicken (Gallus Gallus)
  misc_feature (36): n=a or g
ctacacttaaatttgcaaggtgcaatatactttgcnctggtataaaatgacatgtaactgttgctaaatta

SEQ ID NO: 16354 - DNA, 71 bp, chicken (Gallus Gallus)
  misc_feature (36): n=a or g
ctgtggaaattacaggagaagacggggaatacatcnggtttcagtgatgggtttgatgcacggtgtgacaa

SEQ ID NO: 16355 - DNA, 71 bp, chicken (Gallus Gallus)
  misc_feature (36): n=c or t
atgtattaccagccacttttgtctacaaaactgaangtacagagcacagtacaagaatgttctgggcagga

SEQ ID NO: 16356 - DNA, 71 bp, chicken (Gallus Gallus)
  misc_feature (36): n=c or t
gtcacatagtgcaattttcctgtagtgaacaggganacctacagctaaatcaggttgctctgaagcctgtc

SEQ ID NO: 16357 - DNA, 71 bp, chicken (Gallus Gallus)
  misc_feature (36): n=c or t
tatagtgttgcccaaaaaatcttagttcattttctnatgggttatcttgtacacacttctgtgttaaaagc

SEQ ID NO: 16358 - DNA, 71 bp, chicken (Gallus Gallus)
  misc_feature (36): n=a or c
taattcttaaagagctatggcactcttcacataccnaaatgacatggatgtggaaggaacaactcagacac

SEQ ID NO: 16359 - DNA, 71 bp, chicken (Gallus Gallus)
  misc_feature (36): n=c or t
acatcatgggcatacttgtcccactaacagccatantgtcagaattaggattgaatgacttttaaatacag

SEQ ID NO: 16360 - DNA, 71 bp, chicken (Gallus Gallus)
  misc_feature (36): n=c or t
gctcacatcaacacaggctacaccaagctaattggngttttccacacagagtacgggttacttaacacagg

SEQ ID NO: 16361 - DNA, 71 bp, chicken (Gallus Gallus)
  misc_feature (36): n=c or g
aaaaaaaaaaaaaaaaaaggaataagaatgcaggtngagaacttgtaattccagttcatcttagggaaaga

SEQ ID NO: 16362 - DNA, 71 bp, chicken (Gallus Gallus)
  misc_feature (36): n=a or g
gtgttccatttgatgtgactgctggaagaaagagtncaatgacactctcaaaagcaatatgccttacagag

SEQ ID NO: 16363 - DNA, 71 bp, chicken (Gallus Gallus)
  misc_feature (36): n=c or t
ataagctgtagccacatagaatgcagtaaagtacanatggaattgtgtgcatatgtgagcacgtgcacatg

SEQ ID NO: 16364 - DNA, 71 bp, chicken (Gallus Gallus)
  misc_feature (36): n=a or g
taggccatgcttaattcttaatgtagcgttacatcngccagcagggcttttatatttgggatgagttgtag

SEQ ID NO: 16365 - DNA, 71 bp, chicken (Gallus Gallus)
  misc_feature (36): n=a or g
gttgtgggactaaattttcccccaagagaggatctnaacttgatgtgcactgaggaacaaatagagactgg

SEQ ID NO: 16366 - DNA, 71 bp, chicken (Gallus Gallus)
  misc_feature (36): n=c or t
aaaagccaataagtaaattgccagctgagtagacanactaatgattagtctgtattaatgcagttaatagc

SEQ ID NO: 16367 - DNA, 71 bp, chicken (Gallus Gallus)
  misc_feature (36): n=a or g
gatgtccaagcactacaggatcttggcctttccacnaaaaattcaattcctataaacaacgagcaggatct

SEQ ID NO: 16368 - DNA, 71 bp, chicken (Gallus Gallus)
  misc_feature (36): n=g or t
tgagaagtagtacaagccttaactgaattagcaganaaattggatagaaatattatataaatctatttcta

SEQ ID NO: 16369 - DNA, 71 bp, chicken (Gallus Gallus)
  misc_feature (36): n=c or t
gaagaggagcagtagagaggtgaggtacatttctgnagagccagtgctttatttgaaattgcaaaaactca

SEQ ID NO: 16370 - DNA, 71 bp, chicken (Gallus Gallus)
  misc_feature (36): n=a or g
atagggaaatatttctttccccccacgccactttcngtgattatccctgcctactgtcacatgctgtcttc

SEQ ID NO: 16371 - DNA, 71 bp, chicken (Gallus Gallus)
  misc_feature (36): n=c or t
atacacactgaaaatgtcagaaagcttacaggttgnggctaatgcacccatgttttgttcccctctttcac

SEQ ID NO: 16372 - DNA, 71 bp, chicken (Gallus Gallus)
  misc_feature (36): n=c or g
ttccaattctttcctacacagagagtaggtctgtanagcctcagtgtaagataagttactttctgttggaa

SEQ ID NO: 16373 - DNA, 71 bp, chicken (Gallus Gallus)
  misc_feature (36): n=c or g
ctggattgtgttcagacctctgtcacacaattcttntaagagtttaggcaattttctgagcttcatttttc

SEQ ID NO: 16374 - DNA, 71 bp, chicken (Gallus Gallus)
  misc_feature (36): n=a or g
ggaacagcccatgaaagtgcataaacagcattcacnttaaaacagtggtcagttctgctcaagaggcactc

SEQ ID NO: 16375 - DNA, 71 bp, chicken (Gallus Gallus)
  misc_feature (36): n=a or c
atggtgaaaagtattttgcagatatgatgtcttgangatgagacctttatccacctatttaaattagttgt

SEQ ID NO: 16376 - DNA, 71 bp, chicken (Gallus Gallus)
  misc_feature (36): n=g or t
ttcttgtatacactctgctccatccctcactattantgttaaacatctttctatatcagtacctatacaat

SEQ ID NO: 16377 - DNA, 71 bp, chicken (Gallus Gallus)
  misc_feature (36): n=c or g
tgctggtcaattttaagagggatggcctaacaatancaacttctctccacaaatagaatcatagtatccta

SEQ ID NO: 16378 - DNA, 71 bp, chicken (Gallus Gallus)
  misc_feature (36): n=c or t
atattgcaaagaacagtagggtctttgatgaaagcnaggtggaacttcagcacagtttaaagacattctta

SEQ ID NO: 16379 - DNA, 71 bp, chicken (Gallus Gallus)
  misc_feature (36): n=a or c
tcaagtcatgtcccatgacttgggacgacatggtgnaaacatggccaaaaaatcatttgtgctccaagtat

SEQ ID NO: 16380 - DNA, 71 bp, chicken (Gallus Gallus)
  misc_feature (36): n=c or t
tatgtatatgcaggaaaataagctctatttcttttncatctgaatattagtcttgtgagatattagtattt

SEQ ID NO: 16381 - DNA, 71 bp, chicken (Gallus Gallus)
  misc_feature (36): n=a or g
ctccctgcagcctgagcacgtctctgaatcacagantcattcaggttggaaaagacctctaagatcatcta

SEQ ID NO: 16382 - DNA, 71 bp, chicken (Gallus Gallus)
  misc_feature (36): n=a or c
ggggtcttgtaaattcctaggtagttacatcaggcnttcattcttacattggaatacttcagttcttcctt

SEQ ID NO: 16383 - DNA, 71 bp, chicken (Gallus Gallus)
  misc_feature (36): n=c or t
gtgcccttgctctttagcattgatgtgcacggccangtcaatggcacagcatcagcaacaggaccaccagt

SEQ ID NO: 16384 - DNA, 71 bp, chicken (Gallus Gallus)
  misc_feature (36): n=a or g
ctgtaggcttatgctgactgatgtttggaaggtaanttggttgctgccagtttggagcttccacatgcatc

SEQ ID NO: 16385 - DNA, 71 bp, chicken (Gallus Gallus)
  misc_feature (36): n=a or g
agtttggattttctttcctcttgaaactttcagcanaatttgaagagatgagtatctcagagaatttgcag

SEQ ID NO: 16386 - DNA, 71 bp, chicken (Gallus Gallus)
  misc_feature (36): n=a or g
attttgaccaactcagatctcttgaagcacagattnaaatattctcattaaagaacatctttcatatgatt

SEQ ID NO: 16387 - DNA, 71 bp, chicken (Gallus Gallus)
  misc_feature (36): n=c or g
ccttcttctcatcagcatggaggtatactgacagcngctcattgtcattcccatgagcttttctgattgcc

SEQ ID NO: 16388 - DNA, 71 bp, chicken (Gallus Gallus)
  misc_feature (36): n=a or g
cactagtcttctatcatgacgccagtcaagcagtcnaacaggttgcccattgaggttgttttgacactgag

SEQ ID NO: 16389 - DNA, 71 bp, chicken (Gallus Gallus)
  misc_feature (36): n=c or t
gtgcatctccagctgtagcttagggttttttttttncccagccccttagttttgtcaaagttggagcaacc

SEQ ID NO: 16390 - DNA, 71 bp, chicken (Gallus Gallus)
  misc_feature (36): n=a or t
aatgcatggattacacttttgcactggtcaactgantaaaagggaaagtagcatcaaagcattccgtagat

SEQ ID NO: 16391 - DNA, 71 bp, chicken (Gallus Gallus)
  misc_feature (36): n=a or g
ttccctttcttattgttagcggctttcaagtagatnggtgtcttggctggcattttgcttgtagattctag

SEQ ID NO: 16392 - DNA, 71 bp, chicken (Gallus Gallus)
  misc_feature (36): n=a or g
aagtaacttttcaacaaatatgcaaggcagtgcagngaagagcattacagggtcagagggccatcagcttg

SEQ ID NO: 16393 - DNA, 71 bp, chicken (Gallus Gallus)
  misc_feature (36): n=a or g
aatgcaatgaaattcccagattagtaaagagatganttgagattgcccaaagcggtgcagcactgttcagg

SEQ ID NO: 16394 - DNA, 71 bp, chicken (Gallus Gallus)
  misc_feature (36): n=a or t
cctgtttctttctttgtctctccccattactagaangactaaggaaaatgctgcttatgttcctgaatcct

SEQ ID NO: 16395 - DNA, 71 bp, chicken (Gallus Gallus)
  misc_feature (36): n=c or t
cgtaggaatgatactaactcactaagctgacagttnttctaggaggatccaacacacttcacaaatgggtc

SEQ ID NO: 16396 - DNA, 71 bp, chicken (Gallus Gallus)
  misc_feature (36): n=a or c
gtggaagaaaaaaacatgtacagtgtcacatcaggnaaagtattagcacagtttcattcagttccatagtc

SEQ ID NO: 16397 - DNA, 71 bp, chicken (Gallus Gallus)
  misc_feature (36): n=a or t
ttgctatgtttctatgcagctaaatgagctgtgctnggaagaatcaaattgctgctcctggaagacacttg

SEQ ID NO: 16398 - DNA, 71 bp, chicken (Gallus Gallus)
  misc_feature (36): n=c or t
gctctagagaagcccaggggttagcagaggcactgnactaattgtgcctaaaaagcttaattcccatccag

SEQ ID NO: 16399 - DNA, 71 bp, chicken (Gallus Gallus)
  misc_feature (36): n=c or t
cctatgtgcatgtaaatacactagagcctcacaacngacacagcacccacacagtacattaatcatttgta

SEQ ID NO: 16400 - DNA, 71 bp, chicken (Gallus Gallus)
  misc_feature (36): n=c or t
aggaacccaacaaagaactgtatcaccttctatagnactgtcgaaatagagagatcactaaatcttctgta

SEQ ID NO: 16401 - DNA, 71 bp, chicken (Gallus Gallus)
  misc_feature (36): n=c or g
aagaggattagatcagagaatacttaaacaaactanatctgcgtatgtccatggatcctactgagatgcat

SEQ ID NO: 16402 - DNA, 71 bp, chicken (Gallus Gallus)
  misc_feature (36): n=a or g
atgttgtagagggtgttactctcccatgattatagntggctcaaggtgatgagctttcattttgtattcaa

SEQ ID NO: 16403 - DNA, 71 bp, chicken (Gallus Gallus)
  misc_feature (36): n=a or g
caattccaagttcactgtagacatacagcgtggacncacatacaggatgtagaatacaggatggacagtgt

SEQ ID NO: 16404 - DNA, 71 bp, chicken (Gallus Gallus)
  misc_feature (36): n=a or t
aaagggttggtttttttggtattttaaggtttcctntatctgagaataccaccatccttgaacttctccca

SEQ ID NO: 16405 - DNA, 71 bp, chicken (Gallus Gallus)
  misc_feature (36): n=c or g
gtgatctgttctgtatcattaaagataacttatttnatgtaagtagagctgcatcaacaggaaattgaggc

SEQ ID NO: 16406 - DNA, 71 bp, chicken (Gallus Gallus)
  misc_feature (36): n=g or t
atttatgcagagctttacgcttggatttggtaaatnttggtacctttagcttatatgataaagctcatcaa

SEQ ID NO: 16407 - DNA, 71 bp, chicken (Gallus Gallus)
  misc_feature (36): n=c or g
aaggaattgcaactctagatattttttttccataanggttggaattgggaattagttctttggaggcaaaa

SEQ ID NO: 16408 - DNA, 71 bp, chicken (Gallus Gallus)
  misc_feature (36): n=a or g
ctgtggacatacagtttgttcagatgaaaagaacancattagaaactaacctcaaatgactgggagatgag

SEQ ID NO: 16409 - DNA, 71 bp, chicken (Gallus Gallus)
  misc_feature (36): n=a or g
atgtttgttttcttttcactgcacttaatgtagtgntaaaagaggctactatctttactgctttctggatc

SEQ ID NO: 16410 - DNA, 71 bp, chicken (Gallus Gallus)
  misc_feature (36): n=a or g
tctctatcatttgacttgaaagtgcctctcagcagngactgtgcagctggtcactgaccacctcagtattg

SEQ ID NO: 16411 - DNA, 71 bp, chicken (Gallus Gallus)
  misc_feature (36): n=a or g
tacagtctcaatttcacttttcttctgagttggtcnatgcaaaagtttgagttagaccacatgaaaaataa

SEQ ID NO: 16412 - DNA, 71 bp, chicken (Gallus Gallus)
  misc_feature (36): n=a or g
ttggattaaaacttggccagagctgcagtaaggcanttgtccaatactggcaagttttgaggaagatgttt

SEQ ID NO: 16413 - DNA, 71 bp, chicken (Gallus Gallus)
  misc_feature (36): n=c or t
aaaagaacttgcccagaatgtagcacagagactatngggttcattcttttgccttttaacaagtacacatt

SEQ ID NO: 16414 - DNA, 71 bp, chicken (Gallus Gallus)
  misc_feature (36): n=a or t
tcctcacgaatgcaaatatttgctttattgattccncttcttaaaatgcaagattaaaacagtataccatg

SEQ ID NO: 16415 - DNA, 71 bp, chicken (Gallus Gallus)
  misc_feature (36): n=a or c
tccttgctcattttcaaagaagatcccccccccccncactgaaaatgaagctaacttcttccaacagcact

SEQ ID NO: 16416 - DNA, 71 bp, chicken (Gallus Gallus)
  misc_feature (36): n=a or g
ctgctatgtggcctcatcatgtggggcatcagaaanggacatcttcctgaaagagttatttcctggcttgc

SEQ ID NO: 16417 - DNA, 71 bp, chicken (Gallus Gallus)
  misc_feature (36): n=a or t
acttttctttctttaagtaaaaatgtatttgtaatnagtgatgtctgaaataaaaaaaatatgtgaatact

SEQ ID NO: 16418 - DNA, 71 bp, chicken (Gallus Gallus)
  misc_feature (36): n=a or g
gagcattttgttttgttttgtttgtttgctactganaactctacaaattaagcagaaggtgcaaaagctgg

SEQ ID NO: 16419 - DNA, 71 bp, chicken (Gallus Gallus)
  misc_feature (36): n=c or t
atttattctcccatgtttatgtttgcagcagacagnaaacaatactgtaatttgccatcagtacttctgta

SEQ ID NO: 16420 - DNA, 71 bp, chicken (Gallus Gallus)
  misc_feature (36): n=g or t
atcattttgcaaaatcaatctgcttttttctagacntgaatagtttgaggtccttcaatatttcctcattt

SEQ ID NO: 16421 - DNA, 71 bp, chicken (Gallus Gallus)
  misc_feature (36): n=a or g
ttcctctgtttcagagtctatgatacaggtagtgangtttttttcacttgtatttccacatctactgtaca

SEQ ID NO: 16422 - DNA, 71 bp, chicken (Gallus Gallus)
  misc_feature (36): n=a or g
ctagcacaatcaaaaggaaaggaaacagctatcatnggcatatggaaagcatacctggccagtatattcag

SEQ ID NO: 16423 - DNA, 71 bp, chicken (Gallus Gallus)
  misc_feature (36): n=g or t
gatgatgctgcagaaaaatattcatccacagaattnttattgtctttcaaatacagctgacagaatttaac

SEQ ID NO: 16424 - DNA, 71 bp, chicken (Gallus Gallus)
  misc_feature (36): n=c or t
ggtcaggaaagatctgaagaagtcattacacaaaangttctgttaatgtatccttataagcacagccactg

SEQ ID NO: 16425 - DNA, 71 bp, chicken (Gallus Gallus)
  misc_feature (36): n=c or g
aaaagtggatttattttttcccagtctgaaactttnagactgtcagccatctctaggagctgttaatcata

SEQ ID NO: 16426 - DNA, 71 bp, chicken (Gallus Gallus)
  misc_feature (36): n=c or t
ctgtagtcctaacatataaataaatgaaagttctcnctctggtgttactgaactggagggggagaggtaat

SEQ ID NO: 16427 - DNA, 71 bp, chicken (Gallus Gallus)
  misc_feature (36): n=a or g
gaacaaatcaaccccgtgtcacctccttgctttttncactgctcacataacattttatactgacagctaat

SEQ ID NO: 16428 - DNA, 71 bp, chicken (Gallus Gallus)
  misc_feature (36): n=a or g
acccctgcaatgggaggggccagaaagttgaaaagncaagtgcaataactcctgggttgagataagaacag

SEQ ID NO: 16429 - DNA, 71 bp, chicken (Gallus Gallus)
  misc_feature (36): n=c or t
tgtcctatcttctcaaacttgcttttcagattcttngcttgaatagaaccacttctttttagctttattaa

SEQ ID NO: 16430 - DNA, 71 bp, chicken (Gallus Gallus)
  misc_feature (36): n=a or g
atatgcttagcattttgcagaaagagaattgaatanagagctaagtcttaaaaggactccgtgcatcactt

SEQ ID NO: 16431 - DNA, 71 bp, chicken (Gallus Gallus)
  misc_feature (36): n=c or t
tgataggatatgatctctttcttatctacaatgcangatggaatcctcttttgccatgttttaaaggtatt

SEQ ID NO: 16432 - DNA, 71 bp, chicken (Gallus Gallus)
  misc_feature (36): n=a or t
tcggcattgtggctttgcccttggcaagattttatntagtgtctgtgcacagcacagccttataccgtgat

SEQ ID NO: 16433 - DNA, 71 bp, chicken (Gallus Gallus)
  misc_feature (36): n=c or t
cgctgtcctgaatccaggtggatcagatgcagtgcntcttctcaactgctggctgcaactgaggtgtcaac

SEQ ID NO: 16434 - DNA, 71 bp, chicken (Gallus Gallus)
  misc_feature (36): n=c or g
aaagctgtggataaatttggaccaaactgatatatnttatgcttccaatgataggaaataatgattaagaa

SEQ ID NO: 16435 - DNA, 71 bp, chicken (Gallus Gallus)
  misc_feature (36): n=a or g
agaatatacacatcaaatagcatgacttagcagacnctctcatagttccagtcttgcaccatttcccacct

SEQ ID NO: 16436 - DNA, 71 bp, chicken (Gallus Gallus)
  misc_feature (36): n=a or g
agcgatgcattcatgacaagacttagatttgcatanattttgtatttttgtgtagctgattagccaatgtg

SEQ ID NO: 16437 - DNA, 71 bp, chicken (Gallus Gallus)
  misc_feature (36): n=a or g
atagaggcaaataagatgcatgttttaaatgaactnttctgcattttgtctttgtataaaaggtatgcaag

SEQ ID NO: 16438 - DNA, 71 bp, chicken (Gallus Gallus)
  misc_feature (36): n=c or g
ggttgtgggttctccctttctggatatacacaaaanctgtctgaactcccacctgtgtgacctgctgtagg

SEQ ID NO: 16439 - DNA, 71 bp, chicken (Gallus Gallus)
  misc_feature (36): n=c or t
ttgtgggaatagaagtattcattgaaaggttgtatncagaagtttgttttacactactctgaagttaattc

SEQ ID NO: 16440 - DNA, 71 bp, chicken (Gallus Gallus)
  misc_feature (36): n=c or t
aaatacctaatcagaacagagtgtggttgctacagntccctttacttaccagataaaagcctgtagagggc

SEQ ID NO: 16441 - DNA, 71 bp, chicken (Gallus Gallus)
  misc_feature (36): n=c or t
tggaaacagagagaaaccataaattaataatagatngtgtttttgactatgtcctctttatgttgccaaac

SEQ ID NO: 16442 - DNA, 71 bp, chicken (Gallus Gallus)
  misc_feature (36): n=a or g
gttacactgggagggctgatttcctaaatatgtgcntaatatttttgtgtggtgtaaaggtcttcaagaaa

SEQ ID NO: 16443 - DNA, 71 bp, chicken (Gallus Gallus)
  misc_feature (36): n=c or t
tatgatgtccttctctcttcctttgcagtctagagntttgctctgtcttcccagtgctctttctccagttt

SEQ ID NO: 16444 - DNA, 71 bp, chicken (Gallus Gallus)
  misc_feature (36): n=a or g
ataactatttgtatatgcataacactgagagttcanttttggaaatgagaaattaatagagtaacgatttg

SEQ ID NO: 16445 - DNA, 71 bp, chicken (Gallus Gallus)
  misc_feature (36): n=c or g
gacatactactggtaactggcttatgttcaccccanaggtcataggatggaggagaagtagagcaaaaagc

SEQ ID NO: 16446 - DNA, 71 bp, chicken (Gallus Gallus)
  misc_feature (36): n=a or g
ttgaccactgtattgagtgatcccagctcatcagcntgctacctagatctgcagaaggattgttttttggt

SEQ ID NO: 16447 - DNA, 71 bp, chicken (Gallus Gallus)
  misc_feature (36): n=a or g
aaaaggacatgcacttcagaatcatagatttacacngtattgtgttttactgaatgggcttccaagaaggc

SEQ ID NO: 16448 - DNA, 71 bp, chicken (Gallus Gallus)
  misc_feature (36): n=a or g
catcagagaaagccctggtcatttcttactgcagcnaaagaaaaagagactttctgcatgttgagatttgt

SEQ ID NO: 16449 - DNA, 71 bp, chicken (Gallus Gallus)
  misc_feature (36): n=c or t
cttccagctccaactgaggtacctacagatgtgagngtgaaggttttgtcatcttctgaaatttctgtttc

SEQ ID NO: 16450 - DNA, 71 bp, chicken (Gallus Gallus)
  misc_feature (36): n=a or t
gaagcactgattttgatgatgcctggtggctgaggnagctggcaaaccataaggcttacacaactcctcgg

SEQ ID NO: 16451 - DNA, 71 bp, chicken (Gallus Gallus)
  misc_feature (36): n=c or t
aattgatttagcactttgcagtagaaaatatgttcnccctttccttaattccattgaacatatattcccat

SEQ ID NO: 16452 - DNA, 71 bp, chicken (Gallus Gallus)
  misc_feature (36): n=c or t
ctttaaaggatttagttttgttgcaacgactgctgnagaagatcataaaatatcaccactcaccaacatac

SEQ ID NO: 16453 - DNA, 71 bp, chicken (Gallus Gallus)
  misc_feature (36): n=c or t
ttgtcttcacagtcaaggagatcctttccaaaaacnagtcatactaacagtttactaaactgtataaagct

SEQ ID NO: 16454 - DNA, 71 bp, chicken (Gallus Gallus)
  misc_feature (36): n=c or t
tctaatggaaatgcaatcacagagcatacagtttanacttggaatcagatctatgaaatgcagagtgtaga

SEQ ID NO: 16455 - DNA, 71 bp, chicken (Gallus Gallus)
  misc_feature (36): n=a or g
agaaagattgtgaggtaagtttcctggttacctcanaagttgttgaggagagatgaatagaagagttggat

SEQ ID NO: 16456 - DNA, 71 bp, chicken (Gallus Gallus)
  misc_feature (36): n=g or t
caggaggactatcagccagctgtgagagccacaaanagccaaacagtaatcattcagctgtgccttaacgt

SEQ ID NO: 16457 - DNA, 71 bp, chicken (Gallus Gallus)
  misc_feature (36): n=a or c
ttaagtaacagttttgagaaaacagctaaaaagtgntatttttgacaaaatttccattgtctttaatattt

SEQ ID NO: 16458 - DNA, 71 bp, chicken (Gallus Gallus)
  misc_feature (36): n=g or t
accttcccaaattctccttctccaagagtcttgccnagaaccaggttcttccgagggaattcccactttgg

SEQ ID NO: 16459 - DNA, 71 bp, chicken (Gallus Gallus)
  misc_feature (36): n=a or t
gctttagcttataaattgcaggctagacagctgttntcccagggatttatgaccatcctcttttgagttat

SEQ ID NO: 16460 - DNA, 71 bp, chicken (Gallus Gallus)
  misc_feature (36): n=a or c
aaagagagagagaggcactatgcagactaccaccantcaaaggtcttcacaaaaggacacataacaaagat

SEQ ID NO: 16461 - DNA, 71 bp, chicken (Gallus Gallus)
  misc_feature (36): n=c or t
cacttttctctgaccacacccttcctaattatactntgtaggaaaaaatagctctactgtgcaaaagaaca

SEQ ID NO: 16462 - DNA, 71 bp, chicken (Gallus Gallus)
  misc_feature (36): n=a or g
agtcaatagatcaagatgccaaggggcatatttagnatagtgttgaacacctccagggatggggcattcac

SEQ ID NO: 16463 - DNA, 71 bp, chicken (Gallus Gallus)
  misc_feature (36): n=a or g
ctccatcagttcacagtgcctacctttaatcctganaccagaaagtcatctggaatttacagtccctaagg

SEQ ID NO: 16464 - DNA, 71 bp, chicken (Gallus Gallus)
  misc_feature (36): n=c or g
tcaggcccttctaagtaatatttcagcatttttcanatttcagctgtgtgctactccagcacagtacaact

SEQ ID NO: 16465 - DNA, 71 bp, chicken (Gallus Gallus)
  misc_feature (36): n=a or g
tgcaggaagataaaggtatttcacgtcacgtcctgnagaaatgctctgtacattgtattgctgactgtgaa

SEQ ID NO: 16466 - DNA, 71 bp, chicken (Gallus Gallus)
  misc_feature (36): n=a or t
ggagaaaacgcatgatatccttctttactcataatntaaatcaattttacttaattctgtcaacacactga

SEQ ID NO: 16467 - DNA, 71 bp, chicken (Gallus Gallus)
  misc_feature (36): n=a or g
tgataaaatgtcaatgttgctgtcaagcagtagccntttttgggtgtgattacttctctttatgaataaat

SEQ ID NO: 16468 - DNA, 71 bp, chicken (Gallus Gallus)
  misc_feature (36): n=a or g
tttcatctgtgaggccagtgttgtatttattctacnattagggggatggaggaggaattggtctctcaaaa

SEQ ID NO: 16469 - DNA, 71 bp, chicken (Gallus Gallus)
  misc_feature (36): n=a or t
attgggaaatctctcctgagatcataatcagggaantagttgtgtcagaagggacccttaaatgtcatcta

SEQ ID NO: 16470 - DNA, 71 bp, chicken (Gallus Gallus)
  misc_feature (36): n=c or t
gaggtttatcacaaatgtgctacaacactacaacangctctgcaaaagaaggatgtttcttgtggtttaag

SEQ ID NO: 16471 - DNA, 71 bp, chicken (Gallus Gallus)
  misc_feature (36): n=g or t
tatatagtgacttcgacttgtgtgcaagtggaatanatgctctggtataatgagtaatgactgttgtatag

SEQ ID NO: 16472 - DNA, 71 bp, chicken (Gallus Gallus)
  misc_feature (36): n=c or t
gctacagggctttctcctcatgttgtttttagaggnacataggaacaactgacaacaccgtgagcactgaa

SEQ ID NO: 16473 - DNA, 71 bp, chicken (Gallus Gallus)
  misc_feature (36): n=c or g
ttgcaaaaagccagtattcctataaataggacaagngcactatctattaaatctgtaagaatgctggcact

SEQ ID NO: 16474 - DNA, 71 bp, chicken (Gallus Gallus)
  misc_feature (36): n=c or g
tgctagcacagattgcagagatggaattatattttnttaaaagtgcaggactggtgtctcacaatggacta

SEQ ID NO: 16475 - DNA, 71 bp, chicken (Gallus Gallus)
  misc_feature (36): n=a or t
gcaaaaaagtcaaacaaaaccaatcaatcaatcaancaaacaaacaaaaaacaactgacaaagacatgcgt

SEQ ID NO: 16476 - DNA, 71 bp, chicken (Gallus Gallus)
  misc_feature (36): n=a or g
atttcttgcatacttaagatcaacagcaaacacatncttggaagcattactccatcacgatatgaaagaat

SEQ ID NO: 16477 - DNA, 71 bp, chicken (Gallus Gallus)
  misc_feature (36): n=c or t
cagcatctttatactttgcgcctccctgttgattcnaaaagaaaccaaaaagtcccattttgatttaactg

SEQ ID NO: 16478 - DNA, 71 bp, chicken (Gallus Gallus)
  misc_feature (36): n=a or g
cagtctctgtgtgtttctacttctatattctttctncatagagttcaattcatatcagttgattcttcttc

SEQ ID NO: 16479 - DNA, 71 bp, chicken (Gallus Gallus)
  misc_feature (36): n=a or c
gcttccactacattgtctttatattagtcctgttcnttgtccaacgtgtcctcattaccccatccagtttt

SEQ ID NO: 16480 - DNA, 71 bp, chicken (Gallus Gallus)
  misc_feature (36): n=c or t
tctgaatgaatctttgcactcatgttcctgctatgngactcacaaaataccatctagatgtgattgactga

SEQ ID NO: 16481 - DNA, 71 bp, chicken (Gallus Gallus)
  misc_feature (36): n=c or t
caaatctgtatttagacttgaagaatacaggcagantatcttctgtctgcagttttaccagctgaagagtt

SEQ ID NO: 16482 - DNA, 71 bp, chicken (Gallus Gallus)
  misc_feature (36): n=a or g
tttttcttttataatttctgtggcaaaaacttgtcntgcttttcactgtcaattgaacttctggtccagaa

SEQ ID NO: 16483 - DNA, 71 bp, chicken (Gallus Gallus)
  misc_feature (36): n=a or c
gcatatttactacttctatctgtggcacgagtgggncaatgtagctctctaaagttccatcaaaagggatt

SEQ ID NO: 16484 - DNA, 71 bp, chicken (Gallus Gallus)
  misc_feature (36): n=a or g
agacagctcgtgtactatccatgtgacagtgggctncatttcattagagagcttatatggataataaacac

SEQ ID NO: 16485 - DNA, 71 bp, chicken (Gallus Gallus)
  misc_feature (36): n=c or t
ttttcattctccttgtatttgtataactcttgaacngttattcagagtctgacaaatgaaagtaagcagat

SEQ ID NO: 16486 - DNA, 71 bp, chicken (Gallus Gallus)
  misc_feature (36): n=c or t
cactaaacaataaagcacacaaagtatttcaatttngttcggttataaggaattacagtctgggtaagaga

SEQ ID NO: 16487 - DNA, 71 bp, chicken (Gallus Gallus)
  misc_feature (36): n=a or g
tttgctaaatgctgagcccaaggggagccagagccntatgaagctttagttttcctgatagcaacaggctg

SEQ ID NO: 16488 - DNA, 71 bp, chicken (Gallus Gallus)
  misc_feature (36): n=c or t
gtgcagaggtggagaaatggatctgaaaaggaagtngtaaggtcagagctaaaattgcctgggcagctttc

SEQ ID NO: 16489 - DNA, 71 bp, chicken (Gallus Gallus)
  misc_feature (36): n=a or g
tgtgtttgtagtgctccttaatgatttccaacatantaacaacatttctaaagcatgggtaggtgtgacat

SEQ ID NO: 16490 - DNA, 71 bp, chicken (Gallus Gallus)
  misc_feature (36): n=a or g
aagtattttgtaaatgctaatttttttaggactacnatagttgacatattaaactgtatatgaacatttcc

SEQ ID NO: 16491 - DNA, 71 bp, chicken (Gallus Gallus)
  misc_feature (36): n=a or g
atgaatgacacaactgaactgaaaaataaaatgctngctttgctaacatttgcttcaggagctcaggagat

SEQ ID NO: 16492 - DNA, 71 bp, chicken (Gallus Gallus)
  misc_feature (36): n=c or t
tagattaagtatgtacatatcatctgtactccttcngtgcaggtgttgctatgtttccatttctaaagcca

SEQ ID NO: 16493 - DNA, 71 bp, chicken (Gallus Gallus)
  misc_feature (36): n=c or t
agacatggaagtgaaagaggacaaattcttgttttncagcctgcatgaagcagatgcagcctgcccgtgct

SEQ ID NO: 16494 - DNA, 71 bp, chicken (Gallus Gallus)
  misc_feature (36): n=a or g
gcaagtgggggacgtgcagtctgttactcagctgancagggacacattctgatttaatttatctttcgtag

SEQ ID NO: 16495 - DNA, 71 bp, chicken (Gallus Gallus)
  misc_feature (36): n=a or g
ctcagagaactaaacgactagcttaaaaaaaactgngattggtaagatttcaagaatgatattaatatttt

SEQ ID NO: 16496 - DNA, 71 bp, chicken (Gallus Gallus)
  misc_feature (36): n=c or t
aaagtttagtgtaaaatatttatcattcagttcttnatctcttaggactctgttattaatttcctatgaga

SEQ ID NO: 16497 - DNA, 71 bp, chicken (Gallus Gallus)
  misc_feature (36): n=a or c
tgttcatggagaatttgagaagtgttttgcattganagtcatcatccattcacttgctaccacttggacac

SEQ ID NO: 16498 - DNA, 71 bp, chicken (Gallus Gallus)
  misc_feature (36): n=a or g
gacctctgacctcttacctattacaggcctgtatcntagcttctaatagctgagttgcccatatgccaaga

SEQ ID NO: 16499 - DNA, 71 bp, chicken (Gallus Gallus)
  misc_feature (36): n=a or g
taaacttggtgtcaggttgtcacttccagagacggnaagaaccgagaggctctcagagtactggatacaac

SEQ ID NO: 16500 - DNA, 71 bp, chicken (Gallus Gallus)
  misc_feature (36): n=c or t
cagctcatgcctctatagtcttttgttggaatgtantgattttgatattttctacactggatatgaaaaca

SEQ ID NO: 16501 - DNA, 71 bp, chicken (Gallus Gallus)
  misc_feature (36): n=g or t
gtagaagcaacacaacagcatagcagattatttggnatttgctgattttattagaatgaaaatgctttgta

SEQ ID NO: 16502 - DNA, 71 bp, chicken (Gallus Gallus)
  misc_feature (36): n=c or t
aataaatacattgcattattcttctatatgtacttntgcagtttttactaataaatttataatactgaggt

SEQ ID NO: 16503 - DNA, 71 bp, chicken (Gallus Gallus)
  misc_feature (36): n=a or t
ccacatcaacattattcttcatatatgagcagtgancctctgtgagtcttattaatcctgtctcaagtagt

SEQ ID NO: 16504 - DNA, 71 bp, chicken (Gallus Gallus)
  misc_feature (36): n=c or t
gcaggtagatgggaagggcagtgccccgttccttgntaatttctgttcaattctgacctgttgcatggcct

SEQ ID NO: 16505 - DNA, 71 bp, chicken (Gallus Gallus)
  misc_feature (36): n=c or t
gaaggttagggtgtttgtctcatctttgcttgagantgttatttcatgcagggaaaaggacacttggcaaa

SEQ ID NO: 16506 - DNA, 71 bp, chicken (Gallus Gallus)
  misc_feature (36): n=a or g
ggcatttaatttcacccttactgtatttatggaaantttcccaagcacatctcttttgccaaaaaaattct

SEQ ID NO: 16507 - DNA, 71 bp, chicken (Gallus Gallus)
  misc_feature (36): n=c or g
ggtgcatagcttgttgggtgtggtgcagtatctganaaggtagttcagatggcatctgaatgcaggtgctt

SEQ ID NO: 16508 - DNA, 71 bp, chicken (Gallus Gallus)
  misc_feature (36): n=a or g
agcatagcaggatgtgcctagtttggccatgtctgncatgactggaagataactgctggtctcaaatgtcc

SEQ ID NO: 16509 - DNA, 71 bp, chicken (Gallus Gallus)
  misc_feature (36): n=a or g
ctcacccttggcttgcagcagcgcgtggaagcccanaatgggtaactggctgacggagctcattgctcatt

SEQ ID NO: 16510 - DNA, 71 bp, chicken (Gallus Gallus)
  misc_feature (36): n=g or t
tgggggagggaaggaggagcttcagactctcatttngaggagtgaaaggaaggagtagagctccacgtctc

SEQ ID NO: 16511 - DNA, 71 bp, chicken (Gallus Gallus)
  misc_feature (36): n=c or t
caggagcgtggttgtgactaactggaactatagatntgcagactacttagggaggaaagaaattttgtttg

SEQ ID NO: 16512 - DNA, 71 bp, chicken (Gallus Gallus)
  misc_feature (36): n=c or t
gggagagtctttgaagtgaagacaaaagcaaagaangcattcagcatctctgccttctcagcatcccctgt

SEQ ID NO: 16513 - DNA, 71 bp, chicken (Gallus Gallus)
  misc_feature (36): n=g or t
acagcacactgtcctgaattggaaatcataagcacnggcctctctgagcctgttttctttgcactaaatgg

SEQ ID NO: 16514 - DNA, 71 bp, chicken (Gallus Gallus)
  misc_feature (36): n=c or t
cttgcatttcattcaccaactctcagatggatttgngtgtcagcccagtttattagtaaaaaacagcaaca

SEQ ID NO: 16515 - DNA, 71 bp, chicken (Gallus Gallus)
  misc_feature (36): n=a or g
tccaaaaatcacagttatcccatagttctattaacnaatggcaagtgcagaagacatcctcagtaatgtta

SEQ ID NO: 16516 - DNA, 71 bp, chicken (Gallus Gallus)
  misc_feature (36): n=a or g
cttacagtgctgtgatttattcttgctgttgcaganctgtgatcaaaaaggatacaggcagaccttttttt

SEQ ID NO: 16517 - DNA, 71 bp, chicken (Gallus Gallus)
  misc_feature (36): n=a or g
actcgttcctcctcgttgtattttcctacatagacnccattttttttggagagcacaaaggccaagacaag

SEQ ID NO: 16518 - DNA, 71 bp, chicken (Gallus Gallus)
  misc_feature (36): n=a or c
aagcagtaaagacgtagtagttatcaactaaaaggnggttagccaattacttttctacccagttacttttt

SEQ ID NO: 16519 - DNA, 71 bp, chicken (Gallus Gallus)
  misc_feature (36): n=a or c
catggtactacacattgctggtaaaaaagaaaagtnacatgcagagttgtttacatttcagtgagtcttca

SEQ ID NO: 16520 - DNA, 71 bp, chicken (Gallus Gallus)
  misc_feature (36): n=g or t
cgagggctgtgaaatcacctcccctttccggggctntctgtcagagcgagagttgtacattattgttaccg

SEQ ID NO: 16521 - DNA, 71 bp, chicken (Gallus Gallus)
  misc_feature (36): n=c or t
aattaaaaataataataatgataataaaggatacanttaggcatgtagaacattctgcaaaatgtcgtaat

SEQ ID NO: 16522 - DNA, 71 bp, chicken (Gallus Gallus)
  misc_feature (36): n=c or t
gcaggatgtaagaagcttttttgaagtctctctgtnaacagtcataacacaacaggtcttagagtttggag

SEQ ID NO: 16523 - DNA, 71 bp, chicken (Gallus Gallus)
  misc_feature (36): n=g or t
gtgcatctctcaacactatctttcataatatagtgnaaggcagacacgggttggtaaaatgcaagagaaac

SEQ ID NO: 16524 - DNA, 71 bp, chicken (Gallus Gallus)
  misc_feature (36): n=a or g
cacacctgcaacgtacacagatacgatgctcatgtnaatgcacagagattccttaatatggcttaataagg

SEQ ID NO: 16525 - DNA, 71 bp, chicken (Gallus Gallus)
  misc_feature (36): n=a or g
agtgacatcaggagtggtttttactcatgtgtaggntagcagtgtgtggcaagcactcatacagagctgaa

SEQ ID NO: 16526 - DNA, 71 bp, chicken (Gallus Gallus)
  misc_feature (36): n=c or g
gagcttaaattaaagttttgtatgatatgattgtantgaactgagtaggaaccactatacttcagacaata

SEQ ID NO: 16527 - DNA, 71 bp, chicken (Gallus Gallus)
  misc_feature (36): n=a or t
actagttggtttctctgcatgactcagaagaataantctaagtgaatattctcctcatcagcttcaagtat

SEQ ID NO: 16528 - DNA, 71 bp, chicken (Gallus Gallus)
  misc_feature (36): n=c or t
agatatgaatctgccttatttcatgagagagatcangctgactgtctgaacaggagctactctgtgctaca

SEQ ID NO: 16529 - DNA, 71 bp, chicken (Gallus Gallus)
  misc_feature (36): n=c or t
gacaggaatcccagaacacaagtcagaaaaagaaancaaataaatgtatctgaaactcttaacactgtaac

SEQ ID NO: 16530 - DNA, 71 bp, chicken (Gallus Gallus)
  misc_feature (36): n=c or t
cttaggatctcctttgcaggaagtggaaggtatgcnggaaagaaaagcaatgatttttctagagttcagtg

SEQ ID NO: 16531 - DNA, 71 bp, chicken (Gallus Gallus)
  misc_feature (36): n=g or t
gtagagaagaaataacttccatccaacagtcctaanagtgttcctaagacagaaaaattacaatattttat

SEQ ID NO: 16532 - DNA, 71 bp, chicken (Gallus Gallus)
  misc_feature (36): n=c or t
ttactgtacttcttgcacagaagagctcctcataanttcagggtgactttagccatgaactagaattgtaa

SEQ ID NO: 16533 - DNA, 71 bp, chicken (Gallus Gallus)
  misc_feature (36): n=a or c
gattttataaagccaagacacatacacaccacaaangcttactttctgcttacctattataacttggagct

SEQ ID NO: 16534 - DNA, 71 bp, chicken (Gallus Gallus)
  misc_feature (36): n=a or c
ttcaagacatggcaatggtgagcttccaggctccantggttgtccaaaacactgagcactactcagaaatt

SEQ ID NO: 16535 - DNA, 71 bp, chicken (Gallus Gallus)
  misc_feature (36): n=a or g
attgaatatcatataaaatgtatatttctatacacnaacagattcttcattctctattaatcctttgtggt

SEQ ID NO: 16536 - DNA, 71 bp, chicken (Gallus Gallus)
  misc_feature (36): n=a or g
atagcatagagtcatattttctgcatgcttccaaancatggatgcagtcaaagatgtgcttttaggaagga

SEQ ID NO: 16537 - DNA, 71 bp, chicken (Gallus Gallus)
  misc_feature (36): n=c or t
ctctctcaggcttaaacaagagagtacacacctggnaggaattaggaaccaatacattgatttcatggggg

SEQ ID NO: 16538 - DNA, 71 bp, chicken (Gallus Gallus)
  misc_feature (36): n=a or g
aggagagctggagactttttgtcagggaaagaatgnggaaaaaaagttgcagatacagtcagtagcaaact

SEQ ID NO: 16539 - DNA, 71 bp, chicken (Gallus Gallus)
  misc_feature (36): n=a or g
tgtgatgtatgtcacttacagtgcatatttgggatntaatgtataaaatatttgtttctataacaagctgt

SEQ ID NO: 16540 - DNA, 71 bp, chicken (Gallus Gallus)
  misc_feature (36): n=c or t
tagctatctttgtgtactaagtggaaattctctcanggtgcttcaacacatctgtcaacacgtgctggaca

SEQ ID NO: 16541 - DNA, 71 bp, chicken (Gallus Gallus)
  misc_feature (36): n=c or g
aagtcaacaagacttctttgcttgttgtggtgtttngcaggaatctggaggactgtattgctttctcactc

SEQ ID NO: 16542 - DNA, 71 bp, chicken (Gallus Gallus)
  misc_feature (36): n=c or t
tgttgagcaacttaatcatcagatcagacttgaacnaggcattttcccacgagtttaatcacatcactgaa

SEQ ID NO: 16543 - DNA, 71 bp, chicken (Gallus Gallus)
  misc_feature (36): n=a or g
agcacgtttggcattacaaatggcacacacgtggcntaaaggggtaaaatgaaatttagaaacatggtttt

SEQ ID NO: 16544 - DNA, 71 bp, chicken (Gallus Gallus)
  misc_feature (36): n=a or c
cttggctcaaagctgaacacccacatttaaaatgcngtacttttggagtaacagcccaggatgttactccc

SEQ ID NO: 16545 - DNA, 71 bp, chicken (Gallus Gallus)
  misc_feature (36): n=a or g
caggtatctgccctgttattaagtgactgcaaagangaagaaaaattgctgttatcttttggatatatgtt

SEQ ID NO: 16546 - DNA, 71 bp, chicken (Gallus Gallus)
  misc_feature (36): n=g or t
gttaaaaagtaacagcgtgcagagagccaagttgtnagctctgcgatcgctaatgctctgagccaaaacca

SEQ ID NO: 16547 - DNA, 71 bp, chicken (Gallus Gallus)
  misc_feature (36): n=a or t
gcaattgagcagaattatagcattgtatggaatagnaaaccttagatagccagctttagtgctggggtcta

SEQ ID NO: 16548 - DNA, 71 bp, chicken (Gallus Gallus)
  misc_feature (36): n=c or g
gtacaagtggcttccttgacacctttgctaaccctnaaactgtaatgaagtcccaaaggaaaataagaccc

SEQ ID NO: 16549 - DNA, 71 bp, chicken (Gallus Gallus)
  misc_feature (36): n=c or t
aagttctgacaagttaccaggcatgcacagacatancctgagtactacggatggaagaagaggaaaagctt

SEQ ID NO: 16550 - DNA, 71 bp, chicken (Gallus Gallus)
  misc_feature (36): n=a or c
tacttccacggtgacatttaaggaagcatttgggcnttggaactatgacagattccatagttatagtagat

SEQ ID NO: 16551 - DNA, 71 bp, chicken (Gallus Gallus)
  misc_feature (36): n=g or t
agtccttgtttccttgttttgttttgttttgttttnttttgttttttagtgaataaagggcatgatatttt

SEQ ID NO: 16552 - DNA, 71 bp, chicken (Gallus Gallus)
  misc_feature (36): n=a or g
ggattagtccaatacttaagtggcagtctgtcaggnaatgcttctgtttaacagatggtactgaataagtg

SEQ ID NO: 16553 - DNA, 71 bp, chicken (Gallus Gallus)
  misc_feature (36): n=c or t
agtctgctggagaagagcaagtttgcttactgtaangcttacagttatggtaagagtggaagataagccca

SEQ ID NO: 16554 - DNA, 71 bp, chicken (Gallus Gallus)
  misc_feature (36): n=a or g
gtctcagagtggtagcagctctgttccctcctcacncgcattagctatggatgaacctgaggagcagtcct

SEQ ID NO: 16555 - DNA, 71 bp, chicken (Gallus Gallus)
  misc_feature (36): n=a or g
attagcagctacagtgtctgtaggtgaacaaagaancttaattttctaatactgcatctagattataacat

SEQ ID NO: 16556 - DNA, 71 bp, chicken (Gallus Gallus)
  misc_feature (36): n=g or t
tggatcctcaaatagcactgacaaaaaaaaaaatgnttatatgaattaggtgcagcataatcctcttgggg

SEQ ID NO: 16557 - DNA, 71 bp, chicken (Gallus Gallus)
  misc_feature (36): n=a or c
ccctcaccaggtaatgagtcaaaggacctccatttnattgctccagcagcccaagcctatgcttggtgcag

SEQ ID NO: 16558 - DNA, 71 bp, chicken (Gallus Gallus)
  misc_feature (36): n=a or g
tctttaattcaataaagctgtacatttattagctantgaatgctcagttttctgctattgtcacagtattg

SEQ ID NO: 16559 - DNA, 71 bp, chicken (Gallus Gallus)
  misc_feature (36): n=c or t
tttggataaaggtgggccaactttggttagcattcntaccaaataaacatttaggggtttgggtgcttacc

SEQ ID NO: 16560 - DNA, 71 bp, chicken (Gallus Gallus)
  misc_feature (36): n=a or t
attttttaaattgttttaaggactcagtggctgatnattgcattggctttatcctacaagcatattttgtt

SEQ ID NO: 16561 - DNA, 71 bp, chicken (Gallus Gallus)
  misc_feature (36): n=c or t
gcttgtaacaggagcgctctcacagaaagaaatggngtgtgggcccagcacagatatcatccctcagcccg

SEQ ID NO: 16562 - DNA, 71 bp, chicken (Gallus Gallus)
  misc_feature (36): n=c or t
tttcaagggagctgtcaaagtgttttagtccaagangcagatgacgcagccctctgtatataatttcagct

SEQ ID NO: 16563 - DNA, 71 bp, chicken (Gallus Gallus)
  misc_feature (36): n=a or g
taatgtgtagttgtagaaaaagcagccatgcagagntcctgacatcagtttattcgcttgttttgtaggcg

SEQ ID NO: 16564 - DNA, 71 bp, chicken (Gallus Gallus)
  misc_feature (36): n=a or g
aaaagtttgttgcctttttatgatggttgaatagtnctggtattcctgcagcaagtcactggctcaaagtc

SEQ ID NO: 16565 - DNA, 71 bp, chicken (Gallus Gallus)
  misc_feature (36): n=a or g
cgcagtccagacaggaggaggcaggaaagcagtcgncaccggactgaatatgacagaggaagaatgtcgcc

SEQ ID NO: 16566 - DNA, 71 bp, chicken (Gallus Gallus)
  misc_feature (36): n=c or t
tgcaattctattttggactgacttatatttttagangagagctgcattatgggaggtacccccagtgatgc

SEQ ID NO: 16567 - DNA, 71 bp, chicken (Gallus Gallus)
  misc_feature (36): n=c or t
attcaaacgttttaacttcaggaaagggaaacgaanatgagatgtgacaaacattcctgaaggacaactgt

SEQ ID NO: 16568 - DNA, 71 bp, chicken (Gallus Gallus)
  misc_feature (36): n=a or g
gaggagggatttagattgaatatgaataaatttttnttctatgatatgggcagtaaggcactggaacagta

SEQ ID NO: 16569 - DNA, 71 bp, chicken (Gallus Gallus)
  misc_feature (36): n=g or t
tgaaagtgggatttctccttaaatatacatatatanagagagaaatgtatattggttttgtacctaggagc

SEQ ID NO: 16570 - DNA, 71 bp, chicken (Gallus Gallus)
  misc_feature (36): n=c or t
tgcatatctagagaaaagttgatgtacgtgttcccntcttctcaggtgtcacatttttttgtgtgtgtgct

SEQ ID NO: 16571 - DNA, 71 bp, chicken (Gallus Gallus)
  misc_feature (36): n=g or t
tttcaagcagtccactttagagggggaaaaagctgncagctgtttaattttttgacttagtatcaatggat

SEQ ID NO: 16572 - DNA, 71 bp, chicken (Gallus Gallus)
  misc_feature (36): n=c or t
tcagtcagccttaggggaactgcaggctctgaaganctcttaccactagaggcagctttgaacatcagctg

SEQ ID NO: 16573 - DNA, 71 bp, chicken (Gallus Gallus)
  misc_feature (36): n=a or t
ttcagttgtcctaaacctatgacttttctaaaccantgtccacaatagggatgttttccaggtctcacact

SEQ ID NO: 16574 - DNA, 71 bp, chicken (Gallus Gallus)
  misc_feature (36): n=c or t
agacaaggttatatttggtacctattccagacagangataaacaaggattttctaatacattttctagcca

SEQ ID NO: 16575 - DNA, 71 bp, chicken (Gallus Gallus)
  misc_feature (36): n=g or t
atcatcaataatggtgtttcaaaagcaagtttctcnaagcacataggacaaaaaagcatctttcagagctt

SEQ ID NO: 16576 - DNA, 71 bp, chicken (Gallus Gallus)
  misc_feature (36): n=a or g
ccaacttgaggaccagagaagagcttcacctacctncaatgggattcagcgcttgctttcacaaacctcag

SEQ ID NO: 16577 - DNA, 71 bp, chicken (Gallus Gallus)
  misc_feature (36): n=a or c
ctgaaattgcactgaatttactacagcatcttctancagcttttgatacatggaagatatattttggatct

SEQ ID NO: 16578 - DNA, 71 bp, chicken (Gallus Gallus)
  misc_feature (36): n=c or g
gttgttttaattgatttctacatacatctccacaantgcagtgcaaacaaatgggtactctaccatccctt

SEQ ID NO: 16579 - DNA, 71 bp, chicken (Gallus Gallus)
  misc_feature (36): n=a or c
ttaaatctgctactgctgcatcactcattctgcacntatcaattccttaatgaaaaataaggcacaaaata

SEQ ID NO: 16580 - DNA, 71 bp, chicken (Gallus Gallus)
  misc_feature (36): n=a or t
gtgtgacttcttgattatgtcatgtagaagtataanatcagatataaaactatacaccatctaaaatttct

SEQ ID NO: 16581 - DNA, 71 bp, chicken (Gallus Gallus)
  misc_feature (36): n=a or c
tatttatgttattgaatgggaaagatttgtggtccntaaagaacataaatttagaatagagtagaaaattc

SEQ ID NO: 16582 - DNA, 71 bp, chicken (Gallus Gallus)
  misc_feature (36): n=a or g
aggtaagggtaagatctaaggacctttaaaacagantgacctccactgtcagtttggttccttgccttatg

SEQ ID NO: 16583 - DNA, 71 bp, chicken (Gallus Gallus)
  misc_feature (36): n=g or t
caactgtaatttattaaataaagctgtgcagtgcanaagcatttaagaaaactgcacattcacttaagatc

SEQ ID NO: 16584 - DNA, 71 bp, chicken (Gallus Gallus)
  misc_feature (36): n=a or g
ttttcagtataaggaatgcatatgtaattttaaatntgttcatttctattgtagttactatagatacggag

SEQ ID NO: 16585 - DNA, 71 bp, chicken (Gallus Gallus)
  misc_feature (36): n=a or g
cagctgttctctgaacacaggctcaattggcttagnttttcccatactgccctaatgtttaattcctgtgg

SEQ ID NO: 16586 - DNA, 71 bp, chicken (Gallus Gallus)
  misc_feature (36): n=c or t
gagggatgatttccagaggtcccacccaacccctangattttgtgattatgtgaacgctgggagcaacact

SEQ ID NO: 16587 - DNA, 71 bp, chicken (Gallus Gallus)
  misc_feature (36): n=c or t
tgcagtatttctaccaagttcagtcaaggtggaagncatggattgaaacctgtttgatggaagctgtcaca

SEQ ID NO: 16588 - DNA, 71 bp, chicken (Gallus Gallus)
  misc_feature (36): n=g or t
tactttcagggagagctgttgtttttggctgtgggntagttccatcccatgagctcctgaatctgtgcagt

SEQ ID NO: 16589 - DNA, 71 bp, chicken (Gallus Gallus)
  misc_feature (36): n=c or g
tagaaaaacattttatttccaagtttctgcctcagnttggaaggtgcagtggttttgcttttcttgcgaaa

SEQ ID NO: 16590 - DNA, 71 bp, chicken (Gallus Gallus)
  misc_feature (36): n=a or g
gtcccttcctgatttggcaaatgcttgattttaagnccagcgtggttttggtttgcccataaatatgccaa

SEQ ID NO: 16591 - DNA, 71 bp, chicken (Gallus Gallus)
  misc_feature (36): n=a or g
ggcagatgatgtgtgctggtttcatgatttgagtanagaatttacccacctgactcagtctgtgatatgcc

SEQ ID NO: 16592 - DNA, 71 bp, chicken (Gallus Gallus)
  misc_feature (36): n=c or g
cttagtgcagtgcacagtacgactaagtacatctantttctgtgcagtagatggagctgcccaagtgaggc

SEQ ID NO: 16593 - DNA, 71 bp, chicken (Gallus Gallus)
  misc_feature (36): n=a or g
atctgaaagttgagttaaaaagaacgctgggaaacnagccagttacaaagccatatggacgaggaaaacaa

SEQ ID NO: 16594 - DNA, 71 bp, chicken (Gallus Gallus)
  misc_feature (36): n=a or g
tactagaactgaacgtgtgttgaaacatgaaaaacntttggcagtttggtttatgtgctgagtattggctc

SEQ ID NO: 16595 - DNA, 71 bp, chicken (Gallus Gallus)
  misc_feature (36): n=a or t
aactgtcactgcttcagtcaaagagaagggatgcantgcctttctgaatgtggagggagagagtaaggatt

SEQ ID NO: 16596 - DNA, 71 bp, chicken (Gallus Gallus)
  misc_feature (36): n=a or g
ggaaatgcatacagaagcagtctcctaggaaaaccnaccgtggaaaatgcagcttaagaagcaataaaaga

SEQ ID NO: 16597 - DNA, 71 bp, chicken (Gallus Gallus)
  misc_feature (36): n=c or t
gcagaaatagggacggagagtgactccactaagtgnattttagaagaactttttcagtcaagccttgcagg

SEQ ID NO: 16598 - DNA, 71 bp, chicken (Gallus Gallus)
  misc_feature (36): n=c or t
agccccaacatcaaattttagaggatgtccttctanaggagggtaaagtctgcacctgttgcaaatcctca

SEQ ID NO: 16599 - DNA, 71 bp, chicken (Gallus Gallus)
  misc_feature (36): n=a or g
acagacccaggaaaaccacctgagagctaaaagaantactttttgcagtaagaagctcagagagttcagca

SEQ ID NO: 16600 - DNA, 71 bp, chicken (Gallus Gallus)
  misc_feature (36): n=a or g
ctttagaaactgtttatgcatagctctacatacacntatattttaccttcattataactgagttacaaagc

SEQ ID NO: 16601 - DNA, 71 bp, chicken (Gallus Gallus)
  misc_feature (36): n=a or g
gcaatattcagttattgcagttcatttttacttacntacaagttgattgtgtgaaacaagtaaaagtcgct

SEQ ID NO: 16602 - DNA, 71 bp, chicken (Gallus Gallus)
  misc_feature (36): n=g or t
tgttttccacacaccacatcctccaggggatttggntgcaaaagcactgtggatcactggtgttgggccaa

SEQ ID NO: 16603 - DNA, 71 bp, chicken (Gallus Gallus)
  misc_feature (36): n=g or t
agttacctttcctaataactctccataattctgtanaacacgctgcaggaaactggttgttagaaacgtgg

SEQ ID NO: 16604 - DNA, 71 bp, chicken (Gallus Gallus)
  misc_feature (36): n=g or t
caggtgtgctaatgtggggctagtagttcttgctgnggtaccagcaacaacatcaccacatcactgaagca

SEQ ID NO: 16605 - DNA, 71 bp, chicken (Gallus Gallus)
  misc_feature (36): n=a or g
ttatttttcacagtctctcaaagcaaaagtcagcanagcccataattggcataaaaagtaaatgttttaag

SEQ ID NO: 16606 - DNA, 71 bp, chicken (Gallus Gallus)
  misc_feature (36): n=c or t
tgaatcttcagtgtgcagtatcagaatattctgttnttatttggtctcttgataccaagttgtaaaccatt

SEQ ID NO: 16607 - DNA, 71 bp, chicken (Gallus Gallus)
  misc_feature (36): n=c or g
gtattttaccaccttagctggatgaaaaacagaatncaaaaggaaaatagccttgaaacaccagtttaagt

SEQ ID NO: 16608 - DNA, 71 bp, chicken (Gallus Gallus)
  misc_feature (36): n=a or g
cttttttgtctctctgaagctagctgtcctccttcnttgtacatggcaaatgaagattgatgacagtacgt

SEQ ID NO: 16609 - DNA, 71 bp, chicken (Gallus Gallus)
  misc_feature (36): n=a or g
gggtggtgctcccccagggtatgaaaatctcaccancagtatgtcagatgtttgttcagcacgccctcaag

SEQ ID NO: 16610 - DNA, 71 bp, chicken (Gallus Gallus)
  misc_feature (36): n=c or t
attcgtacatctgtacagaaaggaagtgggggaagnggataagaatcttggaaatgcatcttggctgtaag

SEQ ID NO: 16611 - DNA, 71 bp, chicken (Gallus Gallus)
  misc_feature (36): n=a or g
cctccatgatgttgtgaggtaccagaaagttgtacncatttttaagactcctatacctgttactggaatcc

SEQ ID NO: 16612 - DNA, 71 bp, chicken (Gallus Gallus)
  misc_feature (36): n=a or g
aacagtgcagtctttctaaaaaccaacatagcaagntttcactgtaattttcgttgtcctgattatagaaa

SEQ ID NO: 16613 - DNA, 71 bp, chicken (Gallus Gallus)
  misc_feature (36): n=c or t
ccttccttccctcaacacttgtttttcagatacgtnctgatattctaatttaattatttcttaggaaagga

SEQ ID NO: 16614 - DNA, 71 bp, chicken (Gallus Gallus)
  misc_feature (36): n=c or t
ttctgggctttatgttaatgcagtgtctgtcacatncctcttcactggaagctttcaaagtcttggtggaa

SEQ ID NO: 16615 - DNA, 71 bp, chicken (Gallus Gallus)
  misc_feature (36): n=a or g
gaagttgtgactagtctaagcgtcctcacacacgcngcatacaaccatcttcaaaagacacattaaggtat

SEQ ID NO: 16616 - DNA, 71 bp, chicken (Gallus Gallus)
  misc_feature (36): n=a or t
tagttggttttccacatttttttctggaagtacttngtcacaaaatgtaattcctcttgatttatggactc

SEQ ID NO: 16617 - DNA, 71 bp, chicken (Gallus Gallus)
  misc_feature (36): n=a or g
atctcctgaaatactgtttcatggtttattaagtanggggaaggcattcaaatgatacatgcaaggaagta

SEQ ID NO: 16618 - DNA, 71 bp, chicken (Gallus Gallus)
  misc_feature (36): n=c or t
aaatttgttgtactttaatgatggctttgtttcaanccaataaaatatgcagacctgtctcttcatgtgaa

SEQ ID NO: 16619 - DNA, 71 bp, chicken (Gallus Gallus)
  misc_feature (36): n=a or g
ataatttgaaaaatgttagagtaaaataaattactnatttgtgttaccttaaatggctttctggaatacag

SEQ ID NO: 16620 - DNA, 71 bp, chicken (Gallus Gallus)
  misc_feature (36): n=a or g
tgttggggtcgttctggaggaaagaagtctcctttnggaaaggctcgttcatcctaaaaataattcaatac

SEQ ID NO: 16621 - DNA, 71 bp, chicken (Gallus Gallus)
  misc_feature (36): n=a or g
ctgtagcttctttatttaacaaatacttcctgctcnggagaacatgctgttagatatacggcaatttgtaa

SEQ ID NO: 16622 - DNA, 71 bp, chicken (Gallus Gallus)
  misc_feature (36): n=c or t
gtttacagagaaaaagaattacagctaccttttaanagaattgcagctattattttttcagtgcttgctta

SEQ ID NO: 16623 - DNA, 71 bp, chicken (Gallus Gallus)
  misc_feature (36): n=a or g
tccaacattcatgtgaaaaaaagatactgtcaagcncacacaaataactgctttgaaatgttcaaacatca

SEQ ID NO: 16624 - DNA, 71 bp, chicken (Gallus Gallus)
  misc_feature (36): n=a or g
tttattttaggtgtttgagactttgaatcacaatcnagacatttttgtgcattgaatttagagtagatttt

SEQ ID NO: 16625 - DNA, 71 bp, chicken (Gallus Gallus)
  misc_feature (36): n=a or g
gagtacccccttagtaggaagggaatgcttccttangctgctgttaaacattgaggcatttgactcccagc

SEQ ID NO: 16626 - DNA, 71 bp, chicken (Gallus Gallus)
  misc_feature (36): n=a or g
ccactgctttgtcccccagtcccccgtgcaagtagnatgttaatacatgttagcagtttaagtctaactga

SEQ ID NO: 16627 - DNA, 71 bp, chicken (Gallus Gallus)
  misc_feature (36): n=a or c
ttaatttcttggttattcattattctgtatactttntggtgctttattaaagaagacaaaattaggacagg

SEQ ID NO: 16628 - DNA, 71 bp, chicken (Gallus Gallus)
  misc_feature (36): n=a or g
aagaacacagtataattatgcaacacaagcaagttncttcaagcttgtcaacaattcactcaattaaaaaa

SEQ ID NO: 16629 - DNA, 71 bp, chicken (Gallus Gallus)
  misc_feature (36): n=a or g
tgtaagttacgttggttcaaccgctttgatagaccncgcatgcaaactcacctgttagattaatctgcagc

SEQ ID NO: 16630 - DNA, 71 bp, chicken (Gallus Gallus)
  misc_feature (36): n=c or g
aaaatgaggtggatgcaattagtttgtctatacttnacaccctctgtgttttccccttcggtgaatgagtc

SEQ ID NO: 16631 - DNA, 71 bp, chicken (Gallus Gallus)
  misc_feature (36): n=a or g
cagctttactcctggtagtgtgttcttcttcacagnagagcagaaatagctggtatttaacagcaactcct

SEQ ID NO: 16632 - DNA, 71 bp, chicken (Gallus Gallus)
  misc_feature (36): n=c or t
atgacagcctcatggtctgattgacccattttccancttcaaggacccattcccaaaagcagaacccagga

SEQ ID NO: 16633 - DNA, 71 bp, chicken (Gallus Gallus)
  misc_feature (36): n=c or t
aatggccaccttcaacatcctcaacctagagttgangacaaaaagtcctgcagtacaatttgagagcaagt

SEQ ID NO: 16634 - DNA, 71 bp, chicken (Gallus Gallus)
  misc_feature (36): n=c or g
aattctcttgaaaatatccttagtattttcccacangagatcccagtgcaaatataacttttactgttcca

SEQ ID NO: 16635 - DNA, 71 bp, chicken (Gallus Gallus)
  misc_feature (36): n=a or g
tctgcatttccttacagttaaatacatcgcattacntttacctgaaagtttccaggttaaaaagtcccatg

SEQ ID NO: 16636 - DNA, 71 bp, chicken (Gallus Gallus)
  misc_feature (36): n=a or t
taaaatattacaactacagcactctgtgtttctgtntactgaaagttacattgaaatggaaactatagttt

SEQ ID NO: 16637 - DNA, 71 bp, chicken (Gallus Gallus)
  misc_feature (36): n=a or g
taaaaatcaattgatgccagcgcttgttattggagngatcattcttcatctagtgattaattcacttccca

SEQ ID NO: 16638 - DNA, 71 bp, chicken (Gallus Gallus)
  misc_feature (36): n=a or t
gtgatatgatccatagggatttgctattgcctttcntggcctcaggacacttctgccatcctcccaaaact

SEQ ID NO: 16639 - DNA, 71 bp, chicken (Gallus Gallus)
  misc_feature (36): n=c or g
gtgtaatttgaaatcagagactaaaaaaggtcattnagaatgctgtatatgtgatatagttggtgaaatgg

SEQ ID NO: 16640 - DNA, 71 bp, chicken (Gallus Gallus)
  misc_feature (36): n=a or t
gggggtatatactcctttgcctgtcaccaatgtacntatagaatcccttcttgttatttttcacatccctt

SEQ ID NO: 16641 - DNA, 71 bp, chicken (Gallus Gallus)
  misc_feature (36): n=a or g
tctttcaaaagatttcccagcagagagtgcgggggnaaaaaaatatcatttcagcaacaataacaaaagac

SEQ ID NO: 16642 - DNA, 71 bp, chicken (Gallus Gallus)
  misc_feature (36): n=a or c
aagagaatagagcagtgagcctacaaatggaagtantgcttggtttacgcattctctaaatgacatcagtg

SEQ ID NO: 16643 - DNA, 71 bp, chicken (Gallus Gallus)
  misc_feature (36): n=g or t
tcatgaatttttgattatcctcagccaagtttagtntgctgttctgaaatctacagcaaaaactgacagag

SEQ ID NO: 16644 - DNA, 71 bp, chicken (Gallus Gallus)
  misc_feature (36): n=a or g
ataataacacagtaccattatcagatactctccagnaggacaggacttctgggtgctccacctgccacctt

SEQ ID NO: 16645 - DNA, 71 bp, chicken (Gallus Gallus)
  misc_feature (36): n=a or g
ttcttaaagcatagcagctttaattgcaagctaacntacttcaaccttaattgccaagtagactcttgaat

SEQ ID NO: 16646 - DNA, 71 bp, chicken (Gallus Gallus)
  misc_feature (36): n=a or g
tttggccttctgctttttgtttttctccacagatcntttctcctgagtttgctgcccacaatccttattat

SEQ ID NO: 16647 - DNA, 71 bp, chicken (Gallus Gallus)
  misc_feature (36): n=c or t
cagctgagatgctgctctaggaagctctgctccagnaaacagtacttttataggaaaggtataagaaatag

SEQ ID NO: 16648 - DNA, 71 bp, chicken (Gallus Gallus)
  misc_feature (36): n=a or g
gaggatgaaggaaatgtcctaaaagaagaacctggnttcctgctatcacaaagacttaacagaagcaaaac

SEQ ID NO: 16649 - DNA, 71 bp, chicken (Gallus Gallus)
  misc_feature (36): n=a or g
ttcagtacctgccatactgtccgagaggtggtgtcngtggtgtctaaattagtatgtactgcttgtgcatg

SEQ ID NO: 16650 - DNA, 71 bp, chicken (Gallus Gallus)
  misc_feature (36): n=a or g
ttttctttgccttttataacatctattatacctaancagttattttcattgtcatcacactgctgctggat

SEQ ID NO: 16651 - DNA, 71 bp, chicken (Gallus Gallus)
  misc_feature (36): n=a or t
atgaatcaaaactactgtcctcagttctgtttatcncaacattaacagaagttcagatgtcactgctcagg

SEQ ID NO: 16652 - DNA, 71 bp, chicken (Gallus Gallus)
  misc_feature (36): n=a or g
aattgcctaatttgtgtcttccttctgccttcaatnaagagagtgtaagaagtgtgcacaggcttgggggg

SEQ ID NO: 16653 - DNA, 71 bp, chicken (Gallus Gallus)
  misc_feature (36): n=c or t
atctccccagaattgaggttatggctgcaacctcanctctacttccttgtccatacgtactgtgattaact

SEQ ID NO: 16654 - DNA, 71 bp, chicken (Gallus Gallus)
  misc_feature (36): n=a or g
gtaattcaaagcacataactcactctgaaagtaatncttcttatttattttcgtagcttcttatttatttt

SEQ ID NO: 16655 - DNA, 71 bp, chicken (Gallus Gallus)
  misc_feature (36): n=a or g
tatgtgaactctaacagctatgctttgtagcagccngacacttttccaggacttgttagagagctataata

SEQ ID NO: 16656 - DNA, 71 bp, chicken (Gallus Gallus)
  misc_feature (36): n=a or g
gcattactttcaggggggttgtatatattccggtantagccaatggagcgaatagtctgcatggtatgacg

SEQ ID NO: 16657 - DNA, 71 bp, chicken (Gallus Gallus)
  misc_feature (36): n=a or t
agagcaaagaattcataaaactagtcacttgaaagnaaagaaatggaaagaaaagagaaggaataaacatt

SEQ ID NO: 16658 - DNA, 71 bp, chicken (Gallus Gallus)
  misc_feature (36): n=c or t
cccgagagctgccttcaacatctaaggtgatgggcngtgcttgggttcctgcctcaggatggatgtgcctc

SEQ ID NO: 16659 - DNA, 71 bp, chicken (Gallus Gallus)
  misc_feature (36): n=a or g
attcaactgttcaaggaacaaaagtaaactattgtnaatgctatgatctctacaagcggataatactaaca

SEQ ID NO: 16660 - DNA, 71 bp, chicken (Gallus Gallus)
  misc_feature (36): n=c or t
tcgaacaataaacctcctctgttgtcatgtccttanggccacccattcgatggtgaaatctcagattgaat

SEQ ID NO: 16661 - DNA, 71 bp, chicken (Gallus Gallus)
  misc_feature (36): n=c or t
gttttaagaaattacatgacagttacacaggaaagngccaactctgatagacgagcgttaccctgtctttc

SEQ ID NO: 16662 - DNA, 71 bp, chicken (Gallus Gallus)
  misc_feature (36): n=a or g
acatcatcaacgcacgtttgaaatgagcagagtgcntttgttggaggaagcacactgctgatacaagtaac

SEQ ID NO: 16663 - DNA, 71 bp, chicken (Gallus Gallus)
  misc_feature (36): n=c or g
tgctgaaataagaattgtgaaacattattgaagctnaggaagatgaaaactctgaatgataagaatttctt

SEQ ID NO: 16664 - DNA, 71 bp, chicken (Gallus Gallus)
  misc_feature (36): n=c or t
atttctgttctcctgcaaatctaattcctgtagatnttagcattccttcttaaagcatcctgagctacaaa

SEQ ID NO: 16665 - DNA, 71 bp, chicken (Gallus Gallus)
  misc_feature (36): n=a or g
aatagttatatatttttttaagtgcagttctaccanatcagtgctttcctagtgctgaacatttgacgtgt

SEQ ID NO: 16666 - DNA, 71 bp, chicken (Gallus Gallus)
  misc_feature (36): n=c or t
agccacaatacggtaactgaaaacaggagaatgaangtagtagtgcttttgatgcaggaattactaatgag

SEQ ID NO: 16667 - DNA, 71 bp, chicken (Gallus Gallus)
  misc_feature (36): n=c or t
acaccattctatctttgctggtccctttgctgttangcttttctgtcaccttttcactgtactgacctttt

SEQ ID NO: 16668 - DNA, 71 bp, chicken (Gallus Gallus)
  misc_feature (36): n=a or g
gagcccattcattactgcatacctttaatacccgtnttttaatgatgcactacacttcgccaacctcctac

SEQ ID NO: 16669 - DNA, 71 bp, chicken (Gallus Gallus)
  misc_feature (36): n=a or t
ataataaatatcagaagtctatttggttgcgatagngtctatgctgcaaatcctagagctggaaaaatgtg

SEQ ID NO: 16670 - DNA, 71 bp, chicken (Gallus Gallus)
  misc_feature (36): n=c or t
tgctgttaatgtggattgccaatgttatgttcaganctacgacaagtgcaattttaacagaataaattttt

SEQ ID NO: 16671 - DNA, 71 bp, chicken (Gallus Gallus)
  misc_feature (36): n=c or t
gtgtctccatctgtctgatatattctcctcgtaaantggaaatctgctctcagctctccccagagacttct

SEQ ID NO: 16672 - DNA, 71 bp, chicken (Gallus Gallus)
  misc_feature (36): n=a or g
acatgtagagaagtacccgtccctcttgacgtttangtagcaaaaactccatacacattcactaaaaaaga

SEQ ID NO: 16673 - DNA, 71 bp, chicken (Gallus Gallus)
  misc_feature (36): n=c or t
gagaatgtgtttccttatcatggaagcttcttctangtttgaaacttaactaaagattttggtcctttttt

SEQ ID NO: 16674 - DNA, 71 bp, chicken (Gallus Gallus)
  misc_feature (36): n=a or c
ttcatcatttgctacttatttgtattatgtgagtcntcacgaaatgtattgttccttctcaatgaatgagg

SEQ ID NO: 16675 - DNA, 71 bp, chicken (Gallus Gallus)
  misc_feature (36): n=c or t
ttgtggcatctattcagggctttttgcccatgcagngtttttacagccaaactgtacaatgtttctgcctt

SEQ ID NO: 16676 - DNA, 71 bp, chicken (Gallus Gallus)
  misc_feature (36): n=a or g
cagagcctgagtgggggcatcatggggcttgcagcntttcctcacctatgcccaaaggcaatcacagaact

SEQ ID NO: 16677 - DNA, 71 bp, chicken (Gallus Gallus)
  misc_feature (36): n=c or t
ctaaaatggattcccaaaattcgccctgcaaagaanatatcccgtatttttgttacctcctttgtgaaaac

SEQ ID NO: 16678 - DNA, 71 bp, chicken (Gallus Gallus)
  misc_feature (36): n=c or t
gcaacagttggctgaaggcatttggcttaggctgcnttgaaacaggagcaagataatagaatcataaaatc

SEQ ID NO: 16679 - DNA, 71 bp, chicken (Gallus Gallus)
  misc_feature (36): n=c or t
ccagggagacagtgcatggcctcctgcttctttctncttagacagtttgctaacgtcctgatttacctcaa

SEQ ID NO: 16680 - DNA, 71 bp, chicken (Gallus Gallus)
  misc_feature (36): n=a or c
aataatttaaaaattcttttgtctgtcaatcatccngttcacataagttggtcacttctgaaggcctattg

SEQ ID NO: 16681 - DNA, 71 bp, chicken (Gallus Gallus)
  misc_feature (36): n=c or t
gctttcttgaaattcacctgccactgcagattatangatggtaggaaatttcattcatcagtcctcagttc

SEQ ID NO: 16682 - DNA, 71 bp, chicken (Gallus Gallus)
  misc_feature (36): n=c or t
atactgtgtgttcacctatttcttgtttccattgangggcctgacattcaacacctcattgaggctgaaat

SEQ ID NO: 16683 - DNA, 71 bp, chicken (Gallus Gallus)
  misc_feature (36): n=a or g
caaggaaatcacttactagaaacataacccacctgntgcatgttctcttcctcactccaaaattagttgtg

SEQ ID NO: 16684 - DNA, 71 bp, chicken (Gallus Gallus)
  misc_feature (36): n=a or g
actgaaaaaccaagcaacatatttaaatatgagacnaagagtgaagagagagcatcaaacattacttcacc

SEQ ID NO: 16685 - DNA, 71 bp, chicken (Gallus Gallus)
  misc_feature (36): n=g or t
agggcagaatatacagaactatctcaatcctcactnaaggcacagtcttttagtagatgcccttactcata

SEQ ID NO: 16686 - DNA, 71 bp, chicken (Gallus Gallus)
  misc_feature (36): n=c or t
tctgcccaagggtgttgtgagtgatgcatggggatngcatctgactggtggtggggagatttcgtgtgaca

SEQ ID NO: 16687 - DNA, 71 bp, chicken (Gallus Gallus)
  misc_feature (36): n=a or g
acatctgaactaattgtgtttttatgctatgccaanatgttggataaccttctaacccttctgtagttaac

SEQ ID NO: 16688 - DNA, 71 bp, chicken (Gallus Gallus)
  misc_feature (36): n=c or t
cttgaaatgaagtataccttagactggttaggagtngatctcttaaaataactgcttctgccttgtctggc

SEQ ID NO: 16689 - DNA, 71 bp, chicken (Gallus Gallus)
  misc_feature (36): n=c or t
acagtggtgatatcttaagacagtgttttaagttcnctacttttgattctgcttttctctagtgtttattt

SEQ ID NO: 16690 - DNA, 71 bp, chicken (Gallus Gallus)
  misc_feature (36): n=a or g
aagaagcaactcttttttcagggtttgtaatgaatntaactttgttcttgtatcacatggaggaaacttgg

SEQ ID NO: 16691 - DNA, 71 bp, chicken (Gallus Gallus)
  misc_feature (36): n=a or g
acttgacagctcagattcggaggtaaagcatcaggncggaccttgcttcttgttggtcagaacctggtcct

SEQ ID NO: 16692 - DNA, 71 bp, chicken (Gallus Gallus)
  misc_feature (36): n=c or t
gtgagcatatttttcaatttcgagctcttgagatancctgaaataacttttcctgcctttctctgcaccca

SEQ ID NO: 16693 - DNA, 71 bp, chicken (Gallus Gallus)
  misc_feature (36): n=a or g
tcagtgggttaggcacatcccatcagacaaacaaanacagtcaccagtttctacctcagaacgttttacct

SEQ ID NO: 16694 - DNA, 71 bp, chicken (Gallus Gallus)
  misc_feature (36): n=c or g
aattgatggttaagcacacttaaaccaaatgctaanaaagaaaataccacttggttttgcagaagtgtaat

SEQ ID NO: 16695 - DNA, 71 bp, chicken (Gallus Gallus)
  misc_feature (36): n=c or t
aatgatgtacccttcataactataaatgtaaatctnccattctgaaggcaaatgagaaagatgcagctggt

SEQ ID NO: 16696 - DNA, 71 bp, chicken (Gallus Gallus)
  misc_feature (36): n=a or g
aatggacagagcagtactgaaacaggacctgatccngcgaaggacaattctcagcagaccaaaccatctgg

SEQ ID NO: 16697 - DNA, 71 bp, chicken (Gallus Gallus)
  misc_feature (36): n=c or t
caggcagatttactgtctcttttagcttataatcanacctagatgtttttgtgggtgcctggcttcagact

SEQ ID NO: 16698 - DNA, 71 bp, chicken (Gallus Gallus)
  misc_feature (36): n=a or g
ttaccatgaactttagtcataatatttttgtcatantagtagcgaagtgcacggctgagtttgtcatagtt

SEQ ID NO: 16699 - DNA, 71 bp, chicken (Gallus Gallus)
  misc_feature (36): n=c or g
aagtaacatttccttgtgttagaaacaagtcctgtnttatttcccccctctgtatggctgtttaaccagct

SEQ ID NO: 16700 - DNA, 71 bp, chicken (Gallus Gallus)
  misc_feature (36): n=c or t
tggctgaggatttggtaagcttggagaaacagaganggtaggttggcctcattgctgtcaaaacttcttga

SEQ ID NO: 16701 - DNA, 71 bp, chicken (Gallus Gallus)
  misc_feature (36): n=a or t
ggatgcattggagattcaattctcttcccaccaacngagtccaactcatcaataaatataacacacggtgc

SEQ ID NO: 16702 - DNA, 71 bp, chicken (Gallus Gallus)
  misc_feature (36): n=a or g
cacaaataattaaaaagtcaagcaatattctctctnttaagcaatgagaatgcaacagttatttgtgatag

SEQ ID NO: 16703 - DNA, 71 bp, chicken (Gallus Gallus)
  misc_feature (36): n=c or t
ggtgtgttactgaactagaaatgcaaactgcttaantggtggtatcacggtacccattagacatagcaata

SEQ ID NO: 16704 - DNA, 71 bp, chicken (Gallus Gallus)
  misc_feature (36): n=c or t
gaaaacaagcaaaggaaaaagaattactcttggtcntttattatcacttaagcagaatcttacaatgaatt

SEQ ID NO: 16705 - DNA, 71 bp, chicken (Gallus Gallus)
  misc_feature (36): n=c or t
ttagtttcagactataatgtggggaggtagaaatgnttaatccaacgttttctttatattgaacagtacta

SEQ ID NO: 16706 - DNA, 71 bp, chicken (Gallus Gallus)
  misc_feature (36): n=c or t
atcatagggtaaaatatacttctaaatcaatacttngtcaattaattcaactttttaaactattgtccact

SEQ ID NO: 16707 - DNA, 71 bp, chicken (Gallus Gallus)
  misc_feature (36): n=c or t
tctgacggattgaagttcatagaactatagaaacancaaggttggaaaggacctccaaagtcatctagtcc

SEQ ID NO: 16708 - DNA, 71 bp, chicken (Gallus Gallus)
  misc_feature (36): n=g or t
gactaagtaaaataaaagtcatgtacaccttcagcngtcgtctatgtgaaatgtaaaaattattctggcaa

SEQ ID NO: 16709 - DNA, 71 bp, chicken (Gallus Gallus)
  misc_feature (36): n=a or g
agtcctgtacagcaaatgtcatgttcagaaagcagnaagaaactgcagaatgtgtagataagttgggttgg

SEQ ID NO: 16710 - DNA, 71 bp, chicken (Gallus Gallus)
  misc_feature (36): n=c or t
tcctcatttaccttgttgcaaatgacccataaatanatatttttttctgctttttcctcaaggcccccctt

SEQ ID NO: 16711 - DNA, 71 bp, chicken (Gallus Gallus)
  misc_feature (36): n=a or g
aaatctattagctgcaagactattttctagaacacnctacagaaattggcagcaaaatatatctcatatta

SEQ ID NO: 16712 - DNA, 71 bp, chicken (Gallus Gallus)
  misc_feature (36): n=a or g
gtccaggagtggattccaaccttgtcagctattccnatgagaggcatattctttaagaaatgcatttccag

SEQ ID NO: 16713 - DNA, 71 bp, chicken (Gallus Gallus)
  misc_feature (36): n=a or c
gaggatttctggagctactcttcccacagtagtagnagagggaggaaatatggcctgagtgggtgagatgg

SEQ ID NO: 16714 - DNA, 71 bp, chicken (Gallus Gallus)
  misc_feature (36): n=a or c
ataattcatcttaaaaagaaaactgaaagatatttnacagtgagaccctacagagcttgcagaagtctttc

SEQ ID NO: 16715 - DNA, 71 bp, chicken (Gallus Gallus)
  misc_feature (36): n=a or g
ctgaaccaagcctccttcatccgtggcatgctctcntatattaagaggtccttctctgtcaagaccaccaa

SEQ ID NO: 16716 - DNA, 71 bp, chicken (Gallus Gallus)
  misc_feature (36): n=a or g
atgagataccattcacaccataagctcttttgtcancaacagagatcagaaggtcaagcacaaagccacca

SEQ ID NO: 16717 - DNA, 71 bp, chicken (Gallus Gallus)
  misc_feature (36): n=c or t
gccatatgattatgtgagttctttggcctgaagatnctgtcctgcatactcatctgacacaaggtcatact

SEQ ID NO: 16718 - DNA, 71 bp, chicken (Gallus Gallus)
  misc_feature (36): n=c or t
atattttcatgttatgtaagaatatgccattcatangtaatgttcgtcttaggtgaagatcatataggaaa

SEQ ID NO: 16719 - DNA, 71 bp, chicken (Gallus Gallus)
  misc_feature (36): n=g or t
acgctcacaggtgcaactctgagaaccctcatgggnaaacagtgctcagtattctcaccaatccctctcaa

SEQ ID NO: 16720 - DNA, 71 bp, chicken (Gallus Gallus)
  misc_feature (36): n=c or t
gcattggctgctctgtaaacagagaactgaaaatantccccttgccaaaaaccatacatagaaatccaggt

SEQ ID NO: 16721 - DNA, 71 bp, chicken (Gallus Gallus)
  misc_feature (36): n=c or t
agggatcagatcagaagatgattcacacatcatagnatattcgataggctggtggcttaggcactgggggg

SEQ ID NO: 16722 - DNA, 71 bp, chicken (Gallus Gallus)
  misc_feature (36): n=a or g
gtacttatacattcccaaatttcgccaggtcttccntggcattttgagattatgtctcacaaattctctca

SEQ ID NO: 16723 - DNA, 71 bp, chicken (Gallus Gallus)
  misc_feature (36): n=a or g
agttcaagtacaagagtgggtgatcaactgtaatantactatgttatttttggagagaattggtcaaagca

SEQ ID NO: 16724 - DNA, 71 bp, chicken (Gallus Gallus)
  misc_feature (36): n=c or t
taaaactgtttccagataatagaacattcttgcttntctttttgcattaatttccaacttccatgagactg

SEQ ID NO: 16725 - DNA, 71 bp, chicken (Gallus Gallus)
  misc_feature (36): n=c or t
agagcactggtttggagagcattgtttgggtgatgngctttcggggggggggagcattgtgacacacacca

SEQ ID NO: 16726 - DNA, 71 bp, chicken (Gallus Gallus)
  misc_feature (36): n=a or g
ccagatcgagcttgatcttcctcatcttcacaagtngaaccattaataacacttccctcatcatcttcttc

SEQ ID NO: 16727 - DNA, 71 bp, chicken (Gallus Gallus)
  misc_feature (36): n=a or g
agaacagctgtctctacagccaggcctgattcagcntggttttaggaaaagaaagccaaagtttcaggaga

SEQ ID NO: 16728 - DNA, 71 bp, chicken (Gallus Gallus)
  misc_feature (36): n=a or g
catctggtatgtaaatacttttattgattcattagnttaaagtgcttttggtgtatacagtatccaggctg

SEQ ID NO: 16729 - DNA, 71 bp, chicken (Gallus Gallus)
  misc_feature (36): n=a or g
gccattacctctcatcctaatgtgtccattccccancaactgcctgaagtctggagagaccttctttatct

SEQ ID NO: 16730 - DNA, 71 bp, chicken (Gallus Gallus)
  misc_feature (36): n=a or g
tcataaaaaaaaaatatatatatgcaccaatggacntaagtttgtattccatctgtctgaaattagagtgt

SEQ ID NO: 16731 - DNA, 71 bp, chicken (Gallus Gallus)
  misc_feature (36): n=c or t
tttgctgctgttttgaatggagcccggattctaccngatgttcaaaagctgaaaggaaggtgtgtgagctc

SEQ ID NO: 16732 - DNA, 71 bp, chicken (Gallus Gallus)
  misc_feature (36): n=c or t
aggcttattttgtgtacgatcccacctttcctcctncactgcatctcatcaatattcagcttaacttgcca

SEQ ID NO: 16733 - DNA, 71 bp, chicken (Gallus Gallus)
  misc_feature (36): n=a or t
cagataaacagattgtgtaaaggaggcactctggcncttgaagagtgagatcttaactactgtttcttttg

SEQ ID NO: 16734 - DNA, 71 bp, chicken (Gallus Gallus)
  misc_feature (36): n=a or g
tagagctagatgatctttaaggtcccttccaacccntcctatgatctaccagtttccatagcataagctgg

SEQ ID NO: 16735 - DNA, 71 bp, chicken (Gallus Gallus)
  misc_feature (36): n=c or t
acagagtcaatgatgattgttgctgaaaatttcttntcattgatagattccaagatgccttcatttcccct

SEQ ID NO: 16736 - DNA, 71 bp, chicken (Gallus Gallus)
  misc_feature (36): n=c or t
ctgcctaaggatggaagtgaagatgtctaatattgncactgttctttagcttgcttaaacactggatttgc

SEQ ID NO: 16737 - DNA, 71 bp, chicken (Gallus Gallus)
  misc_feature (36): n=a or g
gtacttgcaggataatttctacactgacaagcctcncattagcttagtagtaaaataaagtgtcagggatc

SEQ ID NO: 16738 - DNA, 71 bp, chicken (Gallus Gallus)
  misc_feature (36): n=a or g
atagttggcagagttgctttgtattggacaaagaantcagtcgggatgcagagaaacacttttcctgtgct

SEQ ID NO: 16739 - DNA, 71 bp, chicken (Gallus Gallus)
  misc_feature (36): n=g or t
agcactgtaagtaaagataacaacatttctgctttngcaccctctggcatccactaacccagcagagaaat

SEQ ID NO: 16740 - DNA, 71 bp, chicken (Gallus Gallus)
  misc_feature (36): n=c or t
tgctttcttcatccataaattatttgcaagcaaacnaaaactttagcatgcctagtttgggaagatgtgat

SEQ ID NO: 16741 - DNA, 71 bp, chicken (Gallus Gallus)
  misc_feature (36): n=c or t
gactgacatgatctctagcaagttaggtgaagcganatagagcaggcttcccaccccaccttgatgggcag

SEQ ID NO: 16742 - DNA, 71 bp, chicken (Gallus Gallus)
  misc_feature (36): n=c or t
gaacatctccaactcaggagatgcctgacttcccangtgacagtcctgcttgagttcaggctgaagacatg

SEQ ID NO: 16743 - DNA, 71 bp, chicken (Gallus Gallus)
  misc_feature (36): n=a or g
aaatctaaatatgattgctttgcaagttcctaactntggctaacagctaatggaagtccacatgccagcag

SEQ ID NO: 16744 - DNA, 71 bp, chicken (Gallus Gallus)
  misc_feature (36): n=a or g
tcagtgagtgaccgaggcaggtgctgagatttcaanctgttgttcttatttgcctccagatcttcctccaa

SEQ ID NO: 16745 - DNA, 71 bp, chicken (Gallus Gallus)
  misc_feature (36): n=a or c
ttgtgtttacatctcagtaaaaagagacaatgtgtncagtgagaacttcaggtcggatatcaggacaaatt

SEQ ID NO: 16746 - DNA, 71 bp, chicken (Gallus Gallus)
  misc_feature (36): n=a or g
actgttcaatcaaaggttgttgtttctgttccttancaaaacttctgccttcttgaaagaagctgctgctt

SEQ ID NO: 16747 - DNA, 71 bp, chicken (Gallus Gallus)
  misc_feature (36): n=a or g
catcccttttattagtcttagtccatgggatctgcntggattatatggagtattttttttcttcacagtga

SEQ ID NO: 16748 - DNA, 71 bp, chicken (Gallus Gallus)
  misc_feature (36): n=c or t
ttttgatgtttaaaaatacagctattaaccacttgngttcagtgacttaaaaccatataatattttgttga

SEQ ID NO: 16749 - DNA, 71 bp, chicken (Gallus Gallus)
  misc_feature (36): n=a or c
gtaatcttgtgcatgctgtatgtacataaatgagantttctgctttatgcttgaattcttgtgcctatcct

SEQ ID NO: 16750 - DNA, 71 bp, chicken (Gallus Gallus)
  misc_feature (36): n=c or t
ttttgtcctcctccagccagcagaattcacatttanagcatctcagttcctcctgcttactctacaccacg

SEQ ID NO: 16751 - DNA, 71 bp, chicken (Gallus Gallus)
  misc_feature (36): n=a or g
cttatagaggagaaattcctccctccctctcccccntacaacctggaaccaaggttttgagagcaccttca

SEQ ID NO: 16752 - DNA, 71 bp, chicken (Gallus Gallus)
  misc_feature (36): n=a or c
attttcaactgtagaaagagattaatttttttgttnagactccaacccaaaaacgtgcctttctcagaagt

SEQ ID NO: 16753 - DNA, 71 bp, chicken (Gallus Gallus)
  misc_feature (36): n=g or t
agtgccatagtcttttaataaagaaaaatatagctncttttcatcacctcagtagatttgtttgttatctc

SEQ ID NO: 16754 - DNA, 71 bp, chicken (Gallus Gallus)
  misc_feature (36): n=c or t
ccctgccctgttgccagtagtgctggcaccgccctngccctgttaccaggcttttaacaggtacccccaca

SEQ ID NO: 16755 - DNA, 71 bp, chicken (Gallus Gallus)
  misc_feature (36): n=a or g
agaggatagagaagataagcagaagagtgtttgtcnagactggtaattattggggatttttaagaatctgg

SEQ ID NO: 16756 - DNA, 71 bp, chicken (Gallus Gallus)
  misc_feature (36): n=g or t
aggagattaaaaggtttaaagcagaaaaggatcttntagagaaggaaagatctcaagcaaaagtggacagg

SEQ ID NO: 16757 - DNA, 71 bp, chicken (Gallus Gallus)
  misc_feature (36): n=c or g
gtggctctactggcattgcactttttatgttagctnctccagagcttgatttctgtggattgttttctttt

SEQ ID NO: 16758 - DNA, 71 bp, chicken (Gallus Gallus)
  misc_feature (36): n=a or g
gaagactatacagcagtgtttctaggtggaatacantgagtttgtttcatcagtcatagttctttttttgt

SEQ ID NO: 16759 - DNA, 71 bp, chicken (Gallus Gallus)
  misc_feature (36): n=c or t
aagatgtgaacaccttatattgttttgttttgtttngtttcatttcccagaattgcagatcttgagcatgg

SEQ ID NO: 16760 - DNA, 71 bp, chicken (Gallus Gallus)
  misc_feature (36): n=c or g
acgtagcagctcattgaaatttacctttaagctctngttccttttggagtgattaagacaagtcaaatatc

SEQ ID NO: 16761 - DNA, 71 bp, chicken (Gallus Gallus)
  misc_feature (36): n=a or g
tgtgttcctttctgaagtgagagatgagcgttaacntacagatgttctgttttgatctgtggcacaataca

SEQ ID NO: 16762 - DNA, 71 bp, chicken (Gallus Gallus)
  misc_feature (36): n=c or t
caaaagtattgtcaaggtagtggtggcttcggtagntgtgcaagtgcaagttcccttcgaaagtgaatgga

SEQ ID NO: 16763 - DNA, 71 bp, chicken (Gallus Gallus)
  misc_feature (36): n=g or t
gagaggatgaatgctgtaataacactaatgcaactncagtattttgcctgctgaaacgcaggtctgtagct

SEQ ID NO: 16764 - DNA, 71 bp, chicken (Gallus Gallus)
  misc_feature (36): n=a or g
tactattatcagtaagcttatcaaggaaattagagnaaatgcacatctaatgataaacagggagctttccg

SEQ ID NO: 16765 - DNA, 71 bp, chicken (Gallus Gallus)
  misc_feature (36): n=c or t
gctatacatagccaaaagtacatacaattgtgtaantcctatttgcacatttatattgtttccagattgtt

SEQ ID NO: 16766 - DNA, 71 bp, chicken (Gallus Gallus)
  misc_feature (36): n=a or g
gcacaatgcaagaacatgttgataaagacagtaagnatggtagtttctgtgtaaaacttcaatagaaagca

SEQ ID NO: 16767 - DNA, 71 bp, chicken (Gallus Gallus)
  misc_feature (36): n=a or c
ttttaaaggtgatgctcaataggaatgttaaaacangccctttgctgctggattcctctgctggagcgtgg

SEQ ID NO: 16768 - DNA, 71 bp, chicken (Gallus Gallus)
  misc_feature (36): n=a or t
cttcctatttaatatatgaattgcttaaggtatgcnaacagttaaaatgtaacaggtgtgtacatggtttt

SEQ ID NO: 16769 - DNA, 71 bp, chicken (Gallus Gallus)
  misc_feature (36): n=c or t
tcaaacagttaaaattccaagttcagttaactaaangcatgcaatcaatgctgcaccacttgaaaaacatt

SEQ ID NO: 16770 - DNA, 71 bp, chicken (Gallus Gallus)
  misc_feature (36): n=a or g
tccaaagttgtgcaggaggatgaaatagaatgcacntatttgcgtaaagtggaaaagattgctttgatgct

SEQ ID NO: 16771 - DNA, 71 bp, chicken (Gallus Gallus)
  misc_feature (36): n=a or t
gagccagggaggatgtttcagtaactttttctccantcatgcttagttctttatgttttaagcagatgtaa

SEQ ID NO: 16772 - DNA, 71 bp, chicken (Gallus Gallus)
  misc_feature (36): n=a or t
ctgatccatgggaggtaactgaagtgtgacattgcncagaaaagctggtaagtctttaagggcagtattgt

SEQ ID NO: 16773 - DNA, 71 bp, chicken (Gallus Gallus)
  misc_feature (36): n=a or g
tcctaaccatgtgaatgtgctatagcttaatattcnaacagcaatgttgctttatccatgtttttctgcta

SEQ ID NO: 16774 - DNA, 71 bp, chicken (Gallus Gallus)
  misc_feature (36): n=c or t
ctgcaagctgtgaggttaggctgtgctgctccctgnggacaggagaaggcaattttagtttcaactgcctg

SEQ ID NO: 16775 - DNA, 71 bp, chicken (Gallus Gallus)
  misc_feature (36): n=c or t
actgatatacaacgacaaaggtttatttattactcnaaattaacctaaaaactgtaataaccttcctccct

SEQ ID NO: 16776 - DNA, 71 bp, chicken (Gallus Gallus)
  misc_feature (36): n=a or c
agatctcttggactaaaatgtcctgtgattcctganggttagcttctgtttcaactatgtatgtgtatata

SEQ ID NO: 16777 - DNA, 71 bp, chicken (Gallus Gallus)
  misc_feature (36): n=c or t
ccaccctgggattactgcagcattagtataataagnggttctgtttcccacagttgtccttagtctgtgtg

SEQ ID NO: 16778 - DNA, 71 bp, chicken (Gallus Gallus)
  misc_feature (36): n=c or t
gtgcgaaatcttggccttgtgtgagatgcagtgagngttgtaggtgatagtggagggaaagggctttgcct

SEQ ID NO: 16779 - DNA, 71 bp, chicken (Gallus Gallus)
  misc_feature (36): n=c or t
gtaacatgtggaaatcacaactcttcactgcaggangctagttcaactgcttttctgcctagtggattgct

SEQ ID NO: 16780 - DNA, 71 bp, chicken (Gallus Gallus)
  misc_feature (36): n=g or t
ttcgggatctgaatcccatcccaaatgtccaatttncctaattccagttttatttatttgctaatcactgc

SEQ ID NO: 16781 - DNA, 71 bp, chicken (Gallus Gallus)
  misc_feature (36): n=a or g
gtgatacaggcatttagggttggactggccatttcngtgcccatactgtacacattgccactatcacagct

SEQ ID NO: 16782 - DNA, 71 bp, chicken (Gallus Gallus)
  misc_feature (36): n=c or t
ctatttaacatacttctgccaacaccacagcacagnggtcactctgcatgtgacacttttgcagcatacac

SEQ ID NO: 16783 - DNA, 71 bp, chicken (Gallus Gallus)
  misc_feature (36): n=a or g
gccaaaaatggcaatggacacttgagttggtaagantaaccttttccacaaataatgtagggctctgtctt

SEQ ID NO: 16784 - DNA, 71 bp, chicken (Gallus Gallus)
  misc_feature (36): n=a or g
catctttcacccattcagtgtgtgcttactttgaangattaatttttaaatgccacatgatattgaattgt

SEQ ID NO: 16785 - DNA, 71 bp, chicken (Gallus Gallus)
  misc_feature (36): n=g or t
tttagtatatttttatttggacacaattgacaatanggttaaattacttcaaaattttttatttgaatgtt

SEQ ID NO: 16786 - DNA, 71 bp, chicken (Gallus Gallus)
  misc_feature (36): n=g or t
ctacatgtagcacagaaattaaattcctattatganaagtagtgtagcaaagcagtcctcctaatgagacc

SEQ ID NO: 16787 - DNA, 71 bp, chicken (Gallus Gallus)
  misc_feature (36): n=a or g
ctggagcttacaagtccacagtaaatcatccaaatngagccagatgaccccaagattagctgcatggcagt

SEQ ID NO: 16788 - DNA, 71 bp, chicken (Gallus Gallus)
  misc_feature (36): n=c or t
ctccctgtgctgtaagaggagctggtggaggagacnggtgtggatgaccagggagtttttcctgaagcttc

SEQ ID NO: 16789 - DNA, 71 bp, chicken (Gallus Gallus)
  misc_feature (36): n=g or t
gccctttcttttccttcaaggagtaaagaacttacngtttggtggggtttttggttgtttctttttgttgc

SEQ ID NO: 16790 - DNA, 71 bp, chicken (Gallus Gallus)
  misc_feature (36): n=c or t
gaaaaagtactgcagtgatgcattttttatcaaagngaaaccaaagattttagtaatagtatactgtttcc

SEQ ID NO: 16791 - DNA, 71 bp, chicken (Gallus Gallus)
  misc_feature (36): n=g or t
atcagaagctagccaatatcttatctttccattatncagtttccgattacagttatgtactgctatttcat

SEQ ID NO: 16792 - DNA, 71 bp, chicken (Gallus Gallus)
  misc_feature (36): n=c or g
aaagttttttatccagggacatcaggaatttgacantgacttctgaaagtcgataggatgactatgaagaa

SEQ ID NO: 16793 - DNA, 71 bp, chicken (Gallus Gallus)
  misc_feature (36): n=c or g
taagccaggaaccagaaacttacctcactgttctanagtaaaactgagaaaccctctcttcccatgtaatg

SEQ ID NO: 16794 - DNA, 71 bp, chicken (Gallus Gallus)
  misc_feature (36): n=c or g
gcaccttgatctagctgtacgtgtctttgctcactncagaggagttggactaggtggcccttaagggcccc

SEQ ID NO: 16795 - DNA, 71 bp, chicken (Gallus Gallus)
  misc_feature (36): n=a or g
aaaattttcagattaataaacattaacattaatccntgttaatattaatgaaacgttcatctactttctca

SEQ ID NO: 16796 - DNA, 71 bp, chicken (Gallus Gallus)
  misc_feature (36): n=a or g
aaagcttaaaaatagagtgataaaccacatacctgncttttcacaaagacagttgtctcggtcattgcagc

SEQ ID NO: 16797 - DNA, 71 bp, chicken (Gallus Gallus)
  misc_feature (36): n=g or t
agaaagcctttcaagtaattggaaattattttgggngcgcaatctataatcttgcttgtggcttaaatcta

SEQ ID NO: 16798 - DNA, 71 bp, chicken (Gallus Gallus)
  misc_feature (36): n=c or t
tggtgtggttcattgcgcatagtataaaacaggtangtgcacgagcaaattgtttttagtttttattaagg

SEQ ID NO: 16799 - DNA, 71 bp, chicken (Gallus Gallus)
  misc_feature (36): n=c or t
aattctgaagccaaggatgaaacttcctctcttttnactcgtctgtgaccaattgcattccttacctcttc

SEQ ID NO: 16800 - DNA, 71 bp, chicken (Gallus Gallus)
  misc_feature (36): n=a or c
agtctgctaaatactgctcacagaaaccaaggattntgcctttttgttttcttagatttctcagctagatt

SEQ ID NO: 16801 - DNA, 71 bp, chicken (Gallus Gallus)
  misc_feature (36): n=a or g
ggcccacaggagaatctgttaatatctgcctttctnttgttggtagtagccagatacataattatgagctg

SEQ ID NO: 16802 - DNA, 71 bp, chicken (Gallus Gallus)
  misc_feature (36): n=a or g
acagaatatcacacagcaacactgtgatgtgaagcntggagtaccacttcacccaggtcccttcagctcac

SEQ ID NO: 16803 - DNA, 71 bp, chicken (Gallus Gallus)
  misc_feature (36): n=c or g
ttcagcagtccagagtggtgaactgcacactaaaancagattcaaaatatgctgaattatgcctaaattta

SEQ ID NO: 16804 - DNA, 71 bp, chicken (Gallus Gallus)
  misc_feature (36): n=a or g
tcaaaagattctatgattctataagaagtttccagncaaatttgatatagcataaagtaagaaaatattct

SEQ ID NO: 16805 - DNA, 71 bp, chicken (Gallus Gallus)
  misc_feature (36): n=c or g
agaagtgctttgaggggagtccgaaattagatgganaaaggttgggcccctgctatggatctggcttatgc

SEQ ID NO: 16806 - DNA, 71 bp, chicken (Gallus Gallus)
  misc_feature (36): n=a or g
ctgcagtaataatgtttctctacagtctattatttnaagctacttcctggatttttaaatggcagtacaga

SEQ ID NO: 16807 - DNA, 71 bp, chicken (Gallus Gallus)
  misc_feature (36): n=a or c
ggtaggatctggaaacactgagtgtctgatggctcnttcttctttggagcttcacgtgtccctgtcaggtt

SEQ ID NO: 16808 - DNA, 71 bp, chicken (Gallus Gallus)
  misc_feature (36): n=a or g
aagaagagcgcagatacactctggggaattcagaangaactacagttttaaagttgtccaagcaattcact

SEQ ID NO: 16809 - DNA, 71 bp, chicken (Gallus Gallus)
  misc_feature (36): n=a or c
gattgccaattatttttgcactagtgcacataaacnggaaggacagattcttaggtatgagttatatattc

SEQ ID NO: 16810 - DNA, 71 bp, chicken (Gallus Gallus)
  misc_feature (36): n=a or g
tatagttaaatgtgatcaaatgtgtaagtagttttnttttaaagaaaatcagctaaccaccctctcctttc

SEQ ID NO: 16811 - DNA, 71 bp, chicken (Gallus Gallus)
  misc_feature (36): n=a or c
atgtttatcacaatctcacctttttgtgcaagaccngtgcatgcacataaaatggaatggaacagcacatg

SEQ ID NO: 16812 - DNA, 71 bp, chicken (Gallus Gallus)
  misc_feature (36): n=a or g
tttgcatgtggggaacttagtgcattggagttatantctatgacagcagtggattattacaaaagaaaaga

SEQ ID NO: 16813 - DNA, 71 bp, chicken (Gallus Gallus)
  misc_feature (36): n=a or g
cattttttgcctgtagggcctggcaaagcagctcanaataacctcctcagatcagtgctgtcgggagaact

SEQ ID NO: 16814 - DNA, 71 bp, chicken (Gallus Gallus)
  misc_feature (36): n=g or t
tttaatttgttcttctatgcagcacaccgagacctncaaaaaaggttggatgcaaaagcatatctgcttac

SEQ ID NO: 16815 - DNA, 71 bp, chicken (Gallus Gallus)
  misc_feature (36): n=a or t
atgtagagcaactttgagggattgggtccaatatcngacaaaaatttaagcctcttccttggtggctgctg

SEQ ID NO: 16816 - DNA, 71 bp, chicken (Gallus Gallus)
  misc_feature (36): n=c or t
acaaataacagcaatggcaaattagaactaggcagncctgccctttggtatatcatgacagtacaattttt

SEQ ID NO: 16817 - DNA, 71 bp, chicken (Gallus Gallus)
  misc_feature (36): n=a or c
gtccaatgcttatactttgtcttatggcagttgtantttgtgatgccaatgctttctggtgcaacctcatt

SEQ ID NO: 16818 - DNA, 71 bp, chicken (Gallus Gallus)
  misc_feature (36): n=g or t
tttggtttcccaactgaggaattactaatgacctcnaactgcaaaatctttgccctttctgatctgcaaac

SEQ ID NO: 16819 - DNA, 71 bp, chicken (Gallus Gallus)
  misc_feature (36): n=a or g
agagaaaggtaatgacaaaagagttttcttaaatcngaaggttgaagtattttccttcaatccttttacta

SEQ ID NO: 16820 - DNA, 71 bp, chicken (Gallus Gallus)
  misc_feature (36): n=c or g
cacagcaatcattggaagtgcctaaacgatacatanattttcaagagaatgactgctgagtctcagtgttg

SEQ ID NO: 16821 - DNA, 71 bp, chicken (Gallus Gallus)
  misc_feature (36): n=a or g
ctttactaccataatcaggtgccagtccctacagtnctctcagtacagcctagaaataacaaacaatagaa

SEQ ID NO: 16822 - DNA, 71 bp, chicken (Gallus Gallus)
  misc_feature (36): n=a or g
aggaagttgcagcatggaagtctaccacatgaagtnggtgatcctttttcattcggttcatctctgccctc

SEQ ID NO: 16823 - DNA, 71 bp, chicken (Gallus Gallus)
  misc_feature (36): n=c or t
aggcccaaatcccagaacaggatattttccctgtanacagttgatcctgagcccttagtattttcaacatc

SEQ ID NO: 16824 - DNA, 71 bp, chicken (Gallus Gallus)
  misc_feature (36): n=c or t
ttttttttttctctttcaatatttatggtaaagtanatatcttcaatagtctttactggctactcctgttt

SEQ ID NO: 16825 - DNA, 71 bp, chicken (Gallus Gallus)
  misc_feature (36): n=c or t
caacagtcgtccacttcagagattaaagaagtcttngtactaaaactacttagccaaagattttcagtttt

SEQ ID NO: 16826 - DNA, 71 bp, chicken (Gallus Gallus)
  misc_feature (36): n=c or t
actctgcactcctccttttttctttttttatttttngttttttttttatagtccagattcttcccattaga

SEQ ID NO: 16827 - DNA, 71 bp, chicken (Gallus Gallus)
  misc_feature (36): n=a or g
ctgaggctgtccagctggtgatgtgcttgttgtggngaagctggttgtgaatgctggttgttcagagaggg

SEQ ID NO: 16828 - DNA, 71 bp, chicken (Gallus Gallus)
  misc_feature (36): n=c or g
gtattacgtgtgatccacagggttaataattaattntgtgattgtaggaccaggtgaagaggagtcgaaaa

SEQ ID NO: 16829 - DNA, 71 bp, chicken (Gallus Gallus)
  misc_feature (36): n=c or t
gaaattgcttggctattacactgcaaataggctggnaggtgatgtttacaggtaactgacaaaggagcaaa

SEQ ID NO: 16830 - DNA, 71 bp, chicken (Gallus Gallus)
  misc_feature (36): n=a or g
acctcattactttacacgagtaaaaaaagaaccttnaataccttgcgtagacagttgtgctgcttgagaaa

SEQ ID NO: 16831 - DNA, 71 bp, chicken (Gallus Gallus)
  misc_feature (36): n=a or t
catcctgtactgttgaaaccttcttgagatggtcantatagacttaaaagaacagctccttctccctcaac

SEQ ID NO: 16832 - DNA, 71 bp, chicken (Gallus Gallus)
  misc_feature (36): n=c or g
ggagaagcgagctatctatggggccctggaggaacnagggatttgcagtgttgaccttctcccatgatttc

SEQ ID NO: 16833 - DNA, 71 bp, chicken (Gallus Gallus)
  misc_feature (36): n=c or t
tttttgttttttgaaaataagcattattgagtgcanagtagaaccaaagaagggtttcctatggatttttt

SEQ ID NO: 16834 - DNA, 71 bp, chicken (Gallus Gallus)
  misc_feature (36): n=c or t
ctctagaagaatatcatacttgcaacctgagtccangttgatgagcctgtgatctgttctcccgtggtgat

SEQ ID NO: 16835 - DNA, 71 bp, chicken (Gallus Gallus)
  misc_feature (36): n=c or g
tctttgctcatgtatgtttccaggatattgggccangtgccacagagcgcctttttttggtttggatcaat

SEQ ID NO: 16836 - DNA, 71 bp, chicken (Gallus Gallus)
  misc_feature (36): n=a or g
aagctgaggtatgctcatcacactggcaggcacaanatctcatgcatcaacattagtacatgcaaattttt

SEQ ID NO: 16837 - DNA, 71 bp, chicken (Gallus Gallus)
  misc_feature (36): n=c or g
cttctagaaggaatgaggcctgaattaaggagaaanttggaaataaagactgttgcctactgaaattggac

SEQ ID NO: 16838 - DNA, 71 bp, chicken (Gallus Gallus)
  misc_feature (36): n=a or c
tttatctgaacttttgaggaagctcataagatctgnaagagtgttcatttgttcagcagagccaaattagg

SEQ ID NO: 16839 - DNA, 71 bp, chicken (Gallus Gallus)
  misc_feature (36): n=c or t
tggcagctatactactaaacttttaaattagttgcnaacctcgagaaactggattctgctgagttcttttg

SEQ ID NO: 16840 - DNA, 71 bp, chicken (Gallus Gallus)
  misc_feature (36): n=a or t
gttggttgtgcttaactcatgcatcagtaattatcngtgactgcttattagtctgtgatatcagaataaga

SEQ ID NO: 16841 - DNA, 71 bp, chicken (Gallus Gallus)
  misc_feature (36): n=g or t
agcatttaaaattacattctaaaggacagcccatgnaaggctatcactagctcaggtataatcagtggaat

SEQ ID NO: 16842 - DNA, 71 bp, chicken (Gallus Gallus)
  misc_feature (36): n=c or t
attcttggagaattcttacaccagtaagattctggnctagattgtacttttgtcctgttctcagttatggt

SEQ ID NO: 16843 - DNA, 71 bp, chicken (Gallus Gallus)
  misc_feature (36): n=c or t
gttcagttacacttttcttcctcttcaaatctctantaaattatctctgtaatatcttgttcataagccaa

SEQ ID NO: 16844 - DNA, 71 bp, chicken (Gallus Gallus)
  misc_feature (36): n=c or t
ctctgtcatggaggagttaattgcttccatcagtangccgtcttccttcgaatcccagaggacttctggat

SEQ ID NO: 16845 - DNA, 71 bp, chicken (Gallus Gallus)
  misc_feature (36): n=c or t
agtctttaaaaatctgatataacagccggttgtggnttgagttaaattgagttgcttgttttcagctatta

SEQ ID NO: 16846 - DNA, 71 bp, chicken (Gallus Gallus)
  misc_feature (36): n=a or g
ctttctactttgtctgcatccacaaatgtttcctcnttctcttcagtctcttcttgatccttaaagcactc

SEQ ID NO: 16847 - DNA, 71 bp, chicken (Gallus Gallus)
  misc_feature (36): n=c or t
gacaccaagtagacgaaaacacatttattgatggcntttttttttttttttgagattttgagacaggtgtg

SEQ ID NO: 16848 - DNA, 71 bp, chicken (Gallus Gallus)
  misc_feature (36): n=c or t
attggataattatgtgttagatgaaattacctgagnagacaaatagtataaaagaataggatatttggcat

SEQ ID NO: 16849 - DNA, 71 bp, chicken (Gallus Gallus)
  misc_feature (36): n=c or t
ataggaattgaaacaattacaaagaagaaatataanacaatgtgtatagtgacactaaaacatgctttaat

SEQ ID NO: 16850 - DNA, 71 bp, chicken (Gallus Gallus)
  misc_feature (36): n=a or c
catttgtagcaagtagcatggtcaatcttgaacttnactaaaaatttaggactatcctagtcaagagttac

SEQ ID NO: 16851 - DNA, 71 bp, chicken (Gallus Gallus)
  misc_feature (36): n=a or g
aagcctagggttgggattgcttttttgtttttgtanaactactaatttctctttagtgttaatgcagggag

SEQ ID NO: 16852 - DNA, 71 bp, chicken (Gallus Gallus)
  misc_feature (36): n=a or g
ggaaggacaccataggtaccaagtctctttagagcntgaaccggtctattttttccatggagatgatattt

SEQ ID NO: 16853 - DNA, 71 bp, chicken (Gallus Gallus)
  misc_feature (36): n=c or t
gttaaaattataataattaaaaaagatgtagttttnatagtctcaccttgcaattctttccttataatggc

SEQ ID NO: 16854 - DNA, 71 bp, chicken (Gallus Gallus)
  misc_feature (36): n=c or t
atgtccctcagtcagctcctcagaaaactgcaattncagcagagacaaactttgcccaaactgttttggac

SEQ ID NO: 16855 - DNA, 71 bp, chicken (Gallus Gallus)
  misc_feature (36): n=c or t
aggaccacctggatcagatggaaaacctgtatgcangggacatcacactggtcattttgggtgctttaaat

SEQ ID NO: 16856 - DNA, 71 bp, chicken (Gallus Gallus)
  misc_feature (36): n=a or g
caagctgaatgaaactttttcttgcatgttctacangcttttttgggcagagaatagttggaaccatgaat

SEQ ID NO: 16857 - DNA, 71 bp, chicken (Gallus Gallus)
  misc_feature (36): n=a or g
ataaaaaatcaagagtctagataggtgctgcttacnttaaatctctaccttagttacattcatgcaaaatc

SEQ ID NO: 16858 - DNA, 71 bp, chicken (Gallus Gallus)
  misc_feature (36): n=a or g
ccagccttttgtctagagtcaaccttgcctgggtgncatcgctatctgagtggcactgttcaggcccactt

SEQ ID NO: 16859 - DNA, 71 bp, chicken (Gallus Gallus)
  misc_feature (36): n=a or g
gaacatcctctgacttcttgccttttaccaaaaacntaagaattatcaaaggtcatgtctagactgtcctc

SEQ ID NO: 16860 - DNA, 71 bp, chicken (Gallus Gallus)
  misc_feature (36): n=a or c
cagcactcagaagtacatgacagctattctagtaanaaaaataaccaaataaataatcttgcagtgcatac

SEQ ID NO: 16861 - DNA, 71 bp, chicken (Gallus Gallus)
  misc_feature (36): n=c or g
tattcatctgtataatgactattaggtgtttttgtnactgaatttacactacaaatcattagaaccactga

SEQ ID NO: 16862 - DNA, 71 bp, chicken (Gallus Gallus)
  misc_feature (36): n=a or g
aatacaagaaatagtcatggaaggaaaaaaagacanaaaaccccctcccaatagttagtatgtgtgtgtat

SEQ ID NO: 16863 - DNA, 71 bp, chicken (Gallus Gallus)
  misc_feature (36): n=a or g
ataaaggtttaggaatgaaatctttggcaaaatggnctgttttggcttacagctgtactgacagtgccaag

SEQ ID NO: 16864 - DNA, 71 bp, chicken (Gallus Gallus)
  misc_feature (36): n=a or g
atatatgtgtatattattatttgttcttgacaaccntgaacgtgcgtgattaacgttcagtgcacagatat

SEQ ID NO: 16865 - DNA, 71 bp, chicken (Gallus Gallus)
  misc_feature (36): n=c or t
atcctgtcacagagagattgtaagcaagagatacantgtgccacatgtattttacaatcaaagactatata

SEQ ID NO: 16866 - DNA, 71 bp, chicken (Gallus Gallus)
  misc_feature (36): n=c or t
ggccatcacaacagatgttcatagaggaattccagntcaccagggaaaaaactaaccaaagacagcaagaa

SEQ ID NO: 16867 - DNA, 71 bp, chicken (Gallus Gallus)
  misc_feature (36): n=c or g
tatttctatgttagtataatcaaatatctaaatgtntcgtctctttgatttttgtggaggccaaaccaatt

SEQ ID NO: 16868 - DNA, 71 bp, chicken (Gallus Gallus)
  misc_feature (36): n=c or g
agcatgtaggagtaaatggaagtttcttgttttcantgaaaaggagctgaggtgtttctcactctgccctg

SEQ ID NO: 16869 - DNA, 71 bp, chicken (Gallus Gallus)
  misc_feature (36): n=c or t
ccacacatcttcagttctgcagaacaaggcagccangctcgcagatattagcacacctgctgaaataatgg

SEQ ID NO: 16870 - DNA, 71 bp, chicken (Gallus Gallus)
  misc_feature (36): n=a or g
aagcttaatggtaaataacttcataaggactagaangaaagttaattctgattattttcctaaaatttata

SEQ ID NO: 16871 - DNA, 71 bp, chicken (Gallus Gallus)
  misc_feature (36): n=a or g
gcaggattatagctgtgaggtgcaaactggatcacngaatcatagaaaggtttggaatagaccttctaaga

SEQ ID NO: 16872 - DNA, 71 bp, chicken (Gallus Gallus)
  misc_feature (36): n=c or t
aaggtagccctttcaaactacttaatctgtgtaaanacctaaagttctgtgttgataaatatcagtaaata

SEQ ID NO: 16873 - DNA, 71 bp, chicken (Gallus Gallus)
  misc_feature (36): n=c or g
aagagtttttacataatcagaaaatagatctggatnttctaaaatattgaacttctatactttctttctct

SEQ ID NO: 16874 - DNA, 71 bp, chicken (Gallus Gallus)
  misc_feature (36): n=c or t
cggggtttggtccccatcttctggtctcgagccganaaatcacagctcttaaaaacatccagcccgtaaaa

SEQ ID NO: 16875 - DNA, 71 bp, chicken (Gallus Gallus)
  misc_feature (36): n=a or c
gtttatgaatctgggactaggaaacacgagggagcntggagcggcctcaccgtgcccagggaccctgggac

SEQ ID NO: 16876 - DNA, 71 bp, chicken (Gallus Gallus)
  misc_feature (36): n=c or g
cagcccatgaataaagaccaggtgggagaggagatnggctctttcaaaccctcgtggctcccgggaccaga

SEQ ID NO: 16877 - DNA, 71 bp, chicken (Gallus Gallus)
  misc_feature (36): n=a or g
acaacaagcatgacaaagtatcaatcaagaaaccantgtctttcagttctcagacattccaacagtaacat

SEQ ID NO: 16878 - DNA, 71 bp, chicken (Gallus Gallus)
  misc_feature (36): n=a or c
ttggatcaatttaggtaggatacctcatcagctgtnaaatgtaattatagatttttcatgtgttgatagtg

SEQ ID NO: 16879 - DNA, 71 bp, chicken (Gallus Gallus)
  misc_feature (36): n=a or c
accatacttgattaatactaccatatgacgcagtcnaacctgtcagcgtttgctccaaccttttgcttcag

SEQ ID NO: 16880 - DNA, 71 bp, chicken (Gallus Gallus)
  misc_feature (36): n=a or t
ctgacaagttgtgcttccagtgtaactaactagtanccttacttatagattgtataaccataggaatgcag

SEQ ID NO: 16881 - DNA, 71 bp, chicken (Gallus Gallus)
  misc_feature (36): n=g or t
agccaacgtaataaataggaggcattaatttcagancagcccttgtagatctaaaaaatgatttaaacaca

SEQ ID NO: 16882 - DNA, 71 bp, chicken (Gallus Gallus)
  misc_feature (36): n=a or g
ataaattggagcgagacactatggaagatagctacncctaggatgaagtatcttctggcaatgtttacaga

SEQ ID NO: 16883 - DNA, 71 bp, chicken (Gallus Gallus)
  misc_feature (36): n=c or t
cccttgtcctacatctacctgcttaaaacatccgtncgcctccaacttataagcttccctcaagcacagga

SEQ ID NO: 16884 - DNA, 71 bp, chicken (Gallus Gallus)
  misc_feature (36): n=a or c
tataaagctgttatctagctctggtgatattccagntactaccaagtacagtgctaaggtatgattactgc

SEQ ID NO: 16885 - DNA, 71 bp, chicken (Gallus Gallus)
  misc_feature (36): n=c or t
acagcttctctgggcagcctgtgccagcgcctcacngctctcactgtgaaaaatgtattccttatatccag

SEQ ID NO: 16886 - DNA, 71 bp, chicken (Gallus Gallus)
  misc_feature (36): n=g or t
agagtcctttacgctttcaactctgaattttttttnacttcataaactgtcttgattttatttgtttattt

SEQ ID NO: 16887 - DNA, 71 bp, chicken (Gallus Gallus)
  misc_feature (36): n=a or g
actttcccatcatgcataagcaacaaatgaaatganaggactcaaacctgagtttatcacatcacaggagt

SEQ ID NO: 16888 - DNA, 71 bp, chicken (Gallus Gallus)
  misc_feature (36): n=a or g
tctgctaaacccagaatacatttgacaggcatcagnctttccccccaaacaccattctaatgtttatttct

SEQ ID NO: 16889 - DNA, 71 bp, chicken (Gallus Gallus)
  misc_feature (36): n=c or t
ctcttaaataagagtgctttgtgttatatcataacntgacataaaagtaagcaaattgatcccaatactaa

SEQ ID NO: 16890 - DNA, 71 bp, chicken (Gallus Gallus)
  misc_feature (36): n=a or g
tctacaaaccacaaaagaattcttgctactagtttnctctttaaaggtaatatctacctactggtatttta

SEQ ID NO: 16891 - DNA, 71 bp, chicken (Gallus Gallus)
  misc_feature (36): n=a or g
ccatcagtaaaaacattacttacggtatttatacancttccactttatattacaagtcttaaaaaagtatt

SEQ ID NO: 16892 - DNA, 71 bp, chicken (Gallus Gallus)
  misc_feature (36): n=c or t
gtcccaattgatgtcctgcacagaccagttcagtcnacagttaggttaattaatcctttctattcaatatg

SEQ ID NO: 16893 - DNA, 71 bp, chicken (Gallus Gallus)
  misc_feature (36): n=a or g
ggctataaacaatatctcctatagcgttacatctcngatcgctggctgccaatcaaacaggaagagaagga

SEQ ID NO: 16894 - DNA, 71 bp, chicken (Gallus Gallus)
  misc_feature (36): n=c or t
gcagcagtgttgaaatagctgaaggggatctctttncaggacagccctccacagaggcatgggtagtgttt

SEQ ID NO: 16895 - DNA, 71 bp, chicken (Gallus Gallus)
  misc_feature (36): n=a or c
tacagaacacaggtgtgactgagggatttccagtgngactggagtgtcgaatctcgggggaaccatcacct

SEQ ID NO: 16896 - DNA, 71 bp, chicken (Gallus Gallus)
  misc_feature (36): n=c or t
aagaactgtttgttttcatacgttcacaatgactgngctggatgtgtagcccagctagtgcggtgtgaaga

SEQ ID NO: 16897 - DNA, 71 bp, chicken (Gallus Gallus)
  misc_feature (36): n=a or g
gacagtgggattgagtgcactgtcagcacatttgcnaatctatcagtgcaaactgagggatgtaagtatag

SEQ ID NO: 16898 - DNA, 71 bp, chicken (Gallus Gallus)
  misc_feature (36): n=a or g
ctccaggttctttgtttgcccactctgagctttggncaggtcaccccagatgaatctacatggatgacaga

SEQ ID NO: 16899 - DNA, 71 bp, chicken (Gallus Gallus)
  misc_feature (36): n=c or t
tcacttgtgaggacctagtcctggaagggcctgagngctgtcacatgtggttacagtatggttttggagac

SEQ ID NO: 16900 - DNA, 71 bp, chicken (Gallus Gallus)
  misc_feature (36): n=a or g
tgggtcaatgatgagcagccaaacttattcagtcantctgcatgtggacttggggggaaaaagcagctcct

SEQ ID NO: 16901 - DNA, 71 bp, chicken (Gallus Gallus)
  misc_feature (36): n=g or t
atcaaaactacacatcatttaacacgagtcttaatnaattcagagatctttgttctaaactatgggagctg

SEQ ID NO: 16902 - DNA, 71 bp, chicken (Gallus Gallus)
  misc_feature (36): n=a or g
gtaacagatatttgttgtgtaaaaataaaatgctcngaagcaggagtcattatcccaaaaatcatgaggct

SEQ ID NO: 16903 - DNA, 71 bp, chicken (Gallus Gallus)
  misc_feature (36): n=a or g
aatgaggaatactggaactagcttctctgcattaanactataatcaaaaagcccaataagattgaatatca

SEQ ID NO: 16904 - DNA, 71 bp, chicken (Gallus Gallus)
  misc_feature (36): n=c or t
ctgaattaaagaccaactttactgattaacaacacngctgatgttgcacagagcaaactatttatcataag

SEQ ID NO: 16905 - DNA, 71 bp, chicken (Gallus Gallus)
  misc_feature (36): n=c or t
gctaattcacaaactccaatagcacttttttttttnccttcttttttaatactccaaaaccactcaagaag

SEQ ID NO: 16906 - DNA, 71 bp, chicken (Gallus Gallus)
  misc_feature (36): n=c or t
ttatgactttttaaaggatgaaaagatactcaaaangatgttttcaatcattgttagaataggacagagaa

SEQ ID NO: 16907 - DNA, 71 bp, chicken (Gallus Gallus)
  misc_feature (36): n=a or g
tgcattgtaattcaacacagtaaattccttgaaacnttgtgaggtatgttgcgctgatcaatgattgcatg

SEQ ID NO: 16908 - DNA, 71 bp, chicken (Gallus Gallus)
  misc_feature (36): n=c or t
acaaaatctgcaatttgaccttatccacactcttantgtcattaacttattaattcttacaacaaactttg

SEQ ID NO: 16909 - DNA, 71 bp, chicken (Gallus Gallus)
  misc_feature (36): n=a or g
ccaagacagatagactaatataaggagacgaaaaanaaaaagaaaaggagcctctatatcaaaagtacact

SEQ ID NO: 16910 - DNA, 71 bp, chicken (Gallus Gallus)
  misc_feature (36): n=c or t
gctgtacttttcaaaatggcagtctgcatgtagaantgacctacccatcctcttctttgtcttttttttca

SEQ ID NO: 16911 - DNA, 71 bp, chicken (Gallus Gallus)
  misc_feature (36): n=g or t
agtggcagagacaatctgaaatgcctatcttgattntcagcaaaagttttggaagctagattacatcccga

SEQ ID NO: 16912 - DNA, 71 bp, chicken (Gallus Gallus)
  misc_feature (36): n=c or t
ccacactttgaagactgcagaacacagtcattctgnctggggagattgaagaggaaggggtgcccgcataa

SEQ ID NO: 16913 - DNA, 71 bp, chicken (Gallus Gallus)
  misc_feature (36): n=a or g
ggcaacagcagattagtggcttataccctgaaattnagttttttcatgtatatgtacatttctgctcagaa

SEQ ID NO: 16914 - DNA, 71 bp, chicken (Gallus Gallus)
  misc_feature (36): n=c or g
gacacagatgttttatgaactttctgtacatcactnaaaagccttattgtgaacttgcatgaattttgaag

SEQ ID NO: 16915 - DNA, 71 bp, chicken (Gallus Gallus)
  misc_feature (36): n=a or c
ttacatggtgggcaataaaacacaatttattaaaantagtgtctttgggagcagaagttcagctggatcta

SEQ ID NO: 16916 - DNA, 71 bp, chicken (Gallus Gallus)
  misc_feature (36): n=a or t
aaactgtgacttgtacacacacagtctatggaatancttcaagcatactgcctaggtccatatgccttgtt

SEQ ID NO: 16917 - DNA, 71 bp, chicken (Gallus Gallus)
  misc_feature (36): n=a or g
gtacctgggtatgtctgctatgtaaaataaggtgtnccacagagattctggagctcttgaaaacctgaact

SEQ ID NO: 16918 - DNA, 71 bp, chicken (Gallus Gallus)
  misc_feature (36): n=a or g
atagtatcaaaagagacaataaataagaagtccacncaactggtaacacaaacagtagttgaaatgtaatg

SEQ ID NO: 16919 - DNA, 71 bp, chicken (Gallus Gallus)
  misc_feature (36): n=a or g
aaatgtgttctgagttacttctgcacctgcttttcntgattcctggtatttggattttgaagctaaatatt

SEQ ID NO: 16920 - DNA, 71 bp, chicken (Gallus Gallus)
  misc_feature (36): n=a or c
cagagataatgaaagtgacagagctgactgcaaagnaagttcatgttagcaccatacttcaataataaatg

SEQ ID NO: 16921 - DNA, 71 bp, chicken (Gallus Gallus)
  misc_feature (36): n=a or g
acacaacttgtgattcttctagtattgcggtgtttnggaatcaaaactgtagatcttaaatgattaggttg

SEQ ID NO: 16922 - DNA, 71 bp, chicken (Gallus Gallus)
  misc_feature (36): n=g or t
taaaaagattttttcatgactcaatacatttcttgntgccttggttaaattctttatgcttctgtttcaac

SEQ ID NO: 16923 - DNA, 71 bp, chicken (Gallus Gallus)
  misc_feature (36): n=a or g
tgtgctgctccctagagcagatcactaacagattcnatctttttatataatggcatattagcctaacaccc

SEQ ID NO: 16924 - DNA, 71 bp, chicken (Gallus Gallus)
  misc_feature (36): n=c or t
tgagtgctgtaaagggatgaaattttaagtagaagngttcttgaaattcatgcaaaaaggagtactgaagc

SEQ ID NO: 16925 - DNA, 71 bp, chicken (Gallus Gallus)
  misc_feature (36): n=a or g
ctgcaaacctgataggtaaggacagaaggacaaatntatctgaggtgaggagtaagattcagcaagactga

SEQ ID NO: 16926 - DNA, 71 bp, chicken (Gallus Gallus)
  misc_feature (36): n=c or g
acaaagtacttatgagccttaaaactagcagaccantggcaagagagagtctatctttgactacgccaaat

SEQ ID NO: 16927 - DNA, 71 bp, chicken (Gallus Gallus)
  misc_feature (36): n=a or g
ggacttcaaggagtgaaattcaagtccgggcgtttnaagttgataacaattaaatactctgcattaatact

SEQ ID NO: 16928 - DNA, 71 bp, chicken (Gallus Gallus)
  misc_feature (36): n=c or t
tcctgcaaatatcagtaacatgtcctgtatgataanagtgcagtgcagtcaacaatattaggcttcttatt

SEQ ID NO: 16929 - DNA, 71 bp, chicken (Gallus Gallus)
  misc_feature (36): n=a or g
tctggtggtgcttcacgcacagtctcattcatcagngcaaaagcagagtcagtaacattaggtggttcttc

SEQ ID NO: 16930 - DNA, 71 bp, chicken (Gallus Gallus)
  misc_feature (36): n=c or t
tgtacctgacagcagggtgtgtactgcaatgagcanctagctgttgccccagctctccccatgtgcctcag

SEQ ID NO: 16931 - DNA, 71 bp, chicken (Gallus Gallus)
  misc_feature (36): n=a or g
acactctgagcaggtgtctgttgttgtctttttgtnatatatttgtgttgtgactgactcataaatgaaca

SEQ ID NO: 16932 - DNA, 71 bp, chicken (Gallus Gallus)
  misc_feature (36): n=a or g
tgagacaaaatgtgctagctctagtatatgatgtancattattttatgaaagaaaacaaaaagcagcacca

SEQ ID NO: 16933 - DNA, 71 bp, chicken (Gallus Gallus)
  misc_feature (36): n=c or t
taatgctcctccaatagccagcactggagcacttanatagcacaaggcttttgattttcttgtgctcagca

SEQ ID NO: 16934 - DNA, 71 bp, chicken (Gallus Gallus)
  misc_feature (36): n=a or g
ctgtattacagcagtcctctgaacgggaagatgggnctaagaccctcagtaccccttcctctctctaaagc

SEQ ID NO: 16935 - DNA, 71 bp, chicken (Gallus Gallus)
  misc_feature (36): n=a or t
tactcaaaaatatgaccggctatgtctttctggctnatgaataggttgcttagtatgtaatttttcttttg

SEQ ID NO: 16936 - DNA, 71 bp, chicken (Gallus Gallus)
  misc_feature (36): n=a or g
atacttacatcaataagctgctgctgatctctctcngacatgttggtcagactgtagtactttccagaaag

SEQ ID NO: 16937 - DNA, 71 bp, chicken (Gallus Gallus)
  misc_feature (36): n=a or g
gaattgagacttcaggaccattgggaatgaagcacntcttgaagagggtttctgttgcttttcagaaagat

SEQ ID NO: 16938 - DNA, 71 bp, chicken (Gallus Gallus)
  misc_feature (36): n=c or t
aaatatgtaagggtgaagtgtggtaaaaaagttaanattgtggcagttgatcttgcaaaattactggttaa

SEQ ID NO: 16939 - DNA, 71 bp, chicken (Gallus Gallus)
  misc_feature (36): n=a or g
tcataaagcgggggaatattactttatgtttctctnccgtaataacttcaaataaatgtgaaaatgtcatc

SEQ ID NO: 16940 - DNA, 71 bp, chicken (Gallus Gallus)
  misc_feature (36): n=a or g
tctgacaaatcaaatatcatacaaacactgagagantcacctgatattggggaattttgctttgcctgggg

SEQ ID NO: 16941 - DNA, 71 bp, chicken (Gallus Gallus)
  misc_feature (36): n=c or t
agcatcctcataccaatagcttgttcacatgggagngacctcagccttccaacacaccacacaaagcccct

SEQ ID NO: 16942 - DNA, 71 bp, chicken (Gallus Gallus)
  misc_feature (36): n=c or g
tcacacatagctaagctttttaatgattctataggnaggtcgtccatcaaatcctaatggcaagcttagat

SEQ ID NO: 16943 - DNA, 71 bp, chicken (Gallus Gallus)
  misc_feature (36): n=a or t
aggaagcattttttgttaatgtaaaaatagtttacntatggatttccatgtagagttaaaaacttagtcga

SEQ ID NO: 16944 - DNA, 71 bp, chicken (Gallus Gallus)
  misc_feature (36): n=c or t
gctttttgaaattatagtttatacttattaacactnatgaaaatgagcatctacagcagatgctgtaagac

SEQ ID NO: 16945 - DNA, 71 bp, chicken (Gallus Gallus)
  misc_feature (36): n=a or t
ccattttgtcacagaagttgaatcaaatcaaaaatnattccttttggagacaagaaagtgtttggagcccc

SEQ ID NO: 16946 - DNA, 71 bp, chicken (Gallus Gallus)
  misc_feature (36): n=c or t
tggctataacagtatttttctaaggaactcccaacnttgtttgcttgcttaatgtctactatttgtatgtt

SEQ ID NO: 16947 - DNA, 71 bp, chicken (Gallus Gallus)
  misc_feature (36): n=a or g
agttgtcttctaagtgattttattgacaatttttanttgctcttatgtatacatttattaagccattttat

SEQ ID NO: 16948 - DNA, 71 bp, chicken (Gallus Gallus)
  misc_feature (36): n=c or t
gaacatgaggtctgatgaaggggatgtgtctcctcngcctgcttccttttgtcttccctggcccagcagcc

SEQ ID NO: 16949 - DNA, 71 bp, chicken (Gallus Gallus)
  misc_feature (36): n=a or c
ttaacgtcgttgcaggatttctctttttgtatcttnaaagaattaaaaaaaaaagaaaaaaaatactgttt

SEQ ID NO: 16950 - DNA, 71 bp, chicken (Gallus Gallus)
  misc_feature (36): n=c or t
ttcactgattttatgaaagcttttttttttttttgnggttagttctttagagagatagtaaacattactaa

SEQ ID NO: 16951 - DNA, 71 bp, chicken (Gallus Gallus)
  misc_feature (36): n=c or t
cagctagaagacagggttcaggtagtagaagttganggtgatgacaatcagcagggcctggatgttaacca

SEQ ID NO: 16952 - DNA, 71 bp, chicken (Gallus Gallus)
  misc_feature (36): n=c or t
gtttatttggcttcaaaccccaccttagcctgcaanttacacactacctcctatactgatcctctggcagc

SEQ ID NO: 16953 - DNA, 71 bp, chicken (Gallus Gallus)
  misc_feature (36): n=c or g
atccgagtgattacgtatggtactaaaacagtgtgngttggtttgttttgtgttttgttttttaatcataa

SEQ ID NO: 16954 - DNA, 71 bp, chicken (Gallus Gallus)
  misc_feature (36): n=a or t
gtttattgtcccagtgagttgtgttcaaaagctacntcgtttacaggaatatttttgtagcattgaattta

SEQ ID NO: 16955 - DNA, 71 bp, chicken (Gallus Gallus)
  misc_feature (36): n=a or c
cacacgctcaacaatgctgtgcacacacttcatatnccagctgaactccacaatccacaagatttaagtca

SEQ ID NO: 16956 - DNA, 71 bp, chicken (Gallus Gallus)
  misc_feature (36): n=a or g
ttgttctaatgtaatctttctcctcattccccccanaacacatgaaagtagcataaactggcaggaaagaa

SEQ ID NO: 16957 - DNA, 71 bp, chicken (Gallus Gallus)
  misc_feature (36): n=a or g
gtagtgtagaagcttcttgtgacactggaactgatngctatttatattgcaggactcccccatactaaaag

SEQ ID NO: 16958 - DNA, 71 bp, chicken (Gallus Gallus)
  misc_feature (36): n=a or g
aggatctgctcacaagggtagaaaccccagctcggngtggatgattttatgcctggcagcattttctgcca

SEQ ID NO: 16959 - DNA, 71 bp, chicken (Gallus Gallus)
  misc_feature (36): n=c or t
aaggactctgtgtgtttccaggcaccatggggggangacagtgttttcatgttgtcttccatgagtgccat

SEQ ID NO: 16960 - DNA, 71 bp, chicken (Gallus Gallus)
  misc_feature (36): n=c or t
tgtcactgtgtggatcatagcactggctatagatcncccactataggtggattcagagcagtccgtgatgt

SEQ ID NO: 16961 - DNA, 71 bp, chicken (Gallus Gallus)
  misc_feature (36): n=c or g
aaacttgtacgtaattcagagttcacagagcatagnctagccattaagcttgcttacagagcattaggcac

SEQ ID NO: 16962 - DNA, 71 bp, chicken (Gallus Gallus)
  misc_feature (36): n=a or g
agtgacttgctcagtgttaaggctctgcttaattcntgtcataccttattaaatcaagttactacatttgt

SEQ ID NO: 16963 - DNA, 71 bp, chicken (Gallus Gallus)
  misc_feature (36): n=a or c
attaacaaagtagagtgatcagttgtcctccaaggntttggaatctgcaggaatgaaatgagtatgcagta

SEQ ID NO: 16964 - DNA, 71 bp, chicken (Gallus Gallus)
  misc_feature (36): n=a or g
taattgagttttgtgcagtgagagttcgaatagccntaagagaggtaacaataaagagctcataataggaa

SEQ ID NO: 16965 - DNA, 71 bp, chicken (Gallus Gallus)
  misc_feature (36): n=c or g
tgcatccactgcacctggtctccagctcactaaccnttgtttatagagccttggaaggaaacacacattgc

SEQ ID NO: 16966 - DNA, 71 bp, chicken (Gallus Gallus)
  misc_feature (36): n=a or c
cagtgataactggttttgcacaacagcagctcctanaagagcatggacagagcctggtgtatgagacagaa

SEQ ID NO: 16967 - DNA, 71 bp, chicken (Gallus Gallus)
  misc_feature (36): n=a or g
aactgatgcacaagttatagattttaagtgttggcntttttttttacatgcctgttgaggtatctgtaaac

SEQ ID NO: 16968 - DNA, 71 bp, chicken (Gallus Gallus)
  misc_feature (36): n=a or g
ataggtacaagcaaagcccagagtaagggctgtgcngcaggaggcttcaggtctgttttctccataacact

SEQ ID NO: 16969 - DNA, 71 bp, chicken (Gallus Gallus)
  misc_feature (36): n=c or t
tagaaaaaggaggtccagacatatgttggaccaganctaaaatgacttatgtctcttattgtgagaaacta

SEQ ID NO: 16970 - DNA, 71 bp, chicken (Gallus Gallus)
  misc_feature (36): n=a or g
tgttgccaattaaggcagtttatagggactgcagcntaagacaaagacaatatgtagatgaaatttcctac

SEQ ID NO: 16971 - DNA, 71 bp, chicken (Gallus Gallus)
  misc_feature (36): n=a or g
cctctttaggaattagaaagtatagagtgatttgcnctgatcagactgagagcgtatgaaacaatggtttt

SEQ ID NO: 16972 - DNA, 71 bp, chicken (Gallus Gallus)
  misc_feature (36): n=a or g
ttacaaagccacaaaagacagtaaatactaattgcnaggttgcaaaatagatgtgcagatatggaagctgt

SEQ ID NO: 16973 - DNA, 71 bp, chicken (Gallus Gallus)
  misc_feature (36): n=c or t
gcacacctggctccaagaaaagtgatgtataattgnaaatcaggattaaagtagaatctggttctctcacc

SEQ ID NO: 16974 - DNA, 71 bp, chicken (Gallus Gallus)
  misc_feature (36): n=a or g
aatatagaactccttaaaaataattagtcagctttnttatctctgtcctgaaaccataactgtacatcttc

SEQ ID NO: 16975 - DNA, 71 bp, chicken (Gallus Gallus)
  misc_feature (36): n=a or g
aatgtttttaatagtttggatcatgcttctgatctntttagaactgtaccacttccaggggtgcctagggg

SEQ ID NO: 16976 - DNA, 71 bp, chicken (Gallus Gallus)
  misc_feature (36): n=a or g
caggtgctagtccaagcacactttgcagagctcctnagaaggtggaggaaaacagcataaagcaggaattg

SEQ ID NO: 16977 - DNA, 71 bp, chicken (Gallus Gallus)
  misc_feature (36): n=c or t
accgtgtcctgatatcttcatttcctcatcgatgtngttttagacaagtttttcatccactggtattgggg

SEQ ID NO: 16978 - DNA, 71 bp, chicken (Gallus Gallus)
  misc_feature (36): n=c or t
aaagaagtataatagagacaaatgcttttctttagngttttggagtatctgaacctgtttttgctgcttcc

SEQ ID NO: 16979 - DNA, 71 bp, chicken (Gallus Gallus)
  misc_feature (36): n=c or t
ggcacagcacacgtactgagaactgcagcagcattntgtcccaactcaccaacagctctcagcccaaccta

SEQ ID NO: 16980 - DNA, 71 bp, chicken (Gallus Gallus)
  misc_feature (36): n=c or t
ggacctggcttacagttattcacgtactgcagctcngtcaggctcccagggggcttgcaggtgcctggcac

SEQ ID NO: 16981 - DNA, 71 bp, chicken (Gallus Gallus)
  misc_feature (36): n=a or g
aacaaaaggtgaaaagccttaattgcacacgggttnaaggtgttcagtttgttggagtgaaacttaactct

SEQ ID NO: 16982 - DNA, 71 bp, chicken (Gallus Gallus)
  misc_feature (36): n=c or g
acaccgcaggatgaaatgaatgagttccaaaccatncttgcacttttttcctccatcacattcctcttttt

SEQ ID NO: 16983 - DNA, 71 bp, chicken (Gallus Gallus)
  misc_feature (36): n=c or t
gggagtatgtatgtttatccatattgtgcctcaccncagactaagaaaggagctaggcctgacctcaatac

SEQ ID NO: 16984 - DNA, 71 bp, chicken (Gallus Gallus)
  misc_feature (36): n=a or g
aaactatcccagatgttgaaaataacaccacctacnaagaacagctataaactatgaataaattcaactcc

SEQ ID NO: 16985 - DNA, 71 bp, chicken (Gallus Gallus)
  misc_feature (36): n=c or g
aatcacaggaatgcgaagttggtggtactatggaantgttaaactgcatagttgttaccctgagccagcag

SEQ ID NO: 16986 - DNA, 71 bp, chicken (Gallus Gallus)
  misc_feature (36): n=g or t
agcatgcccagtaggcagtccatttagtagcagganccttcaaaatctcatatttccagggctcagctctt

SEQ ID NO: 16987 - DNA, 71 bp, chicken (Gallus Gallus)
  misc_feature (36): n=a or g
ggatacaaccaaggcgctgcagaaccatgctcaccncactgctgtaggcctgagatctttgtcctctatgt

SEQ ID NO: 16988 - DNA, 71 bp, chicken (Gallus Gallus)
  misc_feature (36): n=a or c
aaatcttatttttcatgtcaattgcagcataaaaantaccacagaaaaatctggtgttctgtggaaaattt

SEQ ID NO: 16989 - DNA, 71 bp, chicken (Gallus Gallus)
  misc_feature (36): n=a or c
accttacaaggcatcttaccagaaacatgagcaaantgaagcatgagtcaagagatgtactaagacaaaaa

SEQ ID NO: 16990 - DNA, 71 bp, chicken (Gallus Gallus)
  misc_feature (36): n=a or g
tcccccattgtggcattttataaactgccagcaccnggttatttaagtgtcttgataatggcccttgacag

SEQ ID NO: 16991 - DNA, 71 bp, chicken (Gallus Gallus)
  misc_feature (36): n=a or t
gtgaactttggagtactgacattgatcttctaatangccataagagtgtattatatgatgatggagactat

SEQ ID NO: 16992 - DNA, 71 bp, chicken (Gallus Gallus)
  misc_feature (36): n=a or g
ttgaataaatttattttgattgtacttctcaaagcngtgtcaagaatgataatgggagtaatggagtattg

SEQ ID NO: 16993 - DNA, 71 bp, chicken (Gallus Gallus)
  misc_feature (36): n=a or g
aaatagtttttgtatcaactcacaaattctactttngcattctagtctgattttcttccccatctccctct

SEQ ID NO: 16994 - DNA, 71 bp, chicken (Gallus Gallus)
  misc_feature (36): n=c or t
aaacaaagcaaagagaccagttctaggtacagcagngactagcattacaaactcctgaatctattcctcca

SEQ ID NO: 16995 - DNA, 71 bp, chicken (Gallus Gallus)
  misc_feature (36): n=a or g
tttcctgatgttgagtttcaggaacctgaagtgaanctgccagcccttctccagacactctggtgacttga

SEQ ID NO: 16996 - DNA, 71 bp, chicken (Gallus Gallus)
  misc_feature (36): n=a or g
aaactcctacacataagctcacattcagagccatanaagactcacaagacagaactcccatacttaagcat

SEQ ID NO: 16997 - DNA, 71 bp, chicken (Gallus Gallus)
  misc_feature (36): n=a or g
cagtctactaaaaagcattgccagaagttcaaaagnagatactactttccccagtgttgatagggttccac

SEQ ID NO: 16998 - DNA, 71 bp, chicken (Gallus Gallus)
  misc_feature (36): n=c or t
aagactgagggaaagaaggcattaagtaccttagcntttttttctccttcattactgtgtttccccccaca

SEQ ID NO: 16999 - DNA, 71 bp, chicken (Gallus Gallus)
  misc_feature (36): n=c or t
tgcctgaggatatatagcaagttggagttttgatanagaagatcattatgcccatgatatgttttttccct

SEQ ID NO: 17000 - DNA, 71 bp, chicken (Gallus Gallus)
  misc_feature (36): n=c or t
tcttatgtgacacactgggaaaataagcattcacangctgccaagactggaaggtaaggagagaaagggca

SEQ ID NO: 17001 - DNA, 71 bp, chicken (Gallus Gallus)
  misc_feature (36): n=a or t
agattgtagtcatgaacagaaaaataccttagggantgagtttcatggtaaacaaatatgcagctgaagaa

SEQ ID NO: 17002 - DNA, 71 bp, chicken (Gallus Gallus)
  misc_feature (36): n=g or t
cagcttctgtgtggaggaagatggggctctccagcntaatgcagacaagaaatgtggaaacttttttacaa

SEQ ID NO: 17003 - DNA, 71 bp, chicken (Gallus Gallus)
  misc_feature (36): n=a or g
tttgttttcattaaaatcaacttgatgaagcatganaactaaatagaaggagtgaataagaacatttattg

SEQ ID NO: 17004 - DNA, 71 bp, chicken (Gallus Gallus)
  misc_feature (36): n=a or g
cgtatgagagggtctgagacacccacacagatgtcntatctggaggactgacaggcagtttaaatgctgtc

SEQ ID NO: 17005 - DNA, 71 bp, chicken (Gallus Gallus)
  misc_feature (36): n=a or g
caggtgagagcaatatgaacatgtccagctgctttngagttcagatcctccagttggctataatttaagtc

SEQ ID NO: 17006 - DNA, 71 bp, chicken (Gallus Gallus)
  misc_feature (36): n=c or t
ctaagctatttccttagacatatcttaatatcttanggaagtgacaggctcttgcctttactatgcagcta

SEQ ID NO: 17007 - DNA, 71 bp, chicken (Gallus Gallus)
  misc_feature (36): n=c or g
gaagaaattatttataatatccagtgtgaacttccnctggcacaacttaaggtcattccctctctttccct

SEQ ID NO: 17008 - DNA, 71 bp, chicken (Gallus Gallus)
  misc_feature (36): n=a or c
taatttgagactgaaaatctgttgtatttattatanattttaaaaagaagcaaaaaagtaatacaagccct

SEQ ID NO: 17009 - DNA, 71 bp, chicken (Gallus Gallus)
  misc_feature (36): n=g or t
agaacattggtttctgcactgtcttgcacttgaaanatagtactattccactattttgcacattgaaggcc

SEQ ID NO: 17010 - DNA, 71 bp, chicken (Gallus Gallus)
  misc_feature (36): n=c or t
ctggaagtttctttccttttgccaaagagagaaccngagacacatctttagttttccaaggacaagtttga

SEQ ID NO: 17011 - DNA, 71 bp, chicken (Gallus Gallus)
  misc_feature (36): n=a or g
tcattttttaatgtattttagttttggatgtgacanaagattcagatttcttactagcatttaaagcatag

SEQ ID NO: 17012 - DNA, 71 bp, chicken (Gallus Gallus)
  misc_feature (36): n=c or t
atgtggaagaattatttattaactcttttgcaactngcaactaatatgaagtggtttaatacagagtggac

SEQ ID NO: 17013 - DNA, 71 bp, chicken (Gallus Gallus)
  misc_feature (36): n=g or t
aaagaatgagaaggtaaagattttcagaaggacatnttatttagagttctaactctgaacaattactggat

SEQ ID NO: 17014 - DNA, 71 bp, chicken (Gallus Gallus)
  misc_feature (36): n=g or t
attttgtttttcatgttcatcagaagtattttaatngatcattttctacagtttattttatatattttata

SEQ ID NO: 17015 - DNA, 71 bp, chicken (Gallus Gallus)
  misc_feature (36): n=a or g
cgaataataccacctccacgaagttatcctttctcnttctcttctttgaaagacgatcggcccaacagccg

SEQ ID NO: 17016 - DNA, 71 bp, chicken (Gallus Gallus)
  misc_feature (36): n=a or g
gaacataaatgcagtgctgctacaccctcatttctnttagacaacatgcacatggctgtgctataccaata

SEQ ID NO: 17017 - DNA, 71 bp, chicken (Gallus Gallus)
  misc_feature (36): n=a or c
tgggtttgtgagaaagtgaaatggaaacctgactgnctgtcagttattatcaatgataagcaaatacaata

SEQ ID NO: 17018 - DNA, 71 bp, chicken (Gallus Gallus)
  misc_feature (36): n=a or t
tatacattgtgggctctcatgacaaggatgctgggnatgctttgatgtttgctacagtggtgatattattg

SEQ ID NO: 17019 - DNA, 71 bp, chicken (Gallus Gallus)
  misc_feature (36): n=a or g
gtgtgtgtgtggatttcaggcaatcagcctcagacntcagggcaagggggaagcactggcctcacaagtct

SEQ ID NO: 17020 - DNA, 71 bp, chicken (Gallus Gallus)
  misc_feature (36): n=c or g
cctgcacactgcatgggaaagttggaacttatatgnagggaccgactgtggtgagtaccagacaatgtgga

SEQ ID NO: 17021 - DNA, 71 bp, chicken (Gallus Gallus)
  misc_feature (36): n=c or t
aattgataaaaggagcaaacataaaccacaccaagncaagcattactctgcccccacctgactggtggaac

SEQ ID NO: 17022 - DNA, 71 bp, chicken (Gallus Gallus)
  misc_feature (36): n=a or c
ctaaaattagataagtacagccttgagtcatgtatnaccttagccgaaaattcttacgtctcttcactctt

SEQ ID NO: 17023 - DNA, 71 bp, chicken (Gallus Gallus)
  misc_feature (36): n=c or t
gattttgattactgcagacaggtcctgcatctattnctggccacattataaataacgccaaccctaatatg

SEQ ID NO: 17024 - DNA, 71 bp, chicken (Gallus Gallus)
  misc_feature (36): n=g or t
ttgtattttgccggagtggaataagatgaagtccancatacattgtcttcctcatcctaatattttatact

SEQ ID NO: 17025 - DNA, 71 bp, chicken (Gallus Gallus)
  misc_feature (36): n=c or t
aggggcatgattctctctgctcaagcaagcctttgnccgattgtccagtgcgccacatggatatttgccac

SEQ ID NO: 17026 - DNA, 71 bp, chicken (Gallus Gallus)
  misc_feature (36): n=c or t
ctgtaacctatttcctaggtctcccagaaactgttnaggcttctttgagtcaaatagtaaatgcagaaatg

SEQ ID NO: 17027 - DNA, 71 bp, chicken (Gallus Gallus)
  misc_feature (36): n=a or g
ggctgagggtgtgttttctttttaaatctgaggagntgtatgcacagtgtgatatggaaatgtgaagagaa

SEQ ID NO: 17028 - DNA, 71 bp, chicken (Gallus Gallus)
  misc_feature (36): n=a or c
acagctttatctattgccacattcccacttgaaagncagaaaatgtatactcagcaagatggagtatatgc

SEQ ID NO: 17029 - DNA, 71 bp, chicken (Gallus Gallus)
  misc_feature (36): n=a or g
aacatccctggtgcaacttaaagccattgcctcttntcttattcctggccagctttgtggatgtccactga

SEQ ID NO: 17030 - DNA, 71 bp, chicken (Gallus Gallus)
  misc_feature (36): n=a or g
ctgctgggtgaattactatttctaatgcctataacntcttactgacaaaaaaagaatatagttaatattca

SEQ ID NO: 17031 - DNA, 71 bp, chicken (Gallus Gallus)
  misc_feature (36): n=c or t
gtgttgcaaagagagaactgcagtattttcttccangtgaaagggctggtaaattcttcctgctctttgtt

SEQ ID NO: 17032 - DNA, 71 bp, chicken (Gallus Gallus)
  misc_feature (36): n=c or t
aaaatgcttaaataaatgaaggtttaattgaacttngggtggcaattttgtgactcactgggagttacctt

SEQ ID NO: 17033 - DNA, 71 bp, chicken (Gallus Gallus)
  misc_feature (36): n=a or c
ctctggagagaggtgaagctccccgtggaagagggnagaaggaaagagattcacatggacacagaacaaga

SEQ ID NO: 17034 - DNA, 71 bp, chicken (Gallus Gallus)
  misc_feature (36): n=c or t
tcattgaccttagctggcaatttctactaggttcanctgaaatgctaaaaattaaaaattctttgtaagat

SEQ ID NO: 17035 - DNA, 71 bp, chicken (Gallus Gallus)
  misc_feature (36): n=a or g
ctgcatccgtgtgcaacctgtacacgtggggcaccntgcttccttgagtgggatctgaagctgattccctt

SEQ ID NO: 17036 - DNA, 71 bp, chicken (Gallus Gallus)
  misc_feature (36): n=a or g
ttattactttctatacatgtgtaacatacatttctngatgcttttcagaatttcaaaggaatgtgtgtgtg

SEQ ID NO: 17037 - DNA, 71 bp, chicken (Gallus Gallus)
  misc_feature (36): n=a or t
aagattttcatctaggtattgcagccattatgaagnactaaaacaatctcttccatcactggtctgcattt

SEQ ID NO: 17038 - DNA, 71 bp, chicken (Gallus Gallus)
  misc_feature (36): n=c or t
ctagctaggcatggtacaccctacaaaaattgttangcgagctcaaggcatgccaagcccatgttacaaat

SEQ ID NO: 17039 - DNA, 71 bp, chicken (Gallus Gallus)
  misc_feature (36): n=a or g
tgccgaaactcctctcatgtgcttccctgaattctnggaaactctggaattgctgtacctctggtcttcac

SEQ ID NO: 17040 - DNA, 71 bp, chicken (Gallus Gallus)
  misc_feature (36): n=a or g
tgtagaaacacaagggaaagaaataagaggcaaagngattctgtgtaccccgtgaacaacaagttaacagc

SEQ ID NO: 17041 - DNA, 71 bp, chicken (Gallus Gallus)
  misc_feature (36): n=c or t
agaagtctctgatttcttgcacattcttctctgaangattttagtttggataccctgcaacagttgctctc

SEQ ID NO: 17042 - DNA, 71 bp, chicken (Gallus Gallus)
  misc_feature (36): n=c or t
gtaaagtgttcattaaaacatttgctatatcttttnttcttttgttgtgcatggatgatttttacaggaca

SEQ ID NO: 17043 - DNA, 71 bp, chicken (Gallus Gallus)
  misc_feature (36): n=a or c
atttctgctgcaccaaattaattattagcatagtcnatcctgtcaccttgggaactgcagagctgcctgga

SEQ ID NO: 17044 - DNA, 71 bp, chicken (Gallus Gallus)
  misc_feature (36): n=a or g
tgagaaaatccataggcatatccatcagcaagaggnattttgaagatgatgaagattgttcttatataaaa

SEQ ID NO: 17045 - DNA, 71 bp, chicken (Gallus Gallus)
  misc_feature (36): n=a or g
aatatgttgacagactactactgtataatcgtgggnaaaaaaaattacactaacttgaaaaccacaattat

SEQ ID NO: 17046 - DNA, 71 bp, chicken (Gallus Gallus)
  misc_feature (36): n=g or t
ataaaccaacacgtaaatatgtaattcaattaaatncatgagcatctgcacctttaaaattcactttactt

SEQ ID NO: 17047 - DNA, 71 bp, chicken (Gallus Gallus)
  misc_feature (36): n=a or g
gatatattgatatttatgaagaaaacaaaaggtatntattttccctcattctttgttcaaggggtttccaa

SEQ ID NO: 17048 - DNA, 71 bp, chicken (Gallus Gallus)
  misc_feature (36): n=a or g
gcctgggaacagagcagtacaggcagagcactaagngtggctggaaagtcactagcgcaggtgatacttaa

SEQ ID NO: 17049 - DNA, 71 bp, chicken (Gallus Gallus)
  misc_feature (36): n=a or g
ttgtctccaccatgcttgtcaattctgtgagacatnttcccgctttgtgggacttcaacaccatctcccaa

SEQ ID NO: 17050 - DNA, 71 bp, chicken (Gallus Gallus)
  misc_feature (36): n=a or g
aaggataagggattttttcattttaaaaacataatnaaaacactggggttactttaaggattcccaccatg

SEQ ID NO: 17051 - DNA, 71 bp, chicken (Gallus Gallus)
  misc_feature (36): n=c or t
tttgaggtgccatcaccaagctcctgattaaatgcngtggatctgaaaatctaggcagacaagaaaagatt

SEQ ID NO: 17052 - DNA, 71 bp, chicken (Gallus Gallus)
  misc_feature (36): n=a or g
gggaacagctagaaatatccttgtgcccacattgangaacagagagtgtttagtatgcagaaagcttcctt

SEQ ID NO: 17053 - DNA, 71 bp, chicken (Gallus Gallus)
  misc_feature (36): n=a or g
tggtggtagcccacaccttcaaaaccttcttacaanggagcaaaaatactttaatccacaattaaacattc

SEQ ID NO: 17054 - DNA, 71 bp, chicken (Gallus Gallus)
  misc_feature (36): n=a or g
atgaaacttctgaaggaaggcagtcccagtccccgntgcaccaattaatcgtggagcacaccctgtatttt

SEQ ID NO: 17055 - DNA, 71 bp, chicken (Gallus Gallus)
  misc_feature (36): n=a or g
aggcaagattatatcatcgtgcagccatttctttcnattctctatactgagttatgtcctcttactccttg

SEQ ID NO: 17056 - DNA, 71 bp, chicken (Gallus Gallus)
  misc_feature (36): n=c or t
attccatggcacaaactctggttgaaggatgaacantctatcatagaatcatagaagcatagaattgctca

SEQ ID NO: 17057 - DNA, 71 bp, chicken (Gallus Gallus)
  misc_feature (36): n=c or t
ttatcattaatagaagtatagaagtattttatactncagtttgcaccaacattatttgttttattcctttt

SEQ ID NO: 17058 - DNA, 71 bp, chicken (Gallus Gallus)
  misc_feature (36): n=c or t
aaacctccaaagacttatgtaaatgtatagaaaaangaatgctctgtttctatctatgtgggttttttttg

SEQ ID NO: 17059 - DNA, 71 bp, chicken (Gallus Gallus)
  misc_feature (36): n=a or g
tcttttactgtcttcaatggatctttggccagcacntaaagactatgtgggacctagaccaaggcacagac

SEQ ID NO: 17060 - DNA, 71 bp, chicken (Gallus Gallus)
  misc_feature (36): n=c or t
atttgtgtctgtttaccagaaggttgcttctagtgntatatctttgacattgaatccagctactagcagta

SEQ ID NO: 17061 - DNA, 71 bp, chicken (Gallus Gallus)
  misc_feature (36): n=a or c
ccacttcttaacaattggcttatctagtaacaaacngaacagttacccccggtgtattttcttctcttagt

SEQ ID NO: 17062 - DNA, 71 bp, chicken (Gallus Gallus)
  misc_feature (36): n=c or g
taaccacatgcagaaagaagtcagtatgatgacaantataaatatctgctatcataaaaaataattaagca

SEQ ID NO: 17063 - DNA, 71 bp, chicken (Gallus Gallus)
  misc_feature (36): n=c or t
ataaatacatacatgcttttgtttgcaggaattcantgaactagtaggcactgcaaaatccaagaaagact

SEQ ID NO: 17064 - DNA, 71 bp, chicken (Gallus Gallus)
  misc_feature (36): n=a or g
caacaaaaaaccaacggacaaatatgatgtaaactncagttccacagaaatcatagaatcattaaggttgg

SEQ ID NO: 17065 - DNA, 71 bp, chicken (Gallus Gallus)
  misc_feature (36): n=a or g
gagattaaccattaacacatggttgtgattcatctntaaaaacattcctaggctaacgctctggaaaagta

SEQ ID NO: 17066 - DNA, 71 bp, chicken (Gallus Gallus)
  misc_feature (36): n=a or g
ccaccagaccgctgcaaagcgagcgcaggtgggacnggctgtaatgagggacactgtgctctgcagaaaag

SEQ ID NO: 17067 - DNA, 71 bp, chicken (Gallus Gallus)
  misc_feature (36): n=c or g
tggaggactatgccttttaagtgaggggaaattctnccccctgagatgggtttacaaagtacaatgcagtc

SEQ ID NO: 17068 - DNA, 71 bp, chicken (Gallus Gallus)
  misc_feature (36): n=c or t
aacaaagtaccagttggcatgatcccaactgacatnaataatgttggttaagcaaccgatgagcccaaaca

SEQ ID NO: 17069 - DNA, 71 bp, chicken (Gallus Gallus)
  misc_feature (36): n=c or g
atctaatacatagctttatcaccatcggtaacctgnatatttttatacagactctttttgaccttcataca

SEQ ID NO: 17070 - DNA, 71 bp, chicken (Gallus Gallus)
  misc_feature (36): n=a or g
cagagcagggggagataacaaaacctcaccaagcancacgcattgctttacacagctgaggggaaaaacac

SEQ ID NO: 17071 - DNA, 71 bp, chicken (Gallus Gallus)
  misc_feature (36): n=a or g
gcataaaaatgaataagattccttttgaagtcaagncacttgacttcgtcttggtggtcatttctcagaga

SEQ ID NO: 17072 - DNA, 71 bp, chicken (Gallus Gallus)
  misc_feature (36): n=a or g
ccaatccagactagatctttgttacaagtgtctgcnataggatggctgacaagttttggctgaatctacat

SEQ ID NO: 17073 - DNA, 71 bp, chicken (Gallus Gallus)
  misc_feature (36): n=a or g
ataatcattcattatgtgttttctgaagcagttagngactgtaaaatctgttcttggtcagattttttaca

SEQ ID NO: 17074 - DNA, 71 bp, chicken (Gallus Gallus)
  misc_feature (36): n=a or g
acttcaaccatgctctgatcaaaagatgcaaagacngtgtcctagactgacactcctgtgaaagggtgaag

SEQ ID NO: 17075 - DNA, 71 bp, chicken (Gallus Gallus)
  misc_feature (36): n=a or g
gtacagtagctctaaactgtatgagaaggtactggnaaaaaaatgctgagggtgtgtatcttatccttacc

SEQ ID NO: 17076 - DNA, 71 bp, chicken (Gallus Gallus)
  misc_feature (36): n=a or t
aaagaagtaacaatatgtttctgcattctgaaatgnaaagcattcctaatctgtattgtatttgttcagga

SEQ ID NO: 17077 - DNA, 71 bp, chicken (Gallus Gallus)
  misc_feature (36): n=a or g
ttagatgttaggggcacattctttattcagaaggcngtgaggcgctggcacaggcttcccagagaagctgt

SEQ ID NO: 17078 - DNA, 71 bp, chicken (Gallus Gallus)
  misc_feature (36): n=a or g
aaacatatttccagatcctagattcattaaagcccnaaatctgtaccaaggagcatggtgcagttctctac

SEQ ID NO: 17079 - DNA, 71 bp, chicken (Gallus Gallus)
  misc_feature (36): n=a or g
tcagtgttaacagggcagaaaagacttgactgtggntttctcctaaagggcattccaggtacatggacaac

SEQ ID NO: 17080 - DNA, 71 bp, chicken (Gallus Gallus)
  misc_feature (36): n=c or g
gtgcacacactgatgtttgccagattccagttcagnttgatggcagaggtcccacagtgggtactgacaat

SEQ ID NO: 17081 - DNA, 71 bp, chicken (Gallus Gallus)
  misc_feature (36): n=c or t
cacaaaatatttctgttatttaccatggtcaaacangaatgactgccagataggctggccagctgttctcc

SEQ ID NO: 17082 - DNA, 71 bp, chicken (Gallus Gallus)
  misc_feature (36): n=c or t
tacatcactgtgctgacaaatccagcccctggacanggacatgactgtgcatctcaggcaataggaaaaga

SEQ ID NO: 17083 - DNA, 71 bp, chicken (Gallus Gallus)
  misc_feature (36): n=c or t
ctaccaaaatacattatgagctttttccaattttanatttgatttatttggaaagcggcaaaggaatctca

SEQ ID NO: 17084 - DNA, 71 bp, chicken (Gallus Gallus)
  misc_feature (36): n=c or t
tgtaggcacattccagtgctccacaaagaacagtantggtttgtcttcatacacactgatagatcataata

SEQ ID NO: 17085 - DNA, 71 bp, chicken (Gallus Gallus)
  misc_feature (36): n=a or t
taatgacttcacaaatcattattagactacaagctnatatagacatggccagtcttccgcattcaggacct

SEQ ID NO: 17086 - DNA, 71 bp, chicken (Gallus Gallus)
  misc_feature (36): n=a or c
ggaaatgctgactgcagaactcaagcaccaaactcnaagctcaggcactgactgctgccagaaagggagaa

SEQ ID NO: 17087 - DNA, 71 bp, chicken (Gallus Gallus)
  misc_feature (36): n=a or g
gcttcacaacagcactgtgaagccacacctaagacntattacatctgaaatcctacctgttgcatttgaag

SEQ ID NO: 17088 - DNA, 71 bp, chicken (Gallus Gallus)
  misc_feature (36): n=a or g
ccaccttcatacacttagaccattttgagaactgcntgaaagacctaatgtactgatatcacgttgtggtc

SEQ ID NO: 17089 - DNA, 71 bp, chicken (Gallus Gallus)
  misc_feature (36): n=c or t
cccacagttcactttggtctctaactatatgctacngaagaatagagacttaaacccatttacttgaggta

SEQ ID NO: 17090 - DNA, 71 bp, chicken (Gallus Gallus)
  misc_feature (36): n=c or t
ttgttcatcaggtcaaagtggtagtaggagacagcnacatccttggcattgcggcccacatagatcatctg

SEQ ID NO: 17091 - DNA, 71 bp, chicken (Gallus Gallus)
  misc_feature (36): n=c or t
ttggctacttgcacctgagatcacttacgactgacntctttttgaatctttgagttgtagacatttttggt

SEQ ID NO: 17092 - DNA, 71 bp, chicken (Gallus Gallus)
  misc_feature (36): n=c or t
attcaaagccttgctgtcagaaaacacagccagaanatattagggccgtgcctaaaaggtacaggtgagat

SEQ ID NO: 17093 - DNA, 71 bp, chicken (Gallus Gallus)
  misc_feature (36): n=a or g
tgtcatagaatggcttggattagaaaggacttcaangatctccaagttccatcttaaaagaccacacaacc

SEQ ID NO: 17094 - DNA, 71 bp, chicken (Gallus Gallus)
  misc_feature (36): n=c or t
gggtcactttttagcatcaacttatgctaccacatncccctcaaacagaatactgaaactctttcaaagca

SEQ ID NO: 17095 - DNA, 71 bp, chicken (Gallus Gallus)
  misc_feature (36): n=c or t
ctccacatctgatctccaacaacagcactcggtatngagctctcgcttatcagcctctgacgcaaacaggt

SEQ ID NO: 17096 - DNA, 71 bp, chicken (Gallus Gallus)
  misc_feature (36): n=g or t
tttcctacacttttgttaagtaaactctactgcacnctcacacaaatgctacataaattcttgaggagtca

SEQ ID NO: 17097 - DNA, 71 bp, chicken (Gallus Gallus)
  misc_feature (36): n=a or g
ataaatggaaaatctgttccaatttatcacaaaagngaattaaacatactcctcagctgtaatggcttatg

SEQ ID NO: 17098 - DNA, 71 bp, chicken (Gallus Gallus)
  misc_feature (36): n=c or t
atcagaactgtgtttcatgtgctgtcagattgtttnttatggaaaccaaggcttttgaaaacatgatgaaa

SEQ ID NO: 17099 - DNA, 71 bp, chicken (Gallus Gallus)
  misc_feature (36): n=c or t
tcttcttgtctaattccaacacagtattacatctgngtaggtgagaatgctgagagaagattgagtggaat

SEQ ID NO: 17100 - DNA, 71 bp, chicken (Gallus Gallus)
  misc_feature (36): n=c or t
gatgaactgatacatgaactgaagcaaacactgaangcaatcaagttagaagagaaaggtgtttatgtcca

SEQ ID NO: 17101 - DNA, 71 bp, chicken (Gallus Gallus)
  misc_feature (36): n=c or g
aattttctagagatactgaatgacatgtaactaggntataaagtttacaacagcaaagtatattccctatc

SEQ ID NO: 17102 - DNA, 71 bp, chicken (Gallus Gallus)
  misc_feature (36): n=c or t
gttttataattagttatgctaacagcataccttggngttattcaatcaacagctcttttccttcctccttc

SEQ ID NO: 17103 - DNA, 71 bp, chicken (Gallus Gallus)
  misc_feature (36): n=a or c
ctccctttccacagaaaaactgagtttctgcagcanttccacagcaattctgcagctacccagtgtccaat

SEQ ID NO: 17104 - DNA, 71 bp, chicken (Gallus Gallus)
  misc_feature (36): n=a or g
cctgaagcaggtctgacagaacataattctgtgctnttctgttcactcatgtatctagctgatggaaacac

SEQ ID NO: 17105 - DNA, 71 bp, chicken (Gallus Gallus)
  misc_feature (36): n=c or g
tggaaaaacccaggttaactagttactcttatttantaaatttaagtttgcataatttcaggctcttcaaa

SEQ ID NO: 17106 - DNA, 71 bp, chicken (Gallus Gallus)
  misc_feature (36): n=c or t
agataataaaaacttgaccagccaaaacctgagcantctaagctacctttgaagttgagtctgtttgggcc

SEQ ID NO: 17107 - DNA, 71 bp, chicken (Gallus Gallus)
  misc_feature (36): n=a or g
cataaacaagccacagagacataaactccccttcanccccatatccctaacctgcttaatgagggacctat

SEQ ID NO: 17108 - DNA, 71 bp, chicken (Gallus Gallus)
  misc_feature (36): n=a or g
ctctttctcttccttaactcctattttttccagaanagtatcttccactgttagagtagatggatgtcatt

SEQ ID NO: 17109 - DNA, 71 bp, chicken (Gallus Gallus)
  misc_feature (36): n=c or t
gcgtttgctcacaaaaatgtgcacgtctccctgttngtgaatacaaatgcccagtggacagaagaagttac

SEQ ID NO: 17110 - DNA, 71 bp, chicken (Gallus Gallus)
  misc_feature (36): n=c or t
gattattgatttctgagacactatctgtatagggangtcaaatatatcttgctcctcctactctggtgatg

SEQ ID NO: 17111 - DNA, 71 bp, chicken (Gallus Gallus)
  misc_feature (36): n=c or t
tcagtttcgaccgtgcctttcagttttgggcaatgntgtccagctttgtacaaacagctgagtaagatcta

SEQ ID NO: 17112 - DNA, 71 bp, chicken (Gallus Gallus)
  misc_feature (36): n=a or t
aacagatgtagagaggttaaaggaggaacccgtcangctggtgaaatgggaaggacagcctatactcagaa

SEQ ID NO: 17113 - DNA, 71 bp, chicken (Gallus Gallus)
  misc_feature (36): n=c or t
ttcactgggagaaggcttctgtggctaaaaccatantatttggtgatatataagttttgttattaaaacac

SEQ ID NO: 17114 - DNA, 71 bp, chicken (Gallus Gallus)
  misc_feature (36): n=a or g
gtactctttattaccaaaactagtcagattattccngccagggatgctccaaatgtcatctacacataaaa

SEQ ID NO: 17115 - DNA, 71 bp, chicken (Gallus Gallus)
  misc_feature (36): n=a or c
gacttccatccagctgtgagtccttagcacttctanaaatttatccataagatctcaatctggtcagcagt

SEQ ID NO: 17116 - DNA, 71 bp, chicken (Gallus Gallus)
  misc_feature (36): n=a or c
agtacagacttttttccctgacactgtttagatcgnagcccttctctgcaaagatgaggctgtaagttgtt

SEQ ID NO: 17117 - DNA, 71 bp, chicken (Gallus Gallus)
  misc_feature (36): n=c or t
aggtgtccaattacatattctgtttataattaagcnattatctgttatcattttaaaaccagtcaatacca

SEQ ID NO: 17118 - DNA, 71 bp, chicken (Gallus Gallus)
  misc_feature (36): n=c or t
tgtttaagtgggaaatatggggaaggaagtatgtcnctgctaatctgtatgttaagaattttctcttcttg

SEQ ID NO: 17119 - DNA, 71 bp, chicken (Gallus Gallus)
  misc_feature (36): n=a or g
agctaagtgttagtgaattagtgaagaagtttttgntctttgatgtaactactaaaatctttgacaacatc

SEQ ID NO: 17120 - DNA, 71 bp, chicken (Gallus Gallus)
  misc_feature (36): n=a or c
tccacactcaaatattttgcagtttatgcagctgtnttttatgtcttggtctaaaatactatcagctaatc

SEQ ID NO: 17121 - DNA, 71 bp, chicken (Gallus Gallus)
  misc_feature (36): n=c or t
cttacgagtgactcagttctcactagatgccttttntgtgctgtaaaaatgttgagggtctgtggtgccca

SEQ ID NO: 17122 - DNA, 71 bp, chicken (Gallus Gallus)
  misc_feature (36): n=c or t
tatcagcaaatcctacctatcaggagtgaccttcanggtggtttcagcattacttaccagcaacggcgcca

SEQ ID NO: 17123 - DNA, 71 bp, chicken (Gallus Gallus)
  misc_feature (36): n=c or t
ctgggctctgttgctacctctcacgtagcaccgtangtcagtgggcggcctctgtcctgtgttccctggca

SEQ ID NO: 17124 - DNA, 71 bp, chicken (Gallus Gallus)
  misc_feature (36): n=a or c
gaaatttattcctgtccaaataatacgtggtatttntccaagctgagctttccttctgaaagaagagaagg

SEQ ID NO: 17125 - DNA, 71 bp, chicken (Gallus Gallus)
  misc_feature (36): n=a or g
tgtgtgccagatgccttctggagccagctggctgancaaatccacagaaatccaacctgtcccctccccac

SEQ ID NO: 17126 - DNA, 71 bp, chicken (Gallus Gallus)
  misc_feature (36): n=a or g
gctgaagggccctccctactcctcagaatgtcccanttctgctgattatgtttattaggtggagcagtcga

SEQ ID NO: 17127 - DNA, 71 bp, chicken (Gallus Gallus)
  misc_feature (36): n=c or t
tttgaatcagagttcaacttagctttcatttcacanccttggcccttgtgtttgacacaatcgtaacactt

SEQ ID NO: 17128 - DNA, 71 bp, chicken (Gallus Gallus)
  misc_feature (36): n=c or t
ggacacctctgtgagcagagcccagcacctgcccangtcagataagagatatttccaaacagcttccacca

SEQ ID NO: 17129 - DNA, 71 bp, chicken (Gallus Gallus)
  misc_feature (36): n=c or t
aggagaaattgtggcttgagtgaagtgatgaaaganaaccctgttgggatgaagatacggtgtctttctca

SEQ ID NO: 17130 - DNA, 71 bp, chicken (Gallus Gallus)
  misc_feature (36): n=c or t
tgagaaatacaagcacaaggagcgtcaccaacttgnccaaaattacaagaaacctatagaaacacagacac

SEQ ID NO: 17131 - DNA, 71 bp, chicken (Gallus Gallus)
  misc_feature (36): n=a or g
ccttctcaggagtcctctctcttctcaggagcttgnggctaaaagatggaggaatcagcactcagcaccaa

SEQ ID NO: 17132 - DNA, 71 bp, chicken (Gallus Gallus)
  misc_feature (36): n=c or g
gctcttttactgtgaatattcacacaaattagaatntgaagaggagaatgatttgttagatgaaatgttat

SEQ ID NO: 17133 - DNA, 71 bp, chicken (Gallus Gallus)
  misc_feature (36): n=c or t
cagcttgtgggaggcagccacaagctatgaggacangtgtttgaagataaaggtactgtgagctgccctga

SEQ ID NO: 17134 - DNA, 71 bp, chicken (Gallus Gallus)
  misc_feature (36): n=a or c
caagtactttaacagcatgacatttaatgcccttcnagatcacccataaaagttgattaatgtctcttctt

SEQ ID NO: 17135 - DNA, 71 bp, chicken (Gallus Gallus)
  misc_feature (36): n=a or t
ggttttgctattctacagtctcagcttcaatacttngtaaaagcagttctcaagaaagggaagtttaccag

SEQ ID NO: 17136 - DNA, 71 bp, chicken (Gallus Gallus)
  misc_feature (36): n=g or t
aaaatagtatattcactgccttggtatcatcttctncaagtacataggttgttctgaaagtaatgccttcc

SEQ ID NO: 17137 - DNA, 71 bp, chicken (Gallus Gallus)
  misc_feature (36): n=c or t
tgttctaacatgagcaaattttttacttatttcagnccagaacttagagaattgtaatactaaacaattgt

SEQ ID NO: 17138 - DNA, 71 bp, chicken (Gallus Gallus)
  misc_feature (36): n=c or t
tttaaaaagagaatttcagtgcaggtttatgctacncttttcccattcattgtgagcctcttgttgatcta

SEQ ID NO: 17139 - DNA, 71 bp, chicken (Gallus Gallus)
  misc_feature (36): n=a or g
ctcagcctgaaaagatctgaaggtaacaattgggtntatctacacatagatttacatggtatgttccatac

SEQ ID NO: 17140 - DNA, 71 bp, chicken (Gallus Gallus)
  misc_feature (36): n=c or t
cactatttccagtaaaatacaggaagtcccacagangttcagaaacaggctgacagggtcttatcagtaac

SEQ ID NO: 17141 - DNA, 71 bp, chicken (Gallus Gallus)
  misc_feature (36): n=c or t
ttgctgcaagaaaaaaaagtcctggtttcaaggtangtgactgtaagtatcacaggattgtagaataattt

SEQ ID NO: 17142 - DNA, 71 bp, chicken (Gallus Gallus)
  misc_feature (36): n=c or t
tgtggccatctttctacctctgactgacatctgtanagtacacagtgcaaattgtttgacgtattttgaaa

SEQ ID NO: 17143 - DNA, 71 bp, chicken (Gallus Gallus)
  misc_feature (36): n=a or g
acggatttgtgccaagagatatttacagaggaaatncatataacctcagttccctctgtctctaaactcaa

SEQ ID NO: 17144 - DNA, 71 bp, chicken (Gallus Gallus)
  misc_feature (36): n=c or t
tacccgagtcctgcctatccagccttcgcctgtggntctggctacgttatctccaaagacatcgttcagtg

SEQ ID NO: 17145 - DNA, 71 bp, chicken (Gallus Gallus)
  misc_feature (36): n=a or g
ttgacatactgacttcaaatgcaatagtatagaganaattgaactggaatcttcctggcaatctatgtact

SEQ ID NO: 17146 - DNA, 71 bp, chicken (Gallus Gallus)
  misc_feature (36): n=a or t
atgataacttgttgatttttcctgttgcgttattantgcttgtgcaaacaacatgccatttatatgccttt

SEQ ID NO: 17147 - DNA, 71 bp, chicken (Gallus Gallus)
  misc_feature (36): n=a or g
tatcagtgcaagatggatttttcacccatgagttcntccaatttgtttgtgagctttcataacgtgctaat

SEQ ID NO: 17148 - DNA, 71 bp, chicken (Gallus Gallus)
  misc_feature (36): n=g or t
tcagactgagttccttaaggaattgtatcataattntgttcatggcaagatccgtatttcttccagagcat

SEQ ID NO: 17149 - DNA, 71 bp, chicken (Gallus Gallus)
  misc_feature (36): n=a or c
aatgacaaaaagagaacacaagaggtggatgctgcntaaaactttggcatttgcagtcaacaaagaacttg

SEQ ID NO: 17150 - DNA, 71 bp, chicken (Gallus Gallus)
  misc_feature (36): n=c or g
acttcaattaatgacgtcaagttcacagtctctganaaatacaggaatcaagaatgtgataagaattggct

SEQ ID NO: 17151 - DNA, 71 bp, chicken (Gallus Gallus)
  misc_feature (36): n=a or c
atgggtatgtggctatcaaaatagaataaagccttntggaaaacagaatagatggaatggttctcttaagt

SEQ ID NO: 17152 - DNA, 71 bp, chicken (Gallus Gallus)
  misc_feature (36): n=c or t
tgataacattaagaaatctagagttttaaggcatgntggttactcaagtcatcaaacaactgatttttcca

SEQ ID NO: 17153 - DNA, 71 bp, chicken (Gallus Gallus)
  misc_feature (36): n=c or t
ctattaggcctgctccctttggattgtatggcagangacagtgccatttgatgttgttatctttggcccat

SEQ ID NO: 17154 - DNA, 71 bp, chicken (Gallus Gallus)
  misc_feature (36): n=c or t
ctgtactttctatctgcaacactatttttctattgncatattgttttataattttttagagatgtatccat

SEQ ID NO: 17155 - DNA, 71 bp, chicken (Gallus Gallus)
  misc_feature (36): n=c or t
gtgagagggcgaggggtctgcagggttagctgttcnacctccttgtccttcagtgcccttttatgtgctgt

SEQ ID NO: 17156 - DNA, 71 bp, chicken (Gallus Gallus)
  misc_feature (36): n=g or t
tttaaaactcaatcatgatacttcatataagatttncttccattggaacgtgcgcttggacgctcttttat

SEQ ID NO: 17157 - DNA, 71 bp, chicken (Gallus Gallus)
  misc_feature (36): n=c or t
ccatctcctttcaacattcaatcatcagatctaccnagatttatacagtaatcagactttgtagaatgaag

SEQ ID NO: 17158 - DNA, 71 bp, chicken (Gallus Gallus)
  misc_feature (36): n=c or t
ccttggcatgccccctgagtctgtcagggattcctncagcattttgcttctctttagcacccttagacaaa

SEQ ID NO: 17159 - DNA, 71 bp, chicken (Gallus Gallus)
  misc_feature (36): n=a or g
ctgatctggtctgcactcttggccttcaccagggcntatttggggtttatcagcttcttcaccatggcgtt

SEQ ID NO: 17160 - DNA, 71 bp, chicken (Gallus Gallus)
  misc_feature (36): n=a or g
ggttttattcagtagatgtcattttcttcagaagcncatttttacagattaagactttctctatgaaggtt

SEQ ID NO: 17161 - DNA, 71 bp, chicken (Gallus Gallus)
  misc_feature (36): n=a or g
cacacattcataactgcaaaaattctaacatggcancatctgagcactgcacattgttctgctttggtttg

SEQ ID NO: 17162 - DNA, 71 bp, chicken (Gallus Gallus)
  misc_feature (36): n=c or g
atttctttgtgtgcctctatctggaacacagcattntgtggaagggtggccatcagttacacatgcataca

SEQ ID NO: 17163 - DNA, 71 bp, chicken (Gallus Gallus)
  misc_feature (36): n=a or g
ctatgtacattctgcatgtatgtaaggatctgcatncttgtgtatttgtgtattgagtagaatcattcttg

SEQ ID NO: 17164 - DNA, 71 bp, chicken (Gallus Gallus)
  misc_feature (36): n=c or t
accaccacgatattgacacaacacttccaattccanatacccatcacctttttccatctccaaaacaaaca

SEQ ID NO: 17165 - DNA, 71 bp, chicken (Gallus Gallus)
  misc_feature (36): n=g or t
tctataatctgcaaatggatttataagatttatacncttgtttaagcagcgggctgtttttcaacgggatc

SEQ ID NO: 17166 - DNA, 71 bp, chicken (Gallus Gallus)
  misc_feature (36): n=c or t
ttgtatactttacagattgtctgtacttttctcttncaactgttttctcatccacctgctcctggaggcat

SEQ ID NO: 17167 - DNA, 71 bp, chicken (Gallus Gallus)
  misc_feature (36): n=c or t
aaagtacttccaagataccttgaaggattgtttccngaggtttagtaccaatcagattgagtgtgtaattc

SEQ ID NO: 17168 - DNA, 71 bp, chicken (Gallus Gallus)
  misc_feature (36): n=a or t
agagcagcttcactgtgtgcgtgagctgtagaatangaaaggatgcagcttaatgtgcttgtggtggctgt

SEQ ID NO: 17169 - DNA, 71 bp, chicken (Gallus Gallus)
  misc_feature (36): n=a or t
catggactacaaaggataaaaatgaggacaaactantgcctttgaaaatttgggtctgaagaaacttatac

SEQ ID NO: 17170 - DNA, 71 bp, chicken (Gallus Gallus)
  misc_feature (36): n=a or g
tagggtggagtaaatgacgacaaattccacctgacnttttcatcccccttattctccatttccaggtaact

SEQ ID NO: 17171 - DNA, 71 bp, chicken (Gallus Gallus)
  misc_feature (36): n=a or g
tcactagcaaaggtttccaggctgatatctcttctntaagttgcaaagatttaaaactgttctagaatggt

SEQ ID NO: 17172 - DNA, 71 bp, chicken (Gallus Gallus)
  misc_feature (36): n=c or t
caatgacttttcagaggagatacaggttcaagccantacagaaggtggcactggcagaataagctcataaa

SEQ ID NO: 17173 - DNA, 71 bp, chicken (Gallus Gallus)
  misc_feature (36): n=a or c
tcctttgataactgcagggcctccactacagcctgnaattaaagtaaccatgactgctccaaaaagttgac

SEQ ID NO: 17174 - DNA, 71 bp, chicken (Gallus Gallus)
  misc_feature (36): n=a or t
ccccacaggcactccacagacagccctgtccacccnagctggtcatatgtgggcatgtgaaatcccatata

SEQ ID NO: 17175 - DNA, 71 bp, chicken (Gallus Gallus)
  misc_feature (36): n=g or t
acttgccaaagctgaagcgagtggattctgatctcnttgttgagactggctggacccacagagcttctgat

SEQ ID NO: 17176 - DNA, 71 bp, chicken (Gallus Gallus)
  misc_feature (36): n=a or c
tagttattaaaattagaaaactaagactgaaaatantctatctcctctaagtctaatcttgtgttacaggc

SEQ ID NO: 17177 - DNA, 71 bp, chicken (Gallus Gallus)
  misc_feature (36): n=a or g
ggcagagtcaatgcagcttgacttctaattaacttncactcaacaaatgacaaacgttataagcaaacata

SEQ ID NO: 17178 - DNA, 71 bp, chicken (Gallus Gallus)
  misc_feature (36): n=c or t
gaatttttggtgaaaccaacctgaggaaaacactgngagaaggtatggtcgtttctcactgggatgtattt

SEQ ID NO: 17179 - DNA, 71 bp, chicken (Gallus Gallus)
  misc_feature (36): n=c or t
tcagcaactccccttctccactgtatgcaaggatcncttgatccatacctgcttctgtcatgtactatggc

SEQ ID NO: 17180 - DNA, 71 bp, chicken (Gallus Gallus)
  misc_feature (36): n=a or g
ccaaacgagaggaagaactttctcctgaaagagcanaattgagctcaagaggaagtcaggcatctcatata

SEQ ID NO: 17181 - DNA, 71 bp, chicken (Gallus Gallus)
  misc_feature (36): n=a or t
agtagatctgtgctctattgtgctcatgtgggtccncccacatgaattttccctgttctgcttctatcttc

SEQ ID NO: 17182 - DNA, 71 bp, chicken (Gallus Gallus)
  misc_feature (36): n=c or t
ttcgtgccgagcacggcactgacattcacacccgcncttctctcacgttagctgctgtctcgtttgctgcc

SEQ ID NO: 17183 - DNA, 71 bp, chicken (Gallus Gallus)
  misc_feature (36): n=a or g
ttttttaaaaaaattagcgacatggagatgaaagcngaaaactcagaaacatgaaaatgtgaaataaattg

SEQ ID NO: 17184 - DNA, 71 bp, chicken (Gallus Gallus)
  misc_feature (36): n=c or t
ggatttaaagcaagtcaccctgctgttcctgtgccntctggcaatccacattcaattcaggagcagagttt

SEQ ID NO: 17185 - DNA, 71 bp, chicken (Gallus Gallus)
  misc_feature (36): n=a or g
tcttatcaagctgccaatgacatgcactgctacagngcaacaggcctgctcccaagactgaaggccttggg

SEQ ID NO: 17186 - DNA, 71 bp, chicken (Gallus Gallus)
  misc_feature (36): n=c or t
tttattagtggattttggtcttttctactacctctnatagctgtgcttttttatatctacatttcttgagc

SEQ ID NO: 17187 - DNA, 71 bp, chicken (Gallus Gallus)
  misc_feature (36): n=c or t
gcactgcaaagctttgtagttttcctaactctgtanaccatataaatcccccgatcagcaagatttactgc

SEQ ID NO: 17188 - DNA, 71 bp, chicken (Gallus Gallus)
  misc_feature (36): n=a or c
tgaatgaaaaatgatggaatttacataagcaagtantgtaagttaatacctcttacttgattgcgtgcaca

SEQ ID NO: 17189 - DNA, 71 bp, chicken (Gallus Gallus)
  misc_feature (36): n=c or t
aaaggcctgatcctgcaaccatgcagctccactgtncacaggtcgttctgtagtgagtggaggcaaggaga

SEQ ID NO: 17190 - DNA, 71 bp, chicken (Gallus Gallus)
  misc_feature (36): n=c or g
acatttattcttctcttaaaaatcaaagtcaaaatnagctaaagcacaaatgcattttcataggatttttg

SEQ ID NO: 17191 - DNA, 71 bp, chicken (Gallus Gallus)
  misc_feature (36): n=c or t
atcagccatgaggacacttattctgaggttctgtgngctcacagaaagagctattacagacatcagttctg

SEQ ID NO: 17192 - DNA, 71 bp, chicken (Gallus Gallus)
  misc_feature (36): n=c or t
gcaagggcacagagtggtctgaaaaactattcaacngaatttcggctttctttagccaagattgcactgag

SEQ ID NO: 17193 - DNA, 71 bp, chicken (Gallus Gallus)
  misc_feature (36): n=a or g
atactccaggtgccctgaaggagacacagatcaatntgtcataccttttacaggcattctgttccttccat

SEQ ID NO: 17194 - DNA, 71 bp, chicken (Gallus Gallus)
  misc_feature (36): n=a or g
gaactcctaggcttaggaagcttagaaaacatccantgaaagaaggagaggtataagatgttttatcatga

SEQ ID NO: 17195 - DNA, 71 bp, chicken (Gallus Gallus)
  misc_feature (36): n=a or g
tgggcctgagctgactcctccggatcttcctgttcntgcagaaagctgcagatcgtattgggcctgctgta

SEQ ID NO: 17196 - DNA, 71 bp, chicken (Gallus Gallus)
  misc_feature (36): n=c or t
tttagggaggctattggttttatttctgtttgcttnttcagttttcttcacttatccaaactgtaggctgg

SEQ ID NO: 17197 - DNA, 71 bp, chicken (Gallus Gallus)
  misc_feature (36): n=a or g
ctaacatctgatataaatccaccttcttccagttanaagttattgctgcttgtcctatctctgcaggctct

SEQ ID NO: 17198 - DNA, 71 bp, chicken (Gallus Gallus)
  misc_feature (36): n=a or c
tgacctcctcaagatcagggtcgttgttctgtattngtttcagagtttcttccacgtccgttgagttaggc

SEQ ID NO: 17199 - DNA, 71 bp, chicken (Gallus Gallus)
  misc_feature (36): n=a or g
catagttgtcatctactccagcagctacacgagcancgcattcagggtcttctctgtgactgtatgttggt

SEQ ID NO: 17200 - DNA, 71 bp, chicken (Gallus Gallus)
  misc_feature (36): n=a or t
gcatggttctgttttgtagctcaattagagatcatnaagtattaaaaaaaaacaactacaaaaaaccccca

SEQ ID NO: 17201 - DNA, 71 bp, chicken (Gallus Gallus)
  misc_feature (36): n=c or g
gcagataagactgcacaagctcacctcttctggagntgtgatggggacctaaaggcagactgactggcttt

SEQ ID NO: 17202 - DNA, 71 bp, chicken (Gallus Gallus)
  misc_feature (36): n=g or t
gccggactcgatgatctttgtgggtcccttccaacntggaatagtctacgatcctatgggtgcacattcta

SEQ ID NO: 17203 - DNA, 71 bp, chicken (Gallus Gallus)
  misc_feature (36): n=c or t
agaattccaccaggtcaacatcaaggccacatttcngttcaggaaggtcctgagttacaggtgagggggac

SEQ ID NO: 17204 - DNA, 71 bp, chicken (Gallus Gallus)
  misc_feature (36): n=c or t
agtttggtctacactctgagaaattggtcttgaatntctgccttgcaaacagaagcaagacctgttattaa

SEQ ID NO: 17205 - DNA, 71 bp, chicken (Gallus Gallus)
  misc_feature (36): n=c or t
catacagaaatcctgacggatcttgctgtgaggagntgggttattcaaaaaggcttttggtgtctggtgga

SEQ ID NO: 17206 - DNA, 71 bp, chicken (Gallus Gallus)
  misc_feature (36): n=a or c
tccatgtgaatacctcattatttatcacccttaacncccttgaaatctgaagctgtcctcatttaaattac

SEQ ID NO: 17207 - DNA, 71 bp, chicken (Gallus Gallus)
  misc_feature (36): n=a or g
taacaggccaaaattctactaattgtgtaagtagtnatttcctattgtgcaggcagtgtctgactgcagtg

SEQ ID NO: 17208 - DNA, 71 bp, chicken (Gallus Gallus)
  misc_feature (36): n=g or t
taacaaaaaatcttgtattttgctcagcggttactnactgatttggtttgtggatggcgtggctgtggtgc

SEQ ID NO: 17209 - DNA, 71 bp, chicken (Gallus Gallus)
  misc_feature (36): n=a or g
cgaccagccagctcatccaccttcattttttctccntctttgcaggtcattacagctagtgtaatggtata

SEQ ID NO: 17210 - DNA, 71 bp, chicken (Gallus Gallus)
  misc_feature (36): n=a or g
tcagtttcagtgaacctagcataactgtttctatcnattcccataacctagacagtaagagtaattaatgg

SEQ ID NO: 17211 - DNA, 71 bp, chicken (Gallus Gallus)
  misc_feature (36): n=a or g
ttcctctaacggcttagtacaatttcttactttccntagcaatatgagaacatcggttctacctcaggtgt

SEQ ID NO: 17212 - DNA, 71 bp, chicken (Gallus Gallus)
  misc_feature (36): n=a or g
ccttttctcatccctcagtcacaagtcccagtggantcttggatgtgactgtggtttacatggatccagca

SEQ ID NO: 17213 - DNA, 71 bp, chicken (Gallus Gallus)
  misc_feature (36): n=a or g
ttatgcagtttttagccagtctactgaaattcaacncaattcaaattcagcacaattcatttatccacaga

SEQ ID NO: 17214 - DNA, 71 bp, chicken (Gallus Gallus)
  misc_feature (36): n=a or c
gcgtaaatagaatttaaacttgaaactctgatcctnttagatgatctggagtgcaaaattttatattgctt

SEQ ID NO: 17215 - DNA, 71 bp, chicken (Gallus Gallus)
  misc_feature (36): n=g or t
tttatcaagactggctaataaaagcattatgtttcncatctagggagagcggaaggcagaaaaaatgatca

SEQ ID NO: 17216 - DNA, 71 bp, chicken (Gallus Gallus)
  misc_feature (36): n=a or g
gaggtgcaagatgtggaagtctagcctggatagatngagcttaaacctgagaacttcagagatatttctat

SEQ ID NO: 17217 - DNA, 71 bp, chicken (Gallus Gallus)
  misc_feature (36): n=c or t
tttggcccaaatctataggtgatgttgggtttatgntcatagctgggtagcacaaaagctaaatcagcttc

SEQ ID NO: 17218 - DNA, 71 bp, chicken (Gallus Gallus)
  misc_feature (36): n=c or t
gctcagccaagtaacgtatttctggtacgttaacanaaagtcaaaaaatcccttaagaagaaagtaggaat

SEQ ID NO: 17219 - DNA, 71 bp, chicken (Gallus Gallus)
  misc_feature (36): n=g or t
aaagctatagtataactgaatagctctttgacgatnataatgttcaactgagataaagctatatggggatc

SEQ ID NO: 17220 - DNA, 71 bp, chicken (Gallus Gallus)
  misc_feature (36): n=a or g
tcgtaacctcaatgtgcaatctttattaatccatantgcttatcatagtgttggaaattactttcaagcat

SEQ ID NO: 17221 - DNA, 71 bp, chicken (Gallus Gallus)
  misc_feature (36): n=g or t
catgcagcgccttcagctccctcaaagctctccaantgggaaaaagcaccacattcttcctgttaagtatt

SEQ ID NO: 17222 - DNA, 71 bp, chicken (Gallus Gallus)
  misc_feature (36): n=a or g
cttcagttacttttaggttcctactgctctcttaanacaaaccagcctatactcaccagtgtcattctttg

SEQ ID NO: 17223 - DNA, 71 bp, chicken (Gallus Gallus)
  misc_feature (36): n=a or g
aatgttgagctgtagcattgctttggctattgcagnatagaagaaaactgtagctgataggtgacaatcat

SEQ ID NO: 17224 - DNA, 71 bp, chicken (Gallus Gallus)
  misc_feature (36): n=c or t
taatgaggtctgcacctggagtcagtcaggatgaanggaaggagaacgactaaactgttcactttgccagg

SEQ ID NO: 17225 - DNA, 71 bp, chicken (Gallus Gallus)
  misc_feature (36): n=a or t
tagccatgagtcttcatttgcctttagatgaggccnctgtcctcctcttcaacaaccatgaccccttgaca

SEQ ID NO: 17226 - DNA, 71 bp, chicken (Gallus Gallus)
  misc_feature (36): n=a or g
cctcttggtgtgccttaagacctccacttcataccntgtggactatcaaggacttaaataaattagtgtgt

SEQ ID NO: 17227 - DNA, 71 bp, chicken (Gallus Gallus)
  misc_feature (36): n=c or t
catcaagccaatagatcatgggagagaactgagggntgtgagtgtcccaaccagtctgttcagtaacaggt

SEQ ID NO: 17228 - DNA, 71 bp, chicken (Gallus Gallus)
  misc_feature (36): n=a or g
ccttgttgatgccagaggatcaaaacctttaaggcngggggaaatgaaggctgaaggtgaaaaaaggcaca

SEQ ID NO: 17229 - DNA, 71 bp, chicken (Gallus Gallus)
  misc_feature (36): n=c or t
gccccaaataattcaactatattaaaaaagattaangctgcttctcttttctcacttctccagtagaggaa

SEQ ID NO: 17230 - DNA, 71 bp, chicken (Gallus Gallus)
  misc_feature (36): n=c or t
ctagcaaaagctttacagaaaagatatgaaaagcancttttctctgtttcagctcagaaagcacagttgtt

SEQ ID NO: 17231 - DNA, 71 bp, chicken (Gallus Gallus)
  misc_feature (36): n=c or t
aaataaaatcaattaagtgatttttcattgtctgtntgcaaagcatccatgtttccaaactgatcttagaa

SEQ ID NO: 17232 - DNA, 71 bp, chicken (Gallus Gallus)
  misc_feature (36): n=g or t
aagagcataccctgttgcagcactcagggctccctnacgctgttttttaaaaaacatcattcatacttgag

SEQ ID NO: 17233 - DNA, 71 bp, chicken (Gallus Gallus)
  misc_feature (36): n=c or t
tgctgaatacttttgtatttattttctatcacttgncagtacttaagtgaactgatagggactttgccttg

SEQ ID NO: 17234 - DNA, 71 bp, chicken (Gallus Gallus)
  misc_feature (36): n=a or t
taagatcgaatcctccatacttactatgcaagcagntagtatttacatcttgatgttgacttaggattttg

SEQ ID NO: 17235 - DNA, 71 bp, chicken (Gallus Gallus)
  misc_feature (36): n=a or t
tggtttgtttcttgtagttgacttggagagtcccanggaaatggaggaagaaatcccagttgtaatctgcg

SEQ ID NO: 17236 - DNA, 71 bp, chicken (Gallus Gallus)
  misc_feature (36): n=a or g
tcccatttgtcgtcttccatatcattcaagcagaantggcaagttggttgcagtaagaactgtaagattat

SEQ ID NO: 17237 - DNA, 71 bp, chicken (Gallus Gallus)
  misc_feature (36): n=a or c
ttttgtcaaagtagttacagaattagatcctgaggnaaagactcaactaagaagggctgtttttaatagct

SEQ ID NO: 17238 - DNA, 71 bp, chicken (Gallus Gallus)
  misc_feature (36): n=c or t
cggttatcgcgaacgagattccggatcacacacagngcatcatggagagatcgctttgcttcttcaattat

SEQ ID NO: 17239 - DNA, 71 bp, chicken (Gallus Gallus)
  misc_feature (36): n=c or t
cagaccatggtcaagcagccagagcctgaaaatagntttaattgtaactacctggataatttttaacatgg

SEQ ID NO: 17240 - DNA, 71 bp, chicken (Gallus Gallus)
  misc_feature (36): n=c or t
gttacaatctaatcctcaagataaaagcacccaaanagcaatgaatccctccataatggtatcagacatag

SEQ ID NO: 17241 - DNA, 71 bp, chicken (Gallus Gallus)
  misc_feature (36): n=g or t
tgaaaatgctactgcaaaatgagtaaaagtggtcanactgttcctccctgcagaccagtgcccatttccaa

SEQ ID NO: 17242 - DNA, 71 bp, chicken (Gallus Gallus)
  misc_feature (36): n=c or g
agacttgagtgtacctcttaatttctcttattgaanatgatataagaactttggattatttgtgctccaaa

SEQ ID NO: 17243 - DNA, 71 bp, chicken (Gallus Gallus)
  misc_feature (36): n=c or t
ctgcatttctttattctctgccttaccttatgcccnccactgccacaaaattctcagaaggcgaatgtctt

SEQ ID NO: 17244 - DNA, 71 bp, chicken (Gallus Gallus)
  misc_feature (36): n=a or g
ccagggtagggatgccatctaaggcacaggagcacnagatatttgtgtaggcagatgaggcactgcaccaa

SEQ ID NO: 17245 - DNA, 71 bp, chicken (Gallus Gallus)
  misc_feature (36): n=c or t
tctcactgtatttcagaaagaatgtaaacaaagctntgccttacccttatgactcttctatgtgggtgtga

SEQ ID NO: 17246 - DNA, 71 bp, chicken (Gallus Gallus)
  misc_feature (36): n=c or g
gattcataaacagactttctcaattccatatgctgncttcatccctcttcttccctgagttcaggaagatg

SEQ ID NO: 17247 - DNA, 71 bp, chicken (Gallus Gallus)
  misc_feature (36): n=c or t
aacaaggacaactacatgtaaaaaatgggattcgangaacagtgttatttgtcatacatgagatacaggtt

SEQ ID NO: 17248 - DNA, 71 bp, chicken (Gallus Gallus)
  misc_feature (36): n=a or g
gaagtatgtgaaatttgtattaagcattttcatacngaatgtgttttctttgtgttggagttcgggtcctg

SEQ ID NO: 17249 - DNA, 71 bp, chicken (Gallus Gallus)
  misc_feature (36): n=c or t
taaacagattttcagtaactatttacattctatatngggaagaggagaatcttgtttatgtatctgcagtt

SEQ ID NO: 17250 - DNA, 71 bp, chicken (Gallus Gallus)
  misc_feature (36): n=a or c
ctggttaataatagatataactcaaaagagtgcccnaaaccttagatactgcagcagcattaagtcataga

SEQ ID NO: 17251 - DNA, 71 bp, chicken (Gallus Gallus)
  misc_feature (36): n=c or g
caacagaagcagacattcctctcgttcccttcacantgtaagctctttggcagtgttcctctgttcctctc

SEQ ID NO: 17252 - DNA, 71 bp, chicken (Gallus Gallus)
  misc_feature (36): n=a or g
ccatctcaggtccctctccctgggttacagagaaantcgtggtgtcacctctcagccaccatgagcctgac

SEQ ID NO: 17253 - DNA, 71 bp, chicken (Gallus Gallus)
  misc_feature (36): n=a or g
atttggacacttgcaagacccatagtgaggcatacncaatggctgcgtgagggccttaggcagagagcctg

SEQ ID NO: 17254 - DNA, 71 bp, chicken (Gallus Gallus)
  misc_feature (36): n=c or g
agctgccttgtgctctctgcgctgctatagtcccanaagaaaaatacaactaaagagaagcaatctgttta

SEQ ID NO: 17255 - DNA, 71 bp, chicken (Gallus Gallus)
  misc_feature (36): n=a or g
ttcatacaagcaaaagcggactccacagtttgacantgtttctgcattttccaaatgcccactctcccttc

SEQ ID NO: 17256 - DNA, 71 bp, chicken (Gallus Gallus)
  misc_feature (36): n=c or g
aaactcttgcatatcacagactattaaaatttaccnacatacccttgaatggagccctatttcttgaaatg

SEQ ID NO: 17257 - DNA, 71 bp, chicken (Gallus Gallus)
  misc_feature (36): n=a or g
agaaggctgggaacctcccttttcaagtgggaagtntaagaagttcttttctagctacaaagagacatcaa

SEQ ID NO: 17258 - DNA, 71 bp, chicken (Gallus Gallus)
  misc_feature (36): n=a or g
cgctacagctatggatttgtacctagtctcctactncagatcatttgaactaggtaactagtttagcagca

SEQ ID NO: 17259 - DNA, 71 bp, chicken (Gallus Gallus)
  misc_feature (36): n=c or t
acaaagcaggcaaagcaattaaaaccatcgtgctgngacaaataagcaagcattccttcttggtccctccc

SEQ ID NO: 17260 - DNA, 71 bp, chicken (Gallus Gallus)
  misc_feature (36): n=c or g
cttaactgtgctgatcattcgtagtaaaggtaagcnattacttctgtttagcgataagattgtctgtttta

SEQ ID NO: 17261 - DNA, 71 bp, chicken (Gallus Gallus)
  misc_feature (36): n=c or t
agcctttctccaagtgcttgtctgtgtgctggaagnggatcaggatcatcactaggatttccttctgatgc

SEQ ID NO: 17262 - DNA, 71 bp, chicken (Gallus Gallus)
  misc_feature (36): n=a or g
aaaaagcacagatgctcgagcagcagaatggtggtngcatcaatattctacatgaagtcttaatcccttgc

SEQ ID NO: 17263 - DNA, 71 bp, chicken (Gallus Gallus)
  misc_feature (36): n=c or g
ataagcacttgatacgatcaccacctcagacttctncaggctgagatggatactaagcctgcagatgtttc

SEQ ID NO: 17264 - DNA, 71 bp, chicken (Gallus Gallus)
  misc_feature (36): n=a or c
tgatatgaaaccagcaaagcctttctgctttacatntgactttgacaaggttgtttctcatttcctttcca

SEQ ID NO: 17265 - DNA, 71 bp, chicken (Gallus Gallus)
  misc_feature (36): n=c or t
tttcgtttgtgaagggctccagctgcacacagcagngcggaagaggctgagccttttcctattaaaaatgt

SEQ ID NO: 17266 - DNA, 71 bp, chicken (Gallus Gallus)
  misc_feature (36): n=a or t
atggaccctggtcagacaggaagttatttcagcagngtttgggatggccttttcaatgggtacctttcttc

SEQ ID NO: 17267 - DNA, 71 bp, chicken (Gallus Gallus)
  misc_feature (36): n=a or t
gacatggaaagtcaaactcattctgtggtatgaggnttggttctgctggagaagggagaatgcagaaatag

SEQ ID NO: 17268 - DNA, 71 bp, chicken (Gallus Gallus)
  misc_feature (36): n=a or g
gatgtctaatagaggtagggatggtggtgaaattcngaaaaaatactactactcatgacaaggacttgata

SEQ ID NO: 17269 - DNA, 71 bp, chicken (Gallus Gallus)
  misc_feature (36): n=c or g
ggacttctgttcaaatctcttctgatatttttctgntattgatgcttttctgttttgtagctgagttgact

SEQ ID NO: 17270 - DNA, 71 bp, chicken (Gallus Gallus)
  misc_feature (36): n=c or t
atttctactagaattgttacagtagatagcctttgntacccaatttaacaaaaacttgagtattgttcttc

SEQ ID NO: 17271 - DNA, 71 bp, chicken (Gallus Gallus)
  misc_feature (36): n=c or t
gaaattataactttaaattattccttcagtgtctgngttttaaacataacgaagtactttgcatattttaa

SEQ ID NO: 17272 - DNA, 71 bp, chicken (Gallus Gallus)
  misc_feature (36): n=c or t
aacaaagatccacttaaggtgcaactacagggaacntgggggaggaagacagatgacccaagagactgggt

SEQ ID NO: 17273 - DNA, 71 bp, chicken (Gallus Gallus)
  misc_feature (36): n=a or g
ctgcatttctcttaccacacacatgaagcaacaganttggtcccctgagggtttgaacacgcagctgaatt

SEQ ID NO: 17274 - DNA, 71 bp, chicken (Gallus Gallus)
  misc_feature (36): n=a or g
ctttgcttttgcaagccagagagatcaaaagttagntagtagaacccagtgtttatatttcaaaggcatta

SEQ ID NO: 17275 - DNA, 71 bp, chicken (Gallus Gallus)
  misc_feature (36): n=a or g
gagtgttaaggcagtaccaaaccctgccttagaatntgactttttttggtgtctttttgctgattgccagc

SEQ ID NO: 17276 - DNA, 71 bp, chicken (Gallus Gallus)
  misc_feature (36): n=a or g
taattctattctgggagagaagacaaggcagcagcngttagttgctgaatgcgttgtggcaagggattctt

SEQ ID NO: 17277 - DNA, 71 bp, chicken (Gallus Gallus)
  misc_feature (36): n=a or g
agcaaccagatgcctacgtgccaaaataacaacacnctgatcccttttgttggttcctgataacaaagcaa

SEQ ID NO: 17278 - DNA, 71 bp, chicken (Gallus Gallus)
  misc_feature (36): n=c or t
attatgaaatgcagagaggaaaaccagaaatactgnccttatattaaaatgttacctagaaacagctgata

SEQ ID NO: 17279 - DNA, 71 bp, chicken (Gallus Gallus)
  misc_feature (36): n=g or t
ttgcatcacacaaaaatcaagtcaactgtggaaacntcttttacagagaaatattttatgttgttatagac

SEQ ID NO: 17280 - DNA, 71 bp, chicken (Gallus Gallus)
  misc_feature (36): n=c or t
tatattactggcaactgattgttgctgacatgtaanacatgcttaaggatgcatatgaagcaaaatgaaca

SEQ ID NO: 17281 - DNA, 71 bp, chicken (Gallus Gallus)
  misc_feature (36): n=a or c
cagttcattgccctgcttgagttttgctttataacntgcagcaggagttgttttttcagcatagatttttg

SEQ ID NO: 17282 - DNA, 71 bp, chicken (Gallus Gallus)
  misc_feature (36): n=c or t
aaaccttgaattttgcacacagagctacatcatttncaggataagaagatgactttttaatctctctttaa

SEQ ID NO: 17283 - DNA, 71 bp, chicken (Gallus Gallus)
  misc_feature (36): n=c or t
tttttttttccagaccacatctctgatgtgcttttnctacctaaaagaatacatgatctgaacaaaaccaa

SEQ ID NO: 17284 - DNA, 71 bp, chicken (Gallus Gallus)
  misc_feature (36): n=c or t
agaaatgatttgctggtggcagcagattcaatcacnaacacgatgtcttctttggtaaaagaactaaattc

SEQ ID NO: 17285 - DNA, 71 bp, chicken (Gallus Gallus)
  misc_feature (36): n=c or t
gatgttataaggcagctgtttaaaaacaatactctnttacagaaaaatcaataggaggcttttcatgctta

SEQ ID NO: 17286 - DNA, 71 bp, chicken (Gallus Gallus)
  misc_feature (36): n=c or g
gactaaataatatatttaaatttccagttaaagctngttcaaaaggccaagttaatgagcagagaattata

SEQ ID NO: 17287 - DNA, 71 bp, chicken (Gallus Gallus)
  misc_feature (36): n=c or t
aatactaggtaaattgagttgaaaataacaaaggangctatccgtaggcaattaccaaaataagtactgtg

SEQ ID NO: 17288 - DNA, 71 bp, chicken (Gallus Gallus)
  misc_feature (36): n=c or t
ttcaaaacatgatgcataggaacatcttagatcccncccacaagtgcactctcacttttattgttgttttc

SEQ ID NO: 17289 - DNA, 71 bp, chicken (Gallus Gallus)
  misc_feature (36): n=a or g
taatagccgaggtttgttaaataggccgagtgttcncatctcacagttggctatcccatttaatgtgcttc

SEQ ID NO: 17290 - DNA, 71 bp, chicken (Gallus Gallus)
  misc_feature (36): n=c or t
tgaatttctaaataagaaatatatgttgttacttantgtacaatacaaaacaaaagaaaccaatgcaactg

SEQ ID NO: 17291 - DNA, 71 bp, chicken (Gallus Gallus)
  misc_feature (36): n=g or t
catggggctaaacttcatttaccatcctctttgacnaaattgttcctgctttatacactgggtaattactt

SEQ ID NO: 17292 - DNA, 71 bp, chicken (Gallus Gallus)
  misc_feature (36): n=a or g
ttctggaaacaaggtaagaaactatattatattttngtgttttactatctcatcaatctgttaggtatgat

SEQ ID NO: 17293 - DNA, 71 bp, chicken (Gallus Gallus)
  misc_feature (36): n=a or g
agcaaagagatacgggagcaggtagaacttacaagngaaagatgagagggagagtgtaaaaaataaagcat

SEQ ID NO: 17294 - DNA, 71 bp, chicken (Gallus Gallus)
  misc_feature (36): n=a or g
cagtacaagccatcatctttgtgctttttgagtttnttcttatgcattttgcttctcccttttattgggtt

SEQ ID NO: 17295 - DNA, 71 bp, chicken (Gallus Gallus)
  misc_feature (36): n=a or g
accataatatgtgcacataaaattaacacctagtgngctggtaaacaaatggacgagaaacaaggttctta

SEQ ID NO: 17296 - DNA, 71 bp, chicken (Gallus Gallus)
  misc_feature (36): n=c or t
gtagaggtactggccagagtgaaagctgtacttgtnttctcgaagtgaggctgcataacttagagtaaaat

SEQ ID NO: 17297 - DNA, 71 bp, chicken (Gallus Gallus)
  misc_feature (36): n=c or t
cagcatttggcaagcatttcacatgctgctatttcnaccttctaaacagtggagccaaatcatccggtgag

SEQ ID NO: 17298 - DNA, 71 bp, chicken (Gallus Gallus)
  misc_feature (36): n=c or t
ccctctggtgaatatttaagaacaattccaggtcangtgaagtgcctgaggcaattacatggcttctttta

SEQ ID NO: 17299 - DNA, 71 bp, chicken (Gallus Gallus)
  misc_feature (36): n=c or t
ataggcaacaaagagcaactcgctgtgaggttgtgntatgaacggtgctgcagacgaaggatctccttggc

SEQ ID NO: 17300 - DNA, 71 bp, chicken (Gallus Gallus)
  misc_feature (36): n=a or g
ggtgttgatggcttcctggttggaatggttgggatngctgggattgctgcctgtggccaccagcactttag

SEQ ID NO: 17301 - DNA, 71 bp, chicken (Gallus Gallus)
  misc_feature (36): n=a or g
ttcaaaatgcagctacaagctttccatggggatttnacagctcctgcattttcagcatggctgagactcat

SEQ ID NO: 17302 - DNA, 71 bp, chicken (Gallus Gallus)
  misc_feature (36): n=c or t
atccaattgttgccaaaaggacacattcgtatacantcaggtatctttgatatgactggtagtgaagtgtg

SEQ ID NO: 17303 - DNA, 71 bp, chicken (Gallus Gallus)
  misc_feature (36): n=a or g
taatatgtgtaatatggtggaattttaacagatgantgttgtacgaaaaaaaatggaatagcatatgttat

SEQ ID NO: 17304 - DNA, 71 bp, chicken (Gallus Gallus)
  misc_feature (36): n=a or g
ctcaatttaacataaatgaaagttttacttactacnactgctggtaacaagaatgttcctgacatgaaata

SEQ ID NO: 17305 - DNA, 71 bp, chicken (Gallus Gallus)
  misc_feature (36): n=a or t
ggaaaattgtatatagtaagagttttgggggtggantaggtagtgtttgaaagcactcactgaacagcaca

SEQ ID NO: 17306 - DNA, 71 bp, chicken (Gallus Gallus)
  misc_feature (36): n=c or t
cttttaggagaatttgtttgcatattgcatgaggangactcaattattgattcatgtttgtagattagagc

SEQ ID NO: 17307 - DNA, 71 bp, chicken (Gallus Gallus)
  misc_feature (36): n=c or t
attgtgcttttcaatacaatatttatattaatttgnactgtatactatataaactacctagtacttgtttg

SEQ ID NO: 17308 - DNA, 71 bp, chicken (Gallus Gallus)
  misc_feature (36): n=a or g
atttaggccagagtcttctaatcatatctacatacntaatctctcttcctaccactgttagctgggagaaa

SEQ ID NO: 17309 - DNA, 71 bp, chicken (Gallus Gallus)
  misc_feature (36): n=a or c
ttagaaagaaaacctgcacatttcactattgacttnttatattacttttacaatttaactacagctgtata

SEQ ID NO: 17310 - DNA, 71 bp, chicken (Gallus Gallus)
  misc_feature (36): n=a or g
agaggcttttgctgcatcaaagcctgcagatatctntatgccacaaaagctgattttcagtgacgaataaa

SEQ ID NO: 17311 - DNA, 71 bp, chicken (Gallus Gallus)
  misc_feature (36): n=c or t
gcgggcttgtaacgtagatccctcagttaactgtcnatcaatactaactgttcaagcaaaggagtataaat

SEQ ID NO: 17312 - DNA, 71 bp, chicken (Gallus Gallus)
  misc_feature (36): n=a or c
aatgaaaatcaaatcacagagatgctcttcacaaanaatatgtctgtttctaaaagcaaagaatcaaagaa

SEQ ID NO: 17313 - DNA, 71 bp, chicken (Gallus Gallus)
  misc_feature (36): n=c or t
attgtttcagggtactggctgaaactgcagctgcgngtttactgcaagtgcattacattggtgcatgcatg

SEQ ID NO: 17314 - DNA, 71 bp, chicken (Gallus Gallus)
  misc_feature (36): n=a or c
acataatgtataaaaagaggagaaaagcctggaaanaaacagctgctggtcgtttttgtttgtggcactaa

SEQ ID NO: 17315 - DNA, 71 bp, chicken (Gallus Gallus)
  misc_feature (36): n=a or t
gctcatttgccacagtgtaaagcaaggtcttgtatnaaaccaagaatgtagagttctgttaacctaaaaag

SEQ ID NO: 17316 - DNA, 71 bp, chicken (Gallus Gallus)
  misc_feature (36): n=c or t
ttaccatctgtagaatactgaatgtattttgtgtgngtttctgcagtcattttctataaatgtaaatatat

SEQ ID NO: 17317 - DNA, 71 bp, chicken (Gallus Gallus)
  misc_feature (36): n=a or t
aggagacagaatgtgcaggaacaaattaccacaccnaatgcttctagctaacttctttccaaacagtgaat

SEQ ID NO: 17318 - DNA, 71 bp, chicken (Gallus Gallus)
  misc_feature (36): n=c or t
aaaattaaattccgcaaatccaacaaacatagtagnttactttgctacatggtgaggagaaaaacttaaat

SEQ ID NO: 17319 - DNA, 71 bp, chicken (Gallus Gallus)
  misc_feature (36): n=g or t
gctctggggaaacaaacgtataagacagcattgatnatataaatccagaaccctgaaaaatagagatacct

SEQ ID NO: 17320 - DNA, 71 bp, chicken (Gallus Gallus)
  misc_feature (36): n=a or g
gcttactgaatggttacactgaacactgtgtatctnaacttgaatatttcttcagaaaccttagtggtttc

SEQ ID NO: 17321 - DNA, 71 bp, chicken (Gallus Gallus)
  misc_feature (36): n=c or t
ggtcatgaagaagagggttatctcctaatgacttancctacttcattttttctcccaaagccagaatcatc

SEQ ID NO: 17322 - DNA, 71 bp, chicken (Gallus Gallus)
  misc_feature (36): n=c or g
tcagtgctcctcatcgtgaaggtgccactgtgtagntgcggcctgtggttcagttcaacttgttaggtata

SEQ ID NO: 17323 - DNA, 71 bp, chicken (Gallus Gallus)
  misc_feature (36): n=c or t
cattcacatttctgtattctttatatttgcagcaangctgatctcaatcatggctaactaaataaggaaaa

SEQ ID NO: 17324 - DNA, 71 bp, chicken (Gallus Gallus)
  misc_feature (36): n=c or t
atcagaatgggctttgattgtctcgcagggaggcantgttttggtgttggagccagtgaacagtgataaga

SEQ ID NO: 17325 - DNA, 71 bp, chicken (Gallus Gallus)
  misc_feature (36): n=a or g
catcagctgttatgccctttggttcacacacaaagntaccatttctgcagccaatgggccatccctctaaa

SEQ ID NO: 17326 - DNA, 71 bp, chicken (Gallus Gallus)
  misc_feature (36): n=a or g
atggagtgacccatgtaattcctgtggtatgtaggngggtgcatttctaaaatattggttgtttagacaaa

SEQ ID NO: 17327 - DNA, 71 bp, chicken (Gallus Gallus)
  misc_feature (36): n=c or g
gtgatactattcagctctcaaacaagataagattanttatgaaaaaaaatcatatgagaaaacagaatatc

SEQ ID NO: 17328 - DNA, 71 bp, chicken (Gallus Gallus)
  misc_feature (36): n=a or g
acaccagtgtgccattacagcttgaccacatttgtntcaccgaagtttctttctatttatgtcaaaggact

SEQ ID NO: 17329 - DNA, 71 bp, chicken (Gallus Gallus)
  misc_feature (36): n=c or t
tcagatttgagctgatgggctaacacaaaggtcaanttacatgggcagaagagcagaactgaagtggtgta

SEQ ID NO: 17330 - DNA, 71 bp, chicken (Gallus Gallus)
  misc_feature (36): n=a or c
tgtgtgcttgttctgatgtgctttagtgcacagtangaatagagaaaagcctgatgctgatattccaatgg

SEQ ID NO: 17331 - DNA, 71 bp, chicken (Gallus Gallus)
  misc_feature (36): n=c or g
atggggcatctctttctttccgtggtttatcctganaatactgcttggaagaagaagaatttaatccacga

SEQ ID NO: 17332 - DNA, 71 bp, chicken (Gallus Gallus)
  misc_feature (36): n=g or t
cccccattttttttctcattcttctatccacaaaancatctctgctttatactgtgctgaaagaatgacca

SEQ ID NO: 17333 - DNA, 71 bp, chicken (Gallus Gallus)
  misc_feature (36): n=a or g
tagtgaaattcatcaaaaagcagtaattcattactnctctcgacaatatttggtggcattgcacctggcat

SEQ ID NO: 17334 - DNA, 71 bp, chicken (Gallus Gallus)
  misc_feature (36): n=a or g
taaacgctcagtaggattatcactctaatgtttaangactgagcaggagtaggaaagggtagagaagttag

SEQ ID NO: 17335 - DNA, 71 bp, chicken (Gallus Gallus)
  misc_feature (36): n=a or g
tcagctgatggttggcacttctgcagccacatgaancacagcttgtggaagtctctccattatcacaacac

SEQ ID NO: 17336 - DNA, 71 bp, chicken (Gallus Gallus)
  misc_feature (36): n=c or t
cctgatctttgtttaagcagattgagctcctggagnccttcactgcaaggcacattttctagtcttttaat

SEQ ID NO: 17337 - DNA, 71 bp, chicken (Gallus Gallus)
  misc_feature (36): n=c or t
tccttagtcctgtatgcctggtatttcaatattcangcttctcccctacttgaaaatatcacctgtgaaac

SEQ ID NO: 17338 - DNA, 71 bp, chicken (Gallus Gallus)
  misc_feature (36): n=c or t
ttttttctttattttttttctttttgcactgccgantgtattgggctggcaatattaaaacaatgggcaac

SEQ ID NO: 17339 - DNA, 71 bp, chicken (Gallus Gallus)
  misc_feature (36): n=c or g
ctcccaccttttttttttttttacttttcttgagangaatatgtatagataactattttatttacattgag

SEQ ID NO: 17340 - DNA, 71 bp, chicken (Gallus Gallus)
  misc_feature (36): n=c or t
ccctagccttgcttattttcacatcacacaagacantggaagactaaaacaacggcaaatgctcagacagc

SEQ ID NO: 17341 - DNA, 71 bp, chicken (Gallus Gallus)
  misc_feature (36): n=a or c
aatgtactgccatgcgtgtatttatctttctcaganttatgccatctactttgttttccatttcaaccttc

SEQ ID NO: 17342 - DNA, 71 bp, chicken (Gallus Gallus)
  misc_feature (36): n=g or t
atcataaggcagttgtttgtgtacttgttttgtttnagttctccaagaaggcttaaggctaaaaaagttaa

SEQ ID NO: 17343 - DNA, 71 bp, chicken (Gallus Gallus)
  misc_feature (36): n=a or g
aacacagctgaggtgtgacgggatccgaacaggtcngatgcttgaagtgaccatcagcttttctttgaaat

SEQ ID NO: 17344 - DNA, 71 bp, chicken (Gallus Gallus)
  misc_feature (36): n=c or t
cggctctccaccacacagaggagagcagcagcaagnctagagatctagagatgtgttggactacacgatct

SEQ ID NO: 17345 - DNA, 71 bp, chicken (Gallus Gallus)
  misc_feature (36): n=a or t
ccagtgaggatgtgtgatatactttcatacttctangctacttctgacagagcccagcagcctcctcctca

SEQ ID NO: 17346 - DNA, 71 bp, chicken (Gallus Gallus)
  misc_feature (36): n=c or g
gttcaacagtgacttagggtcctgtgagacaaatgnttgtcaataagcaattgacagaaatcataaaggaa

SEQ ID NO: 17347 - DNA, 71 bp, chicken (Gallus Gallus)
  misc_feature (36): n=c or t
ggtcagttttttctacagcaaaagaaatgtgagatnattattagtttctttggtatttttcttctgggtga

SEQ ID NO: 17348 - DNA, 71 bp, chicken (Gallus Gallus)
  misc_feature (36): n=a or g
tggtcagatgagtacaggttcctgcaactcagatgnacttactctacagtgtgtaatatcagaaggaagtt

SEQ ID NO: 17349 - DNA, 71 bp, chicken (Gallus Gallus)
  misc_feature (36): n=c or g
tcctacaggccgtgctgggctctagtggtgagcaancctgctagtcagcaaatcatgcactgagtgggcaa

SEQ ID NO: 17350 - DNA, 71 bp, chicken (Gallus Gallus)
  misc_feature (36): n=a or g
gaagataatggtgcattgcctcatttttgttggcancttttaataaacacacttaagcacgcacagtggga

SEQ ID NO: 17351 - DNA, 71 bp, chicken (Gallus Gallus)
  misc_feature (36): n=a or g
gagttttaagaccacaacaaaacaaattgaaaatanaattgtatgtgcagatagataggccgcatttatta

SEQ ID NO: 17352 - DNA, 71 bp, chicken (Gallus Gallus)
  misc_feature (36): n=a or g
attcccatgctgagaggtgatgaaaaggtaacaganttcagaaagcatatactgtagaagactttgaagta

SEQ ID NO: 17353 - DNA, 71 bp, chicken (Gallus Gallus)
  misc_feature (36): n=a or t
acattaaaaagataggtttaaatgatttgttaatangctcaaggtgaacattatcaggcttgtagccatca

SEQ ID NO: 17354 - DNA, 71 bp, chicken (Gallus Gallus)
  misc_feature (36): n=c or t
agcacaatcacagtattttaataaatatatataaanataggcatgtttttttctacactattttacaattc

SEQ ID NO: 17355 - DNA, 71 bp, chicken (Gallus Gallus)
  misc_feature (36): n=a or g
tgcaaagaggtctggcttcaccagaaacaaaatccntctctctgtcggcagttaaatccagctcaactccc

SEQ ID NO: 17356 - DNA, 71 bp, chicken (Gallus Gallus)
  misc_feature (36): n=c or t
aactccagaagtatgcctttcttgaaaatctgcaangacttaatcattcacagtaattgataagctattcg

SEQ ID NO: 17357 - DNA, 71 bp, chicken (Gallus Gallus)
  misc_feature (36): n=a or g
tttgggacagaaggcagtatttttcatagaaccatngaatggcctaagttgcaaaggcccacaatgctcac

SEQ ID NO: 17358 - DNA, 71 bp, chicken (Gallus Gallus)
  misc_feature (36): n=a or g
gaatgaggcacattggtttcaccaagctgtctttcntgggtagataataaaaaggcgaacactcgggatgt

SEQ ID NO: 17359 - DNA, 71 bp, chicken (Gallus Gallus)
  misc_feature (36): n=g or t
ttaggctggaaatcaggaataatttttcaggcacanaataggttgctcaggggaatggtggaatcctcatc

SEQ ID NO: 17360 - DNA, 71 bp, chicken (Gallus Gallus)
  misc_feature (36): n=a or g
gaaatcaagcaaagatcaaggaaaaccctttgaagntatgctcagggcacagtttcaaaactcagtttttc

SEQ ID NO: 17361 - DNA, 71 bp, chicken (Gallus Gallus)
  misc_feature (36): n=a or g
gccctggtaaatgagcttgtgcctttcctcttgccntggggtagcaaagatgaagcagaactcccagttgc

SEQ ID NO: 17362 - DNA, 71 bp, chicken (Gallus Gallus)
  misc_feature (36): n=g or t
ttgtgcagttaatgctgcatcctctactggaatcantatggacatgtcaaagcacaggagctgttccttgg

SEQ ID NO: 17363 - DNA, 71 bp, chicken (Gallus Gallus)
  misc_feature (36): n=a or c
agtctgatatgctcaaacttacagacttctcttaantcctgggagatacatccatttcagcttgctttagc

SEQ ID NO: 17364 - DNA, 71 bp, chicken (Gallus Gallus)
  misc_feature (36): n=c or t
cagaggattgcactcagtgctctcaagtccaagtcntccacctattattttaagaaagttgtccctgcagg

SEQ ID NO: 17365 - DNA, 71 bp, chicken (Gallus Gallus)
  misc_feature (36): n=g or t
tagtgagtggtaaataaaaaagaaaaatagagaaanagagaagaaatccatgttgacctcattgtactttt

SEQ ID NO: 17366 - DNA, 71 bp, chicken (Gallus Gallus)
  misc_feature (36): n=a or g
ctgccagcccaagttcagctctagctgcatccccantgtttgcactatcaatgtctaacgcaagacattga

SEQ ID NO: 17367 - DNA, 71 bp, chicken (Gallus Gallus)
  misc_feature (36): n=g or t
gcaaaccccacacctgtaaataaaaaaggacactangaaagttttatctccatgattttctcttatctggg

SEQ ID NO: 17368 - DNA, 71 bp, chicken (Gallus Gallus)
  misc_feature (36): n=g or t
ctgtttcattaataactcaattgtactcatcaagtncaatcctctcaatgttttatatgcatcaaactccc

SEQ ID NO: 17369 - DNA, 71 bp, chicken (Gallus Gallus)
  misc_feature (36): n=a or g
gcgtaaagaataaaagtatattaaactctctatganaatcatgtactctggttggacaaaggcttcagaat

SEQ ID NO: 17370 - DNA, 71 bp, chicken (Gallus Gallus)
  misc_feature (36): n=g or t
taataacataaaacacaaagcataaccccgaagttntcagaactgacctgcactagaagggtaggactgga

SEQ ID NO: 17371 - DNA, 71 bp, chicken (Gallus Gallus)
  misc_feature (36): n=a or g
ttcaagaagccataacgtaaaaaaatgagtaccacngagtaccactggccgggctcccagtttgctttctg

SEQ ID NO: 17372 - DNA, 71 bp, chicken (Gallus Gallus)
  misc_feature (36): n=c or t
tcctttacatgcaccagttagatgccacttagatanagtagcatggcaacagggtgcttggtagctgtgtt

SEQ ID NO: 17373 - DNA, 71 bp, chicken (Gallus Gallus)
  misc_feature (36): n=a or g
caactgcaccttccaactgataagaatgcaaacctntaaatctcagcattaccagcaaggtttggtacaac

SEQ ID NO: 17374 - DNA, 71 bp, chicken (Gallus Gallus)
  misc_feature (36): n=a or c
taaaaataaactttgtacttttattctatgaacaanaaaaggatttttctccttgcaaatgtgaatctgta

SEQ ID NO: 17375 - DNA, 71 bp, chicken (Gallus Gallus)
  misc_feature (36): n=c or g
tttcttatttatttaactactttgtttgtttgtctnttcaataggttcgttagtcagcttctgtgcagaga

SEQ ID NO: 17376 - DNA, 71 bp, chicken (Gallus Gallus)
  misc_feature (36): n=a or c
ctgacatccattcactccattgcccatttactaacnctggactatgagtattgtaggcagggtcattatcc

SEQ ID NO: 17377 - DNA, 71 bp, chicken (Gallus Gallus)
  misc_feature (36): n=a or g
ggttaagtaacacagcagctccttgatggtaagctnatgacctaaggctggggataacaggtcaaactggg

SEQ ID NO: 17378 - DNA, 71 bp, chicken (Gallus Gallus)
  misc_feature (36): n=a or g
aagtaaagtaaagtaaataatactggccttatacangcctattttctgctgagccaaattcatcctttcag

SEQ ID NO: 17379 - DNA, 71 bp, chicken (Gallus Gallus)
  misc_feature (36): n=c or t
ctcataaaacatattcattccctaatgcccagcagncaactgttttgactggtgtcaactatttgtttgca

SEQ ID NO: 17380 - DNA, 71 bp, chicken (Gallus Gallus)
  misc_feature (36): n=a or t
tagattaccacgccacatttttacattctccacctntttaaagatccactgaggaacatattcacacattc

SEQ ID NO: 17381 - DNA, 71 bp, chicken (Gallus Gallus)
  misc_feature (36): n=a or g
caaacaaagatgcagcgatgcctcttgtctgaaacntgctcttacttccttagtgaggagtattttacacc

SEQ ID NO: 17382 - DNA, 71 bp, chicken (Gallus Gallus)
  misc_feature (36): n=c or t
acacattaacatcaagatgccttgccaatacagatnccctgtaagtgacataatagcttgctttaagctta

SEQ ID NO: 17383 - DNA, 71 bp, chicken (Gallus Gallus)
  misc_feature (36): n=a or g
tgttctgctaaaatagctgaaggttaaacactgttnttgtatggacctgaaatattactatttaatggtgt

SEQ ID NO: 17384 - DNA, 71 bp, chicken (Gallus Gallus)
  misc_feature (36): n=a or g
cgtgggagtgcctcaaagctgcactagcaattaggnaaaagattttactgagagggtcattagacatggga

SEQ ID NO: 17385 - DNA, 71 bp, chicken (Gallus Gallus)
  misc_feature (36): n=a or t
gatgatgctactataatcagatgttaaataccatantaattttaaaaatatagaagaagaattagtgagga

SEQ ID NO: 17386 - DNA, 71 bp, chicken (Gallus Gallus)
  misc_feature (36): n=a or g
ttcctatttcttagtattgttaatttctaagtgccnatgctgtacaagaaagcagggattgtccctgcagc

SEQ ID NO: 17387 - DNA, 71 bp, chicken (Gallus Gallus)
  misc_feature (36): n=a or g
ggtggcaagattctaactttatttagctcaaaaaantgaattaagtatatttgaactgtgtagaagagaag

SEQ ID NO: 17388 - DNA, 71 bp, chicken (Gallus Gallus)
  misc_feature (36): n=a or g
actctccagccaatggagagtgctcttcttgcccantgctcttcttgggcatatgtgaagtaaacaaatta

SEQ ID NO: 17389 - DNA, 71 bp, chicken (Gallus Gallus)
  misc_feature (36): n=c or t
ctaatcccgttcctgtccccacgtgccctctacttntgttgagacaactttgtgctcagaattatttattt

SEQ ID NO: 17390 - DNA, 71 bp, chicken (Gallus Gallus)
  misc_feature (36): n=c or g
ttgaagttttcaatactggaaacatttagtccagantgtttgcaacggggtctctaatttctcatatggtt

SEQ ID NO: 17391 - DNA, 71 bp, chicken (Gallus Gallus)
  misc_feature (36): n=g or t
gcttgatgtgtattaaggagaaaactcaatggatanttgagatcagtcaaaaaacgtagaccttggaggat

SEQ ID NO: 17392 - DNA, 71 bp, chicken (Gallus Gallus)
  misc_feature (36): n=c or t
ttaaaataaactcattgaagtgttagtgcaatgtanccagcccatccaaatacagtatttctgtttcaaga

SEQ ID NO: 17393 - DNA, 71 bp, chicken (Gallus Gallus)
  misc_feature (36): n=c or t
cctgttcgcagagctttctgcttttttgccttttgngtttagttttgttttcccattttcatatttgcagt

SEQ ID NO: 17394 - DNA, 71 bp, chicken (Gallus Gallus)
  misc_feature (36): n=a or g
tatgtaccccaggctacttctggttaaatttgaganaatagttactttatttttcctgcattttcagattc

SEQ ID NO: 17395 - DNA, 71 bp, chicken (Gallus Gallus)
  misc_feature (36): n=c or t
tcaacagccactatgtgcaggtaataggcctgatgngtgcgggacccagagcagctaggtaccaatggctt

SEQ ID NO: 17396 - DNA, 71 bp, chicken (Gallus Gallus)
  misc_feature (36): n=a or g
tttttaagctactttaaactcacaaagtagccggtnagtgttttgctaaattcatggcaatggctgtcctt

SEQ ID NO: 17397 - DNA, 71 bp, chicken (Gallus Gallus)
  misc_feature (36): n=c or t
gtacagtgcaaactattcagaaaagcttgatgagantgacagtagtaacatgatctaaaatctgagcacac

SEQ ID NO: 17398 - DNA, 71 bp, chicken (Gallus Gallus)
  misc_feature (36): n=c or t
gaaatagagggaaaacactgtgactgttgaatgtcntaagacacatacagtacatagacacattcatatga

SEQ ID NO: 17399 - DNA, 71 bp, chicken (Gallus Gallus)
  misc_feature (36): n=c or t
aaataattatatttttagcaaacaaaacagaatagnaataaagatgtcattttggcaccttgcagtagagt

SEQ ID NO: 17400 - DNA, 71 bp, chicken (Gallus Gallus)
  misc_feature (36): n=c or t
aataattcttgcttcaggtgtccttactccttatgncattaagtcaattgttttaccacaccttgtcccat

SEQ ID NO: 17401 - DNA, 71 bp, chicken (Gallus Gallus)
  misc_feature (36): n=c or t
caacaatcaggtgacaatgactacttttagcagtgnacgcagtcatgattcattgcaatcaacgtcggtac

SEQ ID NO: 17402 - DNA, 71 bp, chicken (Gallus Gallus)
  misc_feature (36): n=g or t
gttttacttatttatttattaaatttctgatatctntttgatctcttcctacaaagtttgtgttctgataa

SEQ ID NO: 17403 - DNA, 71 bp, chicken (Gallus Gallus)
  misc_feature (36): n=a or t
ctcatatccttgaaatgtaggtaaccataaagaatntaagtacttgccagtcttggaacccagcattgaaa

SEQ ID NO: 17404 - DNA, 71 bp, chicken (Gallus Gallus)
  misc_feature (36): n=a or g
gagtatttaagtattttacagcaaaatggaacaccnttaggataaattgagagtgatgtgtgtgtatcatg

SEQ ID NO: 17405 - DNA, 71 bp, chicken (Gallus Gallus)
  misc_feature (36): n=a or g
ttgtttgtgtgtttgtgtgtgtgtataaatatgttncagttgaaatgtacatctgcaggtgctgcttaaaa

SEQ ID NO: 17406 - DNA, 71 bp, chicken (Gallus Gallus)
  misc_feature (36): n=c or t
ctcctaaagataaatgagtctcacaggggcattccntcagcaggtcagtttacacgcccatgtgtttgtag

SEQ ID NO: 17407 - DNA, 71 bp, chicken (Gallus Gallus)
  misc_feature (36): n=c or t
agttgatcccattacacaaatgcctaatgcataccngccacttctcatgatgaaaatttaagagagaatat

SEQ ID NO: 17408 - DNA, 71 bp, chicken (Gallus Gallus)
  misc_feature (36): n=a or g
ttgtctgcgatactgaatatcatgattcaggaattncattttgagtacaagtgataaaaattcacctgcaa

SEQ ID NO: 17409 - DNA, 71 bp, chicken (Gallus Gallus)
  misc_feature (36): n=c or t
aatgcttctccccagttttacaatatccacactatncctgcgtagttgcaaaactatatatatagggcacc

SEQ ID NO: 17410 - DNA, 71 bp, chicken (Gallus Gallus)
  misc_feature (36): n=a or c
atattagcaaaagatcttggcgttcaagtgcaagantggaccaatccaatatctttagacttcacaaaaga

SEQ ID NO: 17411 - DNA, 71 bp, chicken (Gallus Gallus)
  misc_feature (36): n=a or g
gcagctatgctatagtagtaaacctttaattgtcantggaagtagcaatgctaggtttgttttcttgtcat

SEQ ID NO: 17412 - DNA, 71 bp, chicken (Gallus Gallus)
  misc_feature (36): n=a or g
acatcataccatttccaaaactgcaggaaacatacngagtgcagagaaaacctcggaagcagatataattt

SEQ ID NO: 17413 - DNA, 71 bp, chicken (Gallus Gallus)
  misc_feature (36): n=g or t
accatttatttaggatgcagtatgtaacttcaaatnctctcacacctgaataaattaaattccttgagatt

SEQ ID NO: 17414 - DNA, 71 bp, chicken (Gallus Gallus)
  misc_feature (36): n=a or g
agaagtttcatcgactggaagctggcagacatcccngttttcaagaagggcaagaaagaagacgctggtaa

SEQ ID NO: 17415 - DNA, 71 bp, chicken (Gallus Gallus)
  misc_feature (36): n=c or t
acaacttacggacccagactggcaacggtaattgcntttgctatgtacttctgtgcatgaattgttaggca

SEQ ID NO: 17416 - DNA, 71 bp, chicken (Gallus Gallus)
  misc_feature (36): n=c or t
aagtgtaatagaatcaccgaactattgcagatagcntcctgtatctgtatttatgtttgcacatagatgta

SEQ ID NO: 17417 - DNA, 71 bp, chicken (Gallus Gallus)
  misc_feature (36): n=a or g
atctaattcaggcacatttaataaaaacatatgggngacaggtctcagatcttagtttacgtcatatcctc

SEQ ID NO: 17418 - DNA, 71 bp, chicken (Gallus Gallus)
  misc_feature (36): n=a or c
tgatcaggacacgttatgtgaagttctgtgtccagngtgtgctgctggaatccagtggcatagtctttgca

SEQ ID NO: 17419 - DNA, 71 bp, chicken (Gallus Gallus)
  misc_feature (36): n=a or g
taccattcattttccctcaaaaaagagcagctttcncattgaacaagaagttaaatcttatctactatgac

SEQ ID NO: 17420 - DNA, 71 bp, chicken (Gallus Gallus)
  misc_feature (36): n=a or g
tcactatcttatattgcagcctggtttagttgtgtntgaccacattttggaagtatgaaatctgcttgata

SEQ ID NO: 17421 - DNA, 71 bp, chicken (Gallus Gallus)
  misc_feature (36): n=c or t
cccaagctcctcatctcagaatgccactatcacaanactgcacacaacaaataaaagtatagagtcccaat

SEQ ID NO: 17422 - DNA, 71 bp, chicken (Gallus Gallus)
  misc_feature (36): n=a or c
aatatgttttgctacattaacagtcagctcattaangttcagaaatatttcagggcagttcacctcaggaa

SEQ ID NO: 17423 - DNA, 71 bp, chicken (Gallus Gallus)
  misc_feature (36): n=c or t
acaaacaagccagctgttggcattctgataagaaanactgatgctctcaaagcactggaactgagttgacc

SEQ ID NO: 17424 - DNA, 71 bp, chicken (Gallus Gallus)
  misc_feature (36): n=a or g
atatatttcccttgaaaaatattctaattcactccnacgttacccacaacactcacatgagtcataatcat

SEQ ID NO: 17425 - DNA, 71 bp, chicken (Gallus Gallus)
  misc_feature (36): n=a or g
cagttgtctcacacagatgtaataaaaactttaggnaaaagtctttgtagaagaaaagtgctgttttcctt

SEQ ID NO: 17426 - DNA, 71 bp, chicken (Gallus Gallus)
  misc_feature (36): n=a or t
aatgtaataacatagaaagcttgtcccttagcatgnagttaaggaattgaagaaaaaaattagctatagtc

SEQ ID NO: 17427 - DNA, 71 bp, chicken (Gallus Gallus)
  misc_feature (36): n=a or c
cactgacaatttaatggcagggctttgcacttcagnattcctgctccgagagacttttcctacctgttggt

SEQ ID NO: 17428 - DNA, 71 bp, chicken (Gallus Gallus)
  misc_feature (36): n=a or g
taagaacgtatgtaaatatggtaacaaatatactcntagacttttctttcatacagactttagaaattcta

SEQ ID NO: 17429 - DNA, 71 bp, chicken (Gallus Gallus)
  misc_feature (36): n=a or g
aggagaaaaaaatgaaaaatccaacattgcttaatntacaacatgtttttaatgtttcctttctgaaaaga

SEQ ID NO: 17430 - DNA, 71 bp, chicken (Gallus Gallus)
  misc_feature (36): n=a or g
atcacacttcatctgaaagcctcattcatatattancaaaagatgcactttaagcagacagcaaaaaggta

SEQ ID NO: 17431 - DNA, 71 bp, chicken (Gallus Gallus)
  misc_feature (36): n=a or t
tgcacaagatgttcagaaataagacaaactggaaangattctcactgctctgctatcattccccatttatc

SEQ ID NO: 17432 - DNA, 71 bp, chicken (Gallus Gallus)
  misc_feature (36): n=a or g
ttttaaatggtcattattctatatgcaaacaagganctgaatttaacttatgtttgagcccagtaatgttt

SEQ ID NO: 17433 - DNA, 71 bp, chicken (Gallus Gallus)
  misc_feature (36): n=a or g
acagcagaaattaaatggatagctaaatggtgtctncatgcaaactccaaataagtccacctccacctgaa

SEQ ID NO: 17434 - DNA, 71 bp, chicken (Gallus Gallus)
  misc_feature (36): n=g or t
agggaaaagcagcatgtttttttgtcaggatcaagncttctagttgtttcctgtaacatcctcagtgacaa

SEQ ID NO: 17435 - DNA, 71 bp, chicken (Gallus Gallus)
  misc_feature (36): n=c or t
gaatctgagaataaaaaactgaagaatgagttgaangagctgcagaaggccctcacagaaacacgagctcc

SEQ ID NO: 17436 - DNA, 71 bp, chicken (Gallus Gallus)
  misc_feature (36): n=c or g
ctgcagtgacagctcaatatctcgtggctgcatacntcccttctaccttagacacggtgtgttgtaagagt

SEQ ID NO: 17437 - DNA, 71 bp, chicken (Gallus Gallus)
  misc_feature (36): n=a or g
gaaatgctccaaaccaacctcctagtatactgcacntcgtagtaatctgtaggctgttttcccagatggac

SEQ ID NO: 17438 - DNA, 71 bp, chicken (Gallus Gallus)
  misc_feature (36): n=a or g
atgctcggccttataggacgtatcattagcatggcncttcagagtcaggatgaatttgacaaactgttctg

SEQ ID NO: 17439 - DNA, 71 bp, chicken (Gallus Gallus)
  misc_feature (36): n=c or t
agttcttcagctgtttactttggactaaatcaattngattaatttggctcctctggcttttttgttgattt

SEQ ID NO: 17440 - DNA, 71 bp, chicken (Gallus Gallus)
  misc_feature (36): n=a or g
tgctttcactgaataaagtactgcagattttctcanctgaatgaggtaaggtcacattttgggtgcactaa

SEQ ID NO: 17441 - DNA, 71 bp, chicken (Gallus Gallus)
  misc_feature (36): n=a or g
gaggggtccagggcctgcttattctttttgtctagncttcgcagtctctaggctagctcagggtttgcctt

SEQ ID NO: 17442 - DNA, 71 bp, chicken (Gallus Gallus)
  misc_feature (36): n=a or c
ccaaagcccagttgcaaaacatgtcctgggatcatngctgcactgtgggtttcggaagaaagtgaaggaac

SEQ ID NO: 17443 - DNA, 71 bp, chicken (Gallus Gallus)
  misc_feature (36): n=c or t
tgcaagtttcctgcaatcctaagatactccaattcnttttcacgccctagtaagcagttgtctttactatc

SEQ ID NO: 17444 - DNA, 71 bp, chicken (Gallus Gallus)
  misc_feature (36): n=a or c
ctaccagcccttctgagcttgtctgtttatttagcnctttagtaatgccacagtaaataagatttcatttc

SEQ ID NO: 17445 - DNA, 71 bp, chicken (Gallus Gallus)
  misc_feature (36): n=a or c
atatctttgcaaagttaactgtagaatctaagtagnaaatacagctcaatatgaataaggtaattgcaagt

SEQ ID NO: 17446 - DNA, 71 bp, chicken (Gallus Gallus)
  misc_feature (36): n=c or t
gaaaagtcctttgcaactcacattatgacccaaccnacagtcatgttataaaatgccattttctccaaggg

SEQ ID NO: 17447 - DNA, 71 bp, chicken (Gallus Gallus)
  misc_feature (36): n=a or c
tctcagaagtcaaaaattcatgaagcaatacactgnatctcctgaaagagtttaggaatggctgctttcct

SEQ ID NO: 17448 - DNA, 71 bp, chicken (Gallus Gallus)
  misc_feature (36): n=c or t
gcaaacttggccacttcagtcgaatgtaaggatacnggttttatctggcatgtagtaagagaagatttgtt

SEQ ID NO: 17449 - DNA, 71 bp, chicken (Gallus Gallus)
  misc_feature (36): n=a or g
aaggccaatggagaacatccctgaaaacagtgtgtncatgtgtggctttgcatagcaagccccatgctgtg

SEQ ID NO: 17450 - DNA, 71 bp, chicken (Gallus Gallus)
  misc_feature (36): n=a or g
aatgcaatctggacataaatgcagtcttcaacaccntgtcccagacagtgctcaaccagcctgcagcaatg

SEQ ID NO: 17451 - DNA, 71 bp, chicken (Gallus Gallus)
  misc_feature (36): n=a or c
cttgagactgaaatgtgctgggtgggggcacgctgnaattcatctctcaatgccttggacttgaaaattaa

SEQ ID NO: 17452 - DNA, 71 bp, chicken (Gallus Gallus)
  misc_feature (36): n=g or t
gcgctgctcttaacattccaattaaacattcttttncagcttgaccctgaactaccacacagaaccccttt

SEQ ID NO: 17453 - DNA, 71 bp, chicken (Gallus Gallus)
  misc_feature (36): n=a or g
gtaggactggacacgggactaaaaatgaaagtcagnactcctaaattgaaatcccacttgtttaataggga

SEQ ID NO: 17454 - DNA, 71 bp, chicken (Gallus Gallus)
  misc_feature (36): n=a or t
tagtaaccctcccttatctgctgtgctgaccacccnaaaacatttcctagcatttccttagcacaaaataa

SEQ ID NO: 17455 - DNA, 71 bp, chicken (Gallus Gallus)
  misc_feature (36): n=a or c
ttacagctgtgcaattgcatttaaaaacagtagggntacatggctgagatttgctctatttatctttgaag

SEQ ID NO: 17456 - DNA, 71 bp, chicken (Gallus Gallus)
  misc_feature (36): n=c or t
gagaatgtgcaataagtaacaaattcagtgaacaantgtatttattatcctctgtttctcctatttcaccc

SEQ ID NO: 17457 - DNA, 71 bp, chicken (Gallus Gallus)
  misc_feature (36): n=a or c
gtttatggtccaattcagaactccttaatgtagaanataaattgtactctcctgtactgctgaaggatctg

SEQ ID NO: 17458 - DNA, 71 bp, chicken (Gallus Gallus)
  misc_feature (36): n=g or t
ctgtcttgataagacattgaaagtcagcgttgaaantttatcaacaggagttctgctttgattgtgcaagg

SEQ ID NO: 17459 - DNA, 71 bp, chicken (Gallus Gallus)
  misc_feature (36): n=a or g
gtttgtgtgaagattcatagccttgcatggatcacnttctgggcagaaaagaaccaccttggggaaaaaaa

SEQ ID NO: 17460 - DNA, 71 bp, chicken (Gallus Gallus)
  misc_feature (36): n=a or g
tctcaagttcaaaaagaaacttccagttcgaccaantgaagtctcaaaactatatgcgagaagagaacata

SEQ ID NO: 17461 - DNA, 71 bp, chicken (Gallus Gallus)
  misc_feature (36): n=a or t
atatatgtttgttatgagactgatggcaagatgttncagctgtcaaattctggtgaagttactaaattaac

SEQ ID NO: 17462 - DNA, 71 bp, chicken (Gallus Gallus)
  misc_feature (36): n=a or g
tgatgacattttttgactaatcattgaagcaagacnaaattaaaattatttctgatctggtacagatgtaa

SEQ ID NO: 17463 - DNA, 71 bp, chicken (Gallus Gallus)
  misc_feature (36): n=a or g
tccgacgtgactttccctaggcttcagtttcatganggaaataagaatcttttctcattgccatttggatt

SEQ ID NO: 17464 - DNA, 71 bp, chicken (Gallus Gallus)
  misc_feature (36): n=a or t
ctaggaaaccgtttgctatagatatgtgggtagttnaagaagtaatgtaggtgagaggtagagagacagtt

SEQ ID NO: 17465 - DNA, 71 bp, chicken (Gallus Gallus)
  misc_feature (36): n=a or g
accaaacgcttacaagtcactaagactgtggagtcngaagaaaagcaagcatagttcaacactgtatctgg

SEQ ID NO: 17466 - DNA, 71 bp, chicken (Gallus Gallus)
  misc_feature (36): n=c or t
aagactctgtcaatgccaaaagagaatgtttcaaanctgaatgacatcattaactgtggcatttatcagct

SEQ ID NO: 17467 - DNA, 71 bp, chicken (Gallus Gallus)
  misc_feature (36): n=c or t
agaagaatcgcaaggacccttctgttaaggtttccnattgcctgcctaaagattcctcttgtgcagtgctt

SEQ ID NO: 17468 - DNA, 71 bp, chicken (Gallus Gallus)
  misc_feature (36): n=c or g
ttgctcgagtaggatattgaagtgtgagatgaatcnttgcagagcaggtaatcatagaatcagaatcatag

SEQ ID NO: 17469 - DNA, 71 bp, chicken (Gallus Gallus)
  misc_feature (36): n=a or g
gctttgcctccaaacaagatagcgtacgtgctactntgtagaacagaatcaaagaatcacagcatcatttg

SEQ ID NO: 17470 - DNA, 71 bp, chicken (Gallus Gallus)
  misc_feature (36): n=a or g
gcctgggcaacctgtgccagtgcctcaccacccttnttgtaaaaaaacattaagattcttacatccaatct

SEQ ID NO: 17471 - DNA, 71 bp, chicken (Gallus Gallus)
  misc_feature (36): n=c or t
gggtgttatttgccattttataggagaaagagcacngatacctgttgaatctactgagttggaaagcatca

SEQ ID NO: 17472 - DNA, 71 bp, chicken (Gallus Gallus)
  misc_feature (36): n=a or g
acgatgcagttgtagaactgtaatcaaatgaagtcnattagaactggtgacacatactactaaaatgactc

SEQ ID NO: 17473 - DNA, 71 bp, chicken (Gallus Gallus)
  misc_feature (36): n=a or g
tctgcatttggacgacagctttcctgaagctctacnaaaccaacccggactttttgccttgtggcctctcc

SEQ ID NO: 17474 - DNA, 71 bp, chicken (Gallus Gallus)
  misc_feature (36): n=c or g
gctacaagcagctcacagttacggtttacttttaangccaaataaattaaacagtgttcttgttgcatgtt

SEQ ID NO: 17475 - DNA, 71 bp, chicken (Gallus Gallus)
  misc_feature (36): n=a or c
ctcgtcaaacagtagaaaacaaagacctgtaagacnaaaagaacttgcttcgttgctgctgttaatcccag

SEQ ID NO: 17476 - DNA, 71 bp, chicken (Gallus Gallus)
  misc_feature (36): n=a or g
ctgtgtggggaaaatgtggtcatattaatgcattcntacattacaataacaaacaccactgttttaatggg

SEQ ID NO: 17477 - DNA, 71 bp, chicken (Gallus Gallus)
  misc_feature (36): n=a or c
gaggcttttctgctttagggatactgacaactattntctcccatacactacacttgcaaccatggtcatta

SEQ ID NO: 17478 - DNA, 71 bp, chicken (Gallus Gallus)
  misc_feature (36): n=c or t
gtaatacctagagcgactcttctcacgtgttcaatnaggagaaagtcaaaactgaccctcatgctgagtgc

SEQ ID NO: 17479 - DNA, 71 bp, chicken (Gallus Gallus)
  misc_feature (36): n=g or t
gctttcttcagctattaagttttccattcctgaggntcttcagtctgaataaatgcagaaagaagacattt

SEQ ID NO: 17480 - DNA, 71 bp, chicken (Gallus Gallus)
  misc_feature (36): n=c or t
catgggtacaattcctcatttgcttacactttcacngtgccttgtgagtacagagaggctgccttcagtct

SEQ ID NO: 17481 - DNA, 71 bp, chicken (Gallus Gallus)
  misc_feature (36): n=c or g
aagtgtaggagtttgtggtgcccttagcgtgctttnttgcactggtttcttctggtggttgtttaagtgac

SEQ ID NO: 17482 - DNA, 71 bp, chicken (Gallus Gallus)
  misc_feature (36): n=c or g
aaggtggtgcacttaattcagcattttcatatttgntgtcagtaatggagaagtcacaggctctgcctttg

SEQ ID NO: 17483 - DNA, 71 bp, chicken (Gallus Gallus)
  misc_feature (36): n=c or t
gctccagcttaaggccgcagctctgagcacacagcntcaggctgatgacgtctgctgtgtaatccagcaca

SEQ ID NO: 17484 - DNA, 71 bp, chicken (Gallus Gallus)
  misc_feature (36): n=a or g
tttctctctgtaatagtatttctgagttcagaaggnatttcccctgtaggggcacagacagaaaggcctgc

SEQ ID NO: 17485 - DNA, 71 bp, chicken (Gallus Gallus)
  misc_feature (36): n=c or t
gttcttttgagttaatttttttttatatatatatanacatatatacacttaagaattaattgttcagtagt

SEQ ID NO: 17486 - DNA, 71 bp, chicken (Gallus Gallus)
  misc_feature (36): n=a or t
cttaaatagattggtcattaattgctttcattaggncatgtgccctctgctttcaggaatccccatagcct

SEQ ID NO: 17487 - DNA, 71 bp, chicken (Gallus Gallus)
  misc_feature (36): n=a or g
caatgatttgcaaatatttttgagggctttactgcntggaaggaatggagaaagggcttctctacaggtag

SEQ ID NO: 17488 - DNA, 71 bp, chicken (Gallus Gallus)
  misc_feature (36): n=a or g
taataaataaaaataaagaaagaaataaactattgnaaactgttagaggcatgaagccagtatttcacaga

SEQ ID NO: 17489 - DNA, 71 bp, chicken (Gallus Gallus)
  misc_feature (36): n=g or t
gctttgttgattttctcagaagttgttcagatttangaatttatgggatgcctgtgtaaagatgaaaacat

SEQ ID NO: 17490 - DNA, 71 bp, chicken (Gallus Gallus)
  misc_feature (36): n=c or t
ttccaaactatgtcctaagccttctcagaagttctnctgattttggataagatatgaaatgtgttgtatgt

SEQ ID NO: 17491 - DNA, 71 bp, chicken (Gallus Gallus)
  misc_feature (36): n=a or t
agcgcaggaatcaagcgagagctgaaaacatcattngcaaccaaaaagcatccagaagtgttttcctttct

SEQ ID NO: 17492 - DNA, 71 bp, chicken (Gallus Gallus)
  misc_feature (36): n=a or g
gtatctgaaggaagtggtgaatagctctaagaaatntcagctgaagatcaagtgaatcattgtcaatttaa

SEQ ID NO: 17493 - DNA, 71 bp, chicken (Gallus Gallus)
  misc_feature (36): n=g or t
ttattgtaagaacttttctttatgtccagcctaaanctctattcattctaaatctctaatgatttgtatga

SEQ ID NO: 17494 - DNA, 71 bp, chicken (Gallus Gallus)
  misc_feature (36): n=g or t
ttttatttatttatttatttataatattgccacccnctgcaaaatatacaaaataaatgaaatcttctcgt

SEQ ID NO: 17495 - DNA, 71 bp, chicken (Gallus Gallus)
  misc_feature (36): n=c or t
aacaaaatttactgttctcagcctgactcactccanaacatttcaaggacctcagcaatcagtcaaaagac

SEQ ID NO: 17496 - DNA, 71 bp, chicken (Gallus Gallus)
  misc_feature (36): n=a or g
aatgtaatctctatccagagagatgctgctctctcngctgctcacagttaagtgagagtgggtgaattcag

SEQ ID NO: 17497 - DNA, 71 bp, chicken (Gallus Gallus)
  misc_feature (36): n=a or g
tttaatttaacctttttctccaaatccaaaagcaanggtgacatgtggtaaacttggtaaacttagatttg

SEQ ID NO: 17498 - DNA, 71 bp, chicken (Gallus Gallus)
  misc_feature (36): n=a or g
ctgttgaatttgagctctcagattgcctgatgtccntgcctggatggatagtggacctttaccaaactact

SEQ ID NO: 17499 - DNA, 71 bp, chicken (Gallus Gallus)
  misc_feature (36): n=a or g
aatgggagctatagaagagcaaagccgacagtgtcnattttgaaaggaaaaataaacaaatataccacagt

SEQ ID NO: 17500 - DNA, 71 bp, chicken (Gallus Gallus)
  misc_feature (36): n=c or t
caagccgaatgggtgtagaagctgtgcttgcacttntagaagctactccagacactcctgcttgtgttgtg

SEQ ID NO: 17501 - DNA, 71 bp, chicken (Gallus Gallus)
  misc_feature (36): n=a or c
atcttagaaaagacaaatattaattgcaacaactgnacaaataacaaaggtagggtgttaaaaaaaatagt

SEQ ID NO: 17502 - DNA, 71 bp, chicken (Gallus Gallus)
  misc_feature (36): n=a or g
aaatgcggccttccaaatacttgaaatgttcctttnattttgtctcattaaagggcaaggaacagaaagac

SEQ ID NO: 17503 - DNA, 71 bp, chicken (Gallus Gallus)
  misc_feature (36): n=a or t
gatgtcacctattttgagcagataagtaacgttagnttgagtgaaagaaaagtagagagaaaaggtgtttc

SEQ ID NO: 17504 - DNA, 71 bp, chicken (Gallus Gallus)
  misc_feature (36): n=c or t
aatctgagacaaacctctgttcacatgaaccagggnataaatggaatcctgtctgtttgtgtatctggttc

SEQ ID NO: 17505 - DNA, 71 bp, chicken (Gallus Gallus)
  misc_feature (36): n=a or g
ccaaccccagcgagcaggagggcaatgccttcatcntggcttacaagcagagcctgacaggaagcatagaa

SEQ ID NO: 17506 - DNA, 71 bp, chicken (Gallus Gallus)
  misc_feature (36): n=a or t
aagtcactgacgcaggagaattggactttttggcangataaggacctgaatctggtttccctgttctacac

SEQ ID NO: 17507 - DNA, 71 bp, chicken (Gallus Gallus)
  misc_feature (36): n=a or t
tattttcacttccactgtaagaataacatgaagacnagaacataatttacataataaagtggatggaggtt

SEQ ID NO: 17508 - DNA, 71 bp, chicken (Gallus Gallus)
  misc_feature (36): n=c or t
ttcagagatgttttatgtgaggaaatcctgtagccnggctggtgagggtcagggtttttctctagggactc

SEQ ID NO: 17509 - DNA, 71 bp, chicken (Gallus Gallus)
  misc_feature (36): n=c or t
agaggtactagcagaggttcagggtcgtggttaacntgtggactgcaccattctgtcttttaatcaccaac

SEQ ID NO: 17510 - DNA, 71 bp, chicken (Gallus Gallus)
  misc_feature (36): n=c or t
cttttcatggacacgtgcttcattggtcaacattangggaagaagccaagccatgaggccaggtcttgttc

SEQ ID NO: 17511 - DNA, 71 bp, chicken (Gallus Gallus)
  misc_feature (36): n=g or t
gaagagtagtgatgtagtgaaaactagtggtatgtnagaacaggaagcttgagagcatctggaggaaatct

SEQ ID NO: 17512 - DNA, 71 bp, chicken (Gallus Gallus)
  misc_feature (36): n=a or g
tattttgttagtagccttcatttaatttggcataancttgaattactgaacttctgataaatgagctaaag

SEQ ID NO: 17513 - DNA, 71 bp, chicken (Gallus Gallus)
  misc_feature (36): n=c or t
aacagccagtattttctagtttgtactttaatcagngtctggaattagatttcaggacctggcagttagtg

SEQ ID NO: 17514 - DNA, 71 bp, chicken (Gallus Gallus)
  misc_feature (36): n=g or t
cattgtttcaggagcagtaaaaccaaggggctaccntggtgatgttaattctccatgataaatcttcatga

SEQ ID NO: 17515 - DNA, 71 bp, chicken (Gallus Gallus)
  misc_feature (36): n=c or t
atcaaagtcacccctgtaagcaactgagggtactgntgaagagtaaatgatattacattcagaaagatcag

SEQ ID NO: 17516 - DNA, 71 bp, chicken (Gallus Gallus)
  misc_feature (36): n=c or t
ttgtgtcagcttgtgctgagtgggcacatagctttngtattcattctagcacagttactcctgttttgcct

SEQ ID NO: 17517 - DNA, 71 bp, chicken (Gallus Gallus)
  misc_feature (36): n=a or g
atcacataccatagtatttcaaggacagagaacagnctgttatatttaaaagcatagatatagcttcagta

SEQ ID NO: 17518 - DNA, 71 bp, chicken (Gallus Gallus)
  misc_feature (36): n=g or t
gctctctgattggataacagagcccgtgacgtgtcnctcgatacgaacggctctgtaattggtccatcaca

SEQ ID NO: 17519 - DNA, 71 bp, chicken (Gallus Gallus)
  misc_feature (36): n=a or g
atacctgtaagttctactgtgctacaaaactcttanctgaagctgtttgtgttttcaataagaatgatgaa

SEQ ID NO: 17520 - DNA, 71 bp, chicken (Gallus Gallus)
  misc_feature (36): n=c or t
gtgggaatcttccccaacctctgccaggccaaccangactgctggcccaactgtactgtcatcttcaacaa

SEQ ID NO: 17521 - DNA, 71 bp, chicken (Gallus Gallus)
  misc_feature (36): n=c or g
tctcttttacactgtcatttagcagtgtttcttcanctttctctggcttctgtttaagcaagtctctcttt

SEQ ID NO: 17522 - DNA, 71 bp, chicken (Gallus Gallus)
  misc_feature (36): n=c or t
agtaaagggcttgtgaactctgtaaagggtttgctncgtgaattgctgcccgggaagaggagctggtcagt

SEQ ID NO: 17523 - DNA, 71 bp, chicken (Gallus Gallus)
  misc_feature (36): n=c or t
taaacccagtagctgaaactgaagaatccaaatagnttaaaacacaagtcactaaatagaaaaaatgacta

SEQ ID NO: 17524 - DNA, 71 bp, chicken (Gallus Gallus)
  misc_feature (36): n=a or g
cacttctcaatgtaaaaataaataaaacacacctcntgagcttgatgtgtggtcttcaacccacaggcttt

SEQ ID NO: 17525 - DNA, 71 bp, chicken (Gallus Gallus)
  misc_feature (36): n=a or t
ttctcatatccagtctcttcagattgcaaataaagngatgtttaattcacttttattttcctttaagtact

SEQ ID NO: 17526 - DNA, 71 bp, chicken (Gallus Gallus)
  misc_feature (36): n=c or t
atggaaatatcagctttactgcaacaattcatagantgaaaaaaaaccctcatcatttccatatgaaacac

SEQ ID NO: 17527 - DNA, 71 bp, chicken (Gallus Gallus)
  misc_feature (36): n=g or t
ggatggagcatccacagcttctctgggcagcctgtnccaatgaaaatttgggataaatgtggatggtcttc

SEQ ID NO: 17528 - DNA, 71 bp, chicken (Gallus Gallus)
  misc_feature (36): n=a or c
cgttacttcagcagttaataaaacttatgattttgnagttatcaatcactttaacgaattcagaaagtgaa

SEQ ID NO: 17529 - DNA, 71 bp, chicken (Gallus Gallus)
  misc_feature (36): n=c or t
tatgaaatctgctgaggggagagttatgtctgagtngctttctgtaagcacgtttgactgagtgacagaat

SEQ ID NO: 17530 - DNA, 71 bp, chicken (Gallus Gallus)
  misc_feature (36): n=c or t
aggagatgtagttttaggcacgcactggggagtagntgagtccctttactgaaggagatttcatctcacat

SEQ ID NO: 17531 - DNA, 71 bp, chicken (Gallus Gallus)
  misc_feature (36): n=g or t
agtggtgttgctgaacgtcaaaacagaagaggaganggaaaccttatggtcaggcctgactttttcatgaa

SEQ ID NO: 17532 - DNA, 71 bp, chicken (Gallus Gallus)
  misc_feature (36): n=a or g
tcctgggatttgtagattagttcattaacattctanaccaggctggtcaaagatttggatggtgatcagac

SEQ ID NO: 17533 - DNA, 71 bp, chicken (Gallus Gallus)
  misc_feature (36): n=c or t
acatgggattattctctgtccctgcacccaatcagngtaattcagtcacattattaaaacttccttactct

SEQ ID NO: 17534 - DNA, 71 bp, chicken (Gallus Gallus)
  misc_feature (36): n=a or c
tataagtttgtactgatattgagagctgtaacattnacaaaaatattttggtaaaaagtagttgtaaactg

SEQ ID NO: 17535 - DNA, 71 bp, chicken (Gallus Gallus)
  misc_feature (36): n=g or t
tatccatcaacctcaattgattttccttctggtttngggtttagaaattaaaattgtcttgactatttacc

SEQ ID NO: 17536 - DNA, 71 bp, chicken (Gallus Gallus)
  misc_feature (36): n=a or g
cttctcctattaaggtagggaaataagagactgtcntggcagttagctgttggtcagctaaggtcaaccca

SEQ ID NO: 17537 - DNA, 71 bp, chicken (Gallus Gallus)
  misc_feature (36): n=a or g
cagccacccacttctttgtttgattgtcttttctcnctgaaacatatgcttccccttttccatggcatttc

SEQ ID NO: 17538 - DNA, 71 bp, chicken (Gallus Gallus)
  misc_feature (36): n=c or t
aaatgcagacaaaatacagtgggaacttccagatancagtgaaggaacaatattctttctgtcctcagaga

SEQ ID NO: 17539 - DNA, 71 bp, chicken (Gallus Gallus)
  misc_feature (36): n=c or t
attttagcatttcagagtcttttaaaagcagaaaanatgagtcagcaagaatttctttttaacttctattt

SEQ ID NO: 17540 - DNA, 71 bp, chicken (Gallus Gallus)
  misc_feature (36): n=a or g
tgaatacatttagaaatttagtcaactgctgcactngacggagtttaggatatcatatatttccaaacaaa

SEQ ID NO: 17541 - DNA, 71 bp, chicken (Gallus Gallus)
  misc_feature (36): n=g or t
cctaaaccttgctgttccccttggttgtgacttcanacctggataaaagcaacatacatataataaatacc

SEQ ID NO: 17542 - DNA, 71 bp, chicken (Gallus Gallus)
  misc_feature (36): n=a or g
gtaagatgatctcttgtatcactcaggccgcatacntgctttctgcccttacccatcatctgtgtcatctg

SEQ ID NO: 17543 - DNA, 71 bp, chicken (Gallus Gallus)
  misc_feature (36): n=c or t
atagaagttacagtaaccaaatacctccatttcccnccacttagttccaaactatcagttccactatcagt

SEQ ID NO: 17544 - DNA, 71 bp, chicken (Gallus Gallus)
  misc_feature (36): n=g or t
gctgtgaggtccacgctcacccttctggctctgtcngactgtgacaggtttcagaacttccttttcaggtt

SEQ ID NO: 17545 - DNA, 71 bp, chicken (Gallus Gallus)
  misc_feature (36): n=c or t
gctcagacattgcaatgtgcagaatcaaaggctaantggaaaagacaaaatctaagactcatttgaatgtc

SEQ ID NO: 17546 - DNA, 71 bp, chicken (Gallus Gallus)
  misc_feature (36): n=a or g
tgttgaagtcagtgagataagacatcagtgacttgnacatgctgggaagagtccagtggagggctaccaag

SEQ ID NO: 17547 - DNA, 71 bp, chicken (Gallus Gallus)
  misc_feature (36): n=c or t
cttttttttttttttttttttttttcttgttttttncccttttaaatgacttttaactctatgggcctatg

SEQ ID NO: 17548 - DNA, 71 bp, chicken (Gallus Gallus)
  misc_feature (36): n=c or g
tggaagctagaatgctacttggaatagtagtgtaanttctctatgttctttttcaattctgcaattccagg

SEQ ID NO: 17549 - DNA, 71 bp, chicken (Gallus Gallus)
  misc_feature (36): n=a or g
catggtgtgcagaatgttcacaactccaagtcctantgctgtaccagctgaaaaaaataaagcgaaaagaa

SEQ ID NO: 17550 - DNA, 71 bp, chicken (Gallus Gallus)
  misc_feature (36): n=c or t
tctttcaggttcttttgcccactgtctttactcatnttcagttttctccttaccccctcactctttgcttt

SEQ ID NO: 17551 - DNA, 71 bp, chicken (Gallus Gallus)
  misc_feature (36): n=c or t
aatgcagcagcaaagactgtgtgggtaacaggatanatggaggcagggagcctccaaaaagccaaccaaaa

SEQ ID NO: 17552 - DNA, 71 bp, chicken (Gallus Gallus)
  misc_feature (36): n=a or g
aaaagcatataaaggattttgatgttaaagggaaanaagctcatagaatcatacaatggcttgagttggaa

SEQ ID NO: 17553 - DNA, 71 bp, chicken (Gallus Gallus)
  misc_feature (36): n=a or g
atcctaaagagtaacattcagagtagcagaaaaagnatgtgagtaacagcaatgaaagaaagatttatgtt

SEQ ID NO: 17554 - DNA, 71 bp, chicken (Gallus Gallus)
  misc_feature (36): n=c or t
ccgaatcaaatggcaggaaagtagctgctatttcangaatgcaacctttcaactttctgccagatctgata

SEQ ID NO: 17555 - DNA, 71 bp, chicken (Gallus Gallus)
  misc_feature (36): n=c or t
tcatgactagggcctccatcttgcaagagggatccnacagcacattctgctcattgctgaaggaaaattac

SEQ ID NO: 17556 - DNA, 71 bp, chicken (Gallus Gallus)
  misc_feature (36): n=a or g
tgtagcccacatgtgtttgtatgccgtggaaggacngcaaaacactctacgttaagtagtgaagaagatgc

SEQ ID NO: 17557 - DNA, 71 bp, chicken (Gallus Gallus)
  misc_feature (36): n=a or g
atggggcaaaagctactgttactgggctggaagagnacagtcagattagttttatcaatatgagttaattc

SEQ ID NO: 17558 - DNA, 71 bp, chicken (Gallus Gallus)
  misc_feature (36): n=a or g
aaaacgatggcttgtttgcaaagaagaatgaggaanctcctctgcttaagctgttgtcaccttgttggctt

SEQ ID NO: 17559 - DNA, 71 bp, chicken (Gallus Gallus)
  misc_feature (36): n=a or g
gccgacagcaattataggtggagttccctgaacacnaccttttcatgtcaattcaatttctaggagagttc

SEQ ID NO: 17560 - DNA, 71 bp, chicken (Gallus Gallus)
  misc_feature (36): n=a or c
ttttccctctttccccttccttgcgggagcagcagncctccgagttccctcttaaactttcctctcgctcc

SEQ ID NO: 17561 - DNA, 71 bp, chicken (Gallus Gallus)
  misc_feature (36): n=c or t
attgtcgctgtaacacattgtgcaaaagaacaaaantaagagccaaaaaattttaaaaagcacgaaggtgg

SEQ ID NO: 17562 - DNA, 71 bp, chicken (Gallus Gallus)
  misc_feature (36): n=a or g
aagaacctggggatttagcttacaattcctgtgcantatattcctcagtagcttctagacactaaaaagaa

SEQ ID NO: 17563 - DNA, 71 bp, chicken (Gallus Gallus)
  misc_feature (36): n=a or g
acttcacagttagactaactgctgtgatgtagtgtngcataaaaatggacctttcatcaggcctgtgtcca

SEQ ID NO: 17564 - DNA, 71 bp, chicken (Gallus Gallus)
  misc_feature (36): n=c or t
catgaggatacaaaatgactttttatatgagatttntacattgggtacatctcataaatttttggatgctg

SEQ ID NO: 17565 - DNA, 71 bp, chicken (Gallus Gallus)
  misc_feature (36): n=c or t
aattttgctaacatctccaatttatcatttggaganctgagattttaatcccccctggtattttcagcagc

SEQ ID NO: 17566 - DNA, 71 bp, chicken (Gallus Gallus)
  misc_feature (36): n=a or g
caggtgtttttctatagcacaggtggaagttcttgnaagtttttggaggtatgatttatttgtttgccttt

SEQ ID NO: 17567 - DNA, 71 bp, chicken (Gallus Gallus)
  misc_feature (36): n=c or t
gcacagtattaatgcccttgattttcatcactcctncaggaaaccacccagccaacgcctctgaaggatgt

SEQ ID NO: 17568 - DNA, 71 bp, chicken (Gallus Gallus)
  misc_feature (36): n=c or t
tggcttcttgttcatagcagagggacagtccaaatntcagaccatccccaaagctcaacagatatagtgtt

SEQ ID NO: 17569 - DNA, 71 bp, chicken (Gallus Gallus)
  misc_feature (36): n=a or g
atgatgccagctcttttgggcgtgcgtttagccctntatgtcaaaggccttgtgatggaaaaatatctgtc

SEQ ID NO: 17570 - DNA, 71 bp, chicken (Gallus Gallus)
  misc_feature (36): n=a or t
tctggttccagctgtattatccaagtgtcaaaatanttttttcagattcatacagtcttgacattttgtag

SEQ ID NO: 17571 - DNA, 71 bp, chicken (Gallus Gallus)
  misc_feature (36): n=c or g
gattgcagcccatcttatttcagattcatacacganagaatgctaacacatcttgcacaaagacaaactgc

SEQ ID NO: 17572 - DNA, 71 bp, chicken (Gallus Gallus)
  misc_feature (36): n=a or g
tgcgcaggtagtggaaacagcgataggtaccacagnaagagtaaaatgaagctgcaagtctgtgtagggat

SEQ ID NO: 17573 - DNA, 71 bp, chicken (Gallus Gallus)
  misc_feature (36): n=c or t
aatgagagatgaccggaatgctatgcaaaaatacantgtggcattaacagtgttctagatatcctcgattt

SEQ ID NO: 17574 - DNA, 71 bp, chicken (Gallus Gallus)
  misc_feature (36): n=c or t
gcctcatatcaagcctggtaggttttcaactgaggntggtacataagcaaaagggaaattaattctatgtt

SEQ ID NO: 17575 - DNA, 71 bp, chicken (Gallus Gallus)
  misc_feature (36): n=c or g
tagacatgttgctggcccacatggccccacaaattnaactggacatgttctataaagcctttattttttaa

SEQ ID NO: 17576 - DNA, 71 bp, chicken (Gallus Gallus)
  misc_feature (36): n=a or c
tgatgacatttggtttggtttgactgccactgtgangcccttgagttctctgcctgagtgcagacagcaag

SEQ ID NO: 17577 - DNA, 71 bp, chicken (Gallus Gallus)
  misc_feature (36): n=a or g
tgtagcttctgcatgcttgattgtagtgtaggtggnaactcctaccagcaataaaccaaaagcaataaatg

SEQ ID NO: 17578 - DNA, 71 bp, chicken (Gallus Gallus)
  misc_feature (36): n=a or g
acaccataaacagcagtaagcaaataaatcatgaantacaataaagtgaatcagaattaagttcatttcct

SEQ ID NO: 17579 - DNA, 71 bp, chicken (Gallus Gallus)
  misc_feature (36): n=a or g
tgtaaagaagcacaatattcagggagatggaatctntggaaaatgtagagggaaatagaaaaaaaaaaaag

SEQ ID NO: 17580 - DNA, 71 bp, chicken (Gallus Gallus)
  misc_feature (36): n=a or g
ctcaaaaaaatggtatattgcctcaaaatgcatcanctctgcatgaatttatgggccatagtggactagca

SEQ ID NO: 17581 - DNA, 71 bp, chicken (Gallus Gallus)
  misc_feature (36): n=a or g
atctgaagctctccaaccaatagactttgtgaaaanctctccaagcattttcatccgtggctgcagcttcc

SEQ ID NO: 17582 - DNA, 71 bp, chicken (Gallus Gallus)
  misc_feature (36): n=a or g
gatatatggattatgcattactcttctgagtgctcnttgttaagcagtaaagaaagtgccattatctacaa

SEQ ID NO: 17583 - DNA, 71 bp, chicken (Gallus Gallus)
  misc_feature (36): n=a or g
gtatggttatcaaaatgcttgctttggcacaacatncaaaatgaacggcatttcggaagcacgactaggtt

SEQ ID NO: 17584 - DNA, 71 bp, chicken (Gallus Gallus)
  misc_feature (36): n=a or g
gagcgtttagcatccacagtctttttcatcttgcancgctgatggacaaatagacaaagctgcccatgatg

SEQ ID NO: 17585 - DNA, 71 bp, chicken (Gallus Gallus)
  misc_feature (36): n=c or t
ataaaatactttaagaaaacagtcacgttgcagttngtaggaacaaaaggattgtctgattatagaaaaga

SEQ ID NO: 17586 - DNA, 71 bp, chicken (Gallus Gallus)
  misc_feature (36): n=a or t
aatgaggtaacttgaatcattattaaggttagaaanactatagttgtatgaatagaacaacattttcaaag

SEQ ID NO: 17587 - DNA, 71 bp, chicken (Gallus Gallus)
  misc_feature (36): n=a or g
caccaaggtacgaaatgaatagatgcagccaataanattaactgtcttgtcttacattaagcaaattttaa

SEQ ID NO: 17588 - DNA, 71 bp, chicken (Gallus Gallus)
  misc_feature (36): n=a or g
tcacagcagatttggaaagttgtttaattctagctntgttggaccggtgcagcaagcaacttctgaaatgg

SEQ ID NO: 17589 - DNA, 71 bp, chicken (Gallus Gallus)
  misc_feature (36): n=a or g
tgctccccgacccagcctgcgaccttgatgaagccntctgtcacatctcttccatgtcttctccaccttcc

SEQ ID NO: 17590 - DNA, 71 bp, chicken (Gallus Gallus)
  misc_feature (36): n=a or g
taacatactcaagatgagtgcctgatcatcactacncagcaggcaaaggtagttcctagagctcagaagaa

SEQ ID NO: 17591 - DNA, 71 bp, chicken (Gallus Gallus)
  misc_feature (36): n=a or g
tcagtactttttgcactgagcctctatgactcaacnaaaaattacctacaaggtttaagtttatttacaag

SEQ ID NO: 17592 - DNA, 71 bp, chicken (Gallus Gallus)
  misc_feature (36): n=c or t
cagcatcggtgtatttctctgaagcattgttgggcngaactggtgaatgctggctgtttgagaccgctgct

SEQ ID NO: 17593 - DNA, 71 bp, chicken (Gallus Gallus)
  misc_feature (36): n=a or g
aaatgctttaacttagagtacacttggttatatacnaaacccagaaaatttacgtactgtgtatggtaaaa

SEQ ID NO: 17594 - DNA, 71 bp, chicken (Gallus Gallus)
  misc_feature (36): n=g or t
ttaaaacctttctgtttgaggaagggatagcttgtncacacctggtatgtgtattgctccgtgatgtctgg

SEQ ID NO: 17595 - DNA, 71 bp, chicken (Gallus Gallus)
  misc_feature (36): n=c or t
gcttagaggtcactccttttgaaaaatcagacttcncagatgtttcaaattagacagccttgaaataaagg

SEQ ID NO: 17596 - DNA, 71 bp, chicken (Gallus Gallus)
  misc_feature (36): n=a or g
tttcaatgaaacatttccgtaaatcagcatgtcccngagctggaaatttgcaattgtttattcataagcaa

SEQ ID NO: 17597 - DNA, 71 bp, chicken (Gallus Gallus)
  misc_feature (36): n=c or t
accttctctatattacatgagtattatgcatctaangcaggaaattaggatactgaaagatgaagagttca

SEQ ID NO: 17598 - DNA, 71 bp, chicken (Gallus Gallus)
  misc_feature (36): n=c or t
aaagggaatggaactgcacatgagtagtgtggaacngctgctgcaaatctaaaatgctccctgttcgatca

SEQ ID NO: 17599 - DNA, 71 bp, chicken (Gallus Gallus)
  misc_feature (36): n=a or c
gcagactgcaatcaggaactcaggagcatcaaattncttaaaagaaacaaaataaactgattttcacatta

SEQ ID NO: 17600 - DNA, 71 bp, chicken (Gallus Gallus)
  misc_feature (36): n=c or t
aagagatccaagtctatggtggaggttcagaatcangcctgtttcacatacttaattcagaatcttccata

SEQ ID NO: 17601 - DNA, 71 bp, chicken (Gallus Gallus)
  misc_feature (36): n=a or g
gattgaaacactgttttattgtttcttcactagctntccttttttagattattttgatttttaaagataat

SEQ ID NO: 17602 - DNA, 71 bp, chicken (Gallus Gallus)
  misc_feature (36): n=c or g
tactgtgaagttagcttaacagcagtattatacaantggacatgtactttgcagctcttacacacctttct

SEQ ID NO: 17603 - DNA, 71 bp, chicken (Gallus Gallus)
  misc_feature (36): n=g or t
ctggattctttcaggagaagttttcaaccatcttcngaggccatcatgctgctaaccagatgggattactg

SEQ ID NO: 17604 - DNA, 71 bp, chicken (Gallus Gallus)
  misc_feature (36): n=c or t
tacctgttaagtgaaaaccgctcataattacatgangtacttcatcagtgtgggctgctgtgctctctcat

SEQ ID NO: 17605 - DNA, 71 bp, chicken (Gallus Gallus)
  misc_feature (36): n=c or t
actctacctgtcccttgaaggagtccatgcatgatnactgttgcatagcagcctcccaggaaatcttcaga

SEQ ID NO: 17606 - DNA, 71 bp, chicken (Gallus Gallus)
  misc_feature (36): n=a or t
tccctgacatccctccatcctgacaaaagaaaacanataataataacaaaaaaaaaaaaaatcatttacat

SEQ ID NO: 17607 - DNA, 71 bp, chicken (Gallus Gallus)
  misc_feature (36): n=a or g
acttattcgtctaagtgatcctcagcccaaagtcantgcaattacagtaacagaatctgagagtattcagc

SEQ ID NO: 17608 - DNA, 71 bp, chicken (Gallus Gallus)
  misc_feature (36): n=g or t
tgattttctctttctttccttgccattgacatttangcagcattaatgtcaggttctagttatattccgct

SEQ ID NO: 17609 - DNA, 71 bp, chicken (Gallus Gallus)
  misc_feature (36): n=c or t
agttgtcttggcttcttatagcaaattgttatttcngtgcagccaaacagcccggaggattactacacttc

SEQ ID NO: 17610 - DNA, 71 bp, chicken (Gallus Gallus)
  misc_feature (36): n=c or t
aactttaggctgaatcgtcctcctccagctaaaaangttgttgtctacagagctataactgttccataccc

SEQ ID NO: 17611 - DNA, 71 bp, chicken (Gallus Gallus)
  misc_feature (36): n=c or t
acaccatactggggttctgctacaggcctcctgacnaggaagactaagtggataaggccctctataaacaa

SEQ ID NO: 17612 - DNA, 71 bp, chicken (Gallus Gallus)
  misc_feature (36): n=g or t
gttagtatgaaggctagcagttctgaagtgcagttntaccgttacctttgccttgggatggtcttggttct

SEQ ID NO: 17613 - DNA, 71 bp, chicken (Gallus Gallus)
  misc_feature (36): n=c or g
tattggaaattataatgtagaaagtaaaaatgatantttacagagatactgttcagaagttttatttcagt

SEQ ID NO: 17614 - DNA, 71 bp, chicken (Gallus Gallus)
  misc_feature (36): n=a or t
aagaatgatttgttcgcaagataattgtcttcgtgngtgaaatcaaaaagggagacattttttgaagcata

SEQ ID NO: 17615 - DNA, 71 bp, chicken (Gallus Gallus)
  misc_feature (36): n=c or t
ctagaatggaagcatgtcatatcactgtccattaanggaaatagtggctattttatcttaacaaggaactt

SEQ ID NO: 17616 - DNA, 71 bp, chicken (Gallus Gallus)
  misc_feature (36): n=c or t
taatgtattaatgacacgaatctcggagagaagttnagcacacttgcactgaaccaattgtgcttcccaaa

SEQ ID NO: 17617 - DNA, 71 bp, chicken (Gallus Gallus)
  misc_feature (36): n=a or g
ttatacttctttaaagctttccttaaaggcaaaaanaaaggctagttttcctgttctgttgctgttctgtg

SEQ ID NO: 17618 - DNA, 71 bp, chicken (Gallus Gallus)
  misc_feature (36): n=a or g
cctgatggctttctgccatttgaaatggatgctggnattgtcatctcacaggatgtccaggagaccctgtg

SEQ ID NO: 17619 - DNA, 71 bp, chicken (Gallus Gallus)
  misc_feature (36): n=c or t
agtcctcaggtcaacactttatggctccaagcacanagtttcatgcatacttaaaagcattgaaggtgttc

SEQ ID NO: 17620 - DNA, 71 bp, chicken (Gallus Gallus)
  misc_feature (36): n=a or t
gaactgtatagtattcagaactgttctctctgaagngaatgcttataaaaacctgtccagtgcatttattg

SEQ ID NO: 17621 - DNA, 71 bp, chicken (Gallus Gallus)
  misc_feature (36): n=c or t
aaccctgaagcatttaaggaggaatatgtaactaangcagtttttatcacttttaaacatgttgcaatata

SEQ ID NO: 17622 - DNA, 71 bp, chicken (Gallus Gallus)
  misc_feature (36): n=a or g
aacacacctccatcaattggcttttctatgtagatntcacaagtgactgtcagatttaccctgcaagagaa

SEQ ID NO: 17623 - DNA, 71 bp, chicken (Gallus Gallus)
  misc_feature (36): n=a or g
gagtcagagagatcaaaatgttctgctctagacacntgcaaatacttgaagaagactactggtattttaca

SEQ ID NO: 17624 - DNA, 71 bp, chicken (Gallus Gallus)
  misc_feature (36): n=c or g
cagtacccaaaaatcattattgcagtcctaaacctntaactatgactaaatgagccagcagtgtgagattg

SEQ ID NO: 17625 - DNA, 71 bp, chicken (Gallus Gallus)
  misc_feature (36): n=c or t
gagccaatgggagagattctgatggaggtacgggancatctggaacacagtctgactgggaaggaaaagca

SEQ ID NO: 17626 - DNA, 71 bp, chicken (Gallus Gallus)
  misc_feature (36): n=a or g
tgaaattgataataacaaagtggtatcaacgtgcanatgacagacatgaccatacatcttcctaagtagat

SEQ ID NO: 17627 - DNA, 71 bp, chicken (Gallus Gallus)
  misc_feature (36): n=a or g
ccagtaggaaaaaaagtggtaggaagctgagtggtnaggcctgtgctccatggggattttggcaggagcac

SEQ ID NO: 17628 - DNA, 71 bp, chicken (Gallus Gallus)
  misc_feature (36): n=a or g
ctgttctttgtaatttgtgataataatgtgaatttntgctcttaaaaaaaagaaaacaatacagaactggc

SEQ ID NO: 17629 - DNA, 71 bp, chicken (Gallus Gallus)
  misc_feature (36): n=a or g
taattttggagcgggcatacatagtacaaaacagcnctgtgtaaatataccttagcaaggctagtaccttc

SEQ ID NO: 17630 - DNA, 71 bp, chicken (Gallus Gallus)
  misc_feature (36): n=a or g
gcctatgcatttgggttttcccatgtagcaaggctngtggtgtggatgaggctgtatgttcacagatgtgt

SEQ ID NO: 17631 - DNA, 71 bp, chicken (Gallus Gallus)
  misc_feature (36): n=a or g
tttgaagccagtaggtatatatttatttcacaatcnaaacatctctgaaatccaggtggcattaaattttg

SEQ ID NO: 17632 - DNA, 71 bp, chicken (Gallus Gallus)
  misc_feature (36): n=c or t
cagcccggaagcattctatgttagggatccaccttntatgcaaatgatctctgttcatctttgatagactt

SEQ ID NO: 17633 - DNA, 71 bp, chicken (Gallus Gallus)
  misc_feature (36): n=a or g
taaggtccacaaatcagtgaataaaatcctgctttnaaatggtggtcccaaaaagtgactaactctgaata

SEQ ID NO: 17634 - DNA, 71 bp, chicken (Gallus Gallus)
  misc_feature (36): n=a or g
atcaaaaccacattagcttacagcagctgggaagtnaaattgttaatgttagtgaattttggaaaaaaata

SEQ ID NO: 17635 - DNA, 71 bp, chicken (Gallus Gallus)
  misc_feature (36): n=c or t
agagatactaaatatagtagtccactctagttgaantatatgtccaataacaagttacaagactcttggga

SEQ ID NO: 17636 - DNA, 71 bp, chicken (Gallus Gallus)
  misc_feature (36): n=a or c
taacccttccttctctgaaaattcctcggctttatntccttttcgccgcactaacctctccctcctctaca

SEQ ID NO: 17637 - DNA, 71 bp, chicken (Gallus Gallus)
  misc_feature (36): n=a or g
cttcaagagtcattgcaaaaagggaagagttggacntaggagcacataaggaggggaagaactcagtgaga

SEQ ID NO: 17638 - DNA, 71 bp, chicken (Gallus Gallus)
  misc_feature (36): n=c or t
acctggatgtctctatgtcacatacagcattatggnatggaaatttgagtaatcttttctgcttaaaaaca

SEQ ID NO: 17639 - DNA, 71 bp, chicken (Gallus Gallus)
  misc_feature (36): n=a or g
tgcatgcagaaggtcctcaacttgagtgatatcccncacagatcagagtgtactgaaggggcttatcagtt

SEQ ID NO: 17640 - DNA, 71 bp, chicken (Gallus Gallus)
  misc_feature (36): n=c or t
ttgagttactttgatcctacaattaagtaagaaacngactgaagtgaacctttcaaaactactgtgtaaga

SEQ ID NO: 17641 - DNA, 71 bp, chicken (Gallus Gallus)
  misc_feature (36): n=c or t
ttacatgtaaagctgttccaatattcatctttcttnttccacacaactatttcaggtattccttgcaccaa

SEQ ID NO: 17642 - DNA, 71 bp, chicken (Gallus Gallus)
  misc_feature (36): n=g or t
ataggcttgttcagttttgaaagagactgctttagnaactcattgtcagccacctcaacctcacatggagc

SEQ ID NO: 17643 - DNA, 71 bp, chicken (Gallus Gallus)
  misc_feature (36): n=c or t
tgtatctggatgcttagatcactcagtctaaacaangtgcgtgtgattttaaaccatcagattataggatg

SEQ ID NO: 17644 - DNA, 71 bp, chicken (Gallus Gallus)
  misc_feature (36): n=c or t
gtcacgtcgaggttacacctgcataattcactcccngcaatagagcgactcctgatatctatttgtgtgtg

SEQ ID NO: 17645 - DNA, 71 bp, chicken (Gallus Gallus)
  misc_feature (36): n=a or c
atatgatgatgaaagttactcatttagataactctntactgtcttacagattttctgctctgtttcttttc

SEQ ID NO: 17646 - DNA, 71 bp, chicken (Gallus Gallus)
  misc_feature (36): n=c or t
ctcacccacagctgcagctgaggttctccctgcaantgagcctgcctgtgtggccatttcataaggaggaa

SEQ ID NO: 17647 - DNA, 71 bp, chicken (Gallus Gallus)
  misc_feature (36): n=a or g
atggatcacttggtttctgactatgctgtagcagtntttagatttggagaatgtaagtagaagcccaggga

SEQ ID NO: 17648 - DNA, 71 bp, chicken (Gallus Gallus)
  misc_feature (36): n=a or c
attctcttctcatatacttctccaatgattctcatnagcctgaaagaccttcagctgaatcaaaggttgca

SEQ ID NO: 17649 - DNA, 71 bp, chicken (Gallus Gallus)
  misc_feature (36): n=a or g
ttttggttggggggggggggagagaaggaggggtcntagtatcagtagagaaattgaaaatttgttcacct

SEQ ID NO: 17650 - DNA, 71 bp, chicken (Gallus Gallus)
  misc_feature (36): n=c or g
catcttcttctacatggcattttgcctgtatctgcntctcttctatgaggttacctgatactgttgctcct

SEQ ID NO: 17651 - DNA, 71 bp, chicken (Gallus Gallus)
  misc_feature (36): n=c or t
tttaagttatatccacacagtaaaataaccttgttnccagctgactcaaaacatatgtttcagcctctttg

SEQ ID NO: 17652 - DNA, 71 bp, chicken (Gallus Gallus)
  misc_feature (36): n=a or t
actcagatagcctttttcattctaagctctctcctncctttgagttgttcaaattatatttatctgtaagt

SEQ ID NO: 17653 - DNA, 71 bp, chicken (Gallus Gallus)
  misc_feature (36): n=c or t
aacatctgcatcttgtttcaattaatatctttctgntttcacagacttttaatgaacacaccatccttgga

SEQ ID NO: 17654 - DNA, 71 bp, chicken (Gallus Gallus)
  misc_feature (36): n=c or t
tgggctaaaaatcttgtactactcttctaattgccngttaagtgaccaatggcctgaattttatacagcaa

SEQ ID NO: 17655 - DNA, 71 bp, chicken (Gallus Gallus)
  misc_feature (36): n=a or c
aatcgtgtttgatcacatttatagtagaatcaggtnaaataaggctaccttcctgcatacttagcctttat

SEQ ID NO: 17656 - DNA, 71 bp, chicken (Gallus Gallus)
  misc_feature (36): n=c or t
ctggaaggtgtttgcctttattagaaatagttgctntggatcaaatagtaagccatacacttaggatggta

SEQ ID NO: 17657 - DNA, 71 bp, chicken (Gallus Gallus)
  misc_feature (36): n=c or t
agtgcaatgaaataacaacatcaacatcatgggccnaaattccaccttaggtaaagaggaaacttttgaaa

SEQ ID NO: 17658 - DNA, 71 bp, chicken (Gallus Gallus)
  misc_feature (36): n=a or g
tcaattcataataagaaagtgaagtttttccattcngttcgataatacagacagaacttacgaaaaaacta

SEQ ID NO: 17659 - DNA, 71 bp, chicken (Gallus Gallus)
  misc_feature (36): n=c or t
aacgataatacaaaaggactaataattagggagtanttctattctgagctacattgatgtataaccactga

SEQ ID NO: 17660 - DNA, 71 bp, chicken (Gallus Gallus)
  misc_feature (36): n=a or t
catattcccaggtcagcctaggtccagagatgcagncaagagtatgatcgttgttcccaaaatttttccct

SEQ ID NO: 17661 - DNA, 71 bp, chicken (Gallus Gallus)
  misc_feature (36): n=a or g
tttccatcagggttgcattaaaacagcctgaagagncttaacaccaaacgcttttccctggaagtgcagat

SEQ ID NO: 17662 - DNA, 71 bp, chicken (Gallus Gallus)
  misc_feature (36): n=a or c
gacattaaggttagttggaaaggactgagcgcagcnttgccaaagaagacctgggggtattggtggatggg

SEQ ID NO: 17663 - DNA, 71 bp, chicken (Gallus Gallus)
  misc_feature (36): n=a or g
acttctataaatacaacaaatgtttctataaatgcnactgcatcctgatgaagaataattatttttttatt

SEQ ID NO: 17664 - DNA, 71 bp, chicken (Gallus Gallus)
  misc_feature (36): n=c or g
ttgattgagttttccttgaaattttaactttatttnaaaaatgttttgtttccacttaatttctatgttta

SEQ ID NO: 17665 - DNA, 71 bp, chicken (Gallus Gallus)
  misc_feature (36): n=c or t
aacaaaacccagcaaaaccccactgacctgaacacngacctaggtgctactgctgcaaattacactgaacc

SEQ ID NO: 17666 - DNA, 71 bp, chicken (Gallus Gallus)
  misc_feature (36): n=a or g
tcccttacaactcaaaccattcttgtttcattcctntaccatatcttgtaaagatatcacaaggccagtgg

SEQ ID NO: 17667 - DNA, 71 bp, chicken (Gallus Gallus)
  misc_feature (36): n=a or g
tctcaagggggactgttctcttctttacacctttcnaaatccaaattgagggagatgaatcagctcaaaag

SEQ ID NO: 17668 - DNA, 71 bp, chicken (Gallus Gallus)
  misc_feature (36): n=a or g
gaactagcaggaagtctcacatccttcaatatgaangcagcactgcaatgcacacagcacaattcacagga

SEQ ID NO: 17669 - DNA, 71 bp, chicken (Gallus Gallus)
  misc_feature (36): n=a or g
gaacaatcttggcatctgttacaagcctctacaccncaaagacctgattcagcaaatgctgcattttgctg

SEQ ID NO: 17670 - DNA, 71 bp, chicken (Gallus Gallus)
  misc_feature (36): n=c or g
cccaattcctgaatttgtggctgttgcattatttgnttgtcagatttctgctgatgcgtccttctgaggat

SEQ ID NO: 17671 - DNA, 71 bp, chicken (Gallus Gallus)
  misc_feature (36): n=c or t
cttccacttgtggaggttttcaaaaacaggctggtnaaagccctgatgcttacctgagctcatggccgacc

SEQ ID NO: 17672 - DNA, 71 bp, chicken (Gallus Gallus)
  misc_feature (36): n=c or t
tactctcaggctcctaaaatagcattttcaaatccntgatcaccactaatattcccttaatgctcttatcg

SEQ ID NO: 17673 - DNA, 71 bp, chicken (Gallus Gallus)
  misc_feature (36): n=c or t
acatttcaaaagtgcaactcctagccctcatcctanctttcatgccactgccataaatgcagagtggcttc

SEQ ID NO: 17674 - DNA, 71 bp, chicken (Gallus Gallus)
  misc_feature (36): n=c or t
attttcctttttttgtgttctgggtacaaacattangtatctggagactgctatcaaagagcagaaatcat

SEQ ID NO: 17675 - DNA, 71 bp, chicken (Gallus Gallus)
  misc_feature (36): n=c or t
taagaaatgtcagttccagttattgcaaaaaatganatgatcacagttgttactgtattaattcttttttt

SEQ ID NO: 17676 - DNA, 71 bp, chicken (Gallus Gallus)
  misc_feature (36): n=c or t
tttccacaggattccttagtctgtgtcttaagcatnctgggtaggtttcattcaacctgattttggctatc

SEQ ID NO: 17677 - DNA, 71 bp, chicken (Gallus Gallus)
  misc_feature (36): n=a or g
cattgttcattgatcaatgatcatggttatcattgntcatgatgaagaatttgtgactttacccttgtgac

SEQ ID NO: 17678 - DNA, 71 bp, chicken (Gallus Gallus)
  misc_feature (36): n=a or c
ctggcactctggaatggacatctttttgcttacccnctgcatccatctgttatccatcatcaatttcagtt

SEQ ID NO: 17679 - DNA, 71 bp, chicken (Gallus Gallus)
  misc_feature (36): n=a or g
atgtctgattcagaggaaaattcctgaagggaacanagtgaaaatactccacagtaataccactgaaaaga

SEQ ID NO: 17680 - DNA, 71 bp, chicken (Gallus Gallus)
  misc_feature (36): n=a or g
ttgcattcaccgtttttcttcctctctgagcagtantaagtgaaaaggaatctactgttttttgttttttg

SEQ ID NO: 17681 - DNA, 71 bp, chicken (Gallus Gallus)
  misc_feature (36): n=c or g
gctcagcacaaatattctggacatcaaagacaggtnacacattatagcagaaacaaatgctacaccatggg

SEQ ID NO: 17682 - DNA, 71 bp, chicken (Gallus Gallus)
  misc_feature (36): n=a or g
cttcaaatcatcagcgtgttttgtgtgcctcatctnaacacccttcgtagtgcttaatctctgagttttaa

SEQ ID NO: 17683 - DNA, 71 bp, chicken (Gallus Gallus)
  misc_feature (36): n=c or g
agggaaaatataattccataaaagcaccaccatggnatttacagggttttaccttcatatgcatgtacatt

SEQ ID NO: 17684 - DNA, 71 bp, chicken (Gallus Gallus)
  misc_feature (36): n=c or t
ttaggaaaactgaaatactgagctataacaaaactncttgctttaaattagttctcaccttggtatttgat

SEQ ID NO: 17685 - DNA, 71 bp, chicken (Gallus Gallus)
  misc_feature (36): n=c or g
acagtcagaagacgtcatcttaaataatcttttttnttcctctcttccattctttctccctttctctctgt

SEQ ID NO: 17686 - DNA, 71 bp, chicken (Gallus Gallus)
  misc_feature (36): n=g or t
agctctgggcccgattcttacagtgagtggagtagngtacgttaattaaaaacatgtaccattttttctta

SEQ ID NO: 17687 - DNA, 71 bp, chicken (Gallus Gallus)
  misc_feature (36): n=c or t
ccagcatctctgctgctctcaccttgagaagctttnaattttaatttaccagctttcaaatttccatccgt

SEQ ID NO: 17688 - DNA, 71 bp, chicken (Gallus Gallus)
  misc_feature (36): n=a or t
tattattattattattattgtaaataaaattcaggngcacgctcttgagtatagtgcagctgtttggtgat

SEQ ID NO: 17689 - DNA, 71 bp, chicken (Gallus Gallus)
  misc_feature (36): n=c or t
ctttttcacagcaaagtttgcataaattaagggcantgtaaatctaagttactgtgaggagcagattactt

SEQ ID NO: 17690 - DNA, 71 bp, chicken (Gallus Gallus)
  misc_feature (36): n=a or c
tgagtctgtttgcttagttttcacagatgcacaganagcaagacacacgattctgggtttctgtttggtat

SEQ ID NO: 17691 - DNA, 71 bp, chicken (Gallus Gallus)
  misc_feature (36): n=c or t
tctttattccaaaatgtattcctgtctcatataatngattcagataggcagcaatttgcaaaaggcttttg

SEQ ID NO: 17692 - DNA, 71 bp, chicken (Gallus Gallus)
  misc_feature (36): n=a or g
tgaaccatgacacttctgtgtaaaatgtgtttttcncagaagtgttactgaaactgatccaagctacagac

SEQ ID NO: 17693 - DNA, 71 bp, chicken (Gallus Gallus)
  misc_feature (36): n=g or t
gtctccaagtttaaaacagattggttgcaaaatctnttgtttcttcttctttcttgtgtttgctgcaacac

SEQ ID NO: 17694 - DNA, 71 bp, chicken (Gallus Gallus)
  misc_feature (36): n=g or t
atgtaagtaaacagaaatagtcttgtcttgaaatgnaggaatccagaaggtggagaaatcccacaccatgg

SEQ ID NO: 17695 - DNA, 71 bp, chicken (Gallus Gallus)
  misc_feature (36): n=a or g
gtaatgcatagcatgatggaatatccttttggtcantttgggcagctgttcacactgtgtcctctctcagc

SEQ ID NO: 17696 - DNA, 71 bp, chicken (Gallus Gallus)
  misc_feature (36): n=a or c
tcttcgtgagattttacatccagtccaagctcttcnagcatttctgaaggatctgacagagatcgagaacg

SEQ ID NO: 17697 - DNA, 71 bp, chicken (Gallus Gallus)
  misc_feature (36): n=a or c
ccaaaataagtaaaataatactgttactagaaatanctagcacagtaaaattggagatttagccttctatt

SEQ ID NO: 17698 - DNA, 71 bp, chicken (Gallus Gallus)
  misc_feature (36): n=a or g
aagtaaatatcatgtgctgataataaaattgtgtantaccctcacccatcattgaaaatttgcccgcaaaa

SEQ ID NO: 17699 - DNA, 71 bp, chicken (Gallus Gallus)
  misc_feature (36): n=c or t
agtgcttcatgcattacaggttgcacataggtaatncagttatttggaagattcattctgagcatttaacg

SEQ ID NO: 17700 - DNA, 71 bp, chicken (Gallus Gallus)
  misc_feature (36): n=c or t
tggggttctgtgaaccttgcgcaactctacccccanagccacagaagaattgcagccatgtgagcaagcaa

SEQ ID NO: 17701 - DNA, 71 bp, chicken (Gallus Gallus)
  misc_feature (36): n=c or t
gaaatcagaagaaagacacagaatggatcagtggtncagctaggaacagaagccaaactcctgcctccttt

SEQ ID NO: 17702 - DNA, 71 bp, chicken (Gallus Gallus)
  misc_feature (36): n=c or t
gcttgtgctgatggtgagctcctgagttaaacctgntggaaaaatagggagcgaagaaaggcaggtttgtg

SEQ ID NO: 17703 - DNA, 71 bp, chicken (Gallus Gallus)
  misc_feature (36): n=a or t
agaacatttaaataaaatataacttattcactctgnaatgtgtttgccttggtaggtcctgtcttcttcct

SEQ ID NO: 17704 - DNA, 71 bp, chicken (Gallus Gallus)
  misc_feature (36): n=a or g
aaaatttacactaacccagaagatctacaaagtgantgggctcaataaaaccccaaacatctgaagctgaa

SEQ ID NO: 17705 - DNA, 71 bp, chicken (Gallus Gallus)
  misc_feature (36): n=c or g
gcatgttttgtgacatccacacacctgctagccacnagccttaggctgccttggagaaacgctctgcttgc

SEQ ID NO: 17706 - DNA, 71 bp, chicken (Gallus Gallus)
  misc_feature (36): n=a or c
gggttagcacagaaacaactttggaagacttgatanaaaaatgcaaatgtgatcacactataagagaggca

SEQ ID NO: 17707 - DNA, 71 bp, chicken (Gallus Gallus)
  misc_feature (36): n=c or t
caggagggcttgaaaaagaggcaaagagctataccncctctcttctccatgtcactgaatcagatctggca

SEQ ID NO: 17708 - DNA, 71 bp, chicken (Gallus Gallus)
  misc_feature (36): n=a or g
agagggtttgctcagtaatctgtctgaacagtacantgttattgaataagttaatcttattgatatcccat

SEQ ID NO: 17709 - DNA, 71 bp, chicken (Gallus Gallus)
  misc_feature (36): n=g or t
cgatgactccatacctccctgggcagcctgtgccantgcctcatcactcttttgaagaagattttcctaat

SEQ ID NO: 17710 - DNA, 71 bp, chicken (Gallus Gallus)
  misc_feature (36): n=c or t
gggtatttttcatcattcagtgctttgatattctcnttctgccaatagcaaggaaatacagtgatgtgcag

SEQ ID NO: 17711 - DNA, 71 bp, chicken (Gallus Gallus)
  misc_feature (36): n=a or g
ttaactacgtgtaaattattcttatctggcaaggantagtgttccttaataaaatctaattgtttttaaaa

SEQ ID NO: 17712 - DNA, 71 bp, chicken (Gallus Gallus)
  misc_feature (36): n=c or t
tgtggcacctctgggacattcaggttactttgtggnctcagggctgctctgagacagtgatgtctgcagca

SEQ ID NO: 17713 - DNA, 71 bp, chicken (Gallus Gallus)
  misc_feature (36): n=a or g
attccaaataaaacattgattttcctacagtcccantagttcagtgtcaggcccttcacaaagccacctgc

SEQ ID NO: 17714 - DNA, 71 bp, chicken (Gallus Gallus)
  misc_feature (36): n=c or t
atgtacaagtgaaaagcaaatatttactggagaaanacagaatgttatatgtaataactatatgtaacgtt

SEQ ID NO: 17715 - DNA, 71 bp, chicken (Gallus Gallus)
  misc_feature (36): n=a or g
gtgaccatgagtttggcatactcctctcagaaatcnaatgctttggacctttggagatgaaggatgcatcc

SEQ ID NO: 17716 - DNA, 71 bp, chicken (Gallus Gallus)
  misc_feature (36): n=c or t
tttctctttaatattaacatttgtcttgtctgttantgaagttagtaggttcagagttaagatctggaatt

SEQ ID NO: 17717 - DNA, 71 bp, chicken (Gallus Gallus)
  misc_feature (36): n=a or c
cagattgacacttcctgctaacttggtttcatctgnaaacttacagagggtgcatcagtgccctcatctgg

SEQ ID NO: 17718 - DNA, 71 bp, chicken (Gallus Gallus)
  misc_feature (36): n=a or c
cagacctaagccactacagtcatgccaatccattcnattcaggccactgggtgtagcagttaaatcagatg

SEQ ID NO: 17719 - DNA, 71 bp, chicken (Gallus Gallus)
  misc_feature (36): n=a or g
gtacagactccagaagtctgtactgacacaatcacnctatgcaacacaaaacatgtatgttatgctgaact

SEQ ID NO: 17720 - DNA, 71 bp, chicken (Gallus Gallus)
  misc_feature (36): n=c or t
cagacaaaagtttgcgttgagtctttggagaggaanagggctgtatccattccataagctaactttatcag

SEQ ID NO: 17721 - DNA, 71 bp, chicken (Gallus Gallus)
  misc_feature (36): n=a or g
gtctgatggagaagctttctttacttgctgtgtacnttaaagaattcagtgtccactgcagacaatagaga

SEQ ID NO: 17722 - DNA, 71 bp, chicken (Gallus Gallus)
  misc_feature (36): n=c or t
ttttgtaaatatatatttcctcatttgttgtatctnttacagaagcaagcctttaaatccagaactggtgc

SEQ ID NO: 17723 - DNA, 71 bp, chicken (Gallus Gallus)
  misc_feature (36): n=a or c
agaataaataatggttcattccagaattctttttanatcacagtgtaggactaaatgcagttcagtataaa

SEQ ID NO: 17724 - DNA, 71 bp, chicken (Gallus Gallus)
  misc_feature (36): n=a or c
gaaaaggctgtttcgtttaggaattatgctgggctntatgtaggacaattaccaatgttaaattttgctga

SEQ ID NO: 17725 - DNA, 71 bp, chicken (Gallus Gallus)
  misc_feature (36): n=a or c
tggctacgtacagcagacccagatgccccaatcagnatggcgttaagacatcacttagagattataatgag

SEQ ID NO: 17726 - DNA, 71 bp, chicken (Gallus Gallus)
  misc_feature (36): n=c or t
ctggatatctttctttgacgtcagggcataaatgcnagatctgaaaaggaagtgttagtgaggaataatgg

SEQ ID NO: 17727 - DNA, 71 bp, chicken (Gallus Gallus)
  misc_feature (36): n=c or t
aagaaatttatttgattgctgcttccatcttggagngagagatgtgataaggggaccagaagcataccttg

SEQ ID NO: 17728 - DNA, 71 bp, chicken (Gallus Gallus)
  misc_feature (36): n=a or g
gaaatggttttcgagaattcattatgaggaaaagtncatttccattgctaaaaagaaaaaaagtattttgg

SEQ ID NO: 17729 - DNA, 71 bp, chicken (Gallus Gallus)
  misc_feature (36): n=c or t
aaacaaaaacaaacaaacaaacaaacaaaaaaggcnattttttatgtaaaaagcaaaaaaagcactgggga

SEQ ID NO: 17730 - DNA, 71 bp, chicken (Gallus Gallus)
  misc_feature (36): n=a or g
tgcagaagaatgagatttccttccagggagagctcncacacagcgtgcatttttagagacagaaacccatc

SEQ ID NO: 17731 - DNA, 71 bp, chicken (Gallus Gallus)
  misc_feature (36): n=a or g
ggaactggcaggttttcagaatactgcagtaagaangaataatctgatcatagcagatacatgcacaagtg

SEQ ID NO: 17732 - DNA, 71 bp, chicken (Gallus Gallus)
  misc_feature (36): n=a or g
gtagtgcttctaactacttgctgttctaatctagangagttgttccttgcagggaaaatgttttgctactg

SEQ ID NO: 17733 - DNA, 71 bp, chicken (Gallus Gallus)
  misc_feature (36): n=g or t
tgaagtgattctgcagaaggagtaagtttgtatccngtttaatggaagaagggcaaattgaagctcgctgt

SEQ ID NO: 17734 - DNA, 71 bp, chicken (Gallus Gallus)
  misc_feature (36): n=a or t
acatagattcagtgcggtctagaggcaatcccaganttggcattgtcaaaccttactcatcttcctctcag

SEQ ID NO: 17735 - DNA, 71 bp, chicken (Gallus Gallus)
  misc_feature (36): n=c or t
tgtccatccctcttatctcagctaagcagctgggcnacaaatcaggagtgaagccaggtgaggggacctgt

SEQ ID NO: 17736 - DNA, 71 bp, chicken (Gallus Gallus)
  misc_feature (36): n=a or t
cttattacttgatgtgacattagctttttaaattgngtttatgggtggatatgggatttctttatacacac

SEQ ID NO: 17737 - DNA, 71 bp, chicken (Gallus Gallus)
  misc_feature (36): n=a or g
agctctcctttcctgcagcactttgagggaagcacnttggggggggaaaataacagcccattcttaattat

SEQ ID NO: 17738 - DNA, 71 bp, chicken (Gallus Gallus)
  misc_feature (36): n=c or t
gcattcagtccaagtcctctgggtccctcaccacangtacatgtcccttaatcctccagtcagtctaacca

SEQ ID NO: 17739 - DNA, 71 bp, chicken (Gallus Gallus)
  misc_feature (36): n=a or g
ttttaaaaaatatgtctttggcatattgttctatcnttatgtttgttttaatattctctaaaagttcatga

SEQ ID NO: 17740 - DNA, 71 bp, chicken (Gallus Gallus)
  misc_feature (36): n=a or c
gaatggtattttccagagaatgtttatatgttgggnaagtcaaatgctatgaatcttcctcatctcttgag

SEQ ID NO: 17741 - DNA, 71 bp, chicken (Gallus Gallus)
  misc_feature (36): n=c or t
cagtctccgaatgagccctgcattgtggtgtgctgnaggatcagagatttgcagggattcccatccttatg

SEQ ID NO: 17742 - DNA, 71 bp, chicken (Gallus Gallus)
  misc_feature (36): n=g or t
ctttgataaatgagttgttgatttcttaaaaatggntgtcaacctttcttgcattgcctccagaaaatagc

SEQ ID NO: 17743 - DNA, 71 bp, chicken (Gallus Gallus)
  misc_feature (36): n=a or g
atgttagagaacctcaaccagcatctcctttcagantctctttatgaacctattgtccgtgaagtggacaa

SEQ ID NO: 17744 - DNA, 71 bp, chicken (Gallus Gallus)
  misc_feature (36): n=a or g
aataaaggtcctgactcactggttgtaatggtggangaagaaaagagcaactctagcagcaaaagcagaga

SEQ ID NO: 17745 - DNA, 71 bp, chicken (Gallus Gallus)
  misc_feature (36): n=a or g
tggtggctccatcgttagagatggtggctttgcctncaagcaattcagaaaaagaagctaagccccaaaca

SEQ ID NO: 17746 - DNA, 71 bp, chicken (Gallus Gallus)
  misc_feature (36): n=a or g
cagccttctaaatgcttccatcatggcaatctccanttccctggagtgaatatatttacaccaagtatgag

SEQ ID NO: 17747 - DNA, 71 bp, chicken (Gallus Gallus)
  misc_feature (36): n=a or g
ttggcttatttctgattcttcaaataagtaatatcnctcgtatgacccccaaatggccaaattctttttga

SEQ ID NO: 17748 - DNA, 71 bp, chicken (Gallus Gallus)
  misc_feature (36): n=a or g
ttactgcttatttcataggctctacaaagttctctncaagagcagcaaaaaggcctgaaatatctcaacac

SEQ ID NO: 17749 - DNA, 71 bp, chicken (Gallus Gallus)
  misc_feature (36): n=a or g
gaaccagcagctatccctgaaagccagctccacagnaagttgcttcagtgatcatggctgtgcatgaagag

SEQ ID NO: 17750 - DNA, 71 bp, chicken (Gallus Gallus)
  misc_feature (36): n=a or g
ttctcatacgtactctgcctgctttgaaagagaagntagactgctatttaaccttcgagaatggctttcca

SEQ ID NO: 17751 - DNA, 71 bp, chicken (Gallus Gallus)
  misc_feature (36): n=c or t
tacagtacctcaagtgacatcaagtctgagaaaccntcaacaaaaaaagaacgctccgttcccctgtggat

SEQ ID NO: 17752 - DNA, 71 bp, chicken (Gallus Gallus)
  misc_feature (36): n=a or t
cttttctttttgtatcaattttaacagacagtgggnttttctataactaagaatgaagtttttaggcagca

SEQ ID NO: 17753 - DNA, 71 bp, chicken (Gallus Gallus)
  misc_feature (36): n=c or t
ttgtctcacttaagtctttgacccatttgttatttnacttcttttatattctgtttttctcttctaaaaga

SEQ ID NO: 17754 - DNA, 71 bp, chicken (Gallus Gallus)
  misc_feature (36): n=c or t
caggtaagcccaaaacgctgagcaatgcaaaatacnggacctgttaaggaattgcactggaggctgtgctc

SEQ ID NO: 17755 - DNA, 71 bp, chicken (Gallus Gallus)
  misc_feature (36): n=a or c
gtgtcctcgggccaagcattccgcgtttcactcacncctaatgaagcatcttctttccaccttttttcagg

SEQ ID NO: 17756 - DNA, 71 bp, chicken (Gallus Gallus)
  misc_feature (36): n=c or t
aatagtgctatgttcttcccatacatcgatttctanaaaattgtacagtattatttgaaacagctgacgac

SEQ ID NO: 17757 - DNA, 71 bp, chicken (Gallus Gallus)
  misc_feature (36): n=c or t
gaaatactgggagactatagtttgggcttggtaacnccattctctgggactacatagtatttcaggttgga

SEQ ID NO: 17758 - DNA, 71 bp, chicken (Gallus Gallus)
  misc_feature (36): n=c or t
ccattcttaatggagagttattcttcagtatgaggntccagaagaagagccatcattctggtctcatgact

SEQ ID NO: 17759 - DNA, 71 bp, chicken (Gallus Gallus)
  misc_feature (36): n=a or g
gagtgtatttgaagcaacacttagagagttttttcnaaacaacaacaataaataccacaaaacgcttgctg

SEQ ID NO: 17760 - DNA, 71 bp, chicken (Gallus Gallus)
  misc_feature (36): n=a or g
aaaatcctgaagacagatgtaatcgtctatctgttntaattacaaattaaacgttataagtggtcagtgca

SEQ ID NO: 17761 - DNA, 71 bp, chicken (Gallus Gallus)
  misc_feature (36): n=a or t
gtggttctggagagctaataatttgaccctaaaggnttgtaaatttttaacatctgatttctttagtgaat

SEQ ID NO: 17762 - DNA, 71 bp, chicken (Gallus Gallus)
  misc_feature (36): n=a or g
agggaggctgaggagcatgtatgcccagcctccacnctctcagagactcgcctggcagcaaaatctcccaa

SEQ ID NO: 17763 - DNA, 71 bp, chicken (Gallus Gallus)
  misc_feature (36): n=c or t
cattgtactacagtattcacatgaacaagtgaatgncaaaggcttttgcgtgactgaagtcctcaggacag

SEQ ID NO: 17764 - DNA, 71 bp, chicken (Gallus Gallus)
  misc_feature (36): n=c or t
ggagttcaagtggcagcgcttttgcccatgtttctngtctggttgtcttcctacagtgactaatttcagga

SEQ ID NO: 17765 - DNA, 71 bp, chicken (Gallus Gallus)
  misc_feature (36): n=g or t
ggtgaacttgcaagcaaaaagagctttgtctgtccnagaagtcagctattccttgaacatatttacccaca

SEQ ID NO: 17766 - DNA, 71 bp, chicken (Gallus Gallus)
  misc_feature (36): n=a or g
ttttttagttacataagttcatcccacacatctacnttttgctctctccccagtatgttagaaaagatatc

SEQ ID NO: 17767 - DNA, 71 bp, chicken (Gallus Gallus)
  misc_feature (36): n=c or g
tgttgtttttttttaaatccagaaatgtaacaacanttggtgagtgacaatttgtttttgaaacagaacat

SEQ ID NO: 17768 - DNA, 71 bp, chicken (Gallus Gallus)
  misc_feature (36): n=a or c
actgattttttacaagttatctcctcagagaaccanaaaaactgactcagtaaactgctattcagtgaaat

SEQ ID NO: 17769 - DNA, 71 bp, chicken (Gallus Gallus)
  misc_feature (36): n=c or t
ttatcaacttaattgggcagaagttggtaactaccnagataaatgtattttcttctgttggtctggatggg

SEQ ID NO: 17770 - DNA, 71 bp, chicken (Gallus Gallus)
  misc_feature (36): n=a or g
agctacagaaacaagtcacaaataaaatgagaatantaacatttttcttgtcttaatcttagatttactgg

SEQ ID NO: 17771 - DNA, 71 bp, chicken (Gallus Gallus)
  misc_feature (36): n=g or t
aagaagttcagtgctctctatccaaaggagtgaaangtcacgtgtcattctgcaaacagtcttttagttcc

SEQ ID NO: 17772 - DNA, 71 bp, chicken (Gallus Gallus)
  misc_feature (36): n=a or g
aatgaccctccacgttggaaggaaaaagcaattgcnatgttcatctattcaatacttagcagctcccagga

SEQ ID NO: 17773 - DNA, 71 bp, chicken (Gallus Gallus)
  misc_feature (36): n=c or t
ttcaccttagaccattcacatttatacacagtgttngtctacacttgctatcatgagtcaacaagcatatc

SEQ ID NO: 17774 - DNA, 71 bp, chicken (Gallus Gallus)
  misc_feature (36): n=a or g
agcatggatgcaacgaggctagggagcaaaatgtantcgggccaaatggagcttattcccataactgagac

SEQ ID NO: 17775 - DNA, 71 bp, chicken (Gallus Gallus)
  misc_feature (36): n=c or t
tgggaagttgctgaagacacagacggtgatggagangcaggtggtgtgagcaagctgcagggtaaattcaa

SEQ ID NO: 17776 - DNA, 71 bp, chicken (Gallus Gallus)
  misc_feature (36): n=a or g
agaaataaatgcttgtttgcattctgcagacttggnataggtgcactggagctttctcatagaattaatgg

SEQ ID NO: 17777 - DNA, 71 bp, chicken (Gallus Gallus)
  misc_feature (36): n=a or t
gatttgggatggtttggtgtttacagcatcagatcngagacaggggtgtatggctcagcccaatatttctt

SEQ ID NO: 17778 - DNA, 71 bp, chicken (Gallus Gallus)
  misc_feature (36): n=c or t
gggggtctaatccaatatttagctgtagttgaaacngattgttttcaaatgaatgaactgaaaccgattgt

SEQ ID NO: 17779 - DNA, 71 bp, chicken (Gallus Gallus)
  misc_feature (36): n=a or g
agataatgaaagccaaccaagcaaaagcattttaancctcagagtctttatgtacaaggctgagctgcatc

SEQ ID NO: 17780 - DNA, 71 bp, chicken (Gallus Gallus)
  misc_feature (36): n=c or t
attttctatgaaagacagaaaataaagatgcttatnctcttttcacgtcatctatgagttcagatctttgt

SEQ ID NO: 17781 - DNA, 71 bp, chicken (Gallus Gallus)
  misc_feature (36): n=a or g
agacaagctctcagaaactgtcgtcaactccaagcnaacagctatttttagcccgtcattgtttgtgcctt

SEQ ID NO: 17782 - DNA, 71 bp, chicken (Gallus Gallus)
  misc_feature (36): n=a or c
gttaaattgcctctacaaaaatccaatagtagaggnagcacagttctgagagaactccatcactgtgtgta

SEQ ID NO: 17783 - DNA, 71 bp, chicken (Gallus Gallus)
  misc_feature (36): n=c or t
ggagaagatacctgccttggacaaggagaaaaaggngacagctgagacttatattagtatattccattaga

SEQ ID NO: 17784 - DNA, 71 bp, chicken (Gallus Gallus)
  misc_feature (36): n=c or t
tgaatttattgatccttgattgccataaaatatganacagtttgtccagaggtaattctagcaacgtttgc

SEQ ID NO: 17785 - DNA, 71 bp, chicken (Gallus Gallus)
  misc_feature (36): n=c or t
caatatcctcttggtgtctgaaaatggaccatctcngagaaaacatgcagggtgtcttggatacaacttga

SEQ ID NO: 17786 - DNA, 71 bp, chicken (Gallus Gallus)
  misc_feature (36): n=g or t
ttttattacttagttcttatacttttagagaaaatnacattgtttattcttttttttttttttttttggtc

SEQ ID NO: 17787 - DNA, 71 bp, chicken (Gallus Gallus)
  misc_feature (36): n=g or t
tgacctggatttaggctatgctgaagtctcaaccancttgaacaatgtaattcagctaaagcaaaacaaaa

SEQ ID NO: 17788 - DNA, 71 bp, chicken (Gallus Gallus)
  misc_feature (36): n=c or t
tgcttcatttttttacctgataggaagggtatgtantattctacctgtatgggttgaagaatatccaaaag

SEQ ID NO: 17789 - DNA, 71 bp, chicken (Gallus Gallus)
  misc_feature (36): n=c or t
agatatactagctgatgatccaacacaaaccagccnccaacacccccccaaaatgacttgctcagttttca

SEQ ID NO: 17790 - DNA, 71 bp, chicken (Gallus Gallus)
  misc_feature (36): n=a or g
ttcataccgcaactaaaaactgactgaactccaaanactttactcacatgagaaaaaccacacatattttt

SEQ ID NO: 17791 - DNA, 71 bp, chicken (Gallus Gallus)
  misc_feature (36): n=a or g
aagattttagtgcacattcaggtgttcttttatccntcaaaaagagaagttgcaaaatttctgaaatatac

SEQ ID NO: 17792 - DNA, 71 bp, chicken (Gallus Gallus)
  misc_feature (36): n=a or g
tgctcttcaccgctatcacaaacacttcaaagtctnacctgacacaccaaagttgcccatgtgcacatatg

SEQ ID NO: 17793 - DNA, 71 bp, chicken (Gallus Gallus)
  misc_feature (36): n=c or t
aaaaccagaaactatcaaagcttgagagagtttgtnaaattttccattgcatattcttcacttcccttcca

SEQ ID NO: 17794 - DNA, 71 bp, chicken (Gallus Gallus)
  misc_feature (36): n=a or g
tgctgctcaagcagcagcttaagaagagaagagatnatctggatctgaaaatgtattgttgcgtttttcct

SEQ ID NO: 17795 - DNA, 71 bp, chicken (Gallus Gallus)
  misc_feature (36): n=a or g
ttaggtggtaagaacctcatgcagcgattctttgtntcaagacatgtaacattgaaacaagatctggaatg

SEQ ID NO: 17796 - DNA, 71 bp, chicken (Gallus Gallus)
  misc_feature (36): n=c or t
gatctttaaggtcttttccaacctgagtgattctangatttatagattcaattttgaggagtttgcttatt

SEQ ID NO: 17797 - DNA, 71 bp, chicken (Gallus Gallus)
  misc_feature (36): n=a or c
aggaatgcagggatttctcctgaagtctccttaatntgccaccagcttcttaattctagcaccagcaagca

SEQ ID NO: 17798 - DNA, 71 bp, chicken (Gallus Gallus)
  misc_feature (36): n=c or t
ggctggtaataagtgtaacttaatttataggtattngttaaattcttggaagcttcaacaggagttactat

SEQ ID NO: 17799 - DNA, 71 bp, chicken (Gallus Gallus)
  misc_feature (36): n=a or t
atttactatactagtgagagtgaatttagaataagncccagaataatttaggacccaagaaataaaaatgt

SEQ ID NO: 17800 - DNA, 71 bp, chicken (Gallus Gallus)
  misc_feature (36): n=c or t
ttactttagctgactccaatgctcagtgttctacgngtggtgttagctccatattactttaagagaagctg

SEQ ID NO: 17801 - DNA, 71 bp, chicken (Gallus Gallus)
  misc_feature (36): n=g or t
tttcttttcctttactgtattgtctacagtcatttnctaccaaagatatacaaataatagtaatagtgagg

SEQ ID NO: 17802 - DNA, 71 bp, chicken (Gallus Gallus)
  misc_feature (36): n=a or t
gacagcctaatctggtgaatggtagcgctgcccacngcagagtgatgggaactaaataacagttatgggcc

SEQ ID NO: 17803 - DNA, 71 bp, chicken (Gallus Gallus)
  misc_feature (36): n=a or g
atacaatatctatgtactctgcatcaaaataaaacnttcttgtgcagtgaaatccaaatttagttatcagg

SEQ ID NO: 17804 - DNA, 71 bp, chicken (Gallus Gallus)
  misc_feature (36): n=g or t
gccatctctactaaatgcctgtagactttcattgtncctctgctaaaattccaaagcctttcttcatattt

SEQ ID NO: 17805 - DNA, 71 bp, chicken (Gallus Gallus)
  misc_feature (36): n=a or c
caggcagctgtgtggtgctgacctgcccacaccatntatcccacaaacttgttttacacagcacagcatat

SEQ ID NO: 17806 - DNA, 71 bp, chicken (Gallus Gallus)
  misc_feature (36): n=a or g
cccagtgaaaaccaagagctgctgttgtgtgatacngggcagaaaagtcagtacaggacagcagaggagcc

SEQ ID NO: 17807 - DNA, 71 bp, chicken (Gallus Gallus)
  misc_feature (36): n=a or g
ggaagacctctgttctttcctagaggatgaaaacanaaaaaatgaacacacattacaatcaacctcaaagc

SEQ ID NO: 17808 - DNA, 71 bp, chicken (Gallus Gallus)
  misc_feature (36): n=a or c
tatttctgtaattttttctatacctgaagtatctangaacagtaaaaagcagtatcttatgcatttgtaat

SEQ ID NO: 17809 - DNA, 71 bp, chicken (Gallus Gallus)
  misc_feature (36): n=g or t
actttggtaccagctcctacaagcttggtttttcangtagtttccttcatattatgcagagctgttcatta

SEQ ID NO: 17810 - DNA, 71 bp, chicken (Gallus Gallus)
  misc_feature (36): n=a or g
aggtggcagtgccagctaatacaggctgacaaccanccttgaaagtgcagcccaagttctccaatggtttc

SEQ ID NO: 17811 - DNA, 71 bp, chicken (Gallus Gallus)
  misc_feature (36): n=a or g
ttctattttcatgtgcaaatgaaggtttaaattggnaacaaaaatgtattacgaaaaacaaatttgggagc

SEQ ID NO: 17812 - DNA, 71 bp, chicken (Gallus Gallus)
  misc_feature (36): n=a or g
agacctcattccttctaaggcattgaagacattccncatgtaacagctataaacaccatctttacaagtga

SEQ ID NO: 17813 - DNA, 71 bp, chicken (Gallus Gallus)
  misc_feature (36): n=a or c
tactttctttatctatgtttgcttatgctgaccttnctttggaaagaatgcctctccaaaataatttacat

SEQ ID NO: 17814 - DNA, 71 bp, chicken (Gallus Gallus)
  misc_feature (36): n=c or t
actctactgtgtatatttcgcatatcagattcaggntgcaaacccctgcagcatggggcttcttgtctccc

SEQ ID NO: 17815 - DNA, 71 bp, chicken (Gallus Gallus)
  misc_feature (36): n=c or t
gagtgaagactggatgtctgccagaagctgctttanagacatttgaagctggaggaatctgtttggctaat

SEQ ID NO: 17816 - DNA, 71 bp, chicken (Gallus Gallus)
  misc_feature (36): n=c or t
taatacagctatagaatctgcctgttggtctgtcancttcaccccatcagcttttgagctccaataaactc

SEQ ID NO: 17817 - DNA, 71 bp, chicken (Gallus Gallus)
  misc_feature (36): n=a or g
tgctcaagttggtaaattaaggtggaaacagtgggnaaaaaagaatttaggttcaaaacccaatgtaaagt

SEQ ID NO: 17818 - DNA, 71 bp, chicken (Gallus Gallus)
  misc_feature (36): n=a or g
tttctcattttttctaactttttttttccctggaantttctgtgttaatatctattattttcacatcttct

SEQ ID NO: 17819 - DNA, 71 bp, chicken (Gallus Gallus)
  misc_feature (36): n=a or t
cctacttgcaggtccttcctcttcctcagcacacangcacatggtccctcaaacaaagactgtgaccctac

SEQ ID NO: 17820 - DNA, 71 bp, chicken (Gallus Gallus)
  misc_feature (36): n=c or t
tcattggatcaggatgaaatgaaacaggactctgcnttatttcttctccatccaccccaccacatcctcgc

SEQ ID NO: 17821 - DNA, 71 bp, chicken (Gallus Gallus)
  misc_feature (36): n=a or g
aaacagctcagcatttccccatggctgaagcagagnggtgttcccttttctaagtatagagggattatttt

SEQ ID NO: 17822 - DNA, 71 bp, chicken (Gallus Gallus)
  misc_feature (36): n=c or g
tttctgcatgcttcagtctgattgttgacttctcgntaaactatggagaaaagccattggtcacttttaag

SEQ ID NO: 17823 - DNA, 71 bp, chicken (Gallus Gallus)
  misc_feature (36): n=a or g
gatgcacccaacttggcccatccataaggagtgggntttagtgactggaagatggatgtgaaagcactgtc

SEQ ID NO: 17824 - DNA, 71 bp, chicken (Gallus Gallus)
  misc_feature (36): n=a or g
gcatgtgagagcagcaataggcagaattgcttacgnataaattcaaacaactgcttttaaaatgatagaag

SEQ ID NO: 17825 - DNA, 71 bp, chicken (Gallus Gallus)
  misc_feature (36): n=a or g
taacatgttgctgaatggtggtggtggatgagtcanggagtacagctctccagagctccatccagaagttt

SEQ ID NO: 17826 - DNA, 71 bp, chicken (Gallus Gallus)
  misc_feature (36): n=c or t
cctggaatatcagaacagtgtctgcccaaaaccatngcatttcctcgagaaactcatccatttccacagtt

SEQ ID NO: 17827 - DNA, 71 bp, chicken (Gallus Gallus)
  misc_feature (36): n=a or g
gaacggcagcacagaaatatgacgcttggatttcanaagattagacaggcaaagatgcagataagcaatta

SEQ ID NO: 17828 - DNA, 71 bp, chicken (Gallus Gallus)
  misc_feature (36): n=a or g
tctccttaccacatgacatgtaccatacaaaatgcntagtgaaaaactaaacacctaaaaagataaagaca

SEQ ID NO: 17829 - DNA, 71 bp, chicken (Gallus Gallus)
  misc_feature (36): n=c or t
cttagagagcaaagatgtataagagtactcactgcncttctctgtgcactgtgaggagagagggaacgatt

SEQ ID NO: 17830 - DNA, 71 bp, chicken (Gallus Gallus)
  misc_feature (36): n=a or t
gttaaaccaagatatcattaaaatatctattagaanttgttttttttttttttttgagtgtggatcagatt

SEQ ID NO: 17831 - DNA, 71 bp, chicken (Gallus Gallus)
  misc_feature (36): n=c or t
gccctccagaaacctctgggttgctcacagagactntgaaggatcaaaagtctaagatacacaacacacaa

SEQ ID NO: 17832 - DNA, 71 bp, chicken (Gallus Gallus)
  misc_feature (36): n=c or t
gcagaatgatctgttgaggatttcagagctctcagngaaggctcaaattacccactttccaccagctttgc

SEQ ID NO: 17833 - DNA, 71 bp, chicken (Gallus Gallus)
  misc_feature (36): n=c or t
aagaagagggctccaggacaaggctgtcactgattntctgtttgtgtgtttgcatgagtttcctcaaattc

SEQ ID NO: 17834 - DNA, 71 bp, chicken (Gallus Gallus)
  misc_feature (36): n=c or t
cccagtttctcctacacagggcatgagcagtacaantattagacacttatgccatggtataacctacagct

SEQ ID NO: 17835 - DNA, 71 bp, chicken (Gallus Gallus)
  misc_feature (36): n=c or t
ggaaggggaaaaggacaagaacagcaggatttcatncaaagctcactgtaattgatgaatcatatgcaact

SEQ ID NO: 17836 - DNA, 71 bp, chicken (Gallus Gallus)
  misc_feature (36): n=a or g
tgttatgacctataagtgactatctagcagcaatcnttaatgttgttgaatgtgcttgctgtgcatatgac

SEQ ID NO: 17837 - DNA, 71 bp, chicken (Gallus Gallus)
  misc_feature (36): n=a or g
ttgggcaatctgatccagtggaaggtgtttctgccnatgatggagcattagaactaaatggtctttaagat

SEQ ID NO: 17838 - DNA, 71 bp, chicken (Gallus Gallus)
  misc_feature (36): n=c or t
aggctgacctgaaactcatcagttgaatttgtatanatttggatgaggtggaggaagaagagagcaggcta

SEQ ID NO: 17839 - DNA, 71 bp, chicken (Gallus Gallus)
  misc_feature (36): n=c or t
cctgccaagccaaacatccctaggatcgtatccctntcagcatccccagcattgccccagctgaagcaaac

SEQ ID NO: 17840 - DNA, 71 bp, chicken (Gallus Gallus)
  misc_feature (36): n=a or g
ttgtctcttacagatcagatggtatgggcgaagacnacactatctgggtaggcagctgtgcacaggcaaca

SEQ ID NO: 17841 - DNA, 71 bp, chicken (Gallus Gallus)
  misc_feature (36): n=c or t
aaccattcattttattattctcactgattgatgtangtaaagggtttggggttttttttttttttttttgc

SEQ ID NO: 17842 - DNA, 71 bp, chicken (Gallus Gallus)
  misc_feature (36): n=g or t
gaggttagctgtagactttggacaccaggcttcagnatagcagactgtggcttatttggaaagttgctggg

SEQ ID NO: 17843 - DNA, 71 bp, chicken (Gallus Gallus)
  misc_feature (36): n=c or t
tgttcattttgtctttgtgtgtaatcagatgtcttnaaaatttgacagttcctgtttttctttagaattgc

SEQ ID NO: 17844 - DNA, 71 bp, chicken (Gallus Gallus)
  misc_feature (36): n=c or g
ttcaacatcaataataaagaaaaaatacttcaactntgtactactttaagagtaatcaaatacatactatt

SEQ ID NO: 17845 - DNA, 71 bp, chicken (Gallus Gallus)
  misc_feature (36): n=c or t
tgtttccagagttgcagttaggaagactcaattganagtgtttgtttaagtcttcgcatagatggtcctgt

SEQ ID NO: 17846 - DNA, 71 bp, chicken (Gallus Gallus)
  misc_feature (36): n=c or t
tgtttttttttttttaattcctgttctacttcttanaggatttcaacatagaatagaatgatctgggttga

SEQ ID NO: 17847 - DNA, 71 bp, chicken (Gallus Gallus)
  misc_feature (36): n=a or g
atgaatgggtatcactttatgccaacatgcagcccngtcacttttatgcctaatgaatgacctacttgcat

SEQ ID NO: 17848 - DNA, 71 bp, chicken (Gallus Gallus)
  misc_feature (36): n=a or g
gggaaggggaaagaatcgcctgctccaccaatgaantaacagtattaataaccaccattacaaattgctac

SEQ ID NO: 17849 - DNA, 71 bp, chicken (Gallus Gallus)
  misc_feature (36): n=a or g
gtgtacacacttgcagggaataagcgctcatgctcnctactagttggatctggggacatggagctgcagca

SEQ ID NO: 17850 - DNA, 71 bp, chicken (Gallus Gallus)
  misc_feature (36): n=c or t
ttgttttgttttcctttttcatgctcagtactctgngttttcaaaaagagatctggctgtttcaccctgtg

SEQ ID NO: 17851 - DNA, 71 bp, chicken (Gallus Gallus)
  misc_feature (36): n=a or c
tcaagattttagcctgagtaatgtacctcattacanaaaactctcttaattacctattacctgtggagatt

SEQ ID NO: 17852 - DNA, 71 bp, chicken (Gallus Gallus)
  misc_feature (36): n=a or t
aaaattctgttaagccacatactgtatttttaaggntgcttagatattgtgcttttatattgtactgcaaa

SEQ ID NO: 17853 - DNA, 71 bp, chicken (Gallus Gallus)
  misc_feature (36): n=a or g
cctgaggaattcgtcctcaaactgaaacgttaggangacggagcttgtagtaaactgacaaaatgaataat

SEQ ID NO: 17854 - DNA, 71 bp, chicken (Gallus Gallus)
  misc_feature (36): n=c or t
caaacttgattgttccaagcttttctgtaaccatcnctgccactccagatatacagacgagtgccaactgc

SEQ ID NO: 17855 - DNA, 71 bp, chicken (Gallus Gallus)
  misc_feature (36): n=g or t
tgaaatgtaaagtttagtaactgatcttttattctncttttaaaacatttttgctctcaaacaatcactga

SEQ ID NO: 17856 - DNA, 71 bp, chicken (Gallus Gallus)
  misc_feature (36): n=c or g
catcaacaatcaccttcccaaactcagctgaagcanagaaaacttctaaaatattattctctttcaccagc

SEQ ID NO: 17857 - DNA, 71 bp, chicken (Gallus Gallus)
  misc_feature (36): n=c or t
atgcgcaccaagtgtcacagaggccctctggaaagngaaggtagcgtaattcctttgtttgtaacttaata

SEQ ID NO: 17858 - DNA, 71 bp, chicken (Gallus Gallus)
  misc_feature (36): n=a or g
agggactctagcaggcagtgtagttgtaggatgagnaaacagatttagattagacattaggaaggaatttt

SEQ ID NO: 17859 - DNA, 71 bp, chicken (Gallus Gallus)
  misc_feature (36): n=a or g
tttccccacgctatccacaacctaattgtaaagtangaaagtgtttatctcacttttgtcaacaagaaata

SEQ ID NO: 17860 - DNA, 71 bp, chicken (Gallus Gallus)
  misc_feature (36): n=a or g
ggtttgatgcaggagaaaacggggtatagaaatacnctgtgtggctggggcgctgccatctgcacagggcc

SEQ ID NO: 17861 - DNA, 71 bp, chicken (Gallus Gallus)
  misc_feature (36): n=a or g
tatagaggtaatagggtgcccactctcagtatctcntagcccacctcgtgctgaaaacagcccattcagct

SEQ ID NO: 17862 - DNA, 71 bp, chicken (Gallus Gallus)
  misc_feature (36): n=c or t
cataactcacttttcaataaaagtagtgtaatttgncaacaagcaaagagataacttacatccttaaatag

SEQ ID NO: 17863 - DNA, 71 bp, chicken (Gallus Gallus)
  misc_feature (36): n=c or t
attcttccagttcagaatgtatcagctgaagtgaantgtcaattcttgtgggatataaccatatacactaa

SEQ ID NO: 17864 - DNA, 71 bp, chicken (Gallus Gallus)
  misc_feature (36): n=c or t
cccactgggagcctgcagaggtttacagtgacaggntcctaagccaatccaaggatgcactgaccagagcc

SEQ ID NO: 17865 - DNA, 71 bp, chicken (Gallus Gallus)
  misc_feature (36): n=c or t
agaaaacgtagtgtgttgtggatagtcatattcaantagaacttgtttgtgacctcattacctcactgaac

SEQ ID NO: 17866 - DNA, 71 bp, chicken (Gallus Gallus)
  misc_feature (36): n=c or t
ctgccaggcctctgacttaatagcatttgaaggcantcaggacacaatgtgagaacttgtcatttctcaag

SEQ ID NO: 17867 - DNA, 71 bp, chicken (Gallus Gallus)
  misc_feature (36): n=c or g
atggtgtatctgcagtgtatatcaaaatggcaccgnagtacctgggcaaaacgcatggactgtgtgggaac

SEQ ID NO: 17868 - DNA, 71 bp, chicken (Gallus Gallus)
  misc_feature (36): n=a or g
ttaggacaaattcctgcattctgcttcacttgagcnaggactgtattttcctcataaggctttgtaacaat

SEQ ID NO: 17869 - DNA, 71 bp, chicken (Gallus Gallus)
  misc_feature (36): n=a or g
attaatgtacaaaacaaaattccagattcaactttnaactatgatataattacagaaatggttcagataaa

SEQ ID NO: 17870 - DNA, 71 bp, chicken (Gallus Gallus)
  misc_feature (36): n=c or t
gcagaaatatacaatagcattccatttaattttctnatgatgatatcttatctttcctcctgaaattgtcc

SEQ ID NO: 17871 - DNA, 71 bp, chicken (Gallus Gallus)
  misc_feature (36): n=c or t
acggtaggtgtttttccatgtgtttagcaatgtgcnttgaacagaaaatgaaatagtaatattgagaagac

SEQ ID NO: 17872 - DNA, 71 bp, chicken (Gallus Gallus)
  misc_feature (36): n=c or t
actgtacatttaatagcccttgcattaatacatgtnttctatagggaactatgtgaatggtatcagctgac

SEQ ID NO: 17873 - DNA, 71 bp, chicken (Gallus Gallus)
  misc_feature (36): n=a or g
aatactaagaatgtaaggcagggtacagaggaagtngaagcgaggctctggaagaggcagccttactgtca

SEQ ID NO: 17874 - DNA, 71 bp, chicken (Gallus Gallus)
  misc_feature (36): n=a or g
gcttatctgaatgctgacatttgagggactgtgtgnaggagcacaagtcaatatgtttatgctcctctggt

SEQ ID NO: 17875 - DNA, 71 bp, chicken (Gallus Gallus)
  misc_feature (36): n=a or t
gtaaataattaaattaacttttaacatatctaatgntaacacagctaacagatgtaacctattgaaacaat

SEQ ID NO: 17876 - DNA, 71 bp, chicken (Gallus Gallus)
  misc_feature (36): n=a or c
gtaagcaaacagtgtactgcagtattagaaacctgnattgcaaaggaagtgtagaagcagcagtttaagtg

SEQ ID NO: 17877 - DNA, 71 bp, chicken (Gallus Gallus)
  misc_feature (36): n=g or t
gaggtgacctaattgttctctttctcagggaaaatngaggtattatctgaaaaaacagttcaaaggcatcc

SEQ ID NO: 17878 - DNA, 71 bp, chicken (Gallus Gallus)
  misc_feature (36): n=a or g
accaggttggctctgtatgtcccaaacagtcctctnatgctatcccaccttcatatgtgcactcaagcact

SEQ ID NO: 17879 - DNA, 71 bp, chicken (Gallus Gallus)
  misc_feature (36): n=a or g
acaagctctcggcaggaacaagcatttaatgttacngatattctttagtcgtgctatagggttttcactga

SEQ ID NO: 17880 - DNA, 71 bp, chicken (Gallus Gallus)
  misc_feature (36): n=a or g
ctgacatctatgagactgtcaagtctgtgcatccancagctccctttggccttacactttcctttgagagc

SEQ ID NO: 17881 - DNA, 71 bp, chicken (Gallus Gallus)
  misc_feature (36): n=a or g
gataatgacatcagaatcttagcacaggatttcagncacaggtctccaaaattcaatgaaccaagttgact

SEQ ID NO: 17882 - DNA, 71 bp, chicken (Gallus Gallus)
  misc_feature (36): n=a or g
atttgggactatttgaccctggaacatttgcaaccnaagttagagtatattttagaaatttcacatgcagg

SEQ ID NO: 17883 - DNA, 71 bp, chicken (Gallus Gallus)
  misc_feature (36): n=c or t
gttgttgtattgctcctccatccttcaccacctganttctcttaaagaaatggataccaagaacagcataa

SEQ ID NO: 17884 - DNA, 71 bp, chicken (Gallus Gallus)
  misc_feature (36): n=c or t
ttctcccaccataattacactgctgtgctggttctnactaccaccacctatactgaatagcacaaactgca

SEQ ID NO: 17885 - DNA, 71 bp, chicken (Gallus Gallus)
  misc_feature (36): n=c or t
ggttttgctttgaagccaatgcaaaggagcacaggngcttacacatcctggtgacaaatgtctttagacaa

SEQ ID NO: 17886 - DNA, 71 bp, chicken (Gallus Gallus)
  misc_feature (36): n=c or t
ggttaatgcatagaaaagttcttgcttttatggcantgtgtttataactttccaaaagaaaataatgtaat

SEQ ID NO: 17887 - DNA, 71 bp, chicken (Gallus Gallus)
  misc_feature (36): n=a or t
taattcagtaaaaaacatgagttcagcacaaactcntttctcaaacgcaccttttagcagaagactaatat

SEQ ID NO: 17888 - DNA, 71 bp, chicken (Gallus Gallus)
  misc_feature (36): n=c or t
tggagttagcaatgcaacccttcagcatgcatacangctagctttgcagatgccacttctatagcctagtg

SEQ ID NO: 17889 - DNA, 71 bp, chicken (Gallus Gallus)
  misc_feature (36): n=c or t
atgaaggctttatgaaacatccctgctctggggtcntgtcgggttgaaggggcagagatagctgtatgtgg

SEQ ID NO: 17890 - DNA, 71 bp, chicken (Gallus Gallus)
  misc_feature (36): n=a or t
aaatcctgtcaaagtaaataagagttttgcaggagntttcagggaggccagaatttcattcactttcttta

SEQ ID NO: 17891 - DNA, 71 bp, chicken (Gallus Gallus)
  misc_feature (36): n=a or g
ttactgggcttagtatcaatatagctatatcatcantgttgcacttcaaaagaatagatgcacactagagc

SEQ ID NO: 17892 - DNA, 71 bp, chicken (Gallus Gallus)
  misc_feature (36): n=c or t
ttcctgtatttcataattattaatcaaagaagtctntctagaacatttaatataagcatgtactgtaattg

SEQ ID NO: 17893 - DNA, 71 bp, chicken (Gallus Gallus)
  misc_feature (36): n=a or g
gctgctttgctttaacacagattctgcctccaggantaaaaacaggagagcacagctgcagcgagctcaac

SEQ ID NO: 17894 - DNA, 71 bp, chicken (Gallus Gallus)
  misc_feature (36): n=g or t
tacccggacagctgtcgtccttaaaaattccttttnttaacggaactttttctcaaggaaaacggtacaag

SEQ ID NO: 17895 - DNA, 71 bp, chicken (Gallus Gallus)
  misc_feature (36): n=c or t
cagcagaattcccttggcagtgtgcatcccaaccanggcatttcccaggcgagaggaagcgcatttcagct

SEQ ID NO: 17896 - DNA, 71 bp, chicken (Gallus Gallus)
  misc_feature (36): n=a or g
gtcgtgccacagggctgatttggctgtgggttccantgccaacgttgtcacctggactaccttcagtacac

SEQ ID NO: 17897 - DNA, 71 bp, chicken (Gallus Gallus)
  misc_feature (36): n=a or t
aaaaaaaaaaaaaaaagtaagaaaaaggaaaataanaattcaattgttgtctgcagtgcaataattataga

SEQ ID NO: 17898 - DNA, 71 bp, chicken (Gallus Gallus)
  misc_feature (36): n=a or g
atctctcttagattccagttttggatgttagcctcntggtcctttgggaaccatgacatgtcctgtcctca

SEQ ID NO: 17899 - DNA, 71 bp, chicken (Gallus Gallus)
  misc_feature (36): n=a or g
cctcaatgtttaaattctgtccttctgtcaaatgcnagagttaaactcatgaaaacactacaacctaaaac

SEQ ID NO: 17900 - DNA, 71 bp, chicken (Gallus Gallus)
  misc_feature (36): n=a or t
agctaggtacaagatcaaaactgtagcttcaagcancccaagcatttcatgtgaaaagacagatgtaggta

SEQ ID NO: 17901 - DNA, 71 bp, chicken (Gallus Gallus)
  misc_feature (36): n=a or c
gccacccattagccaggtaagaagtttcttctcatnccaccctcctctcaactcaggatacagagttccct

SEQ ID NO: 17902 - DNA, 71 bp, chicken (Gallus Gallus)
  misc_feature (36): n=a or t
agaaatgcaaatcaaagaaagatggtaagaataacntaaagacacaaacaaagagatctttcaatttagct

SEQ ID NO: 17903 - DNA, 71 bp, chicken (Gallus Gallus)
  misc_feature (36): n=c or t
tgtctggtcctaacatttatggtctctaatatatcnccttagaatttaattgcatattaatatattatact

SEQ ID NO: 17904 - DNA, 71 bp, chicken (Gallus Gallus)
  misc_feature (36): n=a or g
atatcccatatcattagcagagcaccaattacttcncaagccaactccaatggctctgaaccagcagaata

SEQ ID NO: 17905 - DNA, 71 bp, chicken (Gallus Gallus)
  misc_feature (36): n=c or t
tttccttggctctctgttcaaataattcattactangttttgcctgcaaacttttttatggtgtttttttt

SEQ ID NO: 17906 - DNA, 71 bp, chicken (Gallus Gallus)
  misc_feature (36): n=c or t
gactcagcatcgtgatctaaaaataaatacaaaacnagtggcagccaatgtggacttgctcaccaaagcag

SEQ ID NO: 17907 - DNA, 71 bp, chicken (Gallus Gallus)
  misc_feature (36): n=c or t
aaattatatactgagttttaactaactctgcattantgtgcagtgtaagaatgtgtatcttgcttctccac

SEQ ID NO: 17908 - DNA, 71 bp, chicken (Gallus Gallus)
  misc_feature (36): n=c or t
attcaagactattgaaggattctcaaattagcaacncgtaaagcaaaatagtcctaatcagctgtcgtttt

SEQ ID NO: 17909 - DNA, 71 bp, chicken (Gallus Gallus)
  misc_feature (36): n=a or g
actcccatggaatagggggggtatgtttgtttttcngttgcgccaccttaatattcagatgctagtgtttc

SEQ ID NO: 17910 - DNA, 71 bp, chicken (Gallus Gallus)
  misc_feature (36): n=a or g
gtggtttaatagtagaaggtgtcacactacttttanagaagcttcctggaaaatactatgatccatttctt

SEQ ID NO: 17911 - DNA, 71 bp, chicken (Gallus Gallus)
  misc_feature (36): n=a or t
gcttggaaattctgcattttgcattctttggacatngtttttagagaagattatttgagaatcttctataa

SEQ ID NO: 17912 - DNA, 71 bp, chicken (Gallus Gallus)
  misc_feature (36): n=c or t
tgtggatggcagctcatgtcagggatcaaggatcanccagttaatagttttacatttagaactcaccaata

SEQ ID NO: 17913 - DNA, 71 bp, chicken (Gallus Gallus)
  misc_feature (36): n=a or g
aaagtggatcccagatttcatgaagtataaaaatantgagtgtcaagaatccattctcaagttcataattt

SEQ ID NO: 17914 - DNA, 71 bp, chicken (Gallus Gallus)
  misc_feature (36): n=c or t
tttaaaagcacaagcaagcagaactgggtgatccanccttctcagtaatggtctgcaatggcttcttttgc

SEQ ID NO: 17915 - DNA, 71 bp, chicken (Gallus Gallus)
  misc_feature (36): n=c or t
tgctttttgaattagtagtcacattgcttttcagtnacaatatttagaaacaaggcagccctgtagctctg

SEQ ID NO: 17916 - DNA, 71 bp, chicken (Gallus Gallus)
  misc_feature (36): n=a or g
tcctctgctcttgtaaagactacctggacctcagtncttggaaacagaaagcgataggacaagtgtcaatt

SEQ ID NO: 17917 - DNA, 71 bp, chicken (Gallus Gallus)
  misc_feature (36): n=a or g
agaagcagaatctcgccagaagtgtgcaatgcctgnctctgcaagtggtgaaagacttcagggaaactcaa

SEQ ID NO: 17918 - DNA, 71 bp, chicken (Gallus Gallus)
  misc_feature (36): n=a or g
cagatgatatttccaagctttctgcactgagggcgntatcgccattgtttcaacaactgcccctcttcttt

SEQ ID NO: 17919 - DNA, 71 bp, chicken (Gallus Gallus)
  misc_feature (36): n=a or c
gatatggagtacatacgttgtttaaacttaaaatantaaaataatactgtattgctgcatcttaacccagc

SEQ ID NO: 17920 - DNA, 71 bp, chicken (Gallus Gallus)
  misc_feature (36): n=c or g
gctgcacagagagggtacctcgacctgctgtaaganctggatgcttggcttgagcttgtgaatatattaca

SEQ ID NO: 17921 - DNA, 71 bp, chicken (Gallus Gallus)
  misc_feature (36): n=c or t
accacattttcagctagcaacctgaaatataacttntagcttctgaaattaccggcatgcacggtttatct

SEQ ID NO: 17922 - DNA, 71 bp, chicken (Gallus Gallus)
  misc_feature (36): n=c or t
tgagagaacataagacgtatattggctgttacttgnttttaaatttgaaacagacaaaggtactttaaagt

SEQ ID NO: 17923 - DNA, 71 bp, chicken (Gallus Gallus)
  misc_feature (36): n=a or g
acacggattttcttctcctgtcccttccaaaatatntgtaaacagtactgaggaggaaggtgggttactag

SEQ ID NO: 17924 - DNA, 71 bp, chicken (Gallus Gallus)
  misc_feature (36): n=a or c
tatgctaaatccaagttgtccacaacatagttaatnccacttcctctcaagggaactggaatttcaaaaca

SEQ ID NO: 17925 - DNA, 71 bp, chicken (Gallus Gallus)
  misc_feature (36): n=a or g
aaacagcctgtaccccttgccttcaagtttgtaagncaattcctttcagcagaacaaagttacagtttaag

SEQ ID NO: 17926 - DNA, 71 bp, chicken (Gallus Gallus)
  misc_feature (36): n=a or g
atttttttgttttcagcatttaaaaaaaacaacccnacagtacagaagacttgagcaaaacactcagatgt

SEQ ID NO: 17927 - DNA, 71 bp, chicken (Gallus Gallus)
  misc_feature (36): n=g or t
tctgctgtatcgtttttctgtggtgctttagaatanatccagctatcagtaagactagatatgtaaagtgt

SEQ ID NO: 17928 - DNA, 71 bp, chicken (Gallus Gallus)
  misc_feature (36): n=c or t
ctaaatgacagaaacaaaatagcagttccgagacanatattaaagacttaaaacacttattttcagttgca

SEQ ID NO: 17929 - DNA, 71 bp, chicken (Gallus Gallus)
  misc_feature (36): n=a or g
catgagtcattgaaaatcataatgatcaagtgtctncatcacctcccatattaaagtgagatgatagaaca

SEQ ID NO: 17930 - DNA, 71 bp, chicken (Gallus Gallus)
  misc_feature (36): n=c or g
tcaaatttgcttatatggttaagatcattagcattnttacaaagaatccagatgtggaataggaatagggt

SEQ ID NO: 17931 - DNA, 71 bp, chicken (Gallus Gallus)
  misc_feature (36): n=c or t
aagcaaggtatgtgcaagcatagaatttgttgcttngcatttggagctatactttcaatccagttggtgag

SEQ ID NO: 17932 - DNA, 71 bp, chicken (Gallus Gallus)
  misc_feature (36): n=c or t
agactttacgaaaactctaatgctaatgtgatgganggtgcggtgttgcaaaagcaacagagaacagaaaa

SEQ ID NO: 17933 - DNA, 71 bp, chicken (Gallus Gallus)
  misc_feature (36): n=c or t
atcgtttactgtaggcaacttgaaagccatttctcngatactgtgcttacagcttcttaatagctattaag

SEQ ID NO: 17934 - DNA, 71 bp, chicken (Gallus Gallus)
  misc_feature (36): n=c or t
gactggttctgtagaacctctggtgctgtgaatgcncgcaggtcttggtgggaaacattgtcatcagtaaa

SEQ ID NO: 17935 - DNA, 71 bp, chicken (Gallus Gallus)
  misc_feature (36): n=a or g
aaaactattttatggtcctcttgaatcaaagtagtncagtcatgtatgtgtccttttatttgcattcatat

SEQ ID NO: 17936 - DNA, 71 bp, chicken (Gallus Gallus)
  misc_feature (36): n=c or t
tacaggcactggtttcgctgcctgtgttctttatgnactgttatcgtgagtctaattctttgattaataaa

SEQ ID NO: 17937 - DNA, 71 bp, chicken (Gallus Gallus)
  misc_feature (36): n=c or g
aaattcacgttttggcattaaaggacttaataattntgaatgacagcaccccaacatcacttgccactatt

SEQ ID NO: 17938 - DNA, 71 bp, chicken (Gallus Gallus)
  misc_feature (36): n=a or g
ttgtggagcaagctttctgttggtcaactcttttgnctctaggctcagcctataagtaactaaaattttag

SEQ ID NO: 17939 - DNA, 71 bp, chicken (Gallus Gallus)
  misc_feature (36): n=a or c
tctaatacaaaaaaaatgcttttcaaattttctgcngcttagcaaagctacacatacctgagcaaaaaata

SEQ ID NO: 17940 - DNA, 71 bp, chicken (Gallus Gallus)
  misc_feature (36): n=c or t
agaaatatgtaacattttctaatatttagcttatancaacagggagactgaaatttgtattttttttttct

SEQ ID NO: 17941 - DNA, 71 bp, chicken (Gallus Gallus)
  misc_feature (36): n=c or t
agtaacaaccaaaacacggtcctactcatcttcacngttaactttccacatggtttttctctgctatacaa

SEQ ID NO: 17942 - DNA, 71 bp, chicken (Gallus Gallus)
  misc_feature (36): n=a or g
gtttttcttattgtgggaaagtaatgtcatgttcanaactgccaaagttacttgaatttgacttagctgtt

SEQ ID NO: 17943 - DNA, 71 bp, chicken (Gallus Gallus)
  misc_feature (36): n=c or t
tttctaactttctcccatggtgtttgttgtttctanttatgtaatggtaatttgatatcatgttaaaagca

SEQ ID NO: 17944 - DNA, 71 bp, chicken (Gallus Gallus)
  misc_feature (36): n=c or t
aaaaataccctgaattccaaaaacgttatatacttntggaatatctatagaaaacaagaagtgcaaaaacg

SEQ ID NO: 17945 - DNA, 71 bp, chicken (Gallus Gallus)
  misc_feature (36): n=a or g
tgcattctgatgtgcagagatacctacaggccttgntcatgcttcaggtaagaaggatagctgtggctttt

SEQ ID NO: 17946 - DNA, 71 bp, chicken (Gallus Gallus)
  misc_feature (36): n=c or t
agagctgatgacacagatatttcacatcagtaacantggatgtacgggtttctaatttgcacaagcataga

SEQ ID NO: 17947 - DNA, 71 bp, chicken (Gallus Gallus)
  misc_feature (36): n=a or t
ggacagcagacacacattttaagtttaaagactctnccatttctaaatagttaacgccttatttactgaat

SEQ ID NO: 17948 - DNA, 71 bp, chicken (Gallus Gallus)
  misc_feature (36): n=a or c
aacctgctagcaagatggaactgacccacctcccanagcctttcctcatctttcagcaatcttatcctcag

SEQ ID NO: 17949 - DNA, 71 bp, chicken (Gallus Gallus)
  misc_feature (36): n=c or t
tgatcttgaatagcctggacctgtttgattacttangagtgtaccatatggttgtatgttttagttgaacg

SEQ ID NO: 17950 - DNA, 71 bp, chicken (Gallus Gallus)
  misc_feature (36): n=a or g
cctgaatatattccctaaaagcacacatagtatggncgatatacaatatgctaataaacccgccattccct

SEQ ID NO: 17951 - DNA, 71 bp, chicken (Gallus Gallus)
  misc_feature (36): n=a or g
gcacatttgcattgctgagctctcgatggcaagaangcattagaaattgtgtattagaaacaagttattag

SEQ ID NO: 17952 - DNA, 71 bp, chicken (Gallus Gallus)
  misc_feature (36): n=c or t
gtgtcatcttggccagctccctcaggatgctggggnggatttcctcaggagcagccaatcagaacacatct

SEQ ID NO: 17953 - DNA, 71 bp, chicken (Gallus Gallus)
  misc_feature (36): n=c or t
agagtctggaagtgttagagaagtttcttactggangataagtttctatgtgtttgtaatgaatgttgtct

SEQ ID NO: 17954 - DNA, 71 bp, chicken (Gallus Gallus)
  misc_feature (36): n=a or g
tagaggaagtgcagaacatgtgcagaaatggcatcntagaatggcttgggttggaagggaccccaaggatc

SEQ ID NO: 17955 - DNA, 71 bp, chicken (Gallus Gallus)
  misc_feature (36): n=g or t
atatgcatacagcctgcctgcttgttttgctgcgtntaagctcaccatttggcataagacaaagccactga

SEQ ID NO: 17956 - DNA, 71 bp, chicken (Gallus Gallus)
  misc_feature (36): n=c or t
ctgtgccctgcaagccatgtgtaatctgcatggaanacatgctctgtgatattgctcccagcttttaagga

SEQ ID NO: 17957 - DNA, 71 bp, chicken (Gallus Gallus)
  misc_feature (36): n=a or g
tggaccaagttatgcacagattttaatagatgtcantgttggaaaaaaatgtatgtgaaatatggagaaat

SEQ ID NO: 17958 - DNA, 71 bp, chicken (Gallus Gallus)
  misc_feature (36): n=a or c
atggcttttttagatgattagatactacatttgtanaaatcagcagctaccttttatcctcagcccttctt

SEQ ID NO: 17959 - DNA, 71 bp, chicken (Gallus Gallus)
  misc_feature (36): n=c or g
ctctctgacctgttcctgcagagtttcatgatgatntgcttgaacgggcttcagttcatcaccaggtgtag

SEQ ID NO: 17960 - DNA, 71 bp, chicken (Gallus Gallus)
  misc_feature (36): n=g or t
tcctatctcctggatcgttctgcaggctgctcttcnggctgaataaagatagctataggaactcgttaatg

SEQ ID NO: 17961 - DNA, 71 bp, chicken (Gallus Gallus)
  misc_feature (36): n=c or g
actcctactaaactgaaccaacagtcatagaacccnaattcatatttcttttcaatcatcttctgtccaaa

SEQ ID NO: 17962 - DNA, 71 bp, chicken (Gallus Gallus)
  misc_feature (36): n=a or c
gccgtgccataaagacctgaaaagcagggcatgaanatgtcatgatggtacatacaaaatctgctccaaaa

SEQ ID NO: 17963 - DNA, 71 bp, chicken (Gallus Gallus)
  misc_feature (36): n=a or g
atcaggtctgataatggtacctccagaataaggccngtccatacttctcactgtctgtttcaatgcatcct

SEQ ID NO: 17964 - DNA, 71 bp, chicken (Gallus Gallus)
  misc_feature (36): n=c or t
cgtttggcatccccatttctctgtttgagttcaagnagcctacacaccttgcaagtccagcaacaatgagg

SEQ ID NO: 17965 - DNA, 71 bp, chicken (Gallus Gallus)
  misc_feature (36): n=c or t
atttgaaataaataagtattagctattttaaaagangttacctcatagagcagataaatgatagggataaa

SEQ ID NO: 17966 - DNA, 71 bp, chicken (Gallus Gallus)
  misc_feature (36): n=c or t
tccctggagttgctcttggtgttatttcatgtggantgaaacacattggtgaggacgtgttcctcacaact

SEQ ID NO: 17967 - DNA, 71 bp, chicken (Gallus Gallus)
  misc_feature (36): n=a or g
gatttcctgaaaatcacttagcaaatgacagatctngggaaaaaaacgtcgacttccagtgatccactcgc

SEQ ID NO: 17968 - DNA, 71 bp, chicken (Gallus Gallus)
  misc_feature (36): n=a or g
ctgctggaaactaaatccctgattagaccaccaacnattcccttatacatttcctactggctttaattgcc

SEQ ID NO: 17969 - DNA, 71 bp, chicken (Gallus Gallus)
  misc_feature (36): n=a or g
gcctctctttttgcatgaattgctgtcaacttttanaaattttatagccctgggctgcttgctgcaacata

SEQ ID NO: 17970 - DNA, 71 bp, chicken (Gallus Gallus)
  misc_feature (36): n=g or t
gtcaaacaagggatatgaatacgctgcgtatttctntgtggctcccctagtctggaatgtactttttcagg

SEQ ID NO: 17971 - DNA, 71 bp, chicken (Gallus Gallus)
  misc_feature (36): n=a or c
tcacagctttagattaaaaaatttcctttcccatgnagacatttcttagctcacataggggatgcctacag

SEQ ID NO: 17972 - DNA, 71 bp, chicken (Gallus Gallus)
  misc_feature (36): n=a or g
ctactgcagtctgttttaatacagcagaacacaaanttgtttatttttgtgaggctatgtactgaatcaca

SEQ ID NO: 17973 - DNA, 71 bp, chicken (Gallus Gallus)
  misc_feature (36): n=a or c
ctacctttgaactcttctagaatgaaggatattggngagaaatttcaaaacatgtttgtaaaatttgcact

SEQ ID NO: 17974 - DNA, 71 bp, chicken (Gallus Gallus)
  misc_feature (36): n=a or g
cttagagatgtatcttataattagtattactttgcngcatgtattctgaaaacagtttacaaacatcatgt

SEQ ID NO: 17975 - DNA, 71 bp, chicken (Gallus Gallus)
  misc_feature (36): n=a or g
ataaaaagtcttgaaaaggaagatactttactgaangaagaaagcagtacctatgatgacattgtttttgt

SEQ ID NO: 17976 - DNA, 71 bp, chicken (Gallus Gallus)
  misc_feature (36): n=a or g
catcaaagtaaaaattgatggtactgtagatcagcntgaacaattgtccttcaaggataataacaaaagag

SEQ ID NO: 17977 - DNA, 71 bp, chicken (Gallus Gallus)
  misc_feature (36): n=c or t
atctaacttcagttcatactcgttagaccaacaaanaagcatgtctagataaagctgctggatatacttcc

SEQ ID NO: 17978 - DNA, 71 bp, chicken (Gallus Gallus)
  misc_feature (36): n=a or g
gtgtgacagatatcaagtagctgatgataaagcagntgaaggtttcttgtaaattattgatattctctagt

SEQ ID NO: 17979 - DNA, 71 bp, chicken (Gallus Gallus)
  misc_feature (36): n=c or t
cagccattctgaatatctttcaactctccatcacanggaaaaaaaaaaaataggaaggcatttgccccagt

SEQ ID NO: 17980 - DNA, 71 bp, chicken (Gallus Gallus)
  misc_feature (36): n=a or t
tccaggcacagacatatagtagagttaaggagagangagttttagttaagttcaagttctcaggctttgaa

SEQ ID NO: 17981 - DNA, 71 bp, chicken (Gallus Gallus)
  misc_feature (36): n=a or g
aaatagaaaactttgctttctgcttgcgaagcattngggatcaagaacttttccaacagagactaaaacag

SEQ ID NO: 17982 - DNA, 71 bp, chicken (Gallus Gallus)
  misc_feature (36): n=a or g
ataataataataattttctgaaacatccttgtcccntatgattgaaagaagcagtaatcctgtaactgagg

SEQ ID NO: 17983 - DNA, 71 bp, chicken (Gallus Gallus)
  misc_feature (36): n=a or g
cctggtagttagaaggtgttctgcagtaaagtcacncagtttgtaatgagtgacattttgtataaacccag

SEQ ID NO: 17984 - DNA, 71 bp, chicken (Gallus Gallus)
  misc_feature (36): n=c or t
actttatcattctacttcccaccctgtggaaaaatnccccctcctgtcatcatggtgcagaatgtcagctt

SEQ ID NO: 17985 - DNA, 71 bp, chicken (Gallus Gallus)
  misc_feature (36): n=a or g
caaactaatctgggtttggattaaaaatagaagagncattgtgctgttcagacaaacacacacctcatggt

SEQ ID NO: 17986 - DNA, 71 bp, chicken (Gallus Gallus)
  misc_feature (36): n=c or t
tgggttaagacatgcctaagctaattagaagatcgntgtctttcatcacaatataacactagctattgatt

SEQ ID NO: 17987 - DNA, 71 bp, chicken (Gallus Gallus)
  misc_feature (36): n=a or g
gaagcccaggcaaacctaaagtatcagggattaaangtagtgtactttttctcttcgtgatttgactttat

SEQ ID NO: 17988 - DNA, 71 bp, chicken (Gallus Gallus)
  misc_feature (36): n=c or t
actacgctttcctcaactgcaggacatttgccctcnctacacaccaaggcaaacaagttgaacaaatacta

SEQ ID NO: 17989 - DNA, 71 bp, chicken (Gallus Gallus)
  misc_feature (36): n=c or t
acaagaatataggcaactgactcagaagccaatttngctgtgtgcactatgaaatactgaatggcgtttag

SEQ ID NO: 17990 - DNA, 71 bp, chicken (Gallus Gallus)
  misc_feature (36): n=a or g
cacctcttttccagcctcgatataaagaaaggcacntggtacgtgatagaaacaaactacgatcgctggaa

SEQ ID NO: 17991 - DNA, 71 bp, chicken (Gallus Gallus)
  misc_feature (36): n=c or t
aagtggctgtacattttgagttagtgctcaggaaangtttcatcactatttgggaaaacttcattgtctgg

SEQ ID NO: 17992 - DNA, 71 bp, chicken (Gallus Gallus)
  misc_feature (36): n=c or g
caatagcagctgggttcaactcagtgctcactacanggttccaatttttttgaaaaaaaaaaaaaaaattt

SEQ ID NO: 17993 - DNA, 71 bp, chicken (Gallus Gallus)
  misc_feature (36): n=c or g
acatagagagcacacgtgtctgtatagtatatatanacatatatatgtaataaattatatatctataggtg

SEQ ID NO: 17994 - DNA, 71 bp, chicken (Gallus Gallus)
  misc_feature (36): n=c or g
cttcagaaaaaaaaacattaacaacaacaaaaaaanctgttatgtattctgagttgtgctttcatggaagt

SEQ ID NO: 17995 - DNA, 71 bp, chicken (Gallus Gallus)
  misc_feature (36): n=c or g
caagtaaagccctgaagagcatcatctgcagactgnaaaagaaatccttcaatgtaatccagatgttcaag

SEQ ID NO: 17996 - DNA, 71 bp, chicken (Gallus Gallus)
  misc_feature (36): n=a or t
cgtgtcattttattgctgtaatcatgaagtccttcngtagtgcatgctattcagcttttcttttcttctat

SEQ ID NO: 17997 - DNA, 71 bp, chicken (Gallus Gallus)
  misc_feature (36): n=c or g
agtactgaaaaatctacagagtagaattttttgttnaaatactttagttgtgtgtcatgtttttatgattt

SEQ ID NO: 17998 - DNA, 71 bp, chicken (Gallus Gallus)
  misc_feature (36): n=c or t
atttagatctggagcagtctgaaaaacaccacaaangtttttgtcaagtaggcccacattcaccacacaat

SEQ ID NO: 17999 - DNA, 71 bp, chicken (Gallus Gallus)
  misc_feature (36): n=a or c
gcagaatcatggttaccgtagaaaaaattatatgtngctgtatatatgtgtgtgtttttgtcaaaagcaag

SEQ ID NO: 18000 - DNA, 71 bp, chicken (Gallus Gallus)
  misc_feature (36): n=a or t
aggaagtctcagaggcattttaatgtaaatacctgncaggggagactgaagaagacagagcaaggctcttc

SEQ ID NO: 18001 - DNA, 71 bp, chicken (Gallus Gallus)
  misc_feature (36): n=c or t
atgcagacacttactgctcttattggccaagtgctnactaagtgctattgtttgtaatggcaaactgttta

SEQ ID NO: 18002 - DNA, 71 bp, chicken (Gallus Gallus)
  misc_feature (36): n=c or t
acgttcattatattctctgaatacatattttgtatnttgaagatttctccattagatgaaaatacttctta

SEQ ID NO: 18003 - DNA, 71 bp, chicken (Gallus Gallus)
  misc_feature (36): n=a or t
taaccagcagacgtatagctggattttctgctattntcatcttctgactgattctgtgtctatcatcatgc

SEQ ID NO: 18004 - DNA, 71 bp, chicken (Gallus Gallus)
  misc_feature (36): n=a or g
gaccattgcttaactggggccattttcttgatccangcacaagatacttctgcagagagattgctattgca

SEQ ID NO: 18005 - DNA, 71 bp, chicken (Gallus Gallus)
  misc_feature (36): n=a or t
acaggaaatttttaaccatgagagcacttggcaatnggaacaatcgctgaataggaattcaattgctgaat

SEQ ID NO: 18006 - DNA, 71 bp, chicken (Gallus Gallus)
  misc_feature (36): n=a or g
gattctgaacagatcaactttttaaagaaagcaagnctgtatattcagcaacaaaagtacagtgaagcagt

SEQ ID NO: 18007 - DNA, 71 bp, chicken (Gallus Gallus)
  misc_feature (36): n=c or t
aaaaacagttgacaaactaaattatatgagcaaacnacatcagaaaagagaaataacttatctaaaaactt

SEQ ID NO: 18008 - DNA, 71 bp, chicken (Gallus Gallus)
  misc_feature (36): n=c or t
aaagtagttttcactttgccatgactgtcagcttgnctgctttactgtgaaaatgcagcttaattaggcca

SEQ ID NO: 18009 - DNA, 71 bp, chicken (Gallus Gallus)
  misc_feature (36): n=a or g
gacttcataccagcctctggccaggtacggttttancaccacttaatgctgcctagcacaagagagttgat

SEQ ID NO: 18010 - DNA, 71 bp, chicken (Gallus Gallus)
  misc_feature (36): n=c or g
acagtgaggggaaggtggtcagaaagtgtcagatanagtgatgtttctggagggtacaggtatggattaga

SEQ ID NO: 18011 - DNA, 71 bp, chicken (Gallus Gallus)
  misc_feature (36): n=c or g
atattccagacgctacatagtggtagtggacatctnaagagcagtaatataggtgcttatttttgcccttg

SEQ ID NO: 18012 - DNA, 71 bp, chicken (Gallus Gallus)
  misc_feature (36): n=c or g
tcatcttcagtacaatgccttagaatagtagtttanaactcaccacttgattatttgtctcaaaagaaagc

SEQ ID NO: 18013 - DNA, 71 bp, chicken (Gallus Gallus)
  misc_feature (36): n=a or g
ttctctgatgcattacacttgttttgtaaactgtcnctgtgcagctgaacttaccctttgaataaagcctt

SEQ ID NO: 18014 - DNA, 71 bp, chicken (Gallus Gallus)
  misc_feature (36): n=c or t
ctgccttcagctctggtgtccccaacacagaaatangtgatcccatcttgcaccattgacttgcaatatgg

SEQ ID NO: 18015 - DNA, 71 bp, chicken (Gallus Gallus)
  misc_feature (36): n=a or g
aaagcaaacattggagaaaacagttcttggaatttngaacacactgctttccctgtcttcactgtaagtgg

SEQ ID NO: 18016 - DNA, 71 bp, chicken (Gallus Gallus)
  misc_feature (36): n=a or g
catgttgcccattgctaggattatgtgcagctcacnacgactgttcagtgtaaaaatgtggccagtttgag

SEQ ID NO: 18017 - DNA, 71 bp, chicken (Gallus Gallus)
  misc_feature (36): n=a or t
gggtttcagacaggaggcaaatcatttagaaaaaantcttgttctaaatctgatctcaaggacaattaatc

SEQ ID NO: 18018 - DNA, 71 bp, chicken (Gallus Gallus)
  misc_feature (36): n=a or t
gaacaccagtccttcagctaaagcaaacacagctanaaattcctcagctacttaatggctgaaacaacatc

SEQ ID NO: 18019 - DNA, 71 bp, chicken (Gallus Gallus)
  misc_feature (36): n=a or g
gttgcagccaaggaagagaaatgggccaagtgctcnagtgctttctggttgaaacatatgatgcgctctca

SEQ ID NO: 18020 - DNA, 71 bp, chicken (Gallus Gallus)
  misc_feature (36): n=a or g
ttccctgttggtgcccaaatgtcaccgtgagaaccntagctgagattacagagtgtaaaaaggcaatcata

SEQ ID NO: 18021 - DNA, 71 bp, chicken (Gallus Gallus)
  misc_feature (36): n=c or t
gatttcatgtctgttgcgctcttgtctatctgcaanactcttgtggaaaatgatagaaaaatgcttaggcg

SEQ ID NO: 18022 - DNA, 71 bp, chicken (Gallus Gallus)
  misc_feature (36): n=a or g
tatggtcatctcaatctgcacatttaacatctgatngaaaactatcattttaataatacagctgagccttt

SEQ ID NO: 18023 - DNA, 71 bp, chicken (Gallus Gallus)
  misc_feature (36): n=a or g
tactctgtaacacttcacaaatctttgatactccancatttgacagacctcaacccagttacaccacatcc

SEQ ID NO: 18024 - DNA, 71 bp, chicken (Gallus Gallus)
  misc_feature (36): n=c or t
gttaaatgctactgaacaggtactaatgttactganttaatgcaacttaaaaaaaaaaaaagaaaagctga

SEQ ID NO: 18025 - DNA, 71 bp, chicken (Gallus Gallus)
  misc_feature (36): n=c or t
cagtattgttgcatcaacttgtccatgctttcctanagacctgctttgctcctggaaaactatcagccgtg

SEQ ID NO: 18026 - DNA, 71 bp, chicken (Gallus Gallus)
  misc_feature (36): n=c or t
aatcagtggaaaaccagtggcaaccacagactaagngactaagtaccaatgattcagcagtttgtggggat

SEQ ID NO: 18027 - DNA, 71 bp, chicken (Gallus Gallus)
  misc_feature (36): n=a or g
aatgcattgcagaggtttgtgtttactccctgagcnacatgcgcagcaatgcagccctgatggctgcacag

SEQ ID NO: 18028 - DNA, 71 bp, chicken (Gallus Gallus)
  misc_feature (36): n=a or c
cctgatcaacatgagtgatgtcccaagacactgctntggatagcaacagcaggagccaccaaccgtgtgtc

SEQ ID NO: 18029 - DNA, 71 bp, chicken (Gallus Gallus)
  misc_feature (36): n=a or g
gcttgctctccagagaacaacagatgttgcatcttngagcagcctctgcaagctgtgggctaatgacctga

SEQ ID NO: 18030 - DNA, 71 bp, chicken (Gallus Gallus)
  misc_feature (36): n=c or t
ttataaaacctgtgcccaaatatggataaagtgagnagtgggatacctcccaaaatgacctctgaagacca

SEQ ID NO: 18031 - DNA, 71 bp, chicken (Gallus Gallus)
  misc_feature (36): n=a or g
atattgaattattttatatacattggcacatctggnaaaaaaaaaggcaccatacttcataacaataaaga

SEQ ID NO: 18032 - DNA, 71 bp, chicken (Gallus Gallus)
  misc_feature (36): n=a or c
gtgagaaaaccacaggggaaaaaggcagctgctaanaccactggtagtacgtggagcacaacgtgacagca

SEQ ID NO: 18033 - DNA, 71 bp, chicken (Gallus Gallus)
  misc_feature (36): n=g or t
tgtggcttctgagtcctggcagagaacaatactccnatcccatgcatgtactcacattgatttttgggaag

SEQ ID NO: 18034 - DNA, 71 bp, chicken (Gallus Gallus)
  misc_feature (36): n=a or g
ccagaagaatttatatgaattgtgtttgttctgctngttagtgagataaattaaattttctgtaatatgtc

SEQ ID NO: 18035 - DNA, 71 bp, chicken (Gallus Gallus)
  misc_feature (36): n=a or g
tcatccatgctcgttgcctgctggggcaggattatncctctgctatctttcatgtagtctcggtataaaat

SEQ ID NO: 18036 - DNA, 71 bp, chicken (Gallus Gallus)
  misc_feature (36): n=c or t
agaattccgaacagcttctttcctttttccctacanttccaccttttctatatgtgtagctgtaaactgct

SEQ ID NO: 18037 - DNA, 71 bp, chicken (Gallus Gallus)
  misc_feature (36): n=a or t
agctactatatattctttcttagtgccataccaagngttgacatatattcactaaaaatgccttggacctg

SEQ ID NO: 18038 - DNA, 71 bp, chicken (Gallus Gallus)
  misc_feature (36): n=a or g
tcatgagccagaggactgaataaaaataaaagctcngtttcacagattatctgcaggtttgaaagacctta

SEQ ID NO: 18039 - DNA, 71 bp, chicken (Gallus Gallus)
  misc_feature (36): n=a or g
ataaatctcaaaaatctctgcatgttcattatccanttgtaatacagaatacatactgcaaggatggttga

SEQ ID NO: 18040 - DNA, 71 bp, chicken (Gallus Gallus)
  misc_feature (36): n=c or t
tctcagcccttagagtaacactgaattagtgcatgntggcatttaattgcaaaacttattttgtttctata

SEQ ID NO: 18041 - DNA, 71 bp, chicken (Gallus Gallus)
  misc_feature (36): n=c or t
atgaggcactgtcaaaggccttactgaagtccatanagatgatatcagtgtctctttccttgtccattcat

SEQ ID NO: 18042 - DNA, 71 bp, chicken (Gallus Gallus)
  misc_feature (36): n=a or g
ccaggtgcattacatggtgtgcttacgactcctctnaatggcagaagccagcagctgaagcagatgaaccc

SEQ ID NO: 18043 - DNA, 71 bp, chicken (Gallus Gallus)
  misc_feature (36): n=a or g
gtgtgtttctctcccttttctctggcagaactgcangccaagctgctgagctctgaaacagaggtcaaaag

SEQ ID NO: 18044 - DNA, 71 bp, chicken (Gallus Gallus)
  misc_feature (36): n=g or t
aaatcaaaatgtttatgatatgtcttaaatacttgngacatttttcaagcttctgaggcttgcagctatag

SEQ ID NO: 18045 - DNA, 71 bp, chicken (Gallus Gallus)
  misc_feature (36): n=c or t
taagacatgcttttggtttgtagcacagtggctgtngcatcctgcagattctgtccctcttccattggaga

SEQ ID NO: 18046 - DNA, 71 bp, chicken (Gallus Gallus)
  misc_feature (36): n=c or t
tcagagaatcatcgaatcacagaatcatttgagttngaagtgatgtttaaagttcaaagattatctagtcc

SEQ ID NO: 18047 - DNA, 71 bp, chicken (Gallus Gallus)
  misc_feature (36): n=a or g
taattataagtgacaaaagagaaaagacggattacnaatagttaaataatgagtgaaaagcaattaaactc

SEQ ID NO: 18048 - DNA, 71 bp, chicken (Gallus Gallus)
  misc_feature (36): n=a or g
ccctggcttttaaataaataaatacttcttttcatnctgatagttagcttgattagtttggctggcactgg

SEQ ID NO: 18049 - DNA, 71 bp, chicken (Gallus Gallus)
  misc_feature (36): n=c or t
agaaatagtttttctgtttacttttttgctttctcnggaactgatgacttagggtccttacttcctctctg

SEQ ID NO: 18050 - DNA, 71 bp, chicken (Gallus Gallus)
  misc_feature (36): n=a or g
acctccagccccactagctctagaaaaaaatacatnatttgtgacaatacacagatacagagttcttagtt

SEQ ID NO: 18051 - DNA, 71 bp, chicken (Gallus Gallus)
  misc_feature (36): n=a or g
caaaggttatctttaaaactatttccagagaactcnaggaaaatagagcaaaatagaaaagttggaaaatg

SEQ ID NO: 18052 - DNA, 71 bp, chicken (Gallus Gallus)
  misc_feature (36): n=a or g
aagaaaatacccactacaaaataagaacttccacanaagggaaaaagcttatcagtacatcagaactgact

SEQ ID NO: 18053 - DNA, 71 bp, chicken (Gallus Gallus)
  misc_feature (36): n=a or g
gtgcttatatgaacattctcaatccccacatgcatntacactctttagccctcaattcagcaagaatccag

SEQ ID NO: 18054 - DNA, 71 bp, chicken (Gallus Gallus)
  misc_feature (36): n=c or t
ctcactttaccccttccatttagcagaaattttccntctcccctatctggaactcatctgcaggctcagac

SEQ ID NO: 18055 - DNA, 71 bp, chicken (Gallus Gallus)
  misc_feature (36): n=a or g
gaggaagataaaagttccaccaaaacagcgaaatgnacttcaagacagcctaccgtaatcttttttttttt

SEQ ID NO: 18056 - DNA, 71 bp, chicken (Gallus Gallus)
  misc_feature (36): n=c or t
aaataaattggccacaccgttcattgccagacatanagatgacagccatttcagttttcttttccttcttc

SEQ ID NO: 18057 - DNA, 71 bp, chicken (Gallus Gallus)
  misc_feature (36): n=c or t
ttaagggaaatggaactcccagaattaacaaacttntcctgcaaacatcagttgtgttggcttacctaaag

SEQ ID NO: 18058 - DNA, 71 bp, chicken (Gallus Gallus)
  misc_feature (36): n=a or g
tgcacatgtacttcttttgctcctatctcctgcaantctgggtggcttcctcccttccctttctactgctg

SEQ ID NO: 18059 - DNA, 71 bp, chicken (Gallus Gallus)
  misc_feature (36): n=a or c
gaataggtaggtaaaatatctatcaaattcacaagncatgtgatatcttttctaaactatctgcttgaatg

SEQ ID NO: 18060 - DNA, 71 bp, chicken (Gallus Gallus)
  misc_feature (36): n=a or g
taaggaagttccctcttccatcctttcttcctcagnctaactcagtcctagttctttgcatccttcctccc

SEQ ID NO: 18061 - DNA, 71 bp, chicken (Gallus Gallus)
  misc_feature (36): n=c or t
atcttgcatttgataatactaatatgaatattgttnagatactcctgatttaccaaacacaatcactttgt

SEQ ID NO: 18062 - DNA, 71 bp, chicken (Gallus Gallus)
  misc_feature (36): n=a or c
gctgattaatagagtttctttctttaaatggctaancttaatatatttgctctttctttaaaagttagcta

SEQ ID NO: 18063 - DNA, 71 bp, chicken (Gallus Gallus)
  misc_feature (36): n=c or g
tccaagatgacaattaattttctaaatgagaagaantgagagtagaagtgtgaggacatgttgtgaggtag

SEQ ID NO: 18064 - DNA, 71 bp, chicken (Gallus Gallus)
  misc_feature (36): n=c or t
ataaaaacaacagaacatgctacatatggtttttgntgagaaggaaacagccacggctgttgccttgttgc

SEQ ID NO: 18065 - DNA, 71 bp, chicken (Gallus Gallus)
  misc_feature (36): n=a or g
atctttcttttagttttcaaatttatttcttcatcngtcttcctctgtatgcatccatcctgtgcccttgt

SEQ ID NO: 18066 - DNA, 71 bp, chicken (Gallus Gallus)
  misc_feature (36): n=a or c
tgcatctgaaaccatgagcgcggtaacaccttgctntccgtacgtcaaaccagcggtgttcttaagccata

SEQ ID NO: 18067 - DNA, 71 bp, chicken (Gallus Gallus)
  misc_feature (36): n=g or t
taaaacttcagtcctttctaatgcaaatacctgaantgagttaatattgtttgtgagtattcttgatctct

SEQ ID NO: 18068 - DNA, 71 bp, chicken (Gallus Gallus)
  misc_feature (36): n=a or g
tcagctaccccaagtataatcttagtgcagttttgnaggctttcctccacatgtgcccctatttctctctg

SEQ ID NO: 18069 - DNA, 71 bp, chicken (Gallus Gallus)
  misc_feature (36): n=a or g
gagctggtcatccctcagagactttaacaccactgnttgcctggggtgctggagtgaattatccacaggaa

SEQ ID NO: 18070 - DNA, 71 bp, chicken (Gallus Gallus)
  misc_feature (36): n=c or t
agcaaagaggtacacatgattccttcaaattctctnccttatttcctattcctcactacttagtataaatg

SEQ ID NO: 18071 - DNA, 71 bp, chicken (Gallus Gallus)
  misc_feature (36): n=c or t
aggaaaaaaaaaaaaaagtaaactgaaatgaaagtntcctagaaataattgatgaggtaatgtactcttaa

SEQ ID NO: 18072 - DNA, 71 bp, chicken (Gallus Gallus)
  misc_feature (36): n=c or g
gggaggacatgccacagttataaaaattacactganataaatcaatagagggaggaggagagatggcaaag

SEQ ID NO: 18073 - DNA, 71 bp, chicken (Gallus Gallus)
  misc_feature (36): n=c or t
tgaagccttttgtttcttacactgctctgtgttccnacagtagggtagggggtgggcaagaggcttgaagg

SEQ ID NO: 18074 - DNA, 71 bp, chicken (Gallus Gallus)
  misc_feature (36): n=g or t
tttccttcctcatgttgcgaagttatttttctgcanctgggtaagaaattagctcctatatagtcatagtt

SEQ ID NO: 18075 - DNA, 71 bp, chicken (Gallus Gallus)
  misc_feature (36): n=a or g
gtcagcttcgatttacactcctcagacttcataacntgtctgggcggagcttctactcttacattcttttc

SEQ ID NO: 18076 - DNA, 71 bp, chicken (Gallus Gallus)
  misc_feature (36): n=a or g
attgaagggcacaagaacgcttcctctgataaaagntcaaatgcaatggataaaatattaccattaaaaaa

SEQ ID NO: 18077 - DNA, 71 bp, chicken (Gallus Gallus)
  misc_feature (36): n=a or g
gtctggaaaatggtgaatgcaatccaagcctaaaancccctccaaacaataagatccagaagtgttactct

SEQ ID NO: 18078 - DNA, 71 bp, chicken (Gallus Gallus)
  misc_feature (36): n=a or g
tgtcagtgcctaccttccagaaatcctgctggcatntttccaggatcatggtgacaaactccatgattcgc

SEQ ID NO: 18079 - DNA, 71 bp, chicken (Gallus Gallus)
  misc_feature (36): n=g or t
ataatagaaaacaggaagataggagctgagcttagncttacttgatttctgatgtacgtacagcatacaga

SEQ ID NO: 18080 - DNA, 71 bp, chicken (Gallus Gallus)
  misc_feature (36): n=a or g
catcacatcacctttccagggcgaacctagctactntgagatatccttttcacaacacacaatagtaatgg

SEQ ID NO: 18081 - DNA, 71 bp, chicken (Gallus Gallus)
  misc_feature (36): n=c or t
caataaaatgccccaagggacagatctctgacctgnttttttcagtttgggagagaaaacttaaaataact

SEQ ID NO: 18082 - DNA, 71 bp, chicken (Gallus Gallus)
  misc_feature (36): n=c or g
gcattacttttggagcagccctcatatatatgtttnatgttattctgtagtgctgggtgcttagttttatc

SEQ ID NO: 18083 - DNA, 71 bp, chicken (Gallus Gallus)
  misc_feature (36): n=a or g
ctacttcaaataagactcatttctgaactgttaccntattggatgaaatcacaaaatagagaaatgtgtct

SEQ ID NO: 18084 - DNA, 71 bp, chicken (Gallus Gallus)
  misc_feature (36): n=c or t
ccagcagctggtgtgagcagaccactgtttgtgaangactgtgcctggaaacgtttgatagtgtctgctgg

SEQ ID NO: 18085 - DNA, 71 bp, chicken (Gallus Gallus)
  misc_feature (36): n=a or c
aaaaaatcctttgaattgaaccattcagccatcccnagggatatactaaggaatttgtaggctgagaaaat

SEQ ID NO: 18086 - DNA, 71 bp, chicken (Gallus Gallus)
  misc_feature (36): n=c or t
cccttttccttggaatatccaagcattcatgaagcngttgcagcctatttggagcagatgagttctgagaa

SEQ ID NO: 18087 - DNA, 71 bp, chicken (Gallus Gallus)
  misc_feature (36): n=a or c
gaggatgcataaagcttagccgtgttaggtctggangtatttgcagaaggaatttacagagttcttaaaat

SEQ ID NO: 18088 - DNA, 71 bp, chicken (Gallus Gallus)
  misc_feature (36): n=a or g
aaccctgcagagcccaggaaagattaataataaccntcatcatggcctttcctgaaaaaaaaaaacagttc

SEQ ID NO: 18089 - DNA, 71 bp, chicken (Gallus Gallus)
  misc_feature (36): n=a or g
acaaattcaatccatgtgctcatctcttaaaatttnaatgcaatttttgctcacatgcttgaattgttgta

SEQ ID NO: 18090 - DNA, 71 bp, chicken (Gallus Gallus)
  misc_feature (36): n=a or g
aattttggggtgtcttcctgtgggttggtaggtagntagggcagtgtgaatgagttgcatggtaacttcca

SEQ ID NO: 18091 - DNA, 71 bp, chicken (Gallus Gallus)
  misc_feature (36): n=a or g
gctctgcagaccttctcttatcacagaatctagatntacatttttttctcttcatttcaccttacccatgt

SEQ ID NO: 18092 - DNA, 71 bp, chicken (Gallus Gallus)
  misc_feature (36): n=c or t
catacaaggaaaaactggctgagctttcaaccttgngcaatttaataaatggtctcctgataaggaacaca

SEQ ID NO: 18093 - DNA, 71 bp, chicken (Gallus Gallus)
  misc_feature (36): n=c or t
gcctcaccgctctgattgtaaaaaacttccatatanataatctaaatctctcctctttttgtttgaaagca

SEQ ID NO: 18094 - DNA, 71 bp, chicken (Gallus Gallus)
  misc_feature (36): n=a or g
ccttacattttctgcatgctaaactttcagaagcantacttggcacaaacatatgcaatcgtattaaggga

SEQ ID NO: 18095 - DNA, 71 bp, chicken (Gallus Gallus)
  misc_feature (36): n=a or t
aattcaagactccaatcaccccttgtctaacttcanttctatgccagagtaatttcactgaaatcaggtga

SEQ ID NO: 18096 - DNA, 71 bp, chicken (Gallus Gallus)
  misc_feature (36): n=a or g
cattgatagaatgttactctctgcacaaatctcacnttcctactatatatctctgttcaaaagactactgt

SEQ ID NO: 18097 - DNA, 71 bp, chicken (Gallus Gallus)
  misc_feature (36): n=a or g
acaactgcgttgcatgacatgtatactgttttttgntatcttatagtaagtgtctaattgctatatcaact

SEQ ID NO: 18098 - DNA, 71 bp, chicken (Gallus Gallus)
  misc_feature (36): n=c or t
tggatactgtcgttctgcaggtgacccggtgctgantggcttctttcactttgcttttgtcccatctgcca

SEQ ID NO: 18099 - DNA, 71 bp, chicken (Gallus Gallus)
  misc_feature (36): n=a or g
aacacttctgaaacagttgcagaataatctgcgganttgaaagtgatgttttagtaggtgcgttgaaagga

SEQ ID NO: 18100 - DNA, 71 bp, chicken (Gallus Gallus)
  misc_feature (36): n=c or t
gcacgactgctgtctgtacatatagtgatggtacangtgagagaatgccaggaaataatttgaatcaaaag

SEQ ID NO: 18101 - DNA, 71 bp, chicken (Gallus Gallus)
  misc_feature (36): n=a or g
gaagatcatgggagcattaagcgttggaggaagctncgagatttaagaagtaaatctgaagtagaaattaa

SEQ ID NO: 18102 - DNA, 71 bp, chicken (Gallus Gallus)
  misc_feature (36): n=c or t
aaatattcaaaacctccaacagtgaacataaaacancttccagatattaacccgcctgactgatacagctg

SEQ ID NO: 18103 - DNA, 71 bp, chicken (Gallus Gallus)
  misc_feature (36): n=a or t
acagcacactgcagaggttgtattttctagtggaantaggcatgctttatacaactgatgcagcactgtgc

SEQ ID NO: 18104 - DNA, 71 bp, chicken (Gallus Gallus)
  misc_feature (36): n=c or t
acagtgctattaaattgctgtttctaatacaataangcagtgaagaaaccatggaagatttcaaggagaaa

SEQ ID NO: 18105 - DNA, 71 bp, chicken (Gallus Gallus)
  misc_feature (36): n=g or t
cacaagctctttgactggaaacagttttgtactttncatattagtctaatgaaaaaagttgtttttccact

SEQ ID NO: 18106 - DNA, 71 bp, chicken (Gallus Gallus)
  misc_feature (36): n=c or t
tgcagtttggcaatattaaagtcagcaaacctctcnagaatagattcattttttatttttcaggtttaaaa

SEQ ID NO: 18107 - DNA, 71 bp, chicken (Gallus Gallus)
  misc_feature (36): n=a or g
tagaagcctcatttgtgcttcctcttaggttaaacnaactgtgatcaaacaacgatgttttcttcttctgg

SEQ ID NO: 18108 - DNA, 71 bp, chicken (Gallus Gallus)
  misc_feature (36): n=c or t
aggatctgatttgagagctattagtgggagaggtgntctctggtggcaaccacaacataattaagctgcat

SEQ ID NO: 18109 - DNA, 71 bp, chicken (Gallus Gallus)
  misc_feature (36): n=c or t
ataggttaaaaagcatgtagtaggacctaagatttnggggtgagtatatgcttacatgtacatgttgtctg

SEQ ID NO: 18110 - DNA, 71 bp, chicken (Gallus Gallus)
  misc_feature (36): n=c or g
cccacttgctgctcccacagaagtgctgccccagangtaggcatcctggctctgttcgttatcactttgtt

SEQ ID NO: 18111 - DNA, 71 bp, chicken (Gallus Gallus)
  misc_feature (36): n=a or g
aatgataaactatgagcttcatcagtgttaacagtntcatctaatcactacagccagtgctggagaagaat

SEQ ID NO: 18112 - DNA, 71 bp, chicken (Gallus Gallus)
  misc_feature (36): n=c or t
tggagacaaaaggcccacaggatacaccatggtcangtgtgggtcaagcaaaaaactgctgagacagtgag

SEQ ID NO: 18113 - DNA, 71 bp, chicken (Gallus Gallus)
  misc_feature (36): n=c or g
ttgactttgaagtctataagattgctgtaaaatttncaaaacatcgaaccatgtgttaagaatacatggta

SEQ ID NO: 18114 - DNA, 71 bp, chicken (Gallus Gallus)
  misc_feature (36): n=a or t
ttaattctttctctaaggagaaatctgagggggagnaaaaccaactgatcatcagtcctatttgtgaaata

SEQ ID NO: 18115 - DNA, 71 bp, chicken (Gallus Gallus)
  misc_feature (36): n=a or g
acatgagaacagctctggcaaggcttcaggatacantgaagttcctttctttccagcttggctcaatctgc

SEQ ID NO: 18116 - DNA, 71 bp, chicken (Gallus Gallus)
  misc_feature (36): n=a or g
atgggataggataatgaaactctacatagagggttnaatggcttcttccctcaaatatttgttaagcatgt

SEQ ID NO: 18117 - DNA, 71 bp, chicken (Gallus Gallus)
  misc_feature (36): n=g or t
actaaggggtctttcagctacaacccataatttcanctatcgaggaggacggaaattggttctattttatg

SEQ ID NO: 18118 - DNA, 71 bp, chicken (Gallus Gallus)
  misc_feature (36): n=a or c
ataccagcctaatctttgtgtttcatagagaggagnaaacccacaccatgagcttatcccatcctccagca

SEQ ID NO: 18119 - DNA, 71 bp, chicken (Gallus Gallus)
  misc_feature (36): n=a or g
cagtccagtccagtccactccatataaggacaaagngcatgtatttcagtgatgaggaaaataacataaca

SEQ ID NO: 18120 - DNA, 71 bp, chicken (Gallus Gallus)
  misc_feature (36): n=a or c
ggctgtaagaagtgaaaatgtactaaataatttctnctttacttatcaggaaaaggaaagaaacaaaaagg

SEQ ID NO: 18121 - DNA, 71 bp, chicken (Gallus Gallus)
  misc_feature (36): n=c or t
taagtttaagcatgtggataattactttgcttaacngggatcttggtgtttggtttttatttactatttag

SEQ ID NO: 18122 - DNA, 71 bp, chicken (Gallus Gallus)
  misc_feature (36): n=a or g
atccataatttaaactacttagactaatctggaaangaagagactggaattagattcaatctgaaaataca

SEQ ID NO: 18123 - DNA, 71 bp, chicken (Gallus Gallus)
  misc_feature (36): n=c or t
gttgtcacacggcaggtaacagtgtcatagtacagncgggtgctgttgaccttatttctcatgcaagtgct

SEQ ID NO: 18124 - DNA, 71 bp, chicken (Gallus Gallus)
  misc_feature (36): n=c or t
cagctcataatttctccatgctcactagctttgagnagacaagaggagaagcaggggatctcatacaaccc

SEQ ID NO: 18125 - DNA, 71 bp, chicken (Gallus Gallus)
  misc_feature (36): n=a or g
actaggttcatctggaaactatgatcctgaagccanaggcttcacctagcttcacttcccacagaatcacc

SEQ ID NO: 18126 - DNA, 71 bp, chicken (Gallus Gallus)
  misc_feature (36): n=c or t
attacaaaacactgctctctactacagattgcaaangttgctgacccgatctcctgccacttttggagagc

SEQ ID NO: 18127 - DNA, 71 bp, chicken (Gallus Gallus)
  misc_feature (36): n=c or t
tgtgactgagcatctttgcaggtacgcagacaccanagttggcatatgtagaactcagcactctgccttgg

SEQ ID NO: 18128 - DNA, 71 bp, chicken (Gallus Gallus)
  misc_feature (36): n=a or g
tgctgtttctccgcactccatttcatgccatcctgnaggacttccaagattggtacaagtagctttaccat

SEQ ID NO: 18129 - DNA, 71 bp, chicken (Gallus Gallus)
  misc_feature (36): n=a or c
gaattttgtacaccaaaactgagttatgtgactgcntggtgcaggtgtacactggcggtgtgtttgtgagg

SEQ ID NO: 18130 - DNA, 71 bp, chicken (Gallus Gallus)
  misc_feature (36): n=a or g
aaagaagacaatttgcaggagagaaaaagaaatttngtattagattctgcatgaatgaaaagacttaattt

SEQ ID NO: 18131 - DNA, 71 bp, chicken (Gallus Gallus)
  misc_feature (36): n=a or g
aattctctattgagcaccaaagccttgttggcagcnaacaaccttgcctgagacttcaggacatcagagca

SEQ ID NO: 18132 - DNA, 71 bp, chicken (Gallus Gallus)
  misc_feature (36): n=c or t
attaatttaaggtaatactccaaagcactttcagcntggtcactgcttttcatgtgactgtcacttctatt

SEQ ID NO: 18133 - DNA, 71 bp, chicken (Gallus Gallus)
  misc_feature (36): n=c or g
ctaatctctctttcactgtatgtcaagacgatgcgnataatgaaagtcacaggagttgttatgcacagcat

SEQ ID NO: 18134 - DNA, 71 bp, chicken (Gallus Gallus)
  misc_feature (36): n=a or g
aagatactggcatgctaaggagcaaagtaagtgcantgccaaagaaacgctgaacagagcaatggagttag

SEQ ID NO: 18135 - DNA, 71 bp, chicken (Gallus Gallus)
  misc_feature (36): n=a or c
aaggcaaatcacatccaaagcgtctctggaaaaaanagaaaaaaaagagtgacaacagcttcctaatcgct

SEQ ID NO: 18136 - DNA, 71 bp, chicken (Gallus Gallus)
  misc_feature (36): n=a or g
agctggcatacagcagaagctgagttactttgtttnaaacaaaaacatgcatttctatcacctcaggagcc

SEQ ID NO: 18137 - DNA, 71 bp, chicken (Gallus Gallus)
  misc_feature (36): n=c or t
actcccaaagcattcactgtgagcaaccatatttgnttcagcttgtgtttggctaggctaagtgtgttacc

SEQ ID NO: 18138 - DNA, 71 bp, chicken (Gallus Gallus)
  misc_feature (36): n=a or g
gacagaggtgaattttttttttttttttccttcctncagatcttgtcactgttatgagtccagccactgta

SEQ ID NO: 18139 - DNA, 71 bp, chicken (Gallus Gallus)
  misc_feature (36): n=g or t
gatttgtggtattctccttccttgagcatatagccntctgtctctcagtttggacaaaaagggagatctcc

SEQ ID NO: 18140 - DNA, 71 bp, chicken (Gallus Gallus)
  misc_feature (36): n=c or t
agatgagctcagcaggagatattttctgatacctgncaagatggtatgagctctgcctacagccatcagaa

SEQ ID NO: 18141 - DNA, 71 bp, chicken (Gallus Gallus)
  misc_feature (36): n=c or g
cgctatgtgatgatgcactttccttcccaacttttncctcattgtcacagttttagcaagatgggtggaag

SEQ ID NO: 18142 - DNA, 71 bp, chicken (Gallus Gallus)
  misc_feature (36): n=a or g
ttaaatgctttttgtcttgacatcaggtgctttccnctggttcaagagatgtggggtgtttttgttgttct

SEQ ID NO: 18143 - DNA, 71 bp, chicken (Gallus Gallus)
  misc_feature (36): n=c or t
atatctcagcacacactggtaactcacaggtgatantgaaacagcgaggtgatacccataagcatttcttg

SEQ ID NO: 18144 - DNA, 71 bp, chicken (Gallus Gallus)
  misc_feature (36): n=g or t
tcaaacgttactgtattttctggagtaagctgactncaagttgcaagtattcaagtttttctttcagatga

SEQ ID NO: 18145 - DNA, 71 bp, chicken (Gallus Gallus)
  misc_feature (36): n=g or t
atcagtgcttggacatttcaactcacctgcatgatntcattaacagctttacaggcttcttctttgtttga

SEQ ID NO: 18146 - DNA, 71 bp, chicken (Gallus Gallus)
  misc_feature (36): n=a or g
ctccctctagaccacgttgctcacagccccatccangaacttgtagagtgtttctaatacagttagcacag

SEQ ID NO: 18147 - DNA, 71 bp, chicken (Gallus Gallus)
  misc_feature (36): n=a or g
catgtgggaagggttcccaggagagtgtctgcacanccaaggaccaggattgggttactgtcacatgaggt

SEQ ID NO: 18148 - DNA, 71 bp, chicken (Gallus Gallus)
  misc_feature (36): n=c or t
tttttttctcaacatctgtttttctgtgtgaagganactgtaaccctccccacctaattttatggcaaagt

SEQ ID NO: 18149 - DNA, 71 bp, chicken (Gallus Gallus)
  misc_feature (36): n=c or g
caatcccccagttttctcctgtgtattggtgaggtnctttaataagagaacatagattaatagatccctgg

SEQ ID NO: 18150 - DNA, 71 bp, chicken (Gallus Gallus)
  misc_feature (36): n=a or g
ctgagataggtgtaaggagttgaagaaaaatgactngtgtcatcaaagtgtaataaagagtttacaaatac

SEQ ID NO: 18151 - DNA, 71 bp, chicken (Gallus Gallus)
  misc_feature (36): n=a or g
cagtcatggcagggtgactctcagtgaagttcaganccagacctgtttgctcgggactgaggcaagatttg

SEQ ID NO: 18152 - DNA, 71 bp, chicken (Gallus Gallus)
  misc_feature (36): n=c or t
aagagacccttaattctgcaaaataatgagacacantgtccgcaaccttatgaaaagtgctgtaaattaac

SEQ ID NO: 18153 - DNA, 71 bp, chicken (Gallus Gallus)
  misc_feature (36): n=a or g
tagtctgctaactaactctggcttggcttcgtgatngttatgaactcagtatgtctaggttttcctagaca

SEQ ID NO: 18154 - DNA, 71 bp, chicken (Gallus Gallus)
  misc_feature (36): n=c or g
aactgaccaaaccacaggtgtctttgctttacgatngtatgaaaaacaaacggtgcaatgaactgacaagg

SEQ ID NO: 18155 - DNA, 71 bp, chicken (Gallus Gallus)
  misc_feature (36): n=a or c
aggctgtgtgtgtgtctgtgtaggtccgaaatgtancttgggcatcacaagcatgtaaggatgcctgggtg

SEQ ID NO: 18156 - DNA, 71 bp, chicken (Gallus Gallus)
  misc_feature (36): n=a or g
cacttagtttcctaataattgagcaacttcacctcnataccaatacttcaaatcaagatacatgtcattca

SEQ ID NO: 18157 - DNA, 71 bp, chicken (Gallus Gallus)
  misc_feature (36): n=c or t
ttacctcatgcgtgtaactctttgtaagccactgtngtttgtaggttaaaaagaaacaaaaatgaaagaca

SEQ ID NO: 18158 - DNA, 71 bp, chicken (Gallus Gallus)
  misc_feature (36): n=a or c
gtgtgagcacacacgtactctcagaagccgggagcngtaacatgaggactccaacccagatttcaggcagg

SEQ ID NO: 18159 - DNA, 71 bp, chicken (Gallus Gallus)
  misc_feature (36): n=c or t
attctatgattctattattacgcagcagttagctanagtggtgtactttgtggttataaggtgtgacagta

SEQ ID NO: 18160 - DNA, 71 bp, chicken (Gallus Gallus)
  misc_feature (36): n=c or t
ggtaaggtaacgtgtcataaaatgactaatggtacnactaagactcagttgacagcaagaagacaacaaag

SEQ ID NO: 18161 - DNA, 71 bp, chicken (Gallus Gallus)
  misc_feature (36): n=c or t
taatcacaatgatgagttgtggttgtaaccgtagtntccttgcttttactcacattctttaaatgtgtcta

SEQ ID NO: 18162 - DNA, 71 bp, chicken (Gallus Gallus)
  misc_feature (36): n=c or g
gcaatcattgtagtcaattttggtcttgaaaaaccnctctgaagatactgctccgttcttatcagacttcc

SEQ ID NO: 18163 - DNA, 71 bp, chicken (Gallus Gallus)
  misc_feature (36): n=c or t
cttaagttgttcatcctattattaaattaagacttncacagtatatatttcattcccaatgagaaaatggg

SEQ ID NO: 18164 - DNA, 71 bp, chicken (Gallus Gallus)
  misc_feature (36): n=c or t
gtccttcagacacctgcaaaagtattaggaacttgngtccatgtaatccatgaaagtgaatactcaggatt

SEQ ID NO: 18165 - DNA, 71 bp, chicken (Gallus Gallus)
  misc_feature (36): n=c or t
cggtatctttctgttccttttagtgttgctaaatgntaaaaggagagtggaaatgctaaaaatcaaggctg

SEQ ID NO: 18166 - DNA, 71 bp, chicken (Gallus Gallus)
  misc_feature (36): n=c or g
gatcaaaatggttatttaagtacatgtttacaactnaccaggcaaaatgtcttttgcattcaaatttatga

SEQ ID NO: 18167 - DNA, 71 bp, chicken (Gallus Gallus)
  misc_feature (36): n=a or g
tttatcaaaacattttcatttgctaacacaggacancaagcagttccttgtattctccctgctttaatgtt

SEQ ID NO: 18168 - DNA, 71 bp, chicken (Gallus Gallus)
  misc_feature (36): n=c or t
acatcataacaatatgcttccatatcataactatangctatgtgtatttcaggcttcatatatgatcactt

SEQ ID NO: 18169 - DNA, 71 bp, chicken (Gallus Gallus)
  misc_feature (36): n=a or g
ctaatgacagagcaaatcgataggttaaaagcttgnccacctagatacaagaagatacaaatacagagagt

SEQ ID NO: 18170 - DNA, 71 bp, chicken (Gallus Gallus)
  misc_feature (36): n=a or t
tggtttccataccaatatctctcaaacagatgcttntcctgcatgggaagtcccttctttccccgtcacaa

SEQ ID NO: 18171 - DNA, 71 bp, chicken (Gallus Gallus)
  misc_feature (36): n=a or g
caaagtcaaagaactgcattcctgtgcaatctcacntgtcctataagtccagcttagacacaaccaactct

SEQ ID NO: 18172 - DNA, 71 bp, chicken (Gallus Gallus)
  misc_feature (36): n=a or t
aaggaatctgaagttgtcacttatctgcacagaatntaatagtgttctttacacagacactttgcagtcca

SEQ ID NO: 18173 - DNA, 71 bp, chicken (Gallus Gallus)
  misc_feature (36): n=c or t
gcaccacagactctctaggccagataccaatctgantgaacttactgaggccttcctatagggaaaacagt

SEQ ID NO: 18174 - DNA, 71 bp, chicken (Gallus Gallus)
  misc_feature (36): n=c or t
aattttctactgagaaggacagctgagcaccggagnaactgcagtgttcagtggtgactcttgtcacagtt

SEQ ID NO: 18175 - DNA, 71 bp, chicken (Gallus Gallus)
  misc_feature (36): n=a or g
atcagagatcattgcagaggtactcgtggtacctantacctggtacctactatcattcactagtgacataa

SEQ ID NO: 18176 - DNA, 71 bp, chicken (Gallus Gallus)
  misc_feature (36): n=a or g
ctaaatcacttttcctgaccatgtctggtatttggnaagaacaaaggacaaaacagtgcttcctgggactc

SEQ ID NO: 18177 - DNA, 71 bp, chicken (Gallus Gallus)
  misc_feature (36): n=a or g
ctactgagaggtaactgagaaagctgtaggcattgntgatgataaaagaggagaaagttgtacaggcatcc

SEQ ID NO: 18178 - DNA, 71 bp, chicken (Gallus Gallus)
  misc_feature (36): n=c or t
aaagaatatgctaccattacagtatttcagtacttntcgttttattctgacagaaagtaaaagctatgtag

SEQ ID NO: 18179 - DNA, 71 bp, chicken (Gallus Gallus)
  misc_feature (36): n=a or g
atgtaaccttttgatgtactttattcaggctagccnaagagaaatcaagaagtaatttccagatttcaaaa

SEQ ID NO: 18180 - DNA, 71 bp, chicken (Gallus Gallus)
  misc_feature (36): n=a or g
gttctgttaacatattctttaatggcagaccatganactgacacttcatacatgcttaccacaagcagtgt

SEQ ID NO: 18181 - DNA, 71 bp, chicken (Gallus Gallus)
  misc_feature (36): n=c or g
actccgcatgccagctacagtgataacgtttctctnccttggttaaaatgatttctctgatgaccttgacc

SEQ ID NO: 18182 - DNA, 71 bp, chicken (Gallus Gallus)
  misc_feature (36): n=a or g
aacactcaccaaaacacagccctgactggaagaatntatgcttctcatcaatgctactaaaaaagtacttt

SEQ ID NO: 18183 - DNA, 71 bp, chicken (Gallus Gallus)
  misc_feature (36): n=c or g
acatcaggaatggttttaatctcaagaagtcttacnctccaccatggcatacattccctacataagtatca

SEQ ID NO: 18184 - DNA, 71 bp, chicken (Gallus Gallus)
  misc_feature (36): n=c or g
tttagcacaggaagaagcaccgcacagcgcagcagnatgcagttctacagctatgtctgctgcacccacat

SEQ ID NO: 18185 - DNA, 71 bp, chicken (Gallus Gallus)
  misc_feature (36): n=a or g
tagaagcacactgctcctggagggtccatgtttgcntattttgcctttgttcaatagacatgcttttcatg

SEQ ID NO: 18186 - DNA, 71 bp, chicken (Gallus Gallus)
  misc_feature (36): n=g or t
tctgaagacctgtataataacaggaggcgtttactncactgtgctgagcacaagaactgtctccattagtg

SEQ ID NO: 18187 - DNA, 71 bp, chicken (Gallus Gallus)
  misc_feature (36): n=a or g
aacagaagcgtgacaggcaaaatgtgtatcagagtngaactgtttctgctaccattcctttttgctcctgc

SEQ ID NO: 18188 - DNA, 71 bp, chicken (Gallus Gallus)
  misc_feature (36): n=c or t
tcttcattgtctttggtgcagtaataatagttcagnatgagttcataaagattagggaaaaacagtattca

SEQ ID NO: 18189 - DNA, 71 bp, chicken (Gallus Gallus)
  misc_feature (36): n=a or g
ggtggaaggcaaatttcttcctccccccagctcacntgaacaacaagttcagttttcaagctaaaagtaag

SEQ ID NO: 18190 - DNA, 71 bp, chicken (Gallus Gallus)
  misc_feature (36): n=a or g
gactgttaaccatccactattaaactcacagcgcancagagcaaatcctgcaatgtaaagtgcagacaaat

SEQ ID NO: 18191 - DNA, 71 bp, chicken (Gallus Gallus)
  misc_feature (36): n=c or t
tttcactagtgttgccatgatccagctcataaagcngagcccttgcttttaatccatattttgcaatattc

SEQ ID NO: 18192 - DNA, 71 bp, chicken (Gallus Gallus)
  misc_feature (36): n=c or t
caacttgcaatgcggagagttgtgtgctgaacctcnaaaatggtttctcaccactgactttgttcatttct

SEQ ID NO: 18193 - DNA, 71 bp, chicken (Gallus Gallus)
  misc_feature (36): n=c or t
cttcactaagagaccgtgtttccttgtgtggctcanagtgctcataggcagcagagttcactgcaatcaga

SEQ ID NO: 18194 - DNA, 71 bp, chicken (Gallus Gallus)
  misc_feature (36): n=c or t
tgtacagtactggttgaaaataagccacacgttacngagttgtatgtacgtaatgcctcctgcagttatta

SEQ ID NO: 18195 - DNA, 71 bp, chicken (Gallus Gallus)
  misc_feature (36): n=c or t
tggccctgctttgagaattaggttgggctaaagacntcctgaggtcccttccaatctgcattagtcaatga

SEQ ID NO: 18196 - DNA, 71 bp, chicken (Gallus Gallus)
  misc_feature (36): n=a or g
cccactggcatccctaccacgagaaaggctgcggcntgacatccacccaaattgggctgcacctgagaggg

SEQ ID NO: 18197 - DNA, 71 bp, chicken (Gallus Gallus)
  misc_feature (36): n=a or t
aagctcttgttcagaaaatgctttatggattcattnttctgaaatgtttggtcttgaattaaatgggctta

SEQ ID NO: 18198 - DNA, 71 bp, chicken (Gallus Gallus)
  misc_feature (36): n=a or g
ggccactttggcatttacaagcatccaacgtgctcntgttgatggctgtgcaacggtacatagactttggc

SEQ ID NO: 18199 - DNA, 71 bp, chicken (Gallus Gallus)
  misc_feature (36): n=a or g
gttatagttgggtttgttaatgtagccattgacaanaagtaataatgtgcttttaaaagttgtgtaactgc

SEQ ID NO: 18200 - DNA, 71 bp, chicken (Gallus Gallus)
  misc_feature (36): n=c or t
ttattgactgtttggaaaaatgtaagctgttacttntagtgttctattggctaaattaatagctagtaacc

SEQ ID NO: 18201 - DNA, 71 bp, chicken (Gallus Gallus)
  misc_feature (36): n=c or t
gttccttgccctgacaggcatcatgtcttttagtcnccatgcaaattcacatggttgaaagattcaatgac

SEQ ID NO: 18202 - DNA, 71 bp, chicken (Gallus Gallus)
  misc_feature (36): n=a or c
gaggccagatcctccctaccagatcctccaaacagnaaagtcttgtgtcttaactctgagattttggggtc

SEQ ID NO: 18203 - DNA, 71 bp, chicken (Gallus Gallus)
  misc_feature (36): n=a or g
taaatcaagactgtggctgagatgatgtatgtgacnaacaattgcatcttaggagccaatttgaaggacct

SEQ ID NO: 18204 - DNA, 71 bp, chicken (Gallus Gallus)
  misc_feature (36): n=c or t
ttatgaaatgtcgttccttaatcagaaaacagtaangtacatcccccatagctccctcgtccccaaatatt

SEQ ID NO: 18205 - DNA, 71 bp, chicken (Gallus Gallus)
  misc_feature (36): n=c or t
ttctaaagtaaggcaagagagtaacagaggctgaanataggccaaacagaacatcactatctaaagcactc

SEQ ID NO: 18206 - DNA, 71 bp, chicken (Gallus Gallus)
  misc_feature (36): n=c or t
gagagagagcctggccccagcatgctaaggtggganatggcagtgggttatatttaaaggcccataaaagg

SEQ ID NO: 18207 - DNA, 71 bp, chicken (Gallus Gallus)
  misc_feature (36): n=c or t
ccttttaaaaagacagaactgaattttcttgctaanaccagatcactttatttactttacttaaacatcct

SEQ ID NO: 18208 - DNA, 71 bp, chicken (Gallus Gallus)
  misc_feature (36): n=a or g
ataaaatatgatcaaaatacaacatgatttagtgcngaaatataggtggtaggaggatgttcagactagat

SEQ ID NO: 18209 - DNA, 71 bp, chicken (Gallus Gallus)
  misc_feature (36): n=c or g
acagctgttcaacagtatttgttcccagctgggagnagaactgttccattacaaaccgattgttcacaaac

SEQ ID NO: 18210 - DNA, 71 bp, chicken (Gallus Gallus)
  misc_feature (36): n=a or g
gactctgatgatgacagcagctgctccagcagttcngattcggaagtttttgatgtcattgcagaaattaa

SEQ ID NO: 18211 - DNA, 71 bp, chicken (Gallus Gallus)
  misc_feature (36): n=c or t
agcagagaagaaagtgaaggaaagcttccaggaacnggtaagaaaagtgagaagtggattatatggaagga

SEQ ID NO: 18212 - DNA, 71 bp, chicken (Gallus Gallus)
  misc_feature (36): n=a or g
caaagagattagtttgactgttgtatccggggctgnatccacagagcagctggctagagaaactaggccac

SEQ ID NO: 18213 - DNA, 71 bp, chicken (Gallus Gallus)
  misc_feature (36): n=a or t
caggcataactccaacagttctttaagcagtttganttccagcagcctaaagtagagttaaatacaggagc

SEQ ID NO: 18214 - DNA, 71 bp, chicken (Gallus Gallus)
  misc_feature (36): n=a or g
ttcaagaggttccatggccgtgcatttaatgatccntttgttcagaaggaaaaggaaaagttgagttatga

SEQ ID NO: 18215 - DNA, 71 bp, chicken (Gallus Gallus)
  misc_feature (36): n=a or c
gtaacttttgtgaggtcccttataggatttctgcantgcttgaatcagctactgcattcgcgtaccaagga

SEQ ID NO: 18216 - DNA, 71 bp, chicken (Gallus Gallus)
  misc_feature (36): n=a or g
aacctcaaaagcgggtgtctgtatggatgcagcccnttgtgagtgtttgctttgtcagggactgctgcagg

SEQ ID NO: 18217 - DNA, 71 bp, chicken (Gallus Gallus)
  misc_feature (36): n=a or t
caagtgcattttcatactgacagtgcttattttaangctttgtatcataacttatatatgcctgttttctt

SEQ ID NO: 18218 - DNA, 71 bp, chicken (Gallus Gallus)
  misc_feature (36): n=a or g
atacacagaacaaccttcccccactcctgcaatganataaactccaagctagactttaattgaacactcaa

SEQ ID NO: 18219 - DNA, 71 bp, chicken (Gallus Gallus)
  misc_feature (36): n=a or g
cgtctcaggagctctctaaccttctcacttgtttcnttgcagacgcctgtaaaagagcccaacagtgaaaa

SEQ ID NO: 18220 - DNA, 71 bp, chicken (Gallus Gallus)
  misc_feature (36): n=a or g
ctgaataccagtttgtgcttcattcttggcaatganactttatattgtgatgcaagcttctcctcaggatg

SEQ ID NO: 18221 - DNA, 71 bp, chicken (Gallus Gallus)
  misc_feature (36): n=a or g
gttgctttgcttcagtatcttgcagtgggtgggggnaatggaaagagtaaaatgtacacagcctttttttg

SEQ ID NO: 18222 - DNA, 71 bp, chicken (Gallus Gallus)
  misc_feature (36): n=c or g
agagagactaagtaacaagggaaggcatgaggaatntcacgctgttcagaggaggtgatttcaattctgtc

SEQ ID NO: 18223 - DNA, 71 bp, chicken (Gallus Gallus)
  misc_feature (36): n=a or g
gctggggacagaggggcccagggtggagttctaccntcttgctgtatttagtcatgggacggtggatagtg

SEQ ID NO: 18224 - DNA, 71 bp, chicken (Gallus Gallus)
  misc_feature (36): n=c or t
gtaagctagaactgaaattaaagtgcctttttaacnataactgttaaaaccagagatataccgactatgtt

SEQ ID NO: 18225 - DNA, 71 bp, chicken (Gallus Gallus)
  misc_feature (36): n=c or t
ttacagggttctttcataatagaagattatgggcanttttaagtgttagatttaaatcaaccctactccaa

SEQ ID NO: 18226 - DNA, 71 bp, chicken (Gallus Gallus)
  misc_feature (36): n=a or t
gtgaccctcccagttagctgcaatttatggaaatcnatacagtctttctctgacgtcacattcttctttca

SEQ ID NO: 18227 - DNA, 71 bp, chicken (Gallus Gallus)
  misc_feature (36): n=a or t
agcagaaaatactcaggagtacataatggcctagcnctctgaagcaacatcaaagtcatttatttaatatc

SEQ ID NO: 18228 - DNA, 71 bp, chicken (Gallus Gallus)
  misc_feature (36): n=c or g
ttgaattcacctttcgacttggatttgaactgcttntatcgtgggagtgagttcacacctcagactattcc

SEQ ID NO: 18229 - DNA, 71 bp, chicken (Gallus Gallus)
  misc_feature (36): n=a or g
atctaaaacaattccactttgttacattcctatccnctaaaatacccctttatttcactattgcctctgct

SEQ ID NO: 18230 - DNA, 71 bp, chicken (Gallus Gallus)
  misc_feature (36): n=g or t
cataagtcaccttatcataatggaatagtaagaaanaagaaaagttgcaatactccatggacagacaagcc

SEQ ID NO: 18231 - DNA, 71 bp, chicken (Gallus Gallus)
  misc_feature (36): n=c or t
caacactggctcaagaaataaaataaaatcacattncttaccttcacctaccatagaaacacctattgaca

SEQ ID NO: 18232 - DNA, 71 bp, chicken (Gallus Gallus)
  misc_feature (36): n=a or g
actggttatttttactggcatttttctggaagatcnaccttttcagtcacagacattttgcaaacatacta

SEQ ID NO: 18233 - DNA, 71 bp, chicken (Gallus Gallus)
  misc_feature (36): n=c or t
aggaagttgcagggtgcaatgaggattgattataangctccatagtcctttcattcacagagaagcatctg

SEQ ID NO: 18234 - DNA, 71 bp, chicken (Gallus Gallus)
  misc_feature (36): n=c or t
aattgtgcttatttgtaagtaccaacaggaatacanatgaacacacacccattcacatgtccatgaatgca

SEQ ID NO: 18235 - DNA, 71 bp, chicken (Gallus Gallus)
  misc_feature (36): n=a or g
tactgtatagaataagaagttaaatatatatatcantctccctcaaaaatattgcttaaagttaacttact

SEQ ID NO: 18236 - DNA, 71 bp, chicken (Gallus Gallus)
  misc_feature (36): n=c or t
taacattgctagccacacaggaaaccctactgctantgaattgtgcacttgaatttcattctcccttttaa

SEQ ID NO: 18237 - DNA, 71 bp, chicken (Gallus Gallus)
  misc_feature (36): n=g or t
tttgctcagccatgtgtagcaacctgctctaatctntgtaaccatgaaagcaatgaccattaaaagtgcat

SEQ ID NO: 18238 - DNA, 71 bp, chicken (Gallus Gallus)
  misc_feature (36): n=c or t
actgtgtgtacacctcaaagcattacatggttatcnttagtctattgagcagattcatccttgcactaaac

SEQ ID NO: 18239 - DNA, 71 bp, chicken (Gallus Gallus)
  misc_feature (36): n=a or g
acctcttagccaagtcgtacagatttaattcctcanctccttccagcccctcaagtccttgctgtctgatt

SEQ ID NO: 18240 - DNA, 71 bp, chicken (Gallus Gallus)
  misc_feature (36): n=g or t
ttcagcttcctgctgctgtatgcgtatcagaaactnttgaatgaagtaaattcactggagtggtaaacact

SEQ ID NO: 18241 - DNA, 71 bp, chicken (Gallus Gallus)
  misc_feature (36): n=a or g
ttgttggaaaaaaattatttttgttacaaaacaacntcaatagcaaaactaacacaaaatctgtataaaaa

SEQ ID NO: 18242 - DNA, 71 bp, chicken (Gallus Gallus)
  misc_feature (36): n=c or t
ccaacagcataagcatgtacaatagccttttggagngagtacagagcacgtttatcagtagcacaagagca

SEQ ID NO: 18243 - DNA, 71 bp, chicken (Gallus Gallus)
  misc_feature (36): n=c or t
gactccagtgcctcaaatacagcaacatcaaagctntcgtaatgtatgtttgccactgcagaactgaagag

SEQ ID NO: 18244 - DNA, 71 bp, chicken (Gallus Gallus)
  misc_feature (36): n=a or t
gctctgttatcttctctttaaattgccaagtactgncgttctcaaagcctccaatagcttcaggaatcaag

SEQ ID NO: 18245 - DNA, 71 bp, chicken (Gallus Gallus)
  misc_feature (36): n=a or g
aaaagagcctggccccatctccatgattcccacccnttagaaattcataaacagtgctaagatcccacctc

SEQ ID NO: 18246 - DNA, 71 bp, chicken (Gallus Gallus)
  misc_feature (36): n=a or g
gctgctgggcaagatttgaaaacgttatacaacacngcagattaatcttaccacaacaaaacaaaatgcat

SEQ ID NO: 18247 - DNA, 71 bp, chicken (Gallus Gallus)
  misc_feature (36): n=a or g
atcaccgacgtccggaaacgctgaaggcacaagaantgttttggattttgcagaacacttcataggattta

SEQ ID NO: 18248 - DNA, 71 bp, chicken (Gallus Gallus)
  misc_feature (36): n=c or t
cagttttgcaggagcatgtccatttccaccagtatnctgggagtcttaacaagaaacacactattaatgtt

SEQ ID NO: 18249 - DNA, 71 bp, chicken (Gallus Gallus)
  misc_feature (36): n=c or g
gagttgctcccactttgaaggtatacaggaaccctngagaaagtataaactacaacactcaggtctacatg

SEQ ID NO: 18250 - DNA, 71 bp, chicken (Gallus Gallus)
  misc_feature (36): n=a or g
aagaaggaaaattttactactgggatagaatgtggngggaatgttgtggaactgctttccaggagcagaca

SEQ ID NO: 18251 - DNA, 71 bp, chicken (Gallus Gallus)
  misc_feature (36): n=a or g
tggagctgaagcagagctcttttgtcactcagccanagaggctaataagagacaagaacaggaaagctggg

SEQ ID NO: 18252 - DNA, 71 bp, chicken (Gallus Gallus)
  misc_feature (36): n=c or g
acagaataactggaaaagtatttgtgatacattatnacagataattccatgcttaatatactgtgcaaaca

SEQ ID NO: 18253 - DNA, 71 bp, chicken (Gallus Gallus)
  misc_feature (36): n=g or t
tatgtaccactttttttttttacgacccttaaaggncagatgtctatttgaatccagaaatcgcaggcagt

SEQ ID NO: 18254 - DNA, 71 bp, chicken (Gallus Gallus)
  misc_feature (36): n=c or g
aacagtctgatctccctgaacatttctccacagcanagatgctccagccctttgaacatttggtgaccctc

SEQ ID NO: 18255 - DNA, 71 bp, chicken (Gallus Gallus)
  misc_feature (36): n=a or c
gttccatataacttctatggctttataaatgctaantagaacagtcttgtcatttagaaataatcacaact

SEQ ID NO: 18256 - DNA, 71 bp, chicken (Gallus Gallus)
  misc_feature (36): n=a or g
ggatagatttcatttaaaatagttattcggaaatcncagttatttattttaacgccacacttatctttagt

SEQ ID NO: 18257 - DNA, 71 bp, chicken (Gallus Gallus)
  misc_feature (36): n=a or g
ggagtgaaagagttcccaagaaggtggtagcaggcnttgtgctagggtgcattttggagttatagacggat

SEQ ID NO: 18258 - DNA, 71 bp, chicken (Gallus Gallus)
  misc_feature (36): n=a or t
tgctccagcattctgaggaccaaagctaattaattnctctaaaacagaatgagatgaaaactcatacattt

SEQ ID NO: 18259 - DNA, 71 bp, chicken (Gallus Gallus)
  misc_feature (36): n=a or c
ttccacatggaccaaaacaataactcctactaatanataaaggacttaagtattgcttgactttcctggaa

SEQ ID NO: 18260 - DNA, 71 bp, chicken (Gallus Gallus)
  misc_feature (36): n=c or t
tcccaaagaaccgagagacagtccatgcttcaaagntggcagttcagaaatctttgctgtcacactcgttc

SEQ ID NO: 18261 - DNA, 71 bp, chicken (Gallus Gallus)
  misc_feature (36): n=g or t
atgcattatgtttactaaaagtactgatttttgcantcacagaacaaatatctgaagaacgttaaaacaaa

SEQ ID NO: 18262 - DNA, 71 bp, chicken (Gallus Gallus)
  misc_feature (36): n=c or g
attaccacgggtaaaaaattaatataaatctgactnaatcttagtaaacttctgtaatgctgaataaaaca

SEQ ID NO: 18263 - DNA, 71 bp, chicken (Gallus Gallus)
  misc_feature (36): n=c or t
ttaatgtcagtctgttgcccttcaaagcaatactcntgaaatatttaccctgttattaagttagtaaagtc

SEQ ID NO: 18264 - DNA, 71 bp, chicken (Gallus Gallus)
  misc_feature (36): n=c or t
acattcaagccctatgtctgagagcactgtcctaangctccttgacctccagcagtttacttccatgggga

SEQ ID NO: 18265 - DNA, 71 bp, chicken (Gallus Gallus)
  misc_feature (36): n=a or t
gaagcaacagacatttctgtacaacaaaaatcagcnccaaaacacgacagcatttacatttggaggtatct

SEQ ID NO: 18266 - DNA, 71 bp, chicken (Gallus Gallus)
  misc_feature (36): n=c or t
agtgaaatatctcatttctatgtcttgtagaggtantgtgatgaaatgtgagtttgcatgaactcactgca

SEQ ID NO: 18267 - DNA, 71 bp, chicken (Gallus Gallus)
  misc_feature (36): n=a or g
gggatagactacaaccctttctggggctcagccacnctcacagtaaaaaagctcttcctggtcttcacaca

SEQ ID NO: 18268 - DNA, 71 bp, chicken (Gallus Gallus)
  misc_feature (36): n=a or g
gtggtgctgattttcttagtgctcgctttgaccacngcagggggacacgcaggggctgcaggtgctatttt

SEQ ID NO: 18269 - DNA, 71 bp, chicken (Gallus Gallus)
  misc_feature (36): n=a or c
catcctgttcctaatctgctcatcttgtacaaaagntttagttgctaaaagctttcagatttcttcagtct

SEQ ID NO: 18270 - DNA, 71 bp, chicken (Gallus Gallus)
  misc_feature (36): n=c or t
gcaaaggcagtcttctgatactggctttgatacttngcacaaatggtcatttattttgtccattcatatct

SEQ ID NO: 18271 - DNA, 71 bp, chicken (Gallus Gallus)
  misc_feature (36): n=c or g
gattgtgaaattttctctctacttccctgttttctnaatagtctaacaagtagcagacttaaaaacaaata

SEQ ID NO: 18272 - DNA, 71 bp, chicken (Gallus Gallus)
  misc_feature (36): n=a or g
agacctcttgtgaaatgatttgtgcatgatgtgagngcctgcactccacaaagctgtaggggagtggtgaa

SEQ ID NO: 18273 - DNA, 71 bp, chicken (Gallus Gallus)
  misc_feature (36): n=a or c
tatcaatgaagttgttgtttctgttgaattgctcanctacttaagaaataagcatttcagaagagtctaag

SEQ ID NO: 18274 - DNA, 71 bp, chicken (Gallus Gallus)
  misc_feature (36): n=c or t
acacttacatgtattggattgacttggatcagttcnacttagtgtcatcagataatcttggacaagcaatt

SEQ ID NO: 18275 - DNA, 71 bp, chicken (Gallus Gallus)
  misc_feature (36): n=a or t
aacatttcctataccatgttgatggcttctgtaaangctttcttccctttccaacatgcccaacctgaaaa

SEQ ID NO: 18276 - DNA, 71 bp, chicken (Gallus Gallus)
  misc_feature (36): n=c or t
ttgatattgcttttaactttccatgttttcactaangttgaaaataccgaaaatcaaatgacgaaagtctt

SEQ ID NO: 18277 - DNA, 71 bp, chicken (Gallus Gallus)
  misc_feature (36): n=g or t
gagatggtatgagagcttatctcactgggagacaantacagatctcacagtgaaccacaaaatgctaggat

SEQ ID NO: 18278 - DNA, 71 bp, chicken (Gallus Gallus)
  misc_feature (36): n=a or g
ttagttcacctatctgtcctggtgctcagccctcanttgtatttccagaaagcaatcacactgcattccag

SEQ ID NO: 18279 - DNA, 71 bp, chicken (Gallus Gallus)
  misc_feature (36): n=a or c
acctttgtggcaagctcattgcagtcagggcagttnccttctccagaagcttttgggcacctgagtcccca

SEQ ID NO: 18280 - DNA, 71 bp, chicken (Gallus Gallus)
  misc_feature (36): n=a or g
aattaccatcacacagacatcccttctgcaaggcanatcgcagtgcagctgatgccagatgtgtgaggaga

SEQ ID NO: 18281 - DNA, 71 bp, chicken (Gallus Gallus)
  misc_feature (36): n=c or t
agaggtacttcttgttttagtgaaaatatctcaggngctgacacctgggagtaggtgttacagtgatctct

SEQ ID NO: 18282 - DNA, 71 bp, chicken (Gallus Gallus)
  misc_feature (36): n=c or t
gaccatagatgatcattgtatgatgtttcatcattnagagcaaaactgtagcttagtttgtagttatgaat

SEQ ID NO: 18283 - DNA, 71 bp, chicken (Gallus Gallus)
  misc_feature (36): n=a or c
ctgagctcaagcccaaatttcagcacggcagtgttnggattgctgatctccgccgccatttgcctttaacg

SEQ ID NO: 18284 - DNA, 71 bp, chicken (Gallus Gallus)
  misc_feature (36): n=c or t
ccagcaggaaactggcagcatgggtctctggaatgnccattcactctctgaagttacctacctgatcccca

SEQ ID NO: 18285 - DNA, 71 bp, chicken (Gallus Gallus)
  misc_feature (36): n=a or g
tcagtcagttttgaatgtcaatactttatacacacnggaataagatcaaggctagtctgagggcatttcag

SEQ ID NO: 18286 - DNA, 71 bp, chicken (Gallus Gallus)
  misc_feature (36): n=a or t
actgaaagatgatatttgtgtacaagttggttctgntactggcttttccttgtttttgtggctaaatagga

SEQ ID NO: 18287 - DNA, 71 bp, chicken (Gallus Gallus)
  misc_feature (36): n=a or g
aaataggtgcagagacaggctatacaacttctctcncaacagcccatagccaggcagccctggccctcacc

SEQ ID NO: 18288 - DNA, 71 bp, chicken (Gallus Gallus)
  misc_feature (36): n=c or t
gcccacctggcccttaatgcaccgatattgctgtgntcacagaagtgccacagacctccagcatcacagca

SEQ ID NO: 18289 - DNA, 71 bp, chicken (Gallus Gallus)
  misc_feature (36): n=c or t
taccattcaggaagctttttaaagcagaagggtggntgttttttattgttgttgctgttcttgtttttaaa

SEQ ID NO: 18290 - DNA, 71 bp, chicken (Gallus Gallus)
  misc_feature (36): n=g or t
actaagaatttaaggttaagaaaaacttgaatttgngcttgcatttatggatatggtactaagagtagatc

SEQ ID NO: 18291 - DNA, 71 bp, chicken (Gallus Gallus)
  misc_feature (36): n=c or t
actctttctatgataatgatgcagtaagaaacatgnatttctcaagaaagccaaaaacactcctgttcagg

SEQ ID NO: 18292 - DNA, 71 bp, chicken (Gallus Gallus)
  misc_feature (36): n=a or g
tgtcttttttagacaaaaaggaaataagcttgtacncttaattcaatctttagcagccacttttgtttata

SEQ ID NO: 18293 - DNA, 71 bp, chicken (Gallus Gallus)
  misc_feature (36): n=g or t
ctttgattcttgtcctaaaatgttttgatagagtgnttttcttacctaatcttctatgagaaagattattc

SEQ ID NO: 18294 - DNA, 71 bp, chicken (Gallus Gallus)
  misc_feature (36): n=c or t
gatatatatatgacgtgaggaggatggggtttcagntcttcctccaaagtaacttttttaatacttcagct

SEQ ID NO: 18295 - DNA, 71 bp, chicken (Gallus Gallus)
  misc_feature (36): n=c or t
attttaaaacttttttttttttcactgtcctgttgngttcgtccagattggaacacagaaacacagcacat

SEQ ID NO: 18296 - DNA, 71 bp, chicken (Gallus Gallus)
  misc_feature (36): n=a or g
gagcataacactgagtagcagtataatttaagtggntgttcttagatcctaattggttggatgcagacaac

SEQ ID NO: 18297 - DNA, 71 bp, chicken (Gallus Gallus)
  misc_feature (36): n=c or t
tccaaactctaggactgttggcagttggcacatcgngttgaaggagtaatccctgcagtactatcctctcc

SEQ ID NO: 18298 - DNA, 71 bp, chicken (Gallus Gallus)
  misc_feature (36): n=a or g
attttgcttctgagtagtgctaatacttcacaactnagacttttccttcaaaattgtggttattgacctca

SEQ ID NO: 18299 - DNA, 71 bp, chicken (Gallus Gallus)
  misc_feature (36): n=c or g
cacaggagggtacgggaagtcatacaaatttggatntaattttctttgctgtagtcagaaaatactgcagt

SEQ ID NO: 18300 - DNA, 71 bp, chicken (Gallus Gallus)
  misc_feature (36): n=a or c
tacaatgcttacataagcaacaataaacatcagcanttcctaaattccacagaagttttcctactcatttg

SEQ ID NO: 18301 - DNA, 71 bp, chicken (Gallus Gallus)
  misc_feature (36): n=a or g
tgcatactcttccaagtacattttcatacacctttngtatttcttcagtttactttcatggattgtgtgct

SEQ ID NO: 18302 - DNA, 71 bp, chicken (Gallus Gallus)
  misc_feature (36): n=a or g
ctgaacacagcagcacgtgtgggtctcctcacaacngcgtcgtgttttactgatggtgatctgtgtatgct

SEQ ID NO: 18303 - DNA, 71 bp, chicken (Gallus Gallus)
  misc_feature (36): n=a or c
gctcgtgctgccctgagctttcacaaaatacctgangcctggattttgatagcttttggctacgtgacttc

SEQ ID NO: 18304 - DNA, 71 bp, chicken (Gallus Gallus)
  misc_feature (36): n=c or t
taatgtgagtaactaatcagaaagcaatactctagntttctatcctgtagctattttcaaatttgggatgt

SEQ ID NO: 18305 - DNA, 71 bp, chicken (Gallus Gallus)
  misc_feature (36): n=c or t
cagggatttccaagtatccattgcaaaaattgagantgtggtgctacctatggaaaaaggtatttggagtc

SEQ ID NO: 18306 - DNA, 71 bp, chicken (Gallus Gallus)
  misc_feature (36): n=c or t
atacagcccttcccactgtcagattaagttagtaanttgttaataacttgttaaaagattctgatacgcgc

SEQ ID NO: 18307 - DNA, 71 bp, chicken (Gallus Gallus)
  misc_feature (36): n=c or g
agcagagaagtctgaatatctaaagagaggggccancactggtttttagtgcaggtatgatgctggacctg

SEQ ID NO: 18308 - DNA, 71 bp, chicken (Gallus Gallus)
  misc_feature (36): n=c or t
ggcccaaacagcctgaaacaaaacactattgaattngatgggtgcaatttgatgatgctggtcaagatcag

SEQ ID NO: 18309 - DNA, 71 bp, chicken (Gallus Gallus)
  misc_feature (36): n=g or t
accaaaaaagtagaaaatagaatgtatataatgagntacatcagcaacactagagaaagtatgtagctggg

SEQ ID NO: 18310 - DNA, 71 bp, chicken (Gallus Gallus)
  misc_feature (36): n=a or c
agccatatccctgaaattaccttctgccgaatttcnaagtcctcatccaaaataaagggctgctggtgctt

SEQ ID NO: 18311 - DNA, 71 bp, chicken (Gallus Gallus)
  misc_feature (36): n=a or t
gcttgagtaaaccatatttaattcagttagtggaangaattttttaactgaaaaagaaacctgaaacaaca

SEQ ID NO: 18312 - DNA, 71 bp, chicken (Gallus Gallus)
  misc_feature (36): n=c or t
ttctgcccatttccagaagtgcactcataggcacanatacaaatataaataaacaaaatgacattaagcaa

SEQ ID NO: 18313 - DNA, 71 bp, chicken (Gallus Gallus)
  misc_feature (36): n=c or t
atatctaaaccttgaattgcctaatgtcttttaaangatgaaattgtaataagaatttctattttggatga

SEQ ID NO: 18314 - DNA, 71 bp, chicken (Gallus Gallus)
  misc_feature (36): n=c or t
taggccaaaggagaacttctatcagtttattcacgnaagggattatgcttctacgccacagaggttttacc

SEQ ID NO: 18315 - DNA, 71 bp, chicken (Gallus Gallus)
  misc_feature (36): n=a or g
gtttcttgtgtttcttccaagagatgttaggaagtntgcaggaccatgcgtagagtgccaattccacatct

SEQ ID NO: 18316 - DNA, 71 bp, chicken (Gallus Gallus)
  misc_feature (36): n=a or g
ataaaatagaaggcattatttttggagcagccctcntacatacatgttacagttaagagcatgatggatac

SEQ ID NO: 18317 - DNA, 71 bp, chicken (Gallus Gallus)
  misc_feature (36): n=a or g
gacaagcagtcagtacagctcagcacagtaagtaangagaagccatcacaccaccgaaccccatggcaaca

SEQ ID NO: 18318 - DNA, 71 bp, chicken (Gallus Gallus)
  misc_feature (36): n=c or t
catcatcacaggcaaggtttgtgtgcttgttgtcantgctataaacattactctcagttgtgggaggctta

SEQ ID NO: 18319 - DNA, 71 bp, chicken (Gallus Gallus)
  misc_feature (36): n=c or t
aactgattgacgttttgtgggaatgtgttgacttcngtcaagcttcctttcaataagtacagggagtttca

SEQ ID NO: 18320 - DNA, 71 bp, chicken (Gallus Gallus)
  misc_feature (36): n=c or t
gctttaaaagcttgacagggctacttttatgtgganaggggaatgacagtgtggaactgtcaggagaaggg

SEQ ID NO: 18321 - DNA, 71 bp, chicken (Gallus Gallus)
  misc_feature (36): n=a or g
aaaggatgtgcaggcagaggtgggaggagagctgcngcaatctaggatgcttcagggttgtgaattttggg

SEQ ID NO: 18322 - DNA, 71 bp, chicken (Gallus Gallus)
  misc_feature (36): n=c or t
aggtctaggcagtgtatagagcctcttcctgaccanagttaagctgtttccctgacttgtttcacaacaaa

SEQ ID NO: 18323 - DNA, 71 bp, chicken (Gallus Gallus)
  misc_feature (36): n=a or c
gctacggctatttttttgcaagaagagtggatcttnattcaatgctattcaacactcccccatctttttct

SEQ ID NO: 18324 - DNA, 71 bp, chicken (Gallus Gallus)
  misc_feature (36): n=c or t
gaaaccacacaagctcaaataatccaagaaatctanagctttgcaatcttctccaggaagttttccaaaat

SEQ ID NO: 18325 - DNA, 71 bp, chicken (Gallus Gallus)
  misc_feature (36): n=a or g
agaggataggtttgcttctagatcttgttgaaagcngcaatgtcgacgctttgcacctggaacacgacaag

SEQ ID NO: 18326 - DNA, 71 bp, chicken (Gallus Gallus)
  misc_feature (36): n=c or t
tttggaaaagactcctagagtaggcaaagcttttangtatccttattaatcggttaaaatagtgcttaaaa

SEQ ID NO: 18327 - DNA, 71 bp, chicken (Gallus Gallus)
  misc_feature (36): n=a or g
cttgacatggactccagcacgtaaaccagttcccangttggatggacaggtcagaacgtacccgaggcgtt

SEQ ID NO: 18328 - DNA, 71 bp, chicken (Gallus Gallus)
  misc_feature (36): n=g or t
gcacttcatgaatgaggtgatattaaataattaacnagttcacatgaatgatacttatttctagtttatgc

SEQ ID NO: 18329 - DNA, 71 bp, chicken (Gallus Gallus)
  misc_feature (36): n=c or t
cctttgaattctaatataccaatgtattttctgctnagtgaacaagttgaagaggattgatttcagcactg

SEQ ID NO: 18330 - DNA, 71 bp, chicken (Gallus Gallus)
  misc_feature (36): n=g or t
atcctcccagctgcagtagcgtacactgacttctcntctgtgccttatgccacagggcacgcaacaccttg

SEQ ID NO: 18331 - DNA, 71 bp, chicken (Gallus Gallus)
  misc_feature (36): n=c or g
acactattgcctgcagtatgcagatagagagtcccntgtccaacaggagaaaagataaatgaacacctctg

SEQ ID NO: 18332 - DNA, 71 bp, chicken (Gallus Gallus)
  misc_feature (36): n=c or t
gggagcttgtgcaccatgctgcatcctggagcaaanatgcatgctcaagacgtgaaggtagactgaaatct

SEQ ID NO: 18333 - DNA, 71 bp, chicken (Gallus Gallus)
  misc_feature (36): n=c or g
tgacatagattaatgttaaaaggcagatttgttaancactctgtggtaaattatcctagcagtctaatgaa

SEQ ID NO: 18334 - DNA, 71 bp, chicken (Gallus Gallus)
  misc_feature (36): n=a or g
gcattttaacacagtgttgtttggagttaccatttntctcttggctaaatgctcatattttgcatgatgag

SEQ ID NO: 18335 - DNA, 71 bp, chicken (Gallus Gallus)
  misc_feature (36): n=a or g
acaggcttgtgtagtctcatctgagattctgactancatgcaatcataattttctaaatatatttttttaa

SEQ ID NO: 18336 - DNA, 71 bp, chicken (Gallus Gallus)
  misc_feature (36): n=a or g
gtaagtattgattacatatatactttttgatttacnggatgacggcagaatacctcagccatgtgttcttc

SEQ ID NO: 18337 - DNA, 71 bp, chicken (Gallus Gallus)
  misc_feature (36): n=a or g
aattagagcattttagatcagaaaagttttttattncaataacttacactaaccttttctttcaataaagg

SEQ ID NO: 18338 - DNA, 71 bp, chicken (Gallus Gallus)
  misc_feature (36): n=a or g
gctgctgcacctcaactaagtgaatcgtactgctcnggttccggcccgtcattcatcagtgagggcacgtt

SEQ ID NO: 18339 - DNA, 71 bp, chicken (Gallus Gallus)
  misc_feature (36): n=c or t
ttatctcttactggatactcagctgaagtaactcanctttgattgcatctagcaccattgttccagcctgt

SEQ ID NO: 18340 - DNA, 71 bp, chicken (Gallus Gallus)
  misc_feature (36): n=c or g
taccagcaggcatttgggtatcacacaccagaggantacatgtccagtctgtgacagaggcaagcacggaa

SEQ ID NO: 18341 - DNA, 71 bp, chicken (Gallus Gallus)
  misc_feature (36): n=a or g
ttcggacatccagctttcccttaattcttttcaagncaaaaagacccttgacaaatggatgataagcagct

SEQ ID NO: 18342 - DNA, 71 bp, chicken (Gallus Gallus)
  misc_feature (36): n=a or c
gcacgagcactcatctaccaatccattcccactatnaaatatacattacagcaaaatataggttactaaaa

SEQ ID NO: 18343 - DNA, 71 bp, chicken (Gallus Gallus)
  misc_feature (36): n=c or t
ctacaccatctgattggaaagaatgcgaaagtcaangttagaattaaaataattttatttcaatgtacatg

SEQ ID NO: 18344 - DNA, 71 bp, chicken (Gallus Gallus)
  misc_feature (36): n=a or g
attggatagaatattggtgggagggttccacctctnttgtcatacccccaacattcacctcagacatcaca

SEQ ID NO: 18345 - DNA, 71 bp, chicken (Gallus Gallus)
  misc_feature (36): n=c or t
actgttttcagcagtcttgtaactggacaaaatgantgcccctgggggtgacctgcaggaccttcgaaaat

SEQ ID NO: 18346 - DNA, 71 bp, chicken (Gallus Gallus)
  misc_feature (36): n=c or t
gttgtaatttactggacctatgtagaagagagaaanataaagtgtttctcttctgcagagatttatttgca

SEQ ID NO: 18347 - DNA, 71 bp, chicken (Gallus Gallus)
  misc_feature (36): n=a or g
ggatttctgcaggaaagctcctgagaaagcttgctntgacaaacatagtttgcttccggacagcattcagt

SEQ ID NO: 18348 - DNA, 71 bp, chicken (Gallus Gallus)
  misc_feature (36): n=c or t
cattctgctcccgctgttgtggcagcttctcctaantacaatccatttttcatgaatgaccagaatagaaa

SEQ ID NO: 18349 - DNA, 71 bp, chicken (Gallus Gallus)
  misc_feature (36): n=a or g
aagctcaagacagaaaatttcttagtctagctgaanagttttggtagcaacagcaaagacttacaatgcca

SEQ ID NO: 18350 - DNA, 71 bp, chicken (Gallus Gallus)
  misc_feature (36): n=a or g
ggtggtttgcctagcagacagaagtagatctccatntgaggcacagccttctctgtagataagactgaggt

SEQ ID NO: 18351 - DNA, 71 bp, chicken (Gallus Gallus)
  misc_feature (36): n=a or g
agaggtccataaagttcaggaatgcaaacaaaggtnagaagagctggtgcttggggtgtagtatgcttcat

SEQ ID NO: 18352 - DNA, 71 bp, chicken (Gallus Gallus)
  misc_feature (36): n=c or t
tttggggagaggatgaataagaggattgtttctatngcaggaaatattgttaaagcatttttaatgagtga

SEQ ID NO: 18353 - DNA, 71 bp, chicken (Gallus Gallus)
  misc_feature (36): n=a or g
gttctttggcacgtaattgctatagaaaattacccntcatggcttggacttgactaggctagagagcatcc

SEQ ID NO: 18354 - DNA, 71 bp, chicken (Gallus Gallus)
  misc_feature (36): n=a or g
agaacctgagtcacattgtcagatccctgaggaagngaatccaaacctctcttgagatcaggcattatcac

SEQ ID NO: 18355 - DNA, 71 bp, chicken (Gallus Gallus)
  misc_feature (36): n=a or g
aaaagggcataaaaacgtaaagtgtttgaccaactncatggggaaagcatatggcaaagccctgaaatgtt

SEQ ID NO: 18356 - DNA, 71 bp, chicken (Gallus Gallus)
  misc_feature (36): n=c or g
tacctgtgttcctgtggccaccttctccccatgatntggctaatttccagtttcccacccagggcaccttg

SEQ ID NO: 18357 - DNA, 71 bp, chicken (Gallus Gallus)
  misc_feature (36): n=c or g
gtgtaaatgatgtgcatgtacatgccttggtgtctntgctaatctttgccatcatcgctttatttatgttc

SEQ ID NO: 18358 - DNA, 71 bp, chicken (Gallus Gallus)
  misc_feature (36): n=a or g
ggcacctagattgctcacaaaagctctaaactgaanagcaaacattagattcaggcattaataccccatgt

SEQ ID NO: 18359 - DNA, 71 bp, chicken (Gallus Gallus)
  misc_feature (36): n=c or t
atagctaaagtcatgatgatccatgtgctttcaccnagattagttatttcctattttagaagagtaaaaag

SEQ ID NO: 18360 - DNA, 71 bp, chicken (Gallus Gallus)
  misc_feature (36): n=c or t
tagagtctcttaatcttcaggttttttaagggtaanttcagccttcactcactcccttttggtagatgcat

SEQ ID NO: 18361 - DNA, 71 bp, chicken (Gallus Gallus)
  misc_feature (36): n=a or c
ttgctctgcatgcactagtgaggtccagctagtcanttgtgttgtgcttgttgtagggaagatgtatcttc

SEQ ID NO: 18362 - DNA, 71 bp, chicken (Gallus Gallus)
  misc_feature (36): n=c or g
aagaggtgttaggatagaacagaccttagctgtggnaagaggccatgttctttgaagggaactaggtaata

SEQ ID NO: 18363 - DNA, 71 bp, chicken (Gallus Gallus)
  misc_feature (36): n=a or g
cactgacatcattcaaagacttactcctagaaatcnaaaagtaaaaaaaaaaatattcagcttcataacat

SEQ ID NO: 18364 - DNA, 71 bp, chicken (Gallus Gallus)
  misc_feature (36): n=a or g
tctctagtaatactattgcagttcttttttgtaaanattactgcagctttgttccattgaactgaggagca

SEQ ID NO: 18365 - DNA, 71 bp, chicken (Gallus Gallus)
  misc_feature (36): n=a or g
tcgtctaagccctccacgtagccctctgcatcagantctggtgcttctttgtcatcccgatcgtagccatc

SEQ ID NO: 18366 - DNA, 71 bp, chicken (Gallus Gallus)
  misc_feature (36): n=c or t
tcctttaccatcagtgacatgactgtgtctatgggngtgcatacatggagaggcaaagcctacagcttgtg

SEQ ID NO: 18367 - DNA, 71 bp, chicken (Gallus Gallus)
  misc_feature (36): n=c or t
tacatccctatcagctgacctttagtagcgacaggngaaccactccaccctgctgctgcaagcaaggtcag

SEQ ID NO: 18368 - DNA, 71 bp, chicken (Gallus Gallus)
  misc_feature (36): n=a or g
tgctggagatttattattagggttagcattacaccnagtaattttaaaagcttgagagatcaaaagatctg

SEQ ID NO: 18369 - DNA, 71 bp, chicken (Gallus Gallus)
  misc_feature (36): n=a or g
tgtggcatacaaagacagcataaaaacaagcacacnctagataaaaggccatttggaagcatacaaaaaga

SEQ ID NO: 18370 - DNA, 71 bp, chicken (Gallus Gallus)
  misc_feature (36): n=c or t
gctctatcacataaggaagccaggcctagctgattncacactacagattgaaagaggttggggaattgtta

SEQ ID NO: 18371 - DNA, 71 bp, chicken (Gallus Gallus)
  misc_feature (36): n=a or g
tgctgaagacagagaaaaccaaacctgaagttttanaagctcactatggctctgcagctccagagagtgtt

SEQ ID NO: 18372 - DNA, 71 bp, chicken (Gallus Gallus)
  misc_feature (36): n=c or t
tcagtggtagagaaccatgaaaaggtctatcagaanacaggagcttaaattatttgaggcatgtttaaaaa

SEQ ID NO: 18373 - DNA, 71 bp, chicken (Gallus Gallus)
  misc_feature (36): n=a or g
caaactgaaacctacttggcattgacaaacaccacncaattataacttgggcctcctgattttatctagcc

SEQ ID NO: 18374 - DNA, 71 bp, chicken (Gallus Gallus)
  misc_feature (36): n=c or t
tatctagcaaatcttacctctcccttaggcccattntcctctgcaagacatgggtatcctgattccgcacc

SEQ ID NO: 18375 - DNA, 71 bp, chicken (Gallus Gallus)
  misc_feature (36): n=a or g
aaataaatgtcttatttcctttggaaattatatgangtgtatgaaacaccacacagttagaaatatctgaa

SEQ ID NO: 18376 - DNA, 71 bp, chicken (Gallus Gallus)
  misc_feature (36): n=a or g
ttgtttctttttcctcagcactgtatgagaaagcanaaattaaggcacccgaggacaagaagaagcacctc

SEQ ID NO: 18377 - DNA, 71 bp, chicken (Gallus Gallus)
  misc_feature (36): n=a or c
ttttctcctttcttgggtttaatttacagatatggngttatttattgtgcaggcttgaaagaagaatactg

SEQ ID NO: 18378 - DNA, 71 bp, chicken (Gallus Gallus)
  misc_feature (36): n=g or t
acaaaaatgatacaagggatggaacatgtctcctgngagggcaggctgagagagatggggctgttcagcct

SEQ ID NO: 18379 - DNA, 71 bp, chicken (Gallus Gallus)
  misc_feature (36): n=g or t
acatctgagacttcacagcatgaattttgaggaatntcaggattacgaccattgcaatatgtttgtattgt

SEQ ID NO: 18380 - DNA, 71 bp, chicken (Gallus Gallus)
  misc_feature (36): n=c or t
atcagcagctacatgaaggtcagcatctgtttgccnatgcacatagaaacaccgttttctcaggcttatgt

SEQ ID NO: 18381 - DNA, 71 bp, chicken (Gallus Gallus)
  misc_feature (36): n=a or g
acaccaggtgctggagtggatgcagcgcatgaaatnttctcaccacccgttttatcagcagacaactctgg

SEQ ID NO: 18382 - DNA, 71 bp, chicken (Gallus Gallus)
  misc_feature (36): n=c or t
gtaaatgctagtccctgaaaaactcccaggaagaanagattggaaaaagtagcagcaaactgagaaaaaaa

SEQ ID NO: 18383 - DNA, 71 bp, chicken (Gallus Gallus)
  misc_feature (36): n=a or g
taaattctttcatactagagacaattatcttaaagnaaatctgtataagttccaggcataataccttaata

SEQ ID NO: 18384 - DNA, 71 bp, chicken (Gallus Gallus)
  misc_feature (36): n=c or g
aatgtttagggaaaactgatctttatttatatctantaaagagcataaggaagttggattatttctttgca

SEQ ID NO: 18385 - DNA, 71 bp, chicken (Gallus Gallus)
  misc_feature (36): n=a or g
cgccccgtgatgggactgctctgagccccaactggntactttcccattacgtgtagtgctttcattaaaca

SEQ ID NO: 18386 - DNA, 71 bp, chicken (Gallus Gallus)
  misc_feature (36): n=c or t
ctccccagatattcttgttttaatgagttttcatgntgggaagaaacaaccgccttgttctcaaatataga

SEQ ID NO: 18387 - DNA, 71 bp, chicken (Gallus Gallus)
  misc_feature (36): n=g or t
tgagaacccagaagttttgctaaaactctttttctnttgtttttcttgcactaaataaaaaatattatggg

SEQ ID NO: 18388 - DNA, 71 bp, chicken (Gallus Gallus)
  misc_feature (36): n=c or t
tgttcctgtcctttggttttggtcatttttccttanacagcgtgcagggatcctgaacgggaggtggtgca

SEQ ID NO: 18389 - DNA, 71 bp, chicken (Gallus Gallus)
  misc_feature (36): n=c or t
cttgtcattagcagctcacaaagagcgcttgtcatnactactggcagtgtcatattgcttttggtctccat

SEQ ID NO: 18390 - DNA, 71 bp, chicken (Gallus Gallus)
  misc_feature (36): n=c or t
tccaaacctggaatgcagttcatgtgttcagtcatnctgtgactctgcgattgttgcatcgaatactgatt

SEQ ID NO: 18391 - DNA, 71 bp, chicken (Gallus Gallus)
  misc_feature (36): n=c or t
acagatggggagaaaaaatctgtgtctacagaatcntcttcccagtccaaccagttttctctgtgcatttt

SEQ ID NO: 18392 - DNA, 71 bp, chicken (Gallus Gallus)
  misc_feature (36): n=a or g
tttatgttaaggagttattttgtcatagcagtcacnaatttccactctctggttttattctcttatgtgga

SEQ ID NO: 18393 - DNA, 71 bp, chicken (Gallus Gallus)
  misc_feature (36): n=a or g
ttttctctgatttttgaccaagttaatgaaaactcncatcacttgaagacaaaacctctggctactttgtg

SEQ ID NO: 18394 - DNA, 71 bp, chicken (Gallus Gallus)
  misc_feature (36): n=a or g
ctggaagtgaggctaatctgcttcatgaaatttccnagggaaagcagagatggagtaatcttccaaaatta

SEQ ID NO: 18395 - DNA, 71 bp, chicken (Gallus Gallus)
  misc_feature (36): n=g or t
ttttacttggtaaacatatatacctgatggtagtangagtcaaaatgtattggaaattaatgtgtattaaa

SEQ ID NO: 18396 - DNA, 71 bp, chicken (Gallus Gallus)
  misc_feature (36): n=a or c
agtagacaagtttagattactacattttttcattcngttgttttcttaaacagcaaattgattagcttttg

SEQ ID NO: 18397 - DNA, 71 bp, chicken (Gallus Gallus)
  misc_feature (36): n=c or t
ttcgctggaaaattcatcagagatcttcttaggttngtttccttacagctttgcatcctcaccagtgagag

SEQ ID NO: 18398 - DNA, 71 bp, chicken (Gallus Gallus)
  misc_feature (36): n=a or t
aatttcttgggggagatggctcatcttggacagatnaagagtcctgagtgggtgggtgattctccaggaga

SEQ ID NO: 18399 - DNA, 71 bp, chicken (Gallus Gallus)
  misc_feature (36): n=g or t
cagtgaacagatcatgaagtacctgacacaatgcanaggcattggtaactaacagatgcacagcgacaact

SEQ ID NO: 18400 - DNA, 71 bp, chicken (Gallus Gallus)
  misc_feature (36): n=c or t
gaagatttaaaaagagcaagcatcagattctgtgcntgggtgggacagccctgggtatctgtacagactgg

SEQ ID NO: 18401 - DNA, 71 bp, chicken (Gallus Gallus)
  misc_feature (36): n=a or g
tccttcttgttagtattaatcaaagtatcaagccanttctctgtaatccaagcaaagaagattgagttttc

SEQ ID NO: 18402 - DNA, 71 bp, chicken (Gallus Gallus)
  misc_feature (36): n=c or g
gatgaaaatggattgctgaaaaaaaatgagtatgtntcgacagtttacgggctggtccagcctggttccat

SEQ ID NO: 18403 - DNA, 71 bp, chicken (Gallus Gallus)
  misc_feature (36): n=c or t
ttttttttttctccccaattctctctgtcatcccantgaggcagcagagagaataaccagagggcagtgtg

SEQ ID NO: 18404 - DNA, 71 bp, chicken (Gallus Gallus)
  misc_feature (36): n=a or g
cagtgggaacaagtgaaccttcaggaattttgcagntgacaccaaactgaatgatgcaattgaccaaacag

SEQ ID NO: 18405 - DNA, 71 bp, chicken (Gallus Gallus)
  misc_feature (36): n=a or t
cacaaacaaaagccttctgtttcaccagtctctacngtaccaagaaacactcatatgggtaggtttcttca

SEQ ID NO: 18406 - DNA, 71 bp, chicken (Gallus Gallus)
  misc_feature (36): n=c or t
tttgtctcagacattgccagtaggggagggtggccngtgcagagctgttccaaaccacctcctatatgagg

SEQ ID NO: 18407 - DNA, 71 bp, chicken (Gallus Gallus)
  misc_feature (36): n=c or t
aattttaagagtctgaccactcaagagcaggaagtnggtgactaaacacctggaaaaatgtttgcttttgc

SEQ ID NO: 18408 - DNA, 71 bp, chicken (Gallus Gallus)
  misc_feature (36): n=a or g
gaacaaattgtcttgagcatttttgtgtcagcatgntgtaatgagcttgtaagttggcacaaaacacattc

SEQ ID NO: 18409 - DNA, 71 bp, chicken (Gallus Gallus)
  misc_feature (36): n=a or g
tcaacgaagttttgtgcagaaaaatgaacaggaggngcttgagcagtgctacatcctatctcaccctttct

SEQ ID NO: 18410 - DNA, 71 bp, chicken (Gallus Gallus)
  misc_feature (36): n=g or t
tgcgcacagatctgcacttaatcccaggcactgatnccagaaactgctgatgtctccaggcccttgagagg

SEQ ID NO: 18411 - DNA, 71 bp, chicken (Gallus Gallus)
  misc_feature (36): n=a or c
ataaattacaaacgggtagaatttctgccttgtagngagttggaacaatttttgtatttgtcctacaggcc

SEQ ID NO: 18412 - DNA, 71 bp, chicken (Gallus Gallus)
  misc_feature (36): n=c or g
atctcgtatgatcacatctgagctatagctgctgancaccagttatcttaattttccttcccttactggga

SEQ ID NO: 18413 - DNA, 71 bp, chicken (Gallus Gallus)
  misc_feature (36): n=c or g
tctcagatggtaatgtagaaagctatattggactanatgatcttagaggtcttttccaactttaataattc

SEQ ID NO: 18414 - DNA, 71 bp, chicken (Gallus Gallus)
  misc_feature (36): n=a or g
gaaattgttggcaatattatgataatttttgtatgngaagagaccatggtattatcacaatttaaaccatt

SEQ ID NO: 18415 - DNA, 71 bp, chicken (Gallus Gallus)
  misc_feature (36): n=g or t
tcaatacccacagaagccagttgttagtgcttctcngcaaggagagaattgtttccatactgctattcagt

SEQ ID NO: 18416 - DNA, 71 bp, chicken (Gallus Gallus)
  misc_feature (36): n=c or t
attcctttaaccctaacaaatgtttcttcaaccatnttgaagctagcacacagcaggactcatgaccaact

SEQ ID NO: 18417 - DNA, 71 bp, chicken (Gallus Gallus)
  misc_feature (36): n=c or g
ccagagaaggagattccacaacctccctaggcagcntgttacagtgctctgtaactcgcaccgtgaagaat

SEQ ID NO: 18418 - DNA, 71 bp, chicken (Gallus Gallus)
  misc_feature (36): n=a or t
gaagtgcatatacgaagtaatggtgtgtcactgaantccgccatgtggaaaaaaatggtacccactgacat

SEQ ID NO: 18419 - DNA, 71 bp, chicken (Gallus Gallus)
  misc_feature (36): n=a or g
agacagcaaactccattccgcctgttttcaggctcngttgcttgagatgacatgaatggtcggccatggga

SEQ ID NO: 18420 - DNA, 71 bp, chicken (Gallus Gallus)
  misc_feature (36): n=a or g
taaaaattaagaaaatctctgataagagagtactcnctgtttgtataactattattgttttactctcttaa

SEQ ID NO: 18421 - DNA, 71 bp, chicken (Gallus Gallus)
  misc_feature (36): n=c or t
cccatccttgcttgattggtttccataaacaactcnattaaaaaaagaaaaaaaaaaaaaaaaaaagaggc

SEQ ID NO: 18422 - DNA, 71 bp, chicken (Gallus Gallus)
  misc_feature (36): n=a or g
gttctcgtgccatcagccgttttctttatggaaggnaaatctcctccacctctctcctgttccagattccc

SEQ ID NO: 18423 - DNA, 71 bp, chicken (Gallus Gallus)
  misc_feature (36): n=a or g
gaaaagaactatcaagccacagatctcattaactangaatcacagagaacatcaaccatgagtgctaatta

SEQ ID NO: 18424 - DNA, 71 bp, chicken (Gallus Gallus)
  misc_feature (36): n=a or c
aaagaaaaaccttgctctgaactctagcaaaaaaancccatatattaatattggcttcctcagtgctcaca

SEQ ID NO: 18425 - DNA, 71 bp, chicken (Gallus Gallus)
  misc_feature (36): n=c or g
atcctcagggggcacccggggtccctcacactgagntgttgtgctgcacctccttatgtcaccctgtgacc

SEQ ID NO: 18426 - DNA, 71 bp, chicken (Gallus Gallus)
  misc_feature (36): n=a or g
ttcctttgacgctttaggctgtgtgatttttaggcnatgatacactgcctgggcactattacagctgcact

SEQ ID NO: 18427 - DNA, 71 bp, chicken (Gallus Gallus)
  misc_feature (36): n=c or t
ttttagtcacagctctaacatttatttgataaagangttaattgaatgctgaggtctgagaagcctgtcct

SEQ ID NO: 18428 - DNA, 71 bp, chicken (Gallus Gallus)
  misc_feature (36): n=a or g
acacctacagacttctgggatcagctgacttacacnataggaatacctgttgtgctgcctggggatccata

SEQ ID NO: 18429 - DNA, 71 bp, chicken (Gallus Gallus)
  misc_feature (36): n=c or g
catggaaaaacattcctgagatgttacatctacagnaaccttagccagttgagctgaatgtaaacttctgc

SEQ ID NO: 18430 - DNA, 71 bp, chicken (Gallus Gallus)
  misc_feature (36): n=a or g
atacttttcaaatgttttctcatcctccaaacagtnctgctcttttcaattacgttttggttgattgcaga

SEQ ID NO: 18431 - DNA, 71 bp, chicken (Gallus Gallus)
  misc_feature (36): n=g or t
tgctcaaagctaaagaactacaatgccaaatgcagnatgatgaagctgaagagggctcctgaaacaaatca

SEQ ID NO: 18432 - DNA, 71 bp, chicken (Gallus Gallus)
  misc_feature (36): n=a or c
attttataggccagtagctcagaggatgaaaactgnttcccttcccagagaaatcatctcaagctatagtg

SEQ ID NO: 18433 - DNA, 71 bp, chicken (Gallus Gallus)
  misc_feature (36): n=c or g
ggacctcgtgtggagcaggggcagagcagcacaganaaagtgttatgaactgactgcataccctattccct

SEQ ID NO: 18434 - DNA, 71 bp, chicken (Gallus Gallus)
  misc_feature (36): n=c or t
cagcactctgatgaaacccatctgacttctacatangtctggtaccagatggtacatactgcatgcttgaa

SEQ ID NO: 18435 - DNA, 71 bp, chicken (Gallus Gallus)
  misc_feature (36): n=a or g
ggtataaccccactacagagttgtggtaaaaactgnacagtgacagtaggtattttggtaagtcttacatc

SEQ ID NO: 18436 - DNA, 71 bp, chicken (Gallus Gallus)
  misc_feature (36): n=a or g
aacctgactttaagaggcataactgtgcctgaaganaatgcttcagattgaaggaaggtttgtttctatgc

SEQ ID NO: 18437 - DNA, 71 bp, chicken (Gallus Gallus)
  misc_feature (36): n=a or g
atctgcaaaagtaaaagccctctaactatggcacantgctgtataaaataagaaatacaacatcttgcttg

SEQ ID NO: 18438 - DNA, 71 bp, chicken (Gallus Gallus)
  misc_feature (36): n=a or g
ggcactttcctcagagcaaaaaccaaatcatccacntggtggtcactgcttgaataatacaactcaagtga

SEQ ID NO: 18439 - DNA, 71 bp, chicken (Gallus Gallus)
  misc_feature (36): n=a or g
cagaggactttcaccgctgctttaaaggtcacctcngattcatgaatcactgcaggttagtgtgttgttaa

SEQ ID NO: 18440 - DNA, 71 bp, chicken (Gallus Gallus)
  misc_feature (36): n=c or t
ttagtgggtacatctgaacttacctattttctcagngaagagttagctcagatgctcagaaatgaactgtt

SEQ ID NO: 18441 - DNA, 71 bp, chicken (Gallus Gallus)
  misc_feature (36): n=c or t
gcagacagtgccaaaactcactttggtgccagtaanggctgcaaggccacctcctcggtctcggggacgct

SEQ ID NO: 18442 - DNA, 71 bp, chicken (Gallus Gallus)
  misc_feature (36): n=g or t
gctctctggtggcagtggtgtaatacaagggaatgncatggagctacattagggagggtcaggttagagga

SEQ ID NO: 18443 - DNA, 71 bp, chicken (Gallus Gallus)
  misc_feature (36): n=c or t
acatattttatgaaactgatgttaccatcataagcntcatacgctcctctaattaacacaaataaacaatt

SEQ ID NO: 18444 - DNA, 71 bp, chicken (Gallus Gallus)
  misc_feature (36): n=c or t
tataatatggctcaagacaacagccaccaagccagngatgctcagtgatgcactctgtaggtaagaggcaa

SEQ ID NO: 18445 - DNA, 71 bp, chicken (Gallus Gallus)
  misc_feature (36): n=a or g
catagcagctcctagtgggactcagtacttcttccnaatagagctagatatgggactgatataatcttttg

SEQ ID NO: 18446 - DNA, 71 bp, chicken (Gallus Gallus)
  misc_feature (36): n=a or g
ttggcctctgccagccatgcagagtagtgcctgaanaccacgacagcatttaatcccatttttctcatcct

SEQ ID NO: 18447 - DNA, 71 bp, chicken (Gallus Gallus)
  misc_feature (36): n=c or t
aagcaatttggatgatggacagggaggcgtgcaatngcactagctaaactttgagcggggtgctaactttg

SEQ ID NO: 18448 - DNA, 71 bp, chicken (Gallus Gallus)
  misc_feature (36): n=c or t
tgctcccactggagcagcagttgcgagaaacagaancattaccaatgcagacagcactgatggccctagaa

SEQ ID NO: 18449 - DNA, 71 bp, chicken (Gallus Gallus)
  misc_feature (36): n=a or t
atacatcttgtgtggttcttaaagaccaatgttaanacttaagaactacatacagaaaggtaagagaatga

SEQ ID NO: 18450 - DNA, 71 bp, chicken (Gallus Gallus)
  misc_feature (36): n=c or g
gaagtttttcagaactctaaacggctttttgttttnaattcatgaacgttactcaatttttgtatgaaatt

SEQ ID NO: 18451 - DNA, 71 bp, chicken (Gallus Gallus)
  misc_feature (36): n=c or t
tggtgggctgctcaaacaaagctctgaaagatcagnttcagggctcaggccttgtcttcttatgtctttga

SEQ ID NO: 18452 - DNA, 71 bp, chicken (Gallus Gallus)
  misc_feature (36): n=g or t
gaacatttcaactaatttcaaaaagtagaggtaacnacctgaagatgaccatatttctaagatctgtcaat

SEQ ID NO: 18453 - DNA, 71 bp, chicken (Gallus Gallus)
  misc_feature (36): n=c or t
atgcatcagtaataaaatacatgcttttatctcacngacgggcttttggtttgttgtcaaaagcacaaaac

SEQ ID NO: 18454 - DNA, 71 bp, chicken (Gallus Gallus)
  misc_feature (36): n=c or g
agtaaacatttttttacacagggaaaattcagttancttagacaaatgttagcaaaaccaaagctcccagt

SEQ ID NO: 18455 - DNA, 71 bp, chicken (Gallus Gallus)
  misc_feature (36): n=g or t
ctgttgttttttttcctcaaagcagtggcagttacngaacggttggagcaaacacgcaggggtagggctta

SEQ ID NO: 18456 - DNA, 71 bp, chicken (Gallus Gallus)
  misc_feature (36): n=a or t
cacttatagggataaataaagctgtgttttaattcnttactctattaaaaacaggatattttttcaaactc

SEQ ID NO: 18457 - DNA, 71 bp, chicken (Gallus Gallus)
  misc_feature (36): n=a or t
tgtgagaatctgaacgttggaatttggaagtttttnattgggtttgtttagcagattaccactgtgtaaga

SEQ ID NO: 18458 - DNA, 71 bp, chicken (Gallus Gallus)
  misc_feature (36): n=c or t
aaggcatcaattttaggttttaggttttagggaacntctggcaccttcaggaaagtgtagccagaggcaac

SEQ ID NO: 18459 - DNA, 71 bp, chicken (Gallus Gallus)
  misc_feature (36): n=c or t
aataagaatcaaatgaaaagtttaagtagggcgtgnacaactggtgaacacgtggactgttgaggaatgta

SEQ ID NO: 18460 - DNA, 71 bp, chicken (Gallus Gallus)
  misc_feature (36): n=c or t
aaatctgcctcatttgttaatttgtttcttttctcnttatgcctgacaaacacctcctaactaggttaaat

SEQ ID NO: 18461 - DNA, 71 bp, chicken (Gallus Gallus)
  misc_feature (36): n=c or t
aaaaaccttagcgatggagtagcatcagcaaagggntggtaattcaatgactgcttattcatataaatgac

SEQ ID NO: 18462 - DNA, 71 bp, chicken (Gallus Gallus)
  misc_feature (36): n=a or g
gtcctaaaatgccacaggcctccagccacaacaagntgccaaggagtggtgacacatagccaaggtgattt

SEQ ID NO: 18463 - DNA, 71 bp, chicken (Gallus Gallus)
  misc_feature (36): n=c or t
catggtggatacgtgtggctggaaactcaagggacngtcatttacaacacgcgcaacctacagcctcagtg

SEQ ID NO: 18464 - DNA, 71 bp, chicken (Gallus Gallus)
  misc_feature (36): n=c or t
cacactcaagctagttagatctttagttcctcttcnatcttcagaagatcagggaacactcagaactcaga

SEQ ID NO: 18465 - DNA, 71 bp, chicken (Gallus Gallus)
  misc_feature (36): n=a or t
ccaaatactgctgtgggagtctgtaccttgtctctnctccacagattgctgctttgattacctactaccta

SEQ ID NO: 18466 - DNA, 71 bp, chicken (Gallus Gallus)
  misc_feature (36): n=c or t
aatgctgaagtggatgtagtagtttccccagcacancttaaataaaactgtattgtcctactggcatgatt

SEQ ID NO: 18467 - DNA, 71 bp, chicken (Gallus Gallus)
  misc_feature (36): n=a or c
tgcctcttctaggtgggtggatcccatctctccctnacagattatattattcacagaaagttccattatta

SEQ ID NO: 18468 - DNA, 71 bp, chicken (Gallus Gallus)
  misc_feature (36): n=a or g
ctgggcatactggtctcaaaagaaaggtgatgcacntgtgcttcagagctgacccaaagtgatcaaaatca

SEQ ID NO: 18469 - DNA, 71 bp, chicken (Gallus Gallus)
  misc_feature (36): n=a or t
tctaaatgagcttgtattgcagttgtgcaaagccanttgaacagactctcaaacacagaccatgagagtgc

SEQ ID NO: 18470 - DNA, 71 bp, chicken (Gallus Gallus)
  misc_feature (36): n=a or g
actgataggggtgttgcatctccagaagaggtcacncagggcttttggtgcagcgatttctgcctgttgtt

SEQ ID NO: 18471 - DNA, 71 bp, chicken (Gallus Gallus)
  misc_feature (36): n=a or c
tcttcaaaacacagaggtgtgagaatttaccctctnaattaaatttgaccatgacagactctcctcaaaac

SEQ ID NO: 18472 - DNA, 71 bp, chicken (Gallus Gallus)
  misc_feature (36): n=c or t
gcaagaaaaaggccataaaaagaagctgaaacaagntgcaaagtataatgctttttaaatctataatgcag

SEQ ID NO: 18473 - DNA, 71 bp, chicken (Gallus Gallus)
  misc_feature (36): n=c or t
agttgacagtgggggggaagctaatttagggtgganagaagtgtaacaaacggagaaaggaggttcaattt

SEQ ID NO: 18474 - DNA, 71 bp, chicken (Gallus Gallus)
  misc_feature (36): n=a or g
tggagttcccactggtttaagtctggttgcatgacntgcatttgagcatcgtgtctgtggacttccaaatg

SEQ ID NO: 18475 - DNA, 71 bp, chicken (Gallus Gallus)
  misc_feature (36): n=g or t
ggatcatgacattctaggtataccacccacaaatgngagtctgaaatatgatctaatacatctctttatgc

SEQ ID NO: 18476 - DNA, 71 bp, chicken (Gallus Gallus)
  misc_feature (36): n=g or t
ccgatcctaaattcaagaaacacagaattagagatntatgtaaaaatgtattggatgcagcatcaaagcat

SEQ ID NO: 18477 - DNA, 71 bp, chicken (Gallus Gallus)
  misc_feature (36): n=a or t
tagcagtatttaagatgtgctcatcttcagaggaanatagccatatccataaacatttgttcctgctttta

SEQ ID NO: 18478 - DNA, 71 bp, chicken (Gallus Gallus)
  misc_feature (36): n=c or t
cttcaggtcctggatcttgggggtcaggtccacgcnatcacactggagacaaacaaagaggcacttaggtt

SEQ ID NO: 18479 - DNA, 71 bp, chicken (Gallus Gallus)
  misc_feature (36): n=c or g
tgttcttgagactttctggtatgaccctgtacccanaaagttaggaatactaacctttgggccctgtagat

SEQ ID NO: 18480 - DNA, 71 bp, chicken (Gallus Gallus)
  misc_feature (36): n=a or g
gataaacatgtgtttttgatatattgtctatctgantagtgaggttcataactggttcctcacttgatttg

SEQ ID NO: 18481 - DNA, 71 bp, chicken (Gallus Gallus)
  misc_feature (36): n=a or g
atatttcatttagcatttggaactatgtgttagtanaaaggaagttcggaacaacaaacatgcactcttat

SEQ ID NO: 18482 - DNA, 71 bp, chicken (Gallus Gallus)
  misc_feature (36): n=a or g
gttttcataatgaagaaataggtggtattagtccanagagggacctaaatatagtagctcttgaaataata

SEQ ID NO: 18483 - DNA, 71 bp, chicken (Gallus Gallus)
  misc_feature (36): n=a or g
ttgcctaggggtctactactcggtcacagaaccagngcacagtctccactacgctcaacaccctgtactat

SEQ ID NO: 18484 - DNA, 71 bp, chicken (Gallus Gallus)
  misc_feature (36): n=g or t
tcaggtgtggctggatatggaaaggggtttgcaaancactttgctttatatctgtttatttcttaaattca

SEQ ID NO: 18485 - DNA, 71 bp, chicken (Gallus Gallus)
  misc_feature (36): n=a or g
accacatggcacaatggctttgatcatgggagtgcnatgccaaccagtctcgtggccagagaaagtggagt

SEQ ID NO: 18486 - DNA, 71 bp, chicken (Gallus Gallus)
  misc_feature (36): n=c or t
tgtatgtttttacaggaccaactaccaccctgttgnacaggtaacataggcaacttataggaaaacaaaac

SEQ ID NO: 18487 - DNA, 71 bp, chicken (Gallus Gallus)
  misc_feature (36): n=c or t
tactgtgttgtccaagttttcacagcctgtctgcangctgagccctgtgctggctcccaaggctggtggca

SEQ ID NO: 18488 - DNA, 71 bp, chicken (Gallus Gallus)
  misc_feature (36): n=a or g
cataatccaaatagtagccaaacaactgaacacagncctaccggacaaatccttagtaaaagcaaatgtga

SEQ ID NO: 18489 - DNA, 71 bp, chicken (Gallus Gallus)
  misc_feature (36): n=a or g
gcttccccagatagtttttttgcttgtctgatcatntggttaatatttaattctcgatcaaaagaatagac

SEQ ID NO: 18490 - DNA, 71 bp, chicken (Gallus Gallus)
  misc_feature (36): n=a or g
gcttcgaaacagagtgaagaaaacttcacaatcccntggactactgtatctggcctcttctcctgtctgtt

SEQ ID NO: 18491 - DNA, 71 bp, chicken (Gallus Gallus)
  misc_feature (36): n=c or t
tgtagaacgttcccagttaatttagttatcatagtnactgtgggggattccgttttggccaagagcagaca

SEQ ID NO: 18492 - DNA, 71 bp, chicken (Gallus Gallus)
  misc_feature (36): n=a or g
gaaaaggaataggcaatgaaaaaatttgtaccctgnggaaccagttaagtaatcatttatttttaaatact

SEQ ID NO: 18493 - DNA, 71 bp, chicken (Gallus Gallus)
  misc_feature (36): n=c or t
cacccaggagctattgctgtgctctcctgcaggctnctggctgcagatggtgtttaggagcaattggcttc

SEQ ID NO: 18494 - DNA, 71 bp, chicken (Gallus Gallus)
  misc_feature (36): n=a or t
cacgttccttcagcctaaaagtagatgtgtgaagtngtttttcttcctctacttttgtatttatctcctgc

SEQ ID NO: 18495 - DNA, 71 bp, chicken (Gallus Gallus)
  misc_feature (36): n=c or t
ggcagaagcaggagctggaatgagacctacgaaccngagggcaagaaaatgcagaatatgttgacttcctg

SEQ ID NO: 18496 - DNA, 71 bp, chicken (Gallus Gallus)
  misc_feature (36): n=c or t
taataaagtgtgtaattatttctcattttttattgnggagatttaatattgaatagttgcctcaggtctac

SEQ ID NO: 18497 - DNA, 71 bp, chicken (Gallus Gallus)
  misc_feature (36): n=a or g
taacaacagaaactttgctacctgatctgaaaaccnctcctttcatagatgtgaatcagaaataaggttat

SEQ ID NO: 18498 - DNA, 71 bp, chicken (Gallus Gallus)
  misc_feature (36): n=c or g
aatacgtatgcacatgcagaagacaatcacatacanttgtacatatatatactcacacagacagataatga

SEQ ID NO: 18499 - DNA, 71 bp, chicken (Gallus Gallus)
  misc_feature (36): n=a or g
gtaaataaggaacgtgtgtttaagaggaggctgagnaaaggaataggcaatagaacctaataggtatttca

SEQ ID NO: 18500 - DNA, 71 bp, chicken (Gallus Gallus)
  misc_feature (36): n=a or g
taaatctgaaagccagtgcttagtatgtcgaatcanttaaaaagcaaaccaagatatactgttaatagagc

SEQ ID NO: 18501 - DNA, 71 bp, chicken (Gallus Gallus)
  misc_feature (36): n=a or g
tttacacctcattttcacaacagagaatatttacancattacctcctgagtaggacaatcccagtttcatt

SEQ ID NO: 18502 - DNA, 71 bp, chicken (Gallus Gallus)
  misc_feature (36): n=c or t
ccggtttagttgggctattgcttactaatgtaccanggtttactttctacttcaatataaaaaaattatga

SEQ ID NO: 18503 - DNA, 71 bp, chicken (Gallus Gallus)
  misc_feature (36): n=c or t
aactgaggctttgacatggcctaagttgtagtgtcnttctttttccccctattctttgcaagaaacaagta

SEQ ID NO: 18504 - DNA, 71 bp, chicken (Gallus Gallus)
  misc_feature (36): n=a or t
tgggtgtgcagtgatctgccattactgcatgcatanagagtctggaataaagaacataattcttaaagtat

SEQ ID NO: 18505 - DNA, 71 bp, chicken (Gallus Gallus)
  misc_feature (36): n=c or t
tgtctttagtttaacattactcttccttgtcttgtngctatcagagtaaaatgttggtctccatctttgca

SEQ ID NO: 18506 - DNA, 71 bp, chicken (Gallus Gallus)
  misc_feature (36): n=c or t
tttgcacaccatttgctttttctaaaagaactcaangcacggtgttagggctgtgcagtgagacctgacgc

SEQ ID NO: 18507 - DNA, 71 bp, chicken (Gallus Gallus)
  misc_feature (36): n=a or g
gaatgctgaaatattctcatcaatgcagtatttctntaaattctcctgttgtcttcttatgtgtgcatttt

SEQ ID NO: 18508 - DNA, 71 bp, chicken (Gallus Gallus)
  misc_feature (36): n=a or g
gaggagggaaggagacacgcgaactgcattgtcacntcatatatctttgggaacatagcttctgtagtcaa

SEQ ID NO: 18509 - DNA, 71 bp, chicken (Gallus Gallus)
  misc_feature (36): n=a or g
ttcctaatagtgactgaacaaaaaccatgtttcaancatgctgactggttcgcagagctatgggatagctc

SEQ ID NO: 18510 - DNA, 71 bp, chicken (Gallus Gallus)
  misc_feature (36): n=c or t
ctggaggtcgctggtcatctccacctgcacccgggnaagtgttttggatgggaaaaagcagagcaagccct

SEQ ID NO: 18511 - DNA, 71 bp, chicken (Gallus Gallus)
  misc_feature (36): n=a or t
accagttttctgcccgcaataatttgtcccaaagcncttctcagcaacccagatcttctatccgttctgca

SEQ ID NO: 18512 - DNA, 71 bp, chicken (Gallus Gallus)
  misc_feature (36): n=c or t
tggtgaagagctttcccatgtagttttacaaattgntttgctgtattcaagctttatttgtatctctttac

SEQ ID NO: 18513 - DNA, 71 bp, chicken (Gallus Gallus)
  misc_feature (36): n=a or t
gattggcttttttggataggtaataatgtcactgantttttttcttgcttcactgtggacattaaaagaaa

SEQ ID NO: 18514 - DNA, 71 bp, chicken (Gallus Gallus)
  misc_feature (36): n=a or t
acaaaacagagttaatttataaaattaattatcgcntttctttatgtaaccctaaaaacaccataattgaa

SEQ ID NO: 18515 - DNA, 71 bp, chicken (Gallus Gallus)
  misc_feature (36): n=c or t
aatttccaatttccactgtgtaacactccatgcatngttttgggcattccttcacctatcaggtatcattt

SEQ ID NO: 18516 - DNA, 71 bp, chicken (Gallus Gallus)
  misc_feature (36): n=g or t
acaacaatgactgtctgcattccttccctttacaangcagcgattgataaaatgcagcattcaatgcatac

SEQ ID NO: 18517 - DNA, 71 bp, chicken (Gallus Gallus)
  misc_feature (36): n=a or g
ctgtgcacacatggtgttaaaagtaccacgttttcntttcatccttccaaccaatattgcctgccacaacc

SEQ ID NO: 18518 - DNA, 71 bp, chicken (Gallus Gallus)
  misc_feature (36): n=a or g
aaactgtggtgatctttctcttctaaatacatattnttctgttcctggaaaaaaaattttcatcttacatt

SEQ ID NO: 18519 - DNA, 71 bp, chicken (Gallus Gallus)
  misc_feature (36): n=a or c
tgtgcctgtggcagtagattaccaaacgatagcggnctttcagcattttggacataacttttatcaaacac

SEQ ID NO: 18520 - DNA, 71 bp, chicken (Gallus Gallus)
  misc_feature (36): n=g or t
caggactagtcctatccctctgtggatttactattntcatcataatcacattgtaccatgactgtatcagt

SEQ ID NO: 18521 - DNA, 71 bp, chicken (Gallus Gallus)
  misc_feature (36): n=a or g
ccacagcatagaagctccacactgtggtaaacttgnaacttctcatcaagccccaccactcctgcaatggt

SEQ ID NO: 18522 - DNA, 71 bp, chicken (Gallus Gallus)
  misc_feature (36): n=c or t
tgtcctcctttgaatgctctctgatagtttcctatncttagtttgcactgcccagaattacatctagtact

SEQ ID NO: 18523 - DNA, 71 bp, chicken (Gallus Gallus)
  misc_feature (36): n=a or g
atgagttgttttaacttagattgatcttaaaatatntatgaaatttgtttttaaaatctgaactagtatac

SEQ ID NO: 18524 - DNA, 71 bp, chicken (Gallus Gallus)
  misc_feature (36): n=c or t
agctgtgagccctgtcacaagttcaatgattataantgaaacattttcttcattattctagaaacattctg

SEQ ID NO: 18525 - DNA, 71 bp, chicken (Gallus Gallus)
  misc_feature (36): n=c or t
ccctaattactaactagtctcctctctttccagcancatcagtgatttttgcatcctcttttttactttct

SEQ ID NO: 18526 - DNA, 71 bp, chicken (Gallus Gallus)
  misc_feature (36): n=a or g
ctagaaactctaaatataggttgctagatagatggnaaatgaatcaaatctgattagaaataataagcaaa

SEQ ID NO: 18527 - DNA, 71 bp, chicken (Gallus Gallus)
  misc_feature (36): n=a or c
agcagttcaggtatgtgctggaatctggagagtttnctgccagggagaggaggataatgcagcgtggtggt

SEQ ID NO: 18528 - DNA, 71 bp, chicken (Gallus Gallus)
  misc_feature (36): n=a or g
aaggatttgcaattagaatacaaaaggagtagttgngagcttccttttctgagattaaaagatcaggtttc

SEQ ID NO: 18529 - DNA, 71 bp, chicken (Gallus Gallus)
  misc_feature (36): n=a or g
agaaatgcttttttctgcatgatggcaacggcagcnctgattttgtttgttcaggaagtagtttgcaattt

SEQ ID NO: 18530 - DNA, 71 bp, chicken (Gallus Gallus)
  misc_feature (36): n=c or t
gtgtttggtgctgtaaagacgagtaatcagaaccanagaatggtttgtgttggaaaggaactataagatca

SEQ ID NO: 18531 - DNA, 71 bp, chicken (Gallus Gallus)
  misc_feature (36): n=a or g
tatttttgccttcatactgaataagtcaagtaggtntggataaatacatgacctgcttgcaagtttcttct

SEQ ID NO: 18532 - DNA, 71 bp, chicken (Gallus Gallus)
  misc_feature (36): n=c or t
gtgcagttactcatttcactcatgtccctgcctccnacagttatcagttctcattcctcatccttcagcag

SEQ ID NO: 18533 - DNA, 71 bp, chicken (Gallus Gallus)
  misc_feature (36): n=a or g
tctatgattctattgtagtataatactgtgattctncgattttacagttccataatttaggctctttttga

SEQ ID NO: 18534 - DNA, 71 bp, chicken (Gallus Gallus)
  misc_feature (36): n=c or t
tgggtgctacctggagagatggcaaatgggaaagtngacaagaaaacgcttggctggaggagggctcccga

SEQ ID NO: 18535 - DNA, 71 bp, chicken (Gallus Gallus)
  misc_feature (36): n=a or c
tccaaagtaattttccattcaccaggtactttgtcntgaagtagtgttgagtgccacagaactgctcaccc

SEQ ID NO: 18536 - DNA, 71 bp, chicken (Gallus Gallus)
  misc_feature (36): n=c or t
tcctgctctgagcaaaactttttcctggtctaacangtccttttccacagcactgtcatttccaagagcag

SEQ ID NO: 18537 - DNA, 71 bp, chicken (Gallus Gallus)
  misc_feature (36): n=a or g
gctgggggtctcaacagaaggaaagtatcttcagangcatcctctgggtcactcccgtgtccaaaggggat

SEQ ID NO: 18538 - DNA, 71 bp, chicken (Gallus Gallus)
  misc_feature (36): n=c or t
ccgtaataaagaaaattacagtgatcagtgtccttnctcaaccaaacttctcccttctgtgatgttagaaa

SEQ ID NO: 18539 - DNA, 71 bp, chicken (Gallus Gallus)
  misc_feature (36): n=g or t
gtgtaggtatgtatatgcattgctggttgggggttntagctcttctgttcagaaggtttggctattcacac

SEQ ID NO: 18540 - DNA, 71 bp, chicken (Gallus Gallus)
  misc_feature (36): n=a or g
ctgcactgccaccttaaagcagtttttgagctaatncatcctgcccctctgtacatctaatggcacttctt

SEQ ID NO: 18541 - DNA, 71 bp, chicken (Gallus Gallus)
  misc_feature (36): n=c or t
tggtctaccattcatgcagcactccaagatttttcncaagaaaaaagctcaagaccatagtttagaattag

SEQ ID NO: 18542 - DNA, 71 bp, chicken (Gallus Gallus)
  misc_feature (36): n=g or t
ataagaaaataaaaaacagtgaatactcaagtaacncaacaacatcctgtaataagatattttaaacacca

SEQ ID NO: 18543 - DNA, 71 bp, chicken (Gallus Gallus)
  misc_feature (36): n=a or c
cacatacagagttctctatgagctcggtcatttctntattgcctttagtatgcagacttatcttctccaca

SEQ ID NO: 18544 - DNA, 71 bp, chicken (Gallus Gallus)
  misc_feature (36): n=a or t
taaagagtgggatgcagaagcattctccagctccantgaaagcttggctgtgtgtacataggagcagctct

SEQ ID NO: 18545 - DNA, 71 bp, chicken (Gallus Gallus)
  misc_feature (36): n=c or t
aattcttcggtggataattatgactagcaaggacantgaaacaaaatctggattattgcagaagaggctgg

SEQ ID NO: 18546 - DNA, 71 bp, chicken (Gallus Gallus)
  misc_feature (36): n=a or g
gttgctaacaggactgatgcctgcttcatcagggtnattggctctgagctggtgcagaagtatgtgggaga

SEQ ID NO: 18547 - DNA, 71 bp, chicken (Gallus Gallus)
  misc_feature (36): n=a or g
aaatgtaatgactaatattctgaattacaatgtagntaatgcccaggtaacgctgacagtctttttttata

SEQ ID NO: 18548 - DNA, 71 bp, chicken (Gallus Gallus)
  misc_feature (36): n=c or t
ttcagctcttccaaatcaatccaggaatgaacactnctggatttttaactaaatcataatttactgttctc

SEQ ID NO: 18549 - DNA, 71 bp, chicken (Gallus Gallus)
  misc_feature (36): n=c or t
ttgaatggcagaccttcgaggaacgcaaacagtagnagcgctctgtttgctttacagaggtgttaaataaa

SEQ ID NO: 18550 - DNA, 71 bp, chicken (Gallus Gallus)
  misc_feature (36): n=c or t
taaatcttggggctaatccactataataaatacttnactacactaaggggattctttattcttatcaagat

SEQ ID NO: 18551 - DNA, 71 bp, chicken (Gallus Gallus)
  misc_feature (36): n=a or c
ccacttcttggcaaaaccactccatacactttcccnaaaagcttcatttcccctgcagccctttttcaagc

SEQ ID NO: 18552 - DNA, 71 bp, chicken (Gallus Gallus)
  misc_feature (36): n=c or g
ctttttttcctaattttacttacctgtaaaattagncaagtgacagcaaatgaagccagaagtatgttttc

SEQ ID NO: 18553 - DNA, 71 bp, chicken (Gallus Gallus)
  misc_feature (36): n=a or t
ttttttttttctctcttttttggaggggggagtggnttagccaaatatttctgacattgttttgtaaattc

SEQ ID NO: 18554 - DNA, 71 bp, chicken (Gallus Gallus)
  misc_feature (36): n=a or g
tattacattgaggagtaacgtctgtcctattttggnggtgactcacaaaataacgtttttcttccaatttc

SEQ ID NO: 18555 - DNA, 71 bp, chicken (Gallus Gallus)
  misc_feature (36): n=c or t
tccccttaatgagcattagttctcccttcaagatantcaattttttcttcctccttctatctgaaggcttt

SEQ ID NO: 18556 - DNA, 71 bp, chicken (Gallus Gallus)
  misc_feature (36): n=c or t
ttataggaatgcaccacatgaaattctctataaaangtttatcagtcagactgcactcccctcgtcctaga

SEQ ID NO: 18557 - DNA, 71 bp, chicken (Gallus Gallus)
  misc_feature (36): n=c or t
ctctattccaccttgcccactcctaactttctcccncattctttattctccattcctcctttccctcttca

SEQ ID NO: 18558 - DNA, 71 bp, chicken (Gallus Gallus)
  misc_feature (36): n=c or t
tgcctcatggcaaaaaggcagtgtagttccctcctnctcctttgctgtgatattgcttccttccttaaaga

SEQ ID NO: 18559 - DNA, 71 bp, chicken (Gallus Gallus)
  misc_feature (36): n=c or t
ataacctcacagtttaaaataaacaattctaatctngcctaatctaagctaaaatcttttagtcatactac

SEQ ID NO: 18560 - DNA, 71 bp, chicken (Gallus Gallus)
  misc_feature (36): n=a or g
taagaatgctaataccaggacaaaccgttttcaggntacctcctgcagtctcacaaaccacaaaagctgag

SEQ ID NO: 18561 - DNA, 71 bp, chicken (Gallus Gallus)
  misc_feature (36): n=c or t
gagagaggatatgtttactttcctcctgtatcacanaaaggcacctcacaaggttaaggaggttgagttgt

SEQ ID NO: 18562 - DNA, 71 bp, chicken (Gallus Gallus)
  misc_feature (36): n=a or g
agtccatctgcgtgctacttgtcccacacttacatntgtgctgcatttgcacgtcatttaaaaaagtaata

SEQ ID NO: 18563 - DNA, 71 bp, chicken (Gallus Gallus)
  misc_feature (36): n=c or t
tgagtagtttatgaacctgaggacaacaacattgangtatacacaaaataaatcaaactcattagttaatt

SEQ ID NO: 18564 - DNA, 71 bp, chicken (Gallus Gallus)
  misc_feature (36): n=a or t
gtcaaagaaggtttaaagtctgagcaattttgtgcngtgatagcaaaatgcaagataatgggtaaccaaag

SEQ ID NO: 18565 - DNA, 71 bp, chicken (Gallus Gallus)
  misc_feature (36): n=c or t
gtgtgtgtcagacccagagacgcctccaaaagcagncactgaactgggatttctaacagcaccctagagga

SEQ ID NO: 18566 - DNA, 71 bp, chicken (Gallus Gallus)
  misc_feature (36): n=a or c
tacagaaaacgtctgttatttcattattctttaatnatcttaaattccaaaagaatagatggtcctaagga

SEQ ID NO: 18567 - DNA, 71 bp, chicken (Gallus Gallus)
  misc_feature (36): n=a or t
ggacaatgttttaagtgctaattctgtggcattatngtctgtttctcacaccaactttgcagaatatttgg

SEQ ID NO: 18568 - DNA, 71 bp, chicken (Gallus Gallus)
  misc_feature (36): n=a or g
gatgtattactgccaaagtaaggctctttaatagtnaggtgacacaacaagagatcaagagcccttctggc

SEQ ID NO: 18569 - DNA, 71 bp, chicken (Gallus Gallus)
  misc_feature (36): n=c or t
ccgctgctcttggaccaggttatctcacacccatcncaagcacaaactggaaggcagaggaaaaagtctac

SEQ ID NO: 18570 - DNA, 71 bp, chicken (Gallus Gallus)
  misc_feature (36): n=c or g
tcaactattggttattagtgttggccttggtcttantaaaaaactcaacgcatagttaatgataaacttta

SEQ ID NO: 18571 - DNA, 71 bp, chicken (Gallus Gallus)
  misc_feature (36): n=c or t
gtcctctaagctggcgttgcttacctcatgtaggangtaggcgacagagactttggtttggcccactggta

SEQ ID NO: 18572 - DNA, 71 bp, chicken (Gallus Gallus)
  misc_feature (36): n=a or c
gcaacatcatagtgcagaggctaggatgttcttacntgggtaagaaattaatccagaaggcttgagcaata

SEQ ID NO: 18573 - DNA, 71 bp, chicken (Gallus Gallus)
  misc_feature (36): n=c or g
taagaaatcaaatcttaagttaaatttgaaggaggntgggattctattaattcctggcacagtcaggcaaa

SEQ ID NO: 18574 - DNA, 71 bp, chicken (Gallus Gallus)
  misc_feature (36): n=a or g
ctggggcgagtgggtcaccctaaaaagcataggtgnaggatgaccagaggtgacagtgggtgaccataaat

SEQ ID NO: 18575 - DNA, 71 bp, chicken (Gallus Gallus)
  misc_feature (36): n=c or t
ataacctgtgagtgtttaaatacatttacatccttnagaaaagcatgaggtaccagttgagttcacaaagt

SEQ ID NO: 18576 - DNA, 71 bp, chicken (Gallus Gallus)
  misc_feature (36): n=c or t
acaaattaaggtccctatgaagaagtttagacagantggggtaaccaacttcaggagacatttaagttggt

SEQ ID NO: 18577 - DNA, 71 bp, chicken (Gallus Gallus)
  misc_feature (36): n=a or g
gattgctgagggttttacaattttcttgtttggctnttgttttttttttttcccttcaaaaagcttctcaa

SEQ ID NO: 18578 - DNA, 71 bp, chicken (Gallus Gallus)
  misc_feature (36): n=c or t
gacaccacaaccaactatgcatgtgtttaaagtacnggtgaataggctctgaaatgtctcctcccacagct

SEQ ID NO: 18579 - DNA, 71 bp, chicken (Gallus Gallus)
  misc_feature (36): n=a or g
cactctgattaaaaaaaattgcccatggtgaagccntgctggctatcttgaatcaccttatctcgcatgta

SEQ ID NO: 18580 - DNA, 71 bp, chicken (Gallus Gallus)
  misc_feature (36): n=g or t
tggataaaagccattcatgtgatattataggagacnaatcatgtcatttttgctccatcctgtgtcctggg

SEQ ID NO: 18581 - DNA, 71 bp, chicken (Gallus Gallus)
  misc_feature (36): n=c or g
tgagagaccattcatctgttgctcataactggcttntgaaccatcagagttgaccccgaagggtggacaaa

SEQ ID NO: 18582 - DNA, 71 bp, chicken (Gallus Gallus)
  misc_feature (36): n=c or t
ccaaaaggttcatgttcaaccactagatcctcctcngctttgtattttactattttgtttaacagactctc

SEQ ID NO: 18583 - DNA, 71 bp, chicken (Gallus Gallus)
  misc_feature (36): n=a or g
gtaaggatttaaaatatatatgctcaattacaactncattcataaaaattttaaatatagagttctgctct

SEQ ID NO: 18584 - DNA, 71 bp, chicken (Gallus Gallus)
  misc_feature (36): n=a or g
actcaaattcagactatgaaagaatttcattgatcncactgccaaaatatagtactactaggctaacatta

SEQ ID NO: 18585 - DNA, 71 bp, chicken (Gallus Gallus)
  misc_feature (36): n=a or g
tgaggagaggagcataggagatgcaggacttctagnctgaattaagtgtggcatattgagacaaaatgggt

SEQ ID NO: 18586 - DNA, 71 bp, chicken (Gallus Gallus)
  misc_feature (36): n=a or g
gtttctatgtcagtatgtggagtgttcttcacaacncttaaatgtttagttgtagtactgagggacatggt

SEQ ID NO: 18587 - DNA, 71 bp, chicken (Gallus Gallus)
  misc_feature (36): n=a or g
atttgcagaggtagaggtccaattgacagaatttanggccagatgaagagatctgctacagatctgggtat

SEQ ID NO: 18588 - DNA, 71 bp, chicken (Gallus Gallus)
  misc_feature (36): n=a or c
gctttggaaaaaaatattgaagatttctgatgtagnaaaatccatgttattaatgtgaccttgcagaaatt

SEQ ID NO: 18589 - DNA, 71 bp, chicken (Gallus Gallus)
  misc_feature (36): n=a or g
tcttttcatgctacttccagtgctgtcagagtatancgagagtgcaaggaatgagaaaccagttaactcca

SEQ ID NO: 18590 - DNA, 71 bp, chicken (Gallus Gallus)
  misc_feature (36): n=a or t
caacctctttaccacggaaaaaaaaaaaaaatagcntaggatttagttaaaaaaacaaactgtaggcaagg

SEQ ID NO: 18591 - DNA, 71 bp, chicken (Gallus Gallus)
  misc_feature (36): n=a or t
gtgagctggtcatctgatgctttgatgctttactgntaactgagaagcacaggtacccttactatatgatt

SEQ ID NO: 18592 - DNA, 71 bp, chicken (Gallus Gallus)
  misc_feature (36): n=a or g
gcaatttaatgagaatttttattaaaaggagggggnaaaagaatgtatatatatgtatagtagcacttatt

SEQ ID NO: 18593 - DNA, 71 bp, chicken (Gallus Gallus)
  misc_feature (36): n=a or g
atcagatttcactgaatggtgataaagcacttgctntggaaggagtgtaaccggtctgcaaccaatgtgga

SEQ ID NO: 18594 - DNA, 71 bp, chicken (Gallus Gallus)
  misc_feature (36): n=a or g
aaaatagactctaatgaatattatacatcagaattnaggtttttggcatgggaagaggaagaccttgactg

SEQ ID NO: 18595 - DNA, 71 bp, chicken (Gallus Gallus)
  misc_feature (36): n=a or g
gctacttgagatgacattatcatgctactattccanctgtccagcaactccactgaaaaatcaggacaggc

SEQ ID NO: 18596 - DNA, 71 bp, chicken (Gallus Gallus)
  misc_feature (36): n=c or t
gtggttctaaggaaagtgaatgagaattgggcacanaggatttaaaattttaaaagttccacactcctttt

SEQ ID NO: 18597 - DNA, 71 bp, chicken (Gallus Gallus)
  misc_feature (36): n=c or t
actggatacccatcacttcttctggatgccagctcngaatgagacttccaggtctccactagcgtgctgac

SEQ ID NO: 18598 - DNA, 71 bp, chicken (Gallus Gallus)
  misc_feature (36): n=a or t
cggtataattttactcttaagttttgcacaagctgncttatgtactgagaattcctttattttgtcccatc

SEQ ID NO: 18599 - DNA, 71 bp, chicken (Gallus Gallus)
  misc_feature (36): n=c or t
tccatgtgggatctcacagtttgttgatagttctcnagccttattttaagtgcaggttttaatcatgtaga

SEQ ID NO: 18600 - DNA, 71 bp, chicken (Gallus Gallus)
  misc_feature (36): n=c or t
ctcttgccaaaccaaacaaggaataataaactatanatatatatatatatatacatatatatataatataa

SEQ ID NO: 18601 - DNA, 71 bp, chicken (Gallus Gallus)
  misc_feature (36): n=c or t
ggatcttaaattaaacataccttccctataggtcangaaattggcagaatcagacaaaaatatttggctaa

SEQ ID NO: 18602 - DNA, 71 bp, chicken (Gallus Gallus)
  misc_feature (36): n=c or t
tactgctctggatcagaccaatattaatgtcccagnatactctggaatagcaactgacaatgctgttgaac

SEQ ID NO: 18603 - DNA, 71 bp, chicken (Gallus Gallus)
  misc_feature (36): n=g or t
aaaatacagcattctatagcttgctattatcaacanaggggcaggctccaaggttgttactcaggccttat

SEQ ID NO: 18604 - DNA, 71 bp, chicken (Gallus Gallus)
  misc_feature (36): n=c or t
ctatagaacaagttttgtcctgtcaaagtactgaanactttttcaacacaattccatgctatatttaatac

SEQ ID NO: 18605 - DNA, 71 bp, chicken (Gallus Gallus)
  misc_feature (36): n=g or t
aaatgcaaacaaaactagtttaatgtcagggaaaanaattgatgggatattttcatttattagtaggagtt

SEQ ID NO: 18606 - DNA, 71 bp, chicken (Gallus Gallus)
  misc_feature (36): n=c or t
ttgatgctcttagcggtcttttacaaccttaatgantctatgatttgcctggagtgagaaaggccaggggc

SEQ ID NO: 18607 - DNA, 71 bp, chicken (Gallus Gallus)
  misc_feature (36): n=a or t
actatgggaggatacatatagatgacacactctgcntataagaccataatcacagaattccgcccacagac

SEQ ID NO: 18608 - DNA, 71 bp, chicken (Gallus Gallus)
  misc_feature (36): n=a or g
tctagtaggtaggttggaaaaattagtttcataacnatgacttaattcaacatgtgcctgaggcaacagca

SEQ ID NO: 18609 - DNA, 71 bp, chicken (Gallus Gallus)
  misc_feature (36): n=c or t
tgtagcatcaccttatctgactccaatatcacctgncttacctgcccaagcagcaatgtgtttctccacct

SEQ ID NO: 18610 - DNA, 71 bp, chicken (Gallus Gallus)
  misc_feature (36): n=a or c
tctgttacaccgtattgctgtgtgagggatggcagnagaggggcactctgagaaaaccgcgtcagcaggtg

SEQ ID NO: 18611 - DNA, 71 bp, chicken (Gallus Gallus)
  misc_feature (36): n=c or t
acctgtatcttagggagtttaagatattacactgtntcactttctgattcttgctatgagtaacaaaatct

SEQ ID NO: 18612 - DNA, 71 bp, chicken (Gallus Gallus)
  misc_feature (36): n=a or g
cataattgtgctacatgtaatgcatatgcacaggtnacaaaaaggaaagcccagatcaggggagatttcgg

SEQ ID NO: 18613 - DNA, 71 bp, chicken (Gallus Gallus)
  misc_feature (36): n=a or g
ggaacacctgcagcagagcctgccctacttgtggangacaatcggccctcattacctggtgaaggtctgct

SEQ ID NO: 18614 - DNA, 71 bp, chicken (Gallus Gallus)
  misc_feature (36): n=a or g
aaatgttgctattttctgcaaaaaaagtaaatccanaacttgatacaatccggcttctactctacaaaatc

SEQ ID NO: 18615 - DNA, 71 bp, chicken (Gallus Gallus)
  misc_feature (36): n=a or g
ctctgagggtggcttattggcatagtaactaggtgnacaaggtagggatgcccatcattttgctagagctt

SEQ ID NO: 18616 - DNA, 71 bp, chicken (Gallus Gallus)
  misc_feature (36): n=a or g
tgtcttggaagtaagtggtcattaatgcttaatttngatgaatttttgcctgtgctcccttagcttcctgc

SEQ ID NO: 18617 - DNA, 71 bp, chicken (Gallus Gallus)
  misc_feature (36): n=c or t
cagaaaccaaatggtgatgtacagagagaaggaatngatttcatcagacttccacaatggattctatgtga

SEQ ID NO: 18618 - DNA, 71 bp, chicken (Gallus Gallus)
  misc_feature (36): n=c or g
ggatggagatcaccagctcacaacacatcactgggntgttagaggatgtaggctggatactaccagaaaga

SEQ ID NO: 18619 - DNA, 71 bp, chicken (Gallus Gallus)
  misc_feature (36): n=a or t
atgccattgtagggtttttgcaaccagtggaaaatnaaacgggtcaaaataggtcaaacctcagtgtgagg

SEQ ID NO: 18620 - DNA, 71 bp, chicken (Gallus Gallus)
  misc_feature (36): n=a or g
tgtaaggggcagaccctacctcttgttcagcaacanagagagcaatatcagcaagagaagacgtctatggg

SEQ ID NO: 18621 - DNA, 71 bp, chicken (Gallus Gallus)
  misc_feature (36): n=a or g
ttgtgtgctcctctggaaggcattttaatcactccntgcatttgtgccccactagcaggatgtgtaagaag

SEQ ID NO: 18622 - DNA, 71 bp, chicken (Gallus Gallus)
  misc_feature (36): n=c or t
ttgatattttgtcatagataaagcatggtactctgncccttacagaattagagaatggttcatgtaggaag

SEQ ID NO: 18623 - DNA, 71 bp, chicken (Gallus Gallus)
  misc_feature (36): n=a or g
agtagcacaagatgcacaacttttagtgttgaagantatggtgttttatgcttctcaaaatcagctctgat

SEQ ID NO: 18624 - DNA, 71 bp, chicken (Gallus Gallus)
  misc_feature (36): n=a or g
atgctaataattaaagttattagcttgtttctggcntgcgtttttgtttcgtggcttatgctgttcggagt

SEQ ID NO: 18625 - DNA, 71 bp, chicken (Gallus Gallus)
  misc_feature (36): n=g or t
ggtggtttatatctttttttccattaatttacagcnaatataaatgaatctcttcagcctcaaactacaaa

SEQ ID NO: 18626 - DNA, 71 bp, chicken (Gallus Gallus)
  misc_feature (36): n=a or t
cagatctgtgagaagcgggtgattcctcttctgtancgtttgtatgttcagcaagagttagaacgttgcgt

SEQ ID NO: 18627 - DNA, 71 bp, chicken (Gallus Gallus)
  misc_feature (36): n=c or t
cagaccagatgtttgctttgactctgtaaactcctngtaacagggacaaacaggatgaaagtcactgggga

SEQ ID NO: 18628 - DNA, 71 bp, chicken (Gallus Gallus)
  misc_feature (36): n=a or g
ataaacaagaagtgtgtacagagcagccttcgtggncatttcataataattcattttaaaccttctgactg

SEQ ID NO: 18629 - DNA, 71 bp, chicken (Gallus Gallus)
  misc_feature (36): n=g or t
aatgatgaatctgttgaccataattttatttcttangtagcttgcaaaaatgaacacattcaaaattcaca

SEQ ID NO: 18630 - DNA, 71 bp, chicken (Gallus Gallus)
  misc_feature (36): n=a or g
cacagaacagtcagttacgggcccagcagatctcancttaagcctaggataccactgctttacagccatat

SEQ ID NO: 18631 - DNA, 71 bp, chicken (Gallus Gallus)
  misc_feature (36): n=c or t
cacacataccaaaactactgatacaggaagttatantctgccatttgcagaatctgtgtctttaaagtaca

SEQ ID NO: 18632 - DNA, 71 bp, chicken (Gallus Gallus)
  misc_feature (36): n=a or t
ccttctgacttgctttcaaagttaccacaactatangtactgaagcaggaaaataagcatgttcatctatc

SEQ ID NO: 18633 - DNA, 71 bp, chicken (Gallus Gallus)
  misc_feature (36): n=c or t
aaactatttttgttttccataggtagagcctaccangatgctttgatcagacatagctgtgtccgtgtaaa

SEQ ID NO: 18634 - DNA, 71 bp, chicken (Gallus Gallus)
  misc_feature (36): n=a or g
gaagttacttgtaatgttcaattagaaaatgagatngatccttccctctcgatgctttatttttcttcctc

SEQ ID NO: 18635 - DNA, 71 bp, chicken (Gallus Gallus)
  misc_feature (36): n=c or g
gctttgacagcttgcaaatattttagcctccacaantatccaaaccaaacatactatttctcatgatttta

SEQ ID NO: 18636 - DNA, 71 bp, chicken (Gallus Gallus)
  misc_feature (36): n=a or c
tggatagtgtggagcatcactggggaatgaggggtnaggttcatcccacctgctttcttcatagcatgagg

SEQ ID NO: 18637 - DNA, 71 bp, chicken (Gallus Gallus)
  misc_feature (36): n=a or t
gtctactgatttcagaagaacattccgcctgtttgngaggcatgtatatgccaatggcacgataaattcat

SEQ ID NO: 18638 - DNA, 71 bp, chicken (Gallus Gallus)
  misc_feature (36): n=c or t
ctcaaaaactgttgatctgtttttgccattgacaanggaaaggatttaagcttcaccccaacctgacacat

SEQ ID NO: 18639 - DNA, 71 bp, chicken (Gallus Gallus)
  misc_feature (36): n=c or t
agcttctgttatacacaggatggatgtgggccttantgttaagttggctaaaatacttttataaacctgca

SEQ ID NO: 18640 - DNA, 71 bp, chicken (Gallus Gallus)
  misc_feature (36): n=a or g
ttcctgtatttgcagcttcacgaaaatattaatacntgacagagggcatagaagaaaccaatactatttca

SEQ ID NO: 18641 - DNA, 71 bp, chicken (Gallus Gallus)
  misc_feature (36): n=c or t
ttctatttgatagctaactttttggaagatgtaggngtgatgttgtatgcaaacaaggaaagttagtaatt

SEQ ID NO: 18642 - DNA, 71 bp, chicken (Gallus Gallus)
  misc_feature (36): n=a or t
ttgaggggggaaaaaaaagaatcacttctccaaganctgggcaaaaaaataaaaggcagtgagggaacaga

SEQ ID NO: 18643 - DNA, 71 bp, chicken (Gallus Gallus)
  misc_feature (36): n=a or c
gaagtgttttgttttatgtcttttgacaacaacaanaaaaaaaacctggacaaaaaaaatccctggaataa

SEQ ID NO: 18644 - DNA, 71 bp, chicken (Gallus Gallus)
  misc_feature (36): n=c or t
cctccacataatttgtagctgttgatgttgagccanagacaaggatggtgagtcctcgtggggctgtgagc

SEQ ID NO: 18645 - DNA, 71 bp, chicken (Gallus Gallus)
  misc_feature (36): n=a or g
tacagcccgggttaggagaaacccatctcttgcatnctgacaaatttgattctgttagattttattcacca

SEQ ID NO: 18646 - DNA, 71 bp, chicken (Gallus Gallus)
  misc_feature (36): n=a or g
gtttttactgttccactatcgcagctgatttgccanctctgctagagatgcacatctcatctctgtttcac

SEQ ID NO: 18647 - DNA, 71 bp, chicken (Gallus Gallus)
  misc_feature (36): n=c or t
ggctccttttgaagcatggctgttcaacataatggncattaaccagttccagcttccctcttacttcttta

SEQ ID NO: 18648 - DNA, 71 bp, chicken (Gallus Gallus)
  misc_feature (36): n=c or t
gtcatgctctgtggaaggtagttgactattaaattngtcttgctgtcttctgtgtttccagaatcaatcgg

SEQ ID NO: 18649 - DNA, 71 bp, chicken (Gallus Gallus)
  misc_feature (36): n=c or g
tgagagaatatctctctgaacccatttgttatcttnagtggtattatgtattttcctgtaatttcattcat

SEQ ID NO: 18650 - DNA, 71 bp, chicken (Gallus Gallus)
  misc_feature (36): n=a or g
acaacaaatatagaaaatgagcaaggttgcatcacntaacttcaagcttcaataaagttttcagtaaagca

SEQ ID NO: 18651 - DNA, 71 bp, chicken (Gallus Gallus)
  misc_feature (36): n=c or t
tcctacaatagtaaatgtactgacaattcaacaatngttggttgcactctgtgcagttttggttgttcttt

SEQ ID NO: 18652 - DNA, 71 bp, chicken (Gallus Gallus)
  misc_feature (36): n=c or t
agccaaaattagcattaagaactaaaaacagtgcanataagatagggagaaaaaggtgaaaacctcagtgc

SEQ ID NO: 18653 - DNA, 71 bp, chicken (Gallus Gallus)
  misc_feature (36): n=a or g
ctataaattgcctatattagggaggtttactctttntaagccaattttcattgaatgaaactgtaaatata

SEQ ID NO: 18654 - DNA, 71 bp, chicken (Gallus Gallus)
  misc_feature (36): n=c or t
actccgacttgcccatacaccttcctcatgaggctntgcaccagctaagtaaaatcacaagcccaaggaga

SEQ ID NO: 18655 - DNA, 71 bp, chicken (Gallus Gallus)
  misc_feature (36): n=c or t
ttccccaagcccaacaagaagcctttcttacagccncccaggaaatcggtggccaacctcctggactattt

SEQ ID NO: 18656 - DNA, 71 bp, chicken (Gallus Gallus)
  misc_feature (36): n=a or t
taagaggcttcctttgttactgaaagtcattttgtnttttgtctaaaggaaaaacaaaaaaagatttctta

SEQ ID NO: 18657 - DNA, 71 bp, chicken (Gallus Gallus)
  misc_feature (36): n=a or g
ccccaattatgcactcacaagtgctgtgggaacagncagaagtgactgttgaacaattctctatcacctct

SEQ ID NO: 18658 - DNA, 71 bp, chicken (Gallus Gallus)
  misc_feature (36): n=g or t
gtttgtttgttaaccaaatacaaggtttcatttcanatttcatgcaaatgtaagtcaatatcatttgtggc

SEQ ID NO: 18659 - DNA, 71 bp, chicken (Gallus Gallus)
  misc_feature (36): n=c or t
gcagtctctgaaggtacacatgatctaccatgaggngatctaatctattgttgttcaaggcagaattggtc

SEQ ID NO: 18660 - DNA, 71 bp, chicken (Gallus Gallus)
  misc_feature (36): n=c or g
tgcagccttggattaggcgacatcgttatctttagnttccagcggttacaggaaaaagggatgagaatgta

SEQ ID NO: 18661 - DNA, 71 bp, chicken (Gallus Gallus)
  misc_feature (36): n=a or g
accacacaatttcactaaatttcacagtgaagcatncacaactgagtctaatgctgattttaaggacaaca

SEQ ID NO: 18662 - DNA, 71 bp, chicken (Gallus Gallus)
  misc_feature (36): n=c or t
gtgattggcagtcaaccattggaggtaaatgacagntaaatagtttagtgggaaaggtagcagagaagtgc

SEQ ID NO: 18663 - DNA, 71 bp, chicken (Gallus Gallus)
  misc_feature (36): n=a or c
cttcattataccccaataccaagcttttttatgtcngaaattataaactctgagaaatagaagtgaaccta

SEQ ID NO: 18664 - DNA, 71 bp, chicken (Gallus Gallus)
  misc_feature (36): n=c or t
atgtttaccatttttttaaaatattgccttctagantcttctatctcaattccttgttatcattgtgtttt

SEQ ID NO: 18665 - DNA, 71 bp, chicken (Gallus Gallus)
  misc_feature (36): n=c or g
tctgtacaaccactaagaaaaattttataaaaaaantaattattaagcagtttgtgtgaagtgtggttttc

SEQ ID NO: 18666 - DNA, 71 bp, chicken (Gallus Gallus)
  misc_feature (36): n=a or t
ctgcctgaagaggatgacattaaagttaagatgganatctttcaactctgagtaaacttataaagtattat

SEQ ID NO: 18667 - DNA, 71 bp, chicken (Gallus Gallus)
  misc_feature (36): n=a or g
tcctacatttatcactagacatagacattaaaaacnttacccaatactgcaactgtccttctaacaaaacc

SEQ ID NO: 18668 - DNA, 71 bp, chicken (Gallus Gallus)
  misc_feature (36): n=a or g
taaaatggactgatactgtgaagacactcctgcagngacagattgagcaggttatgagtaccttaagtgta

SEQ ID NO: 18669 - DNA, 71 bp, chicken (Gallus Gallus)
  misc_feature (36): n=a or g
gcacctattagaagatgtgaacgtaacatgtggccnaaaggatgtgtgcccagaatctgcgcttcgtgtct

SEQ ID NO: 18670 - DNA, 71 bp, chicken (Gallus Gallus)
  misc_feature (36): n=c or t
tgggccccactgagcagagcaaaaacagaagggaangtaaacaaactcaacattattctgaccacaaaatg

SEQ ID NO: 18671 - DNA, 71 bp, chicken (Gallus Gallus)
  misc_feature (36): n=g or t
ggcagctctgatcatgtgcattaagagggtaagttngtcccccactcccttatttggcaaatcaagcaaga

SEQ ID NO: 18672 - DNA, 71 bp, chicken (Gallus Gallus)
  misc_feature (36): n=c or t
tgcttaactcttcttggaaagatggtgtaaaggtcngagagtgataagaaattatgatttactgctagcat

SEQ ID NO: 18673 - DNA, 71 bp, chicken (Gallus Gallus)
  misc_feature (36): n=c or g
ctccagcactggttcagtttgcctatcactactaanaccagcagaaatccaactgttggtctcagtcccac

SEQ ID NO: 18674 - DNA, 71 bp, chicken (Gallus Gallus)
  misc_feature (36): n=a or g
gcaatggatattcatcctaaggtgtgtgtggagggnagagctccatattcaaagcaggaattttccttgcc

SEQ ID NO: 18675 - DNA, 71 bp, chicken (Gallus Gallus)
  misc_feature (36): n=a or g
tgcttgcttgctgcaatttacaacaaccacttaatnaccccatcagggttattcccatttctttatagtca

SEQ ID NO: 18676 - DNA, 71 bp, chicken (Gallus Gallus)
  misc_feature (36): n=a or g
atcctaatttacctgggatttccttctgcatctacngtgtttgctctttgtggtgcatcatgagaaaccgc

SEQ ID NO: 18677 - DNA, 71 bp, chicken (Gallus Gallus)
  misc_feature (36): n=a or g
acacagccctggcattcagacagtacagacctaaangaaggattatctttaatcccaataaactagtacag

SEQ ID NO: 18678 - DNA, 71 bp, chicken (Gallus Gallus)
  misc_feature (36): n=a or g
gcagcagcctctgtgtccatctctgtttgttcagcnttgggtttttttggcttatcagcttcctggcactg

SEQ ID NO: 18679 - DNA, 71 bp, chicken (Gallus Gallus)
  misc_feature (36): n=a or c
cggttagctgttcaacaatccaatgttatttagtgntttctgccatttattttcagcacacttccaaaaaa

SEQ ID NO: 18680 - DNA, 71 bp, chicken (Gallus Gallus)
  misc_feature (36): n=g or t
cagtacgactcttgtcatttgactggaaagtgaaanagaatttgtggacgattttgtgacacagaagagat

SEQ ID NO: 18681 - DNA, 71 bp, chicken (Gallus Gallus)
  misc_feature (36): n=c or t
cagcacttgcaggaagtcttttgaaaatgtctcagnctggatgccaaaataatcatgtctaaatgtttcac

SEQ ID NO: 18682 - DNA, 71 bp, chicken (Gallus Gallus)
  misc_feature (36): n=a or t
aaatagatagaatgacatgtctctgagatgtcagantatcagcctgtagttttggtgttggccttccagtg

SEQ ID NO: 18683 - DNA, 71 bp, chicken (Gallus Gallus)
  misc_feature (36): n=a or g
cataaaagctcagaggtaaatgtgtgtggaagcatnggtactgttgaggtgcacttcctcatttcaaccca

SEQ ID NO: 18684 - DNA, 71 bp, chicken (Gallus Gallus)
  misc_feature (36): n=a or g
atgttacacatttcttctccatgtccttttgacacngaatgataatgtcaaggagcaactgattaaaataa

SEQ ID NO: 18685 - DNA, 71 bp, chicken (Gallus Gallus)
  misc_feature (36): n=a or g
tttgcttttcttcttcccttatatctatctatatanaagtgagatttcttctagcagtataaggggtgtga

SEQ ID NO: 18686 - DNA, 71 bp, chicken (Gallus Gallus)
  misc_feature (36): n=a or g
aaggaaatagcaagtatgtctttctaaatgatggtngtcattacataatgatctcctgatacttgtaaagg

SEQ ID NO: 18687 - DNA, 71 bp, chicken (Gallus Gallus)
  misc_feature (36): n=c or t
agcgcatagtctgatgtaccaggtctctgcctcatnccgggctggtggattcatgttctccatggagcctt

SEQ ID NO: 18688 - DNA, 71 bp, chicken (Gallus Gallus)
  misc_feature (36): n=a or t
gacaaaactacttcaagagctcagttctgagctgangtccacttgatatgtctgtggttgctgtgaaggag

SEQ ID NO: 18689 - DNA, 71 bp, chicken (Gallus Gallus)
  misc_feature (36): n=c or t
tgtgctcacactatgtggaatgggtctgttcccatnttgaagcagtgtttcagcatataaaaaggagattt

SEQ ID NO: 18690 - DNA, 71 bp, chicken (Gallus Gallus)
  misc_feature (36): n=c or t
ttcttcattagtgggacaaagttatgtcattcagtnagtaacacagaaaatttctctgcagtgtagctgac

SEQ ID NO: 18691 - DNA, 71 bp, chicken (Gallus Gallus)
  misc_feature (36): n=c or g
aataaacgtctaaaagtggtcatcataatgcattanttcagatacagctgtcagagttgcagagatcttaa

SEQ ID NO: 18692 - DNA, 71 bp, chicken (Gallus Gallus)
  misc_feature (36): n=a or g
tgcaagtctcttgtatgttttgagcaactctgactntggcacaacaaaggcagcattttgagaagtgacag

SEQ ID NO: 18693 - DNA, 71 bp, chicken (Gallus Gallus)
  misc_feature (36): n=a or g
ttttcatactggatgatctggggggtatggcctggngcacgcttagagcacatgctgacagaagtccttct

SEQ ID NO: 18694 - DNA, 71 bp, chicken (Gallus Gallus)
  misc_feature (36): n=c or t
tgataagaaagtatgcattaagtcaatctacttagncatttttagcaaaaattcccccagtgtcattcctc

SEQ ID NO: 18695 - DNA, 71 bp, chicken (Gallus Gallus)
  misc_feature (36): n=a or c
aaacagtagatacggtaggagaggtgctttgcatgncacttcagtgttgaagcactactgcagttgcctgt

SEQ ID NO: 18696 - DNA, 71 bp, chicken (Gallus Gallus)
  misc_feature (36): n=a or g
gggtagaccgtgtgtggagagatggacagtcagccnagcggttggaaggataagggtatttgctctttcaa

SEQ ID NO: 18697 - DNA, 71 bp, chicken (Gallus Gallus)
  misc_feature (36): n=a or g
tgtggcaactcagtgttctcctggattccctatccnctatggtcagcctctggcatcatttcaatttgact

SEQ ID NO: 18698 - DNA, 71 bp, chicken (Gallus Gallus)
  misc_feature (36): n=c or g
ctcttctctaaagttaagggttgtgtcatcttcaanctagactattcttttttgaatattcttagtattac

SEQ ID NO: 18699 - DNA, 71 bp, chicken (Gallus Gallus)
  misc_feature (36): n=a or g
ctaattttgctcaccgctcggccaatcagccacatncagaacatggcaaatgcttatgcacagactgcttg

SEQ ID NO: 18700 - DNA, 71 bp, chicken (Gallus Gallus)
  misc_feature (36): n=c or t
caaacttctaatgagcaaagaggagacaatatctgnccaaagatgtggtggacaccccatccttagggaca

SEQ ID NO: 18701 - DNA, 71 bp, chicken (Gallus Gallus)
  misc_feature (36): n=a or g
aataacctacgattattctattatggatttatagcncctcctctaccacggacaatgagtgatccccacat

SEQ ID NO: 18702 - DNA, 71 bp, chicken (Gallus Gallus)
  misc_feature (36): n=a or g
agattatttttcaagtcaaaattattcccagcactntcacctcacacgatcaaccagaagattgcctcatt

SEQ ID NO: 18703 - DNA, 71 bp, chicken (Gallus Gallus)
  misc_feature (36): n=c or t
ctcagtggaataccttatctgtgtgtcagccccccntcctgaatgtgtgatacaacagggtatgtgataga

SEQ ID NO: 18704 - DNA, 71 bp, chicken (Gallus Gallus)
  misc_feature (36): n=a or g
caaagaaatcataacttggcattctttgaatgtgtnaagtgaggcattgctttgtatatgaaatacttcat

SEQ ID NO: 18705 - DNA, 71 bp, chicken (Gallus Gallus)
  misc_feature (36): n=c or t
ccacttgcattctccttgcttttatcccttcccacnagtactagtcacatcctcagtaatacgaggcttca

SEQ ID NO: 18706 - DNA, 71 bp, chicken (Gallus Gallus)
  misc_feature (36): n=a or g
gcattgtaatatatactatttctgcagaaggaaganaagaaataattggctacaatactttgttttcaact

SEQ ID NO: 18707 - DNA, 71 bp, chicken (Gallus Gallus)
  misc_feature (36): n=a or g
tctactttattttgttcttccaaggatgttaacaanctcactgaagggcataacacttcatctaacgtcca

SEQ ID NO: 18708 - DNA, 71 bp, chicken (Gallus Gallus)
  misc_feature (36): n=a or c
gcaaaattatatctttcaagaaaacacacgaaaatncataaaaacccattttcattatacattttaatctc

SEQ ID NO: 18709 - DNA, 71 bp, chicken (Gallus Gallus)
  misc_feature (36): n=c or t
gtattaccacactattaaaccttccaggggatcatntgtggtatgaattattagcataattgggggcatac

SEQ ID NO: 18710 - DNA, 71 bp, chicken (Gallus Gallus)
  misc_feature (36): n=g or t
ttttcatttgatattcagaaaattctgttccttcanaaagagttaatgttaaatcacttggatacattttc

SEQ ID NO: 18711 - DNA, 71 bp, chicken (Gallus Gallus)
  misc_feature (36): n=a or c
gatttataaaggtcaatcaaatctctcagaaaattnaaataagcccataaagctcatataggccttaaaaa

SEQ ID NO: 18712 - DNA, 71 bp, chicken (Gallus Gallus)
  misc_feature (36): n=a or g
ctgttctgcacatcactctgatagcactgcactgcncagcagacagaatgcaggacggagcctgctgggtg

SEQ ID NO: 18713 - DNA, 71 bp, chicken (Gallus Gallus)
  misc_feature (36): n=c or t
gtctaggtgaaaggttaaggttctatggctttacanctcagtccaaaattcaactgataggttgacacttt

SEQ ID NO: 18714 - DNA, 71 bp, chicken (Gallus Gallus)
  misc_feature (36): n=a or g
attaagaaaatacatctaatactgtactatccttantggtgccagaatgcatttccatgctcaggaaattc

SEQ ID NO: 18715 - DNA, 71 bp, chicken (Gallus Gallus)
  misc_feature (36): n=a or g
gaatgtacagttcacctataactggcattattgggnagtccagaaacatatcctgctgtgccaccttggac

SEQ ID NO: 18716 - DNA, 71 bp, chicken (Gallus Gallus)
  misc_feature (36): n=a or g
cctcttttatatggagtactgaaataaaacattacnctagagaataagcagctgtctaaacatcttttgaa

SEQ ID NO: 18717 - DNA, 71 bp, chicken (Gallus Gallus)
  misc_feature (36): n=a or g
caaactcctgttggccagctgggagcacaggttagngattcatccgacagcagcgatggtttgggttgaag

SEQ ID NO: 18718 - DNA, 71 bp, chicken (Gallus Gallus)
  misc_feature (36): n=c or t
tcttcactatgagtaaaatcgcattagctttgctantcattaatgcagcaacaaatatctctgccctaagg

SEQ ID NO: 18719 - DNA, 71 bp, chicken (Gallus Gallus)
  misc_feature (36): n=a or g
tgttctgtgtttgcaagcaagagaatttcaaaacantaattacttttattcttgcaccgtgacaacactta

SEQ ID NO: 18720 - DNA, 71 bp, chicken (Gallus Gallus)
  misc_feature (36): n=a or g
gcccaatcctgccttgatctgagaggctcaaatganaactatccgctgcctccagccttcctcttctgatc

SEQ ID NO: 18721 - DNA, 71 bp, chicken (Gallus Gallus)
  misc_feature (36): n=c or g
acttcctaagtgttcctctgggattacacataactntacttgcatgttgtgacagtaggattcagtgttgc

SEQ ID NO: 18722 - DNA, 71 bp, chicken (Gallus Gallus)
  misc_feature (36): n=a or g
tcagaattaattaatctaacactttacaacttcggngcaaacttgatgagccaaggttttctctcctctgc

SEQ ID NO: 18723 - DNA, 71 bp, chicken (Gallus Gallus)
  misc_feature (36): n=a or g
agtcaccacctcattagctttcatctgtctttactngttctgggcttacatcaaatgcttttagttccagc

SEQ ID NO: 18724 - DNA, 71 bp, chicken (Gallus Gallus)
  misc_feature (36): n=c or g
gagtgatgggcccatttgagcatgaacatgtaacanctcacacttctgcagatctttccttaggcagcaac

SEQ ID NO: 18725 - DNA, 71 bp, chicken (Gallus Gallus)
  misc_feature (36): n=a or t
tttgccaatttattgatcagtcacataatatcagangatccttctgcaattatttgcaataaactgtggtc

SEQ ID NO: 18726 - DNA, 71 bp, chicken (Gallus Gallus)
  misc_feature (36): n=a or g
ccattttctgtaacatcaaccagttcgtagttgtantagcagtcctatttcagaacaaacccatgtttaca

SEQ ID NO: 18727 - DNA, 71 bp, chicken (Gallus Gallus)
  misc_feature (36): n=a or g
ctccccctctctggctctgacagtagtgaggttgtnaaactctgcagtgggatcgggattagtcttctgta

SEQ ID NO: 18728 - DNA, 71 bp, chicken (Gallus Gallus)
  misc_feature (36): n=c or g
tttaatcatcacacacttgcagaggcatatctaacnaaatacatgtttcagaacacttaaggtatgagtcc

SEQ ID NO: 18729 - DNA, 71 bp, chicken (Gallus Gallus)
  misc_feature (36): n=a or g
tcatcagcagtgaccaaaccgcaacaccttcgctantcacggtttacaaaagaaatgcagaaggtactgac

SEQ ID NO: 18730 - DNA, 71 bp, chicken (Gallus Gallus)
  misc_feature (36): n=c or g
tcactgctctcttcaagcctcgtatttcagtgccantggtcaaactccagaagaaaagcaaatctcagtga

SEQ ID NO: 18731 - DNA, 71 bp, chicken (Gallus Gallus)
  misc_feature (36): n=c or t
cttttgccatgcaagctacttataggagacgtatcncagatatactccttccctggctgcataagaatgtc

SEQ ID NO: 18732 - DNA, 71 bp, chicken (Gallus Gallus)
  misc_feature (36): n=g or t
ttttggctggggggtttatctaaattcttgcttctnatttctcttgcatcttcttcctctgatgcgtgtat

SEQ ID NO: 18733 - DNA, 71 bp, chicken (Gallus Gallus)
  misc_feature (36): n=a or t
ctcaggaacgtgagaaaaataaataaataaataaantctgatctgatttttttcttggatactggtccatg

SEQ ID NO: 18734 - DNA, 71 bp, chicken (Gallus Gallus)
  misc_feature (36): n=a or g
gtttgcaagattccaggttttcataggtattcatgnctggtgatgtttcattatcttagtgctttgtctat

SEQ ID NO: 18735 - DNA, 71 bp, chicken (Gallus Gallus)
  misc_feature (36): n=c or t
gctccacaagtatcacaaggtaagggttcttctccnagtcctgcctgccttattgtttgtgctgctggctg

SEQ ID NO: 18736 - DNA, 71 bp, chicken (Gallus Gallus)
  misc_feature (36): n=g or t
atgtaatggcaatttgcctttatttgaaacacaganggtggtgatgcactggaacaggttgcccaaggagg

SEQ ID NO: 18737 - DNA, 71 bp, chicken (Gallus Gallus)
  misc_feature (36): n=c or t
agatctgtgctcttataggcaagtacagtatatatngatcaatatccatcttaagcatatatatattagct

SEQ ID NO: 18738 - DNA, 71 bp, chicken (Gallus Gallus)
  misc_feature (36): n=c or t
ctgtcctgcaatcactaacaccttcctgcaactttnggctgtccttggcataaactttgcccagatacaga

SEQ ID NO: 18739 - DNA, 71 bp, chicken (Gallus Gallus)
  misc_feature (36): n=c or t
tagttttactgtgggcttattttcataataaagtgnacacactccttggaagcatctctaactagaaagag

SEQ ID NO: 18740 - DNA, 71 bp, chicken (Gallus Gallus)
  misc_feature (36): n=a or t
ggttttgggttttgaagtcctagtttaaggaaacancgaacttgaacatttaagctgactgctccacttgg

SEQ ID NO: 18741 - DNA, 71 bp, chicken (Gallus Gallus)
  misc_feature (36): n=a or g
ttcacacaatcaatttgcattcttttacaagcaacntctcagttctgtttttcttctaccaagtgaaaaca

SEQ ID NO: 18742 - DNA, 71 bp, chicken (Gallus Gallus)
  misc_feature (36): n=c or t
aaaggaacccttgggtgttcatcctattttgttttncatttgtccagtgaagccaaatttgtacctgctaa

SEQ ID NO: 18743 - DNA, 71 bp, chicken (Gallus Gallus)
  misc_feature (36): n=a or g
taccactagcgtggcagaaataacaatgtctcatgnaggctgctgttctgggtctgtgctctgtgggttac

SEQ ID NO: 18744 - DNA, 71 bp, chicken (Gallus Gallus)
  misc_feature (36): n=a or g
aaagcagaagttgcactccttcaccttgcatgatgnaagtccagaagaaatcacagagatgcaaaagccaa

SEQ ID NO: 18745 - DNA, 71 bp, chicken (Gallus Gallus)
  misc_feature (36): n=a or g
agggcagaccttctgcttaataaagacaggttgcangaagcaatattattctacatgtaaagtaacatcca

SEQ ID NO: 18746 - DNA, 71 bp, chicken (Gallus Gallus)
  misc_feature (36): n=a or c
acagcagaaatcttattctgaatgctcttaactccncatatgaattttcttccttgctttgttccagagat

SEQ ID NO: 18747 - DNA, 71 bp, chicken (Gallus Gallus)
  misc_feature (36): n=a or t
gcaattccagcctttctgttgcagtactagctcagngctttttcatttggcattgctttcaaagggattct

SEQ ID NO: 18748 - DNA, 71 bp, chicken (Gallus Gallus)
  misc_feature (36): n=c or t
gaatgagttctttaattatggacttttcaactctantgtcacatgcaacagttttgaagtgtcctaggtaa

SEQ ID NO: 18749 - DNA, 71 bp, chicken (Gallus Gallus)
  misc_feature (36): n=c or t
cctgaccagtataattacatgtttggcactgatagnctgaattcagaaatttctcattttcttaaaagaag

SEQ ID NO: 18750 - DNA, 71 bp, chicken (Gallus Gallus)
  misc_feature (36): n=a or g
gcagaatctctaaagacatggtttgactccaaaatntgcccaggttcacaggatccaggacctccccagga

SEQ ID NO: 18751 - DNA, 71 bp, chicken (Gallus Gallus)
  misc_feature (36): n=g or t
ccaagccttatgagttactgatggcatctctgattnaaatttttatttctgttcctaagttatcaggatgg

SEQ ID NO: 18752 - DNA, 71 bp, chicken (Gallus Gallus)
  misc_feature (36): n=a or t
tgtcagcatttgcaaatgacaaagccaacaatgacnttcatggtagaagttatgatactgatctgtggtct

SEQ ID NO: 18753 - DNA, 71 bp, chicken (Gallus Gallus)
  misc_feature (36): n=g or t
tgttgcactgtttcatccagatgctcacctcaactngtgcacctttcccatcatcaactgaatacttcacc

SEQ ID NO: 18754 - DNA, 71 bp, chicken (Gallus Gallus)
  misc_feature (36): n=a or g
tgagacagccaacatggctttacaaatggaagatcntgcctgaccaatctggtggccttctatgatggagt

SEQ ID NO: 18755 - DNA, 71 bp, chicken (Gallus Gallus)
  misc_feature (36): n=a or g
ttcattcaaatataaggaaactttagtgattacagngaatcacattaacggctaaaggcaagaatggaaag

SEQ ID NO: 18756 - DNA, 71 bp, chicken (Gallus Gallus)
  misc_feature (36): n=g or t
ttcactaacagtattttcactagcaggtacaattcntaccagcagacatagctttgtatttcctggcattc

SEQ ID NO: 18757 - DNA, 71 bp, chicken (Gallus Gallus)
  misc_feature (36): n=g or t
gtgcgcatggggacagttctgatactagtgaaatgngtggaaggagctcgttccagagcaacgctctggag

SEQ ID NO: 18758 - DNA, 71 bp, chicken (Gallus Gallus)
  misc_feature (36): n=a or t
agagccagctcatgttctcttctccaactccattangctcaaggaacactacaagtagcatttgaataacc

SEQ ID NO: 18759 - DNA, 71 bp, chicken (Gallus Gallus)
  misc_feature (36): n=a or c
gcttaatgtctagcacgctcatttgtaattcaagantacctgagatttactagcaaccagagtcattattc

SEQ ID NO: 18760 - DNA, 71 bp, chicken (Gallus Gallus)
  misc_feature (36): n=c or g
gttgagaagcttcattttatctaacagaactacttngtattaagaaaatatgaatgatggatgaacacact

SEQ ID NO: 18761 - DNA, 71 bp, chicken (Gallus Gallus)
  misc_feature (36): n=c or g
ctcctgcttcattgagaatgtggataaggagcgagnctcgatctcctatggcactgaaagctgtgccctgc

SEQ ID NO: 18762 - DNA, 71 bp, chicken (Gallus Gallus)
  misc_feature (36): n=c or g
actcctcaaaactaaaaacagaagtagttctcagcntcacagaaaaatcagtacatgttcctccaccctgc

SEQ ID NO: 18763 - DNA, 71 bp, chicken (Gallus Gallus)
  misc_feature (36): n=a or g
accagaacaagaaaacagaccctgatttggaagagntcattaagcagcttagtaagagatgctttagtaat

SEQ ID NO: 18764 - DNA, 71 bp, chicken (Gallus Gallus)
  misc_feature (36): n=a or g
ctgatgttcagcaagccatggcatagtcctgtaganacttgctggaaaaaacagtgtgcaacacatttcca

SEQ ID NO: 18765 - DNA, 71 bp, chicken (Gallus Gallus)
  misc_feature (36): n=c or t
agggtgtacagaacgtctttagctcccaaaggctanttttaccttctctctcttcggagcaatggcatcca

SEQ ID NO: 18766 - DNA, 71 bp, chicken (Gallus Gallus)
  misc_feature (36): n=a or c
attgcaagacctacagtgagacaacaacatcttacntggtatgtatctgagtaagcatctaactaaagcaa

SEQ ID NO: 18767 - DNA, 71 bp, chicken (Gallus Gallus)
  misc_feature (36): n=a or g
tcattgagagagccagaatcaattttttcttgcccntattcattacataacgttaaataactcgtggtgca

SEQ ID NO: 18768 - DNA, 71 bp, chicken (Gallus Gallus)
  misc_feature (36): n=c or t
tgatgaagtttcaagtgacatgttttttatctcaanagtacatcaacggtaattaagaatctttgtcactc

SEQ ID NO: 18769 - DNA, 71 bp, chicken (Gallus Gallus)
  misc_feature (36): n=c or t
agtacgtgagccaaccatttcctgattaagtacagntaaatgtcatctgaagactcatactacatgcaatc

SEQ ID NO: 18770 - DNA, 71 bp, chicken (Gallus Gallus)
  misc_feature (36): n=a or g
tacttgtaatttgaaggtggaacaggcagtgaactncagctataggtgatgttcacattaaggaaagcacc

SEQ ID NO: 18771 - DNA, 71 bp, chicken (Gallus Gallus)
  misc_feature (36): n=a or t
aagcttggatgagcagaaccttccttatgtttgaanggataccaggggcaattaaataccatgcataatca

SEQ ID NO: 18772 - DNA, 71 bp, chicken (Gallus Gallus)
  misc_feature (36): n=a or t
cattcagatgctatactgagcgaacactatataaanaatttttattccaacagcaacaggtcctgaatcac

SEQ ID NO: 18773 - DNA, 71 bp, chicken (Gallus Gallus)
  misc_feature (36): n=c or t
ctccccctaattcctcctttggcatctgcagtgcancccaaagagacaaaaggagcccttgtgaaaaaaat

SEQ ID NO: 18774 - DNA, 71 bp, chicken (Gallus Gallus)
  misc_feature (36): n=g or t
tggatggttgggattttcctcagaggtaagggacangattcagtttcccagcaaagctgcctgttatcata

SEQ ID NO: 18775 - DNA, 71 bp, chicken (Gallus Gallus)
  misc_feature (36): n=c or t
aaacagaagacctgagaagggttacctaaaggcagnatgcatcagcctctctctgctcccctcttccatta

SEQ ID NO: 18776 - DNA, 71 bp, chicken (Gallus Gallus)
  misc_feature (36): n=c or t
tttcttcagaagtgtaaaccctttggcttcgagacngatactgttagcataaaataagagggaaaacccct

SEQ ID NO: 18777 - DNA, 71 bp, chicken (Gallus Gallus)
  misc_feature (36): n=c or g
ccctaactctaacaaccttctactaaatcatgactntgagcaccacatccaaatagtttttaaacacatcc

SEQ ID NO: 18778 - DNA, 71 bp, chicken (Gallus Gallus)
  misc_feature (36): n=a or g
gcaagtcaaatgtcctttggcataatttgatcaacngtaacaaaaaatgcataataatttgtaaataaaaa

SEQ ID NO: 18779 - DNA, 71 bp, chicken (Gallus Gallus)
  misc_feature (36): n=c or t
atctgtcaataaaaagattatgagattaaaacacanactgggaaaactagcagtataccacatttggctcc

SEQ ID NO: 18780 - DNA, 71 bp, chicken (Gallus Gallus)
  misc_feature (36): n=a or g
gaaaacatgcattcattcttgtgtaaggaagacacncttccacttagtcagaatggaggcttccttcttgt

SEQ ID NO: 18781 - DNA, 71 bp, chicken (Gallus Gallus)
  misc_feature (36): n=a or c
agatccagatgaggggattgagtgcatccacagtanatttacagattacagattacactggaggaagtgtg

SEQ ID NO: 18782 - DNA, 71 bp, chicken (Gallus Gallus)
  misc_feature (36): n=a or g
tggaaaaaacacaacaagtcaaagttcaagtgggtnagttaggaactactgcattatttccaggcagtagc

SEQ ID NO: 18783 - DNA, 71 bp, chicken (Gallus Gallus)
  misc_feature (36): n=g or t
atctggagaattcagtgctgccaatcaccagctcanaaagtatacctctcctattgaaatgtctgtcaaat

SEQ ID NO: 18784 - DNA, 71 bp, chicken (Gallus Gallus)
  misc_feature (36): n=c or t
caccaaacagctcctgagtccaggagccactcccangtgtaaagacaagcatgatttcctcctccctggcc

SEQ ID NO: 18785 - DNA, 71 bp, chicken (Gallus Gallus)
  misc_feature (36): n=c or t
aaaccctcacctgaattgttggctcagatgtcaggngcaatggcactcggtggcacaataggtatgtatat

SEQ ID NO: 18786 - DNA, 71 bp, chicken (Gallus Gallus)
  misc_feature (36): n=c or t
actactttaatacaatatgcctaaaggttgttcccnttgttatattactttagctcaacatggcctttaac

SEQ ID NO: 18787 - DNA, 71 bp, chicken (Gallus Gallus)
  misc_feature (36): n=c or t
acacctacctatcacagagtgctagaaattcatgtncccttgtaaggaaaatacttactgtcattccagca

SEQ ID NO: 18788 - DNA, 71 bp, chicken (Gallus Gallus)
  misc_feature (36): n=c or t
atgaaaaacgagcttctcagaaaatctccacttcanaggctcttgccatctcatctccaagtgtgactcaa

SEQ ID NO: 18789 - DNA, 71 bp, chicken (Gallus Gallus)
  misc_feature (36): n=a or g
gagagactgttctctagctacttttttaagtcccantcaaaagcaggatttgttaacaatcctgtaaacta

SEQ ID NO: 18790 - DNA, 71 bp, chicken (Gallus Gallus)
  misc_feature (36): n=a or g
gcgatgctgcaggtgcttgaagatgatgagccctgnaaactaatcctgcactacagatgtgtccttctccc

SEQ ID NO: 18791 - DNA, 71 bp, chicken (Gallus Gallus)
  misc_feature (36): n=a or g
tgtattagggaaataaatgtcacatataggaagacnaaagagttttgcacagaagttaccctattccttcc

SEQ ID NO: 18792 - DNA, 71 bp, chicken (Gallus Gallus)
  misc_feature (36): n=c or t
gggtagccacccttaaaagcatcagagctcacacangtggaaagcactctccagcatcagctttcccccca

SEQ ID NO: 18793 - DNA, 71 bp, chicken (Gallus Gallus)
  misc_feature (36): n=a or g
aggatgtggaatatacgtatgagctgcagagctcgngtaggtttctgtttgctccaaaggaggacacaaac

SEQ ID NO: 18794 - DNA, 71 bp, chicken (Gallus Gallus)
  misc_feature (36): n=c or t
taagacaaacatagctattgccttggcttttgctcnactgttatcattaagcacgaaaagcacatggataa

SEQ ID NO: 18795 - DNA, 71 bp, chicken (Gallus Gallus)
  misc_feature (36): n=a or t
cgaatcctgtccaaagtgtcatgaaacccttactcnagttgttaggtctggatttgtcatcaaatacttca

SEQ ID NO: 18796 - DNA, 71 bp, chicken (Gallus Gallus)
  misc_feature (36): n=a or t
aattatgaactgcaacttgtataaatcattgcaaanactcccttctagccctggcagtatacaatgaaatc

SEQ ID NO: 18797 - DNA, 71 bp, chicken (Gallus Gallus)
  misc_feature (36): n=c or t
agctcactggggctctccccacttcacaaaaacaanctagacattttgttccaaacttcgcttgagagaag

SEQ ID NO: 18798 - DNA, 71 bp, chicken (Gallus Gallus)
  misc_feature (36): n=a or c
atccaatccaaatctcccctcctttagtttgaaacnatttccctcgtcctgtctgtcccattccttcttac

SEQ ID NO: 18799 - DNA, 71 bp, chicken (Gallus Gallus)
  misc_feature (36): n=a or c
agaaagagggaagacaaattaagaaaaaacaacatnaaaccaaccaagaacagaagctagtgcaagcgtaa

SEQ ID NO: 18800 - DNA, 71 bp, chicken (Gallus Gallus)
  misc_feature (36): n=a or g
ttgttttttgtttgctttttcttttgcagtgtacantgcccattgacaaagctgataccttttgtttgaca

SEQ ID NO: 18801 - DNA, 71 bp, chicken (Gallus Gallus)
  misc_feature (36): n=c or t
atattgtacagccatatttgacttcacttgagaggnagtcatgagataacctgtatagagagcatatgagg

SEQ ID NO: 18802 - DNA, 71 bp, chicken (Gallus Gallus)
  misc_feature (36): n=a or g
gttccattcctcatcccttagtttacagtaaagttnatcagaggttcgtcacagagcagagtttcagattt

SEQ ID NO: 18803 - DNA, 71 bp, chicken (Gallus Gallus)
  misc_feature (36): n=c or t
aaagcagccaacagcagatgttgaactaatgagctncagaggtgacacaagggactatctgtcattgcggc

SEQ ID NO: 18804 - DNA, 71 bp, chicken (Gallus Gallus)
  misc_feature (36): n=a or g
tccttttcttatacagatggacaaagacagaaagtntgtagtcttgtgggatcactactttatctcacaga

SEQ ID NO: 18805 - DNA, 71 bp, chicken (Gallus Gallus)
  misc_feature (36): n=g or t
tgtaaccagtgcatgctgtgggatttctcggagacnaggagaactggaaacactctctagtttgcttgtgc

SEQ ID NO: 18806 - DNA, 71 bp, chicken (Gallus Gallus)
  misc_feature (36): n=c or t
tggcattgaaataaactgggttctcatgctgtgcangttgttggaatatgcaagagatatatctgcacacg

SEQ ID NO: 18807 - DNA, 71 bp, chicken (Gallus Gallus)
  misc_feature (36): n=a or t
ttgtctaaaactgttgaagatcccttctaagaccantttttttatagtgtttgctgcaatgatttggaatc

SEQ ID NO: 18808 - DNA, 71 bp, chicken (Gallus Gallus)
  misc_feature (36): n=a or g
ggaagattagctcggtgtgctgtggtggcattgtcnggctccagtgttcaaaagaatagaatggtccagtt

SEQ ID NO: 18809 - DNA, 71 bp, chicken (Gallus Gallus)
  misc_feature (36): n=a or g
ggctcatgttctgccatgctaggctccatggacacnttcagcaaagggtagtgaccagcactggcacatct

SEQ ID NO: 18810 - DNA, 71 bp, chicken (Gallus Gallus)
  misc_feature (36): n=a or g
ggattttccttttggaatttcaaaatagaaaaaggnaaagaaagataaaaggaaaaaaaggctaatatggc

SEQ ID NO: 18811 - DNA, 71 bp, chicken (Gallus Gallus)
  misc_feature (36): n=a or g
cttaaccatggaatacacttacaagttctatgaacntatgcctttaagacacgggtcaagcaggttaagcc

SEQ ID NO: 18812 - DNA, 71 bp, chicken (Gallus Gallus)
  misc_feature (36): n=c or t
tttattttaaaaatagaaatctctccatcaaaatantttgttgatgaaagtgacacgaaactggcatgtaa

SEQ ID NO: 18813 - DNA, 71 bp, chicken (Gallus Gallus)
  misc_feature (36): n=a or t
attcctgacaggaactcagtggcttttttaaagccnagtcaattccaaaccagtatttcttgaatcaagac

SEQ ID NO: 18814 - DNA, 71 bp, chicken (Gallus Gallus)
  misc_feature (36): n=c or t
ttgtaagtcgtcttgcaagctcataggaataaatgncttgaacatatttattagttaattgatttgattct

SEQ ID NO: 18815 - DNA, 71 bp, chicken (Gallus Gallus)
  misc_feature (36): n=c or t
acctgagctaccaccctccctggctcctggctacangctgactcctagagtgaacccaataatatggcaaa

SEQ ID NO: 18816 - DNA, 71 bp, chicken (Gallus Gallus)
  misc_feature (36): n=c or t
agtatctggtttaagcaagtgccggctcacctaccntagcccaaagattcccaaattgagatgcactaggc

SEQ ID NO: 18817 - DNA, 71 bp, chicken (Gallus Gallus)
  misc_feature (36): n=c or t
ttatcctctcttctatattgggcttctggtacactnttatgccttttgtgtctctattatcagaaaagaat

SEQ ID NO: 18818 - DNA, 71 bp, chicken (Gallus Gallus)
  misc_feature (36): n=a or g
ctcacaagaaattaatcattaattaccacattctcncactaacctggaggaggatttaagtagacactatt

SEQ ID NO: 18819 - DNA, 71 bp, chicken (Gallus Gallus)
  misc_feature (36): n=a or g
acactggctaaactcacaagaaaatatcatagtacntctctaaaacctcaatatgcacaggcagctctgtc

SEQ ID NO: 18820 - DNA, 71 bp, chicken (Gallus Gallus)
  misc_feature (36): n=c or t
ctcttcaggtgagtctcattgctccatgaaccaacnggtaggtgaaaaccatctgggaagctcaggaaaac

SEQ ID NO: 18821 - DNA, 71 bp, chicken (Gallus Gallus)
  misc_feature (36): n=a or g
tgtctttgactgccttactctctttacatctcaccntgccaagagcctgggtagcttttgaacacaaagtg

SEQ ID NO: 18822 - DNA, 71 bp, chicken (Gallus Gallus)
  misc_feature (36): n=c or t
tgttgctttcaaacataaatcatcaaatctttttanaggggatggaaattacctggcctgtgggctggcta

SEQ ID NO: 18823 - DNA, 71 bp, chicken (Gallus Gallus)
  misc_feature (36): n=c or t
aaaaaataccattatatggaatcagtatccaagcantcttcactgtgagacacaaaagcagaggtttttcc

SEQ ID NO: 18824 - DNA, 71 bp, chicken (Gallus Gallus)
  misc_feature (36): n=g or t
gtttggggtgggggagaaaattggaataactaatcntggaacagggaaagacaacctgatgaacagtacag

SEQ ID NO: 18825 - DNA, 71 bp, chicken (Gallus Gallus)
  misc_feature (36): n=c or t
aggcacccacattttctgcatccaagaagaccaacntatagcctggcgagatcacaagtgctgtagcattt

SEQ ID NO: 18826 - DNA, 71 bp, chicken (Gallus Gallus)
  misc_feature (36): n=c or t
gcacacctctacgaaaggttcttataagagcagtcncccccagtgcatcaaacacgtgtgctgccattctc

SEQ ID NO: 18827 - DNA, 71 bp, chicken (Gallus Gallus)
  misc_feature (36): n=a or c
ctgtttaatgctttttttttttccatttcctgcccnaaaagcttaaattctgctggatgaagcccattata

SEQ ID NO: 18828 - DNA, 71 bp, chicken (Gallus Gallus)
  misc_feature (36): n=a or g
taaataggaaaacaaaactgccttttactaaaaaanttaaaattaaaagcagaagcatttttctaaggaag

SEQ ID NO: 18829 - DNA, 71 bp, chicken (Gallus Gallus)
  misc_feature (36): n=a or g
ttaataaggaatggaaatcagtgggttccctctgtnctctcattactttttaattactgaagaattaataa

SEQ ID NO: 18830 - DNA, 71 bp, chicken (Gallus Gallus)
  misc_feature (36): n=a or t
tctgtaatttatttaaccaataaacacttgaaatantaatgtaggtgcttcagagccctgaacactttgca

SEQ ID NO: 18831 - DNA, 71 bp, chicken (Gallus Gallus)
  misc_feature (36): n=a or g
gtcagagggttttttgagaagctcccacaggcttgnaagtggagtccagtccttggtgcagtcagtaggtg

SEQ ID NO: 18832 - DNA, 71 bp, chicken (Gallus Gallus)
  misc_feature (36): n=a or g
tttggccaaatatttcttttgtagatagaagatgcnatgagggaaaaatggataaagaacattatagaaat

SEQ ID NO: 18833 - DNA, 71 bp, chicken (Gallus Gallus)
  misc_feature (36): n=a or g
attttatagccctttgtgcactgagtgggatccacnattcaccttagcaaaaagaaatgagagacaaacgt

SEQ ID NO: 18834 - DNA, 71 bp, chicken (Gallus Gallus)
  misc_feature (36): n=c or g
attttaattcatttctagctctactgttattgaaanagttttagtatatctccaacccataccagtcagaa

SEQ ID NO: 18835 - DNA, 71 bp, chicken (Gallus Gallus)
  misc_feature (36): n=c or t
tcttacagatgcaagtaagaacactggaacgaccantgaggcactttatttcacaattaaaaaagaaaagg

SEQ ID NO: 18836 - DNA, 71 bp, chicken (Gallus Gallus)
  misc_feature (36): n=a or g
ctggaacgggataagaggcttaacgcgctcacaggncttcagtgtgccagcgagtagaaggtgttatcatt

SEQ ID NO: 18837 - DNA, 71 bp, chicken (Gallus Gallus)
  misc_feature (36): n=c or t
actattaaatttagtatgagacaggaatgttagtcnaagaaaagaaaaaagatctgaaaagtctggctaat

SEQ ID NO: 18838 - DNA, 71 bp, chicken (Gallus Gallus)
  misc_feature (36): n=a or g
caacagtaagtgacctctcttctgagccttcataanagaagcagcaagaagagaggtttgtggcagggccc

SEQ ID NO: 18839 - DNA, 71 bp, chicken (Gallus Gallus)
  misc_feature (36): n=a or g
aaattccattaagctgaagaaggggtttatgactcngacgtatctgtggcatggcaaataaaaaagtgcaa

SEQ ID NO: 18840 - DNA, 71 bp, chicken (Gallus Gallus)
  misc_feature (36): n=a or c
taatattgccttgtcgtgatctcaatgaaagtcttncacacagttatttttccactatcttgtgaagcaga

SEQ ID NO: 18841 - DNA, 71 bp, chicken (Gallus Gallus)
  misc_feature (36): n=a or g
gccctgagaaaccagagagcacccaaagagttttcntgtacacgttaattgttgatgcatcgccatttggg

SEQ ID NO: 18842 - DNA, 71 bp, chicken (Gallus Gallus)
  misc_feature (36): n=c or t
aattggttatcacagttgtaacttataccctgttcntcaatcagagttgtttccgcagaagtatctatagc

SEQ ID NO: 18843 - DNA, 71 bp, chicken (Gallus Gallus)
  misc_feature (36): n=c or t
cctcacacagatgagtgcaatgacttcagagacttngtggcccgaaagggacgcactgctttcgtttcagc

SEQ ID NO: 18844 - DNA, 71 bp, chicken (Gallus Gallus)
  misc_feature (36): n=c or t
gtgaactttcttttttagcatgtaagatctattcancatacaggaactacggagagttggcataaatgtgt

SEQ ID NO: 18845 - DNA, 71 bp, chicken (Gallus Gallus)
  misc_feature (36): n=c or t
tggaaaaatgccctctcagagcatgcttgatgcctnccagtggctaacgttcattgagcttttctgatcag

SEQ ID NO: 18846 - DNA, 71 bp, chicken (Gallus Gallus)
  misc_feature (36): n=c or g
tcaaagtcctgtaagaccaggtgtcatgagttgttntaatcacctgatacctgtcctcttcgtatttctgt

SEQ ID NO: 18847 - DNA, 71 bp, chicken (Gallus Gallus)
  misc_feature (36): n=a or t
cgaaaaaacttatatcattcattattatgcagcttncgcattgcaaaacacaatttatagctaaaaactcg

SEQ ID NO: 18848 - DNA, 71 bp, chicken (Gallus Gallus)
  misc_feature (36): n=a or c
tggggtgacatcagagagcacctgcttaatgtcagncacagttactgtcagctttgtgcactagttatcag

SEQ ID NO: 18849 - DNA, 71 bp, chicken (Gallus Gallus)
  misc_feature (36): n=a or g
ttgtctagtcttcttctctgcctttgataagctaanaagtattagcatactttatttaggttataattcat

SEQ ID NO: 18850 - DNA, 71 bp, chicken (Gallus Gallus)
  misc_feature (36): n=a or g
acagctgagagaaatctggtattatttacaggcctnaagtaaaaaaaaaaaaaaaaaaaaaaaaaaaaaaa

SEQ ID NO: 18851 - DNA, 71 bp, chicken (Gallus Gallus)
  misc_feature (36): n=c or t
ttagaaatgctgcattttgacacggaatagaaatcngtgcattttccgagtactttccaaataccttttct

SEQ ID NO: 18852 - DNA, 71 bp, chicken (Gallus Gallus)
  misc_feature (36): n=c or t
cagagggaggagttagatggctgtgggtatttccgntgtgaaagcttcagtatcatgtaattggttttctg

SEQ ID NO: 18853 - DNA, 71 bp, chicken (Gallus Gallus)
  misc_feature (36): n=a or g
tcgagttccctcagctcttgacatgcatcccatctngtctcttggacttgtgtatttccagattgcttgtg

SEQ ID NO: 18854 - DNA, 71 bp, chicken (Gallus Gallus)
  misc_feature (36): n=a or c
tgaagagcagtaggtattaattggccacagatgaanattatgtaaaaatctggaaaattataaatatatga

SEQ ID NO: 18855 - DNA, 71 bp, chicken (Gallus Gallus)
  misc_feature (36): n=c or t
tgtctggcaggatgtcgcgcacactgcagctggganatgtaacctatacaccatctcaaatgcccataggt

SEQ ID NO: 18856 - DNA, 71 bp, chicken (Gallus Gallus)
  misc_feature (36): n=a or g
tagaaaggaataaaaagtatgattaaaaaatgatanagataatatctagggcaagccacgcaaacaactgc

SEQ ID NO: 18857 - DNA, 71 bp, chicken (Gallus Gallus)
  misc_feature (36): n=a or t
aatgtgctagggagcagtcctgttttaggcctgtgnttccagacagtgctacactacactgtaagctgctt

SEQ ID NO: 18858 - DNA, 71 bp, chicken (Gallus Gallus)
  misc_feature (36): n=a or g
catctagaatcctaaaactactatgacactcataancatagaaatttttttaccgacagtttgatgtcatg

SEQ ID NO: 18859 - DNA, 71 bp, chicken (Gallus Gallus)
  misc_feature (36): n=a or c
aaacaagtgttcttctttatcttctttttggtgttnctgtaacaagcacagtaatatagagagaggaaaca

SEQ ID NO: 18860 - DNA, 71 bp, chicken (Gallus Gallus)
  misc_feature (36): n=c or t
ggctggcagggacacaatgtagaagtaaacatatanggggtatgagaaccctgtatctcggaggccagaaa

SEQ ID NO: 18861 - DNA, 71 bp, chicken (Gallus Gallus)
  misc_feature (36): n=g or t
ttgcaggtatcagaagcaaagaaacaccactcagtnggttggaaatgttgtgaaaagcaaaactgtctgaa

SEQ ID NO: 18862 - DNA, 71 bp, chicken (Gallus Gallus)
  misc_feature (36): n=c or t
aaaaagcaaatgtttcagagtttttatgcaaacttngacttgttgcaatatacagcaaaagcttgccaatt

SEQ ID NO: 18863 - DNA, 71 bp, chicken (Gallus Gallus)
  misc_feature (36): n=c or t
aggaaggtgaagatttaggcctaacgtgttcgactntttcaaactagtgtgcatacagtatgttgcaggca

SEQ ID NO: 18864 - DNA, 71 bp, chicken (Gallus Gallus)
  misc_feature (36): n=c or t
ttggacaagcaagcaaaacaacttgagctcactgtnactcttccaaggttcactttcagatgcctttatgt

SEQ ID NO: 18865 - DNA, 71 bp, chicken (Gallus Gallus)
  misc_feature (36): n=a or t
tctttatggttttccagtttgtttatagaacgtgcncatgttatacctagaatgaatttgatacttgtact

SEQ ID NO: 18866 - DNA, 71 bp, chicken (Gallus Gallus)
  misc_feature (36): n=c or t
ggtttaacccccacctgcagccctcgatagctgccnttcacctctttatttcactctgcatactattagct

SEQ ID NO: 18867 - DNA, 71 bp, chicken (Gallus Gallus)
  misc_feature (36): n=c or t
aagcattatgttaattcacttagctcaagtcaaagnccaaaaacttttaaaccagttctaaaaaattctat

SEQ ID NO: 18868 - DNA, 71 bp, chicken (Gallus Gallus)
  misc_feature (36): n=a or g
gccaaggaaaacacattctcaaaatccaaattctcntaatttacaccaccttgcagttgcttggacatgca

SEQ ID NO: 18869 - DNA, 71 bp, chicken (Gallus Gallus)
  misc_feature (36): n=a or g
tattgtggatatgctgggagtgggtgaaagaagacnttatttcaaattgttaggttacttgcattataaaa

SEQ ID NO: 18870 - DNA, 71 bp, chicken (Gallus Gallus)
  misc_feature (36): n=a or g
tttttttttttttctttattcactcacttaaaaatntcttacagtagtcccatgaacgatcccatggacag

SEQ ID NO: 18871 - DNA, 71 bp, chicken (Gallus Gallus)
  misc_feature (36): n=a or g
aactcggacaaattctcactcactctagttgcaggnaaaaaaaaagctatttatttagcttcatctcaagg

SEQ ID NO: 18872 - DNA, 71 bp, chicken (Gallus Gallus)
  misc_feature (36): n=a or g
aacacagctcactgttcaagaatgtatatttggatntctacagcagaaggcaattttctgcacgtggccat

SEQ ID NO: 18873 - DNA, 71 bp, chicken (Gallus Gallus)
  misc_feature (36): n=c or t
aatttgagcaactttagtacagaaatggacaaaatnctacccttgattcaaagcttcaaaggagtaaagtg

SEQ ID NO: 18874 - DNA, 71 bp, chicken (Gallus Gallus)
  misc_feature (36): n=c or t
ccaggactgaacatagagagattcttatgacgtctngtgatctcccagcacactccatgagaatctcagct

SEQ ID NO: 18875 - DNA, 71 bp, chicken (Gallus Gallus)
  misc_feature (36): n=a or t
tgtttgtgagggttttattaccatacgtgctggccnctgatcaactggaacccaacgagcttgaagtgtca

SEQ ID NO: 18876 - DNA, 71 bp, chicken (Gallus Gallus)
  misc_feature (36): n=a or g
ctatagaccagaaactagagggacatcaagtttccntattatttttagtgcttatagccaaggacaaagag

SEQ ID NO: 18877 - DNA, 71 bp, chicken (Gallus Gallus)
  misc_feature (36): n=a or g
ataatcaaggaggtaaagcgaaaagcatggcactcnaggcagggcaatagaagcatcctagcaacaatcca

SEQ ID NO: 18878 - DNA, 71 bp, chicken (Gallus Gallus)
  misc_feature (36): n=g or t
tcttttaatgaaaatgtcttaagacatttaaagacngggagttaagacaggctcagatgtccacatgaatg

SEQ ID NO: 18879 - DNA, 71 bp, chicken (Gallus Gallus)
  misc_feature (36): n=a or g
ccaacaatgccacggcacaatttctggaaaatcaancccttggtgaagtcgttatgtgccaagtatggagt

SEQ ID NO: 18880 - DNA, 71 bp, chicken (Gallus Gallus)
  misc_feature (36): n=c or t
gagaaagagtatcctgaaacagatgcctcaatgaangcctgaaattaatttcccattgaaaccaaacttgg

SEQ ID NO: 18881 - DNA, 71 bp, chicken (Gallus Gallus)
  misc_feature (36): n=c or t
aaaggctagtgcagaaccaacacacagctcgtgaangtggattttgaaaagacaatttgactgcttcagaa

SEQ ID NO: 18882 - DNA, 71 bp, chicken (Gallus Gallus)
  misc_feature (36): n=a or g
tgttccacaccaaagtaggcaaagatgtctagtcancatccaggatttaggcactgaaatttgaaagcaga

SEQ ID NO: 18883 - DNA, 71 bp, chicken (Gallus Gallus)
  misc_feature (36): n=a or t
aaagaactaaaatggataaaagtcagtgttaaaaantaaatgatatgtgaatgtaactggccattcacagc

SEQ ID NO: 18884 - DNA, 71 bp, chicken (Gallus Gallus)
  misc_feature (36): n=c or g
tgagagctttagtgtgtagagccatcacactgcgangccagaacagcttggccacccaaaactctataacc

SEQ ID NO: 18885 - DNA, 71 bp, chicken (Gallus Gallus)
  misc_feature (36): n=c or t
aggtagcctttgctatgatgtatctggaccctgtanctacattttcttccacatgtgatgcttcaaaaaga

SEQ ID NO: 18886 - DNA, 71 bp, chicken (Gallus Gallus)
  misc_feature (36): n=a or g
aactctcttcagtagaaatcagaataagcagttctncattagctcttagttgtcagaactggagctttcta

SEQ ID NO: 18887 - DNA, 71 bp, chicken (Gallus Gallus)
  misc_feature (36): n=a or g
aaaattttggaatgggaacatgtaattaggaaaacncaattagatttgatgtgaaaacaggagggggattc

SEQ ID NO: 18888 - DNA, 71 bp, chicken (Gallus Gallus)
  misc_feature (36): n=c or t
cagaaacttcatctcctaatgtaacttcagcacagnacagagcaaagcgtcagtgctccttaagtaaaaaa

SEQ ID NO: 18889 - DNA, 71 bp, chicken (Gallus Gallus)
  misc_feature (36): n=a or g
gtataatcaggaagtacagagttatctttgacatcnatggcactattggttttgccttcatatgcaccatt

SEQ ID NO: 18890 - DNA, 71 bp, chicken (Gallus Gallus)
  misc_feature (36): n=c or t
ttgaaattgttttattgggtaatataactaagtacngttttcttcaagcacagtcaggcacatcccacctg

SEQ ID NO: 18891 - DNA, 71 bp, chicken (Gallus Gallus)
  misc_feature (36): n=a or g
tgggaaaagatacgatgatttaccacatgggatctntaagggaagtatttttaatgctctgtagttttcac

SEQ ID NO: 18892 - DNA, 71 bp, chicken (Gallus Gallus)
  misc_feature (36): n=a or g
gctgtacctacactgagaaccctgtgctaaggcccnttgaactccaggcagactcagtggtggtcaagctg

SEQ ID NO: 18893 - DNA, 71 bp, chicken (Gallus Gallus)
  misc_feature (36): n=c or t
ttcatcggctgcctggagctggctaccctgaacgangatgtgatcagcctgtacaacttcaagcacgccta

SEQ ID NO: 18894 - DNA, 71 bp, chicken (Gallus Gallus)
  misc_feature (36): n=a or c
ctttaaaatctggttcatatgaagagcagtcagttnaaaaaccacaatataattggacggagaaagtgtta

SEQ ID NO: 18895 - DNA, 71 bp, chicken (Gallus Gallus)
  misc_feature (36): n=a or g
aaacagacattgaggtagggtaaaaatggaataggnatttgggagcgaagccagagcactgaacttgcaag

SEQ ID NO: 18896 - DNA, 71 bp, chicken (Gallus Gallus)
  misc_feature (36): n=g or t
aactgacgtagagactgtggctatgtgtttgcatgntctcccttggtccaacttcaggccatcacctctca

SEQ ID NO: 18897 - DNA, 71 bp, chicken (Gallus Gallus)
  misc_feature (36): n=c or t
tagaatatttcaaataacttttttgctctctacatngctggttaccttttggggattcatttctaattcat

SEQ ID NO: 18898 - DNA, 71 bp, chicken (Gallus Gallus)
  misc_feature (36): n=a or g
aaagaatacttttgcaaaaatgaaaatattggcaantggctgttatgataaaacttgcttcaaaatattgg

SEQ ID NO: 18899 - DNA, 71 bp, chicken (Gallus Gallus)
  misc_feature (36): n=a or c
aatcagcccagaaacaaaaactgaaagaggaaaggnagccacatttggtgatctaaacaaacaaggaaagc

SEQ ID NO: 18900 - DNA, 71 bp, chicken (Gallus Gallus)
  misc_feature (36): n=a or g
gggctgcacagagcccggcatttcttccagcatcantgccatttccatttggaaacttccagtccaacttg

SEQ ID NO: 18901 - DNA, 71 bp, chicken (Gallus Gallus)
  misc_feature (36): n=a or g
ctcaaaggaagatcaaacaggataagtcatctatantagcaggactgctagtgtggttacacaggctattt

SEQ ID NO: 18902 - DNA, 71 bp, chicken (Gallus Gallus)
  misc_feature (36): n=c or t
gggcttcaagcaacatcaagcaacaagtatcaaacnactacagtatcaagtaaggatggtgaattcatcag

SEQ ID NO: 18903 - DNA, 71 bp, chicken (Gallus Gallus)
  misc_feature (36): n=a or t
atatgcaacttgaataactgaagagctaggaacagnaagctcttgaagatattttagacacttaggctcta

SEQ ID NO: 18904 - DNA, 71 bp, chicken (Gallus Gallus)
  misc_feature (36): n=c or t
ttctctcagtagtactgaggtactacaccactaatnatggctctaatttctttgcattcccaaaactatgt

SEQ ID NO: 18905 - DNA, 71 bp, chicken (Gallus Gallus)
  misc_feature (36): n=a or c
gcagaaacctctgcgcttgcggctgctgtggaacancacttcttcctgtaatgcatcttcagggccaggaa

SEQ ID NO: 18906 - DNA, 71 bp, chicken (Gallus Gallus)
  misc_feature (36): n=c or t
aagcaaagctattccagcacatgcaccaaaaagcgnagagcctgttacctcagtcagactaccaatagaca

SEQ ID NO: 18907 - DNA, 71 bp, chicken (Gallus Gallus)
  misc_feature (36): n=c or t
cagagatagtattgaacctttcaagtatgatccaanatttagtttccacctcagatttccttctggtttct

SEQ ID NO: 18908 - DNA, 71 bp, chicken (Gallus Gallus)
  misc_feature (36): n=c or g
taactccccagtggacatcaccaagaaagatcactnatgctgaagtcacaagggaaagaagggtagcaatg

SEQ ID NO: 18909 - DNA, 71 bp, chicken (Gallus Gallus)
  misc_feature (36): n=a or g
ataaaccttattaaactaaattatcaaagccactcnttttaggaatgatgtaaaaacctgaaggcttattg

SEQ ID NO: 18910 - DNA, 71 bp, chicken (Gallus Gallus)
  misc_feature (36): n=a or c
tactcttattcactccataacacccaactttacttnttttaggtaggcatttctcttctgagtatgccacc

SEQ ID NO: 18911 - DNA, 71 bp, chicken (Gallus Gallus)
  misc_feature (36): n=a or g
ttttgctctgtgtgtaggttcctaaaatgtaaaagngttggactattttgctagcaatactggtgaaacag

SEQ ID NO: 18912 - DNA, 71 bp, chicken (Gallus Gallus)
  misc_feature (36): n=c or t
ctggctctgtgacccaaccagcatggaccttcctcntctccatgggcactggagctgacaacactagcttg

SEQ ID NO: 18913 - DNA, 71 bp, chicken (Gallus Gallus)
  misc_feature (36): n=c or t
gaacttaactgtaaggctgctaaacagaaagataanggcaacttcatctgaaattactgatggaccttctg

SEQ ID NO: 18914 - DNA, 71 bp, chicken (Gallus Gallus)
  misc_feature (36): n=c or t
ctcaccagtgagcttttctgcttctagctagaactntggtcttccaacttctcattttacagtgacgccaa

SEQ ID NO: 18915 - DNA, 71 bp, chicken (Gallus Gallus)
  misc_feature (36): n=c or t
acaggtaggatgtctgtgctatacaaacggtaaggngatcagcttaagcatgctggcagggacaggagatt

SEQ ID NO: 18916 - DNA, 71 bp, chicken (Gallus Gallus)
  misc_feature (36): n=a or g
gcattatgtgcaatcagagaaagggatgacattttncaaagggtcagaaactttatttcatgcccaagtaa

SEQ ID NO: 18917 - DNA, 71 bp, chicken (Gallus Gallus)
  misc_feature (36): n=a or g
tcaatgacctccatcaatgacctgggtgatggatantatgcaccctcagcaattttcctgttggtaaaaat

SEQ ID NO: 18918 - DNA, 71 bp, chicken (Gallus Gallus)
  misc_feature (36): n=c or t
ttttttttttctgatcagtcttctggttttgacttngtttactactcctatcaggggttagtttggtatag

SEQ ID NO: 18919 - DNA, 71 bp, chicken (Gallus Gallus)
  misc_feature (36): n=a or g
tccttctgttgctagatcctgtttttcattttagtntatcacctcactttgataagattccagatcatctg

SEQ ID NO: 18920 - DNA, 71 bp, chicken (Gallus Gallus)
  misc_feature (36): n=a or g
tgaagagccagtgcttcttttcgttccttcctttcnttttctgcagattttcacctaaggaacgggccaac

SEQ ID NO: 18921 - DNA, 71 bp, chicken (Gallus Gallus)
  misc_feature (36): n=c or g
ttttccctggcatgttgtgtgttgatttggaatttnactgcagcgggctaactgctaataaaaataaatag

SEQ ID NO: 18922 - DNA, 71 bp, chicken (Gallus Gallus)
  misc_feature (36): n=a or g
tttctacgtcaagcaatcatgaatgcttccagtgcncacgctgctctaggaatgcatagcttatatttcac

SEQ ID NO: 18923 - DNA, 71 bp, chicken (Gallus Gallus)
  misc_feature (36): n=c or t
acacaacaacatgatctcaactctctgtgtggaaancatgggctctgagttcaatgttaccacttagcaat

SEQ ID NO: 18924 - DNA, 71 bp, chicken (Gallus Gallus)
  misc_feature (36): n=c or g
gagaagaagggttaacccaaaacctcagatttagcnatttggcagcaaactttgtacgtaaccaagactga

SEQ ID NO: 18925 - DNA, 71 bp, chicken (Gallus Gallus)
  misc_feature (36): n=a or g
aaagaattacgttagtctttgaatactggtctgcancgactacattcatttctcctgtgactagcacagta

SEQ ID NO: 18926 - DNA, 71 bp, chicken (Gallus Gallus)
  misc_feature (36): n=a or g
agctgcatatggagggacttgagcccctgcgccccnttcaccagaaggctcttaaaaccacgagagagcta

SEQ ID NO: 18927 - DNA, 71 bp, chicken (Gallus Gallus)
  misc_feature (36): n=a or g
agctctgtgctgcacagcagctgcagcatttctgcnctctgatccctaatcctgcctgaagtatgtgctgt

SEQ ID NO: 18928 - DNA, 71 bp, chicken (Gallus Gallus)
  misc_feature (36): n=c or t
tgcacaaagatatggtcagtcttgggactgaaaganggatcaacaacccaatttggcaaacatatttgaaa

SEQ ID NO: 18929 - DNA, 71 bp, chicken (Gallus Gallus)
  misc_feature (36): n=c or t
caaccccttgataaaaaggaaataaatttttgattngggacaaatatctgaacagaaagcacaccagaaca

SEQ ID NO: 18930 - DNA, 71 bp, chicken (Gallus Gallus)
  misc_feature (36): n=a or t
gctttcttacagccatagtacattggacctttcttnactgtggtcccagagcatggccaaacactggacta

SEQ ID NO: 18931 - DNA, 71 bp, chicken (Gallus Gallus)
  misc_feature (36): n=g or t
gacagctgtcaatactgtcaaaagctgccaatgagnctgtcatatttaaactttgctaaaccgcaataata

SEQ ID NO: 18932 - DNA, 71 bp, chicken (Gallus Gallus)
  misc_feature (36): n=c or t
tgatttaacaccttcaaataccttctacatccctangttatccacatcttctactgctttctaacaagttc

SEQ ID NO: 18933 - DNA, 71 bp, chicken (Gallus Gallus)
  misc_feature (36): n=c or t
agtgtcacgttaggaactgactttcaatgaaccagnagcactacaaaagcagaaccacaagagggtggaaa

SEQ ID NO: 18934 - DNA, 71 bp, chicken (Gallus Gallus)
  misc_feature (36): n=c or t
ccagtgctactaattctctcctctgtctcatgacangctatttcagttcccatggaaaggaccaatcctcc

SEQ ID NO: 18935 - DNA, 71 bp, chicken (Gallus Gallus)
  misc_feature (36): n=a or g
ctctgcacttcctgataataatgtataatgctgctntatgggaactgctgagtcacagcctgaaccgctaa

SEQ ID NO: 18936 - DNA, 71 bp, chicken (Gallus Gallus)
  misc_feature (36): n=c or t
cctgggaggatgctgctagctgacaaaagtatcttntatttgaaattataatatgcctgaaataatctaaa

SEQ ID NO: 18937 - DNA, 71 bp, chicken (Gallus Gallus)
  misc_feature (36): n=a or c
ctgttaaatgggagaggacattaagatccacctcancaagacttacagggtttcagtttttaagggataca

SEQ ID NO: 18938 - DNA, 71 bp, chicken (Gallus Gallus)
  misc_feature (36): n=a or g
cacaggctgcaggagaataattgtcaggagctttcnttgtttttattgggcttatttgcagacaggtttgc

SEQ ID NO: 18939 - DNA, 71 bp, chicken (Gallus Gallus)
  misc_feature (36): n=g or t
cagaagactatttgcagcagaccatctgttgactcntatcataacactattaaaaatgcaatctaaataaa

SEQ ID NO: 18940 - DNA, 71 bp, chicken (Gallus Gallus)
  misc_feature (36): n=a or g
tttactagagatgaagcatagagtgagtggaaaganacagagcagtcaaagagaaaacttctggattttgg

SEQ ID NO: 18941 - DNA, 71 bp, chicken (Gallus Gallus)
  misc_feature (36): n=g or t
tgcctgttttaaggacagcctgttgtcatgagaganaatctgtttcagtttcatcctgaagatacagatga

SEQ ID NO: 18942 - DNA, 71 bp, chicken (Gallus Gallus)
  misc_feature (36): n=a or g
aagggaaataaaagcacagagtccataataaagccngttacacattgaaataatagcactatccctagttg

SEQ ID NO: 18943 - DNA, 71 bp, chicken (Gallus Gallus)
  misc_feature (36): n=g or t
caattgccatgacaaattggcagttgtgaatcaganaatgattcagttgaaagaagtcaatgtctgaaagt

SEQ ID NO: 18944 - DNA, 71 bp, chicken (Gallus Gallus)
  misc_feature (36): n=c or g
gtcaatctaggcaaaagttagggagaaaaaaatgantaaaacagaagactgggaatcacgtggatgcagga

SEQ ID NO: 18945 - DNA, 71 bp, chicken (Gallus Gallus)
  misc_feature (36): n=a or g
aaatatttcacagcattgtataatccagtttcttgntgagaatcacgaagggaggtacataatatgaaggg

SEQ ID NO: 18946 - DNA, 71 bp, chicken (Gallus Gallus)
  misc_feature (36): n=a or g
ataaagtgttgttcataatatttgagtatttaattntgattctttccagtactgagcatagccacactaaa

SEQ ID NO: 18947 - DNA, 71 bp, chicken (Gallus Gallus)
  misc_feature (36): n=a or g
tgttgaacaaagtagtttgaaagcaacggatttctngatttccacattaaaagagctactgtttgattagc

SEQ ID NO: 18948 - DNA, 71 bp, chicken (Gallus Gallus)
  misc_feature (36): n=c or t
gttggggtgggttgtgctggggttggctgtgctccngctgtacctcttacaatggatttgtgtttgggaga

SEQ ID NO: 18949 - DNA, 71 bp, chicken (Gallus Gallus)
  misc_feature (36): n=a or g
tcttttttgcagtctatccagtgctgtggttgtacngaccagctccagtgcagaaggaaaactttccctgc

SEQ ID NO: 18950 - DNA, 71 bp, chicken (Gallus Gallus)
  misc_feature (36): n=c or t
aacaaactgctgtcccagactaccaaattcatttcnacatagaagataacatatcagaacagtcatttgtg

SEQ ID NO: 18951 - DNA, 71 bp, chicken (Gallus Gallus)
  misc_feature (36): n=a or t
actggggactgagggactgagatacaaacttggagnacaccaaggttcagcaacttgcctaaggtcacccg

SEQ ID NO: 18952 - DNA, 71 bp, chicken (Gallus Gallus)
  misc_feature (36): n=a or g
tttgacactgaaaaaataaatatagatgtaccaccngtgaatgcatgttatttcaggcaatccttgagcgt

SEQ ID NO: 18953 - DNA, 71 bp, chicken (Gallus Gallus)
  misc_feature (36): n=a or g
aaattttcctgacataggtgtcttttatttatttcnctgtaccactatagcagactattaactgacgttgc

SEQ ID NO: 18954 - DNA, 71 bp, chicken (Gallus Gallus)
  misc_feature (36): n=c or t
aaaggcagtaacagtaatagctgtaaatatgctatntgtgctatttgtagtgttgtaatagatatgcatat

SEQ ID NO: 18955 - DNA, 71 bp, chicken (Gallus Gallus)
  misc_feature (36): n=c or t
aatgctctttccaactgtactgtgttgactgtacanatgcctactgaaataatagcattagcctgttgggt

SEQ ID NO: 18956 - DNA, 71 bp, chicken (Gallus Gallus)
  misc_feature (36): n=c or t
gagcttagacaactcgacagcaaacaagcagaaganggggagattctgagcaggccagctccatgccaaga

SEQ ID NO: 18957 - DNA, 71 bp, chicken (Gallus Gallus)
  misc_feature (36): n=a or g
gcaagtttatggaagtcatgtgacttacaatttttntttgaattttgattgctattttgttaatcagcaaa

SEQ ID NO: 18958 - DNA, 71 bp, chicken (Gallus Gallus)
  misc_feature (36): n=a or g
aggaccaggcgtgagcacccctgggcacggctttcncaggtcgcctcttacctccctccctcagcatcaca

SEQ ID NO: 18959 - DNA, 71 bp, chicken (Gallus Gallus)
  misc_feature (36): n=c or t
ctttaaaaaggaagctgctagtgaaacacctggcantgaaggataaagacaggtggggtcagggaaacaac

SEQ ID NO: 18960 - DNA, 71 bp, chicken (Gallus Gallus)
  misc_feature (36): n=c or t
ctgcctgtcaaggtggaaggaccaagctgtgacaancacagcttcaatcaaaaacgctaaccctgagaccc

SEQ ID NO: 18961 - DNA, 71 bp, chicken (Gallus Gallus)
  misc_feature (36): n=a or g
aaaggccttttctagcttgatgtaaaacaaagacantttgactcctggtgagacaaccattgatgatgagg

SEQ ID NO: 18962 - DNA, 71 bp, chicken (Gallus Gallus)
  misc_feature (36): n=a or g
tcgggctgcctctgtgacagggcgtctgcatgtgcntgaagaaatgtgatttctcctctgtttccctttgc

SEQ ID NO: 18963 - DNA, 71 bp, chicken (Gallus Gallus)
  misc_feature (36): n=c or t
tgcatacaatggatctgttgcagatgttctctatcnttgcatatcttcttgaaagttaagagcatatatta

SEQ ID NO: 18964 - DNA, 71 bp, chicken (Gallus Gallus)
  misc_feature (36): n=g or t
cactttcagcctttgacaaatataaggtattctganaacttaccttaactcccaatgaaagagatttcagt

SEQ ID NO: 18965 - DNA, 71 bp, chicken (Gallus Gallus)
  misc_feature (36): n=c or t
tggactcagcaggtagctgcccctcacccataagangaattacaccagttccctcagaaacatattccagc

SEQ ID NO: 18966 - DNA, 71 bp, chicken (Gallus Gallus)
  misc_feature (36): n=a or g
aaaaaagaaacaacctagaacttgtgggtggtttantaagacagaaaaaaggaagagaaaaaggataatag

SEQ ID NO: 18967 - DNA, 71 bp, chicken (Gallus Gallus)
  misc_feature (36): n=a or c
agccaggccaacctcatctgagagactgcgtggccnaggactatgggactttccagacagaagatcaaatt

SEQ ID NO: 18968 - DNA, 71 bp, chicken (Gallus Gallus)
  misc_feature (36): n=a or g
aagttgtctctttgaaaaacaaaatatttaggcaanaaaaatctttccatgagacagcaatcacagaaata

SEQ ID NO: 18969 - DNA, 71 bp, chicken (Gallus Gallus)
  misc_feature (36): n=g or t
cttcctgaaggatttttgcaagtacttgtgatttgnaaggcctatgttgtgaaagaacagatgtaaatcgg

SEQ ID NO: 18970 - DNA, 71 bp, chicken (Gallus Gallus)
  misc_feature (36): n=a or c
tgatttttaaatattccagtggtgactctatacttncatgtttacacaggtcctgtgttagtgtattactg

SEQ ID NO: 18971 - DNA, 71 bp, chicken (Gallus Gallus)
  misc_feature (36): n=c or g
tttagaatatggcctggatattgtacaagactgctnagagtttaaaattattagaaattgtgttaaaattt

SEQ ID NO: 18972 - DNA, 71 bp, chicken (Gallus Gallus)
  misc_feature (36): n=a or t
ggaagaaaatcaagaaccaagaaggcatccagatanataacaaagggcatcatgcagtatgctcttaaatg

SEQ ID NO: 18973 - DNA, 71 bp, chicken (Gallus Gallus)
  misc_feature (36): n=a or g
ccaagcatcaaattgtacagttgacagtgctttagntgggagactagagcagttgaacttcagagatcctg

SEQ ID NO: 18974 - DNA, 71 bp, chicken (Gallus Gallus)
  misc_feature (36): n=a or g
cagagagaagagagatcacacagctctgaaaccccnaggattcaccatcttagaagggagacattaccata

SEQ ID NO: 18975 - DNA, 71 bp, chicken (Gallus Gallus)
  misc_feature (36): n=c or t
tctattttcatacttctagacagtaattggatatgngacgcggtgttttacaatgtagtatcatctactgt

SEQ ID NO: 18976 - DNA, 71 bp, chicken (Gallus Gallus)
  misc_feature (36): n=a or c
agctttacttttgtttaaaaaaatcaatatatgaangtgtaacaggttattatttgcagataacacaaaac

SEQ ID NO: 18977 - DNA, 71 bp, chicken (Gallus Gallus)
  misc_feature (36): n=g or t
taattttcaagagattgaggttatgtgtataagctntttttacaagtgacttgaaatacaattagtacttc

SEQ ID NO: 18978 - DNA, 71 bp, chicken (Gallus Gallus)
  misc_feature (36): n=a or t
cgaggtgatctgtatttgtctggaaagattgggaangggtgctgtaaggtatctttacattgcagctgtaa

SEQ ID NO: 18979 - DNA, 71 bp, chicken (Gallus Gallus)
  misc_feature (36): n=c or t
tgaatctcttgattttgtagctatgttaattggagntaatcattactatttaaactgtaagtgtaacaatc

SEQ ID NO: 18980 - DNA, 71 bp, chicken (Gallus Gallus)
  misc_feature (36): n=c or t
taaatctggaatgaaaaattaatcctttttacagcnttggagatcatgaataacaggaaaaggaaaaacaa

SEQ ID NO: 18981 - DNA, 71 bp, chicken (Gallus Gallus)
  misc_feature (36): n=g or t
aaaatttgcaatttcgtgatacaaaagttataggtngtaaattggtgaggacaacttgtaaaatgaatgct

SEQ ID NO: 18982 - DNA, 71 bp, chicken (Gallus Gallus)
  misc_feature (36): n=a or g
ccaaaaccaggaacagaatgagaagatctagccaanctcagaaacaaacacagatttcatgggcaagtagt

SEQ ID NO: 18983 - DNA, 71 bp, chicken (Gallus Gallus)
  misc_feature (36): n=c or t
cctagagaaaaagcactcgtttgaaaaagagagganggaagccacgtgaacctgctgagataacattgaag

SEQ ID NO: 18984 - DNA, 71 bp, chicken (Gallus Gallus)
  misc_feature (36): n=c or t
atggtgcatgaagatgaatgatgcttttctttaaantcctcagggagtttccctgacagcacagagagctg

SEQ ID NO: 18985 - DNA, 71 bp, chicken (Gallus Gallus)
  misc_feature (36): n=a or g
gctttcccacatgcatccttcaaaggtacagagatncttcaaaggttatttaatgaatgtctgcatgctgt

SEQ ID NO: 18986 - DNA, 71 bp, chicken (Gallus Gallus)
  misc_feature (36): n=a or g
cgtagcctaagcaaaatgcacctttcctttagcatnaggtatctccttctacctgtactgtatttgaatac

SEQ ID NO: 18987 - DNA, 71 bp, chicken (Gallus Gallus)
  misc_feature (36): n=a or g
agcgagtcagtaagctacgaaatgatgtgggtaggnaagaaagtctgcctctctctttgaagctaggtcac

SEQ ID NO: 18988 - DNA, 71 bp, chicken (Gallus Gallus)
  misc_feature (36): n=g or t
tcctgtggaggaagatatcatctcagttatttgtgnctttctactggtttgtcagtaactattttaatttt

SEQ ID NO: 18989 - DNA, 71 bp, chicken (Gallus Gallus)
  misc_feature (36): n=c or g
tagagtactgaagctctgtacagactttgaattcanatcaaaaagtataggatggaaaacgttccctaacc

SEQ ID NO: 18990 - DNA, 71 bp, chicken (Gallus Gallus)
  misc_feature (36): n=a or g
ctgtgtaaaaattcaataataaaaaatgtgctacantggccctgcctgttatttgtggcatgcctttgttg

SEQ ID NO: 18991 - DNA, 71 bp, chicken (Gallus Gallus)
  misc_feature (36): n=c or t
cttgctgcttcacataaattgccagtggggaaaaanagtttgtaattctgtttcagaacttggaagtacca

SEQ ID NO: 18992 - DNA, 71 bp, chicken (Gallus Gallus)
  misc_feature (36): n=a or g
agatcaggtggcaacactttatataaaactcatttngaaaggaatgggtaacttcatgcaaaagtgggggg

SEQ ID NO: 18993 - DNA, 71 bp, chicken (Gallus Gallus)
  misc_feature (36): n=a or g
caccaacaggttatacttaaataagaaatcctaccnaaagcaatctaagctgcatttctgcctaagaagaa

SEQ ID NO: 18994 - DNA, 71 bp, chicken (Gallus Gallus)
  misc_feature (36): n=g or t
atgccttgcactctgatctggaagagcttctgttgnttcttggtattgcaggaatgaaaggaatcaagtag

SEQ ID NO: 18995 - DNA, 71 bp, chicken (Gallus Gallus)
  misc_feature (36): n=a or c
aaagaagaagaaaaacatctccaaactatatgatanggcagatcagagtgtttctccctgactaatacatg

SEQ ID NO: 18996 - DNA, 71 bp, chicken (Gallus Gallus)
  misc_feature (36): n=c or g
tgtttagggaattaggcagtgaataatacctaccantctgcttttctggaatatggccttttgcactgtca

SEQ ID NO: 18997 - DNA, 71 bp, chicken (Gallus Gallus)
  misc_feature (36): n=c or t
ctcaataaaaacaaaaataaaaatatctacaatccnacaacctccgtttggagaattcaatgttatgatga

SEQ ID NO: 18998 - DNA, 71 bp, chicken (Gallus Gallus)
  misc_feature (36): n=c or t
tgcagcaggcaagcagaaaaagaagggaattgtggngttgcagctattcgttgcatgtaagcgagaatagt

SEQ ID NO: 18999 - DNA, 71 bp, chicken (Gallus Gallus)
  misc_feature (36): n=c or t
aggacagaattcactgttcagctccagaatggttangtggattttactaataaaaggatactgtactttag

SEQ ID NO: 19000 - DNA, 71 bp, chicken (Gallus Gallus)
  misc_feature (36): n=a or g
tgtaacccatgctagtacattacaatgcatcaagantagtaatggaaactctctggggtgctacagcatgc

SEQ ID NO: 19001 - DNA, 71 bp, chicken (Gallus Gallus)
  misc_feature (36): n=a or c
atatgtaccatcaacaccttgtgtaccaagaaaggntggcatattgataggattggccttattaagttact

SEQ ID NO: 19002 - DNA, 71 bp, chicken (Gallus Gallus)
  misc_feature (36): n=c or g
ctcctgagcttggaattcgactttgtagtttggatntcataaagatagctgaaacagtttctctgcaaatg

SEQ ID NO: 19003 - DNA, 71 bp, chicken (Gallus Gallus)
  misc_feature (36): n=a or g
actctcatgcacacattcttgggaaaaaagaaactntttactttatttagcagtgtggctaagcaagcaat

SEQ ID NO: 19004 - DNA, 71 bp, chicken (Gallus Gallus)
  misc_feature (36): n=c or t
gggaagcaattcagtgagagcagataaggacaatgntatgtattcttcaaaagcagtggaccaaaatctct

SEQ ID NO: 19005 - DNA, 71 bp, chicken (Gallus Gallus)
  misc_feature (36): n=c or t
tgtacaaaagggtgtacaagaaaaatgagccagaantgaaatgcaagttttaaaaataaaaatatttttat

SEQ ID NO: 19006 - DNA, 71 bp, chicken (Gallus Gallus)
  misc_feature (36): n=c or t
ccaagcctgccatgtctggtgagtgcagtgaatctngtgttactgatgtcctgtctgtccttccctaggcg

SEQ ID NO: 19007 - DNA, 71 bp, chicken (Gallus Gallus)
  misc_feature (36): n=c or t
aaggtggaaagcaggtactcggctgtgtctggtttngagctgtcatatcctgcgtacacgatctccggttc

SEQ ID NO: 19008 - DNA, 71 bp, chicken (Gallus Gallus)
  misc_feature (36): n=c or g
aggaacagtaattggcctgggtttgagagtggtgtntgactttcccagtaatctgaagtgatcatttccca

SEQ ID NO: 19009 - DNA, 71 bp, chicken (Gallus Gallus)
  misc_feature (36): n=a or g
acacaaagtcttttcagcttttcaaagattttttanaaagctgagaatgaaatgctctttggtccagaccc

SEQ ID NO: 19010 - DNA, 71 bp, chicken (Gallus Gallus)
  misc_feature (36): n=c or t
acgcccatatgactacttctctttttactgacaganttctaagaaagctagggttacgaaaggctctatcc

SEQ ID NO: 19011 - DNA, 71 bp, chicken (Gallus Gallus)
  misc_feature (36): n=a or g
cttttgacttcttccaggcagttttacataactggnatttcgttaatctccagtttctcatttaagaacga

SEQ ID NO: 19012 - DNA, 71 bp, chicken (Gallus Gallus)
  misc_feature (36): n=a or g
agtaaattaacagtcactgataagattagactctcnattcaaacttagaaaaacaaactatttcccttgcc

SEQ ID NO: 19013 - DNA, 71 bp, chicken (Gallus Gallus)
  misc_feature (36): n=a or c
atgatgcctgcagggcatgctggatggagaccctgngtctctttatccctcactccacagccgaaagaggg

SEQ ID NO: 19014 - DNA, 71 bp, chicken (Gallus Gallus)
  misc_feature (36): n=c or t
taatctaaatctcccctcctttcacggcacaacaangtacagccttaaagaggtagctacaggttagcaac

SEQ ID NO: 19015 - DNA, 71 bp, chicken (Gallus Gallus)
  misc_feature (36): n=c or t
ataagcttcataggtcaactgcgatgctactcttcntgtttaaatataagtcataaattatatttggagtg

SEQ ID NO: 19016 - DNA, 71 bp, chicken (Gallus Gallus)
  misc_feature (36): n=a or t
ttcctcatatcaaactgtccatctcagggcaaaatnctcagaaagtttcagtcatagaatggctgtgattg

SEQ ID NO: 19017 - DNA, 71 bp, chicken (Gallus Gallus)
  misc_feature (36): n=c or g
ttttatgaagatggagtcccatcacttcagggcagngatagagaagactcaggagaatattattttaataa

SEQ ID NO: 19018 - DNA, 71 bp, chicken (Gallus Gallus)
  misc_feature (36): n=a or c
acatataagtgatcttgagcaatttctgcaggactncccttcctagatctttcattagaagcatccatttt

SEQ ID NO: 19019 - DNA, 71 bp, chicken (Gallus Gallus)
  misc_feature (36): n=a or t
gagaactcatgaaagacttcaagcaacaactctggntactctacagaaaaataaagaagaaatagcctttg

SEQ ID NO: 19020 - DNA, 71 bp, chicken (Gallus Gallus)
  misc_feature (36): n=a or g
aagagaaacaaaacgatgtgtgtgttatctgccaangctgtcttgaccacatcaactctctgggatgttgc

SEQ ID NO: 19021 - DNA, 71 bp, chicken (Gallus Gallus)
  misc_feature (36): n=a or g
tctagatgtgaggtttgtataatattcagactgtcncttcttaaaaattgtgtctgtctttctacccaact

SEQ ID NO: 19022 - DNA, 71 bp, chicken (Gallus Gallus)
  misc_feature (36): n=a or c
catcccaaggtaatcaggatggaaggtacttcaggnagtcatctggttcagccagtgccaagccatgcctg

SEQ ID NO: 19023 - DNA, 71 bp, chicken (Gallus Gallus)
  misc_feature (36): n=g or t
ctctcttatgcttcttccttctgctgtttcccttcnctgtctcaagcagatgaggcgagagatctgtctcc

SEQ ID NO: 19024 - DNA, 71 bp, chicken (Gallus Gallus)
  misc_feature (36): n=c or g
gatttaaataagtctggagttcagcactggaactanttaactgtattatccagcttttctaaggtataaaa

SEQ ID NO: 19025 - DNA, 71 bp, chicken (Gallus Gallus)
  misc_feature (36): n=a or t
taattattcatccaaacatgatgaagaaaaactgtntacatataagatgactagggtatcatgaccttact

SEQ ID NO: 19026 - DNA, 71 bp, chicken (Gallus Gallus)
  misc_feature (36): n=a or g
agcatggaacctattcacagtagattttagcataancaaatgagtcactaaaatgatcttgttctccggga

SEQ ID NO: 19027 - DNA, 71 bp, chicken (Gallus Gallus)
  misc_feature (36): n=a or g
cttgacatgcactagctgtgtaccatgagtaaaacngggaaaaggaaaagaaaacaaacctgaaacaatat

SEQ ID NO: 19028 - DNA, 71 bp, chicken (Gallus Gallus)
  misc_feature (36): n=c or t
ggcaaaaggcagaggtaccagataaaatactgggangtgcacactttgttaaagctcacaaaaatagcagt

SEQ ID NO: 19029 - DNA, 71 bp, chicken (Gallus Gallus)
  misc_feature (36): n=a or g
gcataaacatgtaaaatcgcacatcagctgaaggcnttccagacagcacaaaagacacgttatgtcttaag

SEQ ID NO: 19030 - DNA, 71 bp, chicken (Gallus Gallus)
  misc_feature (36): n=a or g
atcagaatttcagcagccaaaaaaaaaacccacaanaagttattattaaaaactaccatttaaaaacacct

SEQ ID NO: 19031 - DNA, 71 bp, chicken (Gallus Gallus)
  misc_feature (36): n=a or g
catgctctagtgagaattactggtgatacgtggatngttggacgggatgatctctaggtcttttccaacct

SEQ ID NO: 19032 - DNA, 71 bp, chicken (Gallus Gallus)
  misc_feature (36): n=a or g
tcagcagtgtgaagttcttagactactgtaggacantattccttctcttctcagctgagtttatttgagca

SEQ ID NO: 19033 - DNA, 71 bp, chicken (Gallus Gallus)
  misc_feature (36): n=a or g
gttacatactagacactgcacaaaatcaccataggncccgcagggagacgaccactctgcccaaactaagc

SEQ ID NO: 19034 - DNA, 71 bp, chicken (Gallus Gallus)
  misc_feature (36): n=a or g
ctgccagtgaagtggcttgctctggaaagcctggcngataatctgtacacaacacacagcgatgtggtgag

SEQ ID NO: 19035 - DNA, 71 bp, chicken (Gallus Gallus)
  misc_feature (36): n=c or t
ttccagtcagcttcaagcataagtgatctggctttngtcagagcaattgtaccaagttttacacagtagaa

SEQ ID NO: 19036 - DNA, 71 bp, chicken (Gallus Gallus)
  misc_feature (36): n=a or t
cctgccaagcccattaaaggcatttcagacctaatntgtcctccggaggagtacctaactgtaaagaccac

SEQ ID NO: 19037 - DNA, 71 bp, chicken (Gallus Gallus)
  misc_feature (36): n=a or c
caggcacgcttttagttttccatgtacaaacagtangtgtcaagcacccaagtggatatagactgatcagt

SEQ ID NO: 19038 - DNA, 71 bp, chicken (Gallus Gallus)
  misc_feature (36): n=c or t
agcactgggtgattgttctgcagtagggcaggaatnctttgggaaaggtctacaaaacttctaaaagagag

SEQ ID NO: 19039 - DNA, 71 bp, chicken (Gallus Gallus)
  misc_feature (36): n=a or g
ggacctggagtttgtggagaacaagaagcatctctntagtaactctgtagtaagtaaggatggagaattcc

SEQ ID NO: 19040 - DNA, 71 bp, chicken (Gallus Gallus)
  misc_feature (36): n=a or t
agcaatgtctcgatcagcgtacctctcggtaaaaanctgctgagatattggctctgccaaatttagtaact

SEQ ID NO: 19041 - DNA, 71 bp, chicken (Gallus Gallus)
  misc_feature (36): n=c or t
tgccggaacaggaacacctagattagctgtcttaanttgactaggaattttaactccggcaggattctcct

SEQ ID NO: 19042 - DNA, 71 bp, chicken (Gallus Gallus)
  misc_feature (36): n=c or t
gaggctgagggcaagtaagcagaatggctctcatantgcttccagcttcattgctctacgtttcatgcaat

SEQ ID NO: 19043 - DNA, 71 bp, chicken (Gallus Gallus)
  misc_feature (36): n=a or g
ttatgtttaaggagtgagctttttcgaaatgagtgnaggcattttatttagctgtggtgtggactgaaaca

SEQ ID NO: 19044 - DNA, 71 bp, chicken (Gallus Gallus)
  misc_feature (36): n=a or t
aatgcctattttgattaatttgaaaaaaaaaaaaanaggtgtaaaaatgaggccctgaaaatgtcaggaga

SEQ ID NO: 19045 - DNA, 71 bp, chicken (Gallus Gallus)
  misc_feature (36): n=a or g
actaggaggtttgtttgcctgcaatggacagtaacntgagttcgacttaggtctgatgaaaggtttcacat

SEQ ID NO: 19046 - DNA, 71 bp, chicken (Gallus Gallus)
  misc_feature (36): n=c or t
tgcctttaggatccaagtggtgagacaccttcctcnctatacagagttgctgctgttctattacaacataa

SEQ ID NO: 19047 - DNA, 71 bp, chicken (Gallus Gallus)
  misc_feature (36): n=a or g
catgaagctgatggcatctctgtgacacgtatttangaaagcataaaaaaccatgcagcagctatatgtga

SEQ ID NO: 19048 - DNA, 71 bp, chicken (Gallus Gallus)
  misc_feature (36): n=c or t
cacaaaagctaatgcacatgctgggtgacacctacnattgggccaatgcctgagaactcacagcagagaca

SEQ ID NO: 19049 - DNA, 71 bp, chicken (Gallus Gallus)
  misc_feature (36): n=a or g
cagtctagctcttaaccatgtgcccagattcttacngttcccaggccagaagccttcccaagtacagtgag

SEQ ID NO: 19050 - DNA, 71 bp, chicken (Gallus Gallus)
  misc_feature (36): n=c or t
gaactgtggacaaggaatctgctcccagcatcaagngtggcaattcccacagtaagaactcagactgggac

SEQ ID NO: 19051 - DNA, 71 bp, chicken (Gallus Gallus)
  misc_feature (36): n=c or t
atcttcaacttttacctttttttttttaatgtcagngtagtattcaaattaattatggtagcaagaagtag

SEQ ID NO: 19052 - DNA, 71 bp, chicken (Gallus Gallus)
  misc_feature (36): n=a or g
gagagcttcagtaatacaaatggacatttctaacantggaacatgatgttaacacccaagctcgctgatca

SEQ ID NO: 19053 - DNA, 71 bp, chicken (Gallus Gallus)
  misc_feature (36): n=c or t
tgttaagagtagaaactaaattcaccacctcctggngctctctgccagctgcacagctccttcccagctct

SEQ ID NO: 19054 - DNA, 71 bp, chicken (Gallus Gallus)
  misc_feature (36): n=a or g
ctaaattaaatggcaattccatatggctagtgatcnaattattcaataatatatgcttaaagaaaaaggtg

SEQ ID NO: 19055 - DNA, 71 bp, chicken (Gallus Gallus)
  misc_feature (36): n=a or t
ttggtaattctgtgattcaaacaagaaagcctagantttttttactcagttctgtaagcaaaagctgttac

SEQ ID NO: 19056 - DNA, 71 bp, chicken (Gallus Gallus)
  misc_feature (36): n=c or t
ctcttgaatgaaggttgatttcattctagtattctntttcaaaagtaggaaaaatgtggcaacagaaaatt

SEQ ID NO: 19057 - DNA, 71 bp, chicken (Gallus Gallus)
  misc_feature (36): n=a or g
agcatctctgttctcattatttttctgccttgactnatttcaggttcttaaagacatatatccaaacactg

SEQ ID NO: 19058 - DNA, 71 bp, chicken (Gallus Gallus)
  misc_feature (36): n=c or t
caaccagttcttcatccatcgaacaatctacccatngagtccatattgttccaaaatggagagaataatgt

SEQ ID NO: 19059 - DNA, 71 bp, chicken (Gallus Gallus)
  misc_feature (36): n=a or g
ttgggaacagtcacatcactctggtttcacagcagnacatggcacggggatggggtgcagtgggaccaggc

SEQ ID NO: 19060 - DNA, 71 bp, chicken (Gallus Gallus)
  misc_feature (36): n=g or t
gcacaaataggtggggaggaaattaggataggaacngacaagattatcatctgcttgtgtggaatcacctg

SEQ ID NO: 19061 - DNA, 71 bp, chicken (Gallus Gallus)
  misc_feature (36): n=a or g
gtgttttatggaagagcacttcgccttcagctggcncccatttgcagctcagcagagctgtaaatatatga

SEQ ID NO: 19062 - DNA, 71 bp, chicken (Gallus Gallus)
  misc_feature (36): n=c or t
tacgtggttggcattgctagaagatattttaaagantgcttcaaaatagtgtaaagctgatgatgaatcaa

SEQ ID NO: 19063 - DNA, 71 bp, chicken (Gallus Gallus)
  misc_feature (36): n=a or c
ttggaaatataagatacaggaaaaagaaataaagantagtggatatcgagtatccttccttcaaaacatac

SEQ ID NO: 19064 - DNA, 71 bp, chicken (Gallus Gallus)
  misc_feature (36): n=c or t
atgtttattgttcataactcttggagtgtcatcttntaggtgtagggatgtgattccctgtctgcttggca

SEQ ID NO: 19065 - DNA, 71 bp, chicken (Gallus Gallus)
  misc_feature (36): n=a or g
ttatttattgaccctaacaggagcatcagaaggggnaatcattgcattgggcaacagagggagaaagtagt

SEQ ID NO: 19066 - DNA, 71 bp, chicken (Gallus Gallus)
  misc_feature (36): n=a or g
tatctttacagataaaaaatccaagtttatacagtntatatatatatatatatatatatttagtttccttt

SEQ ID NO: 19067 - DNA, 71 bp, chicken (Gallus Gallus)
  misc_feature (36): n=c or t
catgtggctgaagagtaagtttgagagagaaatcgngttaagaggatggagtgaatacctggtgccaagaa

SEQ ID NO: 19068 - DNA, 71 bp, chicken (Gallus Gallus)
  misc_feature (36): n=a or c
gtcattaaatatacaaacacattttcagactggganattacgggtaatgcaaggcaaaaagtttgctcagc

SEQ ID NO: 19069 - DNA, 71 bp, chicken (Gallus Gallus)
  misc_feature (36): n=c or t
gttaaagtagtcaagaaaataaagatcttttgtganggcacttccccagttttactaatatatggaagact

SEQ ID NO: 19070 - DNA, 71 bp, chicken (Gallus Gallus)
  misc_feature (36): n=a or g
gattcttgagagagaaagctttgttagctaatgcantgaaactgtgatggatggacagagtggcatcctga

SEQ ID NO: 19071 - DNA, 71 bp, chicken (Gallus Gallus)
  misc_feature (36): n=c or t
cacgctgctgcttataatgaaagcaaatttttcagntcagaaacacagtggaaactcagtaaaagctggag

SEQ ID NO: 19072 - DNA, 71 bp, chicken (Gallus Gallus)
  misc_feature (36): n=a or c
ccctctgaaacttgatttagggagctccagcaaaanccttgctccttccttactgtttagtttatgcctca

SEQ ID NO: 19073 - DNA, 71 bp, chicken (Gallus Gallus)
  misc_feature (36): n=a or g
gtctctgtcacagtgcagatatgggaacatgaccanagcactgcatcacacacacctgcaatttgctatta

SEQ ID NO: 19074 - DNA, 71 bp, chicken (Gallus Gallus)
  misc_feature (36): n=c or t
gcacagccattattatttattctcctatataagcancagaatcactcttttcaaaatagaaatattgatcc

SEQ ID NO: 19075 - DNA, 71 bp, chicken (Gallus Gallus)
  misc_feature (36): n=a or g
cccttggtgccagcagtgtctcttctggccttaaantccagctctaactacagaacttccccacatataaa

SEQ ID NO: 19076 - DNA, 71 bp, chicken (Gallus Gallus)
  misc_feature (36): n=c or t
tatatagctgacacaaggctcagcagcagcttaggnagtacctttacatctgagtatacctccatgttagc

SEQ ID NO: 19077 - DNA, 71 bp, chicken (Gallus Gallus)
  misc_feature (36): n=a or g
caggctgtgaggtgtaggcttcttgggctgattctngctgggagtggcacttttcccctggaagctttccc

SEQ ID NO: 19078 - DNA, 71 bp, chicken (Gallus Gallus)
  misc_feature (36): n=c or t
cacttcaaagtggattaggctaaataatgagaatanataggtggagagtaatcttacagtgaacagcaggc

SEQ ID NO: 19079 - DNA, 71 bp, chicken (Gallus Gallus)
  misc_feature (36): n=a or t
ccccatcttcaggggagttccaccatgccagtcaanctaaatgggagctttttgttgttgttgttgtttgt

SEQ ID NO: 19080 - DNA, 71 bp, chicken (Gallus Gallus)
  misc_feature (36): n=a or c
aacaggagggttctcttccatcctcatcgggaaccncaaccagaatcctgttggcaggactcatattcttg

SEQ ID NO: 19081 - DNA, 71 bp, chicken (Gallus Gallus)
  misc_feature (36): n=a or g
tcatctgagcaatggggagagagttttggtctaggncttcgtctgtgtagttaggcatccttttaccatat

SEQ ID NO: 19082 - DNA, 71 bp, chicken (Gallus Gallus)
  misc_feature (36): n=a or g
ctgggggcacacacagaacaacaagggttaaaaagnagtagagcagtgacttattaactcaatttcttccc

SEQ ID NO: 19083 - DNA, 71 bp, chicken (Gallus Gallus)
  misc_feature (36): n=a or g
acaaatataaatttttgagcttaagagaataaagcncagtgcctgtattttagtaggtttgatctcactca

SEQ ID NO: 19084 - DNA, 71 bp, chicken (Gallus Gallus)
  misc_feature (36): n=a or g
attatttactataactcagcagtgcacggaagagcngctcacgccaggcagggacagcccggatgattcag

SEQ ID NO: 19085 - DNA, 71 bp, chicken (Gallus Gallus)
  misc_feature (36): n=c or t
gaatacgctgtgtacattcaccagaaagtgaacaanaaactgctgttgtgttattctcatttaataattag

SEQ ID NO: 19086 - DNA, 71 bp, chicken (Gallus Gallus)
  misc_feature (36): n=c or t
tgtatgcgtggtcgtcgtctcgttttcaaagtcacnggagccccagttcacatcaacctgttacacatctg

SEQ ID NO: 19087 - DNA, 71 bp, chicken (Gallus Gallus)
  misc_feature (36): n=c or g
gggtgccatctgacatcataagccagtgacctgagncacagggggcaggtgaaaaagtgggacaggaggct

SEQ ID NO: 19088 - DNA, 71 bp, chicken (Gallus Gallus)
  misc_feature (36): n=c or t
ataccatcaaaatttcaaagttagttagtttttaangagtaatagaaaaacaaacaaataaataaatacat

SEQ ID NO: 19089 - DNA, 71 bp, chicken (Gallus Gallus)
  misc_feature (36): n=a or c
tttaacagagacgttccaaggcagaacccagaagancatgctgaaaagaattatatgagggaaaaggatct

SEQ ID NO: 19090 - DNA, 71 bp, chicken (Gallus Gallus)
  misc_feature (36): n=a or c
tttttcaggcacgatcgtgttgtccaaacattttanagaaagacccgttgcttcttaaatttcgtattatt

SEQ ID NO: 19091 - DNA, 71 bp, chicken (Gallus Gallus)
  misc_feature (36): n=a or c
aatgacgtttgtggtaagtcacaggagctagaaacnttacagccattctaattgttctaaatatcttcagt

SEQ ID NO: 19092 - DNA, 71 bp, chicken (Gallus Gallus)
  misc_feature (36): n=c or t
gtaagcatctcctaagtataacagctgtggctctcnggaagctccctgagcacagcacttggctgagacac

SEQ ID NO: 19093 - DNA, 71 bp, chicken (Gallus Gallus)
  misc_feature (36): n=c or t
atgaacagcagctgagttggaaatgccaagtcaggncacaagactgacattattctcattggatatttgtg

SEQ ID NO: 19094 - DNA, 71 bp, chicken (Gallus Gallus)
  misc_feature (36): n=a or g
ctcttctcccaagtggatacattctttttttaaccntttcatggatttctattcagatggacaaattcatc

SEQ ID NO: 19095 - DNA, 71 bp, chicken (Gallus Gallus)
  misc_feature (36): n=c or t
ggcggcaggaattttgatgaggctttggtagactanttctctgaagaatttaggacaaaatacaaactgaa

SEQ ID NO: 19096 - DNA, 71 bp, chicken (Gallus Gallus)
  misc_feature (36): n=c or t
ttatggggaagataattgtacccagcttacctgaanatatatacatatacttactgccagggtgttgtaga

SEQ ID NO: 19097 - DNA, 71 bp, chicken (Gallus Gallus)
  misc_feature (36): n=a or g
ctacctctgctttatggtagaactacatggagaaanctaatcactgcagaatgagcactgcatctcccttt

SEQ ID NO: 19098 - DNA, 71 bp, chicken (Gallus Gallus)
  misc_feature (36): n=a or g
ttgatagactggaggctggacagtcctggagtggtntgacctatgggtttgggctctgtagctcttggaga

SEQ ID NO: 19099 - DNA, 71 bp, chicken (Gallus Gallus)
  misc_feature (36): n=a or g
gccaaactgaggaaactgaaggagaaggaagaattngaaggtggcaaagaagcagcaaagccaaaggaagc

SEQ ID NO: 19100 - DNA, 71 bp, chicken (Gallus Gallus)
  misc_feature (36): n=c or t
cattctcctctcactcagccaggcttctgtctattngcactgaaaataattcagtatacccacttaaaatc

SEQ ID NO: 19101 - DNA, 71 bp, chicken (Gallus Gallus)
  misc_feature (36): n=c or g
ataagaaggtgaagatttcttgccttcttcacacanagagtcatttgccacacttttatatgaaggctttg

SEQ ID NO: 19102 - DNA, 71 bp, chicken (Gallus Gallus)
  misc_feature (36): n=c or t
tttccagtaaagacactctgtgttttagaaagggantacaggtatgcattgcatccatccatcctatggca

SEQ ID NO: 19103 - DNA, 71 bp, chicken (Gallus Gallus)
  misc_feature (36): n=c or t
ccatccgtaagccgctcagtgctcttcatacatgtngtatcactaccaggcatgggctgatgcagcttttt

SEQ ID NO: 19104 - DNA, 71 bp, chicken (Gallus Gallus)
  misc_feature (36): n=a or g
ttctgtgattctttggtgtggagactgatgcatacncaccgctcaggtgttggcatttctgcctatgtctg

SEQ ID NO: 19105 - DNA, 71 bp, chicken (Gallus Gallus)
  misc_feature (36): n=a or g
gcagccacataagcaggatgagccaggcaaggaagncagctggaaaagcctgactaggtaaagatgaagca

SEQ ID NO: 19106 - DNA, 71 bp, chicken (Gallus Gallus)
  misc_feature (36): n=a or g
gttctggagatggagcttgaaacaaatctcacagcngctgcagcaggaattattactacttggcttccctc

SEQ ID NO: 19107 - DNA, 71 bp, chicken (Gallus Gallus)
  misc_feature (36): n=c or t
taaaagatccatacatgagctaaggagagaggattntttgtctgaggagggtcaaatataagatagggaat

SEQ ID NO: 19108 - DNA, 71 bp, chicken (Gallus Gallus)
  misc_feature (36): n=a or g
taggaacataaagtagcagtatgtctttttgagccnttatactttgtttagaaatgccataaaatgctgct

SEQ ID NO: 19109 - DNA, 71 bp, chicken (Gallus Gallus)
  misc_feature (36): n=c or t
acagtaaggcagtgggtggtgtgcttcagcagtganaacaatgtcatgaaacacaaagcacgatccagaca

SEQ ID NO: 19110 - DNA, 71 bp, chicken (Gallus Gallus)
  misc_feature (36): n=a or g
gacacaataggaaatgtcttctaagccatctttggnttatgcttaacagacatttcttgttggaaatctgc

SEQ ID NO: 19111 - DNA, 71 bp, chicken (Gallus Gallus)
  misc_feature (36): n=c or t
ggcctgcaggtagactgtgaaccaatagttaccatnctgtggttccaaccaacaaatcagcttttcatcca

SEQ ID NO: 19112 - DNA, 71 bp, chicken (Gallus Gallus)
  misc_feature (36): n=c or t
gtaaagaatttgacttaaaagtctaacaaatcttcnaaagggggaagtgaattcttaaggtatcacccact

SEQ ID NO: 19113 - DNA, 71 bp, chicken (Gallus Gallus)
  misc_feature (36): n=a or g
cctggagcaacactgaaactctttagatgtcttganatcgtgcaagtttaaccttttgttctttggacatc

SEQ ID NO: 19114 - DNA, 71 bp, chicken (Gallus Gallus)
  misc_feature (36): n=a or g
gagctctctgcattgccgcacttatctcctccagcntgcagctttattctggtgcttgcgtgtcgtcctga

SEQ ID NO: 19115 - DNA, 71 bp, chicken (Gallus Gallus)
  misc_feature (36): n=a or g
agtactatttcctctgcatcccttctttctagcacntcagttgcaccactcagcttggtgtcatctgcaaa

SEQ ID NO: 19116 - DNA, 71 bp, chicken (Gallus Gallus)
  misc_feature (36): n=c or t
cgttgatttgagtaaacacacagcgttaactgttgntatcatttgttataaaaaccatagctaataaaaaa

SEQ ID NO: 19117 - DNA, 71 bp, chicken (Gallus Gallus)
  misc_feature (36): n=a or t
gcttcctattgagcatgatgttgacaggaataaaanacggtaaccttatcacattttgacatttaatttga

SEQ ID NO: 19118 - DNA, 71 bp, chicken (Gallus Gallus)
  misc_feature (36): n=c or t
tagcaacattatggagaataagcatcagagtcagantgtaattgctgacaaagtcatcactcttaccttac

SEQ ID NO: 19119 - DNA, 71 bp, chicken (Gallus Gallus)
  misc_feature (36): n=c or t
ccctaacaaggtgtatttaacagctctttctcacancaatctgttaatagcaatctgacacagcattagac

SEQ ID NO: 19120 - DNA, 71 bp, chicken (Gallus Gallus)
  misc_feature (36): n=a or t
gattctaggattttgttcctttgtgatgcccctaanaactctgggcagtactacagtgttttctgtattgc

SEQ ID NO: 19121 - DNA, 71 bp, chicken (Gallus Gallus)
  misc_feature (36): n=c or t
aaaataaaacatctgcctttcaagcaactgaactcntatttactctcatttacttgaaattgtagctgaac

SEQ ID NO: 19122 - DNA, 71 bp, chicken (Gallus Gallus)
  misc_feature (36): n=c or t
ttgaagagattggcttttgcatttataccactcacnatttaggagagatggctttacataaaagcattcaa

SEQ ID NO: 19123 - DNA, 71 bp, chicken (Gallus Gallus)
  misc_feature (36): n=a or t
tggccttctctccatgttttttcttctgcttgtggntgtgcattagtttgaatattgcatagtgtggtggt

SEQ ID NO: 19124 - DNA, 71 bp, chicken (Gallus Gallus)
  misc_feature (36): n=c or t
caacaagtgatgaaaaaccactgcaacattcttcangaagttttttgtttggttggttggttggatttttt

SEQ ID NO: 19125 - DNA, 71 bp, chicken (Gallus Gallus)
  misc_feature (36): n=g or t
gagagggaatcagtgcgtagttagcatttgagaatntgctgcagttctggattatgaggtcacatcataaa

SEQ ID NO: 19126 - DNA, 71 bp, chicken (Gallus Gallus)
  misc_feature (36): n=c or t
tcaatagcaattcttgttttaaggtctggttcttangaagatatcctctctctattgtcaaaatggattaa

SEQ ID NO: 19127 - DNA, 71 bp, chicken (Gallus Gallus)
  misc_feature (36): n=c or g
gaggaagctcaaacaatacacttgcagaacacacanagaaaataatatatcgaacaatcattaggcgtttc

SEQ ID NO: 19128 - DNA, 71 bp, chicken (Gallus Gallus)
  misc_feature (36): n=c or t
agctctttaccatctctgagttttcggttgttttgnagacagattaattgtgcttcttgtgaactggggaa

SEQ ID NO: 19129 - DNA, 71 bp, chicken (Gallus Gallus)
  misc_feature (36): n=a or g
cttgctactatttccatcactgagtcccactgtgcngcagctaaatatctcttgttcacttcatactaagc

SEQ ID NO: 19130 - DNA, 71 bp, chicken (Gallus Gallus)
  misc_feature (36): n=c or t
ttgaatagcttgtaatatcacaacgatatcagaatngtttatatcaggtttatagtaggagaagtatgtac

SEQ ID NO: 19131 - DNA, 71 bp, chicken (Gallus Gallus)
  misc_feature (36): n=g or t
cctcagaacatcagctaggatcttgatggtttcgtnctgtacggtgaccattaatctctatctaaattcac

SEQ ID NO: 19132 - DNA, 71 bp, chicken (Gallus Gallus)
  misc_feature (36): n=c or t
tacatagtccccaaaatgtgaccaaaaaaattctgntgtgaggatttccccagcaatatttggagtttggc

SEQ ID NO: 19133 - DNA, 71 bp, chicken (Gallus Gallus)
  misc_feature (36): n=a or c
tgcacatcattttcagtttattaaggtttggacctngcccttatgataccaaagaaaacaacaacactcag

SEQ ID NO: 19134 - DNA, 71 bp, chicken (Gallus Gallus)
  misc_feature (36): n=a or g
tcatataaaccagaattactgcaaacataacctaanaagtggaacaaaaagtcagtagaggagaatccttt

SEQ ID NO: 19135 - DNA, 71 bp, chicken (Gallus Gallus)
  misc_feature (36): n=a or g
ctgataagactgaatgtgtgcaagtctatggggtcngatagtatgcatcccatgaaggaactgggtgaatt

SEQ ID NO: 19136 - DNA, 71 bp, chicken (Gallus Gallus)
  misc_feature (36): n=a or g
ccataaagccccttccattttctgtactgtaggatnaaaaagcaataatgcaaaatgaaaatgttgttctg

SEQ ID NO: 19137 - DNA, 71 bp, chicken (Gallus Gallus)
  misc_feature (36): n=c or t
agacacacggtgacagcctatgacaaagcagtgagnggcttctgcctccatgatttgctgaagaaggatta

SEQ ID NO: 19138 - DNA, 71 bp, chicken (Gallus Gallus)
  misc_feature (36): n=c or g
attacctctaacaaagaaacttttgcctctttagtngtgtgtgttcagggaattggctgcactgggccttg

SEQ ID NO: 19139 - DNA, 71 bp, chicken (Gallus Gallus)
  misc_feature (36): n=g or t
gttgttttgttgttgttgttgttgttgttgttgttntttccactatggatcagtattttattcatagctgc

SEQ ID NO: 19140 - DNA, 71 bp, chicken (Gallus Gallus)
  misc_feature (36): n=g or t
ttgtttaaaagccaggttggaaaagaaaatgttcanaagtgacattgaggctaagaaaggagctcttttaa

SEQ ID NO: 19141 - DNA, 71 bp, chicken (Gallus Gallus)
  misc_feature (36): n=a or g
ccagaatatttccctgctgagttttgaagcagcacnataagtttctgaaatttaatatccacacatcacaa

SEQ ID NO: 19142 - DNA, 71 bp, chicken (Gallus Gallus)
  misc_feature (36): n=a or g
aaaacaaccttccttttatattcctctttatatacngcataacagaattatgatgcattttaaacatgctg

SEQ ID NO: 19143 - DNA, 71 bp, chicken (Gallus Gallus)
  misc_feature (36): n=a or g
tttgtatgatctcgtataaacaatgagtattttgangacttattatttgctttccaaacctgtactggact

SEQ ID NO: 19144 - DNA, 71 bp, chicken (Gallus Gallus)
  misc_feature (36): n=c or t
aatgtccatgaagtgtcagtggagttcatacagctnctggcttggcttctgcctgtgtgtggcagttattc

SEQ ID NO: 19145 - DNA, 71 bp, chicken (Gallus Gallus)
  misc_feature (36): n=a or g
gagcgaattttggaggactctggctttgatgagcancaggaatttcgttcccggtgcagcagtgtcactgc

SEQ ID NO: 19146 - DNA, 71 bp, chicken (Gallus Gallus)
  misc_feature (36): n=c or t
cagccagaaacttgccaaagtaaactggattactgncatgatttgagatggcagtgcagcagcaactgtac

SEQ ID NO: 19147 - DNA, 71 bp, chicken (Gallus Gallus)
  misc_feature (36): n=a or g
cattatttttttttttttccaagttaagatagctcntatacttgtgtgacctgtctgtgccttcagaagag

SEQ ID NO: 19148 - DNA, 71 bp, chicken (Gallus Gallus)
  misc_feature (36): n=c or t
cagcactttcttaactgttttatatcatagataaantcttaataaacgtgttagttggtagcaatactaga

SEQ ID NO: 19149 - DNA, 71 bp, chicken (Gallus Gallus)
  misc_feature (36): n=a or g
tcccatgagtcagtccccaagctgagtattctcaanaatgatctttctgcgacatgggaactctcaattat

SEQ ID NO: 19150 - DNA, 71 bp, chicken (Gallus Gallus)
  misc_feature (36): n=c or t
gagataataaataaataaacacataaataaataagncatcctctttcaataacttctaatatatccagagg

SEQ ID NO: 19151 - DNA, 71 bp, chicken (Gallus Gallus)
  misc_feature (36): n=a or c
tcatcctctctccatccccaccaaagacctctgtgnttttgtttccacatctaccaattatgagccgggag

SEQ ID NO: 19152 - DNA, 71 bp, chicken (Gallus Gallus)
  misc_feature (36): n=g or t
ggagccgaaggcatctcctcaaccagagaagacatngctgactcaaaagctctgagagcagccaaggctgg

SEQ ID NO: 19153 - DNA, 71 bp, chicken (Gallus Gallus)
  misc_feature (36): n=a or g
aaaaaattatgcataggggaaaactaattcctgacnggttagatatgaaggattgtatgatgcaagttagc

SEQ ID NO: 19154 - DNA, 71 bp, chicken (Gallus Gallus)
  misc_feature (36): n=a or t
cgagccgcctgtgcaagagtctgtctgaaactaaanattgaccaaaaataaaagttttattacacacgaga

SEQ ID NO: 19155 - DNA, 71 bp, chicken (Gallus Gallus)
  misc_feature (36): n=c or t
ggtttgtaggggtttttgtgcagatgaaggaaaggngcacgtgctacagcagccagcctggaagacagccc

SEQ ID NO: 19156 - DNA, 71 bp, chicken (Gallus Gallus)
  misc_feature (36): n=c or t
ctttcagataccttgaattaggttccctacaattancaggttgccttaaaaagcttttacagttgacatac

SEQ ID NO: 19157 - DNA, 71 bp, chicken (Gallus Gallus)
  misc_feature (36): n=a or c
aacaagagagatatgagtccttggactctccattcnatttatcaaattaaactttaatcacatttgcagtt

SEQ ID NO: 19158 - DNA, 71 bp, chicken (Gallus Gallus)
  misc_feature (36): n=a or c
aaaacagtaacagaataggagaaacaattctgatcncaaggaactccctaaattctgggttccagatgagt

SEQ ID NO: 19159 - DNA, 71 bp, chicken (Gallus Gallus)
  misc_feature (36): n=a or g
gaaaatacccttaaaatatccccacacacgcacacncggtttagtgcacacacaccctccccttagaagga

SEQ ID NO: 19160 - DNA, 71 bp, chicken (Gallus Gallus)
  misc_feature (36): n=a or g
aagaaaatgcattatgaagctgtaaatatttatccngagattaaagtagaaatgagggtagcacaacttgg

SEQ ID NO: 19161 - DNA, 71 bp, chicken (Gallus Gallus)
  misc_feature (36): n=a or g
catcgaagggactggcttttgggtggaaacagacanggtaggatctccttcagctctagcattcactgccc

SEQ ID NO: 19162 - DNA, 71 bp, chicken (Gallus Gallus)
  misc_feature (36): n=a or g
agaataaaacaataaactcgaattcaaatccccaantaactgtcttccctctctctgtctttcatggtctc

SEQ ID NO: 19163 - DNA, 71 bp, chicken (Gallus Gallus)
  misc_feature (36): n=a or c
tgacatatatttggaggagataagaaaaagttacanatgtaaatgtctttgcacaagagactttttggttc

SEQ ID NO: 19164 - DNA, 71 bp, chicken (Gallus Gallus)
  misc_feature (36): n=c or t
taatgtagctgttccaaacattattttactaaatgnctgaaattaaacattctctgtcaattatggattat

SEQ ID NO: 19165 - DNA, 71 bp, chicken (Gallus Gallus)
  misc_feature (36): n=a or g
cttctccatctcttagtagctagtctacataggccntgatatcctactgtatttctctcaaaaagttggaa

SEQ ID NO: 19166 - DNA, 71 bp, chicken (Gallus Gallus)
  misc_feature (36): n=a or g
taactgaaatccattaaaccaatataatctgctacnccggcagacaaatcagtttatagtatgcatatatt

SEQ ID NO: 19167 - DNA, 71 bp, chicken (Gallus Gallus)
  misc_feature (36): n=c or g
ctcaggagggttaaattacctgctgctgcccccaantcagaaagaaggtcagcgccttgtgcaaggaggca

SEQ ID NO: 19168 - DNA, 71 bp, chicken (Gallus Gallus)
  misc_feature (36): n=a or g
ctttttggactttgtgtgcttgtttatgtccaatanatagctggattctgtaagcactctcaaagatgtat

SEQ ID NO: 19169 - DNA, 71 bp, chicken (Gallus Gallus)
  misc_feature (36): n=g or t
aaccagaaaacctgtaaaagaaggcacaaatattgnacaatactcaagtcctatcaagtacctgtgaactg

SEQ ID NO: 19170 - DNA, 71 bp, chicken (Gallus Gallus)
  misc_feature (36): n=c or t
ctctgtcagtgaaggaccatcacttttgtcttacanggcactaagcaaacattcaactcttgcatttgtag

SEQ ID NO: 19171 - DNA, 71 bp, chicken (Gallus Gallus)
  misc_feature (36): n=a or g
aggctgtaatggtaacactgagacacgatgaggctngaatggagttctgccagatttccccgggcagattc

SEQ ID NO: 19172 - DNA, 71 bp, chicken (Gallus Gallus)
  misc_feature (36): n=c or t
ttcctccaggtagcaacagagaagtgggtgaatcanatagagtttggagcaaacatttttatcctcaactg

SEQ ID NO: 19173 - DNA, 71 bp, chicken (Gallus Gallus)
  misc_feature (36): n=a or g
gacatttgctgggaatccagtatatcagcacatgtnggacaatgttttgatgctgaaagttgtgttttgat

SEQ ID NO: 19174 - DNA, 71 bp, chicken (Gallus Gallus)
  misc_feature (36): n=a or g
gaggactggctagcatagcttgcgctaagggatgcngaacatgccgcccagggaagctgttgattcactgt

SEQ ID NO: 19175 - DNA, 71 bp, chicken (Gallus Gallus)
  misc_feature (36): n=a or g
gtagataatattctaggaagcacctaaaagtgaagntaaggtaaatatcacatgctgctcaacacttaaat

SEQ ID NO: 19176 - DNA, 71 bp, chicken (Gallus Gallus)
  misc_feature (36): n=a or g
acagcatggattcctgactgctgagctcacttcacncaggcatgtgcacgtattccccattctggtgactg

SEQ ID NO: 19177 - DNA, 71 bp, chicken (Gallus Gallus)
  misc_feature (36): n=a or g
acttcagccttgtgctcactctactttttggaggtnaagaaacaatttaaaatgccaactgtttgtctata

SEQ ID NO: 19178 - DNA, 71 bp, chicken (Gallus Gallus)
  misc_feature (36): n=a or g
gatttcactttggattttctgctgcgtttctgttcnttgttgttgcagctctgtggataacgtgttaaggg

SEQ ID NO: 19179 - DNA, 71 bp, chicken (Gallus Gallus)
  misc_feature (36): n=c or t
gcagtactcagagctcttgcaaagctgaataagtgngcagcagcccagggaaaggagtggctctcaaagga

SEQ ID NO: 19180 - DNA, 71 bp, chicken (Gallus Gallus)
  misc_feature (36): n=c or g
aatgtgtcatttccaaagctctgatgaatgttactnaactaaactgcttgaatgtatcatctggctttttt

SEQ ID NO: 19181 - DNA, 71 bp, chicken (Gallus Gallus)
  misc_feature (36): n=a or t
tgacagtcatgtccagcacatgcatccaaagttacntattgaagcccttacttacgggagagaagttggca

SEQ ID NO: 19182 - DNA, 71 bp, chicken (Gallus Gallus)
  misc_feature (36): n=a or c
atggctatcacaggcactgatcatcactgccatctnttctactcatacactgtcactgtactggcagcagc

SEQ ID NO: 19183 - DNA, 71 bp, chicken (Gallus Gallus)
  misc_feature (36): n=a or g
cactaaacccagtggtgttaaaccacagctctcccnttgttaactttacagcatagccgtggagcaaagca

SEQ ID NO: 19184 - DNA, 71 bp, chicken (Gallus Gallus)
  misc_feature (36): n=c or t
acctttaagatcatctagctcccaccaccctactanaggcagggatacttcccagtagaccaggctgctca

SEQ ID NO: 19185 - DNA, 71 bp, chicken (Gallus Gallus)
  misc_feature (36): n=g or t
aggcctaaaatgcactaaaaggcgctgcaactgaanagtaagacctgcctaactgctttgcagcacagtgg

SEQ ID NO: 19186 - DNA, 71 bp, chicken (Gallus Gallus)
  misc_feature (36): n=a or g
aaatttactaagtatctagatttggaaaagaaatcnactgatctaaaatgaaatggaaatcccataatctg

SEQ ID NO: 19187 - DNA, 71 bp, chicken (Gallus Gallus)
  misc_feature (36): n=c or t
ggttcagacagcttacaatgtggctgaagctggaantctttgaaaggtttttcgagtcctttttcatagta

SEQ ID NO: 19188 - DNA, 71 bp, chicken (Gallus Gallus)
  misc_feature (36): n=a or g
taatccctgtttgcagctgtgacacgactgctgtcncaaaacggagtggtattttttccaaaaatacaaga

SEQ ID NO: 19189 - DNA, 71 bp, chicken (Gallus Gallus)
  misc_feature (36): n=c or g
tttttgttaggcccttaagtaaatgtgttatatctnctatgtttaacttcaactggatgaatttgggtggg

SEQ ID NO: 19190 - DNA, 71 bp, chicken (Gallus Gallus)
  misc_feature (36): n=a or t
atgaaggtgataactctttcacatctgcaataaccntcctattactgacttttcctctctttctttttttt

SEQ ID NO: 19191 - DNA, 71 bp, chicken (Gallus Gallus)
  misc_feature (36): n=c or t
cataccgccaaggaagtccaaggagaacatttgganccatcatttctttcaggatgctctgtattgccacc

SEQ ID NO: 19192 - DNA, 71 bp, chicken (Gallus Gallus)
  misc_feature (36): n=a or g
ttaaaggagatacatgcctttctattgcctggcagngaaattatctggcatattagtccacgggggaaggt

SEQ ID NO: 19193 - DNA, 71 bp, chicken (Gallus Gallus)
  misc_feature (36): n=a or g
gaaatgtagtaaattagttttattaaagaaaaaaanatatgatttcccctgtatatttctgcctcccatca

SEQ ID NO: 19194 - DNA, 71 bp, chicken (Gallus Gallus)
  misc_feature (36): n=a or g
aaaaaatggtcagtacttgaaaaattgtcagctttntaaggctgagaagattcccatgtagggcttttcag

SEQ ID NO: 19195 - DNA, 71 bp, chicken (Gallus Gallus)
  misc_feature (36): n=a or c
gccatatcaagaaactgctaattacaggcataaagntaggtctgctaaaagggggggagtgcagtgtgatg

SEQ ID NO: 19196 - DNA, 71 bp, chicken (Gallus Gallus)
  misc_feature (36): n=a or g
aaaagcaaaaaacaaaaaaccagaattaatctatgntggctccactgttttttacttacctcataggtatt

SEQ ID NO: 19197 - DNA, 71 bp, chicken (Gallus Gallus)
  misc_feature (36): n=a or g
agcgggacaaccccttccttcacttggctggcaatnctctgcaaacttcttactctgaagaagggcctgtg

SEQ ID NO: 19198 - DNA, 71 bp, chicken (Gallus Gallus)
  misc_feature (36): n=a or g
ttgaaaagtcttggctgtcaggaaatgtccctggcntttggaaaaaacaaaacatcactcccatttttaag

SEQ ID NO: 19199 - DNA, 71 bp, chicken (Gallus Gallus)
  misc_feature (36): n=c or t
ctcagtacttttgctgccagtgttttttttttttcncccctcaatgaaaaaaattagagggaattagtgta

SEQ ID NO: 19200 - DNA, 71 bp, chicken (Gallus Gallus)
  misc_feature (36): n=c or t
aaaggcctcttccaacccaaaccattctatgtttcnatgccttgacaggccatttaacacagcaatttcta

SEQ ID NO: 19201 - DNA, 71 bp, chicken (Gallus Gallus)
  misc_feature (36): n=a or g
tttggagtgcaaggagtttagagatgcacatcagtngataaagtatacctctcaccagtgaggaccaccac

SEQ ID NO: 19202 - DNA, 71 bp, chicken (Gallus Gallus)
  misc_feature (36): n=c or t
gcttcagcaatgaatgacctacttggacttctgaangcctttcaaagtttccacgctgctttctgtcctcc

SEQ ID NO: 19203 - DNA, 71 bp, chicken (Gallus Gallus)
  misc_feature (36): n=a or g
cccaaactggccatcttgcacaagcaaatctgaaantggaagacctagatattttcttggtatttttggtc

SEQ ID NO: 19204 - DNA, 71 bp, chicken (Gallus Gallus)
  misc_feature (36): n=c or t
cttctcctgtttatgacgtgagtatcagaatcaccntccatctcaacagaagtgatacctatatggctggc

SEQ ID NO: 19205 - DNA, 71 bp, chicken (Gallus Gallus)
  misc_feature (36): n=g or t
cctgaagagaaagaacatcagtggcatctcatcgtntatgacttagagaacttcagttcagttagggtact

SEQ ID NO: 19206 - DNA, 71 bp, chicken (Gallus Gallus)
  misc_feature (36): n=a or g
aagagatgaaatccatccactgaaggaagaaaaacnccaaacatttacttgagcagaaccattcatccaca

SEQ ID NO: 19207 - DNA, 71 bp, chicken (Gallus Gallus)
  misc_feature (36): n=a or g
ctttcatgtatgtttgtcactgtgttttgggggttnagctttctggttaatactagatcctgttggttatt

SEQ ID NO: 19208 - DNA, 71 bp, chicken (Gallus Gallus)
  misc_feature (36): n=c or t
gcaccatttgatatattgtagtttctgtatcctctntctcaaagctaaaatttggtacaatacagaataaa

SEQ ID NO: 19209 - DNA, 71 bp, chicken (Gallus Gallus)
  misc_feature (36): n=c or g
tgtgaaaaaaacaccacacacaatctctctccattnttgttgcagctctcagatgccagctgctaatcaca

SEQ ID NO: 19210 - DNA, 71 bp, chicken (Gallus Gallus)
  misc_feature (36): n=a or t
ctctcccaggctgacaaatactgaagagaaataganaacatcctcttcagctgcgggagtcatgcaggtct

SEQ ID NO: 19211 - DNA, 71 bp, chicken (Gallus Gallus)
  misc_feature (36): n=a or c
atagcaataacagagccttagggttttattctactnggaaagtttctagttgaaaatttatatgtaattca

SEQ ID NO: 19212 - DNA, 71 bp, chicken (Gallus Gallus)
  misc_feature (36): n=a or g
cgtggtacatctgccgacacttaaagcttaacaggnaaaaaaaaaagacatcatatatccatttccacaga

SEQ ID NO: 19213 - DNA, 71 bp, chicken (Gallus Gallus)
  misc_feature (36): n=a or t
aacaagtaggagtacagcactgacattcgaataccntttttttttttccagaacctggaaatacctagatc

SEQ ID NO: 19214 - DNA, 71 bp, chicken (Gallus Gallus)
  misc_feature (36): n=c or t
gggttgctcaaaaccttgtcttacccttcatcaaangtcgccatcttaaatatgcccaagccctccaccat

SEQ ID NO: 19215 - DNA, 71 bp, chicken (Gallus Gallus)
  misc_feature (36): n=c or t
cctcatgattctgcagtacacttggctcagtgtgcnggtgatctaagtcactcaaactagttagggcttgt

SEQ ID NO: 19216 - DNA, 71 bp, chicken (Gallus Gallus)
  misc_feature (36): n=a or t
cctcttaaagtgtgaaatgtggtagtactccttggntaccaacttttactttgtgatgggacgccaaagca

SEQ ID NO: 19217 - DNA, 71 bp, chicken (Gallus Gallus)
  misc_feature (36): n=a or g
gttctgctgtgagaggatcctcatcatggaaatatntgaatccagtttattttattataacactttggaaa

SEQ ID NO: 19218 - DNA, 71 bp, chicken (Gallus Gallus)
  misc_feature (36): n=c or t
agtaactatggtttagtcacacctgtacagacccanccctcacctacaggtctcttaacatcttgttaaga

SEQ ID NO: 19219 - DNA, 71 bp, chicken (Gallus Gallus)
  misc_feature (36): n=c or t
acgttgcctcatcaagcagaagaattttaggattgngaaccagagcacgggcaattgctattcgctgcttc

SEQ ID NO: 19220 - DNA, 71 bp, chicken (Gallus Gallus)
  misc_feature (36): n=c or t
tctggtgccagcttctaactactcatttatacatgnctaattacctgaagccaatttctgaaaatttggtc

SEQ ID NO: 19221 - DNA, 71 bp, chicken (Gallus Gallus)
  misc_feature (36): n=a or g
aggtactcaagcactcagttttaagcatccagagantgcatcatcaagtacagtgagaccattcaagtctg

SEQ ID NO: 19222 - DNA, 71 bp, chicken (Gallus Gallus)
  misc_feature (36): n=c or t
aatcaagttcattggcaattcattcctatgagatancgcaatgtgtgattttccagaaagacctcaaaaat

SEQ ID NO: 19223 - DNA, 71 bp, chicken (Gallus Gallus)
  misc_feature (36): n=a or g
tcctgtagaaattctcaagaattataattatcattnagacaactatctttgttctatcatgattgactgct

SEQ ID NO: 19224 - DNA, 71 bp, chicken (Gallus Gallus)
  misc_feature (36): n=c or g
aaaccccaaaatattaaaatctaaaggtttgagaantaacagtgcagaaatggcacaatgctgtctgtctg

SEQ ID NO: 19225 - DNA, 71 bp, chicken (Gallus Gallus)
  misc_feature (36): n=a or g
aaggagatatgtgattctgaagaggatggcatgaangaatttaaggaagttctgaacaatgcagatgtttt

SEQ ID NO: 19226 - DNA, 71 bp, chicken (Gallus Gallus)
  misc_feature (36): n=c or g
caacttcagtttcccattgaagtgatgaagataacnggccaactttggaaagttgctcatttttccatcaa

SEQ ID NO: 19227 - DNA, 71 bp, chicken (Gallus Gallus)
  misc_feature (36): n=g or t
tggatttataagctgttttttcaattgtgaattgtnctcaaattgtttgaaacagtttacaatttgtggta

SEQ ID NO: 19228 - DNA, 71 bp, chicken (Gallus Gallus)
  misc_feature (36): n=c or t
tttgaaacttgaactttcaatagatgtatgaacagnatcttatagtgaatcagaatctgaatgcacagtag

SEQ ID NO: 19229 - DNA, 71 bp, chicken (Gallus Gallus)
  misc_feature (36): n=g or t
tatattcaccaactgcaattatatgccttccaactncagagtgcaatgaatgtgctatgctattttcaact

SEQ ID NO: 19230 - DNA, 71 bp, chicken (Gallus Gallus)
  misc_feature (36): n=c or t
tttatttctacctttacctcaaagtcactttcaaangtggttagaaaactgccatgcctgggctctgctgc

SEQ ID NO: 19231 - DNA, 71 bp, chicken (Gallus Gallus)
  misc_feature (36): n=a or c
aatttgacaaaaactttatggtagggctgttctggncagagaagtgttagaaagaactatgtcctatgttg

SEQ ID NO: 19232 - DNA, 71 bp, chicken (Gallus Gallus)
  misc_feature (36): n=c or t
tgaaatcctctgcaatgacacataaggaacagcagnatttgggatttgttctgctgttcattcacacttag

SEQ ID NO: 19233 - DNA, 71 bp, chicken (Gallus Gallus)
  misc_feature (36): n=g or t
tgattctgagccgcttgggctgctttttatgctcgnagggatttgatgaaagagaagaaggcttgccgtaa

SEQ ID NO: 19234 - DNA, 71 bp, chicken (Gallus Gallus)
  misc_feature (36): n=a or c
aagctttagtttcacactggcagatttagaataatntattgctgtcgcatgcagcacataaaagtaagaaa

SEQ ID NO: 19235 - DNA, 71 bp, chicken (Gallus Gallus)
  misc_feature (36): n=a or g
tacatctgtagtgcagccaaccgtagggcaatgtcntatttcagttctggtccaaatctttcctgaaccac

SEQ ID NO: 19236 - DNA, 71 bp, chicken (Gallus Gallus)
  misc_feature (36): n=c or t
cacatccagggtgagaatatgggtaacaaggcttcntaagaggcagagttgggatatattcacttaaaata

SEQ ID NO: 19237 - DNA, 71 bp, chicken (Gallus Gallus)
  misc_feature (36): n=a or g
tgtttgtgctactggaagggaaacctgtcatttttncaatacataaattacacagtagtaactgaggacac

SEQ ID NO: 19238 - DNA, 71 bp, chicken (Gallus Gallus)
  misc_feature (36): n=g or t
caaactcatagaaaaaacctgaaattaaatacaaangttattgaaattctacagtcagtgctcattttatt

SEQ ID NO: 19239 - DNA, 71 bp, chicken (Gallus Gallus)
  misc_feature (36): n=c or t
aaggctgatgtttcactgtcattaacacgcactagnagatcacccatcaggataggtttcacctcgttcag

SEQ ID NO: 19240 - DNA, 71 bp, chicken (Gallus Gallus)
  misc_feature (36): n=a or g
ataggggaaaaaataaaatttctcccaccaaatcantgaggacaaaagaggcaatcagctggagcagcgcg

SEQ ID NO: 19241 - DNA, 71 bp, chicken (Gallus Gallus)
  misc_feature (36): n=c or t
gcagaattaggggctgacgcctgatgaccaaaccanctccatctgatttttaaaatctgcttcacgtcaaa

SEQ ID NO: 19242 - DNA, 71 bp, chicken (Gallus Gallus)
  misc_feature (36): n=c or t
ttaaacaggaatttcacacctgctgaactagcagtntgtttctgagttatgacaggaaggaaagaagcact

SEQ ID NO: 19243 - DNA, 71 bp, chicken (Gallus Gallus)
  misc_feature (36): n=c or t
ggcgattccccaagaacctgtgctatcagctccaantattagctttatacaaagcaggtctttgtcttaat

SEQ ID NO: 19244 - DNA, 71 bp, chicken (Gallus Gallus)
  misc_feature (36): n=a or g
ccaacagaactggatggtgccgtgacatttgggtcnccaagggtcaccaccacctggggaaaaacagaaag

SEQ ID NO: 19245 - DNA, 71 bp, chicken (Gallus Gallus)
  misc_feature (36): n=g or t
gcatctagcaccaaacttgagagctgtacctgttcnaattctcctttcatcttctcgcacatcatgggagc

SEQ ID NO: 19246 - DNA, 71 bp, chicken (Gallus Gallus)
  misc_feature (36): n=a or g
tgcaacaggtaaaaaaagattcacgtttttgcaccngtatttgcccagttatagagtgccttgttctgaaa

SEQ ID NO: 19247 - DNA, 71 bp, chicken (Gallus Gallus)
  misc_feature (36): n=a or t
actcaaatgtgccctatgctaaatttctgtactcancagattcatctgctcgtatttacaaatcactagca

SEQ ID NO: 19248 - DNA, 71 bp, chicken (Gallus Gallus)
  misc_feature (36): n=a or t
tctaccattttactactgagtaacctgctgcaaaangctacaatgaatcaagcagtgatttcagtacccaa

SEQ ID NO: 19249 - DNA, 71 bp, chicken (Gallus Gallus)
  misc_feature (36): n=a or g
cgcatgattctaattaaatttaaattccttatgggncaccaaattttatgtcaaaaagaatatgtttctct

SEQ ID NO: 19250 - DNA, 71 bp, chicken (Gallus Gallus)
  misc_feature (36): n=c or t
tagagaactgagtctcatgtgtgaactcctttatantgactaaagaatctgtcttgacatacattgaaaag

SEQ ID NO: 19251 - DNA, 71 bp, chicken (Gallus Gallus)
  misc_feature (36): n=g or t
ggaaagttgtttgcatgagttatgtaccatacagcntccaaagtcttcataatacatcttccaaaatgttt

SEQ ID NO: 19252 - DNA, 71 bp, chicken (Gallus Gallus)
  misc_feature (36): n=a or g
cccttatagattggccatgtaaccttagtaatgacntattaaagtatggtcatggatctgttgttttacta

SEQ ID NO: 19253 - DNA, 71 bp, chicken (Gallus Gallus)
  misc_feature (36): n=c or t
ggttcatacccttggtgccacctgtcatttactccntcattttaggccccaggtttccagcttaccattac

SEQ ID NO: 19254 - DNA, 71 bp, chicken (Gallus Gallus)
  misc_feature (36): n=a or g
attttattgaaatgcatgtagaaataaccaaatacntccatcgcaatatgagcacagaagcagctttactt

SEQ ID NO: 19255 - DNA, 71 bp, chicken (Gallus Gallus)
  misc_feature (36): n=a or g
aagcaagctctatctgtacacaactggaagaactgncagcttaataacacagaagtaaccatttatgtctc

SEQ ID NO: 19256 - DNA, 71 bp, chicken (Gallus Gallus)
  misc_feature (36): n=c or t
ttaacattttagttcttaattgtttgataaaactgntaacacaacaggatgttaataaaaaagtatctcaa

SEQ ID NO: 19257 - DNA, 71 bp, chicken (Gallus Gallus)
  misc_feature (36): n=a or g
tgaagtttcaagaaatgtatgtgaggggaaaaacanaccaaataaaacagtatagagaggatgcaggaatt

SEQ ID NO: 19258 - DNA, 71 bp, chicken (Gallus Gallus)
  misc_feature (36): n=a or c
atctcaccaagtggagcttcttcctttatgccccantcactgtaggaagcaagaaagactcaaggagtcag

SEQ ID NO: 19259 - DNA, 71 bp, chicken (Gallus Gallus)
  misc_feature (36): n=a or t
ctttgtatatgaatataaaaacattccataataacnctgaatctgttttctgtttataatcgtattcttct

SEQ ID NO: 19260 - DNA, 71 bp, chicken (Gallus Gallus)
  misc_feature (36): n=c or t
aagatgagagagatgtcccccaaacaatgtgaatcngtttctgtatttgtcatgggaccaacagaagtttg

SEQ ID NO: 19261 - DNA, 71 bp, chicken (Gallus Gallus)
  misc_feature (36): n=c or t
gtggcaaggtggagcatcccagctcgtgagataacngctctgtgctgtacccagcacagggctctgcggct

SEQ ID NO: 19262 - DNA, 71 bp, chicken (Gallus Gallus)
  misc_feature (36): n=a or g
tgtgctgtcttgcctactgggtgtactcaggagacncagagcagtgaagtttaagacaaatagggcaaatc

SEQ ID NO: 19263 - DNA, 71 bp, chicken (Gallus Gallus)
  misc_feature (36): n=c or t
gtgggctctgagttgatatccttgccttgctggtgntacctaactgtgtcaggtctctaacaagtgtggtt

SEQ ID NO: 19264 - DNA, 71 bp, chicken (Gallus Gallus)
  misc_feature (36): n=a or c
tacattttgactgctctttcccattttcttccaggntgtcagactggcctaggactttgaaaactacccca

SEQ ID NO: 19265 - DNA, 71 bp, chicken (Gallus Gallus)
  misc_feature (36): n=c or t
tggtctggagaagttatgtgtctgtccttcccctgntcctgaagtttgctatgcctaaacatggaggcagt

SEQ ID NO: 19266 - DNA, 71 bp, chicken (Gallus Gallus)
  misc_feature (36): n=a or g
agaaatattctagggcagccagcatttcctttagcntaaagtctacgctctctgctgccagaagtggcata

SEQ ID NO: 19267 - DNA, 71 bp, chicken (Gallus Gallus)
  misc_feature (36): n=a or t
gtgcacgtcctctggtcctcaagactgaaaggagcncttgggaggtttagtcctacagtggcatttgacag

SEQ ID NO: 19268 - DNA, 71 bp, chicken (Gallus Gallus)
  misc_feature (36): n=c or t
tcctaagcatcacttgtggggtgccttgtttaaccnatacggcttctccagtcatccaaagacaaataaga

SEQ ID NO: 19269 - DNA, 71 bp, chicken (Gallus Gallus)
  misc_feature (36): n=c or t
aacgccacttaatgttaattacactagaagtatggncactctacagtacagaaaaacattaaagttcatta

SEQ ID NO: 19270 - DNA, 71 bp, chicken (Gallus Gallus)
  misc_feature (36): n=g or t
ttccaacttagttaagcatgtagaaaatagttaacnaagttggtcttgatgagagcaatggccttgaactg

SEQ ID NO: 19271 - DNA, 71 bp, chicken (Gallus Gallus)
  misc_feature (36): n=a or g
acatgcttgccttgaattgtcatcacactgccgttngaagctgaaaaactagcaacaaacactcgcacgca

SEQ ID NO: 19272 - DNA, 71 bp, chicken (Gallus Gallus)
  misc_feature (36): n=c or t
tataagtgcagaagtctttgcctcaggtttgtatcnaaactacttaaaataagagagagcattccaaataa

SEQ ID NO: 19273 - DNA, 71 bp, chicken (Gallus Gallus)
  misc_feature (36): n=a or t
ctcctctttttgatggatgaaatacattatagagangaagagctttgctttcttttgctttatgcatgaaa

SEQ ID NO: 19274 - DNA, 71 bp, chicken (Gallus Gallus)
  misc_feature (36): n=c or t
ggcagagttgttttagcatccactctctgccatgtngtgcagctcacagggattttatgcaggatttctta

SEQ ID NO: 19275 - DNA, 71 bp, chicken (Gallus Gallus)
  misc_feature (36): n=c or t
gtcagacttgatgacctttgaggtcttttccaaccngagcaattctatattcttacctccaggcaaattat

SEQ ID NO: 19276 - DNA, 71 bp, chicken (Gallus Gallus)
  misc_feature (36): n=g or t
tttccataagaaaaaagacacatttctgaattaggntttactgtgaacttgagacatctccgatatctttc

SEQ ID NO: 19277 - DNA, 71 bp, chicken (Gallus Gallus)
  misc_feature (36): n=c or t
tgctcataggcttctccacagcttacattttctccnttgaagctcatcaatcctttactcctaaactccat

SEQ ID NO: 19278 - DNA, 71 bp, chicken (Gallus Gallus)
  misc_feature (36): n=c or t
ctatgagacacagaccaaatgtgtggaaatgaaggncagaacactcaggcttgatatgaggaattctttcc

SEQ ID NO: 19279 - DNA, 71 bp, chicken (Gallus Gallus)
  misc_feature (36): n=a or g
atggtatttaggtagacagaacaatgcatatatacntatatgtatatatacatatttatcagccaccaaca

SEQ ID NO: 19280 - DNA, 71 bp, chicken (Gallus Gallus)
  misc_feature (36): n=a or g
tttttccaaaaaacatatgggaactggttcttttgntataaaacaatgcaatttcttgttctactatgcct

SEQ ID NO: 19281 - DNA, 71 bp, chicken (Gallus Gallus)
  misc_feature (36): n=c or t
gtgagcctcattaagttcaatgaggccacatgtaangtcctgtacatgggttagggcagtcgcaagcaatg

SEQ ID NO: 19282 - DNA, 71 bp, chicken (Gallus Gallus)
  misc_feature (36): n=c or t
gtgccatttattttaggatgtaattaggacgattgnacagagcggtggcatcaagcatttagtaaccatgg

SEQ ID NO: 19283 - DNA, 71 bp, chicken (Gallus Gallus)
  misc_feature (36): n=c or g
ccaaatcccagcaaccttgttttgttccttcaaganagggtatgtaacagtaattccttttcctttagcat

SEQ ID NO: 19284 - DNA, 71 bp, chicken (Gallus Gallus)
  misc_feature (36): n=c or t
agttctattaaggtttgataggtctacttagtctgntccacaaaactccccaaacttctgatttatgtcct

SEQ ID NO: 19285 - DNA, 71 bp, chicken (Gallus Gallus)
  misc_feature (36): n=c or t
ctagatgagtgcaggaggtggcctgcttttctaaanggaagggtagctctccaggagctgcatttagctac

SEQ ID NO: 19286 - DNA, 71 bp, chicken (Gallus Gallus)
  misc_feature (36): n=c or t
tgcagcaagaaactctgaagagtctgttctatcatnagctgcctcttaccacagtggtatcacactttctc

SEQ ID NO: 19287 - DNA, 71 bp, chicken (Gallus Gallus)
  misc_feature (36): n=a or g
tgtgctcggtggtgaaaatgcagttgggtatggcantgtgagtccatcaatcttgaggaaaaaatgtgttt

SEQ ID NO: 19288 - DNA, 71 bp, chicken (Gallus Gallus)
  misc_feature (36): n=a or c
tgggcactgtgtcttttggacacagagaaatcacanacattctgttttaactgaattttagtgaggatttg

SEQ ID NO: 19289 - DNA, 71 bp, chicken (Gallus Gallus)
  misc_feature (36): n=c or t
acgactctctgtgcactctgtataacactcctcttngttgaaagcatgttctttaatctcctggtggtaac

SEQ ID NO: 19290 - DNA, 71 bp, chicken (Gallus Gallus)
  misc_feature (36): n=a or g
gagatgggtgagtagagaggagcttcagactctaantaaagcagtgttttctagtctttatatgactatca

SEQ ID NO: 19291 - DNA, 71 bp, chicken (Gallus Gallus)
  misc_feature (36): n=a or t
acgacgtgtgattattttttttctgccccctttaanttaagacatatagattcctggttttgcccataaaa

SEQ ID NO: 19292 - DNA, 71 bp, chicken (Gallus Gallus)
  misc_feature (36): n=c or t
acaccacaattcttatttacacaaggtgcaaagtanaagcagaatctgaaaccaagtcccattcaggtcca

SEQ ID NO: 19293 - DNA, 71 bp, chicken (Gallus Gallus)
  misc_feature (36): n=c or t
atcctcatgaaatagaaattacagtggttggtttgnaggcaaatgatgacaataatttttcatctcattct

SEQ ID NO: 19294 - DNA, 71 bp, chicken (Gallus Gallus)
  misc_feature (36): n=c or t
caatcataaagacaggacaaaaaacagcaggacaanagggcaggaatcacaaacaagagaagcaaaagtca

SEQ ID NO: 19295 - DNA, 71 bp, chicken (Gallus Gallus)
  misc_feature (36): n=c or t
attcaaactgcatttgaatcatacctatgaatgccngtaaatgaaaataaaacctggtcatgactgcaggg

SEQ ID NO: 19296 - DNA, 71 bp, chicken (Gallus Gallus)
  misc_feature (36): n=a or c
cccagcttgaaaatgttctgctccagcaacgcagancctctggatgacctttgttctgttctttgatttac

SEQ ID NO: 19297 - DNA, 71 bp, chicken (Gallus Gallus)
  misc_feature (36): n=c or t
gtattaaaactgatcgatacaatacaaattctggtntcaaatgcacagaatggtattacttatgggacaag

SEQ ID NO: 19298 - DNA, 71 bp, chicken (Gallus Gallus)
  misc_feature (36): n=a or t
aggggaacgaagagtctgtgtgtcagtgatagagcngtggtaaaatgcaaggataggtaaaaagaaattct

SEQ ID NO: 19299 - DNA, 71 bp, chicken (Gallus Gallus)
  misc_feature (36): n=c or t
acaataataatgtatattctgatatcttgttactgnttgtcttgctttttccttcttttactcaaagtgct

SEQ ID NO: 19300 - DNA, 71 bp, chicken (Gallus Gallus)
  misc_feature (36): n=c or t
tttagttttgtgctgtgagaggtttcttacaggaanggcctagtttttttccatctggacatttcaatttt

SEQ ID NO: 19301 - DNA, 71 bp, chicken (Gallus Gallus)
  misc_feature (36): n=c or t
tgctgcactttgtgactccatgcagtccaacctacnaagcaagttgagttgaagcactgcaacaggttgcc

SEQ ID NO: 19302 - DNA, 71 bp, chicken (Gallus Gallus)
  misc_feature (36): n=c or t
aagtagttttctgatctgggaatactctactgttgntccattccctctcactggtagcctgatgaagctgt

SEQ ID NO: 19303 - DNA, 71 bp, chicken (Gallus Gallus)
  misc_feature (36): n=c or g
gggaggcagatacattcaggccctggcaacaccgtngtccttaggctatgctagtttatctctgcctcact

SEQ ID NO: 19304 - DNA, 71 bp, chicken (Gallus Gallus)
  misc_feature (36): n=c or t
cctccattagcttttaaaatccagtgatcagttacnggaatcccccacggatcaatgatggggctgtccta

SEQ ID NO: 19305 - DNA, 71 bp, chicken (Gallus Gallus)
  misc_feature (36): n=a or c
tcacagcaaggaatctcagcaggtttaggtgtaatntaagtgcatttcagcaactggaaattacatgggaa

SEQ ID NO: 19306 - DNA, 71 bp, chicken (Gallus Gallus)
  misc_feature (36): n=a or g
ttagtcgatgtttccttccagtaccttccactggtntcaggaaattttgttttcaaggtacagcctgagat

SEQ ID NO: 19307 - DNA, 71 bp, chicken (Gallus Gallus)
  misc_feature (36): n=a or t
cattgggatgccaaaatgttacacttatgcttattnttacggataggacaattgtttagttgtactttcta

SEQ ID NO: 19308 - DNA, 71 bp, chicken (Gallus Gallus)
  misc_feature (36): n=c or t
tcactctgtgtcctgagccacaaaggaatgagcacngacaaacactcagtgcaatgatgtagaataatttc

SEQ ID NO: 19309 - DNA, 71 bp, chicken (Gallus Gallus)
  misc_feature (36): n=a or t
cccatcagacgctgttgctgaaactatacctagctngtgtcttcagtactgtgccagctacagacagtagt

SEQ ID NO: 19310 - DNA, 71 bp, chicken (Gallus Gallus)
  misc_feature (36): n=g or t
gatgacatttaatgcctacagaaattttcaactcanaaataaagcacccagaaaaagaccactctaaacat

SEQ ID NO: 19311 - DNA, 71 bp, chicken (Gallus Gallus)
  misc_feature (36): n=a or g
acactgtgttgtattttaccttggtaataagttacntagccttgacagagtaacatcctgattggaggtct

SEQ ID NO: 19312 - DNA, 71 bp, chicken (Gallus Gallus)
  misc_feature (36): n=a or c
gggcttaaaaactcttctctgtaagtcttactggcncagagctttcctcatttctgtgacgttgctgtctg

SEQ ID NO: 19313 - DNA, 71 bp, chicken (Gallus Gallus)
  misc_feature (36): n=a or c
gtccagggggcaaaatgggaatctggtcggtttaanagggattttgacaccttgttttattggtcttccat

SEQ ID NO: 19314 - DNA, 71 bp, chicken (Gallus Gallus)
  misc_feature (36): n=g or t
taaggaatatgtattaagtctattttatgatgtttnaagagtttcccactgcaagaacccctactctaata

SEQ ID NO: 19315 - DNA, 71 bp, chicken (Gallus Gallus)
  misc_feature (36): n=c or t
ctgaaattgagacaccatcactcaggttcacatttnagggtagtatgcagatcagacacataagatgaact

SEQ ID NO: 19316 - DNA, 71 bp, chicken (Gallus Gallus)
  misc_feature (36): n=a or c
aaaagactgagttcagagctgacgtctcactggaantgagaggaggtttctctaattagtgacacagcggg

SEQ ID NO: 19317 - DNA, 71 bp, chicken (Gallus Gallus)
  misc_feature (36): n=c or t
taactccaggttagttgctgtcaaatatatatacangtgtgtttttaaagaatacagaatatttacattat

SEQ ID NO: 19318 - DNA, 71 bp, chicken (Gallus Gallus)
  misc_feature (36): n=c or t
agcaaatcatatcagtagaaccacattttggcaagnttggtttgacctataattatttctttgcccaccat

SEQ ID NO: 19319 - DNA, 71 bp, chicken (Gallus Gallus)
  misc_feature (36): n=a or g
gtgatcaataagccctgaactttttagaaaagaagnttagggttttggatgtgatatgaaaaatgtttatt

SEQ ID NO: 19320 - DNA, 71 bp, chicken (Gallus Gallus)
  misc_feature (36): n=a or g
ctatccatccttctaagaggaggcttttgggtggancagggtaggacagtgtcctagcatcatgaatctga

SEQ ID NO: 19321 - DNA, 71 bp, chicken (Gallus Gallus)
  misc_feature (36): n=c or t
ttttctaaaccctcactaaattctctgccctactgnatcagatttgagataagctagtaaaatctcagtgg

SEQ ID NO: 19322 - DNA, 71 bp, chicken (Gallus Gallus)
  misc_feature (36): n=c or t
attttctttttgacttagtaaatagatttttgtttnagttcaattctgttcaattttgtttccagttctct

SEQ ID NO: 19323 - DNA, 71 bp, chicken (Gallus Gallus)
  misc_feature (36): n=c or t
cccgtaaggacccatatgatctgcatgctgcaccangaatccataaggacccacaggatttgagtgctgta

SEQ ID NO: 19324 - DNA, 71 bp, chicken (Gallus Gallus)
  misc_feature (36): n=c or t
tttcctaaatctatagaatattttccaaactgatantggaggtcagattggcctcttcactgataggtagg

SEQ ID NO: 19325 - DNA, 71 bp, chicken (Gallus Gallus)
  misc_feature (36): n=c or g
tttgggcccctcactacaagaaggatgttggtcttnagttactcaggtgtgtccatattaagaaaactagt

SEQ ID NO: 19326 - DNA, 71 bp, chicken (Gallus Gallus)
  misc_feature (36): n=a or t
aagttttttatttgagaaattattactgtttatctncctgaaaacaaaatctgaataaccagaagcactac

SEQ ID NO: 19327 - DNA, 71 bp, chicken (Gallus Gallus)
  misc_feature (36): n=a or g
tttagaagacaggtgtttatagcagagtattttcancagaatcataacccaatttttaaaattgaaatgtg

SEQ ID NO: 19328 - DNA, 71 bp, chicken (Gallus Gallus)
  misc_feature (36): n=a or g
atgtaaggaattaggcacacatatatctcacttcantatgaaggagctggagcactcatctccctgcacag

SEQ ID NO: 19329 - DNA, 71 bp, chicken (Gallus Gallus)
  misc_feature (36): n=a or g
gcagaaagcagagcaacttgttgaaggcaaaggtgnatgaaatattcaaacttcttatactcagatagtgc

SEQ ID NO: 19330 - DNA, 71 bp, chicken (Gallus Gallus)
  misc_feature (36): n=c or t
tctaggagtggaaacatggagctattagcacaactnactcatgccctagataagaatgttgaaatagttcc

SEQ ID NO: 19331 - DNA, 71 bp, chicken (Gallus Gallus)
  misc_feature (36): n=a or g
tttactcttccacatgcagctactcagaagtaccangacatgcctggctaggatctcttgtatgcaacaca

SEQ ID NO: 19332 - DNA, 71 bp, chicken (Gallus Gallus)
  misc_feature (36): n=c or t
cttttgccaccagaagtggaaataaaaagatgcttntgtgtgcctttcagaatcattccttctattaaaca

SEQ ID NO: 19333 - DNA, 71 bp, chicken (Gallus Gallus)
  misc_feature (36): n=a or c
ctgctctgaggtgatacgcctagacttgaacatagncatcatgttaccggacccttatgtagctttccctc

SEQ ID NO: 19334 - DNA, 71 bp, chicken (Gallus Gallus)
  misc_feature (36): n=g or t
aatgaagttagggacttccaatcacgcaggtgaatngcttccacctgcgctcccagggctggctctgcctc

SEQ ID NO: 19335 - DNA, 71 bp, chicken (Gallus Gallus)
  misc_feature (36): n=c or t
cagaagttcacattggttttcatcacttcttcaaancaaactgatataaaaacagtgtctttattactaca

SEQ ID NO: 19336 - DNA, 71 bp, chicken (Gallus Gallus)
  misc_feature (36): n=c or t
acctaatgaactggcagcagagacaggtcagcctanagctgtgtctgatgtaagcaccatgtgtgctgcac

SEQ ID NO: 19337 - DNA, 71 bp, chicken (Gallus Gallus)
  misc_feature (36): n=c or t
ggaaacatcctctgttttgaaccagatttacaaatnggggttagtgactttccatcttgttctcagagttg

SEQ ID NO: 19338 - DNA, 71 bp, chicken (Gallus Gallus)
  misc_feature (36): n=a or t
tgtctaaattttatacaagagtacaagcacagaagnaatgcaaggatgccaacagccctgtatcttttccc

SEQ ID NO: 19339 - DNA, 71 bp, chicken (Gallus Gallus)
  misc_feature (36): n=a or g
aaccatcttgcttgacttgcctgtagctttactgtntgttttaatttgcctgcttattttctgcctcccta

SEQ ID NO: 19340 - DNA, 71 bp, chicken (Gallus Gallus)
  misc_feature (36): n=c or t
tggagattaatgattatttcatatatccatatttcngacctaatatctgtattacatttaatacactttaa

SEQ ID NO: 19341 - DNA, 71 bp, chicken (Gallus Gallus)
  misc_feature (36): n=c or t
gggaatattctcccatcagtgcaaattttaataccnccattagggacaaaatgctaacatgaaggttaaga

SEQ ID NO: 19342 - DNA, 71 bp, chicken (Gallus Gallus)
  misc_feature (36): n=a or t
tgcacttctgtgcataaagaaccatattttcctatngtaatttttcctgttttccaattttaatagctctc

SEQ ID NO: 19343 - DNA, 71 bp, chicken (Gallus Gallus)
  misc_feature (36): n=c or t
agcctgtaaactaaaatcttttcctaagctgatctntgtccacaaagaagaatgagaatatttacctgctt

SEQ ID NO: 19344 - DNA, 71 bp, chicken (Gallus Gallus)
  misc_feature (36): n=a or g
taagtcactgatatttgcaaggtttcaggagaagtnaactaggaactccttcatttggatgagcatcagac

SEQ ID NO: 19345 - DNA, 71 bp, chicken (Gallus Gallus)
  misc_feature (36): n=a or g
acatcttctgaagagagcacattttaatgcaatagnaatgttttcaagctttttcagtaactgaaaatcaa

SEQ ID NO: 19346 - DNA, 71 bp, chicken (Gallus Gallus)
  misc_feature (36): n=c or t
aaaacagagagcaacgcaagcaaggagtcatgcaanactcacctttttttgagccaacagcctcttcaaac

SEQ ID NO: 19347 - DNA, 71 bp, chicken (Gallus Gallus)
  misc_feature (36): n=c or t
tgcatggtttgtctgttgatagtaagctctacgtgnttctcttcatgaggaggcagaaggagggaagagac

SEQ ID NO: 19348 - DNA, 71 bp, chicken (Gallus Gallus)
  misc_feature (36): n=a or g
gcatgagctgtaatttcttaaaggtaactaaaaacnctttttacttcgtgagatgaatttacttcatttga

SEQ ID NO: 19349 - DNA, 71 bp, chicken (Gallus Gallus)
  misc_feature (36): n=a or g
gcgctgttgcaattaatgttgaatagatgttgtacnatgttactatctccccaacttacaacagcctagtt

SEQ ID NO: 19350 - DNA, 71 bp, chicken (Gallus Gallus)
  misc_feature (36): n=a or g
ttaatcactgagctctcatctggggtatctgccacntacattccaaatgacaccagaacccaataacatac

SEQ ID NO: 19351 - DNA, 71 bp, chicken (Gallus Gallus)
  misc_feature (36): n=a or g
aactgtgatgtgcttctctcacaaatgttttcagtnattaatgattttctagtgtattgaagatttcagtc

SEQ ID NO: 19352 - DNA, 71 bp, chicken (Gallus Gallus)
  misc_feature (36): n=c or t
gaagtcttgactgaacttgattacagttgatagtcnattcttcatcttatctaaatgtgtctgaggtatgt

SEQ ID NO: 19353 - DNA, 71 bp, chicken (Gallus Gallus)
  misc_feature (36): n=c or t
ttatttgtatttttttccatctgatatgctggtttnctaggagttcacacctctcagtgatgatgtatggg

SEQ ID NO: 19354 - DNA, 71 bp, chicken (Gallus Gallus)
  misc_feature (36): n=c or t
tgctcacggtggctgcctctatgtctctaccccagnaacagcctcaataaaagccctcagagctctcactt

SEQ ID NO: 19355 - DNA, 71 bp, chicken (Gallus Gallus)
  misc_feature (36): n=a or g
ttcaccggtattcgtttcacaatttctacactgaanactacataaggtttaagaccaagtcttcagtctac

SEQ ID NO: 19356 - DNA, 71 bp, chicken (Gallus Gallus)
  misc_feature (36): n=c or t
caagatacggccttcccatgaaagtgttttgaaagngtcttcaatttcttccatcccgatttcaatgatgc

SEQ ID NO: 19357 - DNA, 71 bp, chicken (Gallus Gallus)
  misc_feature (36): n=a or g
gaactgtattaagaagcagcccgaaacgctgtttcngaggtctctgaaggtttgacactgcaaagcctata

SEQ ID NO: 19358 - DNA, 71 bp, chicken (Gallus Gallus)
  misc_feature (36): n=c or t
tctgaggtcgagagcctgagaaatgctggcagtgtnagaaaacattgtgcctgaatccaaggagatggagc

SEQ ID NO: 19359 - DNA, 71 bp, chicken (Gallus Gallus)
  misc_feature (36): n=c or t
cttacaaaatttgtcttccttgttaagcagacacanagattatgtaaaatgtgttacaagcagtgtttgtt

SEQ ID NO: 19360 - DNA, 71 bp, chicken (Gallus Gallus)
  misc_feature (36): n=g or t
tgatgtcaagcacaacacaaaattcatatatttcantgtgtaaaagtatctcccagccagtttttttgttt

SEQ ID NO: 19361 - DNA, 71 bp, chicken (Gallus Gallus)
  misc_feature (36): n=a or g
aggaggacgtgctccatgtcatagacaccacgcatncccttggtcaacccctccaaggagctgatataatc

SEQ ID NO: 19362 - DNA, 71 bp, chicken (Gallus Gallus)
  misc_feature (36): n=a or c
ggcatcacagttattcacatacttgttactaaaatnttcttactatgcttcttcattggtgaaaccaagca

SEQ ID NO: 19363 - DNA, 71 bp, chicken (Gallus Gallus)
  misc_feature (36): n=a or g
tagaatgctgaattgaaattcaattttggtgaagangacttcaaatttccaccaaaagatggctatattgg

SEQ ID NO: 19364 - DNA, 71 bp, chicken (Gallus Gallus)
  misc_feature (36): n=c or t
atggaggtgggaggttacaaaggagaagctggagangactcttaagtaaatctatgaagagctggagctac

SEQ ID NO: 19365 - DNA, 71 bp, chicken (Gallus Gallus)
  misc_feature (36): n=a or g
gatccacagctaaccaagtcccaggtgcagcctagngaatgacaattcatagttctaggccatcaattgct

SEQ ID NO: 19366 - DNA, 71 bp, chicken (Gallus Gallus)
  misc_feature (36): n=a or g
cagtcatgcaatttccataagaagtaaaaatacctnttttactgcagaaaatttcaaaagtcatcagttct

SEQ ID NO: 19367 - DNA, 71 bp, chicken (Gallus Gallus)
  misc_feature (36): n=c or t
gcaaacctcatggttactctgtgttttcagaaaagncagttaggtgatgcttataagcaaatccactgtac

SEQ ID NO: 19368 - DNA, 71 bp, chicken (Gallus Gallus)
  misc_feature (36): n=c or t
tactgttttactagccattacttactataaccattntatcctatcctatcctatcctatcctaccctaccc

SEQ ID NO: 19369 - DNA, 71 bp, chicken (Gallus Gallus)
  misc_feature (36): n=c or t
aaaaaaaatgttaaaaaaatccacatatcacttacnctatcttttagaaacaactcattagaaataaatgt

SEQ ID NO: 19370 - DNA, 71 bp, chicken (Gallus Gallus)
  misc_feature (36): n=c or g
actattctgatgtttgaactggaagcatgaagggtnagtacatttattctcatttctcatagaagaaacag

SEQ ID NO: 19371 - DNA, 71 bp, chicken (Gallus Gallus)
  misc_feature (36): n=c or t
gtaattaaaaatgtgtaagaaaggactgtttgaatncagtctgcccttgtaggaacactaggagatgagac

SEQ ID NO: 19372 - DNA, 71 bp, chicken (Gallus Gallus)
  misc_feature (36): n=a or g
atggaggtgtctcagctcctctaccccactggcacntgtatgaccaagagtgagctcaagggctgaggatg

SEQ ID NO: 19373 - DNA, 71 bp, chicken (Gallus Gallus)
  misc_feature (36): n=c or t
ttaggaatgtaggctggaaatataggaaatatgttncacattgtatccttatccttgctgtaaaccaatta

SEQ ID NO: 19374 - DNA, 71 bp, chicken (Gallus Gallus)
  misc_feature (36): n=a or g
agtatgaacaaggctgtctcactgttatctgattcnatgcccctttatcgggtgctttagaattaaatact

SEQ ID NO: 19375 - DNA, 71 bp, chicken (Gallus Gallus)
  misc_feature (36): n=a or g
atatagttatatgatccactaatgactccaaaaaangcatgagatgaatgagtcactgagatttaaatata

SEQ ID NO: 19376 - DNA, 71 bp, chicken (Gallus Gallus)
  misc_feature (36): n=a or g
gttcctgatggtatcaaagatgaatgcattttcaantgaagaggacattaaactcaaaataaaaggcttta

(The sequence listing continues in the following parts.)

What is claimed is:

1. A chicken breeding chip comprising a combination of oligonucleotide probes immobilized on the chip, wherein the combination of probes consists of 50,000 oligonucleotide probes, each probe consisting of one of the sequences of SEQ ID NOs 1-50,000, respectively.

* * * * *